(12) United States Patent
Liu et al.

(10) Patent No.: US 7,361,468 B2
(45) Date of Patent: Apr. 22, 2008

(54) METHODS FOR GENOTYPING POLYMORPHISMS IN HUMANS

(75) Inventors: Guoying Liu, Emeryville, CA (US);
Simon Cawley, Oakland, CA (US);
Hajime Matsuzaki, Palo Alto, CA (US); Earl A. Hubbell, Palo Alto, CA (US); Geoffrey Yang, San Jose, CA (US); Teresa A. Webster, Santa Clara, CA (US); Rui Mei, Santa Clara, CA (US); Xiaojun Di, Cupertino, CA (US); Richard Chiles, Castro Valley, CA (US)

(73) Assignee: Affymetrix, Inc., Santa Clara, CA (US)

( * ) Notice: Subject to any disclaimer, the term of this patent is extended or adjusted under 35 U.S.C. 154(b) by 387 days.

(21) Appl. No.: 11/175,859

(22) Filed: Jul. 5, 2005

(65) Prior Publication Data
US 2006/0024715 A1    Feb. 2, 2006

Related U.S. Application Data

(60) Provisional application No. 60/585,352, filed on Jul. 2, 2004.

(51) Int. Cl.
*C12Q 1/68*       (2006.01)
*C07H 21/04*      (2006.01)
*C12M 3/00*       (2006.01)
*C12M 1/34*       (2006.01)

(52) U.S. Cl. ............... 435/6; 435/287.2; 435/91.1; 536/23.1; 536/24.3

(58) Field of Classification Search ............... None
See application file for complete search history.

(56) References Cited

OTHER PUBLICATIONS

GeneChip Human Mapping 10K Array and Assay Kit. 2003, Affymetrix Data Sheet.*

* cited by examiner

*Primary Examiner*—Juliet C. Switzer
(74) *Attorney, Agent, or Firm*—Sandra E. Wells

(57) ABSTRACT

Methods, kits and arrays of nucleic acid probes for genotyping large numbers of human SNPs in parallel are provided. A set of more than 100,000 human SNPs, known to be biallelic in at least two populations is provided. Allele specific perfect match probes and genotyping probe sets are provided for each allele of each biallelic SNP in a set of human SNPs that is useful for genetic analysis within and across populations. Probe sets that include perfect match and mismatch probes are provided. The probe sets are suitable for inclusion in an array. The invention provides the SNP and surrounding sequence and provides the sequences in such a way as to make them available for a variety of analyses including genotyping. As such, the invention relates to diverse fields impacted by the nature of genetics, including biology, medicine, and medical diagnostics.

15 Claims, No Drawings

METHODS FOR GENOTYPING POLYMORPHISMS IN HUMANS

RELATED APPLICATIONS

This application claims the priority of U.S. Provisional Application No. 60/585,352 filed Jul. 2, 2004 the disclosure of which is incorporated herein by reference in its entirety for all purposes.

FIELD OF THE INVENTION

The present invention provides pools of nucleic acid sequences and arrays of nucleic acid sequences that are useful for genotyping polymorphisms in nucleic acid samples derived from humans. The invention relates to diverse fields, including genetics, genomics, biology, population biology, medicine, and medical diagnostics.

REFERENCE TO SEQUENCE LISTING

The Sequence Listing submitted on compact disk is hereby incorporated by reference. The file on the disk is named 3690.1 seqlist.txt, the file is 16.7 MB and the date of creation of the compact discs is Jul. 5, 2005. The machine format for the discs is IBM-PC and the operating system compatibility is MS-WINDOWS 2000.

BACKGROUND

Single nucleotide polymorphisms (SNPs) have emerged as the marker of choice for genome wide association studies and genetic linkage studies. Building SNP maps of the genome will provide the framework for new studies to identify the underlying genetic basis of complex diseases such as cancer, mental illness and diabetes. Identification of the genetic polymorphisms that contribute to susceptibility for common diseases will facilitate the development of diagnostics and therapeutics, see Carlson et al., *Nature* 429:446-452 (2004). Whole-genome association studies may be used to identify polymorphisms with disease associations. These studies require the analysis of much denser panels of markers than are required for linkage analysis in families and benefit from technologies that facilitate the analysis of hundreds of thousands of polymorphisms, see, The International HapMap Consortium, *Nature* 426, 789-796 (2003).

SUMMARY OF THE INVENTION

The invention provides nucleic acid sequences that are complementary to particular regions of the human genome that are known or predicted to contain single nucleotide polymorphisms (SNPs). The invention further provides a collection of SNPs that are useful for performing analysis of the human genome. For example, in one embodiment the invention comprises an array comprising any or more, 1000 or more, 10,000 or more, 100,000 or more, or 1,000,000 or more nucleic acid probes containing 15 or more consecutive nucleotides from the sequences listed in SEQ ID NOS: 1-116,211, or the perfect match, perfect mismatch, antisense match or antisense mismatch thereof. In a preferred embodiment the array comprises 25 nucleotide probes that are 25 consecutive nucleotides from each of the sequences listed in SEQ ID NOS 1-116,211, each probe being a different 25 nucleotide sequence. In a further embodiment, the invention comprises the use of any of the above arrays or fragments disclosed in SEQ ID NOS 1-116,211 to: monitor loss of heterozygosity; identify imprinted genes; genotype polymorphisms; determine allele frequencies in a population, characterize biallelic markers; produce genetic maps; detect linkage disequilibrium, determine allele frequencies, do association studies, analyze genetic variation, to identify markers linked to a phenotype or, compare genotypes between different individuals or populations. In a further embodiment the invention comprises a method of analysis comprising hybridizing one or more pools of nucleic acids to two or more of the fragments disclosed in SEQ ID NOS 1-116,211 and detecting said hybridization. In a further embodiment the invention comprises the use of any one or more of the fragments disclosed in SEQ ID NOS 1-116,211 as a primer for PCR.

DETAILED DESCRIPTION OF THE INVENTION a) General

The present invention has many preferred embodiments and relies on many patents, applications and other references for details known to those of the art. Therefore, when a patent, application, or other reference is cited or repeated below, it should be understood that it is incorporated by reference in its entirety for all purposes as well as for the proposition that is recited.

As used in this application, the singular form "a," "an," and "the" include plural references unless the context clearly dictates otherwise. For example, the term "an agent" includes a plurality of agents, including mixtures thereof.

An individual is not limited to a human being but may also be other organisms including but not limited to mammals, plants, bacteria, or cells derived from any of the above.

Throughout this disclosure, various aspects of this invention can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, etc., as well as individual numbers within that range, for example, 1, 2, 3, 4, 5, and 6. This applies regardless of the breadth of the range.

The practice of the present invention may employ, unless otherwise indicated, conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as *Genome Analysis: A Laboratory Manual Series* (Vols. I-IV), *Using Antibodies: A Laboratory Manual, Cells: A Laboratory Manual, PCR Primer: A Laboratory Manual*, and *Molecular Cloning: A Laboratory Manual* (all from Cold Spring Harbor Laboratory Press), Stryer, L. (1995) *Biochemistry* (4th Ed.) Freeman, New York, Gait, "Oligonucleotide Synthesis: A Practical Approach" 1984, IRL Press, London, Nelson and Cox (2000), Lehninger, Principles of Biochemistry 3rd Ed., W.H. Freeman Pub., New York, N.Y. and Berg et al. (2002) Biochemistry, 5th Ed., W.H. Freeman Pub., New York, N.Y., all of which are herein incorporated in their entirety by reference for all purposes.

The present invention can employ solid substrates, including arrays in some preferred embodiments. Methods and techniques applicable to polymer (including protein) array synthesis have been described in U.S. Ser. No. 09/536,841, WO 00/58516, U.S. Pat. Nos. 5,143,854, 5,242,974, 5,252, 743, 5,324,633, 5,384,261, 5,405,783, 5,424,186, 5,451,683, 5,482,867, 5,491,074, 5,527,681, 5,550,215, 5,571,639, 5,578,832, 5,593,839, 5,599,695, 5,624,711, 5,631,734, 5,795,716, 5,831,070, 5,837,832, 5,856,101, 5,858,659, 5,936,324, 5,968,740, 5,974,164, 5,981,185, 5,981,956, 6,025,601, 6,033,860, 6,040,193, 6,090,555, 6,136,269, 6,269,846 and 6,428,752, in PCT Applications Nos. PCT/US99/00730 (International Publication No. WO 99/36760) and PCT/US01/04285 (International Publication No. WO 01/58593), which are all incorporated herein by reference in their entirety for all purposes. Patents that describe synthesis techniques in specific embodiments include U.S. Pat. Nos. 5,412,087, 6,147,205, 6,262,216, 6,310,189, 5,889,165, and 5,959,098.

Nucleic acid arrays that are useful in the present invention include those that are commercially available from Affymetrix (Santa Clara, Calif.) under the brand name GeneChip®. Example arrays are shown on the website at affymetrix.com.

The present invention also contemplates many uses for polymers attached to solid substrates. These uses include gene expression monitoring, profiling, library screening, genotyping and diagnostics. Gene expression monitoring and profiling methods and methods useful for gene expression monitoring and profiling are shown in U.S. Pat. Nos. 5,800,992, 6,013,449, 6,020,135, 6,033,860, 6,040,138, 6,177,248 and 6,309,822. Genotyping and uses therefore are shown in U.S. Ser. Nos. 10/442,021, 10/013,598 (U.S. Patent Application Publication 20030036069), and U.S. Pat. Nos. 5,925,525, 6,268,141, 5,856,092, 6,267,152, 6,300, 063, 6,525,185, 6,632,611, 5,858,659, 6,284,460, 6,361,947, 6,368,799, 6,673,579 and 6,333,179. Other methods of nucleic acid amplification, labeling and analysis that may be used in combination with the methods disclosed herein are embodied in U.S. Pat. Nos. 5,871,928, 5,902,723, 6,045, 996, 5,541,061, and 6,197,506.

The present invention also contemplates sample preparation methods in certain preferred embodiments. Prior to or concurrent with genotyping, the genomic sample may be amplified by a variety of mechanisms, some of which may employ PCR. See, for example, PCR Technology: Principles and Applications for DNA Amplification (Ed. H. A. Erlich, Freeman Press, NY, N.Y., 1992); PCR Protocols: A Guide to Methods and Applications (Eds. Innis, et al., Academic Press, San Diego, Calif., 1990); Mattila et al., Nucleic Acids Res. 19, 4967 (1991); Eckert et al., PCR Methods and Applications 1, 17 (1991); PCR (Eds. McPherson et al., IRL Press, Oxford); and U.S. Pat. Nos. 4,683,202, 4,683,195, 4,800,159 4,965,188, and 5,333,675, and each of which is incorporated herein by reference in their entireties for all purposes. Modifications to PCR may also be used, for example, the inclusion of Betaine or trimethylglycine, which has been disclosed, for example, in Rees et al. Biochemistry 32:137-144 (1993), and in U.S. Pat. Nos. 6,270,962 and 5,545,539. The sample may be amplified on the array. See, for example, U.S. Pat. No. 6,300,070 and U.S. Ser. No. 09/513,300, which are incorporated herein by reference.

Other suitable amplification methods include the ligase chain reaction (LCR) (for example, Wu and Wallace, Genomics 4, 560 (1989), Landegren et al., Science 241, 1077 (1988) and Barringer et al. Gene 89:117 (1990)), transcription amplification (Kwoh et al., Proc. Natl. Acad. Sci. USA 86, 1173 (1989) and WO88/10315), self-sustained sequence replication (Guatelli et al., Proc. Nat. Acad. Sci. USA, 87, 1874 (1990) and WO90/06995), selective amplification of target polynucleotide sequences (U.S. Pat. No. 6,410,276), consensus sequence primed polymerase chain reaction (CP-PCR) (U.S. Pat. No. 4,437,975), arbitrarily primed polymerase chain reaction (AP-PCR) (U.S. Pat. Nos. 5,413,909, 5,861,245) nucleic acid based sequence amplification (NABSA), rolling circle amplification (RCA), multiple displacement amplification (MDA) (U.S. Pat. Nos. 6,124,120 and 6,323,009) and circle-to-circle amplification (C2CA) (Dahl et al. Proc. Natl. Acad. Sci 101:4548-4553 (2004). (See, U.S. Pat. Nos. 5,409,818, 5,554,517, and 6,063,603, each of which is incorporated herein by reference). Other amplification methods that may be used are described in, U.S. Pat. Nos. 5,242,794, 5,494,810, 5,409,818, 4,988,617, 6,063,603 and 5,554,517 and in U.S. Ser. No. 09/854,317, each of which is incorporated herein by reference.

Additional methods of sample preparation and techniques for reducing the complexity of a nucleic sample are described in Dong et al., Genome Research 11, 1418 (2001), in U.S. Pat. Nos. 6,361,947, 6,391,592 and U.S. Ser. Nos. 09/916,135, 09/920,491 (U.S. Patent Application Publication 20030096235), 09/910,292 (U.S. Patent Application Publication 20030082543), and 10/013,598.

Methods for conducting polynucleotide hybridization assays have been well developed in the art. Hybridization assay procedures and conditions will vary depending on the application and are selected in accordance with the general binding methods known including those referred to in: Maniatis et al. Molecular Cloning: A Laboratory Manual (2nd Ed. Cold Spring Harbor, N.Y., 1989); Berger and Kimmel Methods in Enzymology, Vol. 152, Guide to Molecular Cloning Techniques (Academic Press, Inc., San Diego, Calif., 1987); Young and Davism, P. N. A. S, 80: 1194 (1983). Methods and apparatus for carrying out repeated and controlled hybridization reactions have been described in U.S. Pat. Nos. 5,871,928, 5,874,219, 6,045,996 and 6,386, 749, 6,391,623 each of which are incorporated herein by reference The present invention also contemplates signal detection of hybridization between ligands in certain preferred embodiments. See U.S. Pat. Nos. 5,143,854, 5,578,832; 5,631,734; 5,834,758; 5,936,324; 5,981,956; 6,025,601; 6,141,096; 6,185,030; 6,201,639; 6,218,803; and 6,225,625, in U.S. Ser. No. 10/389,194 and in PCT Application PCT/US99/06097 (published as WO99/47964), each of which also is hereby incorporated by reference in its entirety for all purposes.

Methods and apparatus for signal detection and processing of intensity data are disclosed in, for example, U.S. Pat. Nos. 5,143,854, 5,547,839, 5,578,832, 5,631,734, 5,800, 992, 5,834,758; 5,856,092, 5,902,723, 5,936,324, 5,981, 956, 6,025,601, 6,090,555, 6,141,096, 6,185,030, 6,201, 639; 6,218,803; and 6,225,625, in U.S. Ser. Nos. 10/389, 194, 60/493,495 and in PCT Application PCT/US99/06097 (published as WO99/47964), each of which also is hereby incorporated by reference in its entirety for all purposes.

The practice of the present invention may also employ conventional biology methods, software and systems. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes and etc. The computer executable instructions may be written in a suitable computer language or combination of several languages. Basic computational biology methods are described in, for example Setubal and Meidanis et al., *Introduction to Computational Biology Methods* (PWS Publishing Company, Boston, 1997); Salzberg, Searles, Kasif, (Ed.), *Computational Methods in Molecular Biology*, (Elsevier, Amsterdam, 1998); Rashidi and Buehler, *Bioinformatics Basics: Application in Biological Science and Medicine* (CRC Press, London, 2000) and Ouelette and Bzevanis *Bioinformatics: A Practical Guide for Analysis of Gene and Proteins* (Wiley & Sons, Inc., $2^{nd}$ ed., 2001). See U.S. Pat. No. 6,420,108.

The present invention may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170.

The whole genome sampling assay (WGSA) is described, for example in Kennedy et al., Nat. Biotech. 21, 1233-1237 (2003), Matsuzaki et al., Gen. Res. 14: 414-425, (2004), and Matsuzaki, et al. Nature Methods 1:109-111 (2004). Algorithms for use with mapping assays are described, for example, in Liu et al., Bioinformatics 19: 2397-2403 (2003) and Di et al. Bioinformatics 21:1958 (2005). Additional methods related to WGSA and arrays useful for WGSA and applications of WGSA are disclosed, for example, in U.S. Patent Application Nos. 60/676,058 filed Apr. 29, 2005, 60/616,273 filed Oct. 5, 2004, 10/912,445, 11/044,831, 10/442,021, 10/650,332 and 10/463,991. Genome wide association studies using mapping assays are described in, for example, Hu et al., *Cancer Res*.; 65(7):2542-6 (2005), Mitra et al., *Cancer Res.*, 64(21):8116-25 (2004), Butcher et al., *Hum Mol Genet.*, 14(10):1315-25 (2005), and Klein et al., *Science*, 308(5720):385-9 (2005). Each of these references is incorporated herein by reference in its entirety for all purposes.

Additionally, the present invention may have preferred embodiments that include methods for providing genetic information over networks such as the Internet as shown in U.S. Ser. Nos. 10/197,621, 10/063,559 (United States Publication Number 20020183936), 10/065,856, 10/065,868, 10/328,818, 10/328,872, 10/423,403, and 60/482,389.

b) Definitions

The term "admixture" refers to the phenomenon of gene flow between populations resulting from migration. Admixture can create linkage disequilibrium (LD).

The term "allele" as used herein is any one of a number of alternative forms a given locus (position) on a chromosome. An allele may be used to indicate one form of a polymorphism, for example, a biallelic SNP may have possible alleles A and B. An allele may also be used to indicate a particular combination of alleles of two or more SNPs in a given gene or chromosomal segment. The frequency of an allele in a population is the number of times that specific allele appears divided by the total number of alleles of that locus.

The term "array" as used herein refers to an intentionally created collection of molecules which can be prepared either synthetically or biosynthetically. The molecules in the array can be identical or different from each other. The array can assume a variety of formats, for example, libraries of soluble molecules; libraries of compounds tethered to resin beads, silica chips, or other solid supports.

The term "biomonomer" as used herein refers to a single unit of biopolymer, which can be linked with the same or other biomonomers to form a biopolymer (for example, a single amino acid or nucleotide with two linking groups one or both of which may have removable protecting groups) or a single unit which is not part of a biopolymer. Thus, for example, a nucleotide is a biomonomer within an oligonucleotide biopolymer, and an amino acid is a biomonomer within a protein or peptide biopolymer; avidin, biotin, antibodies, antibody fragments, etc., for example, are also biomonomers.

The term "biopolymer" or sometimes refer by "biological polymer" as used herein is intended to mean repeating units of biological or chemical moieties. Representative biopolymers include, but are not limited to, nucleic acids, oligonucleotides, amino acids, proteins, peptides, hormones, oligosaccharides, lipids, glycolipids, lipopolysaccharides, phospholipids, synthetic analogues of the foregoing, including, but not limited to, inverted nucleotides, peptide nucleic acids, Meta-DNA, and combinations of the above.

The term "biopolymer synthesis" as used herein is intended to encompass the synthetic production, both organic and inorganic, of a biopolymer. Related to a bioploymer is a "biomonomer".

The term "combinatorial synthesis strategy" as used herein refers to a combinatorial synthesis strategy is an ordered strategy for parallel synthesis of diverse polymer sequences by sequential addition of reagents which may be represented by a reactant matrix and a switch matrix, the product of which is a product matrix. A reactant matrix is a 1 column by m row matrix of the building blocks to be added. The switch matrix is all or a subset of the binary numbers, preferably ordered, between 1 and m arranged in columns. A "binary strategy" is one in which at least two successive steps illuminate a portion, often half, of a region of interest on the substrate. In a binary synthesis strategy, all possible compounds which can be formed from an ordered set of reactants are formed. In most preferred embodiments, binary synthesis refers to a synthesis strategy which also factors a previous addition step. For example, a strategy in which a switch matrix for a masking strategy halves regions that were previously illuminated, illuminating about half of the previously illuminated region and protecting the remaining half (while also protecting about half of previously protected regions and illuminating about half of previously protected regions). It will be recognized that binary rounds may be interspersed with non-binary rounds and that only a portion of a substrate may be subjected to a binary scheme. A combinatorial "masking" strategy is a synthesis which uses light or other spatially selective deprotecting or activating agents to remove protecting groups from materials for addition of other materials such as amino acids.

The term "complementary" as used herein refers to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. Complementary nucleotides are, generally, A and T (or A and U), or C and G. Two single stranded RNA or DNA molecules are said to be complementary when the nucleotides of one strand, optimally aligned and compared and with appropriate nucleotide insertions or deletions, pair with at least about 80% of the nucleotides of the other strand, usually at least about 90% to 95%, and more preferably from about 98 to 100%. Alternatively, complementarity exists when an RNA or DNA strand will hybridize under selective hybridization conditions to its complement. Typically, selective hybridization will occur when there is at least about 65% complementary over a stretch of at least 14 to 25 nucleotides, preferably at least about 75%, more preferably at least about 90% complementary. See, M. Kanehisa Nucleic Acids Res. 12:203 (1984), incorporated herein by reference. When a probe sequence is perfectly complementary to a target it hybridizes to the target without a single mismatch over the entire length of the probe sequence.

The term "genome" as used herein is all the genetic material in the chromosomes of an organism. DNA derived from the genetic material in the chromosomes of a particular organism is genomic DNA. A genomic library is a collection of clones made from a set of randomly generated overlapping DNA fragments representing the entire genome of an organism.

The term "genotype" as used herein refers to the genetic information an individual carries at one or more positions in the genome. A genotype may refer to the information present at a single polymorphism, for example, a single SNP. For example, if a SNP is biallelic and can be either an A or a C then if an individual is homozygous for A at that position the genotype of the SNP is homozygous A or AA. Genotype may also refer to the information present at a plurality of polymorphic positions.

The term "Hardy-Weinberg equilibrium" (HWE) as used herein refers to the principle that an allele that when homozygous leads to a disorder that prevents the individual from reproducing does not disappear from the population but remains present in a population in the undetectable heterozygous state at a constant allele frequency.

The term "hybridization" as used herein refers to the process in which two single-stranded polynucleotides bind non-covalently to form a stable double-stranded polynucleotide; triple-stranded hybridization is also theoretically possible. The resulting (usually) double-stranded polynucleotide is a "hybrid." The proportion of the population of polynucleotides that forms stable hybrids is referred to herein as the "degree of hybridization." Hybridizations are usually performed under stringent conditions, for example, at a salt concentration of no more than about 1 M and a temperature of at least 25° C. Examples of hybridization conditions include: 5×SSPE (750 mM NaCl, 50 mM NaPhosphate, 5 mM EDTA, pH 7.4) and a temperature of 25-30° C. are suitable for allele-specific probe hybridizations or conditions of 100 mM MES, 1 M [Na$^+$], 20 mM EDTA, 0.01% Tween-20 and a temperature of 30-50° C., preferably at about 45-50° C. Hybridizations may be performed in the presence of agents such as herring sperm DNA at about 0.1 mg/ml, acetylated BSA at about 0.5 mg/ml. In a preferred embodiment 70 ul of labeled DNA is mixed with 190 ul of the following hybridization cocktail: 0.056 M MES, 5.0% DMSO, 2.50× Denhardt's Solution, 5.77 mM EDTA, 0.115 mg/mL Herring Sperm DNA (10 mg/mL), 11.5 μg/mL Human Cot-1, 0.0115% Tween-20, and 2.69 M (3%) TMACL and hybridized to a genotyping array at 16° C.

As other factors may affect the stringency of hybridization, including base composition and length of the complementary strands, presence of organic solvents and extent of base mismatching, the combination of parameters is more important than the absolute measure of any one alone. Hybridization conditions suitable for microarrays are described in the Gene Expression Technical Manual, 2004 and the GeneChip Mapping Assay Manual, 2004.

The term "hybridization probes" as used herein are oligonucleotides capable of binding in a base-specific manner to a complementary strand of nucleic acid. Such probes include oligonucleotides, peptide nucleic acids, as described in Nielsen et al., Science 254, 1497-1500 (1991), LNAs, as described in Koshkin et al. Tetrahedron 54:3607-3630, 1998, and U.S. Pat. No. 6,268,490 and other nucleic acid analogs and nucleic acid mimetics.

The term "hybridizing specifically to" as used herein refers to the binding, duplexing, or hybridizing of a molecule only to a particular nucleotide sequence or sequences under stringent conditions when that sequence is present in a complex mixture (for example, total cellular) DNA or RNA.

The term "initiation biomonomer" or "initiator biomonomer" as used herein is meant to indicate the first biomonomer which is covalently attached via reactive nucleophiles to the surface of the polymer, or the first biomonomer which is attached to a linker or spacer arm attached to the polymer, the linker or spacer arm being attached to the polymer via reactive nucleophiles.

The term "isolated nucleic acid" as used herein mean an object species invention that is the predominant species present (i.e., on a molar basis it is more abundant than any other individual species in the composition). Preferably, an isolated nucleic acid comprises at least about 50, 80 or 90% (on a molar basis) of all macromolecular species present. Most preferably, the object species is purified to essential homogeneity (contaminant species cannot be detected in the composition by conventional detection methods).

The term "ligand" as used herein refers to a molecule that is recognized by a particular receptor. The agent bound by or reacting with a receptor is called a "ligand," a term which is definitionally meaningful only in terms of its counterpart receptor. The term "ligand" does not imply any particular molecular size or other structural or compositional feature other than that the substance in question is capable of binding or otherwise interacting with the receptor. Also, a ligand may serve either as the natural ligand to which the receptor binds, or as a functional analogue that may act as an agonist or antagonist. Examples of ligands that can be investigated by this invention include, but are not restricted to, agonists and antagonists for cell membrane receptors, toxins and venoms, viral epitopes, hormones (for example, opiates, steroids, etc.), hormone receptors, peptides, enzymes, enzyme substrates, substrate analogs, transition state analogs, cofactors, drugs, proteins, and antibodies.

The term "linkage analysis" as used herein refers to a method of genetic analysis in which data are collected from affected families, and regions of the genome are identified that co-segregated with the disease in many independent families or over many generations of an extended pedigree. A disease locus may be identified because it lies in a region of the genome that is shared by all affected members of a pedigree.

The term "linkage disequilibrium" or sometimes referred to as "allelic association" as used herein refers to the preferential association of a particular allele or genetic marker with a specific allele, or genetic marker at a nearby chromosomal location more frequently than expected by chance for any particular allele frequency in the population. For example, if locus X has alleles A and B, which occur equally frequently, and linked locus Y has alleles C and D, which occur equally frequently, one would expect the combination AC to occur with a frequency of 0.25. If AC occurs more frequently, then alleles A and C are in linkage disequilibrium. Linkage disequilibrium may result from natural selection of certain combination of alleles or because an allele has been introduced into a population too recently to have reached equilibrium with linked alleles. The genetic interval around a disease locus may be narrowed by detecting disequilibrium between nearby markers and the disease locus. For additional information on linkage disequilibrium see Ardlie et al., *Nat. Rev. Gen.* 3:299-309, 2002.

The term "lod score" or "LOD" is the log of the odds ratio of the probability of the data occurring under the specific hypothesis relative to the null hypothesis. LOD=log[probability assuming linkage/probability assuming no linkage].

The term "mixed population" or sometimes refer by "complex population" as used herein refers to any sample containing both desired and undesired nucleic acids. As a non-limiting example, a complex population of nucleic acids may be total genomic DNA, total genomic RNA or a combination thereof. Moreover, a complex population of nucleic acids may have been enriched for a given population but include other undesirable populations. For example, a complex population of nucleic acids may be a sample which has been enriched for desired messenger RNA (mRNA) sequences but still includes some undesired ribosomal RNA sequences (rRNA).

The term "monomer" as used herein refers to any member of the set of molecules that can be joined together to form an oligomer or polymer. The set of monomers useful in the present invention includes, but is not restricted to, for the example of (poly)peptide synthesis, the set of L-amino acids, D-amino acids, or synthetic amino acids. As used herein, "monomer" refers to any member of a basis set for synthesis of an oligomer. For example, dimers of L-amino acids form a basis set of 400 "monomers" for synthesis of polypeptides. Different basis sets of monomers may be used at successive steps in the synthesis of a polymer. The term "monomer" also refers to a chemical subunit that can be combined with a different chemical subunit to form a compound larger than either subunit alone.

The term "mRNA" or sometimes refer by "mRNA transcripts" as used herein, include, but not limited to pre-mRNA transcript(s), transcript processing intermediates, mature mRNA(s) ready for translation and transcripts of the gene or genes, or nucleic acids derived from the mRNA transcript(s). Transcript processing may include splicing, editing and degradation. As used herein, a nucleic acid derived from an mRNA transcript refers to a nucleic acid for whose synthesis the mRNA transcript or a subsequence thereof has ultimately served as a template. Thus, a cDNA reverse transcribed from an mRNA, an RNA transcribed from that cDNA, a DNA amplified from the cDNA, an RNA transcribed from the amplified DNA, etc., are all derived from the mRNA transcript and detection of such derived products is indicative of the presence and/or abundance of the original transcript in a sample. Thus, mRNA derived samples include, but are not limited to, mRNA transcripts of the gene or genes, cDNA reverse transcribed from the mRNA, cRNA transcribed from the cDNA, DNA amplified from the genes, RNA transcribed from amplified DNA, and the like.

The term "nucleic acid library" or sometimes refer by "array" as used herein refers to an intentionally created collection of nucleic acids which can be prepared either synthetically or biosynthetically and screened for biological activity in a variety of different formats (for example, libraries of soluble molecules; and libraries of oligos tethered to resin beads, silica chips, or other solid supports). Additionally, the term "array" is meant to include those libraries of nucleic acids which can be prepared by spotting nucleic acids of essentially any length (for example, from 1 to about 1000 nucleotide monomers in length) onto a substrate. The term "nucleic acid" as used herein refers to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus the terms nucleoside, nucleotide, deoxynucleoside and deoxynucleotide generally include analogs such as those described herein. These analogs are those molecules having some structural features in common with a naturally occurring nucleoside or nucleotide such that when incorporated into a nucleic acid or oligonucleoside sequence, they allow hybridization with a naturally occurring nucleic acid sequence in solution. Typically, these analogs are derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "nucleic acids" as used herein may include any polymer or oligomer of pyrimidine and purine bases, preferably cytosine, thymine, and uracil, and adenine and guanine, respectively. See Albert L. Lehninger, PRINCIPLES OF BIOCHEMISTRY, at 793-800 (Worth Pub. 1982). Indeed, the present invention contemplates any deoxyribonucleotide, ribonucleotide or peptide nucleic acid component, and any chemical variants thereof, such as methylated, hydroxymethylated or glucosylated forms of these bases, and the like. The polymers or oligomers may be heterogeneous or homogeneous in composition, and may be isolated from naturally-occurring sources or may be artificially or synthetically produced. In addition, the nucleic acids may be DNA or RNA, or a mixture thereof, and may exist permanently or transitionally in single-stranded or double-stranded form, including homoduplex, heteroduplex, and hybrid states.

The term "oligonucleotide" or sometimes refer by "polynucleotide" as used herein refers to a nucleic acid ranging from at least 2, preferable at least 8, and more preferably at least 20 nucleotides in length or a compound that specifically hybridizes to a polynucleotide. Polynucleotides of the present invention include sequences of deoxyribonucleic acid (DNA) or ribonucleic acid (RNA) which may be isolated from natural sources, recombinantly produced or artificially synthesized and mimetics thereof. A further example of a polynucleotide of the present invention may be peptide nucleic acid (PNA). The invention also encompasses situations in which there is a nontraditional base pairing such as Hoogsteen base pairing which has been identified in certain tRNA molecules and postulated to exist in a triple helix. "Polynucleotide" and "oligonucleotide" are used interchangeably in this application.

The term "polymorphism" as used herein refers to the occurrence of two or more genetically determined alternative sequences or alleles in a population. A polymorphic marker or site is the locus at which divergence occurs. Preferred markers have at least two alleles, each occurring at frequency of greater than 1%, and more preferably greater than 10% or 20% of a selected population. A polymorphism may comprise one or more base changes, an insertion, a repeat, or a deletion. A polymorphic locus may be as small as one base pair. Polymorphic markers include restriction fragment length polymorphisms, variable number of tandem repeats (VNTR's), hypervariable regions, minisatellites, dinucleotide repeats, trinucleotide repeats, tetranucleotide repeats, simple sequence repeats, and insertion elements such as Alu. The first identified allelic form is arbitrarily designated as the reference form and other allelic forms are designated as alternative or variant alleles. The allelic form occurring most frequently in a selected population is sometimes referred to as the wildtype form. Diploid organisms may be homozygous or heterozygous for allelic forms. A diallelic polymorphism has two forms. A triallelic polymorphism has three forms. Single nucleotide polymorphisms (SNPs) are included in polymorphisms.

The term "primer" as used herein refers to a single-stranded oligonucleotide capable of acting as a point of initiation for template-directed DNA synthesis under suitable conditions for example, buffer and temperature, in the presence of four different nucleoside triphosphates and an agent for polymerization, such as, for example, DNA or RNA polymerase or reverse transcriptase. The length of the primer, in any given case, depends on, for example, the intended use of the primer, and generally ranges from 15 to 30 nucleotides. Short primer molecules generally require cooler temperatures to form sufficiently stable hybrid complexes with the template. A primer need not reflect the exact sequence of the template but must be sufficiently complementary to hybridize with such template. The primer site is the area of the template to which a primer hybridizes. The primer pair is a set of primers including a 5' upstream primer that hybridizes with the 5' end of the sequence to be amplified and a 3' downstream primer that hybridizes with the complement of the 3' end of the sequence to be amplified.

The term "probe" as used herein refers to a surface-immobilized molecule that can be recognized by a particular target. See U.S. Pat. No. 6,582,908 for an example of arrays having all possible combinations of probes with 10, 12, and more bases. Examples of probes that can be investigated by this invention include, but are not restricted to, agonists and antagonists for cell membrane receptors, toxins and venoms, viral epitopes, hormones (for example, opioid peptides, steroids, etc.), hormone receptors, peptides, enzymes, enzyme substrates, cofactors, drugs, lectins, sugars, oligonucleotides, nucleic acids, oligosaccharides, proteins, and monoclonal antibodies.

The term "receptor" as used herein refers to a molecule that has an affinity for a given ligand. Receptors may be naturally-occurring or manmade molecules. Also, they can be employed in their unaltered state or as aggregates with other species. Receptors may be attached, covalently or noncovalently, to a binding member, either directly or via a specific binding substance. Examples of receptors which can be employed by this invention include, but are not restricted to, antibodies, cell membrane receptors, monoclonal antibodies and antisera reactive with specific antigenic determinants (such as on viruses, cells or other materials), drugs, polynucleotides, nucleic acids, peptides, cofactors, lectins, sugars, polysaccharides, cells, cellular membranes, and organelles. Receptors are sometimes referred to in the art as anti-ligands. As the term receptors is used herein, no difference in meaning is intended. A "Ligand Receptor Pair" is formed when two macromolecules have combined through molecular recognition to form a complex. Other examples of receptors which can be investigated by this invention include but are not restricted to those molecules shown in U.S. Pat. No. 5,143,854, which is hereby incorporated by reference in its entirety.

The term "solid support", "support", and "substrate" as used herein are used interchangeably and refer to a material or group of materials having a rigid or semi-rigid surface or surfaces. In many embodiments, at least one surface of the solid support will be substantially flat, although in some embodiments it may be desirable to physically separate synthesis regions for different compounds with, for example, wells, raised regions, pins, etched trenches, or the like. According to other embodiments, the solid support(s) will take the form of beads, resins, gels, microspheres, or other geometric configurations. See U.S. Pat. No. 5,744,305 for exemplary substrates.

The term "target" as used herein refers to a molecule that has an affinity for a given probe. Targets may be naturally-occurring or man-made molecules. Also, they can be employed in their unaltered state or as aggregates with other species. Targets may be attached, covalently or noncovalently, to a binding member, either directly or via a specific binding substance. Examples of targets which can be employed by this invention include, but are not restricted to, antibodies, cell membrane receptors, monoclonal antibodies and antisera reactive with specific antigenic determinants (such as on viruses, cells or other materials), drugs, oligonucleotides, nucleic acids, peptides, cofactors, lectins, sugars, polysaccharides, cells, cellular membranes, and organelles. Targets are sometimes referred to in the art as anti-probes. As the term targets is used herein, no difference in meaning is intended. A "Probe Target Pair" is formed when two macromolecules have combined through molecular recognition to form a complex.

C. Interrogation of Selected Human SNPs

SEQ ID NOS 1-116,211, are disclosed. SEQ ID NOS 1-57251 represent SNPs that are found in Hind III fragments of the human genome that are within a selected size range and SEQ ID NOS 57252-116,211 represent SNPs that are present in Xba I fragments of the human genome that are within a selected size range. The sequences provided correspond to one strand of the genomic DNA including the SNP position and 25 bases 5' of the SNP and 24 bases 3' of the SNP. The polymorphic base is at position 26 of the sequences listed in the sequence listing. For example, SEQ ID NO 1 is 5' taatttggaa gacaacaagt tcataYtacc agtctgtctg tcccccagt 3' and the SNP position is represented by Y. The symbols Y, K, M and R are used to represent the SNP position where Y is T or C, K is G or T, M is A or C, and R is G or A. So, for SEQ ID NO 1 the SNP has alleles T and C. Each of SEQ ID Nos. 1-116,211 represents a single SNP from the human genome. SNPs were selected to be included in the list of SNPs and to be interrogated by the mapping array from public databases of SNPs such as dbSNP and from SNPs identified by Perlegen Sciences, Inc. SNPs were selected through a screening and validation process that evaluated accuracy of genotyping calls, rate of genotyping calls, and physical distribution in the genome. The median physical distance between SNPs is 8.5 kb and the average distance between SNPs is 23.6 kb. The average heterozygosity of the SNPs is 0.30.

The SNPs were selected so that the set would broadly cover the human genome, in a preferred embodiment more than 90% of the human genome is within 100 kb of a SNP in the set of SNPs to be genotyped. In another embodiment more than 80% of the genome is within 50 kb of a SNP to be interrogated and more than 40% of the genome is within 10 kb of a SNP to be interrogated. Sets of SNPs that are approximately evenly spaced throughout a genome may be used for linkage and association analysis. In a preferred embodiment the assay allows genotyping of at least 100,000 SNPs using 1 or 2 arrays and costing less than one cent per SNP. More than half of the SNPs in the set have been validated by resequencing at least 50 genomes from 25 individuals. Each allele of each SNP may be interrogated by a single probe sequence or by multiple probe sequences.

The probes of the array are allele specific so if the SNP is either T or C then there is a probe or probe set that is complementary to the T allele and a probe or probe set that is complementary to the C allele and the probe for the T allele is in a different feature of the array than the probe for the C allele. Features are at known or determinable locations.

In a preferred embodiment the array comprises sets of probes to detect the SNPs represented by SEQ ID NOS 1-116,211 or subset of those SNPs. Arrays may detect the genotype of at least 1,000, 5,000, 10,000, 25,000, 50,000 or 100,000 of the SNPs. In one embodiment there are 40 probes for each SNP, comprising 10 quartets of 4 probes. Each quartet consists of a perfect match probe for allele A, a perfect match probe for allele B, a mismatch probe for allele A and a mismatch probe for allele B. The mismatch probe is identical to the perfect match probe with the exception that the central base in the mismatch probe, position 13 in a 25 nucleotide probe, is the complement of the perfect match base. For example, if the perfect match probe has a G at position 13 the mismatch probe has a C at that position. One quartet varies from another in the position of the polymorphic base, for example in one quartet the polymorphic base may be at the central or 0 position of the probe, which is the 13$^{th}$ nucleotide from the 5' end of a 25 nucleotide probe. In the other quartets the polymorphic base may be shifted 5' or 3' of the 0 position. Thus, each 50 nucleotide sequence in the sequence listing represents at least 40 different probes that contain at least 15 contiguous nucleotides of a sequence from the sequence listing. An example of a genotyping probe set of a preferred embodiment for a SNP, SNP 611, is shown in Table 1.

TABLE 1

| SEQ ID NO | PM/ MM, A/G | Position | Probe Sequence | Strand |
|---|---|---|---|---|
| 116,212 | PM A | -4 | TCATTTAACATTTGTGTTAACAAAA | 0 |
| 116,213 | MM A | -4 | TCATTTAACATTAGTGTTAACAAAA | 0 |
| 116,214 | PM A | -2 | ATTTAACATTTGTGTTAACAAAAAC | 0 |
| 116,215 | MM A | -2 | ATTTAACATTTGAGTTAACAAAAAC | 0 |
| 116,216 | PM A | -1 | TTTAACATTTGTGTTAACAAAAACT | 0 |
| 116,217 | MM A | -1 | TTTAACATTTGTCTTAACAAAAACT | 0 |
| 116,218 | PM A | 0 | TTAACATTTGTGTTAACAAAAACTC | 0 |
| 116,219 | MM A | 0 | TTAACATTTGTGATAACAAAAACTC | 0 |
| 116,220 | PM A | 1 | TAACATTTGTGTTAACAAAAACTCC | 0 |
| 116,221 | MM A | 1 | TAACATTTGTGTAAACAAAAACTCC | 0 |
| 116,222 | PM A | 4 | CATTTGTGTTAACAAAAACTCCTCC | 0 |

TABLE 1-continued

| SEQ ID NO | PM/ MM, A/G | Position | Probe Sequence | Strand |
|---|---|---|---|---|
| 116,223 | MM A | 4 | CATTTGTGTTAAGAAAAACTCCTCC | 0 |
| 116,224 | PM G | -4 | TCATTTAACATTTGTGCTAACAAAA | 0 |
| 116,225 | MM G | -4 | TCATTTAACATTAGTGCTAACAAAA | 0 |
| 116,226 | PM G | -2 | ATTTAACATTTGTGCTAACAAAAAC | 0 |
| 116,227 | MM G | -2 | ATTTAACATTTGAGCTAACAAAAAC | 0 |
| 116,228 | PM G | -1 | TTTAACATTTGTGCTAACAAAAACT | 0 |
| 116,229 | MM G | -1 | TTTAACATTTGTCCTAACAAAAACT | 0 |
| 116,230 | PM G | 0 | TTAACATTTGTGCTAACAAAAACTC | 0 |
| 116,231 | MM G | 0 | TTAACATTTGTGGTAACAAAAACTC | 0 |
| 116,232 | PM G | 1 | TAACATTTGTGCTAACAAAAACTCC | 0 |
| 116,233 | MM G | 1 | TAACATTTGTGCAAACAAAAACTCC | 0 |
| 116,234 | PM G | 4 | CATTTGTGCTAACAAAAACTCCTCC | 0 |
| 116,235 | MM G | 4 | CATTTGTGCTAAGAAAAACTCCTCC | 0 |
| 116,236 | PM A | -4 | TTTTGTTAACACAAATGTTAAATGA | 1 |
| 116,237 | MM A | -4 | TTTTGTTAACACTAATGTTAAATGA | 1 |
| 116,238 | PM A | -2 | GTTTTGTTAACACAAATGTTAAAT | 1 |
| 116,239 | MM A | -2 | GTTTTGTTAACTCAAATGTTAAAT | 1 |
| 116,240 | PM A | -1 | AGTTTTGTTAACACAAATGTTAAA | 1 |
| 116,241 | MM A | -1 | AGTTTTGTTAAGACAAATGTTAAA | 1 |
| 116,242 | PM A | 0 | GAGTTTTGTTAACACAAATGTTAA | 1 |
| 116,243 | MM A | 0 | GAGTTTTGTTATCACAAATGTTAA | 1 |
| 116,244 | PM G | -4 | TTTTGTTAGCACAAATGTTAAATGA | 1 |
| 116,245 | MM G | -4 | TTTTGTTAGCACTAATGTTAAATGA | 1 |
| 116,246 | PM G | -2 | GTTTTGTTAGCACAAATGTTAAAT | 1 |
| 116,247 | MM G | -2 | GTTTTGTTAGCTCAAATGTTAAAT | 1 |
| 116,248 | PM G | -1 | AGTTTTGTTAGCACAAATGTTAAA | 1 |
| 116,249 | MM G | -1 | AGTTTTGTTAGGACAAATGTTAAA | 1 |
| 116,250 | PM G | 0 | GAGTTTTGTTAGCACAAATGTTAA | 1 |
| 116,251 | MM G | 0 | GAGTTTTGTTACCACAAATGTTAA | 1 |

The exemplary probe set shown in Table 1 has 40 probes. The two strands of the DNA are indicated by 0 or 1. There are 10 sets of 4 probes. Each set has 2 perfect match probes, 1 for each allele and 2 mismatch probes. In this set there are 24 probes, (6 probe sets of 4 probes), for the 0 strand and 16 probes, (4 probe sets of 4 probes), for the 1 strand. The probe sets for the 0 strand correspond to having the SNP allele at positions -4, -2, -1, 0, 1 and 4 of the probe and the probe sets for the 1 strand correspond to the SNP allele at positions -4, -2, -1 and 0 of the probe (where 0 is the central position of the probe). As shown by this example there can be an unequal number of probe sets for the 0 and 1 strand. PM A indicates perfect match probes for allele A and PM G indicates perfect match probes for allele G. Mismatch probes for allele A and G are indicated by MM A and MM G, respectively.

In a preferred embodiment the optimal 10 quartets are selected for each SNP. This may be 5 quartets for each of the two strands or an unequal number of quartets from each strand, for example, 6 from one strand and 4 from the other as in the example in Table 1. There may be 7 and 3, 8 and 2, 9 and 1 or 10 and 0. The quartets may vary in the position of the SNP base. For example, the 5 quartets may be 0, +2, +4, −3, and −4 on one strand and 0, +1, +3, −2, and −4 on the opposite strand. In some embodiments the quartets for one strand correspond to the quartets from the other strand so that the probes from one quartet are the complements of the probes from the corresponding quartet.

In the example probe set provided in Table 1, SEQ ID No. 116,212 has a T at position 13 and a T at position 17 and is the perfect match (PM) A probe. SEQ ID No. 116,213 has an A at position 13 and a T at position 17 and is the mismatch (MM) A probe. Position 13 is the position of the mismatch base in the MM A probe and position 17 is the position of the allele specific SNP base. The SNP position is shifted to the −4 position relative to the 0 strand. The −4 G allele probes are SEQ ID Nos. 116,224 and 116,225 and they have a C at position 17. The −4 probes for the A allele for the 1 strand, the opposite strand, are SEQ ID Nos. 116,236 and 116,237. The mismatch is at position 13 and the SNP allele is at position 9.

Accordingly, for each nucleic acid sequence listed in SEQ ID NOS 1-116,211, this disclosure includes a probe comprising any contiguous length of from 15 to 50 nucleotides from a sequence in the list or the complement of a sequence in the list. The oligonucleotides may also comprise any contiguous length from 15 to 50 nucleotides from a sequence in the list or the complement of a sequence in the list including a single base mismatch. The position of the mismatch is preferably located at the central position of the probe, for example, for a probe of 25 nucleotides, the mismatch position would be position 13. In another embodiment the mismatch position may be located anywhere in the nucleic acid sequence and may comprise one base, or in some embodiments there may be 2, 3, 4 or 5 mismatches. Generally, the sequences correspond to SNPs each represented by a single sequence from SEQ ID Nos. 1-116,211, which include the SNP position and sequences surrounding the SNP. The SNPs are preferably biallelic but may be triallelic and the probes in a preferred embodiment are used to distinguish between different alleles of a SNP. Allele frequencies vary between populations so a SNP that is biallelic in one population may not be polymorphic in another population or may be represented by different alleles or different allele frequencies.

The present invention includes: the sequences listed in SEQ ID NOS 1-116,211 and the complement of these sequences. In a preferred aspect an array including a genotyping probe set of at least 20 probes for at least 10,000 SNPs, designed from sequences in the sequence listing according to the example in Table 1, is disclosed. Also contemplated are mismatch probes incorporating at least 15 bases from SEQ ID NOS 1-116,211, longer nucleotide sequences which include at least one of the nucleic acid sequences listed in SEQ ID NOS 1-116,211 and the complement of these sequences and sub-sequences greater than 15 nucleotides in length of the target nucleic acid sequences listed in SEQ ID NOS 1-116,211 and the complement of these sequences. Also disclosed are oligonucleotides that comprise 15 to 50 contiguous nucleotides from one of the sequences in SEQ ID No. 1-116,211 or the complement of SEQ ID No. 1-116,211 and additional sequence 5' or 3'. For example, oligonucleotides or probes may comprise one or more tag sequences, universal priming sequence, or restriction enzyme recognition sequences upstream or downstream (5' or 3') of a region comprising 15 to 50 contiguous nucleotides of SEQ ID No. 1-116,211. The oligonucleotides may be attached to a solid support, for example, each different sequence may be attached to one or more beads. In one embodiment an oligonucleotide that is complementary to each allele of each of the SNPs represented by SEQ ID No. 1-116,211 is attached to an array in a determinable location that is different from a plurality of other different sequence oligonucleotides. The oligonucleotides may be extended in an allele specific manner and extension detected. For example, extension may be with labeled nucleotides and may also be allele specific. Differently tagged oligos may be used for each allele of each SNP. See, for example, U.S. Pat. Nos. 6,709,816, 6,287,778, and 6,638,719. Tags, tag probes, arrays of tag probes, methods of using tags, and methods of selecting sets of tags are disclosed, for example, in U.S. Pat. Nos. 6,458,530 and 6,656,412 and in U.S. patent application Ser. No. 09/827,383.

The nucleic acid sequences listed in SEQ ID NOS 1-116,211 correspond to regions of the human genome containing SNPs. Information about the SNPs represented by each of the sequences in the sequence listing can be obtained from public databases. Each SNP has a reference SNP ID or "rs" ID that identifies a SNP in the NCBI (National Center for Biotechnology Information) SNP database (dbSNP). A reference SNP ID, or 'rs' ID is an identification tag assigned by NCBI to SNPs that appear to be unique in the database. The rs ID number, or tag, is assigned at submission. For example, 1000018A, refers to the A allele of a SNP at position 62126003 of chromosome 2. The observed alleles are A and T. A search of the dbSNP database for rs1000018 provides available information about the SNP. For each of the SNP IDs represented in the sequence listing the corresponding entry in dbSNP is incorporated by reference (Build 116, Aug. 2, 2003).

SNPs were selected from the publicly available database of human SNPs. The selected SNPs are from the group of SNPs that are present on XbaI or HindIII fragments of 250 to 2000 base pairs. A computer system was used to predict fragments that would result when the human genome is digested with XbaI or HindIII. Those fragments in the selected size range were selected for further analysis. Of those fragments those that carried a SNP were selected as potential target sequences. SNPs were selected from these potential target sequences and the selected SNPs are represented by SEQ ID NOS 1-116,211. In some embodiments the present invention provides one or more pools of unique nucleotide sequences complementary to SNPs and sequence surrounding SNPs which alone, or in combinations of 2 or more, 10 or more, 100 or more, 1,000 or more, 10,000 or more or 100,000 or more can be used for a variety of applications.

In one embodiment, the present invention provides for a pool of unique nucleotide sequences which are complementary to human SNPs and sequence surrounding SNPs formed into a high density array of probes suitable for array based massive parallel gene expression. Array based methods for SNP analysis and genotyping are disclosed and discussed in detail in U.S. Pat. Nos. 6,361,947 and 6,368,799 which are incorporated herein by reference for all purposes. Generally those methods of SNP analysis involve: (1) providing a pool of target nucleic acids comprising one or more target sequence(s), (2) amplifying a collection of target sequences, (3) hybridizing the amplified nucleic acid sample to a high density array of probes, and (4) detecting the hybridized nucleic acids and determining the presence or absence of one or more alleles for one or more SNPs.

The development of Very Large Scale Immobilized Polymer Synthesis or VLSIPS™ technology has provided methods for making very large arrays of nucleic acid probes in very small arrays. See U.S. Pat. No. 5,143,854 and PCT Nos. WO 90/15070 and 92/10092, and Fodor et al., *Science*, 251:767-77 (1991), each of which is incorporated herein by reference. U.S. Pat. Nos. 5,800,992 and 6,040,138 describe methods for making arrays of nucleic acid probes that can be used to detect the presence of a nucleic acid containing a specific nucleotide sequence. Methods of forming high-density arrays of nucleic acids, peptides and other polymer sequences with a minimal number of synthetic steps are known. The nucleic acid array can be synthesized on a solid substrate by a variety of methods, including, but not limited to, light-directed chemical coupling, and mechanically directed coupling. See also US Pub. Nos. 20030003490, 20020187515, and 20020177141.

In one embodiment probes are present on the array so that each SNP is represented by a collection of probes. The array may comprise between 4 and 80 probes for each SNP. In one embodiment the collection comprises, between 20 and 40 probes for each SNP. In another embodiment the array comprises about 40 to about 56 probes for each SNP. In a preferred embodiment the collection comprises about 40 probes for each SNP, 20 for each allele. In one embodiment the probes may be present in sets of 8 probes that correspond to a PM probe for each of two alleles, a MM probe for each of 2 alleles, and the corresponding probes for the opposite strand. In another embodiment the probes may be present in sets of 4 probes that correspond to a PM probe for each of two alleles and a MM probe for each of 2 alleles, all complementary to the same strand. The polymorphic position may be the central position of the probe region, for example, the probe region may be 25 nucleotides and the polymorphic allele may be in the middle with 12 nucleotides on either side. In other probe sets the polymorphic position may be offset from the center. For example, the polymorphic position may be from 1 to 7 bases from the central position on either the 5' or 3' side of the probe. The interrogation position, which is changed in the mismatch probes, may remain at the center position. In one embodiment there are 56 probes for each SNP: the 8 probes corresponding to the polymorphic position at the center or 0 position and 8 probes for the polymorphic position at each of the following positions: −4, −2, −1, +1, +3 and +4 relative to the central or 0 position. In another embodiment 40 probes are used, 8 for the 0 position and 8 for each of 4 additional positions selected from: −4, −2, −1, +1, +3 and +4 relative to the central or 0 position. The probes sets used may vary depending on the SNP, for example, for one SNP the probes may be −4, −2, 0, +1 and +4 and for another SNP they may be −2, −1, 0, +1 and +4. Empirical data may be used to choose which probe sets to use on an array. In another embodiment 24 or 32 probes may be used for one or more SNPs.

In many embodiments pairs are present in perfect match and mismatch pairs, one probe in each pair being a perfect match to the target sequence and the other probe being identical to the perfect match probe except that the central base is a homo-mismatch. Mismatch probes provide a control for non-specific binding or cross-hybridization to a nucleic acid in the sample other than the target to which the probe is directed. Thus, mismatch probes indicate whether hybridization is or is not specific. For example, if the target is present, the perfect match probes should be consistently brighter than the mismatch probes because fluorescence intensity, or brightness, corresponds to binding affinity. (See e.g., U.S. Pat. No. 5,324,633, which is incorporated herein for all purposes.) Finally, the difference in intensity between the perfect match and the mismatch probe (I(PM)−I(MM)) provides a good measure of the concentration of the hybridized material. See PCT No. WO 98/11223, which is incorporated herein by reference for all purposes.

In another embodiment, the current invention provides a pool of sequences that may be used as probes. Methods for making probes are well known. See e.g., MOLECULAR CLONING A LABORATORY MANUAL, Sambrook and Russell Eds., CSLH Press, ($3^{rd}$ ed. 2001), which is hereby incorporated in its entirety by reference for all purposes. Sambrook describes a number of uses for nucleic acid probes of defined sequence. Some of the uses described by Sambrook include: (1) screening cDNA or genomic DNA libraries, or subclones derived from them, for additional clones containing segments of DNA that have been isolated and previously sequenced; (2) identifying or detect the sequences of specific genes; (3) detecting specific mutations in genes of known sequence; to detect specific mutations generated by site-directed mutagenesis of cloned genes; (4) and mapping the 5' termini of mRNA molecules by primer extensions. Sambrook describes other uses for probes throughout. See also Alberts et al., MOLECULAR BIOLOGY OF THE CELL ($3^{rd}$ ed. 1994) at 307 and Lodish et al., MOLECULAR CELL BIOLOGY, ($4^{th}$ ed. 2000) at 285-286, each of which is hereby incorporated by reference in its entirety for all purposes, for a brief discussion of the use of nucleic acid probes in in situ hybridization. Other uses for probes derived from the sequences disclosed in this invention will be readily apparent to those of skill in the art. See e.g., Lodish et al., MOLECULAR CELL BIOLOGY, ($3^{rd}$ ed. 1995) at 229-233, incorporated above, for a description of the construction of genomic libraries.

In another embodiment, the current invention may be combined with known methods to genotype polymorphism in a wide variety of contexts. For example, the methods may be used to do association studies, identify candidate genes associated with a phenotype, genotype SNPs in clinical populations, or correlate genotype information to clinical phenotypes. The SNPs of Table 1 have been selected based on a number of criteria that make them suitable for complex genetic analysis, for example, linkage analysis and association studies. The SNPs in the set of SNPs represented by the sequence listing are spaced throughout the genome at an average distance of 210 Kb from one another and they are known to be polymorphic in multiple populations. The panel of SNPs or a subset of these SNPs may be genotyped by any method available. See, Color Atlas of Genetics ($2^{nd}$ ed), Ed. Passarge (2001) Thieme, NY, N.Y., which is incorporated by reference.

For a discussion of genotyping analysis methods see, for example, Elena and Lenski Nature Reviews, Genetics 4:457-469 (2003), Twyman and Primrose, Pharmacogenomics 4:67-79 (2003), Hirschhorn et al. Genetics in Medicine 4:45-61 (2002) and Glazier et al. *Science* 298:2345-2349 (2002) each of which is incorporated herein by references for all purposes. For a discussion of high throughput genotyping approaches see, for example, Jenkins and Gibson, *Comp Funct Genom* 2002; 3:57-66 which is incorporated herein by reference. For a review of methods of haplotype analysis in population genetics and association studies see, for example, Zhao et al. Pharmacogenomics 4:171-178 (2003), which is incorporated herein by reference.

In preferred embodiments the SNPs are genotyped by amplification of the sample using the whole genome sampling assay, (WGSA), hybridization to a mapping array as disclosed herein and analysis of the hybridization pattern using software that provides genotyping calls. WGSA is described, for example in Kennedy et al., Nat. Biotech. 21, 1233-1237 (2003), Matsuzaki et al., Gen. Res. 14: 414-425, (2004), and Matsuzaki, et al. Nature Methods 1: 109-111 (2004). Algorithms for use with mapping assays are described, for example, in Liu et al., Bioinformatics 19: 2397-2403 (2003) and Di et al. Bioinformatics 21:1958 (2005). Additional methods related to WGSA and arrays useful for WGSA and applications of WGSA are disclosed, for example, in U.S. Patent Application Nos. 60/676,058 filed Apr. 29, 2005, 60/616,273 filed Oct. 5, 2004, 10/912, 445, 11/044,831, 10/442,021, 10/650,332 and 10/463,991. Genome wide association studies using mapping assays are described in, for example, Hu et al., Cancer Res.;65(7): 2542-6 (2005), Mitra et al., Cancer Res., 64(21):8116-25 (2004), Butcher et al., Hum Mol Genet., 14(10):1315-25 (2005), and Klein et al., Science, 308(5720):385-9 (2005). Each of these references is incorporated herein by reference in its entirety for all purposes.

One skilled in the art will appreciate that a wide range of applications will be available using 2 or more, 10 or more, 100 or more, 1000 or more, 10,000 or more, 100,000 or more, or more of the SEQ ID NOS 1-116,211 sequences as probes for polymorphism detection and analysis. The combination of the DNA array technology and the Human SNP specific probes in this disclosure is a powerful tool for genotyping and mapping disease loci.

In many embodiments the target sequences are a subset that is representative of a larger set. For example, the target sequences may be 1,000, 5,000, 10,000 or 100,000 to 10,000, 20,000, 100,000, 1,500,000 or 3,000,000 SNPs that may be representative of a larger population of SNPs present in a population of individuals. The target sequences may be dispersed throughout a genome, including for example, sequences from each chromosome, or each arm of each chromosome. Target sequences may be representative of haplotypes or particular phenotypes or collections of phenotypes. For a description of haplotypes see, for example, Gabriel et al., Science, 296:2225-9 (2002), Daly et al. Nat Genet., 29:229-32 (2001) and Rioux et al., Nat Genet., 29:223-8 (2001), each of which is incorporated herein by reference in its entirety.

In another embodiment, the present invention may be used for cross-species comparisons. One skilled in the art will appreciate that it is often useful to determine whether a SNP present in one species, for example human, is present in a conserved format in another species, including, without limitation, gorilla, chimp, mouse, rat, or chicken. See e.g. Andersson et al., Mamm. Genome, 7(10):717-734 (1996), which is hereby incorporated by reference for all purposes, which describes the utility of cross-species comparisons. The use of 2 or more, 10 or more, 100 or more, 1000 or more, 10,000 or more, 100,000 or more of the sequences disclosed in this invention in an array can be used to determine whether any sequence from one or more of the human SNPs represented by the sequences disclosed in this invention is conserved in another species by, for example, hybridizing genomic nucleic acid samples from another species to an array comprised of the sequences and probe sets disclosed in this invention.

In a preferred embodiment, the hybridized nucleic acids are detected by detecting one or more labels attached to the sample nucleic acids. The labels may be incorporated by any of a number of means well known to those of skill in the art. In one embodiment, the label is simultaneously incorporated during the amplification step in the preparation of the sample nucleic acids. Thus, for example, polymerase chain reaction (PCR) with labeled primers or labeled nucleotides will provide a labeled amplification product. In another embodiment, transcription amplification using a labeled nucleotide (e.g. fluorescein-labeled UTP and/or CTP) incorporates a label into the transcribed nucleic acids.

Alternatively, a label may be added directly to the original nucleic acid sample (e.g., mRNA, polyA mRNA, cDNA, etc.) or to the amplification product after the amplification is completed. Means of attaching labels to nucleic acids are well known to those of skill in the art and include, for example, nick translation or end-labeling (e.g. with a labeled RNA) by kinasing the nucleic acid and subsequent attachment (ligation) of a nucleic acid linker joining the sample nucleic acid to a label (e.g., a fluorophore). In another embodiment label is added to the end of fragments using terminal deoxytransferase (TdT).

Detectable labels suitable for use in the present invention include any composition detectable by spectroscopic, photochemical, biochemical, immunochemical, electrical, optical or chemical means. Useful labels in the present invention include, but are not limited to: biotin for staining with labeled streptavidin conjugate; anti-biotin antibodies, magnetic beads (e.g., Dynabeads™); fluorescent dyes (e.g., fluorescein, texas red, rhodamine, green fluorescent protein, and the like); radiolabels (e.g., $^3$H, $^{125}$I, $^{35}$S, $^{14}$C, or $^{32}$P); phosphorescent labels; enzymes (e.g., horse radish peroxidase, alkaline phosphatase and others commonly used in an ELISA); and colorimetric labels such as colloidal gold or colored glass or plastic (e.g., polystyrene, polypropylene, latex, etc.) beads. Patents teaching the use of such labels include U.S. Pat. Nos. 3,817,837; 3,850,752; 3,939,350; 3,996,345; 4,277,437; 4,275,149; and 4,366,241, each of which is hereby incorporated by reference in its entirety for all purposes.

Means of detecting such labels are well known to those of skill in the art. Thus, for example, radiolabels may be detected using photographic film or scintillation counters; fluorescent markers may be detected using a photodetector to detect emitted light. Enzymatic labels are typically detected by providing the enzyme with a substrate and detecting the reaction product produced by the action of the enzyme on the substrate, and colorimetric labels are detected by simply visualizing the colored label.

The label may be added to the target nucleic acid(s) prior to, or after the hybridization. So called "direct labels" are detectable labels that are directly attached to or incorporated into the target nucleic acid prior to hybridization. In contrast, so called "indirect labels" are joined to the hybrid duplex after hybridization. Often, the indirect label is attached to a binding moiety that has been attached to the target nucleic acid prior to the hybridization. Thus, for example, the target nucleic acid may be biotinylated before the hybridization. After hybridization, an avidin-conjugated fluorophore will bind the biotin bearing hybrid duplexes providing a label that is easily detected. For a detailed review of methods of labeling nucleic acids and detecting labeled hybridized nucleic acids. See Tijssen, LABORATORY TECHNIQUES IN BIOCHEMISTRY AND MOLECULAR BIOLOGY, VOL. 24: HYBRIDIZATION WITH NUCLEIC ACID PROBES (1993) which is hereby incorporated by reference in its entirety for all purposes.

D. Methods of Use

The methods of the presently claimed invention can be used for a wide variety of applications including, for example, linkage and association studies, identification of candidate gene regions, genotyping clinical populations, correlation of genotype information to phenotype information, loss of heterozygosity analysis, and identification of the source of an organism or sample, or the population from which an organism or sample originates. Any analysis of genomic DNA may be benefited by a reproducible method of polymorphism analysis. Furthermore, the probes, sequences, arrays and collections of SNPs of the presently claimed invention are particularly well suited for study and characterization of extremely large regions of genomic DNA in individual samples and in populations.

In a preferred embodiment, the methods of the presently claimed invention are used to genotype individuals, populations or samples. For example, any of the procedures described above, alone or in combination, could be used to interrogate SNPs present in Table 1. The disclosed arrays could be used in conjunction with methods of reducing the complexity of a sample in a reproducible and predictable manner. For example, complexity reduction methods may be designed to amplify a collection of target sequences that correspond to fragments containing SNPs from Table 1. Arrays may be designed and manufactured on a large scale basis to interrogate those fragments with probes comprising sequences from SEQ ID NOS 1-116,211. Thereafter, a sample from one or more individuals would be obtained and prepared using the same techniques which were used to prepare the selection probes or to design the array. Each sample can then be hybridized to an array and the hybridization pattern can be analyzed to determine the genotype of each individual or a population of individuals. Methods of use for polymorphisms and SNP discovery can be found in, for example, U.S. Pat. No. 6,361,947 which is herein incorporated by reference in its entirety for all purposes.

Correlation of Polymorphisms with Phenotypic Traits

Most human sequence variation is attributable to or correlated with SNPs, with the rest attributable to insertions or deletions of one or more bases, repeat length polymorphisms and rearrangements. On average, SNPs occur every 1,000-2,000 bases when two human chromosomes are compared, resulting in an estimated 3,000,000 SNPs in the human genome. (See, The International SNP Map Working Group, Science 409: 928-933 (2001) incorporated herein by reference in its entirety for all purposes.) Human diversity is limited not only by the number of SNPs occurring in the genome but further by the observation that specific combinations of alleles are found at closely linked sites, generating haplotypes. For a description of haplotypes see, for example, Gabriel et al., Science, 296:2225-9 (2002), Daly et al. Nat Genet., 29:229-32 (2001) and Rioux et al., Nat Genet., 29:223-8 (2001), each of which is incorporated herein by reference in its entirety.

Correlation of individual polymorphisms or groups of polymorphisms with phenotypic characteristics is a valuable tool in the effort to identify DNA variation that contributes to population variation in phenotypic traits. Phenotypic traits include, for example, physical characteristics, risk for disease, and response to the environment. Polymorphisms that correlate with disease are particularly interesting because they represent mechanisms to accurately diagnose disease and targets for drug treatment. Hundreds of human diseases have already been correlated with individual polymorphisms but there are many diseases that are known to have an, as yet unidentified, genetic component and many diseases for which a component is or may be genetic. Large scale association studies using large groups of SNPs provides additional tools for disease association studies.

Many diseases may correlate with multiple genetic changes making identification of the polymorphisms associated with a given disease more difficult. One approach to overcome this difficulty is to systematically explore the limited set of common gene variants for association with disease.

To identify correlation between one or more alleles and one or more phenotypic traits, individuals are tested for the presence or absence of polymorphic markers or marker sets and for the phenotypic trait or traits of interest. The presence or absence of a set of polymorphisms is compared for individuals who exhibit a particular trait and individuals who exhibit lack of the particular trait to determine if the presence or absence of a particular allele is associated with the trait of interest. For example, it might be found that the presence of allele A1 at polymorphism A correlates with heart disease. As an example of a correlation between a phenotypic trait and more than one polymorphism, it might be found that allele A1 at polymorphism A and allele B1 at polymorphism B correlate with a phenotypic trait of interest.

Diagnosis of Disease and Predisposition to Disease

Markers or groups of markers that correlate with the symptoms or occurrence of disease can be used to diagnose disease or predisposition to disease without regard to phenotypic manifestation. To diagnose disease or predisposition to disease, individuals are tested for the presence or absence of polymorphic markers or marker sets that correlate with one or more diseases. If, for example, the presence of allele A1 at polymorphism A correlates with coronary artery disease then individuals with allele A1 at polymorphism A may be at an increased risk for the condition.

Individuals can be tested before symptoms of the disease develop. Infants, for example, can be tested for genetic diseases such as phenylketonuria at birth. Individuals of any age could be tested to determine risk profiles for the occurrence of future disease. Often early diagnosis can lead to more effective treatment and prevention of disease through dietary, behavior or pharmaceutical interventions. Individuals can also be tested to determine carrier status for genetic disorders. Potential parents can use this information to make family planning decisions.

Individuals who develop symptoms of disease that are consistent with more than one diagnosis can be tested to make a more accurate diagnosis. If, for example, symptom S is consistent with diseases X, Y or Z but allele A1 at polymorphism A correlates with disease X but not with diseases Y or Z an individual with symptom S is tested for the presence or absence of allele A1 at polymorphism A. Presence of allele A1 at polymorphism A is consistent with a diagnosis of disease X. Genetic expression information discovered through the use of arrays has been used to determine the specific type of cancer a particular patient has. (See, Golub et al. Science 286: 531-537 (2001) hereby incorporated by reference in its entirety for all purposes.) The arrays may be used for any application that uses genotype information, for examples, applications such as pharmacogenomics, translational medicine, paternity analyis, linkage, association, allele frequency determination, relatedness determination, forensics and genetic mapping.

EXAMPLE

The following example serves to illustrate the type of experiment that could be conducted using the invention.

The GeneChip® Human Mapping 100K set comprises two arrays, each with greater that 50,000 SNPs interrogated per array. The first array comprises probe sets to SNPs on human genome XbaI fragments and the second array comprises probe sets for SNPs on human genome HindIII fragments. Researchers can use one of the arrays to genotype more than 50,000 SNPs in a single experiment or use both arrays to genotype more than 100,000 SNPs. The arrays can be used alone or in combination. The arrays may be used for linkage and association studies. Detailed methods for sample preparation, array hybridization and analysis are disclosed, for example, in U.S. provisional application No. 60/556,753 and U.S. patent application Ser. No. 10/681,773. In general genomic DNA is amplified, labeled and hybridized to arrays. Total genomic DNA (250 ng) is digested with a restriction enzyme (XbaI or HindIII) and ligated to adapters that recognize the cohesive four basepair overhangs. All fragments resulting from digestions, regardless of size, are substrates for adapter ligation. A generic primer that recognizes the adapter sequence is used to amplify adapter ligated DNA fragments. PCR conditions optimized to preferentially amplify fragments in the 250 to 2000 bp size range are used for amplification. The amplified DNA is fragmented, labeled and hybridized to the Mapping 100K set. See, the GeneChip Mapping 100K assay manual for additional information.

Polymorphism Detection by Hybridization to High Density Oligonucleotide Arrays

Arrays containing the desired number of probes can be synthesized using the method described in U.S. Pat. No. 5,143,854, incorporated by reference above. Nucleic acid may be amplified so that a collection of target sequences is preferentially amplified. The amplified fragments may be fragmented and end labeled with terminal deoxytransferase and biotin labeled nucleotides. Hybridizations are carried out in a flow cell that contains the two-dimensional DNA probe arrays. Following a brief washing step to remove unhybridized RNA, the arrays are scanned using a scanning confocal microscope.

250 ng Genomic DNA was digested with XbaI or HindIII by mixing 5 µl 50 ng/µl human genomic DNA (Coriell Cell Repositories) with 10.5 µl H$_2$0 (Accugene), 2 µl 10×RE buffer (NEB, Beverly, Mass.), 2 µl 10×BSA (NEB, Beverly, Mass.), and 0.5 µl XbaI or HindIII (NEB, Beverly, Mass.). The reaction was incubated at 30° C. for 2 hours, then the enzyme was inactivated by incubation at 70° C. for 20 min and then to 4° C. The reaction may be stored at −20° C.

For ligation of the adapters the digested DNA was then mixed with 1.25 µl 5 uM adapter in TE pH 8.0, 2.5 µl T4 DNA ligation buffer and 1.25 µl T4 DNA Ligase (NEB, Beverly, Mass.) which is added last. The reaction was incubated at 16° C. for 2 hours then at 70° C. for 20 min and then to 4° C. The 25 µl ligation mixture is then diluted with 75 µl H$_2$0 and may be stored at −20° C.

For PCR 10 µl of the diluted ligated DNA is mixed with 10 µl PCR buffer II (Perkin Elmer, Boston, Mass.), 10 µl 2.5 mM dNTP (PanVera Takara, Madison, Wis.), 10 µl 25 mM MgCl$_2$, 7.5 µl 10 µM primer (for a final concentration of 0.75 µM), 2 µl 5U/µl Taq Gold (Perkin Elmer, Boston, Mass.) and 50.5 µl H$_2$0. For each array four 100 µl reactions were prepared. Amplification was done using the following program: 95° C. for 3 min; 35 cycles of 95° C. for 20 sec, 59° C. for 15 sec and 72° C. for 15 sec; and a final incubation at 72° C. for 7 min. The reactions were then held at 4° C. The lid heating option was selected.

The PCR reactions were then purified by mixing the 100 µl PCR reaction with 500 µl PB or PM buffer into Qiagen columns (Valencia, Calif.) and the column was centrifuged at 13,000 rpm for 1 min. Flow through was discarded and 750 µl PE buffer with ethanol was added into the column to wash the sample and the column was spun at 13,000 rpm for 1 min. The flow through was discarded and the column was spun at 13,000 rpm for another 1 min. The flow through was discarded and the column was placed in a new collection tube. For 2 of the 4 samples 30 µl of EB elution buffer pH 8.5 was added to the center of the QIAquick membrane to elute the sample and the columns were allowed to stand at room temperature for 5 min and then centrifuged at 13,000 for 1 min. The elution buffer from the first 2 samples was then used to elute the other 2 samples and the eluates were combined. The DNA was quantified and diluted so that 48 µl contains 20 µg DNA.

The DNA was fragmented by mixing 48 µl DNA (20 µg), 5 µl RE Buffer 4, and 2 µl 0.09 U/µl DNase in a total volume of 55 µl. The reaction was incubated at 37° C. for 30 min then 95° C. for 15 min and then held at 4° C.

Fragments were labeled using GeneChip DNA labeling reagent and TdT as described in the 100K manual.

Hybridization mix is 12 µl 1.22 M MES, 13 µl DMSO, 13 µl 50× Denharts, 3 µl 0.5M EDTA, 3 µl 10 mg/ml herring sperm DNA, 3 µl 10 nM oligo B2, 3 µl 1 mg/ml Human Cot-1, 3 µl 1% Tween-20, and 140 µl 5M TMACL. 70 µl labeled DNA was mixed with 190 µl hybridization mix. The mixture was incubated at 95° C. for 10 min, spun briefly and held at 47.5° C. 200 µl of the denatured mixture was hybridized to an array at 47.5° C. for 16 to 18 hours at 60 rpm. The sample was hybridized to either the XbaI array or the HindIII array. Each probe is present in a spatially addressable location.

Staining mix was 990 µl H$_2$0, 450 µl 20× SSPE, 15 µl Tween-20, 30 µl 50% Denharts. For the first stain mix 495 µl staining mix with 5 µl 1 mg/ml streptavidin (Pierce Scientific, Rockford, Ill.), for the second stain mix 495 µl staining mix with 5 µl 0.5 mg/ml biotinylated anti-streptavidin antibody (Vector Labs, Burlingame, Calif.) and for the third stain mix 495 µl staining mix with 5 µl 1 mg/ml streptavidin, R-phycoerythrin conjugate (Molecular Probes, Eugene, Oreg.). Wash and stain under standard conditions.

Hybridized samples were analyzed with a computer system to determine which alleles were present for a particular SNP.

CONCLUSION

The inventions herein provide a pool of unique nucleic acid sequences, which may be used to genotype a collection of Human SNPs. These sequences can be used for a variety of types of analyses.

The above description is illustrative and not restrictive. Many variations of the invention will become apparent to those of skill in the art upon review of this disclosure. The scope of the invention should, therefore, be determined not with reference to the above description, but instead be determined with reference to the appended claims along with their full scope of equivalents.

SEQUENCE LISTING (116251 sequences)

SEQ ID NO: 1 - DNA, 50 bp, homo sapien
taatttggaagacaacaagttcataytaccagtctgtctgtccccccagt

SEQ ID NO: 2 - DNA, 50 bp, homo sapien
aatatgtatctcaaagtttccctaakagatacctccagtgattgaattct

SEQ ID NO: 3 - DNA, 50 bp, homo sapien
cactttcaatggcttgcacaggctaygcgggaatgttccgtgacgtggtc

SEQ ID NO: 4 - DNA, 50 bp, homo sapien
atggtcacattacatgcttattcaamgtcagatatctcagattaacaagg

SEQ ID NO: 5 - DNA, 50 bp, homo sapien
ttagtgctcactaactgcaagactcracagcgtgtacaccagtagaagct

SEQ ID NO: 6 - DNA, 50 bp, homo sapien
gccttaaatttccaagtaggggctakacataatcagcagactggctcact

SEQ ID NO: 7 - DNA, 50 bp, homo sapien
tctcaccctccccttggggacctgamggcaaaactgggcatgttctcata

SEQ ID NO: 8 - DNA, 50 bp, homo sapien
agagtttcacaaattccaggcagaayggagctgtatgagtctcaaacaca

SEQ ID NO: 9 - DNA, 50 bp, homo sapien
ttatggttcaaaatcaaattccaatratagagaaacacaaataagcaatt

SEQ ID NO: 10 - DNA, 50 bp, homo sapien
tgtgcaagggcagatgtgggaagcaytctttctgacaggcggatgccaca

SEQ ID NO: 11 - DNA, 50 bp, homo sapien
agacttatcacactgactgtaaataygtaagttttctctctagactgtac

SEQ ID NO: 12 - DNA, 50 bp, homo sapien
cagttctcttgggtatgtatccttgragtagaactgctgagtcaaacaat

SEQ ID NO: 13 - DNA, 50 bp, homo sapien
agacactagaaatgacatctacaaasgcaaatatgtaattttaacatctg

SEQ ID NO: 14 - DNA, 50 bp, homo sapien
caatgagcacctactatgtggccgamgctcttctaaacgctttacattga

SEQ ID NO: 15 - DNA, 50 bp, homo sapien
cacagagggttaagagcctgttgtcygaagataaacccgctgtgctaaag

SEQ ID NO: 16 - DNA, 50 bp, homo sapien
catctctagttttctgtgagcttctraaaggtacttctgaaaaaatctgg

SEQ ID NO: 17 - DNA, 50 bp, homo sapien
tttctggctccgaggtaactgcatayataattttgttaccaaattcccat

SEQ ID NO: 18 - DNA, 50 bp, homo sapien
atccccggcttgatcagtatgtgtcraacaataacagtaagaactctggt

SEQ ID NO: 19 - DNA, 50 bp, homo sapien
ctccaatctcaagtggcttaaagtaraagtctatttctctcctgcctaaa

SEQ ID NO: 20 - DNA, 50 bp, homo sapien
tgctctgtgccaggcactatgctacraccttcaatactgcagtctcaaag

SEQ ID NO: 21 - DNA, 50 bp, homo sapien
aatgaggattgactgtgtgtttttaygcatcaagagaggcatcaaaaaga

SEQ ID NO: 22 - DNA, 50 bp, homo sapien
gccaccccctccaggtagacttccawgatcaccaagatgaggttggccct

SEQ ID NO: 23 - DNA, 50 bp, homo sapien
gggaaggattctttatctttgactasgagtgcttgatgaaacaccggggc

SEQ ID NO: 24 - DNA, 50 bp, homo sapien
cccttttcttatctgtggtaccaaartgatcaacccttctcaactgttgt

SEQ ID NO: 25 - DNA, 50 bp, homo sapien
tagtgaacgaaaagatgtgaagtaaygatatttttctgcttacaacttat

SEQ ID NO: 26 - DNA, 50 bp, homo sapien
gaattaatggtccttttcgaacaccrgcttgcctttacagtgaactgtga

SEQ ID NO: 27 - DNA, 50 bp, homo sapien
tgtgtatctctgccccagggaacacyagcgtccgtgtcagccccttgtcc

SEQ ID NO: 28 - DNA, 50 bp, homo sapien
caaaattggacaccaggtgtaaacayacttgcaactgcaggcactcgaga

SEQ ID NO: 29 - DNA, 50 bp, homo sapien
aattgcattttacttgtcgtggttcratctgattgtattgtcgaaggact

SEQ ID NO: 30 - DNA, 50 bp, homo sapien
aagttcaacagtagagcatgcattgrattaaccaaaaagtatgtccaggt

SEQ ID NO: 31 - DNA, 50 bp, homo sapien
ggtcaagactttatctttcttttcasataatgaggtggaatgactcttat

SEQ ID NO: 32 - DNA, 50 bp, homo sapien
atgaacaaagacaccagtattaggawcatgtgcatagagagttctgcatc

SEQ ID NO: 33 - DNA, 50 bp, homo sapien
gctactctgtactggcttccaagacwagtatggtagttgtaatttcattt

SEQ ID NO: 34 - DNA, 50 bp, homo sapien
cactggttcctggctaagaataagakaaatctgcttggaaacagagccac

SEQ ID NO: 35 - DNA, 50 bp, homo sapien
cctgtacaagatcccaagcatggtgrcaataggatgcttaagctgagaag

SEQ ID NO: 36 - DNA, 50 bp, homo sapien
ttggtggagacacagatccaatatckatacttaatgaaggatgcatgact

SEQ ID NO: 37 - DNA, 50 bp, homo sapien
gatggatggatagatgatagatagaygaatggatagcaatggaatgatgg

SEQ ID NO: 38 - DNA, 50 bp, homo sapien
accctctctgggaaaatgtaccctcyatggttgtagttgtgtcatttata

SEQ ID NO: 39 - DNA, 50 bp, homo sapien
caagctttccccattcccagtctcayctttttgttgactagtatttcagt

SEQ ID NO: 40 - DNA, 50 bp, homo sapien
ggcctaagggcctttatgcaaagtgracttggtctcctggggggtgccct

SEQ ID NO: 41 - DNA, 50 bp, homo sapien
gccatcaccgccgtcaccaaacaacmaccaaagtattattacaaaaatgt

SEQ ID NO: 42 - DNA, 50 bp, homo sapien
agcactgggtagaattccaaacaccraattatgtggtcaaaagtttctaa

SEQ ID NO: 43 - DNA, 50 bp, homo sapien
tgccttcagagtaagaatggggactmagataagaggacagatgacttgag

SEQ ID NO: 44 - DNA, 50 bp, homo sapien
ccacccaggatctgattgtttttcaygtaagacacagaaaggaggccggg

SEQ ID NO: 45 - DNA, 50 bp, homo sapien
tcaaccgtgaatttcagttatcaaaygaaaatgagcattgtgtggaatgt

SEQ ID NO: 46 - DNA, 50 bp, homo sapien
gatttgtgagacagcatgagtttgasgcaaatagcatcactgaattagtt

SEQ ID NO: 47 - DNA, 50 bp, homo sapien
ctcaaggtataatgtttaaactttcrctgactcactctaaagctcacata

SEQ ID NO: 48 - DNA, 50 bp, homo sapien
tgggtatgggttatccaactgagaawcaaagttagttcactcaaatttcc

SEQ ID NO: 49 - DNA, 50 bp, homo sapien
cataaagctgatcttcatcattcacraatttcttatttgcaaattgtcaa

SEQ ID NO: 50 - DNA, 50 bp, homo sapien
tgggggtaggaaagctgtccagtcartcttggtatactctcaacaaagaa

SEQ ID NO: 51 - DNA, 50 bp, homo sapien
gcaattgcctgggagtcaaagcatcygagaccaaattccaacagcaaggg

SEQ ID NO: 52 - DNA, 50 bp, homo sapien
gtgttctgcagacaagaatgttcccraaaggagtgttctgtaaccaccgt

SEQ ID NO: 53 - DNA, 50 bp, homo sapien
gtaggcttgaatggtgcgtttcttayattactgccacgacactaatccag

SEQ ID NO: 54 - DNA, 50 bp, homo sapien
tctgaagacatggccaactcttagawcctactgaaattttggtagataag

SEQ ID NO: 55 - DNA, 50 bp, homo sapien
agtaatgcagaatgagggtattgaayatctaagggctctttgcctcaggg

SEQ ID NO: 56 - DNA, 50 bp, homo sapien
gaggatcacaaacaaggaggaggcamgcctgaaacataagtaccaggagg

SEQ ID NO: 57 - DNA, 50 bp, homo sapien
cagccgaatatgggcactgagagggraatcgaagatgattgggatgtctg

SEQ ID NO: 58 - DNA, 50 bp, homo sapien
cccgagagccaccaggctaaagaaasagcagtagcttcaagcgtatgaat

SEQ ID NO: 59 - DNA, 50 bp, homo sapien
atgcccagtgaaatgtgaatttctartaaacaatgaatacggccaggtgc

SEQ ID NO: 60 - DNA, 50 bp, homo sapien
ttagtgaaccctcttcctccagttayatggatgctccagaattaaggctg

SEQ ID NO: 61 - DNA, 50 bp, homo sapien
tcattagacaaatcgctgaacaaaamtgacgggtgcaaaaacactttgca

SEQ ID NO: 62 - DNA, 50 bp, homo sapien
acatcggcccctgacctcgcagaaayactaaacaaatgagatgtaggtct

SEQ ID NO: 63 - DNA, 50 bp, homo sapien
tagctgagatctggggcacctgctastaagaagctcttgtttaagcagaa

SEQ ID NO: 64 - DNA, 50 bp, homo sapien
tatgtgtagatggcggggacttcaayggaaggtggtacagaaccctggcc

SEQ ID NO: 65 - DNA, 50 bp, homo sapien
attagaatgtggctgtccattccagsagagtttccatgttatatgtccag

SEQ ID NO: 66 - DNA, 50 bp, homo sapien
agactcagattaatacaccttaatartaagttgagaggttgtgttcagtc

SEQ ID NO: 67 - DNA, 50 bp, homo sapien
gacccagcaaaaggaagtaacacaaygggatctccacccaagtttcttaa

SEQ ID NO: 68 - DNA, 50 bp, homo sapien
gtatggcacatttttaaagtcacagsctattagtttacaggaacctgatc

SEQ ID NO: 69 - DNA, 50 bp, homo sapien
ttgaaggagaaggtgtctgcgggagycgatttcatcatcacgcagctttt

SEQ ID NO: 70 - DNA, 50 bp, homo sapien
ggcaggggacagtgctgaacacaatwatcttgggctgccttaagtccctc

SEQ ID NO: 71 - DNA, 50 bp, homo sapien
gcttgatgaaactgaaaatgtgacayctcttttttagcatagctgccacg

SEQ ID NO: 72 - DNA, 50 bp, homo sapien
aagagggtcatctacctgccttggaragcaacatgtactgctgaaaagaa

SEQ ID NO: 73 - DNA, 50 bp, homo sapien
agcatcagaagcctgtggtaatgtaycttaatgccatttttttttttttt

SEQ ID NO: 74 - DNA, 50 bp, homo sapien
aggcatctcaaacccaggatgttccraactggccgagggtttttgttttg

SEQ ID NO: 75 - DNA, 50 bp, homo sapien
cactggattgaaccatctcctccacraagtccatttcctcacacgaagtc

SEQ ID NO: 76 - DNA, 50 bp, homo sapien
aacatgagtccttagtaaatttaagwatcatgttggcttgcaggcttgta

SEQ ID NO: 77 - DNA, 50 bp, homo sapien
acatatctgaaataaattttcaccaygtgtaatacattatattcccttct

SEQ ID NO: 78 - DNA, 50 bp, homo sapien
ctgtttgtaattaacacaaatctcargatgaattgccaaatctgaaggga

SEQ ID NO: 79 - DNA, 50 bp, homo sapien
ccttggagagggagctgtgcatagargatcaatgagtcccataaatgacc

SEQ ID NO: 80 - DNA, 50 bp, homo sapien
gacatatctatgcaagtattttgcayctttttatttcggttgcctggctt

SEQ ID NO: 81 - DNA, 50 bp, homo sapien
catccttcaaagtcagcaaaaaaggycacctctaatggaacacagccctg

SEQ ID NO: 82 - DNA, 50 bp, homo sapien
tgaaaagaagcattcgttgtttgcaraagtttcgccagccagaacacaac

SEQ ID NO: 83 - DNA, 50 bp, homo sapien
gctagaagacacacgctgtatagacraccctgcctggacaggtgaggagg

SEQ ID NO: 84 - DNA, 50 bp, homo sapien
attgggctagtcttaatttagggaargtagctctggtgattgagaagaca

SEQ ID NO: 85 - DNA, 50 bp, homo sapien
ggtatcttaactctttcaggccttaygcgactgctaaatgtggcgtcata

SEQ ID NO: 86 - DNA, 50 bp, homo sapien
gggcagaacacatttcctctcatcartcttcttttccaggatttgtcagg

SEQ ID NO: 87 - DNA, 50 bp, homo sapien
gagtttgtgcctaaatgaccaacaarcaagactgaaccaaaggcacggag

SEQ ID NO: 88 - DNA, 50 bp, homo sapien
atgataaagagaccacatcatcggcratatactgaagtctacttagaata

SEQ ID NO: 89 - DNA, 50 bp, homo sapien
tttggtctgtgaaatgtgcagaatayggaacaaattatttgtatgtgtgt

SEQ ID NO: 90 - DNA, 50 bp, homo sapien
ggggaggcgattctctctaggataaracaagacacaatgaaatatggaat

SEQ ID NO: 91 - DNA, 50 bp, homo sapien
ggactgaaacccttattgaccctgasgtttttcaagttaagtacacacgt

SEQ ID NO: 92 - DNA, 50 bp, homo sapien
catgcgataacagactactatgaacrggtttttgccaatacatttgaaaa

SEQ ID NO: 93 - DNA, 50 bp, homo sapien
gcaaggtgatccatgcttgcaaccasgacaaaacaagcatgcagtaggca

SEQ ID NO: 94 - DNA, 50 bp, homo sapien
caggcgcgccgccgggttgagtctcscgaacaaaatgaggccagagtgcc

SEQ ID NO: 95 - DNA, 50 bp, homo sapien
agggtccttgtgagagaatgacatgratctcttgaatttgggaggggaaa

SEQ ID NO: 96 - DNA, 50 bp, homo sapien
cacactcagcctctgcacagagacaytcatcagcagaggccataactcaa

SEQ ID NO: 97 - DNA, 50 bp, homo sapien
agtcttgggggccagtgtgacagatkaggatggtatttttcttctgctga

SEQ ID NO: 98 - DNA, 50 bp, homo sapien
gatctgtcaatatcacaatccagcartatcagatgctgtttggctctgat

SEQ ID NO: 99 - DNA, 50 bp, homo sapien
tggggagatttggtcttcatctggaygcatcattgaggaggttgagccaa

SEQ ID NO: 100 - DNA, 50 bp, homo sapien
gctcacaaggaaactagggagagggyaaccttgcagagtcttgggggcca

SEQ ID NO: 101 - DNA, 50 bp, homo sapien
tgtcagttttgtttcattgtactgasaaccttagctggcatcatggacct

SEQ ID NO: 102 - DNA, 50 bp, homo sapien
ctggtctcctctaagttttgatgcaygtggggtttaggcacctgggatga

SEQ ID NO: 103 - DNA, 50 bp, homo sapien
tatagcaacacaaaaatggactgacrcgcatctcaattgcagagtgtaaa

SEQ ID NO: 104 - DNA, 50 bp, homo sapien
tcatcactgctcctgcaggtggcackcggctcaatggctagcagcggcca

SEQ ID NO: 105 - DNA, 50 bp, homo sapien
aacagcaaagcactgtgtatatgtayctattgttacctaagaataaagca

SEQ ID NO: 106 - DNA, 50 bp, homo sapien
cttgatctctacaaaggaattttacyacagtgattaaagttcgagatgca

SEQ ID NO: 107 - DNA, 50 bp, homo sapien
caggcttctgcctctgctgcatcagsataagcatctcccaagcagtgagg

SEQ ID NO: 108 - DNA, 50 bp, homo sapien
gtgggtgtgtggttaatgcttcttamctgcaagaatgagatgctagcatc

SEQ ID NO: 109 - DNA, 50 bp, homo sapien
atccagtgctcatccagtgagtagtraatatggaggaacctgaaagctaa

SEQ ID NO: 110 - DNA, 50 bp, homo sapien
agcgactgcctgtccacccatccaastaagaaagactgactcaccgatga

SEQ ID NO: 111 - DNA, 50 bp, homo sapien
tttctaacttaaaagcacagtagtcrataaacatactctataatttgggt

SEQ ID NO: 112 - DNA, 50 bp, homo sapien
ctctttggtcaagaaagctccagcckaaatagctaattcccctgggtcct

SEQ ID NO: 113 - DNA, 50 bp, homo sapien
ggaaatggatattgtcagcatacatyaagtgtccacaacagccattttct

SEQ ID NO: 114 - DNA, 50 bp, homo sapien
gattttaagaatcacatctgaagcayaaaggatgagacgtaagaccataa

SEQ ID NO: 115 - DNA, 50 bp, homo sapien
acttgtctgagacctgtctcagacaytatttggtttacaacggcatggca

SEQ ID NO: 116 - DNA, 50 bp, homo sapien
actgtggagttggcagtgtttaagayagatgcattccctgccctctacgt

SEQ ID NO: 117 - DNA, 50 bp, homo sapien
gcgtccaacttaggaacttccaggaraggatggaaaacacgtcatccaac

SEQ ID NO: 118 - DNA, 50 bp, homo sapien
aaaaacgcacatccaacaaactactyacgccgagcaactgacaaaaccca

SEQ ID NO: 119 - DNA, 50 bp, homo sapien
acatacacttttattactttttttamatgctcacttccaacagtgactca

SEQ ID NO: 120 - DNA, 50 bp, homo sapien
gcagtacaaatttataagttaaaaaygcacatccaacaaactactcacgc

SEQ ID NO: 121 - DNA, 50 bp, homo sapien
tcacttacataatcacttacaaccayctagatattaagaagattgtactt

SEQ ID NO: 122 - DNA, 50 bp, homo sapien
atacaacatacctgggagctatcatsaagagtgaggtgggcctgtcctat

SEQ ID NO: 123 - DNA, 50 bp, homo sapien
cacaaaaagttatgacaatatacaarggaaagacaatttctttgaatatc

SEQ ID NO: 124 - DNA, 50 bp, homo sapien
ctcattgatttgttaattttttgagmagaagtgattcgtagttggataag

SEQ ID NO: 125 - DNA, 32 bp, homo sapien
agtcattaatattatayaccaaatatctctgg

SEQ ID NO: 126 - DNA, 50 bp, homo sapien
tccgtttttccaattccctttacaawtaactcactctctaagcttcagtt

SEQ ID NO: 127 - DNA, 50 bp, homo sapien
gacagcacctgggacaggtgacctcrgaagaataagcctgggggagagca

SEQ ID NO: 128 - DNA, 50 bp, homo sapien
atccacttatttatttgttcagtaakgtttgttgggcacctcctatatgc

SEQ ID NO: 129 - DNA, 50 bp, homo sapien
gggaagctcctgtactcaaggtcgaygtttcttgccttaagcttcaagag

SEQ ID NO: 130 - DNA, 50 bp, homo sapien
agctatccttccagcatttcattcartctcacacaactaaagccgaaacc

SEQ ID NO: 131 - DNA, 50 bp, homo sapien
gttgtgtacaaattattcagtttaargtatttgttccaggagcccaaaca

SEQ ID NO: 132 - DNA, 50 bp, homo sapien
ctgtgaacttcagggtgaaatccccrattcggtcctggtactcacatgca

SEQ ID NO: 133 - DNA, 50 bp, homo sapien
tagactggaagtggaatagaagtgtsaaggatactgtcttagtttgctgg

SEQ ID NO: 134 - DNA, 50 bp, homo sapien
gatgaatcagatcaataagcggagcrgatatttatttccacgtcagactt

SEQ ID NO: 135 - DNA, 50 bp, homo sapien
tttggggaatttctgaatcatttggragagcgtgcagtgttacatggtgg

SEQ ID NO: 136 - DNA, 50 bp, homo sapien
ctggctgggagtaatgcataggtcartaagtttcatgtatcataatagcg

SEQ ID NO: 137 - DNA, 50 bp, homo sapien
ccaccagagcattgacagtagcttcratatgagttagtcctaaaggagag

SEQ ID NO: 138 - DNA, 50 bp, homo sapien
aaaagttaatcacaagaagagaaacrgactagaattgagatttaaggata

SEQ ID NO: 139 - DNA, 50 bp, homo sapien
tccactcccttctttacttggcaaamtcctatgcatccttcaagacccag

SEQ ID NO: 140 - DNA, 50 bp, homo sapien
ccagcaaggcagatggcaacgtttckagttgaagaggacatctgggcatc

SEQ ID NO: 141 - DNA, 50 bp, homo sapien
aagcacctcaagcctgagcagcctgyagatggggtaagtgctgtggatct

SEQ ID NO: 142 - DNA, 50 bp, homo sapien
caaggctaggagtggtatttctcaayaggtttgttaccaagagcccctct

SEQ ID NO: 143 - DNA, 50 bp, homo sapien
ctttcctttcttcctttctattgtgmaaataccacccaatgattctgttt

SEQ ID NO: 144 - DNA, 50 bp, homo sapien
tgcaaccttgtcaacagcttgtatarggaaaccctaacctccccactttg

SEQ ID NO: 145 - DNA, 50 bp, homo sapien
accctcttcccaatacccaccttgayctttggagactttacctgggaagg

SEQ ID NO: 146 - DNA, 50 bp, homo sapien
ttctgcatgaagggatcagtctacamacagaaactttggctgcctggtct

SEQ ID NO: 147 - DNA, 50 bp, homo sapien
atggggctcatgaagagagaatgatrataagcctcatgaatgaagaatgg

SEQ ID NO: 148 - DNA, 50 bp, homo sapien
ggaaagtgacagcttttaaccatggrcacatatcactttaataaattgtc

SEQ ID NO: 149 - DNA, 50 bp, homo sapien
taaacatttttgcttcacttcctcaratagagttttacattcataattat

SEQ ID NO: 150 - DNA, 50 bp, homo sapien
tatattttaatttttggtatggagaytataacagcccactgataatattc

SEQ ID NO: 151 - DNA, 50 bp, homo sapien
aagctgtgagtttaaaatgcctcatkaaaagtgcatgagcatgcgtttat

SEQ ID NO: 152 - DNA, 50 bp, homo sapien
tatgaatgagccagaagtgatttgcygagtaggaagtgcattaagaaatg

SEQ ID NO: 153 - DNA, 50 bp, homo sapien
attttctgtgaactttctgaagacakattttgctgaaaaagaaatgtccc

SEQ ID NO: 154 - DNA, 50 bp, homo sapien
tctcaaagcctctttgcaaacaacaytggaacactgagtatcccaattta

SEQ ID NO: 155 - DNA, 50 bp, homo sapien
ctaagatttgctgctgctcaaaaaaycttcaaaggctcctaaataaaacc

SEQ ID NO: 156 - DNA, 50 bp, homo sapien
tccaactttggccttactcatcacaytgtaatatggtttggctacgtgtc

SEQ ID NO: 157 - DNA, 50 bp, homo sapien
tcataggtctgtgatttgagggagartaaaaggtcagcccttttgcaaac

SEQ ID NO: 158 - DNA, 50 bp, homo sapien
tttctctctttcattcaaagtggcaragatcccctagtcaaccctcagcc

SEQ ID NO: 159 - DNA, 32 bp, homo sapien
tggcaaggcatacaaaygaatttcccaattat

SEQ ID NO: 160 - DNA, 50 bp, homo sapien
ggctgttctcggtgctctcggcctcrctctcactgttgctgccctcggtg

SEQ ID NO: 161 - DNA, 50 bp, homo sapien
aaatacaagtttataaataactaaamtatcaggtcaagcacattgcagga

SEQ ID NO: 162 - DNA, 50 bp, homo sapien
caagtggtattcctatttgggagaaraataattgttcaataaatgtgttg

SEQ ID NO: 163 - DNA, 50 bp, homo sapien
taactattaaacgaacatgaaagacscagagagcaaacatcagtatttga

SEQ ID NO: 164 - DNA, 50 bp, homo sapien
aatcattagcagaaatcattagctaraatacagcctcccccataaatctc

SEQ ID NO: 165 - DNA, 50 bp, homo sapien
tggatggagatggtgcgatgggggasctattgagaaacgagcctgggctc

SEQ ID NO: 166 - DNA, 50 bp, homo sapien
gacaggagagcaagggcagaagttayggtagatagctcagctttacaacc

SEQ ID NO: 167 - DNA, 50 bp, homo sapien
gaaagagcttttgaaagttaaaaggycacatgtgttgttctgactccaga

SEQ ID NO: 168 - DNA, 50 bp, homo sapien
ctcttggccagcctgtgggatgtgawacagtagaaatgtttctggtgccc

SEQ ID NO: 169 - DNA, 50 bp, homo sapien
tcttgtgtgagttcacaggccgagtmaaacaaaactgcagcgccgcccag

SEQ ID NO: 170 - DNA, 50 bp, homo sapien
cggcccctctccatgttgggagagaygtagatgtccacgccaggcgtccc

SEQ ID NO: 171 - DNA, 50 bp, homo sapien
caacatgattctcttacatctcaaarcagcttttttatgaaaagggaaat

SEQ ID NO: 172 - DNA, 50 bp, homo sapien
tcacatacgctggccacagaacttcrattattcaggtttggatatccagc

SEQ ID NO: 173 - DNA, 50 bp, homo sapien
agcctccaggagatggagataataaraggaacttgctaccacatgggaca

SEQ ID NO: 174 - DNA, 50 bp, homo sapien
gttttatgtcaatccctttaataagmacattgggtgaatttaaaattggg

SEQ ID NO: 175 - DNA, 50 bp, homo sapien
acaatttacttccttagcttctgtckaaagattaggccacataaaaacca

SEQ ID NO: 176 - DNA, 50 bp, homo sapien
ctgtctgcatggagttctgaggtcaygtcaaacttgcgcaaaatactctg

SEQ ID NO: 177 - DNA, 50 bp, homo sapien
gcgaggatgcagggtataactatttmaaagcgatctgattcattcaccgc

SEQ ID NO: 178 - DNA, 50 bp, homo sapien
aataagcaaagggtctggaacagtamctggcacacgatagtcatctctta

SEQ ID NO: 179 - DNA, 50 bp, homo sapien
tgactaaaaatggaatgatctgccamctttggattatttgcgttcgtaat

SEQ ID NO: 180 - DNA, 50 bp, homo sapien
tgttttagacatcacacacttagtayatgaacaagaggaaatgcgaggat

SEQ ID NO: 181 - DNA, 50 bp, homo sapien
ctggttcagggaaatcttcaaagacrgtcataacagcaggcagttcagct

SEQ ID NO: 182 - DNA, 50 bp, homo sapien
gggcaactgtcagacaatttgattcraattccctgcaagtcagttcaact

SEQ ID NO: 183 - DNA, 50 bp, homo sapien
tagtgttccctccccagcaccacggsaattgtatccatctaatggcattg

SEQ ID NO: 184 - DNA, 50 bp, homo sapien
gcaaatgttatctgttagctaaaagkcctgctgagcatggacctcaccag

SEQ ID NO: 185 - DNA, 50 bp, homo sapien
aatgagaggaggtaggtatatccagragaattcctttatatccagttgac

SEQ ID NO: 186 - DNA, 50 bp, homo sapien
ttcaaagcttgtggtgctgaagccaygctctttaagaaggaagagagtgc

SEQ ID NO: 187 - DNA, 50 bp, homo sapien
acgtacaaaatgctacaggtcataamagtcgtctgatagcccagccttgc

SEQ ID NO: 188 - DNA, 50 bp, homo sapien
cagcttggctgcctactccacgttayacaaatacacctcctctgtgcggc

SEQ ID NO: 189 - DNA, 50 bp, homo sapien
aaacttagcaatgttgctacataagyataaggtacacgttaaaatgtaaa

SEQ ID NO: 190 - DNA, 50 bp, homo sapien
aagaaactataacattaacatcaaartatatcaaataacaaggaataaat

SEQ ID NO: 191 - DNA, 50 bp, homo sapien
taaatctaacaaaaagcccttaagascactctacagaaatctatgagacg

SEQ ID NO: 192 - DNA, 50 bp, homo sapien
acacttggcaagtaggacggtgacgracaatggttttagcttgtttccat

SEQ ID NO: 193 - DNA, 50 bp, homo sapien
cctaagaaccactaaattatgtgaaytaagggcttggttcatagtaggtg

SEQ ID NO: 194 - DNA, 50 bp, homo sapien
cctttctctgatgcatttggatctcratttaaggaacagctgccctgact

SEQ ID NO: 195 - DNA, 50 bp, homo sapien
aggcatcttacaaggagctgctcgamgctcttttcattttccatacaacc

SEQ ID NO: 196 - DNA, 50 bp, homo sapien
gctgcatcctgtccgtgttaccgackggttaagtgttgtgctctgtgact

SEQ ID NO: 197 - DNA, 50 bp, homo sapien
ccagcttcaatgctttgatgagagarctgaaatccctaagcttttatgat

SEQ ID NO: 198 - DNA, 50 bp, homo sapien
gggacagcttgatgctgtccatcacyaactggaatcccagctggaaaaaa

SEQ ID NO: 199 - DNA, 50 bp, homo sapien
gaacagcacctggtccttagaagcaycacgcgactgttcagtgttattat

SEQ ID NO: 200 - DNA, 50 bp, homo sapien
gcagggaaggatttgatctgttcccracattagacagaaaaataaaatct

SEQ ID NO: 201 - DNA, 50 bp, homo sapien
atccttgacaagaagttgcctttacraagaaaagtcgtgagacatacaaa

SEQ ID NO: 202 - DNA, 50 bp, homo sapien
taaaatttatttctgagcacttaaaytgtgttgcatacccctaatttttt

SEQ ID NO: 203 - DNA, 50 bp, homo sapien
tctttgctgagctacagttctctgaygtggtaaccgccttggtcctcttt

SEQ ID NO: 204 - DNA, 50 bp, homo sapien
caccaccacaggttcatttaagacaragaagagttccaccttgcagatac

SEQ ID NO: 205 - DNA, 50 bp, homo sapien
gattctaagaaggagccagggccgaraaccactattttagagaataaatg

SEQ ID NO: 206 - DNA, 50 bp, homo sapien
tcccaggagctacctgcaaccatcayacaattcagttttcagacctctca

SEQ ID NO: 207 - DNA, 50 bp, homo sapien
ctgcttatctcagggaagccaaagaygactttacgaaagaggagattcag

SEQ ID NO: 208 - DNA, 50 bp, homo sapien
ttcctcttactgattttatgatgatmagataagaggatgtttatgaaatg

SEQ ID NO: 209 - DNA, 50 bp, homo sapien
ctgaactggactgtctaggacaagaygatcacctcctttactcatggtat

SEQ ID NO: 210 - DNA, 50 bp, homo sapien
gtcgtgaaaatgtggaccagaacacrgtatatactcagtaagcgtctgct

SEQ ID NO: 211 - DNA, 50 bp, homo sapien
aaagtatgttatgatttatgaatacratgtggaattagtaaatcaaacta

SEQ ID NO: 212 - DNA, 50 bp, homo sapien
tcactgtgcaacctcagggacattckccatcctctctgatcttgctccct

SEQ ID NO: 213 - DNA, 50 bp, homo sapien
accttgaggtactctgggctacaaargatattgcctttcagggtacttat

SEQ ID NO: 214 - DNA, 50 bp, homo sapien
ttcctcatatgtgagctctgaggacsgtaagcacacatgacaaagctcag

SEQ ID NO: 215 - DNA, 50 bp, homo sapien
aaaaaataacttatcatattacccartcggggtgtacaaacaacctcaga

SEQ ID NO: 216 - DNA, 50 bp, homo sapien
gtggaagaatgccctctctgttgtcyatgcgagagcagtgcagttcagga

SEQ ID NO: 217 - DNA, 50 bp, homo sapien
agggcacataatcaggcactccagaraagaaaaatggccacgattaccag

SEQ ID NO: 218 - DNA, 50 bp, homo sapien
atttattttattgaaataaaatgcaygtagagaaaaatgtgtgtatcata

SEQ ID NO: 219 - DNA, 50 bp, homo sapien
aacctgtggggagatgggtggtaaaygtaaagtatggagcacgtctgtgg

SEQ ID NO: 220 - DNA, 50 bp, homo sapien
agtgagatctccaggctttttcaaakagtcaaacaatttatactcaaact

SEQ ID NO: 221 - DNA, 50 bp, homo sapien
atgtgaacaataagtttaactacacygtaactgtaaactatttcaataca

SEQ ID NO: 222 - DNA, 50 bp, homo sapien
ttactcccttgggaagagggtaggartatgcccagatgtttttgtgttgt

SEQ ID NO: 223 - DNA, 50 bp, homo sapien
aaattcaaagcttgccagcaaacaaygtggaactgcaggaattgggaggg

SEQ ID NO: 224 - DNA, 50 bp, homo sapien
tatctgcaagaattatgataaataamacaatgtttataatataaaccaaa

SEQ ID NO: 225 - DNA, 50 bp, homo sapien
agctgggatttgagcccaggcactcygaatcaagaacacatattctcaat

SEQ ID NO: 226 - DNA, 50 bp, homo sapien
gctggatacactctgtaatttattcyacttatgtgtttgttatttcaact

SEQ ID NO: 227 - DNA, 50 bp, homo sapien
acattggagagtatgaccttcttggragccagtttacattatggcagtca

SEQ ID NO: 228 - DNA, 50 bp, homo sapien
agtttatgggaatagacgatgtcaaygtactctacttatgatcccataat

SEQ ID NO: 229 - DNA, 50 bp, homo sapien
gcacctctttgtcccttcaaaagacmaggcctgtgccctgggggagggaa

SEQ ID NO: 230 - DNA, 50 bp, homo sapien
ctcatgctggtatctcattaagccaratccttgcaaagtaaaagattttc

SEQ ID NO: 231 - DNA, 50 bp, homo sapien
tgtattcccaggtattagggatataycagtaaataaagcaaagtcctttc

SEQ ID NO: 232 - DNA, 50 bp, homo sapien
gggtacctatttgccataggttttaygtcaatatctcatttaatttaatc

SEQ ID NO: 233 - DNA, 50 bp, homo sapien
gaagacaattcaaaaccacaagggaragggagtctgaaatttgaagtatg

SEQ ID NO: 234 - DNA, 50 bp, homo sapien
tgaaaaacaacttagacaaccgttarcattgtgatccatacgtcagaggt

SEQ ID NO: 235 - DNA, 50 bp, homo sapien
aaccagggttgaagcaggttgtaaartgttgaaatctgctgagctccgga

SEQ ID NO: 236 - DNA, 50 bp, homo sapien
atcactttcatgctattgtcatactragtataggaagctcctatgcctct

SEQ ID NO: 237 - DNA, 50 bp, homo sapien
acatctcttccctcagtaactaccayggcccaagttctgagagagaaaat

SEQ ID NO: 238 - DNA, 50 bp, homo sapien
cagttttctttgttgtttaaaaactyagtcttctgtgtctatctatcttt

SEQ ID NO: 239 - DNA, 50 bp, homo sapien
aaaaaaaagttcctttgaccctcaaycttgcttaagtcattaaagggtaa

SEQ ID NO: 240 - DNA, 50 bp, homo sapien
acaggacatttcaagacctgtgtaargacaatagactactgatatgaaca

SEQ ID NO: 241 - DNA, 50 bp, homo sapien
ttgctttcggagacttatttctaagragagctttcagggtgactttagac

SEQ ID NO: 242 - DNA, 50 bp, homo sapien
actacacgctcggttctgttctaaaygctagggatgcaaaagacagcaaa

SEQ ID NO: 243 - DNA, 50 bp, homo sapien
cccccaacacaccccaatcgtatackctttgtaaaatacaacagaacatc

SEQ ID NO: 244 - DNA, 50 bp, homo sapien
tagtgtcatgcatctctctgtccgamaaccaaaacttcttctttcactgt

SEQ ID NO: 245 - DNA, 50 bp, homo sapien
tggatatacttccttaattcttagawgagtggtagtaatgttggtagcct

SEQ ID NO: 246 - DNA, 50 bp, homo sapien
gagattcatcagtatttcatccttaygtcgcttaaaaaatgttattttta

SEQ ID NO: 247 - DNA, 50 bp, homo sapien
tgagtccaacgtttgggggccaaaakaaaatagagaacaaccaaaggatg

SEQ ID NO: 248 - DNA, 50 bp, homo sapien
gcaagtttctaggggatctcattgcmcagtaaaataggcgacccagtgcc

SEQ ID NO: 249 - DNA, 50 bp, homo sapien
ttaagtaaatacattagttctctgamaagtcattgcaggaaaatgcctac

SEQ ID NO: 250 - DNA, 50 bp, homo sapien
ttccctagtagacttgcatggtacayataagagctgctatttcctgagtg

SEQ ID NO: 251 - DNA, 50 bp, homo sapien
acagagagaagagagtccaggcagargtaatagcaagaccatgtgtgtca

SEQ ID NO: 252 - DNA, 50 bp, homo sapien
gaactctgcctatgcttgctaaatayagatcgaattaatggtttactaaa

SEQ ID NO: 253 - DNA, 50 bp, homo sapien
ttatgatcgctttgtattcactgacrcagaatggcatggatggttaagag

SEQ ID NO: 254 - DNA, 50 bp, homo sapien
gattgacgagctaagtctcttctgtraaagtcaaagccccttgcataaat

SEQ ID NO: 255 - DNA, 50 bp, homo sapien
aaattatgtacactatgtataacacmgtccttggctggcagtggctcatg

SEQ ID NO: 256 - DNA, 50 bp, homo sapien
ttcaaggacagaggcctccagcaggkactaagaagggtcagaggttctgg

SEQ ID NO: 257 - DNA, 50 bp, homo sapien
tatttacagttaaactctctagtgamatttataataacacagtcctttaa

SEQ ID NO: 258 - DNA, 50 bp, homo sapien
gctgcttggcattctgtaaacacacyataactatgcatactgccatgctg

SEQ ID NO: 259 - DNA, 50 bp, homo sapien
acttccttcaatgtactctggacacycgtttgattccaaagttaagccaa

SEQ ID NO: 260 - DNA, 50 bp, homo sapien
cccgacctcctcctgcacgtcctgasaagctccctgagctccctgctcag

SEQ ID NO: 261 - DNA, 50 bp, homo sapien
aatccgtgtctttatctttttttccyacgtggtagatatgatcccattgg

SEQ ID NO: 262 - DNA, 50 bp, homo sapien
gatctcatgttgctcatgttttgtcmcaagcattcaaatatatttcaaag

SEQ ID NO: 263 - DNA, 50 bp, homo sapien
tagggccttttactttcttttgatargatccttgctactacccagtggaa

SEQ ID NO: 264 - DNA, 50 bp, homo sapien
ataaaacacgagttaatcatattgtkaatacggtagtgggaggcagtttg

SEQ ID NO: 265 - DNA, 50 bp, homo sapien
tttttgtcccagagcatgaaggtccraaaataacaatacagtaattacct

SEQ ID NO: 266 - DNA, 50 bp, homo sapien
agggttgttaattttatgcatgtacwctgctaatcaatagctccatcagg

SEQ ID NO: 267 - DNA, 50 bp, homo sapien
gtacacaagaaacctacaatgcttarctatttcagtcttgtcttcctaag

SEQ ID NO: 268 - DNA, 50 bp, homo sapien
gagattcaaacccaagcaaatcccaygtgactctcaaactggttctggga

SEQ ID NO: 269 - DNA, 50 bp, homo sapien
ctctgccagctcagtttctcagtacracagagggcctagtggcaaacaca

SEQ ID NO: 270 - DNA, 50 bp, homo sapien
gctggtgggatgcagaaagaaaccargaacagagattttctcaggccact

SEQ ID NO: 271 - DNA, 50 bp, homo sapien
ctcatgttcttgctgggatgtagacrgtaaacaagaggccaattactggt

SEQ ID NO: 272 - DNA, 50 bp, homo sapien
ccaaggcagagttagtcattcgcackagtattctaaatgaagttttgatt

SEQ ID NO: 273 - DNA, 50 bp, homo sapien
ttctgcagcccgggaggatactgtaygaagtctttcctagggtcgtgcct

SEQ ID NO: 274 - DNA, 50 bp, homo sapien
ggaccctatgtccagaagatctgaartgctataatgccagagccttccag

SEQ ID NO: 275 - DNA, 50 bp, homo sapien
caaggactaggactcagggtaaagayaagctgccctgaaataaacaagtt

SEQ ID NO: 276 - DNA, 50 bp, homo sapien
tccagtcccaactacttccactgagkattcccactgtaggaacgttctgt

SEQ ID NO: 277 - DNA, 50 bp, homo sapien
ttacagtatgagccactggccctgakgtttatacagtctcccattcccta

SEQ ID NO: 278 - DNA, 50 bp, homo sapien
taaaaagacacattccgccatcctgragtatacaaaggtagactagcata

SEQ ID NO: 279 - DNA, 50 bp, homo sapien
atgatgaagtaactcaggaagaatayatagagtggttacttggatggagg

SEQ ID NO: 280 - DNA, 50 bp, homo sapien
gccttgaaggatgtgcaggagttcamtaggtaaagagcaggggaaaggac

SEQ ID NO: 281 - DNA, 50 bp, homo sapien
atgggcaaaagctttgttttatctawgtttatcttggctctttctagaag

SEQ ID NO: 282 - DNA, 50 bp, homo sapien
tgtcaggcattatatcaagcacatgsatacgttataatgattccttaaaa

SEQ ID NO: 283 - DNA, 50 bp, homo sapien
tatggtggcctcagttttgtcatatsaacatttatgagacataggccctc

SEQ ID NO: 284 - DNA, 50 bp, homo sapien
ttctgtacaatttcaaactgctgacraatttctgcagctcaaaacttttt

SEQ ID NO: 285 - DNA, 50 bp, homo sapien
ttttaccttgttgtctaatgaaaackagaatgtgctaaatatgaaacttt

SEQ ID NO: 286 - DNA, 50 bp, homo sapien
agacttagaggccaataccaaatatragagatatgcagctttgaaaagag

SEQ ID NO: 287 - DNA, 50 bp, homo sapien
gtgctgcagatttttttaaagcaaasctcagaataaggcttcccctgtga

SEQ ID NO: 288 - DNA, 50 bp, homo sapien
atcaagaggaggcaaagaatgaataygcagaactcactctcttccttccc

SEQ ID NO: 289 - DNA, 50 bp, homo sapien
taaagtcaggttttggaagatgtaasagacctatggatgtggaggagctg

SEQ ID NO: 290 - DNA, 50 bp, homo sapien
tccctgtatagagcagcagcatagawggattgtagtgctgttgactgaga

SEQ ID NO: 291 - DNA, 50 bp, homo sapien
gagtcccccaaaaaaagtaagagaasaagctgtgtggatatctgaggaaa

SEQ ID NO: 292 - DNA, 50 bp, homo sapien
aaatttgaggtgacatttgggccatwagcaaaacattttcagttcaccag

SEQ ID NO: 293 - DNA, 50 bp, homo sapien
cacatagaccagacatagtggatccrgaacttgaacccaggacattggac

SEQ ID NO: 294 - DNA, 50 bp, homo sapien
gtgtgctcacattagacattaaatgmcaacgtgaaaagtaaagtttcata

SEQ ID NO: 295 - DNA, 50 bp, homo sapien
aacagctctcgtcacagtgagttgartagatcgtaaaggggaaaagtata

SEQ ID NO: 296 - DNA, 50 bp, homo sapien
ataacaaaggcactctcatgataatratctaatcagctcttattaggccc

SEQ ID NO: 297 - DNA, 50 bp, homo sapien
gtgcttggaacataactctagcacaytgaagtattaaagggcttaaaaag

SEQ ID NO: 298 - DNA, 50 bp, homo sapien
aattaccaaggaagttttccattccrcctagtaagagagagagaaaatga

SEQ ID NO: 299 - DNA, 50 bp, homo sapien
gcttcccatttagagggaaagacagmaaacagtggcattaagcatgtgtt

SEQ ID NO: 300 - DNA, 50 bp, homo sapien
ttgcatagatttaaaattctaaataytatcagattaacacactggacatg

SEQ ID NO: 301 - DNA, 50 bp, homo sapien
tatatagcttaaaaactaacagacayctaggctgagatttgtccaataca

SEQ ID NO: 302 - DNA, 50 bp, homo sapien
atttactgatgtttagattataagcmcagggatcctcctatctccccagc

SEQ ID NO: 303 - DNA, 50 bp, homo sapien
taccagcctcatcagcagtcacaaayctttaatctggatccagcctctcc

SEQ ID NO: 304 - DNA, 50 bp, homo sapien
attatcatcccattttacagatgaarttactgaggcacacaaagttacac

SEQ ID NO: 305 - DNA, 50 bp, homo sapien
tatcatcaagcactagtctaaacacygctaggaaggtactctttagataa

SEQ ID NO: 306 - DNA, 50 bp, homo sapien
cacgtgtgaaagcgtgcagcatacargccagtgtgtagttgaaaattgca

SEQ ID NO: 307 - DNA, 50 bp, homo sapien
aggggccggtgcaggtttttgatgcrgagcaatgagatagttgctctgtg

SEQ ID NO: 308 - DNA, 50 bp, homo sapien
ctcacgtctgctctgctcttccaccrccagaggttttgtagcaacagccc

SEQ ID NO: 309 - DNA, 50 bp, homo sapien
catactgtcccttcctattaagcaayatttgttggatgaatgagtgaaat

SEQ ID NO: 310 - DNA, 50 bp, homo sapien
taccaatcagcagatatctgaaaaasaaaaatttacagaagttttgcctc

SEQ ID NO: 311 - DNA, 50 bp, homo sapien
gtagaactaattaatgtaaaaaaaayagaccatctcgtgttgtgtgcact

SEQ ID NO: 312 - DNA, 50 bp, homo sapien
caaatgacagtgctttagataccaayaggacatttgtttgcaagtcaagc

SEQ ID NO: 313 - DNA, 50 bp, homo sapien
tttgtttcagaccaattgacaactayccgtgaacataactaaatttaaac

SEQ ID NO: 314 - DNA, 50 bp, homo sapien
gagatttaaaaagtaacctgggacckgataagctagaattccaactttga

SEQ ID NO: 315 - DNA, 50 bp, homo sapien
gaaccaggcacacagaagtttcccartgacagtttgatgactgagtgaat

SEQ ID NO: 316 - DNA, 50 bp, homo sapien
agttcttgtcaccagtgattgcaaargttctgggataggaggaagtcatt

SEQ ID NO: 317 - DNA, 50 bp, homo sapien
tagggaggcaataacatttgagtgargtcctgggtacctacaaataagag

SEQ ID NO: 318 - DNA, 50 bp, homo sapien
gcgcgcgcatgcgtgcatgtatgtcmaacactctttccaggtgcatggtg

SEQ ID NO: 319 - DNA, 50 bp, homo sapien
gaagccaggtagaattaactaaatakacaaattcaaaatgacaggtacag

SEQ ID NO: 320 - DNA, 50 bp, homo sapien
aaaacaacgaataatattaatgacaratatcaaggccatactatcacaga

SEQ ID NO: 321 - DNA, 50 bp, homo sapien
ttagaaaaaaatactctattagtcaygtggaggatggtggcaagactaag

SEQ ID NO: 322 - DNA, 50 bp, homo sapien
cttggggaaactgacagtatccaagsagacgaaggctgtgattctctcct

SEQ ID NO: 323 - DNA, 50 bp, homo sapien
cgagccatttgtaagctctgggtaayactctctctcaggcatgctccctt

SEQ ID NO: 324 - DNA, 50 bp, homo sapien
ccgttttgctcttgctggtctttacraatctcaagggggtggccatttgt

SEQ ID NO: 325 - DNA, 50 bp, homo sapien
cctggcccatatccattatttgaaastattaacaactcctgattaaaaga

SEQ ID NO: 326 - DNA, 50 bp, homo sapien
cgggatgatgatcccacgttggagtyaaggattacccagctcagttcccc

SEQ ID NO: 327 - DNA, 50 bp, homo sapien
ttcccccaggtttagagtatagacayatttagacaagtcccataacttga

SEQ ID NO: 328 - DNA, 50 bp, homo sapien
tacccagttgtagatcttctctccartcgtgaataatatcattaaaaaca

SEQ ID NO: 329 - DNA, 50 bp, homo sapien
tgttttgttcatttcttcagaatcaygtttagctcctgaagaagagggtg

SEQ ID NO: 330 - DNA, 50 bp, homo sapien
tggactcagctccaaatctttctaarctccaccctcttcttcaggagcta

SEQ ID NO: 331 - DNA, 50 bp, homo sapien
tgatcacatttgcttgagattggtckatgtgaatttattaatttacaaaa

SEQ ID NO: 332 - DNA, 50 bp, homo sapien
cacaccaggatggtaggaaaggttcraggtgttgagttcagaggtggctg

SEQ ID NO: 333 - DNA, 50 bp, homo sapien
ttcttaaaactaaaaagccctaaggyatagatctctgactggcagatgtt

SEQ ID NO: 334 - DNA, 50 bp, homo sapien
aatcacacctgtattgtggctcccaraagaaaaagcagatgatgaatagc

SEQ ID NO: 335 - DNA, 50 bp, homo sapien
agtttctagctctggataggtctcartaacatacattttccccactttcc

SEQ ID NO: 336 - DNA, 50 bp, homo sapien
ttcctgcagttctgttactaaaaatsacataaagtaagacccaatgtctt

SEQ ID NO: 337 - DNA, 50 bp, homo sapien
tacaagaacaggtaaatccagaatayatttgagcagttaggaggaaacca

SEQ ID NO: 338 - DNA, 50 bp, homo sapien
ctcaacccaattctttcatttgtgcmaccaacatttgctgagctcctgct

SEQ ID NO: 339 - DNA, 50 bp, homo sapien
gatgtacatttcctctcttaagcaayttaatttgggtgctacttccctcc

SEQ ID NO: 340 - DNA, 50 bp, homo sapien
tttagtaacagaactgcaggaagatsaagacaatgttgtaatcccagcaa

SEQ ID NO: 341 - DNA, 50 bp, homo sapien
gagcaatatttaatcaggtgaatacsagcaaagagagaaaatacagaaaa

SEQ ID NO: 342 - DNA, 50 bp, homo sapien
ccagggatggttttggtgtctctaayctccagtctctccatgatactgag

SEQ ID NO: 343 - DNA, 50 bp, homo sapien
catggctgatgtaaaggatgggtgasaaaggaagaaaagacagaagatca

SEQ ID NO: 344 - DNA, 50 bp, homo sapien
cacttaggagatcatatatagtcaayaaatgttagctcttcttacctaaa

SEQ ID NO: 345 - DNA, 50 bp, homo sapien
tcccctcctgagggttggatctgtcyctaattctcagctgttgactcagg

SEQ ID NO: 346 - DNA, 50 bp, homo sapien
atgtgtgggatgatcttgtattcaaytaacctgtcaaatactcttatcaa

SEQ ID NO: 347 - DNA, 50 bp, homo sapien
caccatgatccctcttaggcaaacamtgaaccaataccatgttgtgttta

SEQ ID NO: 348 - DNA, 50 bp, homo sapien
caaacttgtgaggccaatgtgattaygcccctcatacacacaaggcaata

SEQ ID NO: 349 - DNA, 50 bp, homo sapien
atatcaagtatttagtgtcttactaygaagtaaatcatatactttctcaa

SEQ ID NO: 350 - DNA, 50 bp, homo sapien
gggaaagaatcatcatcatttcagamgacgaaaaaagaattggaagactt

SEQ ID NO: 351 - DNA, 50 bp, homo sapien
actgtcacagaatgactgcctcttaraactctccccagcttggacagatt

SEQ ID NO: 352 - DNA, 50 bp, homo sapien
ccttaatagtctacatgtaaacgaayagaatataagccaaaatagaaaac

SEQ ID NO: 353 - DNA, 50 bp, homo sapien
atacacccacacacaggatgctgacragaattcatttaacttggcttgga

SEQ ID NO: 354 - DNA, 50 bp, homo sapien
ttgttattgttgacaacattaatacrgtaacacctcatttatttagcatt

SEQ ID NO: 355 - DNA, 50 bp, homo sapien
ctgagaagtttgtataatgtggtacwattttaaggaaacaaacaatggca

SEQ ID NO: 356 - DNA, 50 bp, homo sapien
tgagtagggtccacactgaactagasagtgcctttcatccccatcctccc

SEQ ID NO: 357 - DNA, 50 bp, homo sapien
caaagcttgcttgaagcataagggarcgacctggggctagagcttggcgc

SEQ ID NO: 358 - DNA, 50 bp, homo sapien
ctgggcaaagggcttggtctctttgraactgagattcagaagggtgtgat

SEQ ID NO: 359 - DNA, 50 bp, homo sapien
aaacaaataaatagctaagtaaacaytggtcttcaactccatcctctggt

SEQ ID NO: 360 - DNA, 50 bp, homo sapien
gataaaatattggatatttaacccaytcctgatatacttagtgtttttca

SEQ ID NO: 361 - DNA, 50 bp, homo sapien
agcaaaggttcagatatgtcaccaascaaacgcagtccctcttgtttttg

SEQ ID NO: 362 - DNA, 50 bp, homo sapien
aaagcttgttgctacggcactatgaragattacgttatgtagcctttgct

SEQ ID NO: 363 - DNA, 50 bp, homo sapien
aatataattttttagcacctctatayatgtgtgatgcagaaccaagcttt

SEQ ID NO: 364 - DNA, 50 bp, homo sapien
tacaataatagtctgtagagtcaaamttcatgagttattattcccatttt

SEQ ID NO: 365 - DNA, 50 bp, homo sapien
gaaagagatgtgaactcttttagaayatctgtgtgttgcagttatttgca

SEQ ID NO: 366 - DNA, 50 bp, homo sapien
gatttattatggtataaagaaacaayttagcttctggcagtaacaggcag

SEQ ID NO: 367 - DNA, 50 bp, homo sapien
tgtgatgatggacctcctgcctctartaagaatggacttagtagaagatg

SEQ ID NO: 368 - DNA, 50 bp, homo sapien
tccacattcaactgcatggtgtgcayggtcttgcatgaccaggcccctgc

SEQ ID NO: 369 - DNA, 50 bp, homo sapien
caaaggcccagagggaggaacttgcrccttcataagagactcttggggct

SEQ ID NO: 370 - DNA, 50 bp, homo sapien
tgtgaggattacagaataaagtaagraaaaatactgcatggaaaaggacc

SEQ ID NO: 371 - DNA, 50 bp, homo sapien
tactacattctgttttgatttgtgtyaaataaggagaacattagaagatt

SEQ ID NO: 372 - DNA, 50 bp, homo sapien
tggaaagccaatgttagctgctcatsaactaggactcaaggatgtaaacc

SEQ ID NO: 373 - DNA, 50 bp, homo sapien
cattatgccgaaataagccagataaraaagggtttttgccctacatactc

SEQ ID NO: 374 - DNA, 50 bp, homo sapien
ctggctcctccacttgccgtgtgtayaaccttggacggcagttcaagtgg

SEQ ID NO: 375 - DNA, 50 bp, homo sapien
gggaacgataaaggccatcaggaaaraaaccaaattgttacaatgtattt

SEQ ID NO: 376 - DNA, 50 bp, homo sapien
tcccaggttcatcttgacgcatcctragctacttaacttcggttcctatc

SEQ ID NO: 377 - DNA, 50 bp, homo sapien
ggaatgattactgcagttaagcaaaytaacatatccatctcctcacatag

SEQ ID NO: 378 - DNA, 50 bp, homo sapien
ccacagacgatttattttccacaacygtggcctgaggggcatgtgcacgt

SEQ ID NO: 379 - DNA, 50 bp, homo sapien
aagatttactccatttccaggcctargcattcaccagcatttgtcccctg

SEQ ID NO: 380 - DNA, 50 bp, homo sapien
tgactttctggctataaactttttaygattattaactgaggaaacctaga

SEQ ID NO: 381 - DNA, 50 bp, homo sapien
cccgtcctaagtagagaggctaaaasagagtgcagaatcactgacacagg

SEQ ID NO: 382 - DNA, 50 bp, homo sapien
agcaggtgatctcagagctactcacrgatgattggagcagggggatacac

SEQ ID NO: 383 - DNA, 50 bp, homo sapien
aggaagtgatcacatccttttgtacmggcattgctgagagctgctggtgt

SEQ ID NO: 384 - DNA, 50 bp, homo sapien
tgactccccttaaggatgagaagggycccaagtaaataggtgggatgggt

SEQ ID NO: 385 - DNA, 50 bp, homo sapien
gaatataacctcagtggatggcatargctcctcgtgtcaccatggggaca

SEQ ID NO: 386 - DNA, 50 bp, homo sapien
aaaatttaggggtgccttcgacacargagtcagaggtttgtgttgtcctg

SEQ ID NO: 387 - DNA, 50 bp, homo sapien
ccctctgtggctgggacaatgatacmgacagctaccgcttccagggcatt

SEQ ID NO: 388 - DNA, 50 bp, homo sapien
atgagaagctgttgctatttaaggamggtgttttcattctctggacccag

SEQ ID NO: 389 - DNA, 50 bp, homo sapien
aaatactacacacaaaaaaactcaaytcaatggactgatttaaaaatagt

SEQ ID NO: 390 - DNA, 50 bp, homo sapien
gaacctcagccctgagatctgaacaycgtgtttcttcactgggaacctac

SEQ ID NO: 391 - DNA, 50 bp, homo sapien
ggctggtttacagactgatatttagsaactattggcctaactcctcattt

SEQ ID NO: 392 - DNA, 50 bp, homo sapien
ggtctatttgtctttctttagtccartgctatactgttttgattactgta

SEQ ID NO: 393 - DNA, 50 bp, homo sapien
tatttctaatcaaatcatattttaastgcattaaagaaaaaataatacca

SEQ ID NO: 394 - DNA, 50 bp, homo sapien
ctcagctaatgtttgaggaccacctraatgaatcagtgattgaaatgaat

SEQ ID NO: 395 - DNA, 50 bp, homo sapien
gagttaccaagatgaacacgagttcracgcccacctggtttgtcgcatgt

SEQ ID NO: 396 - DNA, 50 bp, homo sapien
ctcacacagtaaacaacactaaatcyaaggaacagaaacttctgtggcct

SEQ ID NO: 397 - DNA, 50 bp, homo sapien
cataactgtttcctttaaggactcartacctgggaaaaataaatttgtaa

SEQ ID NO: 398 - DNA, 50 bp, homo sapien
agtattcccaaaaggaagtgatccayaaggtaggaaaatatcctgtctgc

SEQ ID NO: 399 - DNA, 50 bp, homo sapien
acttaacaaggatagtcacagaacckacgctgcattggctcttaggttct

SEQ ID NO: 400 - DNA, 50 bp, homo sapien
cctggcatacagggtccatcttgcartaaaaaatgggcacaatgctgagt

SEQ ID NO: 401 - DNA, 50 bp, homo sapien
ttagctgtagtattatgtgattataygctaaattactctgcgatagtttt

SEQ ID NO: 402 - DNA, 50 bp, homo sapien
caaggccagtcatgctatcattctgragccttctttgtttactccagacc

SEQ ID NO: 403 - DNA, 50 bp, homo sapien
ccatttctagatggtcactagtccaytgatgacactttgaggagctcaag

SEQ ID NO: 404 - DNA, 50 bp, homo sapien
aacggaatagtaactgatatcttacratttgagttttattaatgtttatt

SEQ ID NO: 405 - DNA, 50 bp, homo sapien
caacaccaactcaagtatttaaacaktcttattcttcagtcttgtgtcca

SEQ ID NO: 406 - DNA, 50 bp, homo sapien
actgaaattaagtaatatactggaaktctaaaggtgtagatctgtgcttt

SEQ ID NO: 407 - DNA, 50 bp, homo sapien
taaggcaggaagagcttgatgataaygataataagagtaaccacaattgc

SEQ ID NO: 408 - DNA, 50 bp, homo sapien
gcattttaaaaaatgcaatttcatcrattatccctttctgccttcaaaag

SEQ ID NO: 409 - DNA, 50 bp, homo sapien
atttctacctgttctttctctataayacccttttcctatgcatttttctc

SEQ ID NO: 410 - DNA, 50 bp, homo sapien
cttctcttttttttcgaatcttattmaaacaccacagagattaagtaatg

SEQ ID NO: 411 - DNA, 50 bp, homo sapien
tagttcagccctcaccatgtttaccracgtcacttctgtgttcccctcat

SEQ ID NO: 412 - DNA, 50 bp, homo sapien
aggtgggtgtgagtgggcggtggcayacaaaaagtctggagaggtggcag

SEQ ID NO: 413 - DNA, 50 bp, homo sapien
agggttgttagcagacttagaccacygatgcaaagggactagcacaatgt

SEQ ID NO: 414 - DNA, 50 bp, homo sapien
acccaattctctctcaattgttcatraatttcttgctgtactgggaatta

SEQ ID NO: 415 - DNA, 50 bp, homo sapien
tcaaagaccatagtttgaaaagcacrgtagttcagacagcaaacaaaata

SEQ ID NO: 416 - DNA, 50 bp, homo sapien
catgatcctgcatcccactgatagcmattttaaaagtggaagagtggttc

SEQ ID NO: 417 - DNA, 50 bp, homo sapien
tccttgaagcacaataaacagatagyatttctgcatgtgtcactctgagt

SEQ ID NO: 418 - DNA, 50 bp, homo sapien
ttttacctggacaggaaaagaatacrgtacttcctcatattgcctccctt

SEQ ID NO: 419 - DNA, 50 bp, homo sapien
aggagagagacttattttttgtccawgtatacacagttgtagatataatt

SEQ ID NO: 420 - DNA, 50 bp, homo sapien
tcataggaatattataaaaaatcaaycagacactatatataagcacttgt

SEQ ID NO: 421 - DNA, 50 bp, homo sapien
atgtgaatctagacaaactgataaaycactccaggtcccatttttctagt

SEQ ID NO: 422 - DNA, 50 bp, homo sapien
cactatgtgaactctaagttctgaayatccgaatttttcaaatagttctg

SEQ ID NO: 423 - DNA, 50 bp, homo sapien
ttctgatggtaagaaactgattaacygaccataggctgaaatgatgaggg

SEQ ID NO: 424 - DNA, 50 bp, homo sapien
tcattaatattgatttggcctggaaytgggttgagacttactttctattg

SEQ ID NO: 425 - DNA, 50 bp, homo sapien
caacaccaaagtgtatcaagtagtamtaaaaaagatcccagttactaagg

SEQ ID NO: 426 - DNA, 50 bp, homo sapien
aaatactagtattagagctaaaagaygctggaaccatgagagcaggagtc

SEQ ID NO: 427 - DNA, 50 bp, homo sapien
ttctacagacatggacaacaaagacwctcttttgcagacatgggaaagag

SEQ ID NO: 428 - DNA, 50 bp, homo sapien
tttcttctgcagttttactcattgaycttccttggaagggccatgctggt

SEQ ID NO: 429 - DNA, 50 bp, homo sapien
ggcaggcagagcagggattgctatcratattttacccaaagaaagctgca

SEQ ID NO: 430 - DNA, 50 bp, homo sapien
tgcatctgcctatttctcctacaacwgaaagttacaagatttttttcaaa

SEQ ID NO: 431 - DNA, 50 bp, homo sapien
gttcgaaacaggcagaaggaagctaktaagtgtgtaggtttttttttaag

SEQ ID NO: 432 - DNA, 50 bp, homo sapien
tggaatattattcagccataaaagasataaactattgatacttactctaa

SEQ ID NO: 433 - DNA, 50 bp, homo sapien
tccaaggaacaggccttctactttayacatggagaaaacaagtcacagaa

SEQ ID NO: 434 - DNA, 50 bp, homo sapien
tggtgagttccctgtaagtagggagyatgcaagtcaaagtgctccagagc

SEQ ID NO: 435 - DNA, 50 bp, homo sapien
accaaaggctcagaagagtaaaatcrattcccccaagtgccacagatcat

SEQ ID NO: 436 - DNA, 50 bp, homo sapien
cctgagatttctgggaagaagccackcctggttttccaattcctactgct

SEQ ID NO: 437 - DNA, 50 bp, homo sapien
actacataaactgaaaatcgcccaayaagcgtctcaataatgatcttgtc

SEQ ID NO: 438 - DNA, 50 bp, homo sapien
taaaattggggattatacacaaaaaygatttttcatataacagtctctta

SEQ ID NO: 439 - DNA, 50 bp, homo sapien
taaaacaaagttttaaccgaatcacrgtacttcaagtgcattccagataa

SEQ ID NO: 440 - DNA, 50 bp, homo sapien
aatgtatttttaaatgactatatccracagccacggagtcagacccacag

SEQ ID NO: 441 - DNA, 50 bp, homo sapien
agtcctattcttgagcccacttcacrgaaaaggaaactgaaactcataga

SEQ ID NO: 442 - DNA, 50 bp, homo sapien
gcacctactatgttccagatcctgcrcctgctatgttccagagccctggc

SEQ ID NO: 443 - DNA, 50 bp, homo sapien
aagcaggataaagcagccaaggtgaraaactcccagtgtgtgaggtacct

SEQ ID NO: 444 - DNA, 50 bp, homo sapien
agatttatataatatgacccaactaygtgaaaacactgagagagagagac

SEQ ID NO: 445 - DNA, 50 bp, homo sapien
agccaaagcattgagtctgatctgcygagtatgagagttatgtctgtgtt

SEQ ID NO: 446 - DNA, 50 bp, homo sapien
gatgtattttaaaggctattatgagrcaaaaataaaagcaccacatccta

SEQ ID NO: 447 - DNA, 50 bp, homo sapien
cagaccaaacacacaaaaaaagaaakaattctcagcctctctgcagcata

SEQ ID NO: 448 - DNA, 50 bp, homo sapien
tattgggcattcaatatatagttccrgatagaataaaataaatcctcaat

SEQ ID NO: 449 - DNA, 50 bp, homo sapien
tgtcctctgaacaccaggaataagamatagcgccagaccctcttaaattc

SEQ ID NO: 450 - DNA, 50 bp, homo sapien
gttaaattaaaaaaccaagtacactsaaatatctaagtcctaaatgagtc

SEQ ID NO: 451 - DNA, 32 bp, homo sapien
gaggcattcttctaagyaaagtgtgaagaaaa

SEQ ID NO: 452 - DNA, 50 bp, homo sapien
ggcagacccatgggcctatgtgatawccccaagactgggacaccaggcct

SEQ ID NO: 453 - DNA, 50 bp, homo sapien
aggtgaggttgctgaaatactaccayatcgtgttgaaaacagaattcttt

SEQ ID NO: 454 - DNA, 50 bp, homo sapien
tgcagtgggctttgaaaacttggacygcattatgcaaaaagcacagctgt

SEQ ID NO: 455 - DNA, 50 bp, homo sapien
gctaatgattctagcagtttaaaaayggacttcttgtttatcagcagcca

SEQ ID NO: 456 - DNA, 50 bp, homo sapien
tgattatgtagacttactggaaaaawtaaccttcattaaaattttttgga

SEQ ID NO: 457 - DNA, 50 bp, homo sapien
ataacccaaaaagtatcttccacaaraataaatctgtagcctgcttgctt

SEQ ID NO: 458 - DNA, 50 bp, homo sapien
cttctgactggaccctgactgatacrcttagagaaattcactgtaagctc

SEQ ID NO: 459 - DNA, 50 bp, homo sapien
tgaagtcagagttcgactagaaggawaggtgatggctttggccttagatg

SEQ ID NO: 460 - DNA, 50 bp, homo sapien
cctctcaaatttcacagacattataygcctttggatgatactaacaatgt

SEQ ID NO: 461 - DNA, 50 bp, homo sapien
tccaaaaggacaggtaacataatgcracttgtcaacattgatgtgtgtgt

SEQ ID NO: 462 - DNA, 50 bp, homo sapien
aacacagaggtcatataatagatacracacagtggaaggaaggaaaagag

SEQ ID NO: 463 - DNA, 50 bp, homo sapien
gaaaacaggaaagcaatatggaaacyctaatgtaagtgattctttacata

SEQ ID NO: 464 - DNA, 50 bp, homo sapien
gcctaactattgaggcttgagcaacmgattaaggtcaaaaggagcttatt

SEQ ID NO: 465 - DNA, 50 bp, homo sapien
cctcctgtctcaggggtgaaggctcmaatcctagctgcgcctctgcttgc

SEQ ID NO: 466 - DNA, 50 bp, homo sapien
tcatacatgccagatactgtgctgcrataggatgagctcccaatacccac

SEQ ID NO: 467 - DNA, 50 bp, homo sapien
atgtttgtttatgatactaggggaaratgatgaataaatgtatgcaattg

SEQ ID NO: 468 - DNA, 50 bp, homo sapien
aatgaattctccgtttgagaacagakagaagaaatttggtcatggagtta

SEQ ID NO: 469 - DNA, 50 bp, homo sapien
tcttgttcatagtgctctacttgtaycatggagtcagagtttgaatccaa

SEQ ID NO: 470 - DNA, 50 bp, homo sapien
aactcttggactttatacacaacaaygaacataataagactcctaaaggt

SEQ ID NO: 471 - DNA, 50 bp, homo sapien
aagcctaagaagtttctgagaattasagaggccaagacatagtccctttt

SEQ ID NO: 472 - DNA, 50 bp, homo sapien
gcatcactgcagttctccttaaacasagaagagctttggtcaggaatgca

SEQ ID NO: 473 - DNA, 50 bp, homo sapien
aaaaccagcttttgaaaccctaagtraattgcaataatagaaaacaaagc

SEQ ID NO: 474 - DNA, 50 bp, homo sapien
atctgactcaaaagcacatgctctcwccctaaaaagacacctacatatga

SEQ ID NO: 475 - DNA, 50 bp, homo sapien
aggttgtaatttacaaaaataaggcrctgtttgccccaataatgaatttt

SEQ ID NO: 476 - DNA, 50 bp, homo sapien
cagacagtctaatagaatggtaaaakaacctattgaagagtcagttatgg

SEQ ID NO: 477 - DNA, 50 bp, homo sapien
gccaagaagagtagagaaagagcaakaggtaggtgataatgggggtggtg

SEQ ID NO: 478 - DNA, 50 bp, homo sapien
catattctaagggtgataagccataygaaacccatcatctaagactggat

SEQ ID NO: 479 - DNA, 50 bp, homo sapien
atgaggatgaaatgagataacatgaraaaacctaaattcatcaccttgtt

SEQ ID NO: 480 - DNA, 50 bp, homo sapien
catacttcctattgcaaactcaaaamttccatctaaatatctcatagtca

SEQ ID NO: 481 - DNA, 50 bp, homo sapien
ttttgtttttctaaaaatggtatcaycctatgtacattcctcagcactcg

SEQ ID NO: 482 - DNA, 50 bp, homo sapien
aattcagcaaacattttcatttcacrctctagtttccggaagccatggtt

SEQ ID NO: 483 - DNA, 50 bp, homo sapien
ctgaccagcctggctccatccttacygcttgtcagctttttttcttgagg

SEQ ID NO: 484 - DNA, 50 bp, homo sapien
ttgagatatgagctcatattatcacygtgactttattaatatggagaaaa

SEQ ID NO: 485 - DNA, 50 bp, homo sapien
tcaatgtggtcagtgtggttcctcamtctcctaccaatctgtcaccaagt

SEQ ID NO: 486 - DNA, 50 bp, homo sapien
tttagattttcaatgaccacaaatcygaaataataacactatctggtaat

SEQ ID NO: 487 - DNA, 50 bp, homo sapien
catcattacaatgggttggactcaayataaatcaactggagccccaagta

SEQ ID NO: 488 - DNA, 50 bp, homo sapien
tttattgagattatttactaaataaytgatatacatccaacatcactgaa

SEQ ID NO: 489 - DNA, 50 bp, homo sapien
gctactgtatatttaaagttgtaagwactgagagtaacagaagagtagag

SEQ ID NO: 490 - DNA, 50 bp, homo sapien
agatgaatgcagagagaccagttaaragagtaatgtggtttcatgagcgc

SEQ ID NO: 491 - DNA, 50 bp, homo sapien
acaagacaatggctatctcttaaacwcattcaaattcccaggtaaataat

SEQ ID NO: 492 - DNA, 50 bp, homo sapien
aagaaaaaactcagatctaaacccasgtacccaacactctactcttctgt

SEQ ID NO: 493 - DNA, 50 bp, homo sapien
attattttaaaagggatcaaaaccaytgaagtaaggagaccagtcccaac

SEQ ID NO: 494 - DNA, 50 bp, homo sapien
gggaagagcaatattgtaaaagactraatttcctgctatgacaggtaagg

SEQ ID NO: 495 - DNA, 50 bp, homo sapien
agtaacaggccaatcctgtatcccartgccagaaattaactccctagaga

SEQ ID NO: 496 - DNA, 50 bp, homo sapien
tactgttcgtagggctgttatctagsagaattgtgctttgcttgggaccc

SEQ ID NO: 497 - DNA, 50 bp, homo sapien
tgcccaggctgctgcttagaaaataragaaaattgccaagtgcttcagag

SEQ ID NO: 498 - DNA, 50 bp, homo sapien
gctgctaggatagggcttggttataygatgaagaacctaacaagattatc

SEQ ID NO: 499 - DNA, 50 bp, homo sapien
catacaagaaggctgtggagaacgaraagagaaggcagcctaggacggaa

SEQ ID NO: 500 - DNA, 50 bp, homo sapien
ctggctggcaggaatgaggactcaayggaaaggggatgtgtcaaatactc

SEQ ID NO: 501 - DNA, 50 bp, homo sapien
gttcactaaatagtagcagccattaygtatatagtgccacaggagcacag

SEQ ID NO: 502 - DNA, 50 bp, homo sapien
cagacaggcagggtccccaaggccaygttgctaggagatgcggccctagg

SEQ ID NO: 503 - DNA, 50 bp, homo sapien
ctaggtaacggttaccagtttaacasatgcctttctggcttttccctgaa

SEQ ID NO: 504 - DNA, 50 bp, homo sapien
gtggagtgggttaagtgcaacggaamctcaactctttcaccaggtgtcct

SEQ ID NO: 505 - DNA, 50 bp, homo sapien
tttaaataaattttattccattacascaaaatctttagatatacttgtta

SEQ ID NO: 506 - DNA, 50 bp, homo sapien
ccctgaggatatatattacattgacyctgtcttcaagaaaatcacaattt

SEQ ID NO: 507 - DNA, 50 bp, homo sapien
ttcctgttccagcaaaaattctgcaycagctgtagccaaaggaagacctt

SEQ ID NO: 508 - DNA, 50 bp, homo sapien
ctaattaatcatggtgttcttagaartgaaatggataggtagcctactgc

SEQ ID NO: 509 - DNA, 50 bp, homo sapien
ggcccagatgcttgtagctaattcayctactaagttatctaatgtaatgt

SEQ ID NO: 510 - DNA, 50 bp, homo sapien
cacagattagtttgggacccaatcaytaagggatttgaatgtgaaaatca

SEQ ID NO: 511 - DNA, 50 bp, homo sapien
gcaggatgcatcacaggacttaatayggtgaggtcattgttgtggttggt

SEQ ID NO: 512 - DNA, 50 bp, homo sapien
ctagtgactcagttttgattttgacracattcaggcatgaaggaggcaca

SEQ ID NO: 513 - DNA, 50 bp, homo sapien
tttgactagaagtccagtgtagtagraccactcctgtcaatgggcatgta

SEQ ID NO: 514 - DNA, 50 bp, homo sapien
tatttaaagtcgctgtacctagttaycatcaacaggcagattagcttttg

SEQ ID NO: 515 - DNA, 50 bp, homo sapien
agtgtttcttaatgttcatattaaayttgatgtctaaaaatttgtttatg

SEQ ID NO: 516 - DNA, 50 bp, homo sapien
tttacacataagaaaactgaatttgragagattatttgtgtaaaggaacc

SEQ ID NO: 517 - DNA, 50 bp, homo sapien
gaataaggatgaagagagacttgtaygatgccatcaagcataccaacaaa

SEQ ID NO: 518 - DNA, 50 bp, homo sapien
gctaaaatgatgattaaaaacagtartaataacagaataccatcactacc

SEQ ID NO: 519 - DNA, 50 bp, homo sapien
catgcctgttaatagaaagccagaaytagtcttaaggtctcttaattcct

SEQ ID NO: 520 - DNA, 50 bp, homo sapien
atctaatttaattctttatcattcargtagagagacaggcattttccaaa

SEQ ID NO: 521 - DNA, 50 bp, homo sapien
gtgggtttgaatcaggacctcgtacrggttacttctgtttcttcttatga

SEQ ID NO: 522 - DNA, 50 bp, homo sapien
gttaaatggcctttaagatcattcaraactcaaaaactgattctgtgatt

SEQ ID NO: 523 - DNA, 50 bp, homo sapien
ccttctttcccattctcctcttttaycatatgttactcactacctcacta

SEQ ID NO: 524 - DNA, 50 bp, homo sapien
agcttgtgtcaggggctatgcttgakgttagaagtacagagattgaatta

SEQ ID NO: 525 - DNA, 50 bp, homo sapien
gctgttccaactacaggggtgaaggycaaataaatgattatatcaagtgg

SEQ ID NO: 526 - DNA, 50 bp, homo sapien
atttacagattctgcagaagacccartaggaagattctgttgtaccttat

SEQ ID NO: 527 - DNA, 50 bp, homo sapien
atggagtgtgctagaaattctgatgyaatgccaggagactctggccgtca

SEQ ID NO: 528 - DNA, 50 bp, homo sapien
cctctctgatggagggcttttccacygtagaatattttcaaccaccttat

SEQ ID NO: 529 - DNA, 50 bp, homo sapien
tcttaattttagacgtatttttaaamgaggtacatgtcatattttctacc

SEQ ID NO: 530 - DNA, 50 bp, homo sapien
gtgtgtgatagagatttggactacaygtaatgagatttgctgtaatagta

SEQ ID NO: 531 - DNA, 50 bp, homo sapien
tgtatgctagagatctttccatttargtacaaagtttattattttctata

SEQ ID NO: 532 - DNA, 50 bp, homo sapien
tagtgagtaactgatttaggattgaraattggtctttcttttgccttgta

SEQ ID NO: 533 - DNA, 50 bp, homo sapien
gtaccaaaaggttccttcttcactcrcatagctccagattttcctaaagc

SEQ ID NO: 534 - DNA, 50 bp, homo sapien
ggtatgtgtgaaattttaacacaaayttgaagtgataaagaaaagagcca

SEQ ID NO: 535 - DNA, 50 bp, homo sapien
attgatttttttcatttatgagttaygcttttaatgttgtatctgagaac

SEQ ID NO: 536 - DNA, 50 bp, homo sapien
tctgatcagcgtccctagtttgacckatttgcaatccctgatagcccagt

SEQ ID NO: 537 - DNA, 50 bp, homo sapien
tcaatctcctagtctttgtatgtcaygcagcctttcaaaaaatatacaga

SEQ ID NO: 538 - DNA, 50 bp, homo sapien
ctctttaaaattaatagtttaggaaygtctatgctaaaatatctcaagga

SEQ ID NO: 539 - DNA, 50 bp, homo sapien
aatattcatatagacaaacaggttcragttacttaggaaccaaccaggat

SEQ ID NO: 540 - DNA, 50 bp, homo sapien
ttaaagcagcacctgagtgaattaamagccatacaaggcaagtctcttca

SEQ ID NO: 541 - DNA, 50 bp, homo sapien
aaaaataaaaacaataccagctgacycttatatatgtttataattcaaag

SEQ ID NO: 542 - DNA, 50 bp, homo sapien
agtaggcctcctggagtgggtatgaragtgaaaatcagcacctcacattg

SEQ ID NO: 543 - DNA, 50 bp, homo sapien
aaagtcaacccttcattgtaaacatmacttcaaaagtttacaaaatcttg

SEQ ID NO: 544 - DNA, 50 bp, homo sapien
agcaggtcaagcagtgtgcttgttckcgggtatttggaagggagagtcct

SEQ ID NO: 545 - DNA, 50 bp, homo sapien
tcttcaggactccttactataaaaarccttatctacgttggaaatgtgat

SEQ ID NO: 546 - DNA, 50 bp, homo sapien
gtattttttatacgtagaaggagcasactctaaataatacagtaaataca

SEQ ID NO: 547 - DNA, 50 bp, homo sapien
ctaaggaaactttctatttgacttgractccagagtggaaaacaatgaat

SEQ ID NO: 548 - DNA, 50 bp, homo sapien
tacatgtgggaaaaaaattgcaactragatattttagagagcccacctct

SEQ ID NO: 549 - DNA, 50 bp, homo sapien
ttttctttctaaaattattagtgacrgcgaatctgtacaggtctgtagca

SEQ ID NO: 550 - DNA, 50 bp, homo sapien
aggcattcttcccttaccagccgaawgtccctggaaagtcatgtatcagt

SEQ ID NO: 551 - DNA, 50 bp, homo sapien
catgcttgactagctacctactgtamcaaaatgatgggccaattaacttt

SEQ ID NO: 552 - DNA, 50 bp, homo sapien
tgccaggcagccagctaatacaaaawcgggaggcactaaacatcaccatg

SEQ ID NO: 553 - DNA, 50 bp, homo sapien
cttctatgctttaagcatttaattgyaatgtgtaggtaactcattcattt

SEQ ID NO: 554 - DNA, 50 bp, homo sapien
aggatccctggtctcccttaactcaygctggactgttccctttggtcttt

SEQ ID NO: 555 - DNA, 50 bp, homo sapien
gtgtttaagaattaactttatgaaaygtagtagcattcagtgtagtatta

SEQ ID NO: 556 - DNA, 50 bp, homo sapien
ttcctgctgtgtaacataagaatacyatatacctcattgatggtgggttg

SEQ ID NO: 557 - DNA, 50 bp, homo sapien
cttgtatcttactttctcaagttatsagtccacaaacatgaagagtatta

SEQ ID NO: 558 - DNA, 50 bp, homo sapien
tcatcagcttattcctaaaattctcyataagcactctaatcagtctctcc

SEQ ID NO: 559 - DNA, 50 bp, homo sapien
ctggagaaaatagcctcgtatcttayagtgaagaattgagaaataccatc

SEQ ID NO: 560 - DNA, 50 bp, homo sapien
gtcactgtttctgaacttctacaccrcatttgaaactgtcaacaccctgc

SEQ ID NO: 561 - DNA, 50 bp, homo sapien
cactcttccatcagataaatagggaygctaaagcccaaggggaaaagtaa

SEQ ID NO: 562 - DNA, 50 bp, homo sapien
aaaagtttgctaagatccatgcttamaaaatttcttttgcttgtggtatt

SEQ ID NO: 563 - DNA, 50 bp, homo sapien
atgctatacattaaatggtgaacacyggtggatagtctggcccagatagc

SEQ ID NO: 564 - DNA, 50 bp, homo sapien
cccaggtcatctacctcagtaacaawtgctcattagatgaggaaattcct

SEQ ID NO: 565 - DNA, 50 bp, homo sapien
aatgtcacagactcttaactgtctargctgacaagactcagtgtcccccc

SEQ ID NO: 566 - DNA, 50 bp, homo sapien
ctaaatgaagctttattaaataccaygggggagtgtgcaggtgcagtggc

SEQ ID NO: 567 - DNA, 50 bp, homo sapien
cgccccagcagcctcctctaaagtamcttctgcatagaatcactataaga

SEQ ID NO: 568 - DNA, 50 bp, homo sapien
tccctttctccccagcatattcatamagacagaccatggagggcagccaa

SEQ ID NO: 569 - DNA, 50 bp, homo sapien
aggatatctgtgattacaagattacmatgcaattttgaaagcctgctgtt

SEQ ID NO: 570 - DNA, 50 bp, homo sapien
cttctggatgcccatctgagctctcrcaggagaattcaattactccctct

SEQ ID NO: 571 - DNA, 50 bp, homo sapien
tgctctaccagtaataagctacctgraggctgtttagcaggtggaaccac

SEQ ID NO: 572 - DNA, 50 bp, homo sapien
agcagttgggtttctctcacgcctcrcgttccgtgtgcctcctggcgtcc

SEQ ID NO: 573 - DNA, 50 bp, homo sapien
aggtctatccatcaaatgcagacacraatagagagatcataattagacaa

SEQ ID NO: 574 - DNA, 50 bp, homo sapien
tgctaaataaatgtgagtgacttttwaaaaatcctcacaacctacacagc

SEQ ID NO: 575 - DNA, 50 bp, homo sapien
gagaaaagctaaacatatttcacaarttaaaaagaagctaaattttagaa

SEQ ID NO: 576 - DNA, 50 bp, homo sapien
gcctacctgatgcaggaataagcaaygtcgagaaatccaaggtgactcct

SEQ ID NO: 577 - DNA, 50 bp, homo sapien
attcggagttaatttttctgttctaragatgataggtggttgctgacaga

SEQ ID NO: 578 - DNA, 50 bp, homo sapien
taaaatcacctttattcatcccaaaygtgttcgagtttcaaagcaaaccc

SEQ ID NO: 579 - DNA, 50 bp, homo sapien
caaaaatggggtcatattctacatamcgcttagtacctattttccactcc

SEQ ID NO: 580 - DNA, 50 bp, homo sapien
cagagaaaagcaaatatccaggacaytacttgctagttaagtgagtctgt

SEQ ID NO: 581 - DNA, 50 bp, homo sapien
cagtgttattcatctggaaacttcawgtcatgggactatttatttcctgt

SEQ ID NO: 582 - DNA, 50 bp, homo sapien
ccagtgggtattggaacaaaagaccygggagatatcactgtagtaagtag

SEQ ID NO: 583 - DNA, 50 bp, homo sapien
acagaaaataagtatagacttcaacygctctgtggcaattcttcgaaatt

SEQ ID NO: 584 - DNA, 50 bp, homo sapien
tttaaagaagaatgtatttcaagtayaactcagtttaaccaagtatagaa

SEQ ID NO: 585 - DNA, 50 bp, homo sapien
ctacttaactcatctagtctctgaakaatttttctcattacttaacaaat

SEQ ID NO: 586 - DNA, 50 bp, homo sapien
ccttttgaaatcctttctggaccaargacatacatcaatcattccatcaa

SEQ ID NO: 587 - DNA, 50 bp, homo sapien
cactgacagcttggcaacggggtcamcttgagcgtgcccagcccaccgct

SEQ ID NO: 588 - DNA, 50 bp, homo sapien
tatctgcacctatagatctagggtcragaaaagaccattctttggccagg

SEQ ID NO: 589 - DNA, 50 bp, homo sapien
tgatcacgctagatgctcgcatggtsaaacggcaagacgcagcttcttcc

SEQ ID NO: 590 - DNA, 50 bp, homo sapien
gtggcttcttcaagtgacttctccayaaaacacccctgaggaaccttctg

SEQ ID NO: 591 - DNA, 50 bp, homo sapien
acttgaagtgattcaattaatgtcartcttctctatgagagcataaaacc

SEQ ID NO: 592 - DNA, 50 bp, homo sapien
tggagaccagtcatctctcgtgaccrctcaaatactacctctttcaagaa

SEQ ID NO: 593 - DNA, 50 bp, homo sapien
tacctaaggacgcggcttttccgtarctgatactgactcacacccttccc

SEQ ID NO: 594 - DNA, 50 bp, homo sapien
agtgtggtgtggggagatatcacaaraatggtacacagaaggttcaggtc

SEQ ID NO: 595 - DNA, 50 bp, homo sapien
acttctgcagtgaattggatgaataygcacattaagtagaattagtaaag

SEQ ID NO: 596 - DNA, 50 bp, homo sapien
ccccagagtacttgactgttgatgtyaaaaagcataggcatagctactcg

SEQ ID NO: 597 - DNA, 50 bp, homo sapien
cagttgcaggccaaatctacataaartggacctgtgccaggaacaaactg

SEQ ID NO: 598 - DNA, 50 bp, homo sapien
tctaataacttcatttcctttaaatyacaagatcagagctgaaataggcc

SEQ ID NO: 599 - DNA, 50 bp, homo sapien
ctacaggtttgcagagagtacaacartgaaaaagaagtcatctcgttttt

SEQ ID NO: 600 - DNA, 50 bp, homo sapien
tcacgcacagcacgcggcaacactaratatgctgcccttaaagctaaaaa

SEQ ID NO: 601 - DNA, 50 bp, homo sapien
tgagagttccttgtggaacaattgayggagtaaggtttgttggagtcaga

SEQ ID NO: 602 - DNA, 50 bp, homo sapien
cccatcatcattttttatggttaccyggagcatatagggaaatgtgtaga

SEQ ID NO: 603 - DNA, 50 bp, homo sapien
tctagccactgtgcaggcataattcrcaactcattccagtgtaattaatt

SEQ ID NO: 604 - DNA, 50 bp, homo sapien
cagtattccataatatacactgaacwcgtattaccttaattgcattaaaa

SEQ ID NO: 605 - DNA, 50 bp, homo sapien
attccatattcttttcatcctgatcracttctggaagaaggttacagtct

SEQ ID NO: 606 - DNA, 50 bp, homo sapien
ggtcaaagaagacatcagtgataacyattgattcagtaaatattaaacat

SEQ ID NO: 607 - DNA, 50 bp, homo sapien
cattggagtccacagtataaagcatmaggctcttgagtatttttatatag

SEQ ID NO: 608 - DNA, 50 bp, homo sapien
aatttcactgggcccaacagcttccrgacagatttggcaacaaataaaga

SEQ ID NO: 609 - DNA, 50 bp, homo sapien
aactctattcccaactcttcccttayactgtcaggctcctctcacatctc

SEQ ID NO: 610 - DNA, 50 bp, homo sapien
acaatttttattgactatccactaartcttatgtactgggtatattaaac

SEQ ID NO: 611 - DNA, 50 bp, homo sapien
tttgcatttgttcttcaggacaataygtgaaagaggcagaatcagaataa

SEQ ID NO: 612 - DNA, 50 bp, homo sapien
gggcccactgtaaaaatttatacacrggcatgtccagctgcagtcatgag

SEQ ID NO: 613 - DNA, 50 bp, homo sapien
actaagcaatctcagcaactaatgcwcaccggatatttctatttgcctct

SEQ ID NO: 614 - DNA, 50 bp, homo sapien
agtttctgagggtttgggaagataartactctgcagaagaggccaaggaa

SEQ ID NO: 615 - DNA, 50 bp, homo sapien
actacttattatgacaaggcgcttayaatgatttgcatttctctgcaaaa

SEQ ID NO: 616 - DNA, 50 bp, homo sapien
aggaatttttaatcttaatggctagwcccagaattttttttttttttttt

SEQ ID NO: 617 - DNA, 50 bp, homo sapien
gaactgcagaagctatttgaatgtayggttttacacttattgtttgtgtg

SEQ ID NO: 618 - DNA, 50 bp, homo sapien
gagagaggcagggtagcagtgtaaayatcatgaggcaagaagccatgtgg

SEQ ID NO: 619 - DNA, 50 bp, homo sapien
acccttttcttgccacatagaatcasggagaatctgggtctctggcaagc

SEQ ID NO: 620 - DNA, 50 bp, homo sapien
aatacacagtgcctggctcagtgtasgtgtttaatacatgtttgctgtga

SEQ ID NO: 621 - DNA, 50 bp, homo sapien
tcacagctctattaactattgtaccrcctgtataaacccttctccacctc

SEQ ID NO: 622 - DNA, 50 bp, homo sapien
ttctttttgaaatctgatatttagartcctcttccccacttaattgcaag

SEQ ID NO: 623 - DNA, 50 bp, homo sapien
catcattaactttttacaaaattgasacaattcatgattttaaaaggaca

SEQ ID NO: 624 - DNA, 50 bp, homo sapien
ctgcaattctgtatagtcgagggaayaggttcttagcagctctgactctg

SEQ ID NO: 625 - DNA, 50 bp, homo sapien
ctgttcatttcttatgccattaacargcaacttttaatctttaatcctcc

SEQ ID NO: 626 - DNA, 50 bp, homo sapien
cacttgctacaaatcttttacctgawatactttgtatggaaactcattaa

SEQ ID NO: 627 - DNA, 50 bp, homo sapien
tctcttataaataatctttgtttaayatcctgggcagaattatcttttct

SEQ ID NO: 628 - DNA, 50 bp, homo sapien
caaataactcttgagattttggtcamcttgctccatttacatggactttt

SEQ ID NO: 629 - DNA, 50 bp, homo sapien
acgagttctctaggaaagagacttayatagtttagctgaataagtcggtt

SEQ ID NO: 630 - DNA, 50 bp, homo sapien
tcctataaaatatttatataaaagarctgactacaatcatgccttcacat

SEQ ID NO: 631 - DNA, 50 bp, homo sapien
catttgaggcccatcctggctgaaaktgccattgggaagctgttacataa

SEQ ID NO: 632 - DNA, 50 bp, homo sapien
atttctgactgtgtgttcctcaggayggccactctcttgatttccatctc

SEQ ID NO: 633 - DNA, 50 bp, homo sapien
agagttccagtatgactgctgacaasggaaaattcaaaggaaatgaggag

SEQ ID NO: 634 - DNA, 50 bp, homo sapien
taaatgttcttatttctaaattggarataataaaacttcatccaggtcac

SEQ ID NO: 635 - DNA, 50 bp, homo sapien
accaggtgctattaaactcagacacygtgctaggaacagaataatgataa

SEQ ID NO: 636 - DNA, 50 bp, homo sapien
aaagaaatcagcagatacaagcagtwaacacaaggtgtatatatatatag

SEQ ID NO: 637 - DNA, 50 bp, homo sapien
ctttgttataggtaactaaagggaawctgttatctttgcattatagaaaa

SEQ ID NO: 638 - DNA, 50 bp, homo sapien
tactaatgggaaacatgcatgcgaargcaaacaacatctccaatttatgc

SEQ ID NO: 639 - DNA, 50 bp, homo sapien
tttttcagcaggatcgataacattcraaagaagaatgggttccttgcgat

SEQ ID NO: 640 - DNA, 50 bp, homo sapien
ccttccccagagcctgttccattaargaagtaatcaatgacctatcattc

SEQ ID NO: 641 - DNA, 50 bp, homo sapien
atacactgatcttgagctgtatccamaatattaagttcagagtttttgga

SEQ ID NO: 642 - DNA, 50 bp, homo sapien
cacaatgacctttccccagactctaycaggacacctgcgtgtgtttaata

SEQ ID NO: 643 - DNA, 50 bp, homo sapien
ttcctaaggaaacccactgccacgakatctgttttccaggccttgaatgc

SEQ ID NO: 644 - DNA, 50 bp, homo sapien
aagcttgtagaagtcccacccataaktgtatcatcctaaagaaaccattg

SEQ ID NO: 645 - DNA, 50 bp, homo sapien
accacagtcagaaactggatccatartactcccagacagcagagggataa

SEQ ID NO: 646 - DNA, 50 bp, homo sapien
cctggtttcagactttgttgtgaacmcagatttcatttcaagttctgaca

SEQ ID NO: 647 - DNA, 50 bp, homo sapien
atgactgtgtttccctggaaaattaygtaacttctctaggcttcagtttc

SEQ ID NO: 648 - DNA, 50 bp, homo sapien
caaaagtatatcattagatttagaayaaacgtactgtacatcctggtttc

SEQ ID NO: 649 - DNA, 50 bp, homo sapien
ctcatgaaagagagatagagaatgcratttaggaactgaaatgagagcgt

SEQ ID NO: 650 - DNA, 50 bp, homo sapien
caaaaaaaaaaaaaaaaaatcgttaycctgaagagaatcttgagagtcag

SEQ ID NO: 651 - DNA, 50 bp, homo sapien
atatccctgatacacagtgtggttaygtatgtggactgtgagatcacagg

SEQ ID NO: 652 - DNA, 50 bp, homo sapien
aatattaggttatttaaagtagaaawttcacagattttgccataaacaga

SEQ ID NO: 653 - DNA, 50 bp, homo sapien
gtgaaagggcatgctggccaaccacrgattaatggctagatacacaaagt

SEQ ID NO: 654 - DNA, 50 bp, homo sapien
ccttaatggaacaggctctggggaargacaaagataatcctgttagagaa

SEQ ID NO: 655 - DNA, 50 bp, homo sapien
ggaatggagccctctgctttcactaygcataagtcaattagaacatgctg

SEQ ID NO: 656 - DNA, 50 bp, homo sapien
ctttttagacaattatccttctgtgyatagggttgacaatgaaaaaaaaa

SEQ ID NO: 657 - DNA, 50 bp, homo sapien
acaaaacagttattacctctagaacycattatattagaataaataacatt

SEQ ID NO: 658 - DNA, 50 bp, homo sapien
gcaatgagaaaaaaatgtggggtgaycttttcacgtcttactgcaactat

SEQ ID NO: 659 - DNA, 50 bp, homo sapien
gttaactgagaacatatttgtgagayatttagcacagtgtttagcccaga

SEQ ID NO: 660 - DNA, 50 bp, homo sapien
gatagaagaaacaagagaaagttagrattgagtagagctaggagagggca

SEQ ID NO: 661 - DNA, 50 bp, homo sapien
gaagaaaggttttaatttaaacatargcatccctaaagcagtatattacc

SEQ ID NO: 662 - DNA, 50 bp, homo sapien
tatacactttagatgtctttgttacrgcggccactattaccctaactaat

SEQ ID NO: 663 - DNA, 50 bp, homo sapien
tatgtagacatccaaattttgctaartcaatctctatggcatgttgcttg

SEQ ID NO: 664 - DNA, 50 bp, homo sapien
attatttatattttcagggtgcctaygatgttctctcactgtgctagcca

SEQ ID NO: 665 - DNA, 50 bp, homo sapien
agcattgttgtatgtgtaacctatayggtaatgagagtgaaatagttaaa

SEQ ID NO: 666 - DNA, 50 bp, homo sapien
ggtgccatacagaggcagtctttaayacttactaacctgagaacaggtta

SEQ ID NO: 667 - DNA, 50 bp, homo sapien
aaggcacttgcattctatggggagawtaaatttgaacacagcaaatcaac

SEQ ID NO: 668 - DNA, 50 bp, homo sapien
gtaactaaagtgttatggaagcaaaygtacagggtgttatggcagcgggc

SEQ ID NO: 669 - DNA, 50 bp, homo sapien
ggttgaaatgaaagaatgactgatayaggtatgaatctttaaattaggcc

SEQ ID NO: 670 - DNA, 50 bp, homo sapien
accaatttgaggtatgttttagagtyaaaattagaggactgggcgtctaa

SEQ ID NO: 671 - DNA, 50 bp, homo sapien
gcagcttaagggttattttctccttyaaagaataggtcgagttttaaaac

SEQ ID NO: 672 - DNA, 50 bp, homo sapien
aaggctaccaatgtgaataggctccygaggtaaaaatgttctccccgctg

SEQ ID NO: 673 - DNA, 50 bp, homo sapien
tctttcattaatgtctccatgaaagsatataagtagagaatgccaggaag

SEQ ID NO: 674 - DNA, 50 bp, homo sapien
agcttaatgtaaatgactttcataarcctgtattcctttaacttattttt

SEQ ID NO: 675 - DNA, 50 bp, homo sapien
tttcattcctttttcattaagttgamaaaaagaacaaggtgaccttcctt

SEQ ID NO: 676 - DNA, 50 bp, homo sapien
cacttttgttcttctttgaaaaacaycagtgatctttggaaaacggcttt

SEQ ID NO: 677 - DNA, 50 bp, homo sapien
ctcattgataagatttgtaatatggmaacagtctatgattctattaaaaa

SEQ ID NO: 678 - DNA, 50 bp, homo sapien
gactgtttccatattacaaatcttaycaatgaggtagtgggggctaggaa

SEQ ID NO: 679 - DNA, 50 bp, homo sapien
ctggctttgttctgcaatttagggarctaagagcttgttagaaaggcttt

SEQ ID NO: 680 - DNA, 50 bp, homo sapien
gcaacaacaacaagcatgtttgaacwcttcttgtcactttcctaaatatt

SEQ ID NO: 681 - DNA, 50 bp, homo sapien
tcccctttgcccctaattcattttcscggtcattctctgttacttaactc

SEQ ID NO: 682 - DNA, 50 bp, homo sapien
acactcctaaaatggttatacctaaygatgacccctcccccaccaaaatt

SEQ ID NO: 683 - DNA, 50 bp, homo sapien
tttcatattcttcatctgtaaaataygggaccagtgtaatgaggttgatt

SEQ ID NO: 684 - DNA, 50 bp, homo sapien
ttaatttagttcatatctcctataaygcaggatttttaccaccttgaggt

SEQ ID NO: 685 - DNA, 50 bp, homo sapien
tgagactgttaggtctttgagatcasggaccatttcttttttcatttata

SEQ ID NO: 686 - DNA, 50 bp, homo sapien
tacctgaaagattaaaaaataaggaygactttgtctataactaaaaaaag

SEQ ID NO: 687 - DNA, 50 bp, homo sapien
ttcctgagtatcgaatcttcctgaarcattgaagaataaaggatattctg

SEQ ID NO: 688 - DNA, 50 bp, homo sapien
ttaaacctgcaatttctgactccaarttagcatgcctccccattctctgt

SEQ ID NO: 689 - DNA, 50 bp, homo sapien
tttatgtgcttaatattagttaatgycatgtccaagaattcactaaatgt

SEQ ID NO: 690 - DNA, 50 bp, homo sapien
ctgcagctcacaactgatagcacaayccatcggagtctgcagatcaaatc

SEQ ID NO: 691 - DNA, 50 bp, homo sapien
gaccatactttcctggacttgtttayctgtagcctgtctaattctgacca

SEQ ID NO: 692 - DNA, 50 bp, homo sapien
cacgttatcatcagggtctaaattaygtttctaaactgctactgtgacta

SEQ ID NO: 693 - DNA, 50 bp, homo sapien
actagaacaaagtcatgaataatacrgagttgaagtcagagactaactgt

SEQ ID NO: 694 - DNA, 50 bp, homo sapien
aagtgcctgcacttaattggtactayctaagtattaaaaatagctaatta

SEQ ID NO: 695 - DNA, 50 bp, homo sapien
taacacccccaactctttttttttcraagaagtcagagtcagaatcttac

SEQ ID NO: 696 - DNA, 50 bp, homo sapien
tattcattatgatgctttgaatttaygtctgcttaataattaatctgctt

SEQ ID NO: 697 - DNA, 50 bp, homo sapien
tcctttcctgaaatttggttgttcartattatcttaatctgttcagtcaa

SEQ ID NO: 698 - DNA, 50 bp, homo sapien
cccaactcagacaaggtcaagcagarcggaaatttattggaaggttactg

SEQ ID NO: 699 - DNA, 50 bp, homo sapien
tatcctgtttgtgatatgcatcaatwagagattttctatttactccatct

SEQ ID NO: 700 - DNA, 50 bp, homo sapien
tccccttttattgttctcatcctccraaatatggcagctacttttcttta

SEQ ID NO: 701 - DNA, 50 bp, homo sapien
actagtgcactaataatttagatggyaattcgtaaaaataacacactgga

SEQ ID NO: 702 - DNA, 50 bp, homo sapien
agcctcatccatttttggtgtataayaatagcttgttcttttatattatt

SEQ ID NO: 703 - DNA, 50 bp, homo sapien
tccctcagtattccaaaggtattccrgacattgtgttaaagaagataatc

SEQ ID NO: 704 - DNA, 50 bp, homo sapien
ggcaaaatgattttccaacaatgacygtatttttccacatagtaagattc

SEQ ID NO: 705 - DNA, 50 bp, homo sapien
tcaactctgataatcagcggattggyagatgtagtagcttgacaactttt

SEQ ID NO: 706 - DNA, 50 bp, homo sapien
ttgcgacttctattcctaagctgaartaaagaaactccctgcaggagtca

SEQ ID NO: 707 - DNA, 50 bp, homo sapien
ctatagttcaaattgccaactacagrcagaaacaaattaattctttaaac

SEQ ID NO: 708 - DNA, 50 bp, homo sapien
taaggcacttgcttatctgattctayagttcaaattgccaactacaggca

SEQ ID NO: 709 - DNA, 50 bp, homo sapien
cagcatcaaatctgaggactctgtamatctctctaactcttagcttattg

SEQ ID NO: 710 - DNA, 50 bp, homo sapien
cactgtcgacaagagccagacttcamaagcatctaaagaaacaaagacaa

SEQ ID NO: 711 - DNA, 50 bp, homo sapien
ggcggcgttggttgaggggagtgaaygggttatatctattgaaaatctac

SEQ ID NO: 712 - DNA, 50 bp, homo sapien
tcaggaaattatttctaggtgtttayatgaggaaagaggaaaagctgctg

SEQ ID NO: 713 - DNA, 50 bp, homo sapien
tccaatgaatgactttcttggcaaayagtgacacacagaatgttcattaa

SEQ ID NO: 714 - DNA, 50 bp, homo sapien
caccaccacatgccatcattataggyactgctacaccatcaccagggact

SEQ ID NO: 715 - DNA, 50 bp, homo sapien
aactggtggttccccgtaggaatcayatcgataatgtttaactcatgtta

SEQ ID NO: 716 - DNA, 50 bp, homo sapien
tcctccatcagccctgtcttctccaygattagcagagtgaattcctaagg

SEQ ID NO: 717 - DNA, 50 bp, homo sapien
ctctctcaagtttataggatcaaatsaggtaatgttggtaaaatcacgaa

SEQ ID NO: 718 - DNA, 50 bp, homo sapien
tatttccagtgctgttggtaaacacractaatccaagaagaaattaaaat

SEQ ID NO: 719 - DNA, 50 bp, homo sapien
ataaactctcttttatttgtattaaygaaaatgaggattaaaaggtcgag

SEQ ID NO: 720 - DNA, 50 bp, homo sapien
cgtgctgtgggctgtgtttcctttcyagactgctggggcctctgcttgcc

SEQ ID NO: 721 - DNA, 50 bp, homo sapien
tggctgggccttacttccccacttayacgcattgagactgcttgtacttg

SEQ ID NO: 722 - DNA, 50 bp, homo sapien
gtaatgaggattgttaaggaatgaawgtatcacccagcttgggcaatgag

SEQ ID NO: 723 - DNA, 50 bp, homo sapien
ggggtgtgtcaggtgtgtttgtgtakaataaacctctttcaaaaagtgta

SEQ ID NO: 724 - DNA, 50 bp, homo sapien
agtaaattgtcccataaaatgcatarctaaatattacagatttggacatt

SEQ ID NO: 725 - DNA, 50 bp, homo sapien
cacctgacacaccccaataataccayaccccaatactacctgctgtggta

SEQ ID NO: 726 - DNA, 50 bp, homo sapien
attaaagctgagccacagacagttcmcattggtgttttttaagaactgat

SEQ ID NO: 727 - DNA, 50 bp, homo sapien
tacaaagtgttggggatggtagagamcaacgtagtgcccgggttgggttg

SEQ ID NO: 728 - DNA, 50 bp, homo sapien
actagtgcctaaaatacaggagatayacaatgcatgttctttgaatgaat

SEQ ID NO: 729 - DNA, 50 bp, homo sapien
cttttgtgtagcagctctctcatcaratgattgtcatgatgatacagcag

SEQ ID NO: 730 - DNA, 50 bp, homo sapien
aagaattttagtggtgtggatagatsaaacaagacacagtatttccttaa

SEQ ID NO: 731 - DNA, 50 bp, homo sapien
ttgtctgcttgtctccatagtcaacygtatcacaagatcttcttgatctt

SEQ ID NO: 732 - DNA, 50 bp, homo sapien
tattattattactcttatttttccaygggcatagtgtatttgtacagaga

SEQ ID NO: 733 - DNA, 50 bp, homo sapien
atggggtaaagatggtacaatccacygaaaaagatatgcttcgtttgaga

SEQ ID NO: 734 - DNA, 50 bp, homo sapien
ccagaactattaagaacaccaattgyaatcactgtcagtccttgggggac

SEQ ID NO: 735 - DNA, 50 bp, homo sapien
atgtagaaatcctgcccttgagagayaaggctgaattcactagaggctga

SEQ ID NO: 736 - DNA, 50 bp, homo sapien
ggcagctactgcttatacaatgacamgttgagaacaataaaaccatatta

SEQ ID NO: 737 - DNA, 50 bp, homo sapien
gtatagctgttggaattaaaaaatastatcactctttgtgggcatcattc

SEQ ID NO: 738 - DNA, 50 bp, homo sapien
attcatgtaatctctctacattatayagaagtgctccaagaatgagaaaa

SEQ ID NO: 739 - DNA, 50 bp, homo sapien
catttggtaagtctcatggtcccagsaagatttgagaaaaagtccttgag

SEQ ID NO: 740 - DNA, 50 bp, homo sapien
gatggaatattttgcatgcttgtaayctgcctatgcacagtgagctgcag

SEQ ID NO: 741 - DNA, 50 bp, homo sapien
tttccagtagtttttctcaagctcawcctccaagaactctaataactctc

SEQ ID NO: 742 - DNA, 50 bp, homo sapien
tcaagagttcttaatgccacccttaygctatggaagtggtaactttcatc

SEQ ID NO: 743 - DNA, 50 bp, homo sapien
actggtgttttgcaagctgtcaagcmatgtcatatatttctctcaattga

SEQ ID NO: 744 - DNA, 50 bp, homo sapien
aatttgatctcttagaaaatcccctsaattcaaatggaatagactctatc

SEQ ID NO: 745 - DNA, 50 bp, homo sapien
ctgtgagtcagacccctgacagtcamtaccaattccacctcagctttctg

SEQ ID NO: 746 - DNA, 50 bp, homo sapien
gtatataattctaagttaaacatacractcagaaaagcagtgcagtataa

SEQ ID NO: 747 - DNA, 50 bp, homo sapien
tctgtccggtctagtcccaggctacrctgttttcataatttaataagcgg

SEQ ID NO: 748 - DNA, 50 bp, homo sapien
ttgatctaatacaatttgaatttcaytaacaccactccatgatcactgct

SEQ ID NO: 749 - DNA, 50 bp, homo sapien
ttctcacttccaattcatgctttgawctaatacaatttgaatttcattaa

SEQ ID NO: 750 - DNA, 50 bp, homo sapien
taagcaaaggtcatcttacattgacratactagaaatttgggtaggaagg

SEQ ID NO: 751 - DNA, 50 bp, homo sapien
ttattaaagtggagtgtatttattcmatttattaaacaggaatatttgaa

SEQ ID NO: 752 - DNA, 50 bp, homo sapien
gctgacagtaccatagatcatgtcarctagcattcttattaatttcctgc

SEQ ID NO: 753 - DNA, 50 bp, homo sapien
ggaaatcattcacttcaagggtgcarataaagactgagtgaggagactga

SEQ ID NO: 754 - DNA, 50 bp, homo sapien
aattgccctcatcatttatgtgtgamtattttaatacacaggcctagaaa

SEQ ID NO: 755 - DNA, 50 bp, homo sapien
aaaagagtattaagtaatatgaagargcatccaaaagaaagtgggaattg

SEQ ID NO: 756 - DNA, 50 bp, homo sapien
gcatatgtttattcaattataaggakagcatttactcaattttggacaca

SEQ ID NO: 757 - DNA, 50 bp, homo sapien
gtccaaaatttaggggaaaatagaargcatttagataaaaaagaatgtta

SEQ ID NO: 758 - DNA, 50 bp, homo sapien
ttgttgtggttctggcaaataaaacygccactgtgaggaaaaattaacca

SEQ ID NO: 759 - DNA, 50 bp, homo sapien
agttggagactgctgatctggagtaygtaaatagttgttatactgcattg

SEQ ID NO: 760 - DNA, 50 bp, homo sapien
attgtgttcagtgctcttagggattmaaaaataagacaaaagggatctta

SEQ ID NO: 761 - DNA, 50 bp, homo sapien
ggggagattttttccaacctactaargaatcaaagagagagagtttcttg

SEQ ID NO: 762 - DNA, 50 bp, homo sapien
tgttttcagtaaaactatactcctamatcttttgcaacggaaacactttt

SEQ ID NO: 763 - DNA, 50 bp, homo sapien
tgttcaaaactcaaaatgttgtgacraaattggggaaacttttatgtcta

SEQ ID NO: 764 - DNA, 50 bp, homo sapien
ttctcccacttgttcttcattcctayatttattcaacttcccttataatc

SEQ ID NO: 765 - DNA, 50 bp, homo sapien
gcagggaccttcctttgtgttaatcmaccttgcactaccctgaagatctg

SEQ ID NO: 766 - DNA, 50 bp, homo sapien
ttttttaaaggaaagagaaaaggaamcatttgtgaatcagcggttaccaa

SEQ ID NO: 767 - DNA, 50 bp, homo sapien
actgatagaataaatgaaaaagtgaytagtgaaggagtaaataagtaaat

SEQ ID NO: 768 - DNA, 50 bp, homo sapien
ttgtgccttcagtttaggtagatgarccaaaagatcccttcaaagcttaa

SEQ ID NO: 769 - DNA, 50 bp, homo sapien
tcataacaaataaattttagatctcraaagaacattagaaataatctaat

SEQ ID NO: 770 - DNA, 50 bp, homo sapien
gcttaccccaactgtcagaattcaayatcatttttatccccacgttcatt

SEQ ID NO: 771 - DNA, 50 bp, homo sapien
ttgctcaaactaaaaagccctgaacraccttaattgcctctattgtcatt

SEQ ID NO: 772 - DNA, 50 bp, homo sapien
cttttagaaaatcctttagttccaaycatgaagcattccaatgtctcaga

SEQ ID NO: 773 - DNA, 50 bp, homo sapien
acaggttggtcattcaactctagacrctatggacaggaaccttcatgaaa

SEQ ID NO: 774 - DNA, 50 bp, homo sapien
agtgcctggtacctgttattatgtgyattagccaaagggaagcaagttgt

SEQ ID NO: 775 - DNA, 50 bp, homo sapien
agtcccacatgcagattgcttgagtyacgttgatcttctggctatttccc

SEQ ID NO: 776 - DNA, 50 bp, homo sapien
gcaaaatgatgggtttgaggctacaytgagcaggagtagctttgggcctg

SEQ ID NO: 777 - DNA, 50 bp, homo sapien
tgttaggaattggtaataggataaargatgttctatttttggtgtactcc

SEQ ID NO: 778 - DNA, 50 bp, homo sapien
taagatgcttctggagcaatgttgcmctaatccatctgtgcattcttctg

SEQ ID NO: 779 - DNA, 50 bp, homo sapien
accacttctcaggctatccagagatkaaaaataggcttcactctcacatt

SEQ ID NO: 780 - DNA, 50 bp, homo sapien
ctatgtgcaagcttgggcaacaaaamacgttactaattatctcctagaaa

SEQ ID NO: 781 - DNA, 50 bp, homo sapien
ccataatggaaataatcttctctcaratacaaaaacataatcagaaaatt

SEQ ID NO: 782 - DNA, 50 bp, homo sapien
ccctcagcacactcagccctggaccratgtgactggagatgtcttgagat

SEQ ID NO: 783 - DNA, 50 bp, homo sapien
aataaatccaaatacccttatagtargtacaccatttataacagggaagt

SEQ ID NO: 784 - DNA, 50 bp, homo sapien
catttccgtctaatgaaattggtctmacagttttaatgagggaaaattct

SEQ ID NO: 785 - DNA, 50 bp, homo sapien
gaaatgatgacattatggttttgacsgaagaatctgaaggtgatgtgcgg

SEQ ID NO: 786 - DNA, 50 bp, homo sapien
ttggaagactataaactcctcccacyactgttattgtaagtacaggtata

SEQ ID NO: 787 - DNA, 50 bp, homo sapien
ctttcctttattctgtgttatctacmagattttaatgatatttgattatg

SEQ ID NO: 788 - DNA, 50 bp, homo sapien
tggtccttttattcaaaactcattcyacaaataaccaagtattgattctg

SEQ ID NO: 789 - DNA, 50 bp, homo sapien
cttttctcacctccatttggagataygtgaagtctaacacccaaaataga

SEQ ID NO: 790 - DNA, 50 bp, homo sapien
atacaacaggactgtctcaaacaaaktgatcataaatttgagatgtatgc

SEQ ID NO: 791 - DNA, 50 bp, homo sapien
ggtcactcttgcattagttcctttamaatgatgttaattttctttcccaa

SEQ ID NO: 792 - DNA, 50 bp, homo sapien
tcctgaattttcagatgaggaaaccrggatccatttatgtggccaatggc

SEQ ID NO: 793 - DNA, 50 bp, homo sapien
gggctccactccggaggggcggcacrgattgaaatagctgaggcaagttt

SEQ ID NO: 794 - DNA, 50 bp, homo sapien
atgagctctgcatattcaaaacacargtaattgatagtccaatttaaagt

SEQ ID NO: 795 - DNA, 50 bp, homo sapien
taaaaagcctactataaagagatcartaattacacctggtatttattcag

SEQ ID NO: 796 - DNA, 50 bp, homo sapien
cagaaatgattggaaatgatcgaaaygctggtcatctaggggaccctctg

SEQ ID NO: 797 - DNA, 50 bp, homo sapien
gtaaatgaggatttatgaggcatcasagagatcaagtaaacttgcttaag

SEQ ID NO: 798 - DNA, 50 bp, homo sapien
gtcatcatcaaccacatttgacagakaaggagactgatgatcagaaagtt

SEQ ID NO: 799 - DNA, 50 bp, homo sapien
aatgcatcctcccattggcaaacacraggaatttacttatggaatcgtat

SEQ ID NO: 800 - DNA, 50 bp, homo sapien
cttgattgcaatatatactttcaaakcacacagaaatcaagttcctttca

SEQ ID NO: 801 - DNA, 50 bp, homo sapien
aattgaggacttctggatgctcatayaagtagaataaaggaataaaatca

SEQ ID NO: 802 - DNA, 50 bp, homo sapien
atgtgacttcttacaaggacataggyatcttttttcttttatttttattc

SEQ ID NO: 803 - DNA, 50 bp, homo sapien
tcaatctgtctgacatttttcatgayacaatatttgtaggaaaaaaatac

SEQ ID NO: 804 - DNA, 50 bp, homo sapien
ccgatttcttctgtgttcaatgttaraaatacttttggaagactgatttt

SEQ ID NO: 805 - DNA, 50 bp, homo sapien
acaactacagtatctagaacagtgaycataacaaaagcaagcaatgctat

SEQ ID NO: 806 - DNA, 50 bp, homo sapien
caactgcattctgagacctaagggarcacagcaaaaggaaattaattcct

SEQ ID NO: 807 - DNA, 50 bp, homo sapien
acctttacttagagttacagggaaamacagtacattctttgtgtatggta

SEQ ID NO: 808 - DNA, 50 bp, homo sapien
gtttaagctcacttctgaactgccaragttatgttggatgttatgttgta

SEQ ID NO: 809 - DNA, 50 bp, homo sapien
tccaggttcatccaggtttgtagcaygtatctgtatttcattccttttta

SEQ ID NO: 810 - DNA, 50 bp, homo sapien
gccatggaaggagacaggaaaccccragtgatgtgtaggaataaaactaa

SEQ ID NO: 811 - DNA, 50 bp, homo sapien
tgaaaagtgctatagagtgagccaamggcaggcttgtgcatggatctatt

SEQ ID NO: 812 - DNA, 50 bp, homo sapien
aatatttcacacatagtagatgatcmgaatatttatagaattgatacatt

SEQ ID NO: 813 - DNA, 50 bp, homo sapien
ggaggacatgttgatgtgaaaagaayaggaaatttatccttgaaaattca

SEQ ID NO: 814 - DNA, 50 bp, homo sapien
gtaacatatagaacacttctattcayaagtggttgcaaagctgatgccat

SEQ ID NO: 815 - DNA, 50 bp, homo sapien
cgtaacctctggtaacattttcttcyatttatagccattgagaatatttc

SEQ ID NO: 816 - DNA, 50 bp, homo sapien
atggggtaatagttggagcaagagarggtttttgttctgtttaacactga

SEQ ID NO: 817 - DNA, 50 bp, homo sapien
atgtagcaggtggggtgttggaaacrgttcccaattaggagccaggatac

SEQ ID NO: 818 - DNA, 50 bp, homo sapien
ttacatcctgaatgcctaccacatartaagtactcaaaaatacctgtgaa

SEQ ID NO: 819 - DNA, 50 bp, homo sapien
tgttgtttcttagctagattagtaartatgtaatcaactggggatcatgc

SEQ ID NO: 820 - DNA, 50 bp, homo sapien
cattcattcagtcaaaacttactgamtaccttcaatgtccccagccctcc

SEQ ID NO: 821 - DNA, 50 bp, homo sapien
tcttccatgtcccataggtaggaaaygaaaagctgaaagtccaaaatgta

SEQ ID NO: 822 - DNA, 50 bp, homo sapien
tcatgtcttagtctgttcaggtaacyatgacaaaatactatcatctgagt

SEQ ID NO: 823 - DNA, 50 bp, homo sapien
ctttctcgagtaggctgatttaactmagagtagtattgaaacgcagaaca

SEQ ID NO: 824 - DNA, 50 bp, homo sapien
ggcaagaggaaaggacataaaaatcragcgtgggcttgctaaattcaaga

SEQ ID NO: 825 - DNA, 50 bp, homo sapien
aattttatatcctggtaatctgtacraccaagagatataccaccctttta

SEQ ID NO: 826 - DNA, 50 bp, homo sapien
ctctaagactacaagtaaaacaaaamttctaatcacaactggctcttata

SEQ ID NO: 827 - DNA, 50 bp, homo sapien
agaaggtaggtgttctactgcatggrcatctcagcagccatccatcctag

SEQ ID NO: 828 - DNA, 50 bp, homo sapien
acatcttcttggcatcctgagttacygatcaattgaatgaacatttatca

SEQ ID NO: 829 - DNA, 50 bp, homo sapien
ctgtatgtcttgaaacatcattctayacaaaactgtacattaatacaaca

SEQ ID NO: 830 - DNA, 50 bp, homo sapien
cttcaggagactaagtggctaaatayctgttttcctattagctcattgaa

SEQ ID NO: 831 - DNA, 50 bp, homo sapien
cacttgagtctgtttccagtagttcycgttgtacagtgctaccaatgtcc

SEQ ID NO: 832 - DNA, 50 bp, homo sapien
ttgtattcactatgctagtccataayaagataattttaatcactgagtta

SEQ ID NO: 833 - DNA, 50 bp, homo sapien
ttatgcttgttagtgttgtgctacayggcttgataagtttttctcataag

SEQ ID NO: 834 - DNA, 50 bp, homo sapien
ctaaatgttttatattggaaacccamaatttatgaatctaaatgaatctg

SEQ ID NO: 835 - DNA, 50 bp, homo sapien
tcaaatactaaaataatccaagcatsaattaggagcttctggatgtgtta

SEQ ID NO: 836 - DNA, 50 bp, homo sapien
tccatgttatcttccattactttccmagctgtatctgatgatctagggaa

SEQ ID NO: 837 - DNA, 50 bp, homo sapien
ctagtttggctcggtgctcgcagtcmatgtttgcaaacaaccaggtgcca

SEQ ID NO: 838 - DNA, 50 bp, homo sapien
gatgaatggagagatttaaacatatwacatcatttgagtctcatagcatc

SEQ ID NO: 839 - DNA, 50 bp, homo sapien
gagagaagaggcagcagaattagcayggcattgtgggatgaattatatcc

SEQ ID NO: 840 - DNA, 50 bp, homo sapien
gtgggctttgtcctaagaagtgttamggaactgggttctgagaacatgtg

SEQ ID NO: 841 - DNA, 50 bp, homo sapien
aaagtaaatgaaaaatatagatccaratggttaccaactaatctgtcaag

SEQ ID NO: 842 - DNA, 50 bp, homo sapien
aaccaaattctacatggatcgaaggwcagaaacaagtctagatattggtt

SEQ ID NO: 843 - DNA, 50 bp, homo sapien
atgtattggtgtcttagtaaacgaayccaaatttagctaatttatctcat

SEQ ID NO: 844 - DNA, 50 bp, homo sapien
aaagaagaagaaagaatcctgctaamatctttctatggctaaactataat

SEQ ID NO: 845 - DNA, 50 bp, homo sapien
attaccaagcttcctatctctaaaawcatccaagcagagactaaatagtt

SEQ ID NO: 846 - DNA, 50 bp, homo sapien
aattaaatctatacctgcaatatcayagaatacaatataggaagcaagct

SEQ ID NO: 847 - DNA, 50 bp, homo sapien
aaacagtatttgcacaaataacaccrccatgtaaagtgtggaaggagttt

SEQ ID NO: 848 - DNA, 50 bp, homo sapien
cgtttaggtattacatagactgaaamgagaaggaagacagaatccctgaa

SEQ ID NO: 849 - DNA, 50 bp, homo sapien
aaagctcccacttccaaataccatarcgttagagatttaagcttcagcat

SEQ ID NO: 850 - DNA, 50 bp, homo sapien
gaagttagagcagtgtaaaataagcrcaaggcccaggacttttaaagcta

SEQ ID NO: 851 - DNA, 50 bp, homo sapien
cggttcagtcttatctcctttaagaygctttcctgaaactttcagattag

SEQ ID NO: 852 - DNA, 50 bp, homo sapien
atgactcctagtaactcaatacaaaytttgcaagcaagagaccatggaac

SEQ ID NO: 853 - DNA, 50 bp, homo sapien
gagtatattgcaaaaacctgtctacmgaaaagtaacacttatggactgac

SEQ ID NO: 854 - DNA, 50 bp, homo sapien
tgttggaggaactaatgttatgttaycttttagagcttcctgttcttttc

SEQ ID NO: 855 - DNA, 50 bp, homo sapien
catagacccacttgttttctctaaamgcgtacctgcccactattacctga

SEQ ID NO: 856 - DNA, 50 bp, homo sapien
tttaggtatcatttcaaccaatcaamtgttcacagacttgtagaaaaggc

SEQ ID NO: 857 - DNA, 50 bp, homo sapien
gaaacagtgggaactactccctaagkctgttaaccaataccagttccttc

SEQ ID NO: 858 - DNA, 50 bp, homo sapien
atatttgaaacaggtatttcccagcmaggatagtacaaagtgtataaatt

SEQ ID NO: 859 - DNA, 50 bp, homo sapien
acacacaaaataaactagggcaatamaatatgagaagcaaattacatttt

SEQ ID NO: 860 - DNA, 50 bp, homo sapien
caccctccagagataatgaaggcgargaatccaatttgaactccctggga

SEQ ID NO: 861 - DNA, 50 bp, homo sapien
gtcaggagtgtatctaaatattcaastctatctaaaaagattctgtaatt

SEQ ID NO: 862 - DNA, 50 bp, homo sapien
gttgtttataattgggtctttttaayccagcatgataatctttgccttct

SEQ ID NO: 863 - DNA, 50 bp, homo sapien
taaaaaacattgagctcataatagasagtagaattatggttattagaagc

SEQ ID NO: 864 - DNA, 50 bp, homo sapien
ttgcttcaccttgtaagcaaccactsagtattttcataaagtactacaag

SEQ ID NO: 865 - DNA, 50 bp, homo sapien
tgtagctgtctcaggttctaaaagcmataatgacttcttagtaaagacat

SEQ ID NO: 866 - DNA, 50 bp, homo sapien
aagacatttcaggttacagtgatgarctcagaggaacctttcagggtaga

SEQ ID NO: 867 - DNA, 50 bp, homo sapien
acaaaaaaccattcttatttccaagrccaagaaacctcccgtgtggttag

SEQ ID NO: 868 - DNA, 50 bp, homo sapien
ggaccaaatcttcaaaatcccaaaarttacaaaacataccaagatagaga

SEQ ID NO: 869 - DNA, 50 bp, homo sapien
gaggataacctgactagccctatacractaaagaaatgtatttgtaatta

SEQ ID NO: 870 - DNA, 50 bp, homo sapien
tcttattttgtaaatatacctttgakaatcttaccatggtttacatttcc

SEQ ID NO: 871 - DNA, 50 bp, homo sapien
atgatcttcacactgaaactctgaargacatatatctttggggcactgag

SEQ ID NO: 872 - DNA, 50 bp, homo sapien
cttaatatacttagccaatcccttayggaacaacagaattatatagaatg

SEQ ID NO: 873 - DNA, 50 bp, homo sapien
tcacatagcactatatattttggtcraatttacatacaaaagcagcaaca

SEQ ID NO: 874 - DNA, 50 bp, homo sapien
ttggatagttgtacctaaacatctayactacagaattcctgctcccagaa

SEQ ID NO: 875 - DNA, 50 bp, homo sapien
ggtaactggaaacctagccaagctcratgatgaacgcagccatgtgagtg

SEQ ID NO: 876 - DNA, 50 bp, homo sapien
accttataaaagaaatttagtgaaartaagtctctttgaagtaatgttta

SEQ ID NO: 877 - DNA, 50 bp, homo sapien
tgcatatacatacaggtttatttaartgattggatctacacttttggagg

SEQ ID NO: 878 - DNA, 50 bp, homo sapien
ggagagcacagctaatgggagtgcamgtaagaagaggactaaaacgtaat

SEQ ID NO: 879 - DNA, 50 bp, homo sapien
actaggaaaagagatacaccattaartaccaagcagtaatttggagacaa

SEQ ID NO: 880 - DNA, 50 bp, homo sapien
caaaggctggtgggacttaacattcragtgaagaggacctagcactgaag

SEQ ID NO: 881 - DNA, 50 bp, homo sapien
tgttatcaacgttctccatttcattmaaaaacttcagtgctaggtcctct

SEQ ID NO: 882 - DNA, 50 bp, homo sapien
tttcagagagggctatttcagttcartatgagagccattcaaaaacacaa

SEQ ID NO: 883 - DNA, 50 bp, homo sapien
cttagtattcaagaagaacatatcartaagccaatcctagagctttggga

SEQ ID NO: 884 - DNA, 50 bp, homo sapien
agtcctgaagaataaaacgttaagcragttattatgctgactacaacacc

SEQ ID NO: 885 - DNA, 50 bp, homo sapien
tctaaaacgcattcatctgctttccygcaaagaaaaggtcagaatgctga

SEQ ID NO: 886 - DNA, 50 bp, homo sapien
actgctcttaagagttttcacatccraagctaaccttgggagggggcttc

SEQ ID NO: 887 - DNA, 50 bp, homo sapien
cctgttcaaatgagcgtggagatcasaaagtattctttaaagggtgagtg

SEQ ID NO: 888 - DNA, 50 bp, homo sapien
ggccagatagagcactgaggaataaytgagtatagctggaggggatgatg

SEQ ID NO: 889 - DNA, 50 bp, homo sapien
gggttgtggtgtgtatcgttatgtaygtttatgtctctcgtgctcagtat

SEQ ID NO: 890 - DNA, 50 bp, homo sapien
taaaatcccaaacatactgctcatcratctcctaaactttctctttttca

SEQ ID NO: 891 - DNA, 50 bp, homo sapien
ggttggggagcgattgtagaaagtamattccaactgcttatatttttctc

SEQ ID NO: 892 - DNA, 50 bp, homo sapien
acagagctgctttatgtaactagccraagttttaacatagaaatattact

SEQ ID NO: 893 - DNA, 50 bp, homo sapien
ctctgctcaagattcagagtcctacragaagcagactgactgccctagtc

SEQ ID NO: 894 - DNA, 50 bp, homo sapien
agcgaccttgatgacttgaaaggagkacgagatgaatatgtccaaaaata

SEQ ID NO: 895 - DNA, 50 bp, homo sapien
gaaaaagataatgtacgaaatcatayattttgagctttcctcaagtcaag

SEQ ID NO: 896 - DNA, 50 bp, homo sapien
tttctccagcccagaaagcaagcgartactaaattcccaggccaggtccc

SEQ ID NO: 897 - DNA, 50 bp, homo sapien
agggctttcctgatttatatagtgawgagttggtttaacataagaatgga

SEQ ID NO: 898 - DNA, 50 bp, homo sapien
gaccaccaattggatactgtgaggcyatcccaaaagtgagtcctgccaag

SEQ ID NO: 899 - DNA, 50 bp, homo sapien
gaagttactttcctgttaggttaaayaggaagtctgaaatgaagagtctt

SEQ ID NO: 900 - DNA, 50 bp, homo sapien
tcttcctttatcactcactttcaagraaacaactcaagttctatcaccag

SEQ ID NO: 901 - DNA, 50 bp, homo sapien
gtgtctggccctacctggtgtgacarcttataaaagaacagatgagatga

SEQ ID NO: 902 - DNA, 50 bp, homo sapien
tggtggaggacagctcccatcaggargtttaaaagaggcagtaagactgc

SEQ ID NO: 903 - DNA, 50 bp, homo sapien
gtctggagtgagatggttctgggaartggaggcagaaaagccaatggtct

SEQ ID NO: 904 - DNA, 50 bp, homo sapien
atggctcttgatgagtgtcctgctgsaattagcattagctgacagtaata

SEQ ID NO: 905 - DNA, 50 bp, homo sapien
ctttttattaactccagcaataaaayggtgaagtcactttgttacttagt

SEQ ID NO: 906 - DNA, 50 bp, homo sapien
catgaaagtttacaaataaaacaacsactcacaatcagcctaacacttct

SEQ ID NO: 907 - DNA, 50 bp, homo sapien
aaaattttaagaggctgacagcaaawgatattcacaattcaatttatttt

SEQ ID NO: 908 - DNA, 50 bp, homo sapien
ctaaaagaaaaatacaaagtcaccaygtagtcttatgcattctctaattc

SEQ ID NO: 909 - DNA, 50 bp, homo sapien
ggaatgggagccctagttgcagtaaygtgtcataataaataattgcatat

SEQ ID NO: 910 - DNA, 50 bp, homo sapien
gtctgtgaaagaagccattaaggtayggaaaaattgagatgtatgaccaa

SEQ ID NO: 911 - DNA, 50 bp, homo sapien
atctgtccatgttcagctatccaackcatggaataggaccaaaagaaaca

SEQ ID NO: 912 - DNA, 50 bp, homo sapien
ttatataacactaataacaccaatastaacactgggactttctacatgct

SEQ ID NO: 913 - DNA, 50 bp, homo sapien
cccataatcatacccgttgcttggartagttcccggctccctatctcaag

SEQ ID NO: 914 - DNA, 50 bp, homo sapien
gagtagaataagaggaatgatacttsaaattattgtgaggattgagatca

SEQ ID NO: 915 - DNA, 50 bp, homo sapien
tgactgcagatgacaaagagattatyagaacctgattttgacccatttcc

SEQ ID NO: 916 - DNA, 50 bp, homo sapien
tagtgtgactttgagggtagcattgyagttatgttggaagttgtcctagt

SEQ ID NO: 917 - DNA, 50 bp, homo sapien
gcttgtttgattatgatgtcagccayatttggtagtgtaattagcgctac

SEQ ID NO: 918 - DNA, 50 bp, homo sapien
aggttgaggatacaaaggtaaacacwacatgatccttgccctttgaaaca

SEQ ID NO: 919 - DNA, 50 bp, homo sapien
cctatttattcacttgagcattctgratatcattgacattttctttgact

SEQ ID NO: 920 - DNA, 50 bp, homo sapien
gcatggtaaaaaatctactctatatsagaaaatgtgtgggaagtcagaga

SEQ ID NO: 921 - DNA, 50 bp, homo sapien
gataaaaatattatccaaaatgaacrcaagccaggctgacatttcactgg

SEQ ID NO: 922 - DNA, 50 bp, homo sapien
gaagaatctggcattataagctacayctaaccatatggcttgttcttcag

SEQ ID NO: 923 - DNA, 50 bp, homo sapien
tcccttataagcaacacatcttgagraaactaataactcccactgtgtat

SEQ ID NO: 924 - DNA, 50 bp, homo sapien
atattcaggacaataaaaaaaattayagttcttgagtctaaggatttgca

SEQ ID NO: 925 - DNA, 50 bp, homo sapien
atcagtcaggagctcagattccataycatcagagaaatattttaaaggcc

SEQ ID NO: 926 - DNA, 50 bp, homo sapien
caggagtctcctgggactataaaaaygaaaaagaaatgtctttgggtatg

SEQ ID NO: 927 - DNA, 50 bp, homo sapien
atttcaaaaatacaaccacaactttsaaaagaactatcatatttctgaac

SEQ ID NO: 928 - DNA, 50 bp, homo sapien
ctaagcaactatttgcatttcaagaraaagtgaaaccctctcacctaaag

SEQ ID NO: 929 - DNA, 50 bp, homo sapien
ttgtattcccatgccactgatgacayagctgatattattaataatcgaac

SEQ ID NO: 930 - DNA, 50 bp, homo sapien
ttttctagatttatggctctgattayctacagttctgtctttcccagtag

SEQ ID NO: 931 - DNA, 50 bp, homo sapien
caccttggcaggggcgagggctccarcgtatagtccccggtgctcgggag

SEQ ID NO: 932 - DNA, 50 bp, homo sapien
cacagtggtcccagtgttagagagakgataaaattctattacaaagtagt

SEQ ID NO: 933 - DNA, 50 bp, homo sapien
gtgaatgttttcatttttcattagaygacattcgtaaacatacttgtgtt

SEQ ID NO: 934 - DNA, 50 bp, homo sapien
atttgcaacccactaaacgatcaccrctcttttctcctcacttgggatta

SEQ ID NO: 935 - DNA, 50 bp, homo sapien
gcttcaagagattgaatgaagaacartcactcccccatttacctacctcc

SEQ ID NO: 936 - DNA, 50 bp, homo sapien
gagggcttatgttggattgagctgawcttaaagctaaaaagaaagcaatg

SEQ ID NO: 937 - DNA, 50 bp, homo sapien
atgtctaagcacatagcaggaactcmaatacttaaacaatagctcaatga

SEQ ID NO: 938 - DNA, 50 bp, homo sapien
tatttacgttgttgcatattttattyaaccactgagaaaggatgccaata

SEQ ID NO: 939 - DNA, 50 bp, homo sapien
ctatcccatccaaaatgaggggaaastttatctcggtcaccttaaagctt

SEQ ID NO: 940 - DNA, 50 bp, homo sapien
ccagctattctgactgcaaaggaaaygccttaattgctttgtccaccctg

SEQ ID NO: 941 - DNA, 50 bp, homo sapien
tctggattcacatattaaagatgtcyagttcaagataccattttccctta

SEQ ID NO: 942 - DNA, 50 bp, homo sapien
gtatatgtttagcatgtaatcctaamagtacttctaaatggctaacttta

SEQ ID NO: 943 - DNA, 50 bp, homo sapien
ccagtgaattaggctactgataagartactgaataacaaagctgtgatca

SEQ ID NO: 944 - DNA, 50 bp, homo sapien
gtggagaggattccattctgtccgayaaccaagcgaccgatctaggagaa

SEQ ID NO: 945 - DNA, 50 bp, homo sapien
atcttacctcccaaaatcattgtgargaataactgagtgaacatctacgt

SEQ ID NO: 946 - DNA, 50 bp, homo sapien
taaaaagagcctttccagatcggggycacaatttggatgcattgaaagaa

SEQ ID NO: 947 - DNA, 50 bp, homo sapien
agataaattgatgagtcatttttcawtaatcttgatataaaatttgccct

SEQ ID NO: 948 - DNA, 50 bp, homo sapien
gttatagctcccacagatttgatcgyaactagtgtaaacacactagatgg

SEQ ID NO: 949 - DNA, 50 bp, homo sapien
caaaccatttcatttgtctggaggcraccatcttgttgagagaatgagtc

SEQ ID NO: 950 - DNA, 50 bp, homo sapien
ataacacctctgcttcagattgcacrggaagtaaggagatggtaacgtga

SEQ ID NO: 951 - DNA, 50 bp, homo sapien
ggaagtaaggagatggtaacgtgaasagacggcagaacatgctataattt

SEQ ID NO: 952 - DNA, 50 bp, homo sapien
ctttgaaattttgaaaaattgctcaygttctgagtcctgacgggctggtc

SEQ ID NO: 953 - DNA, 50 bp, homo sapien
acagagggaaactgaatcatggttaygtagctgctgctgctggtggataa

SEQ ID NO: 954 - DNA, 50 bp, homo sapien
actcctttcctccaaaaaaagtacartgctaacgtgaatagaggtagtgc

SEQ ID NO: 955 - DNA, 50 bp, homo sapien
gtgctgagctccaggaattttcacamactggtttaaaaaccagcagccag

SEQ ID NO: 956 - DNA, 50 bp, homo sapien
gattgtgtttgtgtgtctgtgttacratcctgagcaatgacaaggacagc

SEQ ID NO: 957 - DNA, 50 bp, homo sapien
tacaaacattatggtatgtccactcyacaggaaatacatttctggggagt

SEQ ID NO: 958 - DNA, 50 bp, homo sapien
ctttagtttcacctttcacaataaartctttaacttaactttgtatgtaa

SEQ ID NO: 959 - DNA, 50 bp, homo sapien
atgtgagggtcttggaaaaagaatargagtttgccaactagacaagcagg

SEQ ID NO: 960 - DNA, 50 bp, homo sapien
tgctaatgagttcctgttgataaaakgcttagatcagtgctcaggatgta

SEQ ID NO: 961 - DNA, 50 bp, homo sapien
tgcctttggcattctaaaccatttckaatttcatgaagataagtcagagg

SEQ ID NO: 962 - DNA, 50 bp, homo sapien
attggatctaacaacacaaaaataaraaacagctataactcaaagagaat

SEQ ID NO: 963 - DNA, 50 bp, homo sapien
agaaatttgcagtcatgtaaatataygaaagcagcccgtgagatgagagc

SEQ ID NO: 964 - DNA, 50 bp, homo sapien
tgttaaaggactgattattagttacraattctgctgctgtttctactgga

SEQ ID NO: 965 - DNA, 50 bp, homo sapien
tggacaatccacaggctcagatagasagaagtattagaatatttttaaac

SEQ ID NO: 966 - DNA, 50 bp, homo sapien
tatttaactaattccctattgatggrcattaaaatacttctgtaactatt

SEQ ID NO: 967 - DNA, 32 bp, homo sapien
tcctgtgcattgcatgwattctaacatattgc

SEQ ID NO: 968 - DNA, 50 bp, homo sapien
gtgggaatcatactattttaagaaartcactttggaacaatggacattat

SEQ ID NO: 969 - DNA, 50 bp, homo sapien
taaaaggaaagctttgatgtgaaaargaaattaatgagatcacctatctt

SEQ ID NO: 970 - DNA, 50 bp, homo sapien
caacctatatcttaataactaccaarctgggtcttattcattgacttaca

SEQ ID NO: 971 - DNA, 50 bp, homo sapien
tgaccagtttcaaagttgggaatcamggaggcatggatcacactacccct

SEQ ID NO: 972 - DNA, 50 bp, homo sapien
tcagtggttcagcttagttcaaagaygtggatgaagttagagaataatca

SEQ ID NO: 973 - DNA, 50 bp, homo sapien
ttaacttcacatttctctgtcaccartgataatcaaatggtctacctaac

SEQ ID NO: 974 - DNA, 50 bp, homo sapien
tcttctctcaggcagtgtcagatcayacggcaggctaccctcccagtatg

SEQ ID NO: 975 - DNA, 50 bp, homo sapien
agttagagagtaaaaatgttactgastatccgcaatagagttgatccacc

SEQ ID NO: 976 - DNA, 50 bp, homo sapien
ttatggttctgcccacaccttttcaraatgtggtgagaatgaatgacacc

SEQ ID NO: 977 - DNA, 50 bp, homo sapien
tttttttcaaagagaacattacatasatttacatgtacacatgcttacac

SEQ ID NO: 978 - DNA, 50 bp, homo sapien
agggtgattttgctctctgatttgarcacttctcagctatttgagttttt

SEQ ID NO: 979 - DNA, 50 bp, homo sapien
atatattatcttgtttattctgcacrcttgagtactctttctacaacttt

SEQ ID NO: 980 - DNA, 50 bp, homo sapien
aagcagtgtagtctaaacctataatragaaagaaaatctcttcaattagc

SEQ ID NO: 981 - DNA, 50 bp, homo sapien
actaccacttaataggtgccagacayaccaagtaatttccgtgtaattat

SEQ ID NO: 982 - DNA, 50 bp, homo sapien
gatgaattagaacataagagttatayaatttgttgtcttttttgtatatt

SEQ ID NO: 983 - DNA, 50 bp, homo sapien
ggccacagatcatggatgtttaatcyactgccactagtatttgtgcttag

SEQ ID NO: 984 - DNA, 50 bp, homo sapien
tgaatgagtggtgaaaatcagaataygggagccgaaagttactttagagt

SEQ ID NO: 985 - DNA, 50 bp, homo sapien
ttttaaacattttataataactgaaracattaaagtgagcaaatgaaatt

SEQ ID NO: 986 - DNA, 50 bp, homo sapien
gactggaaccagaactatagaaaackgacaactaaattatctttccatgc

SEQ ID NO: 987 - DNA, 50 bp, homo sapien
acacacacaaggagctcagtaaacayagaatgtaaaggaaactgtaccat

SEQ ID NO: 988 - DNA, 50 bp, homo sapien
ggctatgagagaagtagtttatggayctatattccaaactgaacagaaca

SEQ ID NO: 989 - DNA, 50 bp, homo sapien
gagttagatactaacattactgtcayccttattttacagagggagaaaca

SEQ ID NO: 990 - DNA, 50 bp, homo sapien
cctcaggatttgatcaagggtaaaayaaaggcccatggtttaaatataaa

SEQ ID NO: 991 - DNA, 50 bp, homo sapien
caactcatttcaaaatctactaacartatgaatagtatgacaaaatttgt

SEQ ID NO: 992 - DNA, 50 bp, homo sapien
ttcctaatgtatatgttctcctaaartcactttaagtgtatcaacttgct

SEQ ID NO: 993 - DNA, 50 bp, homo sapien
cacctaaggctttaaagatttggaawggcttagggtttatacccaaaata

SEQ ID NO: 994 - DNA, 50 bp, homo sapien
aaccttggctccgccacttaataacygagcaacaatgggggagttactta

SEQ ID NO: 995 - DNA, 50 bp, homo sapien
acctaatcctctccatcctttaagaycagttcaagttcagcctctgccag

SEQ ID NO: 996 - DNA, 50 bp, homo sapien
acccagtattgattaatgccctgccrataggtagccagggtcccctacac

SEQ ID NO: 997 - DNA, 50 bp, homo sapien
agaccactctctatgttaaacattayggtgagttagagatagaaaagtgc

SEQ ID NO: 998 - DNA, 50 bp, homo sapien
atcctggagtaagcaacttggttaayggtagaaccacttaattttttttc

SEQ ID NO: 999 - DNA, 50 bp, homo sapien
ccaggaataaggtactcaacatcgawcaatttttcaggtagctgaagctt

SEQ ID NO: 1000 - DNA, 50 bp, homo sapien
agcttgtctataaaagctgagtatayctgagagtgatttcctgagtctag

SEQ ID NO: 1001 - DNA, 50 bp, homo sapien
aatttttcaattaatgttcataacartcctacatccatttcatgggtata

SEQ ID NO: 1002 - DNA, 50 bp, homo sapien
gcttgccacttgttagtctatgagamggatttaagtatagaggacacggt

SEQ ID NO: 1003 - DNA, 50 bp, homo sapien
tgttcctgcttggagcttaaaataawctctgccctttgccactggagagt

SEQ ID NO: 1004 - DNA, 50 bp, homo sapien
tatgtttgaacatatatgtttaaagwctattttcagcacagtagagctta

SEQ ID NO: 1005 - DNA, 50 bp, homo sapien
ttttgacaatggcaaaaaggagaaasatggtcaacatataaaaagtgcag

SEQ ID NO: 1006 - DNA, 50 bp, homo sapien
ttctactccttaaaagacaatgacawaactttctatcgcctaagcttatg

SEQ ID NO: 1007 - DNA, 50 bp, homo sapien
tttaaattttgggtgttcagaataaytgcatgctaacactaaacctactt

SEQ ID NO: 1008 - DNA, 50 bp, homo sapien
atctaggcttcaagaaggatattacraaatagaggagatgtttaaagccc

SEQ ID NO: 1009 - DNA, 50 bp, homo sapien
ttgtctgtgtaacacagatcctaaasttgcccagctatagaagatccaaa

SEQ ID NO: 1010 - DNA, 50 bp, homo sapien
gattaatgctttgaacacttaaaagracgttatcactggggaaagggtaa

SEQ ID NO: 1011 - DNA, 50 bp, homo sapien
tcagcagtgaactcaccaatacagartaactatcctcaaagaccagatta

SEQ ID NO: 1012 - DNA, 50 bp, homo sapien
taggaaaacaaagtaatgaaaccaaktatttttaaagcaaactgatgaga

SEQ ID NO: 1013 - DNA, 50 bp, homo sapien
gtccaagtttggatgataaatttcayggtcaccctacttgatgtccagaa

SEQ ID NO: 1014 - DNA, 50 bp, homo sapien
gcctgttcttgttgatagtgttgggyaataactcctctccatcttcttca

SEQ ID NO: 1015 - DNA, 50 bp, homo sapien
aatgagaaggaaagtcataagcaacyggtgaaggaaatcagaaagaagag

SEQ ID NO: 1016 - DNA, 50 bp, homo sapien
aatatttaggctcactgttcctggaragaaaggaagaaacaaggcaggat

SEQ ID NO: 1017 - DNA, 50 bp, homo sapien
ggtaaaacatataatgtggttaaaargtcaaaagcctagacatcaaacat

SEQ ID NO: 1018 - DNA, 50 bp, homo sapien
ggtaaaaaggggaagatgagttaaayttgtctaaaaataaatgaaaatta

SEQ ID NO: 1019 - DNA, 50 bp, homo sapien
tttttttttcttatgggaggagctaraaatttaaatgtttatcaaaagcc

SEQ ID NO: 1020 - DNA, 50 bp, homo sapien
cacaacatacatttaaaacatgtaarcagaatacataacataaagccaat

SEQ ID NO: 1021 - DNA, 50 bp, homo sapien
ttcagcagactattctttaagaaacrgcacctgaagtaaagatctcttct

SEQ ID NO: 1022 - DNA, 50 bp, homo sapien
ttagggaggctaattctatgacctgyatcttaaccctgccttatatgcag

SEQ ID NO: 1023 - DNA, 50 bp, homo sapien
gtcattagtcaacatctcttaagaastaaatgtctcgggattgtgatata

SEQ ID NO: 1024 - DNA, 50 bp, homo sapien
gactatgtgcactggagcagttctgwcactcctttttgctaatttccttg

SEQ ID NO: 1025 - DNA, 50 bp, homo sapien
ctgaggatggtttcactaaactttcrcctctattcctattccacttgtta

SEQ ID NO: 1026 - DNA, 50 bp, homo sapien
attgtgaaaagaagttctgagggatwaattttcttacctaagactacaaa

SEQ ID NO: 1027 - DNA, 50 bp, homo sapien
tttggtaacaaatatcgctaaacctwactgtgaatttaggcatctctggc

SEQ ID NO: 1028 - DNA, 50 bp, homo sapien
atcaatggttaacttgatcagatgcraaacaaatcataaccactgacatg

SEQ ID NO: 1029 - DNA, 50 bp, homo sapien
cataaaatttttgccattatgcataygtgtgtctacaaatgactaggaaa

SEQ ID NO: 1030 - DNA, 50 bp, homo sapien
ttcctcacatgtttccccttcctggwatatcctttccttgtttgcctatt

SEQ ID NO: 1031 - DNA, 50 bp, homo sapien
agctccagtcctggaggaacactaaygcctagtcaaaaaattagaaaaga

SEQ ID NO: 1032 - DNA, 50 bp, homo sapien
cactgtctaaggctagcaatgcgaaraaaggactccaggctcctaaacta

SEQ ID NO: 1033 - DNA, 50 bp, homo sapien
aaaaatttcaacattttaatgtataygcacaatgcttacacacagtcaat

SEQ ID NO: 1034 - DNA, 50 bp, homo sapien
tacttagggccctgattagaagccasaatactttggatttggagttcaac

SEQ ID NO: 1035 - DNA, 50 bp, homo sapien
tgatttaggtcacgtacctctttaaygttaagcagttaggaggacataca

SEQ ID NO: 1036 - DNA, 50 bp, homo sapien
atttataaacataatcccaggataayaggttgaatttgttataaaacttt

SEQ ID NO: 1037 - DNA, 50 bp, homo sapien
agcttagttttggcatgaacttagargcataaatatgttaacttttccat

SEQ ID NO: 1038 - DNA, 50 bp, homo sapien
ctggcacttaggagacagaaatgtaycatttgacctttaaacttctgttt

SEQ ID NO: 1039 - DNA, 50 bp, homo sapien
ttcatagttattcaggaacctgtagmaagtttgaccttaatcctaagtca

SEQ ID NO: 1040 - DNA, 50 bp, homo sapien
actttgtgctgcttgctatagggtarcataagtaaacagaactctgccat

SEQ ID NO: 1041 - DNA, 50 bp, homo sapien
actatgtccagtgttgaggaaggaaytgatctctagtctcattcacctta

SEQ ID NO: 1042 - DNA, 50 bp, homo sapien
tttcagagcatactgtctctttaaayaaactctgctactacttaatcctt

SEQ ID NO: 1043 - DNA, 50 bp, homo sapien
agcaaatacagtatgagtatcaaaastgctatatctctatcaatatattt

SEQ ID NO: 1044 - DNA, 50 bp, homo sapien
taaatgtcaactttaagatctcaaartggaatataagatggtactcctgt

SEQ ID NO: 1045 - DNA, 50 bp, homo sapien
agataaagagtaaacctaattatcawtccaagtaaacttaaactttgtta

SEQ ID NO: 1046 - DNA, 50 bp, homo sapien
aggtttgtattcatgtagactgtagraaaaacattttagtaataaatatt

SEQ ID NO: 1047 - DNA, 50 bp, homo sapien
tacttaataaatgcttcgtgatttaygtatttgtcacttcttgtaacaat

SEQ ID NO: 1048 - DNA, 50 bp, homo sapien
cacatagcagcatttactttgatagyattggccagttatcaatggtagta

SEQ ID NO: 1049 - DNA, 50 bp, homo sapien
ccatgaaagtgagaaggtagagaaartaagttaatgcaggcaaaaaagag

SEQ ID NO: 1050 - DNA, 50 bp, homo sapien
tgataacagcagctccattttctacrcagggaagttgggataatcaaata

SEQ ID NO: 1051 - DNA, 50 bp, homo sapien
tgtcaaagcaattcatcaatttcatraaaaacagtacattcaaaaacttt

SEQ ID NO: 1052 - DNA, 50 bp, homo sapien
tggagggtagaaattcagtttctcargacctcaaatgaacaaaagctgtt

SEQ ID NO: 1053 - DNA, 50 bp, homo sapien
atatatagagtattttagcggtctcratagaagatctaactagccacaac

SEQ ID NO: 1054 - DNA, 50 bp, homo sapien
tagtgcctctccctattttcttctckattatattatgctaatgtttactt

SEQ ID NO: 1055 - DNA, 50 bp, homo sapien
cacagacttgttaactgtgagtgctkagacaagttatattacctctggca

SEQ ID NO: 1056 - DNA, 50 bp, homo sapien
actaaagatataattattcttaccasatgtttatgtttatgctttttgtg

SEQ ID NO: 1057 - DNA, 50 bp, homo sapien
aattgataagttgatagaaacaccawaaaattcagagaatctaaattcag

SEQ ID NO: 1058 - DNA, 50 bp, homo sapien
gtaatggagaaaatgagtgaaataasttacctaagctagagaagtggatt

SEQ ID NO: 1059 - DNA, 50 bp, homo sapien
tactcttaggtctctactataacagrcctccatgacatatgtgtttataa

SEQ ID NO: 1060 - DNA, 50 bp, homo sapien
tttctctgacccctttatttctgagragagattgttaaaagagcatcagc

SEQ ID NO: 1061 - DNA, 50 bp, homo sapien
acaaattacacacatttgggttgaargaagagaaagaactgtaataagca

SEQ ID NO: 1062 - DNA, 50 bp, homo sapien
tgcaacaagatccaaagtgttattaragtccatataaatgtcctttcccc

SEQ ID NO: 1063 - DNA, 50 bp, homo sapien
agcttataaaatactgtattcttgaytaattaactctaggcaaatatttt

SEQ ID NO: 1064 - DNA, 50 bp, homo sapien
ccgcatgcaagttctaaacatatcaygacaatcactaaatcttaaagttc

SEQ ID NO: 1065 - DNA, 50 bp, homo sapien
tttgtctccaagtttagaaatgccaygtatctatccattttcaccatctc

SEQ ID NO: 1066 - DNA, 50 bp, homo sapien
agaccagctttggagctcttggaacsaactgagcagaaatttgttagcac

SEQ ID NO: 1067 - DNA, 50 bp, homo sapien
atactgttctggtttctcttcatgayagaaatgcaactggctattagaag

SEQ ID NO: 1068 - DNA, 50 bp, homo sapien
caatgcttctctgcccttgcattaaratcgagttactaatccacaatctg

SEQ ID NO: 1069 - DNA, 50 bp, homo sapien
gtagattgttttctttactactcctsaattaaattgctaattaagctttt

SEQ ID NO: 1070 - DNA, 50 bp, homo sapien
ttgcaattaaattaaattcacccaaygtttactaaggtgtcatctctggc

SEQ ID NO: 1071 - DNA, 50 bp, homo sapien
attcatttcttcacttacccttccaytgattcattaattcaaaaattagt

SEQ ID NO: 1072 - DNA, 50 bp, homo sapien
cacacacgcaagtacacacaaaataraagttaatcaaagaatactttacc

SEQ ID NO: 1073 - DNA, 50 bp, homo sapien
cactcttctctgctgtatttttctcyatacctcttagcaccatctggcat

SEQ ID NO: 1074 - DNA, 50 bp, homo sapien
gaaacaggtctgagtccagggaaaamgtagcttaacacaaaattaaatcc

SEQ ID NO: 1075 - DNA, 50 bp, homo sapien
aatatcatcaagcagttgcttcacartattcaacaagagtatgtggaaaa

SEQ ID NO: 1076 - DNA, 50 bp, homo sapien
agtagtaggattactagattgagcaktagttttatttttaattctttgag

SEQ ID NO: 1077 - DNA, 50 bp, homo sapien
gcttcattgtgttgctaccggaaacyaagtccctcagtttgcttggaaat

SEQ ID NO: 1078 - DNA, 50 bp, homo sapien
aatatacaaatgatgaatttagagcrgaaagaggttgtaaacacagtgtg

SEQ ID NO: 1079 - DNA, 50 bp, homo sapien
ggagtcttttttaaaatctcttctaycacaaaaatattaagctttgagga

SEQ ID NO: 1080 - DNA, 50 bp, homo sapien
tgcatctaattttgcttgattatgartatgttcctggtagtcagtggctg

SEQ ID NO: 1081 - DNA, 50 bp, homo sapien
cagtggctggtaggcatcaacagaartgaaaattccaccaaaattcagct

SEQ ID NO: 1082 - DNA, 50 bp, homo sapien
tgggaaccaagttctgttttgtgtgwaaagaaagtgggtagctgcagaaa

SEQ ID NO: 1083 - DNA, 50 bp, homo sapien
gctaaaacatctattgctgcagaacragtcctctaactcagtaatagtgt

SEQ ID NO: 1084 - DNA, 50 bp, homo sapien
tttatttagttctttttgccataccrcctaatatagtaatgtagtcaaca

SEQ ID NO: 1085 - DNA, 50 bp, homo sapien
gggataactttttgcactttttccaraactaaatctgaaacagaaaagag

SEQ ID NO: 1086 - DNA, 50 bp, homo sapien
ccattgcatacacatttattccttcratgaagacttattcagtgcctgta

SEQ ID NO: 1087 - DNA, 50 bp, homo sapien
caaagttataaaatgcaatagaaaasgtggccaaataaaaaaaaattagt

SEQ ID NO: 1088 - DNA, 50 bp, homo sapien
attgcattttataactttgtacatakcgtggcatactataagtaatgata

SEQ ID NO: 1089 - DNA, 50 bp, homo sapien
tttgtgtatttttcttagatagataygaactttgaatgaggtgtgatcac

SEQ ID NO: 1090 - DNA, 50 bp, homo sapien
tcaactacttcttatgtttagtgaartatttccttgaagttcaacgtttc

SEQ ID NO: 1091 - DNA, 50 bp, homo sapien
cacagctccatgaacttttctcaccyggaattgatcacttgattatcagt

SEQ ID NO: 1092 - DNA, 50 bp, homo sapien
gagttctgttccatggagttctgggycatccttctacctcactcatggct

SEQ ID NO: 1093 - DNA, 50 bp, homo sapien
atggacagtgacaatatacttttaartcttccacactgccttccattcag

SEQ ID NO: 1094 - DNA, 50 bp, homo sapien
tgtgtccaagatgcttatttcttaasagagtaactcatgagtaaatggga

SEQ ID NO: 1095 - DNA, 50 bp, homo sapien
ctgttatccaggtgctctaaaggaayggctcaatgtgaaaatacttcgta

SEQ ID NO: 1096 - DNA, 50 bp, homo sapien
cagtagtttttgttttcacaggtcartctagcccatttgatattgatcag

SEQ ID NO: 1097 - DNA, 50 bp, homo sapien
ctccatccatatttgccctattcatkaaattcctatggtggagcagaatt

SEQ ID NO: 1098 - DNA, 50 bp, homo sapien
ttgaaagtcccaaataaatgttagasgagtaagttgtaattcataaattc

SEQ ID NO: 1099 - DNA, 50 bp, homo sapien
tgttagaaagtcaatcagtgtagtayatctaatctacttttcaggaaaaa

SEQ ID NO: 1100 - DNA, 50 bp, homo sapien
cctggacgtgttgaacttgagtcatmaaacttttaaaagtcttaggactg

SEQ ID NO: 1101 - DNA, 50 bp, homo sapien
acgatatacacatcaactatccatgraaacctctctgtcctgtcaaggat

SEQ ID NO: 1102 - DNA, 50 bp, homo sapien
gtgtctatggaaatcagtttattaaygtccggtaggataaagattgttgg

SEQ ID NO: 1103 - DNA, 50 bp, homo sapien
gcacagttctttgtgcttatcttcaytcaattctaagctaaaggattttc

SEQ ID NO: 1104 - DNA, 50 bp, homo sapien
cagagctatcactgctctgtcattasaaatcaaagcattttaactcaata

SEQ ID NO: 1105 - DNA, 50 bp, homo sapien
tgtctcaatcaaatccgccattgacrggtacctaggttgattctacatct

SEQ ID NO: 1106 - DNA, 50 bp, homo sapien
agtaataacaccctgatgtggctaakctctttacagtttgcatcattatt

SEQ ID NO: 1107 - DNA, 50 bp, homo sapien
taaagcttaagccatgtcactcaacrcttactgcttcctctcttcctctc

SEQ ID NO: 1108 - DNA, 50 bp, homo sapien
gcagctccactcagctctctttaccyaatcttctcactccaggatccaag

SEQ ID NO: 1109 - DNA, 50 bp, homo sapien
ataggtatatttaagaaatgaatacmcaactatcttcttactaagaaaat

SEQ ID NO: 1110 - DNA, 50 bp, homo sapien
tttgcaatttgtcccatacgtggtaycttttcctggagctcttcatcttc

SEQ ID NO: 1111 - DNA, 50 bp, homo sapien
cactgattaattagttacatatattkaatagtccataatttaatcttttg

SEQ ID NO: 1112 - DNA, 50 bp, homo sapien
agggaactaatttatccgtgtataaytagaacattgacagaatgaaggaa

SEQ ID NO: 1113 - DNA, 50 bp, homo sapien
tacattacaatgttaaagtggagaaygatgaatagttaatagatgctgat

SEQ ID NO: 1114 - DNA, 50 bp, homo sapien
ttatttatgtgtgcaactcgaataasaaggctaaatttttcagatatgca

SEQ ID NO: 1115 - DNA, 50 bp, homo sapien
gagggtgttaagatggaattgatttwaaaaagtctgatagtggggctgaa

SEQ ID NO: 1116 - DNA, 50 bp, homo sapien
agaggagacaagaaattgagggaccragataggacaggatggcagggaaa

SEQ ID NO: 1117 - DNA, 50 bp, homo sapien
aagtgggagtgggaaaactttatcargctcctcttattccattctttaga

SEQ ID NO: 1118 - DNA, 50 bp, homo sapien
actctgtagttttatttgatttctcyaggatgtactgaatttagaactta

SEQ ID NO: 1119 - DNA, 50 bp, homo sapien
tacaaaatgtgttgcctttttaatcrctatttatccagggaacttttttt

SEQ ID NO: 1120 - DNA, 50 bp, homo sapien
tcaattttcagagacgttataaagtraagtatcagtatagtacaaaagta

SEQ ID NO: 1121 - DNA, 50 bp, homo sapien
aaattaatttattgttttttctaggkcactataagattgatagttctaca

SEQ ID NO: 1122 - DNA, 50 bp, homo sapien
cacacactgacaatcttaagtgcagrcccttactatcacaacagcatttc

SEQ ID NO: 1123 - DNA, 50 bp, homo sapien
acagtaaaagataactacagagacakggataatttgaaaaaaagagatgg

SEQ ID NO: 1124 - DNA, 50 bp, homo sapien
cttatctgattaatgtttaacttatsaaatttattttaataaaagtgttc

SEQ ID NO: 1125 - DNA, 50 bp, homo sapien
atgacttgaagtttaattggtagtaraaacaggttcttaatgttcctgac

SEQ ID NO: 1126 - DNA, 50 bp, homo sapien
tcatgactgccttggctgtccataargttatgacttgaagtttaattggt

SEQ ID NO: 1127 - DNA, 50 bp, homo sapien
tgtacgtgtgtgagggttggaagaaytactggtttaataaaagattttta

SEQ ID NO: 1128 - DNA, 50 bp, homo sapien
aaatttttacttttgtatccattaarctgtcatgaatataaaaatgggtt

SEQ ID NO: 1129 - DNA, 50 bp, homo sapien
tacaggtgtgagccattgggccctgycaggatttgttaattttttgattt

SEQ ID NO: 1130 - DNA, 50 bp, homo sapien
aacttttccagaactccaacaattaycatgtttataaagaaataatattt

SEQ ID NO: 1131 - DNA, 50 bp, homo sapien
tataagtgagccattgtacatcaaartagcacaaacctttaggtgtgtta

SEQ ID NO: 1132 - DNA, 50 bp, homo sapien
gtcagtttcatcctctaccaattacmaatggaaataattataatacatgt

SEQ ID NO: 1133 - DNA, 50 bp, homo sapien
ttcaaaaatacagcattgtgtttaayagtagtcaggcacatcaagcttta

SEQ ID NO: 1134 - DNA, 50 bp, homo sapien
atgcaaaaagttgaaataaaattacwctatacaagttataacactaaata

SEQ ID NO: 1135 - DNA, 50 bp, homo sapien
ttaagtggccgtgactataattccastagtcaagagaatgtcctgcctat

SEQ ID NO: 1136 - DNA, 50 bp, homo sapien
taagccattgaactgcatgaaaagcmaatatggttaattaacaaatgtat

SEQ ID NO: 1137 - DNA, 50 bp, homo sapien
attttctggttattttataagcaagyacatgtgatattttggtcacatcc

SEQ ID NO: 1138 - DNA, 50 bp, homo sapien
tcaaatattttgttgatatgttaaaktgtttcaaaaggcttaataaaaaa

SEQ ID NO: 1139 - DNA, 50 bp, homo sapien
tttataagatatctatggatttaaayaggtattgtctgttgctgtctaca

SEQ ID NO: 1140 - DNA, 50 bp, homo sapien
gttgatgtggctgataattcttgaaycccactccctctaccatatttcac

SEQ ID NO: 1141 - DNA, 50 bp, homo sapien
aaaagaatcaggtatagtgagtgaargttttagaaagacaaatttcagct

SEQ ID NO: 1142 - DNA, 50 bp, homo sapien
tacgggactcaaggtctcaggagaartaacagtgctctaatcatatgtgt

SEQ ID NO: 1143 - DNA, 50 bp, homo sapien
tatctcacaaatctctttgattgaayttactaccagtatccacacacaat

SEQ ID NO: 1144 - DNA, 50 bp, homo sapien
caacccaagattaattctaaaactgkaataagacatcatagactttatat

SEQ ID NO: 1145 - DNA, 50 bp, homo sapien
ggaaagtgtgggtgaaaagtcctagratgagagaccattgcttttattat

SEQ ID NO: 1146 - DNA, 50 bp, homo sapien
ccgaagaaatttcaattatttactcwaatggtggtaataagaacaggatg

SEQ ID NO: 1147 - DNA, 50 bp, homo sapien
aatttccatttttaagctatattcastattctgcggcattcaaaaaggta

SEQ ID NO: 1148 - DNA, 50 bp, homo sapien
ctattgaaccccactttatgttcaaygatgtctaatttaattagtattga

SEQ ID NO: 1149 - DNA, 50 bp, homo sapien
gattatatctcaagacagtcaaataycttgcctaagttcagcctgagaac

SEQ ID NO: 1150 - DNA, 50 bp, homo sapien
cttcagaatgaatatttctgaaatcmaactaataacagaatgaaatatgc

SEQ ID NO: 1151 - DNA, 50 bp, homo sapien
ctatgtccattttacagattgcaaakattatatctcaagacagtcaaata

SEQ ID NO: 1152 - DNA, 50 bp, homo sapien
agtgcccccaaactcatttttagatkatcagtttcactaattttaataca

SEQ ID NO: 1153 - DNA, 50 bp, homo sapien
ggaatacgaagatagaagagtaagakagaatttgtctcattagggagtac

SEQ ID NO: 1154 - DNA, 50 bp, homo sapien
tgagtaattgctgaaacaactgctargtacttgaagaggagaatggacag

SEQ ID NO: 1155 - DNA, 50 bp, homo sapien
ataaatcagtgagccatcccaaaacrcttctagatggaaccagtcactgg

SEQ ID NO: 1156 - DNA, 50 bp, homo sapien
agtcccttctctctgttctagcaacrccacttttaactttaattctttta

SEQ ID NO: 1157 - DNA, 50 bp, homo sapien
cctgtctgttgtttttaaagtcttcratactttgctttttaacttctgca

SEQ ID NO: 1158 - DNA, 50 bp, homo sapien
gcaagagcaacacaagagtaggctgraaagagtcatgagtcagatcattc

SEQ ID NO: 1159 - DNA, 50 bp, homo sapien
aaagaccaatgtatagaagagttcaygactttactacaaatgttatttca

SEQ ID NO: 1160 - DNA, 50 bp, homo sapien
attgttttttgagtttttttaatagwagtttggccatagatttgcatagg

SEQ ID NO: 1161 - DNA, 50 bp, homo sapien
gtaaactattgtgtggttaaatccartggaatcttttaggctttatatca

SEQ ID NO: 1162 - DNA, 50 bp, homo sapien
aataaataaggaaagtgctataaaartgtgctaggataaggtgagaaggt

SEQ ID NO: 1163 - DNA, 50 bp, homo sapien
atcactgagcagtgttccattttgcrgatgtaccaaagttgaatatccat

SEQ ID NO: 1164 - DNA, 50 bp, homo sapien
caaggcaatgttgggatagccagaaygcacacatggtggtttaaacacaa

SEQ ID NO: 1165 - DNA, 50 bp, homo sapien
gaaggttaaaaataacaaacgagtamaatagttaataagtactaatggag

SEQ ID NO: 1166 - DNA, 50 bp, homo sapien
actggtacactttggagtgtgaagamaatttagacaggctctttgtattg

SEQ ID NO: 1167 - DNA, 50 bp, homo sapien
gtattcttcacatacatcctaaagckaatttgtatttatttgctggcttt

SEQ ID NO: 1168 - DNA, 50 bp, homo sapien
gtaaaccagcatcaaatctttttacrgcctattgcagtttcaagaaacac

SEQ ID NO: 1169 - DNA, 50 bp, homo sapien
tccagatgtcttcacaccacactcartcttctaaaaggcaaacctgatcc

SEQ ID NO: 1170 - DNA, 50 bp, homo sapien
cattacctgaaaaattagattcaacrattattgctaaccaaatcaacctg

SEQ ID NO: 1171 - DNA, 50 bp, homo sapien
ttcaactcccgaggaaaccattttcraatgccacagaatatgcagtgttc

SEQ ID NO: 1172 - DNA, 50 bp, homo sapien
tctgagaaaaccggaaatgattttasatgcctactgtggagaacagggga

SEQ ID NO: 1173 - DNA, 50 bp, homo sapien
ttctaaaagtaaacctttcttttacwcatagtcttaaatatctaagactc

SEQ ID NO: 1174 - DNA, 50 bp, homo sapien
aaatgtgtttggttaatcttacctgraatcttacaataacataatttcag

SEQ ID NO: 1175 - DNA, 50 bp, homo sapien
ttgaaaaattgtgagaattattaaartgtagcacagagacacaaagtgag

SEQ ID NO: 1176 - DNA, 50 bp, homo sapien
tgacattcattaggttatgggtttasctactatgatttataagatataag

SEQ ID NO: 1177 - DNA, 50 bp, homo sapien
caaaatgagtcatagaactttttgcrccaattcataataattacaatacc

SEQ ID NO: 1178 - DNA, 50 bp, homo sapien
tttccttattgctatgaaaataccastaaataaatgaaacaactatttgt

SEQ ID NO: 1179 - DNA, 50 bp, homo sapien
ctccctctttctaaaactcctttgcscttgataaagaacaaaactgatat

SEQ ID NO: 1180 - DNA, 50 bp, homo sapien
gagtacaccctatgtgtgggaagaastgtaaaacagatacatgaagttag

SEQ ID NO: 1181 - DNA, 50 bp, homo sapien
agaatgtaagtcttacctcgtgagtraatgctctctctgtcccaaattgg

SEQ ID NO: 1182 - DNA, 50 bp, homo sapien
aagccagcagatatactagatatgcraagcaacaattgaaatccatggtt

SEQ ID NO: 1183 - DNA, 50 bp, homo sapien
gcagttatgactctgtaaaaatgcaraagtttctaatgcttcagttgcgg

SEQ ID NO: 1184 - DNA, 50 bp, homo sapien
atgcagaatccctgatgaacataaargataaaagagaaaccttcaggaac

SEQ ID NO: 1185 - DNA, 50 bp, homo sapien
gcatataagtgtttcaaaattaccakgtaagcacaataaggaatagattc

SEQ ID NO: 1186 - DNA, 50 bp, homo sapien
gtgtcctgagcagttagagtttcacmaaataactcacaatcaactgttaa

SEQ ID NO: 1187 - DNA, 50 bp, homo sapien
gagtatgaagctttattaaaacttayctcctgagtgtttcaccagttttt

SEQ ID NO: 1188 - DNA, 50 bp, homo sapien
ccctctgacattatacaggttatatsaaaatcatgcctaaatattagaag

SEQ ID NO: 1189 - DNA, 50 bp, homo sapien
gtagagatacattctttaaattcacrgcttcttggttcttatattcttgt

SEQ ID NO: 1190 - DNA, 50 bp, homo sapien
ctgcctagaacagtgacatattgtargcattgaagaaatgtgttgatgag

SEQ ID NO: 1191 - DNA, 50 bp, homo sapien
ggataaatagttctggtagtagtaawgtatcaataactaaatataatatt

SEQ ID NO: 1192 - DNA, 50 bp, homo sapien
gaaaactaagaaatgaaagctctccrataagatgctacatgagaaattca

SEQ ID NO: 1193 - DNA, 50 bp, homo sapien
aatttggttttattactcttatcatkaaggtactgttaagagctgtctat

SEQ ID NO: 1194 - DNA, 50 bp, homo sapien
tgtaattctccatacaaaagtgtaaytcggaatacttgcctctagagggc

SEQ ID NO: 1195 - DNA, 50 bp, homo sapien
ctatttaaaagaatgatttcccctayggcaccatttggactgacaacagt

SEQ ID NO: 1196 - DNA, 50 bp, homo sapien
tttgcattctctgaaccttattgcaragtgaacagtaagaaatcagagta

SEQ ID NO: 1197 - DNA, 50 bp, homo sapien
tcaagaagaagcaaagaaatgataayagatgttgagaaatattggcccag

SEQ ID NO: 1198 - DNA, 50 bp, homo sapien
ttggtaactgctatgaagaacacagratgatgttatagagagaggtgggt

SEQ ID NO: 1199 - DNA, 50 bp, homo sapien
ccaaacttggacacatagtgaaagamgtgttactaaaaattaggaaatgg

SEQ ID NO: 1200 - DNA, 50 bp, homo sapien
gagtactaagtatggtcgttaatagyctaatatgaggaagtcaaaacagt

SEQ ID NO: 1201 - DNA, 50 bp, homo sapien
atctaagtatcctattaccctgtcaygtaaaaagtccgttaatgcatcat

SEQ ID NO: 1202 - DNA, 50 bp, homo sapien
tacattacattaccaggaaatcacayctagccttattatgtgatgaggct

SEQ ID NO: 1203 - DNA, 50 bp, homo sapien
catgttataactgttttgggcttaayagccagtgtttgcagtagttcact

SEQ ID NO: 1204 - DNA, 50 bp, homo sapien
aaaactcctttgcttcagcttaccartctgcaaaacgagatagtaatagt

SEQ ID NO: 1205 - DNA, 50 bp, homo sapien
tcactgctctataggaaacccattgwatatcgcttagtaaacaggattga

SEQ ID NO: 1206 - DNA, 50 bp, homo sapien
aaacaacaaaaaccaaaaattggagsaattaatgagaagagagtagtaag

SEQ ID NO: 1207 - DNA, 50 bp, homo sapien
caagaataaaccaatatttcaagacrattagcagagaaaaaaaagttata

SEQ ID NO: 1208 - DNA, 50 bp, homo sapien
tttaaacaatagcatcactctgtggwaagtgaaatgaatgtcatctagca

SEQ ID NO: 1209 - DNA, 50 bp, homo sapien
tttgactttataccctatgtcaaggkagcagtactggtttgtgacatgtc

SEQ ID NO: 1210 - DNA, 50 bp, homo sapien
aacagacttattagactaactgcaamagacagacaggcagcacaaacaac

SEQ ID NO: 1211 - DNA, 50 bp, homo sapien
cataatgaacattcactgaagggcayataaaggaaaaaaaagaaaaattt

SEQ ID NO: 1212 - DNA, 50 bp, homo sapien
aaagtattgacagaatgactaattayatgacaaaggttcaactttctatg

SEQ ID NO: 1213 - DNA, 50 bp, homo sapien
tgagaacaatttaaagccatttaggyatagagaatatcattagccatgtc

SEQ ID NO: 1214 - DNA, 50 bp, homo sapien
taagaatcattctgcacctgctttaycatcagttgaatggaatgccctcc

SEQ ID NO: 1215 - DNA, 50 bp, homo sapien
tactgagaagggatgggtggatctgrcaatcatacgttaacaaactttat

SEQ ID NO: 1216 - DNA, 50 bp, homo sapien
atcttttcattattaatgcagaatayatatcattgaactaatgaaataat

SEQ ID NO: 1217 - DNA, 50 bp, homo sapien
cagcattcaggtagtctttgccactwaatctttaacatctgagaaaccca

SEQ ID NO: 1218 - DNA, 50 bp, homo sapien
ttctattttttacaactgtaactgarcatctattcttatctgttcaaagt

SEQ ID NO: 1219 - DNA, 50 bp, homo sapien
atccactccagacaccttgcattctsactgtaacattgcttgcgcatcac

SEQ ID NO: 1220 - DNA, 50 bp, homo sapien
aggtcaaatgaaatgttcacgttcaygtctattgattttgatcttatttc

SEQ ID NO: 1221 - DNA, 50 bp, homo sapien
ctacaaatacaaagactaacaagacrgcatccatgtcctcaaaaccttca

SEQ ID NO: 1222 - DNA, 50 bp, homo sapien
agggtaagggaaattagtttttgaargcaaagccatatctcatttcaact

SEQ ID NO: 1223 - DNA, 50 bp, homo sapien
tgaagaggaatgctgtgaatgagaaragactgtaattcaaagggagagca

SEQ ID NO: 1224 - DNA, 50 bp, homo sapien
cttctggggtggtagggacaattcawctcactacagagggttttcagcag

SEQ ID NO: 1225 - DNA, 50 bp, homo sapien
aggttcgaagggaaaaggatgaaaargtggatacgcatgtaaagtggtct

SEQ ID NO: 1226 - DNA, 50 bp, homo sapien
attctacatgctacacaaagaaaagkcctagaggaggaagcatttaggtc

SEQ ID NO: 1227 - DNA, 50 bp, homo sapien
ggagaacagggagggatgcgacaatkaaataaaatgatgggcttggctat

SEQ ID NO: 1228 - DNA, 50 bp, homo sapien
gaatcatctcttcatatctgcaatawgaggataataatatgtatactgca

SEQ ID NO: 1229 - DNA, 50 bp, homo sapien
aagttatccccaccatcaccctatakgtatcacaagagttttacttggtg

SEQ ID NO: 1230 - DNA, 50 bp, homo sapien
ttgaaagtgggtgctcaggataacasagatatacaaaaacttctcttctg

SEQ ID NO: 1231 - DNA, 50 bp, homo sapien
tgtttctgtcaaacttacttgctcartatttctgaatatacctctgaaac

SEQ ID NO: 1232 - DNA, 50 bp, homo sapien
ctaaaagatcttagctaacagaatamccgtttagcttttagagaaatatt

SEQ ID NO: 1233 - DNA, 50 bp, homo sapien
atgcccagagtctgcatagtgtacarctttataaaacccctaaatgtgtc

SEQ ID NO: 1234 - DNA, 50 bp, homo sapien
atggcattgtgtagagtttatcagcrcattcatcaggatagaagatggct

SEQ ID NO: 1235 - DNA, 50 bp, homo sapien
atagcaggacaggtgaaaggaactayggaagccaaggccttgaacccagc

SEQ ID NO: 1236 - DNA, 50 bp, homo sapien
acttagtgctctgcctccatctctayctcgtttatcactgtgttccctgc

SEQ ID NO: 1237 - DNA, 50 bp, homo sapien
acttccaaatagaataactgatcgayagctttttatataggaagagagtg

SEQ ID NO: 1238 - DNA, 50 bp, homo sapien
agacaaagcaggctaagaagttttargatatggcagaacagttaaggcaa

SEQ ID NO: 1239 - DNA, 50 bp, homo sapien
tgcaactatgtagacgaaactagggwattattcttagtgaaaaaagtcat

SEQ ID NO: 1240 - DNA, 50 bp, homo sapien
atacagaaatgacacaaatgcacaartaatgtcacgaatttatgtaatgt

SEQ ID NO: 1241 - DNA, 50 bp, homo sapien
ttccttcatttattcattgacttgasagatattcactgagcaccaaccat

SEQ ID NO: 1242 - DNA, 50 bp, homo sapien
aaacagttttctcaattgtagtccaytccaacatcatatattaagtggtg

SEQ ID NO: 1243 - DNA, 50 bp, homo sapien
cctatgaggatagactgtattcaaaragataaaataggccatgaacagtg

SEQ ID NO: 1244 - DNA, 50 bp, homo sapien
ctatctaattacaatgacaaagggaracattactagagatgatattcttt

SEQ ID NO: 1245 - DNA, 50 bp, homo sapien
ttatctccctgagtgttaccctaaaygctgtcagtgctaatgatatcagg

SEQ ID NO: 1246 - DNA, 50 bp, homo sapien
ttagagatctatagcctcaatgccargaaatataaatgtctaccgacaaa

SEQ ID NO: 1247 - DNA, 50 bp, homo sapien
agctatacatctagaaaagcagaaaytgactggatgattgttcataaagc

SEQ ID NO: 1248 - DNA, 50 bp, homo sapien
agatttttaaatgagtggtaatagcyagacataaagaaggtattgatgtg

SEQ ID NO: 1249 - DNA, 50 bp, homo sapien
tatctcagattacatttcttccaaasagaaagtatatgtaaccagttcag

SEQ ID NO: 1250 - DNA, 50 bp, homo sapien
tatgtaaccagttcagatctttatayctttatgaacccagatttgagtaa

SEQ ID NO: 1251 - DNA, 50 bp, homo sapien
tgttgcggtgctatgcatatggtgargaaaacaattcccccttctcaagg

SEQ ID NO: 1252 - DNA, 50 bp, homo sapien
aatctgcaatttgtctgtccagctasaggttctacatctggatggtaggg

SEQ ID NO: 1253 - DNA, 50 bp, homo sapien
acattatttgatcctgtttaccatgmagaaaattgtcacctaaattgaag

SEQ ID NO: 1254 - DNA, 50 bp, homo sapien
gtaccattctggcctgtctataggayggtcttatgacttggacagagctg

SEQ ID NO: 1255 - DNA, 50 bp, homo sapien
tcccttcacagatgggaattttatarctatcttgccccacaggctccatt

SEQ ID NO: 1256 - DNA, 50 bp, homo sapien
acaggcttggggttaggttttcatgyaaggctagagtaggataaaacata

SEQ ID NO: 1257 - DNA, 50 bp, homo sapien
tctattattttgatcaatgagaaaasttaagtcatttagcttgcaaatgc

SEQ ID NO: 1258 - DNA, 50 bp, homo sapien
caagttatatttcattttatcatccygaaatacaagacattctgcaaata

SEQ ID NO: 1259 - DNA, 50 bp, homo sapien
aatgctgtcagtgctaatgatatcargacatggattaaataaatcctttt

SEQ ID NO: 1260 - DNA, 50 bp, homo sapien
ttaaaaatctgaatacagacatcacratcacttgatatatacttgataat

SEQ ID NO: 1261 - DNA, 50 bp, homo sapien
tattaattttctgctctatcagtggkattaaagaattcatacaatataag

SEQ ID NO: 1262 - DNA, 50 bp, homo sapien
tgtcaattattagcacaataaccaaytgataagtaacctcaaaatagatc

SEQ ID NO: 1263 - DNA, 50 bp, homo sapien
ctaacacagaaataattttcatgctwaaagtattgatacgttggtgacac

SEQ ID NO: 1264 - DNA, 50 bp, homo sapien
atttaacaatagctcactgaaatcakctaggggcacacctgtgctagaag

SEQ ID NO: 1265 - DNA, 50 bp, homo sapien
catagttaaagagaaagtggacctcrgaaaatgttctgtaaaagtgaaac

SEQ ID NO: 1266 - DNA, 50 bp, homo sapien
cttgctttaaaactttctcttcttayaggttgtgaatatttccatgcaaa

SEQ ID NO: 1267 - DNA, 50 bp, homo sapien
ttatgaactcttctttatagttgtgyacttgaatctaatcacttacatag

SEQ ID NO: 1268 - DNA, 50 bp, homo sapien
ttccaatctttggcaatttgtgctastaaaaaatgtaataagaatgtctt

SEQ ID NO: 1269 - DNA, 50 bp, homo sapien
gataacaagcatttactgttcatccrcatgagaaagagtcttaactcaat

SEQ ID NO: 1270 - DNA, 50 bp, homo sapien
atccaaatatgaggcttaattgtagyaatgttgatgaattgcatgtttaa

SEQ ID NO: 1271 - DNA, 50 bp, homo sapien
atatatgagagatatattcttactgraaataccttcaaagataatgtcct

SEQ ID NO: 1272 - DNA, 50 bp, homo sapien
taatatcaatatgatactaatgaaaycttctgttactatggtttttggtt

SEQ ID NO: 1273 - DNA, 50 bp, homo sapien
tataaaattttacctccaatataacrccaaaaatactaaatgatttaaca

SEQ ID NO: 1274 - DNA, 50 bp, homo sapien
aaatactaaatgatttaacacaacawcttattctagctctacaaaatatg

SEQ ID NO: 1275 - DNA, 50 bp, homo sapien
tctttaattgatttttcataatgtaygaggtaggaatccatatacgtttt

SEQ ID NO: 1276 - DNA, 50 bp, homo sapien
ctagcatactcgtgataatgatgtargactactgccatttctttagaatg

SEQ ID NO: 1277 - DNA, 50 bp, homo sapien
tttatcacccaaccaaagaactaggycattaccaataaattgcaacttct

SEQ ID NO: 1278 - DNA, 50 bp, homo sapien
agggttttaattggatttggaattgyattagtagtcaggaaaggtttggg

SEQ ID NO: 1279 - DNA, 50 bp, homo sapien
ttgaaaatttggtttatggtgatgaygtaattccattgaaagaaatggaa

SEQ ID NO: 1280 - DNA, 50 bp, homo sapien
taccgcaggttatctggataacaackcatggaccaaatactatatataac

SEQ ID NO: 1281 - DNA, 50 bp, homo sapien
taattatcctcctgacttacttaaaycttctgtgacattatttgaagtaa

SEQ ID NO: 1282 - DNA, 50 bp, homo sapien
caactccccacaaattaatcagaacmaatgaacttgaattatatgttaaa

SEQ ID NO: 1283 - DNA, 50 bp, homo sapien
tctcctactttagacagcataatcargaaaggtctatctaatgagatgtc

SEQ ID NO: 1284 - DNA, 50 bp, homo sapien
aaaatattgtgataaaatgtttccamcttctgtactcatatcatgcactg

SEQ ID NO: 1285 - DNA, 50 bp, homo sapien
atgaattagggttcccggacccttayagtgagtgacccatatcagacctt

SEQ ID NO: 1286 - DNA, 50 bp, homo sapien
tactgctcttccagcgatggctataragggtagcaaatatcatttgtaca

SEQ ID NO: 1287 - DNA, 50 bp, homo sapien
gcatatggcattatggcattggatamgcagagaattctgctctggaattt

SEQ ID NO: 1288 - DNA, 50 bp, homo sapien
tagccccaaagagggatgaggctgaycaaaccttcccttcactccagaga

SEQ ID NO: 1289 - DNA, 50 bp, homo sapien
taatactattttttatgcaccttacygaacaagagtatgctaaggccaat

SEQ ID NO: 1290 - DNA, 50 bp, homo sapien
tatgccatgtaatctataaaatgtawcaaaaagagttaaatataataaga

SEQ ID NO: 1291 - DNA, 50 bp, homo sapien
tcatagctggttctatactcacttgyaaatcattttagtattggaaggct

SEQ ID NO: 1292 - DNA, 50 bp, homo sapien
ttgaaataatatgagcttttggacastatgtattcagtacagactttcag

SEQ ID NO: 1293 - DNA, 50 bp, homo sapien
cagagtaatttccttctttacacaartatgagcctctaggaagagactaa

SEQ ID NO: 1294 - DNA, 50 bp, homo sapien
aaagtgtgagaaaggatttgatatgyaatcagcaggaacaaaattccttg

SEQ ID NO: 1295 - DNA, 50 bp, homo sapien
accgttagtgagcataggtacattarcacaattctgtccatttccactcc

SEQ ID NO: 1296 - DNA, 50 bp, homo sapien
attagcaaagaataaacctcatagayatttttcagaaacattaattaggc

SEQ ID NO: 1297 - DNA, 50 bp, homo sapien
atttatgctttctgtgaacagaatargtagtagaattctgacagggttta

SEQ ID NO: 1298 - DNA, 50 bp, homo sapien
aatccaccaaacccattctcaagcartacgtggggcaaaaggtaaggtga

SEQ ID NO: 1299 - DNA, 50 bp, homo sapien
aatttcatcttaacttagatgaaaayagtgttaaaagtaaacctaaaaga

SEQ ID NO: 1300 - DNA, 50 bp, homo sapien
tgctgtcacctggctattctcttgcracatactgtaactttgattgccct

SEQ ID NO: 1301 - DNA, 50 bp, homo sapien
aaaattaatacaatgtccttttagasgtcctaagtcagcacactaagttg

SEQ ID NO: 1302 - DNA, 50 bp, homo sapien
gcttttttggagagtttaggaaagcrccaaccttgaaagtcacatctgtt

SEQ ID NO: 1303 - DNA, 50 bp, homo sapien
aaaaccaaatatccttctctaggcamaatagattttcaaagcaaattgat

SEQ ID NO: 1304 - DNA, 50 bp, homo sapien
acgttgccactagggagcttttaacrccgtggttgtaggcttatagctat

SEQ ID NO: 1305 - DNA, 50 bp, homo sapien
cagtctaaatttttaaagggttcacrgaattatcactaacacatttcttc

SEQ ID NO: 1306 - DNA, 50 bp, homo sapien
aataagtattataatgtcactaaaarttaaggaaaatgtttaaaaaaggg

SEQ ID NO: 1307 - DNA, 32 bp, homo sapien
gcatcaacaacacaatsagattttatttgaca

SEQ ID NO: 1308 - DNA, 50 bp, homo sapien
attgttaattaaaatccgaacattcycatttatgtaatcataaagcaaaa

SEQ ID NO: 1309 - DNA, 50 bp, homo sapien
aaaaaatgttactagccaatatggaygtatcaggcacagttctaggtttt

SEQ ID NO: 1310 - DNA, 50 bp, homo sapien
catctatttttaaaagataactaaasaatcagattttgctcctaagcaac

SEQ ID NO: 1311 - DNA, 50 bp, homo sapien
acttccctaagacagacttgaaactyaatattgcaaattgtctcatcatt

SEQ ID NO: 1312 - DNA, 50 bp, homo sapien
gtttaacaacacattttatttcccaytggaagaactcccataaccttacg

SEQ ID NO: 1313 - DNA, 50 bp, homo sapien
tcctcttattctaccattagagaaamtgtagcctgggaagaagtgatatg

SEQ ID NO: 1314 - DNA, 50 bp, homo sapien
atgcttataatggtaaagaagcaacrgtacccgaagtgacaggcctatgt

SEQ ID NO: 1315 - DNA, 50 bp, homo sapien
tagttacgagaaatagacagcattcyagcttggaacaaaataggaagagg

SEQ ID NO: 1316 - DNA, 50 bp, homo sapien
gattagggactttacttccaactaayccttgactcttattaacaatccat

SEQ ID NO: 1317 - DNA, 50 bp, homo sapien
ccatcatctggaaaattactactcayctggaaattataagagaagattct

SEQ ID NO: 1318 - DNA, 50 bp, homo sapien
ggtagagtacaacctccatggtacayagtaaattctcgcatctttgacat

SEQ ID NO: 1319 - DNA, 50 bp, homo sapien
cttggtgcttttcaagtgaaaggaartgctatcattagttagactagaca

SEQ ID NO: 1320 - DNA, 50 bp, homo sapien
gaagtatatagaattaacttatgtargaaggatatcattgagaattaaag

SEQ ID NO: 1321 - DNA, 50 bp, homo sapien
ggcttggctaagtgggcttccagaayggaataggtaaagcaaaagagcaa

SEQ ID NO: 1322 - DNA, 50 bp, homo sapien
taaaaaatatctgttcgtcaaccgawtacactgtagttgggaaaatttta

SEQ ID NO: 1323 - DNA, 50 bp, homo sapien
aataaatgatgtcatcatcaaattaygaaaggcttattagttatgcctag

SEQ ID NO: 1324 - DNA, 50 bp, homo sapien
ctttgataagtgtataatagagaaamgtgtgaaagattcatggggcagta

SEQ ID NO: 1325 - DNA, 50 bp, homo sapien
agtggccttgaaaatgtgctcagtayagccaagttgtacccttgaggacc

SEQ ID NO: 1326 - DNA, 50 bp, homo sapien
ttaattcagaacattttcactagtaraaacaacaggatttaaaaatcaaa

SEQ ID NO: 1327 - DNA, 50 bp, homo sapien
tgtagggcagtgaagatgtgtgtagraagttagatagaatatatagaaaa

SEQ ID NO: 1328 - DNA, 50 bp, homo sapien
atgatgtttatcaagcgtatcatcaygaaactatttttaacgattatgga

SEQ ID NO: 1329 - DNA, 50 bp, homo sapien
aaaaggtttttgtcacaaggagaaaycaacataatgagaatggagatgcc

SEQ ID NO: 1330 - DNA, 50 bp, homo sapien
aaaactcaagcatttcttgttaaacrggaactcagtgtacatgtgtgata

SEQ ID NO: 1331 - DNA, 50 bp, homo sapien
agccaattgagtcagctctgggacartgataaccaatggattttagatgc

SEQ ID NO: 1332 - DNA, 50 bp, homo sapien
catgctgtttggctacctttgaaaawtttgagggacaaaactaagaacaa

SEQ ID NO: 1333 - DNA, 50 bp, homo sapien
ttctgaaacactgcaatcatacccaracaatggaagaaaagaaatatttt

SEQ ID NO: 1334 - DNA, 50 bp, homo sapien
tttcaatttgtaggaatccggcttcyaagatatagcttttgtatttaatt

SEQ ID NO: 1335 - DNA, 50 bp, homo sapien
acctactttaggtcaaacactgtgcrattatatgacagataaagcatact

SEQ ID NO: 1336 - DNA, 50 bp, homo sapien
gaaattagaattatgaaccattgtayattgtgttagaagtgagaaataag

SEQ ID NO: 1337 - DNA, 50 bp, homo sapien
ttcctctagcctcaagagaacataaytgtaaactggaatattatccttac

SEQ ID NO: 1338 - DNA, 50 bp, homo sapien
gaaaaatcccacagctttctagtaaycttcaggaattaatacagcttgcc

SEQ ID NO: 1339 - DNA, 50 bp, homo sapien
tataggagttaatggtcactcttgcwctataaattctattggcagatact

SEQ ID NO: 1340 - DNA, 50 bp, homo sapien
tctcccactgcagttagtctgttacwcaattattcacaaaggctgtgtag

SEQ ID NO: 1341 - DNA, 50 bp, homo sapien
aaatgtacatacatagatacagtccrggaaaggaattttagaaggattgt

SEQ ID NO: 1342 - DNA, 50 bp, homo sapien
tagtaacaggtgaggtctttagttaygcctagagagaaggaagtggcatt

SEQ ID NO: 1343 - DNA, 50 bp, homo sapien
gaggaatggcatgctctataggcacygtaaaaattctctttcctttaaag

SEQ ID NO: 1344 - DNA, 50 bp, homo sapien
gataccagtgggtatcagtaggagastcagagatagtagtatgatcaatt

SEQ ID NO: 1345 - DNA, 50 bp, homo sapien
aatctctcccagttccaacattcccragtgaaattttaaacatgtagctc

SEQ ID NO: 1346 - DNA, 50 bp, homo sapien
aatgcagtaaaaatatataaaaggaracaccgggctgcatgatcctaaaa

SEQ ID NO: 1347 - DNA, 50 bp, homo sapien
agttaaaagaccagaaaactaagcartacaattgaatctataactttcta

SEQ ID NO: 1348 - DNA, 50 bp, homo sapien
gggtaaattgaataaattgcatctgraaaatgaggagttatttgagaatt

SEQ ID NO: 1349 - DNA, 50 bp, homo sapien
tcataccctgagtatttctggtcaarttaagcactttcatcttgtatgtt

SEQ ID NO: 1350 - DNA, 50 bp, homo sapien
ttaacatttgtttcaaggggtctagwaatgagttaaccacattagtgagt

SEQ ID NO: 1351 - DNA, 50 bp, homo sapien
ataagcccttaaccatagacaaaacsgataggtaaattatttacaatggt

SEQ ID NO: 1352 - DNA, 50 bp, homo sapien
ggctctcaagccagaatgcctgaaayggctgcattaatctaatcaaatat

SEQ ID NO: 1353 - DNA, 50 bp, homo sapien
tgttgggcttagagatgtgaaatgastatcacaagtggaatggatgagat

SEQ ID NO: 1354 - DNA, 50 bp, homo sapien
ctatatctctgtctcagcctcaaacrggaagtactggctcatttcttcaa

SEQ ID NO: 1355 - DNA, 50 bp, homo sapien
acagttaggtttctaaaaatatcatragattgattcggcacctaggagta

SEQ ID NO: 1356 - DNA, 50 bp, homo sapien
atacaaatatgatagtataaccagaraaaccatctaacctaatgtatggg

SEQ ID NO: 1357 - DNA, 50 bp, homo sapien
gtcatcaaatagtgaagattctaggmccatccaatcaagttttcacattg

SEQ ID NO: 1358 - DNA, 50 bp, homo sapien
cacagttgtcctcacccattgaagartagtcaacctgatgctgcatcacc

SEQ ID NO: 1359 - DNA, 50 bp, homo sapien
gtgagaacttgtgcaagatttgtcaytcagattgaatttactcttctgta

SEQ ID NO: 1360 - DNA, 50 bp, homo sapien
tgggaataaaaactggaaaagacctwaatcaccatattagaaaactctag

SEQ ID NO: 1361 - DNA, 50 bp, homo sapien
ggaattatttaagttttcaaaatatwaacagcgtcatcaatggaatgagt

SEQ ID NO: 1362 - DNA, 50 bp, homo sapien
ttgctatttgcaaatttgtagtaccrcacacaaaaatgtagtacaagctt

SEQ ID NO: 1363 - DNA, 50 bp, homo sapien
gttatctcagttgtccacaaacatayattcacctgtagcttgggctctga

SEQ ID NO: 1364 - DNA, 50 bp, homo sapien
agaacttattgtcaaattatacttawcctaaatttgttatccactttaaa

SEQ ID NO: 1365 - DNA, 50 bp, homo sapien
taaacataactgccttcaggtgaaartgtggtcagtgaattacatctccc

SEQ ID NO: 1366 - DNA, 50 bp, homo sapien
catagaaaatttatagtctagaagaraggatcaacaataaacatgtgaat

SEQ ID NO: 1367 - DNA, 50 bp, homo sapien
tgtagttcaacatcacaggtgagagragattcaagaaaaaataatttcag

SEQ ID NO: 1368 - DNA, 50 bp, homo sapien
ctataatagaaagacacaatgacacrgtagcataatacagaaacttattt

SEQ ID NO: 1369 - DNA, 50 bp, homo sapien
cacagcaatagacaatgtttttggcycacataactacaaaacagtaaaag

SEQ ID NO: 1370 - DNA, 50 bp, homo sapien
tactagaacagtcacaggccacatgrcaattattgagagaagggatatat

SEQ ID NO: 1371 - DNA, 50 bp, homo sapien
aatatctgtgaatgaaggcataacgycactgatatggtttggctctgtgt

SEQ ID NO: 1372 - DNA, 50 bp, homo sapien
atgttttagttatcccacaatcaaawtaatttaaccaatttcattttgac

SEQ ID NO: 1373 - DNA, 50 bp, homo sapien
ttactggaaagaaagaaatatcttgmactattatgtaaaaagacatttat

SEQ ID NO: 1374 - DNA, 50 bp, homo sapien
gctagttccagtcagaggtggaatcycttaccaagataaagcatcagatc

SEQ ID NO: 1375 - DNA, 50 bp, homo sapien
aatagtaaacatatcagtgataataygaacttgttttctaataaattcta

SEQ ID NO: 1376 - DNA, 50 bp, homo sapien
ttttataggtctattttgttggttcyatctcagttataaaattcacttga

SEQ ID NO: 1377 - DNA, 50 bp, homo sapien
agaaacctaaggacaaacctactaawcataatatacaaaatacatcctat

SEQ ID NO: 1378 - DNA, 50 bp, homo sapien
ttgtgatgactccagaaacgctctayccactgagacttattaaccattca

SEQ ID NO: 1379 - DNA, 50 bp, homo sapien
taacacaggtcaaattgtactctacrgatagtgcctctggccagaaaaat

SEQ ID NO: 1380 - DNA, 50 bp, homo sapien
tgtgtcttctgctttatcttgcatgracttttgtaactgcctccatcaac

SEQ ID NO: 1381 - DNA, 50 bp, homo sapien
tagaagaacttcagctgccattttcratcactgggttactatgtgttggc

SEQ ID NO: 1382 - DNA, 50 bp, homo sapien
ttggcaacagaaaacgaatttagaartggagatagctctgggagcaggta

SEQ ID NO: 1383 - DNA, 50 bp, homo sapien
tgaattgagattgagatgtcatgaargtcaagaggtaactagaaatctac

SEQ ID NO: 1384 - DNA, 50 bp, homo sapien
aggatagctttagataagaagacccmaattagcagttactttatgaagat

SEQ ID NO: 1385 - DNA, 50 bp, homo sapien
gtcctaacttcctgatgtctgctgarctaactatagaatttaaaataatt

SEQ ID NO: 1386 - DNA, 50 bp, homo sapien
acacaaatatttagaccaatttatcsaggatatttttgtcctgctcctct

SEQ ID NO: 1387 - DNA, 50 bp, homo sapien
ctctagaaaacagttcttgctgagayagataatccaacatgtacatgtgg

SEQ ID NO: 1388 - DNA, 50 bp, homo sapien
taactgcctccatcaacagagtatartgtttaaatgctgtacagagctaa

SEQ ID NO: 1389 - DNA, 50 bp, homo sapien
caagtcatctaaaatgattagaaacmgtctatagttgtcttttatgagga

SEQ ID NO: 1390 - DNA, 50 bp, homo sapien
ttaacccaggaagatgatcttgcaakcactgccccctattcctggtaggt

SEQ ID NO: 1391 - DNA, 50 bp, homo sapien
acaaaaaaatcaagcactaagagtaygaaaaatattaagcatgcataata

SEQ ID NO: 1392 - DNA, 50 bp, homo sapien
gtgtacctgaaagtgatgggcggatsaagccaagttggaaaacactcttc

SEQ ID NO: 1393 - DNA, 50 bp, homo sapien
gtaacacaaatcttcaagttaatcartcatgacaaatatataacatagaa

SEQ ID NO: 1394 - DNA, 50 bp, homo sapien
atgaggctttaaacaagttattaaamctcctttgcttcagcttaccagtc

SEQ ID NO: 1395 - DNA, 50 bp, homo sapien
ctagttacgcaaacgtaatctaaacraaggctctaatactcttctctata

SEQ ID NO: 1396 - DNA, 50 bp, homo sapien
gattcctcactaagttaatccagaaygtccacttcacagagagtctgata

SEQ ID NO: 1397 - DNA, 50 bp, homo sapien
catactgtacttaaactacctccaayagataagaatttattttgtttttt

SEQ ID NO: 1398 - DNA, 50 bp, homo sapien
cgtccacttcacagagagtctgatawtaatgatgccctttagaggtctga

SEQ ID NO: 1399 - DNA, 50 bp, homo sapien
gtagtttaagtacagtatgctaagartagaccatgtggtcttcctcctta

SEQ ID NO: 1400 - DNA, 50 bp, homo sapien
agagctggtgaatttgttgtctttcrctttaaacatgcttcttctatagt

SEQ ID NO: 1401 - DNA, 50 bp, homo sapien
aagtaagggactctatctctctgacrcagaagttacgaatgcatgtcaga

SEQ ID NO: 1402 - DNA, 50 bp, homo sapien
atggcaagaaattcaaggaagagtamatacagagagtggagaatgctgtg

SEQ ID NO: 1403 - DNA, 50 bp, homo sapien
aacactcataaacaccatgtaaaaamggacaagtttgtctcaatgcagtt

SEQ ID NO: 1404 - DNA, 50 bp, homo sapien
taatctgtgttacatttgtatagaamagagactaggtgaatttctcaaag

SEQ ID NO: 1405 - DNA, 50 bp, homo sapien
gcaaggactggaattacatttgtcawgatgaagtaacttggaagtggaaa

SEQ ID NO: 1406 - DNA, 50 bp, homo sapien
atttcacatctttatcatgaatgtcrgaaactagcttcagagatactgaa

SEQ ID NO: 1407 - DNA, 50 bp, homo sapien
gtttttttgttataaaaatgccacamaatgttccaaattactatgctata

SEQ ID NO: 1408 - DNA, 50 bp, homo sapien
aagtcatccaattctgtattctgacrgtatcaccactgttaatgctgatc

SEQ ID NO: 1409 - DNA, 50 bp, homo sapien
cctttatataatccctacttcttcastctagtatcagtctagtaacagta

SEQ ID NO: 1410 - DNA, 50 bp, homo sapien
tatgtacaagatctatccaaatgtcragaaaataaatcaaagaactaaat

SEQ ID NO: 1411 - DNA, 50 bp, homo sapien
caagtgagtattgtaattattcccaycttaaaatgaaaacttgagactca

SEQ ID NO: 1412 - DNA, 50 bp, homo sapien
atgtctatccttttattcaaaaaatwacaaataatctactcatactatct

SEQ ID NO: 1413 - DNA, 50 bp, homo sapien
agcctgcctcacgacctctgttccarggagtaagttcatggataaggcag

SEQ ID NO: 1414 - DNA, 50 bp, homo sapien
agggaactaggaagggctcatagaaraacaagaaagctgaggtgatagaa

SEQ ID NO: 1415 - DNA, 50 bp, homo sapien
aaaaatcttaagatggggctgtatayattgaggagaaatatgaacttaaa

SEQ ID NO: 1416 - DNA, 50 bp, homo sapien
ttgctccatcctaggtttaagacacrgcatttcaccttgactggctgtta

SEQ ID NO: 1417 - DNA, 50 bp, homo sapien
tatttgaaattgtaatcactcttcaytctttaatgcttcttccttttctg

SEQ ID NO: 1418 - DNA, 50 bp, homo sapien
gaggtgagtgctatcataagtcacaraatggatacattatttgagtagtc

SEQ ID NO: 1419 - DNA, 50 bp, homo sapien
catgtccggaggtgactacaaagcaraagcatggaatgtcatacattcca

SEQ ID NO: 1420 - DNA, 50 bp, homo sapien
gctttagaaatatcctattcttttaygattgtccttaggcaggattcatt

SEQ ID NO: 1421 - DNA, 50 bp, homo sapien
tttgaggacctcagagagatccttasaacatgtatacacaaccactgcta

SEQ ID NO: 1422 - DNA, 50 bp, homo sapien
gctatttgtatcatttttaatactayaatttgcctttgaaaaacaaagat

SEQ ID NO: 1423 - DNA, 50 bp, homo sapien
tcttataccatggaaagccattggasgattttggtcagaagactggcata

SEQ ID NO: 1424 - DNA, 50 bp, homo sapien
agaaacaaggtatggtctatgtccaraaacagaaatacaactcattattt

SEQ ID NO: 1425 - DNA, 50 bp, homo sapien
tctttgtttcttgcaagtcacttgamatatagcaggtgaccaaaatatgt

SEQ ID NO: 1426 - DNA, 50 bp, homo sapien
aaaggatgatttaaaagtaaatgacrcatatttttcagcatatttgatca

SEQ ID NO: 1427 - DNA, 50 bp, homo sapien
cacacatgcacacataatggaagcasgtattaaaatcagatgctcagtct

SEQ ID NO: 1428 - DNA, 50 bp, homo sapien
tttttccttctgactcttgtgaaacyacattcttataaatgtttcttagg

SEQ ID NO: 1429 - DNA, 50 bp, homo sapien
gggtcatctgtcatgtctggacataygtaggcagagatcaagtctaaaat

SEQ ID NO: 1430 - DNA, 50 bp, homo sapien
atcttaaataagtgtatttttgctaygtgatttaattaagtcatcaataa

SEQ ID NO: 1431 - DNA, 50 bp, homo sapien
tttggaaactgtgatcagattgctamaaatacaatattagatatgtagaa

SEQ ID NO: 1432 - DNA, 50 bp, homo sapien
ccctccctgcacataaacacatctasagaaaaaatagggccactaagcca

SEQ ID NO: 1433 - DNA, 50 bp, homo sapien
ttgagacccattcaacccaatacacmaagtaagaggtcagtgagctgttt

SEQ ID NO: 1434 - DNA, 50 bp, homo sapien
cttatattggtacagcacatttgtcrctattaataaaccagtatccaggg

SEQ ID NO: 1435 - DNA, 50 bp, homo sapien
catttggcaataaatattgaggtaastatgagtaaggcactgttttaggt

SEQ ID NO: 1436 - DNA, 50 bp, homo sapien
ggtatcggatgactccaagccacacragcatggtagaagtcccaagaagt

SEQ ID NO: 1437 - DNA, 50 bp, homo sapien
gactgtaggccttactcttatgcgasagagaaaatcaacaatactgccat

SEQ ID NO: 1438 - DNA, 50 bp, homo sapien
aagaagaacttaatactagagaggtwaaatcactttcccgtaagccagaa

SEQ ID NO: 1439 - DNA, 50 bp, homo sapien
aaacttgacttcactggtggtaaacrggacttaattacctgatatattgc

SEQ ID NO: 1440 - DNA, 50 bp, homo sapien
atatctctctctatgtatttttgcaygaaacatagagtatatgaaataaa

SEQ ID NO: 1441 - DNA, 50 bp, homo sapien
tggggcaaggggaatcactataactsaaatgggaattactgtacctcaga

SEQ ID NO: 1442 - DNA, 50 bp, homo sapien
tataactgaaatgggaattactgtamctcagattacccattagccattct

SEQ ID NO: 1443 - DNA, 50 bp, homo sapien
atatcagattctgtgttgttggtgamactagtcttcctatttggcatctt

SEQ ID NO: 1444 - DNA, 50 bp, homo sapien
gttctcctggcctattttcaggtgayggaggtttggtgataataactgca

SEQ ID NO: 1445 - DNA, 50 bp, homo sapien
cttagttgtgggtaatttcactcacmggtctaaattcattaaattcttag

SEQ ID NO: 1446 - DNA, 50 bp, homo sapien
acagagatcacaggcacatggtccayaaagatttacagaaaaaggatgct

SEQ ID NO: 1447 - DNA, 50 bp, homo sapien
agttttcaccacaatgtatctgcaartaaatatgaatcagataatgccat

SEQ ID NO: 1448 - DNA, 50 bp, homo sapien
gcttgtgtccaaaaaataaattagamaatgattaaattatatgaataaca

SEQ ID NO: 1449 - DNA, 50 bp, homo sapien
gtttaaaaaaaaaaaggattaactgrcacattacaattatgagtttattc

SEQ ID NO: 1450 - DNA, 50 bp, homo sapien
gaatgactatggaagtgctgtattayggggttacaaagacattttagcaa

SEQ ID NO: 1451 - DNA, 50 bp, homo sapien
gaaagtttagtaacattattgcctayaataacctggaaagtagaaatgtg

SEQ ID NO: 1452 - DNA, 50 bp, homo sapien
catgcagtccttatctattaccacaycaaaaggtcatataaattccattg

SEQ ID NO: 1453 - DNA, 50 bp, homo sapien
atagcatacacatacacccactaaaragcattgaaaataaaatgtataaa

SEQ ID NO: 1454 - DNA, 50 bp, homo sapien
taaataaggaaacagtttaataactmactgtgtaagcaaaggtatgctta

SEQ ID NO: 1455 - DNA, 50 bp, homo sapien
tggaggaaatagttcattctctcaarccattattatacttataactagaa

SEQ ID NO: 1456 - DNA, 50 bp, homo sapien
ttattattatgaggatctaaatacamtgcttgaaatggagtatctgagag

SEQ ID NO: 1457 - DNA, 50 bp, homo sapien
taagcaaggctgagagcatgttctgratcaatattgtatatatttaggtt

SEQ ID NO: 1458 - DNA, 50 bp, homo sapien
gaagcagatgtcacacaaagattaartgttattttttatatgtctctaaa

SEQ ID NO: 1459 - DNA, 50 bp, homo sapien
tttaagagttaagaaaattattgggyattactgaattttgcaaaatgtgg

SEQ ID NO: 1460 - DNA, 50 bp, homo sapien
agacaatagaacttgcagcagtaacrgtgaaatggcttaccaaagtgaat

SEQ ID NO: 1461 - DNA, 50 bp, homo sapien
gatgaaacaactggtgagttggtcastaaatttcattgcatgatgtatga

SEQ ID NO: 1462 - DNA, 50 bp, homo sapien
tccgtgtgctcttaaatacaaccaamcctctttaagttggcaacataagt

SEQ ID NO: 1463 - DNA, 50 bp, homo sapien
gacagctctggcttcaataggttgasatgggactacaggttgtctaggct

SEQ ID NO: 1464 - DNA, 50 bp, homo sapien
caatgttgtctcaccatgctcttacrcttaccctgtgtttcagccaaata

SEQ ID NO: 1465 - DNA, 50 bp, homo sapien
cattacactaggagaagtaaatggamagttctcactacctggcctggttt

SEQ ID NO: 1466 - DNA, 50 bp, homo sapien
ttaataggatctggaacctacccaamtgtgactgaaatctaagtgtcctt

SEQ ID NO: 1467 - DNA, 50 bp, homo sapien
acatcataacatatcacgctgaaagsaatgtaataaaaacaggtattcag

SEQ ID NO: 1468 - DNA, 50 bp, homo sapien
tctaggattactacttgcctaaatargaagcaaagtactttaggattatt

SEQ ID NO: 1469 - DNA, 50 bp, homo sapien
caaaaaaaaaactgtcaacatagaaytctttacaagcaaaaatatctttc

SEQ ID NO: 1470 - DNA, 50 bp, homo sapien
acacaattatgtgaggaaattatcayaggatggaaaatgaaccactgcaa

SEQ ID NO: 1471 - DNA, 50 bp, homo sapien
gcagacatgtgctctttgaatttaaytgaacgtctgcttcagaaaaacgt

SEQ ID NO: 1472 - DNA, 50 bp, homo sapien
gatatgatgtaaacagccagtaatayaattagaggtgttcgaatcaaaag

SEQ ID NO: 1473 - DNA, 50 bp, homo sapien
cctcatcttattttatctactactgwcaattccacatagttacttatttc

SEQ ID NO: 1474 - DNA, 50 bp, homo sapien
cttttttatggtgtggcaaaagtcayatttatcgctaaggctagaatttt

SEQ ID NO: 1475 - DNA, 50 bp, homo sapien
ggcagttggctttttcaaccatgaaygttttcaaattaccagactctcag

SEQ ID NO: 1476 - DNA, 50 bp, homo sapien
tagacaccatatattgccttggcagwaagggtgattagtagtatttcctt

SEQ ID NO: 1477 - DNA, 50 bp, homo sapien
caatgtgtagcaggtgatgatttgastaaatattttgtagatttattata

SEQ ID NO: 1478 - DNA, 50 bp, homo sapien
caatagaagaatgttatgaactaaastaagttttcaaattgaattttgaa

SEQ ID NO: 1479 - DNA, 50 bp, homo sapien
ctacacagagctagggaaatagaaartaattggccactgtactggatagc

SEQ ID NO: 1480 - DNA, 50 bp, homo sapien
gaaatctcagtaaaactcgaaaggayatagataagcattgctaagctagg

SEQ ID NO: 1481 - DNA, 50 bp, homo sapien
ggtcaggttagccttctttttcagtsaattagttgaatagtggcaaaata

SEQ ID NO: 1482 - DNA, 50 bp, homo sapien
gccaaaccagggcttatttagcctcragaatgctgcttgtaaaaagaatc

SEQ ID NO: 1483 - DNA, 50 bp, homo sapien
cgcatggcaacatgaaaactttagtraagagaactccagtgttttctcaa

SEQ ID NO: 1484 - DNA, 50 bp, homo sapien
atttggaaggcccctgtgactttaaygaaaatcaaatatttcaagtgttg

SEQ ID NO: 1485 - DNA, 50 bp, homo sapien
ataactggacttcaaaaaactaacartcctcagaacaagaattactgaag

SEQ ID NO: 1486 - DNA, 50 bp, homo sapien
cttcagaagaagacaaaaacagtaastgaatgtatgaatttcttaagtct

SEQ ID NO: 1487 - DNA, 50 bp, homo sapien
gttacatgggaagtgaggatagtgaygaactggggtgttgactcacctag

SEQ ID NO: 1488 - DNA, 50 bp, homo sapien
ctagcagtccagagaataatgttccrgacgagacactgagaagctgtatt

SEQ ID NO: 1489 - DNA, 50 bp, homo sapien
aaaaacgataactatgttgaagaaakgatttggaaatatattcataaatg

SEQ ID NO: 1490 - DNA, 50 bp, homo sapien
gcatggatggaatatgatattaaggmagcctattgattctctagattacc

SEQ ID NO: 1491 - DNA, 50 bp, homo sapien
tcatcaaagcttggcatatccagcawctacagcacagttttttagatggg

SEQ ID NO: 1492 - DNA, 50 bp, homo sapien
gttcagttcagagtacagtgaatatraggtcaacaaatgccttggaaaag

SEQ ID NO: 1493 - DNA, 50 bp, homo sapien
tttctacagaaaggaaactgaggcayggaacacttacataacttgtgaaa

SEQ ID NO: 1494 - DNA, 50 bp, homo sapien
ttttttggtgaagcacattccatgcyaaatttactaaatagatgttttat

SEQ ID NO: 1495 - DNA, 50 bp, homo sapien
tttagacatggaaaaagatagtgtargacagagattcattcattcattca

SEQ ID NO: 1496 - DNA, 50 bp, homo sapien
aatttggcatggaatgtgcttcaccraaaaaaaatgaagccaacacctct

SEQ ID NO: 1497 - DNA, 50 bp, homo sapien
tagccatatgtttttggctttcatartatactgtaggctgatagctggct

SEQ ID NO: 1498 - DNA, 50 bp, homo sapien
ccaatgcatcaaggttctacttaaasgatatcttctgcattttaacattt

SEQ ID NO: 1499 - DNA, 50 bp, homo sapien
ccaaaaggagagttaactgcttagamctctgggtggactctgtgttgtac

SEQ ID NO: 1500 - DNA, 50 bp, homo sapien
tccatatatcgggacctgcatcatgmaaaaatggttggggtggagtggga

SEQ ID NO: 1501 - DNA, 50 bp, homo sapien
tgtataggcataactcttagaaaaayagatcatgtaaacactgtcagatt

SEQ ID NO: 1502 - DNA, 50 bp, homo sapien
attaaagttggtcccacatcatggcraactaaagcggggatttattctgt

SEQ ID NO: 1503 - DNA, 50 bp, homo sapien
tagaacttgtttttccatcaacgtayctgattctaaagcacatggtcttc

SEQ ID NO: 1504 - DNA, 50 bp, homo sapien
tcaaagcaaacaataatgtacaatgkattaaatgctttaaagtttgcttt

SEQ ID NO: 1505 - DNA, 50 bp, homo sapien
aagacctcacatctttaaagggtgakactcagagttggacatcccttgtc

SEQ ID NO: 1506 - DNA, 50 bp, homo sapien
gtggtgataacaagaaatgaatccaygagaatgtcctaattcacggttgc

SEQ ID NO: 1507 - DNA, 50 bp, homo sapien
tagttgcttctcctgaactgggactsaaggacttctcctctattcaaaat

SEQ ID NO: 1508 - DNA, 50 bp, homo sapien
ttcagataaaacctggacccactcaracttttactgtagactggaaacaa

SEQ ID NO: 1509 - DNA, 50 bp, homo sapien
caagtaaaactcctgcaaatattcaraaggaaagacaatcatttcttttt

SEQ ID NO: 1510 - DNA, 50 bp, homo sapien
aactgtagtaattgtatgtcatgtawctctaataaaaatttgggtttgca

SEQ ID NO: 1511 - DNA, 50 bp, homo sapien
cctcttttcccctcctttctagtcawggcatacatttttaagtttcatat

SEQ ID NO: 1512 - DNA, 50 bp, homo sapien
caaaaacaaaaaaacatagtccttgratcataacttaatggaaaatagtg

SEQ ID NO: 1513 - DNA, 50 bp, homo sapien
tttgccccttacataaatgctgcaarttaagttctctcaacctgacttga

SEQ ID NO: 1514 - DNA, 50 bp, homo sapien
gttaacttttgtattttgcatgaggyatggatcaaagttctttttaaaag

SEQ ID NO: 1515 - DNA, 50 bp, homo sapien
agcatattatgacatgaaatgaaaarctaaaaattttgctacacaccttt

SEQ ID NO: 1516 - DNA, 50 bp, homo sapien
ctaagagaaatatggattaagttgastattataagttatggttttcaaat

SEQ ID NO: 1517 - DNA, 50 bp, homo sapien
gaagatttacattctatatactatamcaggattttatacacagatttctt

SEQ ID NO: 1518 - DNA, 50 bp, homo sapien
caggccaagtggagccgagggatgasagatacaaaatgaacactggaatg

SEQ ID NO: 1519 - DNA, 50 bp, homo sapien
tttagtcagactgacaggaagtaccraaggaatgacagttgggcctggag

SEQ ID NO: 1520 - DNA, 50 bp, homo sapien
atgagaattaaacaacagtgaagtastaaaagatcaattgaaaaaataat

SEQ ID NO: 1521 - DNA, 50 bp, homo sapien
tatcaaacactcatcataacagaaayttagcgatgtgggtagagtgcttc

SEQ ID NO: 1522 - DNA, 50 bp, homo sapien
ttcagttgttgagaatggaagttaaygaagcactctacccacatcgctaa

SEQ ID NO: 1523 - DNA, 50 bp, homo sapien
gaataaactagggaacaattccagarcaaataagatgtagttgggcatat

SEQ ID NO: 1524 - DNA, 50 bp, homo sapien
agtctgggcattggaggaagtattargtttgcaatggaaaggatgggagg

SEQ ID NO: 1525 - DNA, 50 bp, homo sapien
caagggcaaaaatgtgagacacttaygccaacagggaaatgttcttaatt

SEQ ID NO: 1526 - DNA, 50 bp, homo sapien
acactatattttaggcaatgaataasaacctattagtgtatgttttctta

SEQ ID NO: 1527 - DNA, 50 bp, homo sapien
agataccttctgatttccactgtaasgctagctcagaaaatagcagagtt

SEQ ID NO: 1528 - DNA, 50 bp, homo sapien
agacatgtgactgctctgggaaagastattcaaggaagaaggaacagcaa

SEQ ID NO: 1529 - DNA, 50 bp, homo sapien
tttccaaaaccagataaatagctgayggtttacatttattaagggctgac

SEQ ID NO: 1530 - DNA, 50 bp, homo sapien
ccttttcattattttacaattcagcmctatagcaggggttatgaaggaaa

SEQ ID NO: 1531 - DNA, 50 bp, homo sapien
ttaaaatttttgatgtaaagctacakgaggctaatggtccccaacaacat

SEQ ID NO: 1532 - DNA, 50 bp, homo sapien
catttgtataacttgatatagactaygaatttctgtaagaagttatgaaa

SEQ ID NO: 1533 - DNA, 50 bp, homo sapien
ttagaaattccttggacattaagtcrcccttccaccaatgaggttagtaa

SEQ ID NO: 1534 - DNA, 50 bp, homo sapien
tattagtccggcttagctaggaaggwatacaatatagaatcagggggtta

SEQ ID NO: 1535 - DNA, 50 bp, homo sapien
tccacatgtgctcttggctctagtcratacctttgccctcctggctgtaa

SEQ ID NO: 1536 - DNA, 50 bp, homo sapien
ttaggaacatcaggaaccagaattaraacagatgatgcctaattacctgg

SEQ ID NO: 1537 - DNA, 50 bp, homo sapien
ctactcaagtaatcatgaaggctcaracaacatgaagaaatgtaaacttt

SEQ ID NO: 1538 - DNA, 50 bp, homo sapien
acaggtgtaatttacaaatctgttarcttatatggaaccaagacaaacaa

SEQ ID NO: 1539 - DNA, 50 bp, homo sapien
tccaacatcctttgaaagactgacasagtaaagaaggcagattatttttt

SEQ ID NO: 1540 - DNA, 50 bp, homo sapien
gctttccaaggggcaagagaacactmactccgttgctataattattactt

SEQ ID NO: 1541 - DNA, 50 bp, homo sapien
tcttttctgtgcatttgactagtacratccttccccaatcacaaataata

SEQ ID NO: 1542 - DNA, 50 bp, homo sapien
ccctgtgaccacttgtgcctacggaygagtcttaagcctccaagtcttcc

SEQ ID NO: 1543 - DNA, 50 bp, homo sapien
tgtccgcctctactaacctacaccaycttcttagactgctgtttgcatct

SEQ ID NO: 1544 - DNA, 50 bp, homo sapien
ctctttgtgggttttggatggtaaartcttcaatctgttccacaggcaga

SEQ ID NO: 1545 - DNA, 50 bp, homo sapien
agaattgaaagagagtatatattatsagagtatgaaaattgttcagtgac

SEQ ID NO: 1546 - DNA, 50 bp, homo sapien
attttgagagttcactggagggggamgtcaactttctactgcttgatctt

SEQ ID NO: 1547 - DNA, 50 bp, homo sapien
cagtcttttgtacttgttcctaatayagggcaaaccaattctgaaagagt

SEQ ID NO: 1548 - DNA, 50 bp, homo sapien
ttagctttttcaatagctctgtcacrctatgggttcgtatgaagtttgtg

SEQ ID NO: 1549 - DNA, 50 bp, homo sapien
cagatggtcaataattgcaacaactragagaaattgaattgctttactca

SEQ ID NO: 1550 - DNA, 50 bp, homo sapien
cctccccacccttttcaaccaggacygaatgttgcgtctttctcagctgc

SEQ ID NO: 1551 - DNA, 50 bp, homo sapien
ttggaaccgtttcttcttctaaaccrgagtctcctgctgctcctgttggt

SEQ ID NO: 1552 - DNA, 50 bp, homo sapien
ctatctatgaatctaaatttacaatsaatcaagtgcaaaaaataacctag

SEQ ID NO: 1553 - DNA, 50 bp, homo sapien
ttattttacttctttgagagttgaasgtactaatattatttaatagccat

SEQ ID NO: 1554 - DNA, 50 bp, homo sapien
aagtttccccacaacatatttgcaaytctgtgatggagtaagtcttgaaa

SEQ ID NO: 1555 - DNA, 50 bp, homo sapien
tctacttctctaaacctgaagtttaraaatgaaagtcatgcctggaaatg

SEQ ID NO: 1556 - DNA, 50 bp, homo sapien
ctcatcccactgccttgtctgggctsaacggctgatgctttgctccattt

SEQ ID NO: 1557 - DNA, 50 bp, homo sapien
cctgatccataaaatgaggctaaaartgcttttccttctactgcttaggg

SEQ ID NO: 1558 - DNA, 50 bp, homo sapien
tgggctcagccacaggtatttcttargagtctcacctcctcgggtgactt

SEQ ID NO: 1559 - DNA, 50 bp, homo sapien
agcaagagaaaggttcagggtaaaawtaggagttgcagaaattatattgc

SEQ ID NO: 1560 - DNA, 50 bp, homo sapien
ttattaacttcatttgggagctctartaaaaaagtgagataaacaccttt

SEQ ID NO: 1561 - DNA, 50 bp, homo sapien
gtcgtgtttagatttgtgatgagagrataacatacttctgtaaaataaag

SEQ ID NO: 1562 - DNA, 50 bp, homo sapien
ttctagttctgtcagtccggtgataragatagaataggatgcacaatcct

SEQ ID NO: 1563 - DNA, 50 bp, homo sapien
acactaggtctcaggttgttctcaayaaaatccaaaggaagaaaactggc

SEQ ID NO: 1564 - DNA, 50 bp, homo sapien
ttgcattttatagtgttttgttataycagacttttacaggattgactttt

SEQ ID NO: 1565 - DNA, 50 bp, homo sapien
tccctggttggtgtgatatattcaargctcacttcatatttctactcctc

SEQ ID NO: 1566 - DNA, 50 bp, homo sapien
tgctttcagattggctttctcctgcyaagtgttttacacaagaaatctct

SEQ ID NO: 1567 - DNA, 50 bp, homo sapien
aataaggtatggactttgtcccaaayctaacagctagtaaattacagagc

SEQ ID NO: 1568 - DNA, 50 bp, homo sapien
aataaaatatttaaaatgcttaataraatgcctacctacagttggtctgt

SEQ ID NO: 1569 - DNA, 50 bp, homo sapien
acatccaacattcagctacataaaaygtgagtcctatatcactccaaata

SEQ ID NO: 1570 - DNA, 50 bp, homo sapien
gttaccttacataaatcgttacattwaatcagagatgatttaatcaatca

SEQ ID NO: 1571 - DNA, 50 bp, homo sapien
ggataaactgtggagtggagaagacmatggagggcaaggcaaaaacccac

SEQ ID NO: 1572 - DNA, 50 bp, homo sapien
gttttgggcaagctgaacgtggtccrgagagatattaatgagagggcaag

SEQ ID NO: 1573 - DNA, 50 bp, homo sapien
acattacctgacttatctaccagaaytccagtcttaaaatgaacaaaatg

SEQ ID NO: 1574 - DNA, 50 bp, homo sapien
ttacatccctgagggtacttattaamcttcttctcttgtcctgcatgaat

SEQ ID NO: 1575 - DNA, 50 bp, homo sapien
aaaaataggtttggaatagccttaarttaaacagagtactgtaggacttc

SEQ ID NO: 1576 - DNA, 50 bp, homo sapien
tggattgaatcttagctccattcctwaataatcattggtctttgataggt

SEQ ID NO: 1577 - DNA, 50 bp, homo sapien
gtcaaatttgctcaagattcatggckcttacctgaagcactggggtgcct

SEQ ID NO: 1578 - DNA, 50 bp, homo sapien
tagcaaggggtctgcttcaaaagaaygtgagatcaactcctaagtaagac

SEQ ID NO: 1579 - DNA, 50 bp, homo sapien
tcaaagagaaataatgtttaaaagaygtgaagcatttaatccttgaatgc

SEQ ID NO: 1580 - DNA, 50 bp, homo sapien
tgagtaaaaagaatcataagtgaaayaaccaaatataaaaggagtcagaa

SEQ ID NO: 1581 - DNA, 50 bp, homo sapien
ctaataataagaaatggaatcctatraaagactctaaaaattctctaatg

SEQ ID NO: 1582 - DNA, 50 bp, homo sapien
tcttctccccagtccatcattgttayatatacgctctacagcttgctttt

SEQ ID NO: 1583 - DNA, 50 bp, homo sapien
catgttctacgaagttgggacctcartctcatttgtcacaaagtggcctt

SEQ ID NO: 1584 - DNA, 50 bp, homo sapien
aaatggaagaaaaagagttaaacaaygcaaagcaaaaccagattctgttc

SEQ ID NO: 1585 - DNA, 50 bp, homo sapien
tcacataggctgttctatatgataaragtaaaggaatgtgatagatcgga

SEQ ID NO: 1586 - DNA, 50 bp, homo sapien
aacatttagaaaaggactccaaactkacccttgcagagcttatagcttgc

SEQ ID NO: 1587 - DNA, 50 bp, homo sapien
gtttatagaactaagaattcgtaatraaacaggaaatatgaagagtaata

SEQ ID NO: 1588 - DNA, 50 bp, homo sapien
tacgctcactggcatgtgtgtttccragtatgggtcattttcaagctttc

SEQ ID NO: 1589 - DNA, 50 bp, homo sapien
ctaactcttccccttttggatgtcaycatcttgttttgctttgggaaatc

SEQ ID NO: 1590 - DNA, 50 bp, homo sapien
acttaccttatcagagacattaaaaygaatgtaagccccaagaaacctag

SEQ ID NO: 1591 - DNA, 50 bp, homo sapien
tagttacatctacaacagttcttgaytacatagatacatcaaaatacatt

SEQ ID NO: 1592 - DNA, 50 bp, homo sapien
tgtaagtcattggtatgattgagtcwctaatttgaactaaactgaccccc

SEQ ID NO: 1593 - DNA, 50 bp, homo sapien
aattacaattagagatttcctgacarggcctatgctaaacgagttataga

SEQ ID NO: 1594 - DNA, 50 bp, homo sapien
tatatgtcagagaatgtgaactagasaaaaatggaagagttctgggataa

SEQ ID NO: 1595 - DNA, 50 bp, homo sapien
accaagtatcttggtcgcagacataygttaggtttaatgcatcccctgcc

SEQ ID NO: 1596 - DNA, 50 bp, homo sapien
gggtgcccagagcataatgttgtcascttcttgggaacacagtatttcta

SEQ ID NO: 1597 - DNA, 50 bp, homo sapien
atgaggaaacacttagacgagcccasgcttttgcttgattttctcctact

SEQ ID NO: 1598 - DNA, 50 bp, homo sapien
aaaaaaccacatagtgaagttgacastcaggaactgctgaaattttatca

SEQ ID NO: 1599 - DNA, 50 bp, homo sapien
aaatggttataattctctcgtttgargtagcagaccactctgtatttgaa

SEQ ID NO: 1600 - DNA, 50 bp, homo sapien
ctactatgtttcaggtcttattctakgtagttggcatatttaatctcact

SEQ ID NO: 1601 - DNA, 50 bp, homo sapien
ttgtatatctagcctgtcattgatasatacaccattatgtgccatatgac

SEQ ID NO: 1602 - DNA, 50 bp, homo sapien
ccattttgtgttgagcagaatacagmaatacatggggagatagagagggc

SEQ ID NO: 1603 - DNA, 50 bp, homo sapien
ataattgcttataatacacagactcrattttatatgactaattagaacag

SEQ ID NO: 1604 - DNA, 50 bp, homo sapien
ctttacctttttatccataaaataaycacacttacaatccaacagtgaca

SEQ ID NO: 1605 - DNA, 50 bp, homo sapien
gagcctcccatttgtgtctggattcyataaaatggggaacataagaccca

SEQ ID NO: 1606 - DNA, 50 bp, homo sapien
aacatatattcaaggggatggaaaawtacttactgaacaataattttatt

SEQ ID NO: 1607 - DNA, 50 bp, homo sapien
tttgagtatatacatcagatggtaayacattataaagtgaattttccatt

SEQ ID NO: 1608 - DNA, 50 bp, homo sapien
agggcccaagaattgggcaattcacrgctttcacacaggatgaaattcct

SEQ ID NO: 1609 - DNA, 50 bp, homo sapien
aaaaacaaaaaacaaaacccaggtamgttgattcagcaaaattaaaaact

SEQ ID NO: 1610 - DNA, 50 bp, homo sapien
gagaggcttgtagcacaatatagacyggacacctcagacttctgaaaggc

SEQ ID NO: 1611 - DNA, 50 bp, homo sapien
atgaatatttccaaattgatacaagycctctcaactctttaatatcaaga

SEQ ID NO: 1612 - DNA, 50 bp, homo sapien
gtgggggtagcctgtcagttttaccragagacagaattgaagcaatagaa

SEQ ID NO: 1613 - DNA, 50 bp, homo sapien
agggtaaggaagagatactctgctaygcattctaagaagattgaaataga

SEQ ID NO: 1614 - DNA, 50 bp, homo sapien
gaccatataagctttgttgtgtatcmatggccagttgtacctttatctca

SEQ ID NO: 1615 - DNA, 50 bp, homo sapien
cattatctcattttatcatcaaaacmataccacaaagaattattgtgttg

SEQ ID NO: 1616 - DNA, 50 bp, homo sapien
ttgatcctaatgtgtaaatacattasctaactacctagcaagacttcaaa

SEQ ID NO: 1617 - DNA, 50 bp, homo sapien
aacacctctcactgatttagaactayatcccattcaacattctttcagga

SEQ ID NO: 1618 - DNA, 50 bp, homo sapien
atcatcaactggattgcacaaagaakatgtatttaaggctctttctgaat

SEQ ID NO: 1619 - DNA, 50 bp, homo sapien
aattcatagaaataatttctggggaktaatgctagggagtagtataagaa

SEQ ID NO: 1620 - DNA, 50 bp, homo sapien
tcttcaacatcctggattcctataawcactaccatactgtatttattaga

SEQ ID NO: 1621 - DNA, 50 bp, homo sapien
acccagctcctgtatctcctggttcrctatttcccggtgcttctgtaata

SEQ ID NO: 1622 - DNA, 50 bp, homo sapien
tggtacattaattatactttcactaractttaaaatggaggagttatgta

SEQ ID NO: 1623 - DNA, 50 bp, homo sapien
ttccactgagtctatttgacaccacrggtaataagtgtgaactgcctgta

SEQ ID NO: 1624 - DNA, 50 bp, homo sapien
gcttcatggggcatatgctagagtckccttaccctctaacactgcccgtg

SEQ ID NO: 1625 - DNA, 50 bp, homo sapien
ttttgtgtctggtttcttttccttayatgtttgtgagattcaattacctc

SEQ ID NO: 1626 - DNA, 50 bp, homo sapien
agagatctggctcctcattcataaaytgaatctggtttttgacctacatg

SEQ ID NO: 1627 - DNA, 50 bp, homo sapien
aaaaacttagaagactttgcattagycaagaaacaaggtcaaacaacttt

SEQ ID NO: 1628 - DNA, 50 bp, homo sapien
tcctttatccttgaaatatctgaaakagcttatagaaaacattgatctaa

SEQ ID NO: 1629 - DNA, 50 bp, homo sapien
caaaggggtttgtgcacaaacataaratattggaatctatgattatatat

SEQ ID NO: 1630 - DNA, 50 bp, homo sapien
ttccttcttggatgattcagggaagwcttccaaaagatgtgccatttgag

SEQ ID NO: 1631 - DNA, 50 bp, homo sapien
aagtgtttctttgagttttaacccgmatgtatcaagttgctcgagaagat

SEQ ID NO: 1632 - DNA, 50 bp, homo sapien
gaactatctgcaatgtcatttctgawgaactggtctatttttagtcatgg

SEQ ID NO: 1633 - DNA, 50 bp, homo sapien
tttcctgagatgtcttttacctgagrctaataaggattgaaccaagcagt

SEQ ID NO: 1634 - DNA, 50 bp, homo sapien
acatctatctgggagaggtctggtaygttaaacactgatgctgatttggg

SEQ ID NO: 1635 - DNA, 50 bp, homo sapien
agataaagtgacatatataacaaccraaagacaggttgccttcaaaaagt

SEQ ID NO: 1636 - DNA, 50 bp, homo sapien
tgatctataagatggcacagagtaargtaaaaggaaatatgtgggtctta

SEQ ID NO: 1637 - DNA, 50 bp, homo sapien
tatcacgtagatcggctgtcttccaygcggcaacatctatctgggagagg

SEQ ID NO: 1638 - DNA, 50 bp, homo sapien
actgcagctcctttatctgggtttayctattaatatggccagatgttata

SEQ ID NO: 1639 - DNA, 50 bp, homo sapien
ccagtatatttaaagtctgttgcatragtcagcatttctcaggaactctc

SEQ ID NO: 1640 - DNA, 50 bp, homo sapien
ttgctttgactgagttttctttgacrgacagagtccactgtgcctgacca

SEQ ID NO: 1641 - DNA, 50 bp, homo sapien
aaaaactttagaactaggatgggaasaagagttggctaaacaagagcagg

SEQ ID NO: 1642 - DNA, 50 bp, homo sapien
gtagattgggatttttcaatgctgawactaggtggagttattctatgctc

SEQ ID NO: 1643 - DNA, 50 bp, homo sapien
aaaaaactaatactgtatgttgaacscatgatcttaagaccctagtccat

SEQ ID NO: 1644 - DNA, 50 bp, homo sapien
gtgtagcacagctgttactcaatatwagaaggacatttttaaacataatt

SEQ ID NO: 1645 - DNA, 50 bp, homo sapien
cattggtatagaaagagcatttgggmataggaaagatcacacatgaaact

SEQ ID NO: 1646 - DNA, 50 bp, homo sapien
aatagttactattcagccctttgcargaagagcttggcaattcctgtaat

SEQ ID NO: 1647 - DNA, 50 bp, homo sapien
tattacgcatttcttgttttaagtaygctcaccctaataaccctgtgaag

SEQ ID NO: 1648 - DNA, 50 bp, homo sapien
caagaaactgagacattaattgatasaaaatcgcatccaacacgtagatc

SEQ ID NO: 1649 - DNA, 50 bp, homo sapien
gattgtctcttcagtctgtcttctaktacggttgataaaaatttggtttt

SEQ ID NO: 1650 - DNA, 50 bp, homo sapien
tctgtctgtagaattgcatcggtcayagactccttggatttcaagtatgt

SEQ ID NO: 1651 - DNA, 50 bp, homo sapien
tgttttgaagggaaggtgtcggaaamtcattttattaaatagaagataag

SEQ ID NO: 1652 - DNA, 50 bp, homo sapien
ctagaaccctgctaatgtagagaaakaatacttttttaggagatcttttt

SEQ ID NO: 1653 - DNA, 50 bp, homo sapien
tgggtagcaagacccattctgcgtaygaaaggaagaaaggggaaattcag

SEQ ID NO: 1654 - DNA, 50 bp, homo sapien
ctttccaagagttttgtgagaattaratgagagaatatatagaaagtgct

SEQ ID NO: 1655 - DNA, 50 bp, homo sapien
aaagaaataatcaatcattgccttayaaagagaactaccacacaatccct

SEQ ID NO: 1656 - DNA, 50 bp, homo sapien
taaactggatgaagttaggcgataargttgaaccaaattcttcactcagt

SEQ ID NO: 1657 - DNA, 50 bp, homo sapien
tggaaatattaaataatattctgaargccatataactagtgtgtttgtta

SEQ ID NO: 1658 - DNA, 50 bp, homo sapien
ttagcacataaaaggtgatataaaayggcagagaggaaggagctccagag

SEQ ID NO: 1659 - DNA, 50 bp, homo sapien
tcctgctttaagcacgccaggcatayacagtttactttatttagcttata

SEQ ID NO: 1660 - DNA, 50 bp, homo sapien
gcaatatttctgtaaggtaaggtaaygcaaagtgttgtcatcatttactt

SEQ ID NO: 1661 - DNA, 50 bp, homo sapien
aagagggaaatttaaaattttcttcwaacaagtgataatgggcacacaac

SEQ ID NO: 1662 - DNA, 50 bp, homo sapien
tgatcatctaaagaagtgtcttttawagtatggcctgcctattggtgctg

SEQ ID NO: 1663 - DNA, 50 bp, homo sapien
taagtcagagccaagtaattcaagtraactttgtagtcatcagcccaaaa

SEQ ID NO: 1664 - DNA, 50 bp, homo sapien
tgaaggaaaaaattaaggtgacagargatggagtatatcaactggtgttc

SEQ ID NO: 1665 - DNA, 50 bp, homo sapien
ttattgagcgcaacacactcaattgraatggtgaattaatcttatacggt

SEQ ID NO: 1666 - DNA, 50 bp, homo sapien
agaaatgaatgtgcaaactttagaaygctctacaaatattattattattg

SEQ ID NO: 1667 - DNA, 50 bp, homo sapien
gttagttttatatacttggaaattasacctcttattctttctcatgaata

SEQ ID NO: 1668 - DNA, 50 bp, homo sapien
ttgaaaggcatggagtatgagttaaytgctgctgttgtttttcaagctta

SEQ ID NO: 1669 - DNA, 50 bp, homo sapien
tccggcatatacaaagcatcagtcayataacgggtcatcatgcagcaata

SEQ ID NO: 1670 - DNA, 50 bp, homo sapien
tcatggtgctagcctcactctcaagyaattttctggcaagaggcatccat

SEQ ID NO: 1671 - DNA, 50 bp, homo sapien
tgccttagcaattgtcagattaagamgcagagggcaattccttgcttgag

SEQ ID NO: 1672 - DNA, 50 bp, homo sapien
taactcctccaccattactctatccraaaagccaaaattattgaatgtta

SEQ ID NO: 1673 - DNA, 50 bp, homo sapien
tcacaccacctgcaacccaagttacmataggaacaccgattgcagttagc

SEQ ID NO: 1674 - DNA, 50 bp, homo sapien
gaattggtgggtaggagccaactaaratccaataaacttttgtctgtgac

SEQ ID NO: 1675 - DNA, 50 bp, homo sapien
gatttacccctcaaaaattaataaawtgcctgacccacgtagttctaatt

SEQ ID NO: 1676 - DNA, 50 bp, homo sapien
tcagtttttgcatcactagaagaaarcatataattgcacatttcttgatg

SEQ ID NO: 1677 - DNA, 50 bp, homo sapien
tccatctccaatgagtatatatgacrgtcaaggaaatatagaagcaagaa

SEQ ID NO: 1678 - DNA, 50 bp, homo sapien
ctatgatgtgtgtgaattaattttamagggcagtctggctattttgtctg

SEQ ID NO: 1679 - DNA, 50 bp, homo sapien
gtacagagggggtccttagtatccaygcctatgctttttgatgctgtagt

SEQ ID NO: 1680 - DNA, 50 bp, homo sapien
caagatttttatttctctgtcttcaygtttcagatatgccacagagagga

SEQ ID NO: 1681 - DNA, 50 bp, homo sapien
tggcctgtctccctttggacttctaygcgcgataaactatcttgttcaag

SEQ ID NO: 1682 - DNA, 50 bp, homo sapien
cccttttctatttgcatatgtcatcmatgggctgaagagacaagaaatta

SEQ ID NO: 1683 - DNA, 50 bp, homo sapien
aaaatccccaagtgtggcctcagaamataaaggttacattgggtgggttg

SEQ ID NO: 1684 - DNA, 50 bp, homo sapien
taagacaatttaattatttaacaccraattgtcacttgtgactaacttca

SEQ ID NO: 1685 - DNA, 50 bp, homo sapien
aagaaggcccattcttatcagcaacyatatatgtacttctcatcactctc

SEQ ID NO: 1686 - DNA, 50 bp, homo sapien
cccttttgaatagttctgattataakatccaccatgaaattttacgtttc

SEQ ID NO: 1687 - DNA, 50 bp, homo sapien
aattcttactgatctttagtcaacartctaatgtgtataattcttactga

SEQ ID NO: 1688 - DNA, 50 bp, homo sapien
agtactgggcctccagggcgtcgtayctctgtgagacatggctcgctgtg

SEQ ID NO: 1689 - DNA, 50 bp, homo sapien
agtatttgataaagtgagtgagggartaacaagaaaagagggtccccaaa

SEQ ID NO: 1690 - DNA, 50 bp, homo sapien
tataaggttgtgttttacagaaacasctacataaatactttgatgccaaa

SEQ ID NO: 1691 - DNA, 50 bp, homo sapien
ttaaagataagactctgttgtaaaawataaactggcaatttgatcattac

SEQ ID NO: 1692 - DNA, 50 bp, homo sapien
gaaattacatatctcatgcacactayggtaaagcctactgaactattctg

SEQ ID NO: 1693 - DNA, 50 bp, homo sapien
gaatctcactttcagaaaaatgtgasatagaaacattatacctctacagc

SEQ ID NO: 1694 - DNA, 50 bp, homo sapien
tgaataaatttttcactttaaacaasttactctggctgtaatgaggaaaa

SEQ ID NO: 1695 - DNA, 50 bp, homo sapien
ttatttagttgatacaaagagcaaaygtaaatatccctttcagcaggcaa

SEQ ID NO: 1696 - DNA, 50 bp, homo sapien
accaccccttcctgcaatgactgaasataagtcccctccgaagctcatgt

SEQ ID NO: 1697 - DNA, 50 bp, homo sapien
aggagataaccatcagagaaagcatsacaccacagttctgcctacaggac

SEQ ID NO: 1698 - DNA, 50 bp, homo sapien
gttaaaagaattaaagtaaaacatarcaatgactcaacaaataggaaatc

SEQ ID NO: 1699 - DNA, 50 bp, homo sapien
agtccaatctaaaagaggcagatgawtaactcctggctgccttccttctt

SEQ ID NO: 1700 - DNA, 50 bp, homo sapien
aagggccctcaatgatccttgcaatmaaatttcctcaccatttcttattc

SEQ ID NO: 1701 - DNA, 50 bp, homo sapien
actgactcacacacaccataaagtcmacatttaaaacttatgttttgctg

SEQ ID NO: 1702 - DNA, 50 bp, homo sapien
attatcacttactagttgcctaaatmactctcatctttgagttaaactag

SEQ ID NO: 1703 - DNA, 50 bp, homo sapien
taaaaatctagaattttcaatgtagyatatctgaatcctatttttttcct

SEQ ID NO: 1704 - DNA, 50 bp, homo sapien
gatatttgtatttcacagatgtttayctcgtttcaataatgaagacattg

SEQ ID NO: 1705 - DNA, 50 bp, homo sapien
attttctgctatgaaataaaatggcraattactaagcactacctatttta

SEQ ID NO: 1706 - DNA, 50 bp, homo sapien
cttctgatttaaaggtgttttattgracaatatatgccatcttttcttta

SEQ ID NO: 1707 - DNA, 50 bp, homo sapien
tttgacaagaacttgtgctggaaaaytgtcataaatacaatgatacaaat

SEQ ID NO: 1708 - DNA, 50 bp, homo sapien
atctcacccctacttaaccaattccwcaatttagaatctgtcatctgcag

SEQ ID NO: 1709 - DNA, 50 bp, homo sapien
atagagaaagatgctagcaagataaytggtttgtaaacatagcacagata

SEQ ID NO: 1710 - DNA, 50 bp, homo sapien
atgagaaacagatctttaaaatcaaygacctatgtgaaccatttacaaaa

SEQ ID NO: 1711 - DNA, 50 bp, homo sapien
gaggacctccatgtgaggaaagtcgsagcagagatgaaaaaccaaacaac

SEQ ID NO: 1712 - DNA, 50 bp, homo sapien
caagaagcagataaatattcttcacraactgttttaatgatatagcaatc

SEQ ID NO: 1713 - DNA, 50 bp, homo sapien
ttttgttagtaattctgcttaattcraaaagaacacaaaggtgattacaa

SEQ ID NO: 1714 - DNA, 50 bp, homo sapien
tgattcctacagccctggttctttayctcaccacttgcactcatgttgct

SEQ ID NO: 1715 - DNA, 50 bp, homo sapien
gcagcagccaacttatgactatgaasacccaagctgaggatgaatcagtg

SEQ ID NO: 1716 - DNA, 50 bp, homo sapien
cttctattgtattgacttttttctcratgccattatattgctacttacat

SEQ ID NO: 1717 - DNA, 50 bp, homo sapien
acttgtttgatcacaaagtctttgayggatacagtaagtgctctgcaccc

SEQ ID NO: 1718 - DNA, 50 bp, homo sapien
agagggatcagaagactggtcttgayatatgcctgaaaaatctggaaatg

SEQ ID NO: 1719 - DNA, 50 bp, homo sapien
tgaactgagttgttctgaatcctgawaaattttcattatccattttgaaa

SEQ ID NO: 1720 - DNA, 50 bp, homo sapien
aaatggtaataatcgcacagatgaargtgatacatgaataaccaaggttg

SEQ ID NO: 1721 - DNA, 50 bp, homo sapien
ggctagacttagtgacttactcccaragaatagtgaatggatgagaaaaa

SEQ ID NO: 1722 - DNA, 50 bp, homo sapien
tactttcctcatattttctctctgcygattacctcaagcataaattctgc

SEQ ID NO: 1723 - DNA, 50 bp, homo sapien
gtgcaatttatttatattattatcayattgatgttgaaataattatacaa

SEQ ID NO: 1724 - DNA, 50 bp, homo sapien
ccactttatggatggggcctaaaagycagatagtttgtttgacttgaagg

SEQ ID NO: 1725 - DNA, 50 bp, homo sapien
aagtctcctgggtcaaatcctaatamcaaacttgtgctggtttctctctg

SEQ ID NO: 1726 - DNA, 50 bp, homo sapien
ttagaactctttaaacatcaaacccracttctcatgcacagtaaacacaa

SEQ ID NO: 1727 - DNA, 50 bp, homo sapien
aacaatctgtcagatccataaatggyatgtcatctaataacccgcaataa

SEQ ID NO: 1728 - DNA, 50 bp, homo sapien
actaattatatatggtacaagtagtwaatgttaaagaagtggttaaaata

SEQ ID NO: 1729 - DNA, 50 bp, homo sapien
tctgggagatgaaatgtgttcagagraaaaacaggactgtgtctctttgc

SEQ ID NO: 1730 - DNA, 50 bp, homo sapien
aggtgcttacaactgaggtagatacwctattttaaggaggtaaggggagc

SEQ ID NO: 1731 - DNA, 50 bp, homo sapien
tataagcttcccagtctcttatggcraatttaaaagtttacaaataggtt

SEQ ID NO: 1732 - DNA, 50 bp, homo sapien
gaaaaacgaaatcactggttcacagraagtaacaactctgagattccaaa

SEQ ID NO: 1733 - DNA, 50 bp, homo sapien
aaaaggaataattcaccaggaatacraaatagttcaaaattttatgcacc

SEQ ID NO: 1734 - DNA, 50 bp, homo sapien
agagaaaacgaaggaaatttgtcctwaagaagttactgcctaaactctca

SEQ ID NO: 1735 - DNA, 50 bp, homo sapien
tgtgcggtggccgccaaggaggaaamagaaggaggcaacaccaagagagc

SEQ ID NO: 1736 - DNA, 50 bp, homo sapien
taatccttattatctggaggaaacaytcagtatttgcaattttgcattca

SEQ ID NO: 1737 - DNA, 50 bp, homo sapien
gcgtgagccaacgtgcccggcagaakattggttcttttttttttttgaga

SEQ ID NO: 1738 - DNA, 50 bp, homo sapien
tggcttgggattactaggtcatgtcraggtagtctgcagaagttgagttt

SEQ ID NO: 1739 - DNA, 50 bp, homo sapien
ctcttaaaccatgtcctaatctacaytggagtcttacactgcaggtaaga

SEQ ID NO: 1740 - DNA, 50 bp, homo sapien
tacctcagtgctaagtcatcatcccygagagaagaatgtttcacgttcag

SEQ ID NO: 1741 - DNA, 50 bp, homo sapien
ccactaaacagtctaaacagaacgcrgcaatgtcactacactagagctgg

SEQ ID NO: 1742 - DNA, 50 bp, homo sapien
tgcttctttgcatcagattcctggaygagatttcacaaacagccaaagaa

SEQ ID NO: 1743 - DNA, 50 bp, homo sapien
gaacatgactgcaagccaaatagtartacaaacctatgcagccagagaag

SEQ ID NO: 1744 - DNA, 50 bp, homo sapien
gtatgttgaaaaattaccacagcacratttcctctctcatagtaattatc

SEQ ID NO: 1745 - DNA, 50 bp, homo sapien
ttgctataacatgttgtgctactcaygggaatctggatgtaggtggggga

SEQ ID NO: 1746 - DNA, 50 bp, homo sapien
ttctaatgatgaagctacaagtatayggtttaaaaagatgtgtggtaatg

SEQ ID NO: 1747 - DNA, 50 bp, homo sapien
tagaagtagtaatagttgatgaaacrctgtacaaaatggatctcaaaagc

SEQ ID NO: 1748 - DNA, 50 bp, homo sapien
taattatttagggatccaaagtagcygccattaatgaatttgaatgtatt

SEQ ID NO: 1749 - DNA, 50 bp, homo sapien
gcttctgtttcttccccaatgtcaaygcttggtaatcttattcttcttcc

SEQ ID NO: 1750 - DNA, 50 bp, homo sapien
tatggtgaagaatcttggtttctatyaacattagcctaattacttatttg

SEQ ID NO: 1751 - DNA, 50 bp, homo sapien
atggaagttacactcaaataggacaraacactatgcaaagtctccttctc

SEQ ID NO: 1752 - DNA, 50 bp, homo sapien
agactgtattccacttgattccttayaagaaaaatgaggaactcattacc

SEQ ID NO: 1753 - DNA, 50 bp, homo sapien
tatattctatcacaaaaaataacacyatattcaactaacagtctcagctt

SEQ ID NO: 1754 - DNA, 50 bp, homo sapien
atctatgtgggaaagatgaaaggaaytgagatattgctgctaagatgggg

SEQ ID NO: 1755 - DNA, 50 bp, homo sapien
ttacccagagtcattcagttgatacscttgggcaatctggcttcaacatc

SEQ ID NO: 1756 - DNA, 50 bp, homo sapien
gaatgactctgggtaaattatctaaygtagctatgtctctccttcatcat

SEQ ID NO: 1757 - DNA, 50 bp, homo sapien
taaattatttgttcgatccttcaaarcagagaaactaagtttaactctac

SEQ ID NO: 1758 - DNA, 50 bp, homo sapien
acatcccgctttccgctctgaaaaaygtactctgtgtataatgtatatag

SEQ ID NO: 1759 - DNA, 50 bp, homo sapien
tgaggtaaaggtaacatttggaccasagatacatcccagactgtttataa

SEQ ID NO: 1760 - DNA, 50 bp, homo sapien
gtaagggcacagcaaggacattctascaattttagaacatgcaaggattt

SEQ ID NO: 1761 - DNA, 50 bp, homo sapien
tatgaaaaatcttaaatcttaaaaartggagtttatgtagtcatgtgcca

SEQ ID NO: 1762 - DNA, 50 bp, homo sapien
gtaaggtagaagcaaactggtataaraagaatgggtagggacgaggatta

SEQ ID NO: 1763 - DNA, 50 bp, homo sapien
cagatattttaaccagggttatgaasacaatttctactaccaagagagga

SEQ ID NO: 1764 - DNA, 50 bp, homo sapien
tttcctgagtgatgtatgtagcaaamgcctctggcacccgtgtcatatct

SEQ ID NO: 1765 - DNA, 50 bp, homo sapien
tatcttgaaatgaaacagtacagacracttagttcccgaatgccatagaa

SEQ ID NO: 1766 - DNA, 50 bp, homo sapien
ccttgtgctgacaatgccacacttcmcatgtatgctgtacgtcttcctgc

SEQ ID NO: 1767 - DNA, 50 bp, homo sapien
ctgcttagtgaagctcttgccatacratctcctgaatgggatagataact

SEQ ID NO: 1768 - DNA, 50 bp, homo sapien
atatcctctagattgaaatattcaartcacttctgtcttagttcaatgcc

SEQ ID NO: 1769 - DNA, 50 bp, homo sapien
acgggccaacttcatggactagtagrcattttgggagatggtcttaaggt

SEQ ID NO: 1770 - DNA, 50 bp, homo sapien
tctaatatgcaaaatatattactccraacttaaagtgcaataagtagctg

SEQ ID NO: 1771 - DNA, 50 bp, homo sapien
aatcgtatcagtcttgaaaggtccartgattttactgacagattttctct

SEQ ID NO: 1772 - DNA, 50 bp, homo sapien
ttttaaaagctttcctaaattgttcratacatttcaaagtcagaagtgag

SEQ ID NO: 1773 - DNA, 50 bp, homo sapien
ttctcccaggagactggtatagatayggtggttctcagacttctgacact

SEQ ID NO: 1774 - DNA, 50 bp, homo sapien
agtccttaagaaactatgttaagacrccaatttggatttataaagaacac

SEQ ID NO: 1775 - DNA, 50 bp, homo sapien
agaagggtgacaagtgtttagcttarctccagccagtagacagcctggtg

SEQ ID NO: 1776 - DNA, 50 bp, homo sapien
tgtcttcatttttaaatggaaaaaartatagcacttacctgtgatcttta

SEQ ID NO: 1777 - DNA, 50 bp, homo sapien
tcacttgtataaaatttgcacttgastaacattccattcccattttaggt

SEQ ID NO: 1778 - DNA, 50 bp, homo sapien
gaagcccattcaatgttaaagtacaragtaaacacttcctgtagatattg

SEQ ID NO: 1779 - DNA, 50 bp, homo sapien
tggcttaattgtcaccttgttaagasagtatacctttgatgtccctgctc

SEQ ID NO: 1780 - DNA, 50 bp, homo sapien
tataggacaaattggacatttagcayaaaccttatgaactactgtgggtg

SEQ ID NO: 1781 - DNA, 50 bp, homo sapien
gatatggatactggtagtcctcaaamcacacgttgagaaatatctttgca

SEQ ID NO: 1782 - DNA, 50 bp, homo sapien
tctctggagaatcttgactaatatawctaaggactctataggggtttatg

SEQ ID NO: 1783 - DNA, 50 bp, homo sapien
tgcttaataaatgttagctgactcawaaaggaaaacaaaaacacctgcaa

SEQ ID NO: 1784 - DNA, 50 bp, homo sapien
gtttgttgccttagctttgttatgayggtatttgataggacttccaacag

SEQ ID NO: 1785 - DNA, 50 bp, homo sapien
caccaacatacaagatgaactgaagratggaaaagtgcaagcaggcagca

SEQ ID NO: 1786 - DNA, 50 bp, homo sapien
aagtaatatgcaaataactcagacaygtaaatcacatagaattacgaata

SEQ ID NO: 1787 - DNA, 50 bp, homo sapien
aaactgcaggttaatcaccgaggaayggctcatgtcaattccccactgcc

SEQ ID NO: 1788 - DNA, 50 bp, homo sapien
gtattctccttggagagcaaataacrattccttcaagctaaaaacctccc

SEQ ID NO: 1789 - DNA, 50 bp, homo sapien
aaagatggttgatcaacatgctaagraatattaaaaggctatattacata

SEQ ID NO: 1790 - DNA, 50 bp, homo sapien
aaaccttggttctccagagccaatargatagatacagattgagagaaaga

SEQ ID NO: 1791 - DNA, 50 bp, homo sapien
gcctgtgcttttggtgagatatccaraaagtccttgtcaacaccaatatt

SEQ ID NO: 1792 - DNA, 50 bp, homo sapien
tctgatttgatttattatttgtctamaccaattgtataacttccttctaa

SEQ ID NO: 1793 - DNA, 50 bp, homo sapien
tgctttttctagtactactgctgtcrctctatgactgttcatggctaaca

SEQ ID NO: 1794 - DNA, 50 bp, homo sapien
aaggacaaagcagagaatgtattcayaaaatattttgatatgtttcaatg

SEQ ID NO: 1795 - DNA, 50 bp, homo sapien
gaatacagtaatttttagtataatgyaaattcgtagacaagattattgta

SEQ ID NO: 1796 - DNA, 50 bp, homo sapien
tttagggttacaatcaccacttacargatttttacccaaattaatcatta

SEQ ID NO: 1797 - DNA, 50 bp, homo sapien
gatcatactagagtcaactgaaggakgtacattaaccaaaagctctaaat

SEQ ID NO: 1798 - DNA, 50 bp, homo sapien
aataaagtcatattttccaacctcarctggatcctcagcgcccaacaatt

SEQ ID NO: 1799 - DNA, 50 bp, homo sapien
cctaaaagaaattaaatacatctgcragtaacttaattaataggtcagca

SEQ ID NO: 1800 - DNA, 50 bp, homo sapien
tccttaggcaattttggcattgtagkaacaacctagaatgtacttacaga

SEQ ID NO: 1801 - DNA, 50 bp, homo sapien
tacattatttcttctcaacaatatarcgtgtataaaatcatgtgaaattg

SEQ ID NO: 1802 - DNA, 50 bp, homo sapien
ggaaacatgcataatcattttccaayttaatgtgaccattctcctcttcc

SEQ ID NO: 1803 - DNA, 50 bp, homo sapien
atactacctcatcgggtttgtctgasgattaaacgacttcatacatgtaa

SEQ ID NO: 1804 - DNA, 50 bp, homo sapien
tgttgttgatcacttttccaaattayaaacttttgcttaccggtgctttc

SEQ ID NO: 1805 - DNA, 50 bp, homo sapien
tacagcaaacatctttcaactggtcycaatgcatctattttacattcctt

SEQ ID NO: 1806 - DNA, 50 bp, homo sapien
caatttgtttaaagtaatacatatawtagtcatggaattatcaacacaaa

SEQ ID NO: 1807 - DNA, 50 bp, homo sapien
acctaccaaatatctagggatcagaraaattgattcaggaaatactagct

SEQ ID NO: 1808 - DNA, 50 bp, homo sapien
cactaataagttgctgttcttgttcraaatggtgatatgactaggaacat

SEQ ID NO: 1809 - DNA, 50 bp, homo sapien
ctttgaatgtgtcaatccaagatacrgatggctaatccacagataaactc

SEQ ID NO: 1810 - DNA, 50 bp, homo sapien
cacatgtcacgtattttaaacagcartagaacttgagagctaatgggaac

SEQ ID NO: 1811 - DNA, 50 bp, homo sapien
gtgcaaatgaatcacatggggacaarccaacacactggcaccccactgtg

SEQ ID NO: 1812 - DNA, 50 bp, homo sapien
gtttctcacattattagtgtgcaccyatgcttttttatttatcacttata

SEQ ID NO: 1813 - DNA, 50 bp, homo sapien
ttttgaagcttaaacttgaatcaagrcatattacagatttccctttcatg

SEQ ID NO: 1814 - DNA, 50 bp, homo sapien
tcagatttgaataaatgaggtatttsaaaaggtattactctgtgggaagt

SEQ ID NO: 1815 - DNA, 50 bp, homo sapien
gtctctctttttactttcactagaartcctaggccaaacttgaaactcaa

SEQ ID NO: 1816 - DNA, 50 bp, homo sapien
tgaatcttcccaaaaattagcatgastcaaatgtaaacacaaagataggc

SEQ ID NO: 1817 - DNA, 50 bp, homo sapien
tctggcgtatccccactgcttggaasataacaaggtgaactaccggagga

SEQ ID NO: 1818 - DNA, 50 bp, homo sapien
atattcttcccttcaagaaggagagyctaattttcttcccattgaatgtg

SEQ ID NO: 1819 - DNA, 50 bp, homo sapien
tcattctccagattcagtccagtaawaagctgctagatactgccttttgt

SEQ ID NO: 1820 - DNA, 50 bp, homo sapien
tttatatacttatttgtgagtatcaraatctcaagggcagaaggttagaa

SEQ ID NO: 1821 - DNA, 50 bp, homo sapien
ttctttttcaggtcacgtatcagttraaaattcttacaacagcattattt

SEQ ID NO: 1822 - DNA, 50 bp, homo sapien
tctgaggtggtaagtataaacttcaratagcagacagaaaggagttaagg

SEQ ID NO: 1823 - DNA, 50 bp, homo sapien
acctagaggattctgatactgttccmagatataaaaaatatgttacacat

SEQ ID NO: 1824 - DNA, 50 bp, homo sapien
gtactatcctggggagtattaaatgragcaatgggttaaatgcacctaac

SEQ ID NO: 1825 - DNA, 50 bp, homo sapien
ctgggaacagtatcagaatcctctargtacaagtatatttgtttgcatat

SEQ ID NO: 1826 - DNA, 50 bp, homo sapien
taaagattttactcatagtgattcartaccaggagtcaaaattttctcaa

SEQ ID NO: 1827 - DNA, 50 bp, homo sapien
gatccaataatgaaaaggaagtcctsaacgatctcacattagtgggaaaa

SEQ ID NO: 1828 - DNA, 50 bp, homo sapien
ggtagagcttgggtcgagatatccckatttgctggaaatcgggaagtgtc

SEQ ID NO: 1829 - DNA, 50 bp, homo sapien
ttggaaatgcatataaagctataaartgattttaaaatcctaagagaaag

SEQ ID NO: 1830 - DNA, 50 bp, homo sapien
aggcagagtcctactctataaaccartgagatgaattaagtcagcaagaa

SEQ ID NO: 1831 - DNA, 50 bp, homo sapien
taacaaagttttctgaaaggcaaagscaatgtgaaaaagttttgtgcttt

SEQ ID NO: 1832 - DNA, 50 bp, homo sapien
tccctgacattaggtgtgggataaargtggaaaatgcagtttgcctcata

SEQ ID NO: 1833 - DNA, 50 bp, homo sapien
ctctaggatctctcatacaactaaawtatccaggaaacaacaacaagaaa

SEQ ID NO: 1834 - DNA, 50 bp, homo sapien
catttgtaggtataatggacataggractgttaacagcaattacctctac

SEQ ID NO: 1835 - DNA, 50 bp, homo sapien
ggactgttaacagcaattacctctamgaagtcagaccagatgagagaaaa

SEQ ID NO: 1836 - DNA, 50 bp, homo sapien
tcaagaaaacttttctaatatgcacwaatctgcatcatttatgatatgat

SEQ ID NO: 1837 - DNA, 50 bp, homo sapien
actgcttcataattattgtcaggaaygttctggatgaacaatgtggtggt

SEQ ID NO: 1838 - DNA, 50 bp, homo sapien
tataatgggaataggaaatgaagaamaaacaagtcacctataaggtatag

SEQ ID NO: 1839 - DNA, 50 bp, homo sapien
tgttaccatgataagtcaggctcatwaccagggccagagatgagatatga

SEQ ID NO: 1840 - DNA, 50 bp, homo sapien
tggacttcacacacctctgtctaaaygtgcttgaagagtagtcccttatt

SEQ ID NO: 1841 - DNA, 50 bp, homo sapien
cttgaaataggagtgaagggagataygtaaaatgcctagcaaagtgcctg

SEQ ID NO: 1842 - DNA, 50 bp, homo sapien
tgcagaggtaatgagccacttgaaargttctcggtgctttccaaggagat

SEQ ID NO: 1843 - DNA, 50 bp, homo sapien
aagaaagcagaatatagtgaaactcmatttttaggtatttatggtaagta

SEQ ID NO: 1844 - DNA, 50 bp, homo sapien
gacatatttagacatcactagaacaraatttactatgtttcaaaaacact

SEQ ID NO: 1845 - DNA, 50 bp, homo sapien
aaaaagatgcatcagtgaggtaatayaataataactctggatctaaaaac

SEQ ID NO: 1846 - DNA, 50 bp, homo sapien
aaaaattgatgaatttctaataaaaygctgagaaaaagagagaagacacc

SEQ ID NO: 1847 - DNA, 50 bp, homo sapien
atatagagaagcagagagatttaacrggcggttctgttgcatcagtacag

SEQ ID NO: 1848 - DNA, 50 bp, homo sapien
cccaaatgaaagggctgaaggcaaartttcggcagattgaagatgatcga

SEQ ID NO: 1849 - DNA, 50 bp, homo sapien
ccttgcacatatgggccaatgcacaktcatttctagctgagtgccccact

SEQ ID NO: 1850 - DNA, 50 bp, homo sapien
tttcccagctttccactgactttgcygattgacatcctgtggctttatgc

SEQ ID NO: 1851 - DNA, 50 bp, homo sapien
gataagtcctgccgttgagcacagaygaagtaatcggaacacactttcca

SEQ ID NO: 1852 - DNA, 50 bp, homo sapien
gagaaagaaatcaacaatgagccccrgattttacacctagctgcctgatg

SEQ ID NO: 1853 - DNA, 50 bp, homo sapien
gtagaccaacagtaaaggaaatactwaagagtgttcattaaatagaagaa

SEQ ID NO: 1854 - DNA, 50 bp, homo sapien
tactctacctgtactggaaatatcaracacagactatgagacaactatga

SEQ ID NO: 1855 - DNA, 50 bp, homo sapien
tgtacaaggttaaaatatgtaaatcratagtattcgcggaagaaaagtta

SEQ ID NO: 1856 - DNA, 50 bp, homo sapien
tctttcacctgccctaatggatgtaycttataggttaaatgagatcacaa

SEQ ID NO: 1857 - DNA, 50 bp, homo sapien
ttccagagtatgtgctagtccaacartgcaaagagatcgaatttgtccat

SEQ ID NO: 1858 - DNA, 50 bp, homo sapien
cggcctttcttcctaaaatgaagcawaataatcaaatattataatgtcaa

SEQ ID NO: 1859 - DNA, 50 bp, homo sapien
tctataaagtatcccctcagttaagyattaattatgaagcaaattgtcac

SEQ ID NO: 1860 - DNA, 50 bp, homo sapien
tacagggagagaaagagaatcatacrattgaggtacttcaaatacgacgt

SEQ ID NO: 1861 - DNA, 50 bp, homo sapien
aaagtaagaaagggacttactttaargattgtgatgacatggctacctat

SEQ ID NO: 1862 - DNA, 50 bp, homo sapien
aagagattaacacctatacacatcaraattaaactgttgaaatccaaaga

SEQ ID NO: 1863 - DNA, 50 bp, homo sapien
aatttttttattcatagccctctacraatttttttattttgaaagagaac

SEQ ID NO: 1864 - DNA, 50 bp, homo sapien
tcagcatggatatccaaaactgatgmagataggtagctgcgcaattaata

SEQ ID NO: 1865 - DNA, 50 bp, homo sapien
gttcagaatgatttttcctcttcaaygtctaaggctttatggctcaacca

SEQ ID NO: 1866 - DNA, 50 bp, homo sapien
aaaagtcatggaacatgtatattatsaaaaaactgtgaatggatttcaat

SEQ ID NO: 1867 - DNA, 50 bp, homo sapien
tgatcaataggagacagttgaatgayatacattggcagagggagggtcct

SEQ ID NO: 1868 - DNA, 50 bp, homo sapien
aaattagatttgctaaagtgatgaaytggaagatggaacattttactaaa

SEQ ID NO: 1869 - DNA, 50 bp, homo sapien
aatatgtccaaggctctctcacataygtaagtaagcaatgacaaaaaacc

SEQ ID NO: 1870 - DNA, 50 bp, homo sapien
aaaatgcactagagttcttattagcmagctactgctctttctggcagtca

SEQ ID NO: 1871 - DNA, 50 bp, homo sapien
ttagaaagtaaggaaaaagaaccaargattaaaccacagaatatcaacat

SEQ ID NO: 1872 - DNA, 50 bp, homo sapien
agcagctaaaccctgccaggaagaamagtctctgagttgccaccattgct

SEQ ID NO: 1873 - DNA, 50 bp, homo sapien
gagagatctaatagatacccttctayaatgccagtgactcctacaatgtc

SEQ ID NO: 1874 - DNA, 50 bp, homo sapien
aaaactcgacttctttaaagctgtamcctattaatccacagtgcaaccca

SEQ ID NO: 1875 - DNA, 50 bp, homo sapien
caatttttaatggactaacttgaaarcaatcttttatcttatgctggatg

SEQ ID NO: 1876 - DNA, 50 bp, homo sapien
aattatcaaactaattactcctgaakactggttaccagaagcaaagaagc

SEQ ID NO: 1877 - DNA, 50 bp, homo sapien
tctcaattttagatttcttgttatcrcttaaatactatattctagttatc

SEQ ID NO: 1878 - DNA, 50 bp, homo sapien
aggcaatttgttaacttatataagamgtttaaatcacagtgaggcacaaa

SEQ ID NO: 1879 - DNA, 50 bp, homo sapien
tttcaagtagaggaagggctaaaaartacagcaatatcagctgcactgag

SEQ ID NO: 1880 - DNA, 50 bp, homo sapien
ttcacactattgatttatgctttcaktatctgcagaaaactttaatgata

SEQ ID NO: 1881 - DNA, 50 bp, homo sapien
ttctgagcccctgatagaaatgacartctttctcacaaaatttatattag

SEQ ID NO: 1882 - DNA, 50 bp, homo sapien
tcctactttatacttcgaaatttaartaaaatatcatagctccagaaaac

SEQ ID NO: 1883 - DNA, 50 bp, homo sapien
tcagcttacttccaggaaaactgtcwcaattaaataagattctctatgaa

SEQ ID NO: 1884 - DNA, 50 bp, homo sapien
acattggcaatcttgtctggatcacrcactcctagtgaatctcaatgcag

SEQ ID NO: 1885 - DNA, 50 bp, homo sapien
ttttatttctccttgaaggcagtcargttattcacccaatgacctggtat

SEQ ID NO: 1886 - DNA, 50 bp, homo sapien
cttataaatgtgaaagtatgagtcawcttatattaatgcactgaattatg

SEQ ID NO: 1887 - DNA, 50 bp, homo sapien
atattatgatccacagttgaacttayctccatttggttgcatttattatc

SEQ ID NO: 1888 - DNA, 50 bp, homo sapien
ttaagagggcaaatttaaccaatgargtgctgtgttttttaaaaaaagag

SEQ ID NO: 1889 - DNA, 50 bp, homo sapien
tcacacgcagataaagtcatgttgartacagaattgaggctgtttccatc

SEQ ID NO: 1890 - DNA, 50 bp, homo sapien
tctcaaatgacacattccaattgtayatttcactctcaaaattattttaa

SEQ ID NO: 1891 - DNA, 50 bp, homo sapien
tgaaagcaaatgcttacaagaccagraagataacaataatgagtgatacc

SEQ ID NO: 1892 - DNA, 50 bp, homo sapien
ggagcttggggattaggcccatgaayggaaagtcctcaggaatccaggca

SEQ ID NO: 1893 - DNA, 50 bp, homo sapien
attattattaattgatctaaggtatragttttttcaaaataataatagca

SEQ ID NO: 1894 - DNA, 50 bp, homo sapien
catatcatgcagcaccctcgtttaayagtgattacagcagtttcacccag

SEQ ID NO: 1895 - DNA, 50 bp, homo sapien
acacaaatcggaaattccgcaaggtraaatgtgctgagatgcaggcaagc

SEQ ID NO: 1896 - DNA, 50 bp, homo sapien
gggccaaattgaacatagtttattasattactagctatgaaaaaccctga

SEQ ID NO: 1897 - DNA, 50 bp, homo sapien
gaatcatgtcacttcactgtttaaaycatttcatctttcctctgtgccca

SEQ ID NO: 1898 - DNA, 50 bp, homo sapien
aaggtaggtatatgataattatgtaygaaaatgtcctttacttttcactg

SEQ ID NO: 1899 - DNA, 50 bp, homo sapien
taaaacctaagggaggtttaactackaatttactgcttggacctcaatta

SEQ ID NO: 1900 - DNA, 50 bp, homo sapien
tcttttatggggaacgaaggaactakgttttgccctgcaattaaattttc

SEQ ID NO: 1901 - DNA, 50 bp, homo sapien
taaagaaggcatccttcgggtctagkcaggtgaaccagctgtcctcagct

SEQ ID NO: 1902 - DNA, 50 bp, homo sapien
tactacttgaaattagattcagatcratcccacaggttaagctcagttct

SEQ ID NO: 1903 - DNA, 50 bp, homo sapien
tactaagcttcattacagatttcatwagctccagaaggtcaggggccgtg

SEQ ID NO: 1904 - DNA, 50 bp, homo sapien
aacattaacatatgtgttttctgaaktctgtgagccattctgccaaatta

SEQ ID NO: 1905 - DNA, 50 bp, homo sapien
gtcaagaattggatgttgaacattarcctttcagccacaatcacagacag

SEQ ID NO: 1906 - DNA, 50 bp, homo sapien
agataattttctggaaatctgaaacracagcatttatgaaccccaatcca

SEQ ID NO: 1907 - DNA, 50 bp, homo sapien
ttctatgaactcagagccatgcccartctatctcatatctgactacccgg

SEQ ID NO: 1908 - DNA, 50 bp, homo sapien
gaaaggacattaaataccagcaagamattttacagttattaaaagcagta

SEQ ID NO: 1909 - DNA, 50 bp, homo sapien
tcaaaggaagattgcccactctgtargggagagtttaatatgcttaccac

SEQ ID NO: 1910 - DNA, 50 bp, homo sapien
aggaaacttccattgtatcagattayggtaaaatatgcatttcaatgttt

SEQ ID NO: 1911 - DNA, 50 bp, homo sapien
caaatctacttatccttctcctgcartgcaaaattacttgtacttttggg

SEQ ID NO: 1912 - DNA, 50 bp, homo sapien
aattgtacgccatagtgtgacaaaawccttttctgttgttgttttaagat

SEQ ID NO: 1913 - DNA, 50 bp, homo sapien
ctaagaacctcatttatctgaaaccrcattatctgaaaacctctgcaaaa

SEQ ID NO: 1914 - DNA, 50 bp, homo sapien
gttcatttttaaaagattcagtgtarctttgcctggtgcagtggctcatg

SEQ ID NO: 1915 - DNA, 50 bp, homo sapien
ttccaggtgtgggttgcattcgtcaytatactttgtttcttttttgagac

SEQ ID NO: 1916 - DNA, 50 bp, homo sapien
tgtatccccaatatataacatgttcyctcgagtcttcattaaataagata

SEQ ID NO: 1917 - DNA, 50 bp, homo sapien
tctgggaggtgttttgcttctagagmccaaattattaagcaaacttaatc

SEQ ID NO: 1918 - DNA, 50 bp, homo sapien
tcctctctatgggccaaatttctacwcttcagataagatcatccataagt

SEQ ID NO: 1919 - DNA, 50 bp, homo sapien
aaaataagatgtttacttatgggacmgtacagtgagcagataaccaaaac

SEQ ID NO: 1920 - DNA, 50 bp, homo sapien
ccttggactaacaaattaatcatagratagctgtgttcacattttgtgct

SEQ ID NO: 1921 - DNA, 50 bp, homo sapien
agattagttagatcatctatctaaasagtagcaagactattaggaattat

SEQ ID NO: 1922 - DNA, 50 bp, homo sapien
taggtggaagtataccatactgaatragagactattgacacacagattcc

SEQ ID NO: 1923 - DNA, 50 bp, homo sapien
tcacactacatattagccactattayaactgagcaaaacatttttaaatt

SEQ ID NO: 1924 - DNA, 50 bp, homo sapien
gattaaagcctcttccttcctaaaastggtgtctgaaaggttttgtctga

SEQ ID NO: 1925 - DNA, 32 bp, homo sapien
gtgctccctatctgaakaatggtaaccagtta

SEQ ID NO: 1926 - DNA, 50 bp, homo sapien
ttaccttttcaagtagaacaaatacyggccaactcaaactgccaacattt

SEQ ID NO: 1927 - DNA, 50 bp, homo sapien
gagaaaaattaagtaaatatctgaaygacaaaggatgtgattaaatgact

SEQ ID NO: 1928 - DNA, 50 bp, homo sapien
aaactcccttagagactcagattaaygaaaacaaaaggagacttcttcag

SEQ ID NO: 1929 - DNA, 50 bp, homo sapien
actggttataagtactgagaataaasaatcactttgactaactgcattat

SEQ ID NO: 1930 - DNA, 50 bp, homo sapien
atgtaacactagacttgtgggtttawgagatagtaaatctgtatacactg

SEQ ID NO: 1931 - DNA, 50 bp, homo sapien
accataaaatatagctaccttaataygaataaacatgaagaagaactgaa

SEQ ID NO: 1932 - DNA, 50 bp, homo sapien
attccctttattatgctcgatagtcycttttttactacttaaaaactttt

SEQ ID NO: 1933 - DNA, 50 bp, homo sapien
tgcttaattgaaagaaggtacacaaycctgagagttctccttcagaagga

SEQ ID NO: 1934 - DNA, 50 bp, homo sapien
gtagaccgcttttaactctttttacyctctgttctaatattaatttcaac

SEQ ID NO: 1935 - DNA, 50 bp, homo sapien
agaaatgcttcttgagaaactgagtraatacagcctcacatatttaggca

SEQ ID NO: 1936 - DNA, 50 bp, homo sapien
atcaggtccaagttgcaatattccargtaagaaatcaggtggccagaact

SEQ ID NO: 1937 - DNA, 50 bp, homo sapien
catcagccaaatggtgatgcaataayaggctcaagatgaagcttttatta

SEQ ID NO: 1938 - DNA, 50 bp, homo sapien
gatggaaggtcaagtgaacaaattaragaaatcaggcagaaaatatttcc

SEQ ID NO: 1939 - DNA, 50 bp, homo sapien
taagagatagaattctagggaaagtraaaatagcagcagctcccaacact

SEQ ID NO: 1940 - DNA, 50 bp, homo sapien
ttgtgtcattctaaagcaggaataawcttcagaattttttcagatttagt

SEQ ID NO: 1941 - DNA, 50 bp, homo sapien
aattaactcactgaccaattgcattyaaaactatacctatgacaattgga

SEQ ID NO: 1942 - DNA, 50 bp, homo sapien
ctgtgttctttactctatgtcagaaygttttactgtcctgacaaatcctt

SEQ ID NO: 1943 - DNA, 50 bp, homo sapien
gactgaaagaaaagtcttatttagcyctaaaatgcattgcgggggtgagg

SEQ ID NO: 1944 - DNA, 50 bp, homo sapien
ataatcaagcagttattatccatcawcctagaaactattgggcctataaa

SEQ ID NO: 1945 - DNA, 50 bp, homo sapien
ttgtttagtagtggggccactttgasaactgggcattcaattcctagttt

SEQ ID NO: 1946 - DNA, 50 bp, homo sapien
atagcagtactaaagatgtatagatmaaatgattttaatgcatacaacaa

SEQ ID NO: 1947 - DNA, 50 bp, homo sapien
aaatctcttaatacagtgtgttagakcctagactttttgtacatttttct

SEQ ID NO: 1948 - DNA, 50 bp, homo sapien
tttctgccctacttctcccacatcakagtagaccgcttttaactcttttt

SEQ ID NO: 1949 - DNA, 50 bp, homo sapien
ttatacgtaccatacaatataactakgctatctggaacaaataacattgc

SEQ ID NO: 1950 - DNA, 50 bp, homo sapien
tctataaagttccttgattcgtggaktacaagaattaattaaataagcta

SEQ ID NO: 1951 - DNA, 50 bp, homo sapien
atcttattgttgttaataaccacccraaagtgtcaataataaaaattaca

SEQ ID NO: 1952 - DNA, 50 bp, homo sapien
ttactgtcttcccacacacttgaatyatgtaccctgtctctggctcagag

SEQ ID NO: 1953 - DNA, 50 bp, homo sapien
tctggctcagagtaaatgaacatgcscaaagttaactgttccatcatgat

SEQ ID NO: 1954 - DNA, 50 bp, homo sapien
aaccagaatgaaaagacacacgataygttttcttattcactgtttgaatc

SEQ ID NO: 1955 - DNA, 50 bp, homo sapien
tgattaagtacctattatagaatagscactgtgttacatgtcagagattc

SEQ ID NO: 1956 - DNA, 50 bp, homo sapien
ggccaccatgataaagattggctaargtctactctgtggaggcaggttta

SEQ ID NO: 1957 - DNA, 50 bp, homo sapien
tccaacatcatcgcatctttaagtayggtggtcattcaaaacattaaagt

SEQ ID NO: 1958 - DNA, 50 bp, homo sapien
caagaataaacagggaaacaaaaacraagagatttgcctagcggggggat

SEQ ID NO: 1959 - DNA, 50 bp, homo sapien
ccaggaaagagtgtaaaataggtaamtagccaccaggttaaagccaagaa

SEQ ID NO: 1960 - DNA, 50 bp, homo sapien
ggaaaagaccaaacatctgtttaaayataaatagctcagtaatgaacaac

SEQ ID NO: 1961 - DNA, 50 bp, homo sapien
tcccacaaaacaagactcagattccrctctcagtttgaaggaatgccaaa

SEQ ID NO: 1962 - DNA, 50 bp, homo sapien
gagagtgacctgaagtaagctgataytaaccaatctgtctttttgcatta

SEQ ID NO: 1963 - DNA, 50 bp, homo sapien
ctctgatgcttctcactgatcatggraaggacaaaatttttaacatagaa

SEQ ID NO: 1964 - DNA, 50 bp, homo sapien
ggaagaagtgaaataggaaaatgaartaaacggaaacatctttacatgac

SEQ ID NO: 1965 - DNA, 50 bp, homo sapien
agatcattagctacaagtcactatarcagatctaataaagcttgaaaaaa

SEQ ID NO: 1966 - DNA, 50 bp, homo sapien
gcatgatgatgtgatagatacagtartaaatataatgcaagtagaatcaa

SEQ ID NO: 1967 - DNA, 50 bp, homo sapien
taagatttgtgatagaactgactctyaaagatagctgccacaaagaatta

SEQ ID NO: 1968 - DNA, 50 bp, homo sapien
aagtatcaatcctatgggagtacatwagtgccatattatgccttcttttt

SEQ ID NO: 1969 - DNA, 50 bp, homo sapien
agggccaagcgggtgatttgagagaytaagtgtacagtttgaccttttga

SEQ ID NO: 1970 - DNA, 50 bp, homo sapien
tagtttaaacaggatatgatgttgarcactagaaataagaaaaagtatta

SEQ ID NO: 1971 - DNA, 50 bp, homo sapien
ttacatttgactttttcattagcctraaagtttgcagtatctgaacatga

SEQ ID NO: 1972 - DNA, 50 bp, homo sapien
taacattgatgcagtgaggaaagcgraattgttgaataccttacccattt

SEQ ID NO: 1973 - DNA, 50 bp, homo sapien
caggtgatgaaggttaatatgaacartgataagacaggttgatatcattt

SEQ ID NO: 1974 - DNA, 50 bp, homo sapien
tctgccatctgagttttttatacccrcatccttagaaggcgttttataga

SEQ ID NO: 1975 - DNA, 50 bp, homo sapien
ttcttctgtctaacatggtcattacrcggttgaagatacagtaattgctt

SEQ ID NO: 1976 - DNA, 50 bp, homo sapien
tcatccatcaagtattttttaagagyctattcttcgacactcaaactggg

SEQ ID NO: 1977 - DNA, 50 bp, homo sapien
aaccatattatcattgctttacaacraagtctgaattctttaagaaattc

SEQ ID NO: 1978 - DNA, 50 bp, homo sapien
ctattatcatccatctcagagagacraggacttatcaaaagaggatagaa

SEQ ID NO: 1979 - DNA, 50 bp, homo sapien
aatactgtccttaagtcattggtaamtaaatatctgctcactgcttgaag

SEQ ID NO: 1980 - DNA, 50 bp, homo sapien
cacccaagtctcaatggtttaattaygtagaagatttattccttactcat

SEQ ID NO: 1981 - DNA, 50 bp, homo sapien
tagttaattctaaatccaggttcccrgaaatgtaagtgaagaaatggagt

SEQ ID NO: 1982 - DNA, 50 bp, homo sapien
cttgggaaaagcttttgttttagtcwcaatgatagtgaaaatttcacttc

SEQ ID NO: 1983 - DNA, 50 bp, homo sapien
attgcagcatttgttaatgaggtacraagtttcattaaaataattagtaa

SEQ ID NO: 1984 - DNA, 50 bp, homo sapien
acaagtgctatctcatttaattatcycaattctgtaaagtagatattatt

SEQ ID NO: 1985 - DNA, 50 bp, homo sapien
ttgttacacatggggatttcataagracagatacaatattttctacgtac

SEQ ID NO: 1986 - DNA, 50 bp, homo sapien
ggtgctcgtaaatattaaattgacaktatggactgaattgttttccccac

SEQ ID NO: 1987 - DNA, 50 bp, homo sapien
ccccattatatggcaaggacctcaayagtagaaaactgacccaatataga

SEQ ID NO: 1988 - DNA, 50 bp, homo sapien
tctcccaagactgaaccaggaaaaarttacatctctgaaaagaccaaaaa

SEQ ID NO: 1989 - DNA, 50 bp, homo sapien
aaaatctttttttagcataaattcargttagtgattagaaactcgagatt

SEQ ID NO: 1990 - DNA, 50 bp, homo sapien
gcattaaagtttatatgttcaagtgraatattacctatagaggtacagct

SEQ ID NO: 1991 - DNA, 50 bp, homo sapien
gcccttaaaatccctctctcattcarattgttttattggtggcataacaa

SEQ ID NO: 1992 - DNA, 50 bp, homo sapien
tcttggaaatcacattcaggtctatyaaactccaaaacctgcagtttgtt

SEQ ID NO: 1993 - DNA, 50 bp, homo sapien
cttcacagggatgtagcccaagcccrcattttactatggtctcatacaac

SEQ ID NO: 1994 - DNA, 50 bp, homo sapien
acaaggagttactcaattagctgcawcactgaaacctgaagtgatgtgat

SEQ ID NO: 1995 - DNA, 50 bp, homo sapien
gttgggatcaaagattatgtgatcgyatgtatgtgtgtttctttgtcata

SEQ ID NO: 1996 - DNA, 50 bp, homo sapien
acattgtatagagaagggagctgtarcaattactaaagacaacatatggc

SEQ ID NO: 1997 - DNA, 50 bp, homo sapien
taaagcaaatattaaagtgggttackgaatgctacataagagatacaatt

SEQ ID NO: 1998 - DNA, 50 bp, homo sapien
tgtattattttattatttttttgtcyatggaatctatagcaatgtccttt

SEQ ID NO: 1999 - DNA, 50 bp, homo sapien
atattttccttctaaaaatgtcaaaytcttctaggcaatagtcaggagtg

SEQ ID NO: 2000 - DNA, 50 bp, homo sapien
tatgtatttaatatttgacaatttcwcatgattttatacacgttatattg

SEQ ID NO: 2001 - DNA, 50 bp, homo sapien
atgggattgtttgaacgagcttggaycttgatttccaggtctacctgaaa

SEQ ID NO: 2002 - DNA, 50 bp, homo sapien
aacaaagaccaaaaccttttcaaccsactaagcatcaattaagaaccaat

SEQ ID NO: 2003 - DNA, 50 bp, homo sapien
tcaaactgattttagcaaatattgaraccttatctgacaccacaatgatc

SEQ ID NO: 2004 - DNA, 50 bp, homo sapien
ttctgaatggtatcttatatcaaaakgctcccttaattttagctcttgct

SEQ ID NO: 2005 - DNA, 50 bp, homo sapien
caagggacttgctgagttacaagaaktccacacaaacgatatctgaaaga

SEQ ID NO: 2006 - DNA, 50 bp, homo sapien
tggacaagcatcacagcttgcctgaygtttatctcctataaaagtagacc

SEQ ID NO: 2007 - DNA, 50 bp, homo sapien
agttctctcctcttggaaattagaasatggtaattaaagatgtctctctc

SEQ ID NO: 2008 - DNA, 50 bp, homo sapien
ttttaaaattgaattgcctctttatmacttccgtccattttaatgtacat

SEQ ID NO: 2009 - DNA, 50 bp, homo sapien
accacagatgtatatagttttataayattggctcatttattcttatattt

SEQ ID NO: 2010 - DNA, 50 bp, homo sapien
caaagcacagtggcacagtttttaaratggaatagttgaacctgaataaa

SEQ ID NO: 2011 - DNA, 50 bp, homo sapien
taagaaaaataactaacttgactatwaaaacagtgttccgaagtatctat

SEQ ID NO: 2012 - DNA, 50 bp, homo sapien
ccatcacctgtgtgggagtcctaaastctaccacttactggaggtgattt

SEQ ID NO: 2013 - DNA, 50 bp, homo sapien
aaacctgtttttgccttaaaatgccyacaggatgaagactgaacaccttt

SEQ ID NO: 2014 - DNA, 50 bp, homo sapien
atatctttcggtccattactttctartaagctcagcacttttgacctggc

SEQ ID NO: 2015 - DNA, 50 bp, homo sapien
ttaaagccctaacgacttatgcaaaygtttataactggatataaatgttt

SEQ ID NO: 2016 - DNA, 50 bp, homo sapien
agcagccatagacaataggtacataracaagagtgactgcaccagtaaaa

SEQ ID NO: 2017 - DNA, 50 bp, homo sapien
tccttggtcaggagattcactcctasggaaataattggaactgtggagac

SEQ ID NO: 2018 - DNA, 50 bp, homo sapien
aacagtttattgatgataaatgttcsaagtagctcactaggttcattact

SEQ ID NO: 2019 - DNA, 50 bp, homo sapien
attaaaggccaagggccagaaagccracttccttaaaggcaacccaagga

SEQ ID NO: 2020 - DNA, 50 bp, homo sapien
ttccagtatatttcttccctcatagrcctgtaacataaatgctagctaaa

SEQ ID NO: 2021 - DNA, 50 bp, homo sapien
actgagtttccaaattatgaataagmaaaagaggaacaatatagtggttc

SEQ ID NO: 2022 - DNA, 50 bp, homo sapien
aaaaatttaaaaagtaatgatattcracgataggcatgatactcatttaa

SEQ ID NO: 2023 - DNA, 50 bp, homo sapien
ttccagaacaatgtggacgtatagcracagagatatacacatgttattgt

SEQ ID NO: 2024 - DNA, 50 bp, homo sapien
atacccacaggttttctaaagcacarcatttcacaaccttatgtcagtct

SEQ ID NO: 2025 - DNA, 50 bp, homo sapien
gattaaaagtgctattatgcatgaayatgtttaatacagataaaatttaa

SEQ ID NO: 2026 - DNA, 50 bp, homo sapien
gcacttttgtcatttccctgctttasgtcctgcaaaagttccctgcagat

SEQ ID NO: 2027 - DNA, 50 bp, homo sapien
ttaaggtaaggatatatgtgtccatsaagtttagtaataaagatagttgg

SEQ ID NO: 2028 - DNA, 50 bp, homo sapien
ctatccaagggaatttctaacaagaygttttaagagcatgtgaaaaacac

SEQ ID NO: 2029 - DNA, 50 bp, homo sapien
gttgtaataaaaacacttaaaatgakatctgcttgttaccagtggagggc

SEQ ID NO: 2030 - DNA, 50 bp, homo sapien
aactaagggaaagataaaaaggggaragtattctgtcatctgtacaccag

SEQ ID NO: 2031 - DNA, 50 bp, homo sapien
ataagctgaaaggggtggatgttgartatcacctaagtgtcattgcaacc

SEQ ID NO: 2032 - DNA, 50 bp, homo sapien
cattctccagccagctagacgaatamcagctgctcacattggcacgaaaa

SEQ ID NO: 2033 - DNA, 50 bp, homo sapien
cccacagagaccacattatgggctcrctttcaactttagaaagaacctca

SEQ ID NO: 2034 - DNA, 50 bp, homo sapien
ttttagaattgaattgacttatcaasaggagtaagtaggtaatagacaga

SEQ ID NO: 2035 - DNA, 50 bp, homo sapien
tagaattaaaaagagtcaaagagacscaagtttatattccagctccactt

SEQ ID NO: 2036 - DNA, 50 bp, homo sapien
agggaggagatggccaagactacagratcagtaagtataaaattatcctt

SEQ ID NO: 2037 - DNA, 50 bp, homo sapien
agactgatcagtttctggtaattcargacagtagaaggtaattctaacta

SEQ ID NO: 2038 - DNA, 50 bp, homo sapien
gcatctacggcttattgagtagttgwaaatatgttctctgcatctctttt

SEQ ID NO: 2039 - DNA, 50 bp, homo sapien
ccagatgtatgaaaactcattttccragttaacactgagttccaaaaggt

SEQ ID NO: 2040 - DNA, 50 bp, homo sapien
tcacagttccctgtgagctacctctwaagtctgccaatttcttttcttcc

SEQ ID NO: 2041 - DNA, 50 bp, homo sapien
tgacagaaccaaaaagggcctatcaracgcttctaggatctttttggttt

SEQ ID NO: 2042 - DNA, 50 bp, homo sapien
aattggctatatttactcatttcccygaacgtaaccaatcaccaacagta

SEQ ID NO: 2043 - DNA, 50 bp, homo sapien
gagttgggaggcaaactgatgatagwcctggcaccatggaggttctttca

SEQ ID NO: 2044 - DNA, 50 bp, homo sapien
gactaacgtatagcatgtgataaaaygggaacagtactggcacaatgcta

SEQ ID NO: 2045 - DNA, 50 bp, homo sapien
gatcctttaaaccagtgagaaatagyccttcagctcataagtcctttagc

SEQ ID NO: 2046 - DNA, 50 bp, homo sapien
tgaaggactatttctcactggtttaraggatcccgttgccataaatggaa

SEQ ID NO: 2047 - DNA, 50 bp, homo sapien
ggattaggtcatcgtgttggatccaycatgtttgacagggttgcccagtg

SEQ ID NO: 2048 - DNA, 50 bp, homo sapien
ataccgtgtttctgcttcggttgatyagtttttctgtttatatgcaattt

SEQ ID NO: 2049 - DNA, 50 bp, homo sapien
tctgtgtccatagcaaatgcatagamgatgctcaataaattgacttgaat

SEQ ID NO: 2050 - DNA, 50 bp, homo sapien
ctagttttagttctgacattagccckcagaatatgatctttcagaaaaca

SEQ ID NO: 2051 - DNA, 50 bp, homo sapien
ctgaggatgtggttaaaaactcggcycaggagtggaggtgccagcgttca

SEQ ID NO: 2052 - DNA, 50 bp, homo sapien
cacctcatctttctcaatggcatcartaacagaacaaaatcaaatgaaag

SEQ ID NO: 2053 - DNA, 50 bp, homo sapien
tattggtgagcaaagtgattagtgaytagcgagcaaagttataaaggaaa

SEQ ID NO: 2054 - DNA, 50 bp, homo sapien
tggcagcctgaggttggattaatacragtaccaacaactcaccagtcact

SEQ ID NO: 2055 - DNA, 50 bp, homo sapien
aaaccagcagatggggtgttgtagawggtgcaccccagtagaaataacaa

SEQ ID NO: 2056 - DNA, 50 bp, homo sapien
cttggatagagtgtactgaataatayctgaaaaagtgattttagcaagga

SEQ ID NO: 2057 - DNA, 50 bp, homo sapien
tgtcttatgtctgtttctgtttgaasgcacctcatttaatgtgtgctgtt

SEQ ID NO: 2058 - DNA, 50 bp, homo sapien
aaacaagttagaatatggtaggaaawaaaatactatgcttatttagaagt

SEQ ID NO: 2059 - DNA, 50 bp, homo sapien
tcctgttgtgaatctttatgagggaragcgtctatatggctaatactcct

SEQ ID NO: 2060 - DNA, 50 bp, homo sapien
gctcagtaagtataggatttcttaaragtcattgacacattttatcttgg

SEQ ID NO: 2061 - DNA, 50 bp, homo sapien
ttctccaacaaaaacaaaatataacwctttctcacacattgtagccctct

SEQ ID NO: 2062 - DNA, 50 bp, homo sapien
attgttcttactataatcatttctakagttcccttcactctgtcctctta

SEQ ID NO: 2063 - DNA, 50 bp, homo sapien
ccacagagtcattacttttcgagtaycagtggcaacagtgagcactgctt

SEQ ID NO: 2064 - DNA, 50 bp, homo sapien
agaagtgagtaaattgaaggtgaatyagatgatccgtgggaatacttttt

SEQ ID NO: 2065 - DNA, 50 bp, homo sapien
atgttctatgtatgaatgactcttaygcaaaacagtctgatcaaaccatc

SEQ ID NO: 2066 - DNA, 50 bp, homo sapien
atacagagagcagataattcaataayttacaaaactaagtatcttcatta

SEQ ID NO: 2067 - DNA, 50 bp, homo sapien
tatattatgtaaaggacaagttaacrattaaaatcctgcagtgccaagtt

SEQ ID NO: 2068 - DNA, 50 bp, homo sapien
tgattactttgaaaaattaccttacrattaccttagaaaagccattcgac

SEQ ID NO: 2069 - DNA, 50 bp, homo sapien
gaactcataatttctttgtctgcaarttacttgtattaagcttatgtttt

SEQ ID NO: 2070 - DNA, 50 bp, homo sapien
aaattcataatttctgtggttcttaycagttctgagttttattttttgcc

SEQ ID NO: 2071 - DNA, 50 bp, homo sapien
ttacaaacacagagttctaatgcagratattaaagtgaaagtcaattgtt

SEQ ID NO: 2072 - DNA, 50 bp, homo sapien
ggccaatgttttttaagagtcataayctggaattaattacattaagtgct

SEQ ID NO: 2073 - DNA, 50 bp, homo sapien
agatgtccagggtccttgaaatgccrcaggttgccttgggccctttctat

SEQ ID NO: 2074 - DNA, 50 bp, homo sapien
gagttaacatcctcctagacccttakgttcacatttttgaaatcattttt

SEQ ID NO: 2075 - DNA, 50 bp, homo sapien
aaggctaaagtgaattggcaccttaygcaaatgaggattggcccgtgtgt

SEQ ID NO: 2076 - DNA, 50 bp, homo sapien
gccaggatgcaaaagaagaaaaaagrcataagatggaccaggccaagtgt

SEQ ID NO: 2077 - DNA, 50 bp, homo sapien
tatgcttctgttgagctatttccagwcatgtggttgaggacaacgctcca

SEQ ID NO: 2078 - DNA, 50 bp, homo sapien
taattctggttgaagtgtggaagackaactgaattgaatttagaaatagg

SEQ ID NO: 2079 - DNA, 50 bp, homo sapien
gatgaagctccatctctgcttctctyaacagtgttctatagggtgtaatg

SEQ ID NO: 2080 - DNA, 50 bp, homo sapien
gaaagggaatagtctgtaaatataaygcacgtatataagagataaaagtg

SEQ ID NO: 2081 - DNA, 50 bp, homo sapien
tgagacactctaccctacaggctaamctactctaataccttgctttcctg

SEQ ID NO: 2082 - DNA, 50 bp, homo sapien
cttaggggcagggcacagccataacygagagaagtagatggggctattct

SEQ ID NO: 2083 - DNA, 50 bp, homo sapien
aagtaatgtattttaaaaggaatacragtaatgccctgaaaagtacagat

SEQ ID NO: 2084 - DNA, 50 bp, homo sapien
atgatgcatgatatatgactggaaartgagttgttctgatttaaatagaa

SEQ ID NO: 2085 - DNA, 50 bp, homo sapien
accaaaacctccctattctcagcaawttaaaagccaatatttctgttttg

SEQ ID NO: 2086 - DNA, 50 bp, homo sapien
ttccgtcccccatcctacctgaaatsagagccaaggagagtagaatgaag

SEQ ID NO: 2087 - DNA, 50 bp, homo sapien
tattagatgtttcaaacataatcgcragtgacctcttggatatggtatgc

SEQ ID NO: 2088 - DNA, 50 bp, homo sapien
atgtttaaagtacctcaacacaaaartaattatcaaaaaggattaaggtc

SEQ ID NO: 2089 - DNA, 50 bp, homo sapien
accctcttcctcagttaaactaaaayttctgaatgggcactgagttgttg

SEQ ID NO: 2090 - DNA, 32 bp, homo sapien
ggatatctacttgttawctggatgcttgcttt

SEQ ID NO: 2091 - DNA, 50 bp, homo sapien
ggaccttttctgacatttgactttarggccaagagatttttcctaagcag

SEQ ID NO: 2092 - DNA, 50 bp, homo sapien
aggagatatacgtatattatacacasgcataccttattttattacacttt

SEQ ID NO: 2093 - DNA, 50 bp, homo sapien
agttctcaccaagaaaggaagcgtaygatggctattacaatttacatatg

SEQ ID NO: 2094 - DNA, 50 bp, homo sapien
gctgttgctgcctcagtcagtgtagmaatatgactagggtgctagatatg

SEQ ID NO: 2095 - DNA, 50 bp, homo sapien
tggaggcaaattaaccacttagcaakagagcatctttcaatccatggcaa

SEQ ID NO: 2096 - DNA, 50 bp, homo sapien
caagtctagtagtgactctatgtcayacccgcgagcatgctgtggtacag

SEQ ID NO: 2097 - DNA, 50 bp, homo sapien
ttgtcaggggaactgcggagatttasatagacaccacaaccaactccagg

SEQ ID NO: 2098 - DNA, 50 bp, homo sapien
ctagctcccagctctgcactctttcyctgtaccatattgagacctggaat

SEQ ID NO: 2099 - DNA, 50 bp, homo sapien
cattaaagaagaataaaggcaaaagkatttttagattaaaagatactgac

SEQ ID NO: 2100 - DNA, 50 bp, homo sapien
atgaaaaataacatgagaaaaatacscagaagttcttcaagttcatattc

SEQ ID NO: 2101 - DNA, 50 bp, homo sapien
atctatccttacattaaaatgattcragtgcagagtcatatattgaaaaa

SEQ ID NO: 2102 - DNA, 50 bp, homo sapien
cacattataaatttgtacctatatcraaactgtaatttttttttttactg

SEQ ID NO: 2103 - DNA, 50 bp, homo sapien
tatagtttctcccaccactctatacyaaatttcactttaccaaaaatatt

SEQ ID NO: 2104 - DNA, 50 bp, homo sapien
ttgagactttactgggcctccaacaktgtaagacagggagcaatggaaga

SEQ ID NO: 2105 - DNA, 50 bp, homo sapien
tgaattttattttctggaatatgaaktgacttaacagatgcttggaacgt

SEQ ID NO: 2106 - DNA, 50 bp, homo sapien
ctcccattgcatttagaattaaaaarttatggctgggcacagcggttcat

SEQ ID NO: 2107 - DNA, 50 bp, homo sapien
ccaaggcagtaattcacttctaggaytcaaagagccattgtcactaaatt

SEQ ID NO: 2108 - DNA, 50 bp, homo sapien
aatagacaagttggaggtgatctcawtgaagaattgatgacaataatggt

SEQ ID NO: 2109 - DNA, 50 bp, homo sapien
ttgctgtgaccctccatgggttgcckctctctggaaaggtgttaaagggg

SEQ ID NO: 2110 - DNA, 50 bp, homo sapien
gagcagggatgagttggaaaaagtcyctgatgcctgtgttggcaaccgga

SEQ ID NO: 2111 - DNA, 50 bp, homo sapien
tagatgaactactttataggactgamatcccatcaaataaaatggtgtat

SEQ ID NO: 2112 - DNA, 50 bp, homo sapien
cacaatgaatcacctaattgcaaaamacaagaagatattggaccacaaaa

SEQ ID NO: 2113 - DNA, 50 bp, homo sapien
acagaatctgaaccaggaagtaagayagcagtttgacacggtagttgctg

SEQ ID NO: 2114 - DNA, 50 bp, homo sapien
ctctgacttcccaggaagctccaaaygaatattatatataaccagtgtct

SEQ ID NO: 2115 - DNA, 50 bp, homo sapien
gccttcatgaaggatgctaggtgctmactacagcaaacatggcttatcat

SEQ ID NO: 2116 - DNA, 50 bp, homo sapien
tgaattttggcattgtctgcagaaayttatgagagaaaaggggtagcacg

SEQ ID NO: 2117 - DNA, 50 bp, homo sapien
gaattttgcctagaattatcagcaaygaaaatcttactctaagttagtca

SEQ ID NO: 2118 - DNA, 50 bp, homo sapien
gggaaaggattttgtcagtttcttcyatacaaataacccagtgtattagt

SEQ ID NO: 2119 - DNA, 50 bp, homo sapien
cctttctcagaatgctgtagtcacartggcatctgaacctcatttttaca

SEQ ID NO: 2120 - DNA, 50 bp, homo sapien
caatggcatctgaacctcatttttayagttcctattagtgtacaaactat

SEQ ID NO: 2121 - DNA, 50 bp, homo sapien
tgagtttgagacctgttatcatcaaygcagagagaagtttcagttgggcg

SEQ ID NO: 2122 - DNA, 50 bp, homo sapien
ttacagaatccatgtagtcaaatacmattgaggatagttgtgtggtcact

SEQ ID NO: 2123 - DNA, 50 bp, homo sapien
atgctgttttgacaatactttctggycactaggattagaatttgtgtttt

SEQ ID NO: 2124 - DNA, 50 bp, homo sapien
cttgaacttgccttctgaaatgtaayaggaaaaacgacaaataagatcaa

SEQ ID NO: 2125 - DNA, 50 bp, homo sapien
aattacctgcacagggctatccttayctcacttgacccctctacagtatt

SEQ ID NO: 2126 - DNA, 50 bp, homo sapien
aaaaatcacattatgaaactgggaawgtctgaaggaatatgggcaaaata

SEQ ID NO: 2127 - DNA, 50 bp, homo sapien
tcatagggatgaccttgacttattartaaaagaactatgtttacaaacta

SEQ ID NO: 2128 - DNA, 50 bp, homo sapien
tgattctactatgcagtcagggttargtgccattgaaataatccttcaca

SEQ ID NO: 2129 - DNA, 50 bp, homo sapien
tgttaaattaaggtcaatgataacaracttgatgatttggcttctctttt

SEQ ID NO: 2130 - DNA, 50 bp, homo sapien
aacgccttataccttacacctttcaytgaaaacaatggctaatgcaaact

SEQ ID NO: 2131 - DNA, 50 bp, homo sapien
cattcttccttctgtgctttcttagyaaattgtaccatcttccacccagt

SEQ ID NO: 2132 - DNA, 50 bp, homo sapien
gatagcaagaacctgggatagttgamaactttgagtagctgaccagcctt

SEQ ID NO: 2133 - DNA, 50 bp, homo sapien
ttcatcccccacaccataacctcgaytactttcaagggatcagttgtgac

SEQ ID NO: 2134 - DNA, 50 bp, homo sapien
attgcaccttctcacgcaacactccraccaggactttcaactacaacttc

SEQ ID NO: 2135 - DNA, 50 bp, homo sapien
ctcagatccactctctgtgctacaaygattgcaccttctcacgcaacact

SEQ ID NO: 2136 - DNA, 50 bp, homo sapien
gtactcagaactaacccagtagctcraggtgaaccatgcacagaatgaag

SEQ ID NO: 2137 - DNA, 50 bp, homo sapien
ggaattctcatataaggaagtttaaygagactctgcctaaagaattttcc

SEQ ID NO: 2138 - DNA, 50 bp, homo sapien
gggaagaatgtcaggaaagagggaayaattgttaggaagtcacagtgatg

SEQ ID NO: 2139 - DNA, 50 bp, homo sapien
cacctcttccccaggggcctggatgyacaatgttggtcttctatcctaga

SEQ ID NO: 2140 - DNA, 50 bp, homo sapien
ccttctgggatctggaaaaggctgcragatgacttttatagattggtgat

SEQ ID NO: 2141 - DNA, 50 bp, homo sapien
ttcaccgtcttagatactaccaacamtagttacggcaggcacttcaaaat

SEQ ID NO: 2142 - DNA, 50 bp, homo sapien
tgaaaaagaatctaggagaataaacrcatttcaattagcccttaacatct

SEQ ID NO: 2143 - DNA, 50 bp, homo sapien
ctattattttcatgtaaatcacaaastttatatcatttaatctgtaatta

SEQ ID NO: 2144 - DNA, 50 bp, homo sapien
ctgtatggacttatcaagatagacayctcacttacaatctgttcctactg

SEQ ID NO: 2145 - DNA, 50 bp, homo sapien
tccaccagggtgcaagctagttgaayagatatgttgtccaggtgttcaag

SEQ ID NO: 2146 - DNA, 50 bp, homo sapien
ctattatcagctaagcactaaatcartcatcgagaattattccatgtttt

SEQ ID NO: 2147 - DNA, 50 bp, homo sapien
gtacattccttgtatttaaactctgmataaaaacatggaataattctcga

SEQ ID NO: 2148 - DNA, 50 bp, homo sapien
ttaatcttaggaatgtaaggagtcarattctaaagcccccaatacaagtg

SEQ ID NO: 2149 - DNA, 50 bp, homo sapien
cagagactccaaggggaaggccataragttttgagggtccagctcctggg

SEQ ID NO: 2150 - DNA, 50 bp, homo sapien
tactttgcacttttcatccaaaaatraatccacaagatgtattaacaaac

SEQ ID NO: 2151 - DNA, 50 bp, homo sapien
ggttattatctttggagtgagatcartacctaacaacattgaactaattg

SEQ ID NO: 2152 - DNA, 50 bp, homo sapien
gcatttgcaagagtgttcatactaaytacctccacacagagatcaggcat

SEQ ID NO: 2153 - DNA, 50 bp, homo sapien
tcagctccctcccttgctgtactgckcttcttaatgtccttgctgtctgc

SEQ ID NO: 2154 - DNA, 50 bp, homo sapien
agaaaaacgcaataagccaagacaamtctcaaatcacacaaaaaaaaggc

SEQ ID NO: 2155 - DNA, 50 bp, homo sapien
tgtatttctttatcccagatattcgracaattgctagcaaggaaaagtaa

SEQ ID NO: 2156 - DNA, 50 bp, homo sapien
actttcaggaggccttatatgaggaragaagagctaggaactatggggtg

SEQ ID NO: 2157 - DNA, 50 bp, homo sapien
tctttccttgagctagcaatatggartacaatactctctcacaatgctgg

SEQ ID NO: 2158 - DNA, 32 bp, homo sapien
ctttttcatggttccaractgaaactgtgtac

SEQ ID NO: 2159 - DNA, 50 bp, homo sapien
atcaactcagtaggataataggggartaaatagagaaataattctgaaaa

SEQ ID NO: 2160 - DNA, 50 bp, homo sapien
tattgtactttggattgccctggtargtattgtactaagtcttatttcat

SEQ ID NO: 2161 - DNA, 50 bp, homo sapien
atttctaattctcaactcctatctgyatgtatgctttcagcatttcatat

SEQ ID NO: 2162 - DNA, 50 bp, homo sapien
ggcccctatttgtatatcttaaacastagcaaaccagcatattagttaag

SEQ ID NO: 2163 - DNA, 50 bp, homo sapien
cataagaggacaattgtgaactacayagtaaatcatattgtgctcagata

SEQ ID NO: 2164 - DNA, 50 bp, homo sapien
tgcaatcagattcattagtagcccargaattaaacctacccccatcccca

SEQ ID NO: 2165 - DNA, 50 bp, homo sapien
agcttcaagtcaaaggatcagaggcraaaataaaatccaggttgcaaaac

SEQ ID NO: 2166 - DNA, 50 bp, homo sapien
attaatgaaagttccacttaccagasgtcagagaagactgagaagcagga

SEQ ID NO: 2167 - DNA, 50 bp, homo sapien
caaagattttccctagttgatttgtsaaaaaaaaatgaaattaatacatt

SEQ ID NO: 2168 - DNA, 50 bp, homo sapien
taaaagtaggttccctccaaattcakggtgagaaatttcacaaatatttc

SEQ ID NO: 2169 - DNA, 50 bp, homo sapien
tcttgccatgttctgactggggtgarccgctaggatacaaatcactatca

SEQ ID NO: 2170 - DNA, 50 bp, homo sapien
agaagagttcttcttgtaatcaaagrctaatccttttaacagtctctgga

SEQ ID NO: 2171 - DNA, 50 bp, homo sapien
tcagaacatggcaagagcaaagtcamagaatgaaagagatggttctgata

SEQ ID NO: 2172 - DNA, 50 bp, homo sapien
ataaaaattggactctggaaggaaawattttgctcttctgcacccaagga

SEQ ID NO: 2173 - DNA, 50 bp, homo sapien
aacttgactttacaacctatttatayacatttgggtaaataattattaca

SEQ ID NO: 2174 - DNA, 50 bp, homo sapien
aagaacatataaccccaactccatayataaccttgaagttggtgagagga

SEQ ID NO: 2175 - DNA, 50 bp, homo sapien
tcttattttaaagtaaacgaaaatayggaatacaactaaaattataaggt

SEQ ID NO: 2176 - DNA, 50 bp, homo sapien
aggtttatacagggataaattactamctacctaattatgctattagtatt

SEQ ID NO: 2177 - DNA, 50 bp, homo sapien
ccatgttcctgtggcacaccttagaygaatttgaagctggggaaatggct

SEQ ID NO: 2178 - DNA, 50 bp, homo sapien
tcagctgggtaagtaaagaacaataygtgacgtctccaggaaaaggtaaa

SEQ ID NO: 2179 - DNA, 50 bp, homo sapien
aggccaggatatgtgaggaaaaaaaygatttgatttgtgtaccagtaagc

SEQ ID NO: 2180 - DNA, 50 bp, homo sapien
ttgctgctctagcgggagagtcaackgtacttcatccattcttctatcta

SEQ ID NO: 2181 - DNA, 50 bp, homo sapien
atgggtcttacatatttcttaggcargtttctttattacaggattgcttc

SEQ ID NO: 2182 - DNA, 50 bp, homo sapien
ttaagaactttttcttggcaatacamcttctaaagatttatcccaaggaa

SEQ ID NO: 2183 - DNA, 50 bp, homo sapien
atgatacagttgcttctggcttaatmagtggatcctaatagacttttatg

SEQ ID NO: 2184 - DNA, 50 bp, homo sapien
cctaaaattacattagctttgcagtkactcgttcagagaagcttgcatag

SEQ ID NO: 2185 - DNA, 50 bp, homo sapien
aagttttcaaattgtaatttcattcragatgctgagtcaagttcccctcg

SEQ ID NO: 2186 - DNA, 50 bp, homo sapien
aattcttccaaggccaataataacartcatggaatgctaggctcgatgat

SEQ ID NO: 2187 - DNA, 50 bp, homo sapien
gtgatactgcgtagttaagatcatcragcctagcattccatgattgttat

SEQ ID NO: 2188 - DNA, 50 bp, homo sapien
gatttttttagagtattctagaagcrcagtgggaaatgaactgtggtagg

SEQ ID NO: 2189 - DNA, 50 bp, homo sapien
ttacagaaccaagttgcaactcaagrccattcacagtatagtctcagcta

SEQ ID NO: 2190 - DNA, 50 bp, homo sapien
tatacattatattgtatagattaggmatttgataacctacttggcatttg

SEQ ID NO: 2191 - DNA, 50 bp, homo sapien
agctgcataatcttgtctcaaaatcrctccttacactttgaagatttttg

SEQ ID NO: 2192 - DNA, 50 bp, homo sapien
aataaataataaatacattactgaaygaagttaacataagtatcattttc

SEQ ID NO: 2193 - DNA, 50 bp, homo sapien
acagggagaaatcactgcccttaacrataaagagaaaacctctatagggg

SEQ ID NO: 2194 - DNA, 50 bp, homo sapien
gcctgttgttgctatttatgctccaygttatctataaatcccacaggtct

SEQ ID NO: 2195 - DNA, 50 bp, homo sapien
tggcaatcccaaaacctgaaatgtcwctgtggaacctcctacaattaatt

SEQ ID NO: 2196 - DNA, 50 bp, homo sapien
aagattacatgtgtcaatcatataaktaagcaatatttactacggttaaa

SEQ ID NO: 2197 - DNA, 50 bp, homo sapien
ttttttttctttacaaagtgataatracctctatacttgacctcccaatt

SEQ ID NO: 2198 - DNA, 50 bp, homo sapien
accttcctaaataaaacatgataccygaaagccataaggaaaatagctga

SEQ ID NO: 2199 - DNA, 50 bp, homo sapien
gattgatcagaattctggaatctgartattaaaaccttacttagtgactg

SEQ ID NO: 2200 - DNA, 50 bp, homo sapien
gaaggcagggagaactaggttgctayaaataattaagcatttgagtgtcc

SEQ ID NO: 2201 - DNA, 50 bp, homo sapien
gataatacccctgtaagatgagagaytaaaactttcctttgtgacttctc

SEQ ID NO: 2202 - DNA, 50 bp, homo sapien
ctactcattataatacattatttaastactgtcatgtctataatcacatc

SEQ ID NO: 2203 - DNA, 50 bp, homo sapien
acttgagaagtattaccctatttgaratctttctagttgaattgcctggc

SEQ ID NO: 2204 - DNA, 50 bp, homo sapien
gatgatggaagcaaagagatataaaraaatggtcattcattcttcaaaat

SEQ ID NO: 2205 - DNA, 50 bp, homo sapien
ctgtatccctgacttgactagaaccrgccatttaccaaagaagcttgttc

SEQ ID NO: 2206 - DNA, 50 bp, homo sapien
tactcttcctttccctgtggagcaaytacttttctttcttcctcctgcaa

SEQ ID NO: 2207 - DNA, 50 bp, homo sapien
atggtgctggatgagataggtagatsaaaataattccttgagcttctgga

SEQ ID NO: 2208 - DNA, 50 bp, homo sapien
atgtaatcagagaagaaatggaaaakaacacggcatcagtaaagtcctcc

SEQ ID NO: 2209 - DNA, 50 bp, homo sapien
gaggtccatttttcttttgagcctcrctggcattgcctgctagaataggg

SEQ ID NO: 2210 - DNA, 50 bp, homo sapien
tggaaaataacacggcatcagtaaartcctccagtggttccccatggttt

SEQ ID NO: 2211 - DNA, 50 bp, homo sapien
atgacctcactcatcaaaggtgcatsaaaactaggaaacacgcacaccct

SEQ ID NO: 2212 - DNA, 50 bp, homo sapien
aggggcaggcagagtaggcctaaacyaacctggtcatcacccaggaggaa

SEQ ID NO: 2213 - DNA, 50 bp, homo sapien
ctttgaatctttcaaaatataatctraagtccttcaatctctaaactatt

SEQ ID NO: 2214 - DNA, 50 bp, homo sapien
tttcctatatactggtaacttagatyagctttaaaatgatcactgctttt

SEQ ID NO: 2215 - DNA, 50 bp, homo sapien
attttgaaagattcaaaggactacarcacaattagaaacaccttcttaac

SEQ ID NO: 2216 - DNA, 50 bp, homo sapien
tcctggtgatgagaggaggtggaaawtatgctcagtgtcaggagggtggt

SEQ ID NO: 2217 - DNA, 50 bp, homo sapien
tccctcttaaaatatggaactcagargttcatcactctcaaatagccttc

SEQ ID NO: 2218 - DNA, 50 bp, homo sapien
atttatgccattgaggttaatttacyatcttccttaacaaaaataatgac

SEQ ID NO: 2219 - DNA, 50 bp, homo sapien
ttatccaatttatctgaaatcagaaycaaccatcctaaaagtttttaaat

SEQ ID NO: 2220 - DNA, 50 bp, homo sapien
tccccatctttcaggaccactatgartaaagcggccgcacacccactcac

SEQ ID NO: 2221 - DNA, 50 bp, homo sapien
tttggttaagaacaatgtcagtgaaytcaggtctgactccaatgtcatca

SEQ ID NO: 2222 - DNA, 50 bp, homo sapien
ttgcctaaagatatattggctgtagrcaagttttcgtgtgccctattata

SEQ ID NO: 2223 - DNA, 50 bp, homo sapien
gcaataatcaaataatcaacatgtasatatccaattacaaattgaggtga

SEQ ID NO: 2224 - DNA, 50 bp, homo sapien
tttgtattcacttttgctctcaaacraaagaaatcccctctaccataatt

SEQ ID NO: 2225 - DNA, 50 bp, homo sapien
tatgaagactttttcagactcttcarcaagactgcattttgggagcaata

SEQ ID NO: 2226 - DNA, 50 bp, homo sapien
tagtgttgatcaatatttaccagcayggaagagtattgacaatgactctt

SEQ ID NO: 2227 - DNA, 50 bp, homo sapien
aattactaagctctgaaaatgagaaycccatatactggatattacaggtt

SEQ ID NO: 2228 - DNA, 50 bp, homo sapien
ctaaccctggaatctaagttaagccraccagtatcttggatctgggccca

SEQ ID NO: 2229 - DNA, 50 bp, homo sapien
caaatgcaatgaaacagttctacaaygctgtaagtaaatctgagggacta

SEQ ID NO: 2230 - DNA, 50 bp, homo sapien
aatatgaacaatgccatattcttgckgaaaacacttagcctgagtttcat

SEQ ID NO: 2231 - DNA, 50 bp, homo sapien
gaatgccagcagaaacaagttcatastaaggactgagataaaaatttcca

SEQ ID NO: 2232 - DNA, 50 bp, homo sapien
aggagctggcaaattgttggagctaytaattgtacctactgtgtgtgagg

SEQ ID NO: 2233 - DNA, 50 bp, homo sapien
aatatgacacagattactaatggtgsatcttaataaaaatatattttatc

SEQ ID NO: 2234 - DNA, 50 bp, homo sapien
tttattacacttgaagaaaacctatsaaaccagtgtagtccttaaggcct

SEQ ID NO: 2235 - DNA, 50 bp, homo sapien
tgaaaatgatgaaatctcatacagamgaaacgacctgctctgttcccaca

SEQ ID NO: 2236 - DNA, 50 bp, homo sapien
aacaaagatgtgtttcttacaatgarcctcagtcaaaaaagtttggaaaa

SEQ ID NO: 2237 - DNA, 50 bp, homo sapien
attcacaggactatcttcttcccaarttcacaatatgagccaaccaaaaa

SEQ ID NO: 2238 - DNA, 50 bp, homo sapien
gttgagagatttgccattttagtatsagtggcacgaatgttttgctactg

SEQ ID NO: 2239 - DNA, 50 bp, homo sapien
ttattaactgtgtgactctagaaaastttcctaaattctctgagccttat

SEQ ID NO: 2240 - DNA, 50 bp, homo sapien
tgacttactgtgataaaccactttayaattaagcatgccctccactttct

SEQ ID NO: 2241 - DNA, 50 bp, homo sapien
acgtatattaagctaagtgaaagaasacggatacaaaggaccacatattg

SEQ ID NO: 2242 - DNA, 50 bp, homo sapien
tagcgggtaaggtcctgtccttcaasagaaatctagagttataggcaaag

SEQ ID NO: 2243 - DNA, 50 bp, homo sapien
tatgataaccatgtgttaaataataygctgtagctagttctcctctcttc

SEQ ID NO: 2244 - DNA, 50 bp, homo sapien
agatatgattgggtttaggctggtayggttaacaaaaaaacaattagtcc

SEQ ID NO: 2245 - DNA, 50 bp, homo sapien
taactcaggctaggatcttgctactraagagtaaagttttcttcccttta

SEQ ID NO: 2246 - DNA, 50 bp, homo sapien
gagaatagagaggaactagagaatgwaacttttaagagaaggcctgggag

SEQ ID NO: 2247 - DNA, 50 bp, homo sapien
tacaccttctttgacctctttctaaygccatttcaatctatattttccac

SEQ ID NO: 2248 - DNA, 50 bp, homo sapien
ctgaaactataggcaatttaccctcracctcaaatgaagaaatactgaga

SEQ ID NO: 2249 - DNA, 50 bp, homo sapien
ctcataaggagtttaagaaatcctckcaaaaacagtatcaatttcccctt

SEQ ID NO: 2250 - DNA, 50 bp, homo sapien
acagaaaaaaataggactaaaagacsaaacagagacctaagtaaccactg

SEQ ID NO: 2251 - DNA, 50 bp, homo sapien
caatgtaaatattgagtaccttttayatgcaaggcgccatgctagctgct

SEQ ID NO: 2252 - DNA, 50 bp, homo sapien
aataacttcctgggtattgaatattraagaactattgttagtccttatct

SEQ ID NO: 2253 - DNA, 50 bp, homo sapien
ctcaagctaagcaaactaaaccctaraattcaggaatcattgtacaggca

SEQ ID NO: 2254 - DNA, 50 bp, homo sapien
ctattattattatttaacctcaggargaatgaatgacttaactagtggtt

SEQ ID NO: 2255 - DNA, 50 bp, homo sapien
ctaagtgctttggagtataaaaagaygaatgaattgcatttcctgaactc

SEQ ID NO: 2256 - DNA, 50 bp, homo sapien
atctttctaaaccacacagctaaccyatgtcattttcctttctaaaacca

SEQ ID NO: 2257 - DNA, 50 bp, homo sapien
ggaagaacatcttcctctcaagtgarcagtgcttaccgcttcaagcatcc

SEQ ID NO: 2258 - DNA, 50 bp, homo sapien
tttttcttggaagcatagataaggcratatgatggttgactttatgtgtc

SEQ ID NO: 2259 - DNA, 50 bp, homo sapien
agaaatgtattttgcctgtgacatcsaagccagctgcagtggtgggcaaa

SEQ ID NO: 2260 - DNA, 50 bp, homo sapien
ttttgggttaagagaaacccacacartaaattctggtctgacctggactt

SEQ ID NO: 2261 - DNA, 50 bp, homo sapien
ttgggtgcaagagtacatttgattayagtttactaaagcacatttggtta

SEQ ID NO: 2262 - DNA, 50 bp, homo sapien
aactcaatcaatgtttattaagcaasctctttgtgctgaatgctgtattc

SEQ ID NO: 2263 - DNA, 50 bp, homo sapien
gtagcacagatggttagtttctgaaygtatctagccaatgtcagttgcag

SEQ ID NO: 2264 - DNA, 50 bp, homo sapien
taccatgtgcaggacctaagaagtcraggaagtatttcttaataaaatta

SEQ ID NO: 2265 - DNA, 50 bp, homo sapien
cattctcatccttttcttcagcaacyggtaaataattgccttgatcaatt

SEQ ID NO: 2266 - DNA, 50 bp, homo sapien
tttgacagttctactgatccgtaaawgataaccactgcaaattttttcag

SEQ ID NO: 2267 - DNA, 50 bp, homo sapien
ttatttattgtatgttaactgtgaaktgtaactgaaagaaggtatggagc

SEQ ID NO: 2268 - DNA, 50 bp, homo sapien
ggagctcatcaattcttagaccttcragaggacttcccagtggagataac

SEQ ID NO: 2269 - DNA, 50 bp, homo sapien
tttaattttcacggcaatcctataargtttatatattaacagacgaggaa

SEQ ID NO: 2270 - DNA, 50 bp, homo sapien
gtttcaaggaataaagagattaaaarcaatcagactgccctatcaaagaa

SEQ ID NO: 2271 - DNA, 50 bp, homo sapien
acctctaaaggaaatcctatcagackaatagcagaattctcagcagaaac

SEQ ID NO: 2272 - DNA, 50 bp, homo sapien
tttgtgaattcataacaagggctccragtcaccagatcttagagctgacc

SEQ ID NO: 2273 - DNA, 50 bp, homo sapien
atgcattttagaaatattgaataggwataatcaacaggacttgatgattg

SEQ ID NO: 2274 - DNA, 50 bp, homo sapien
ttaagtttatgctcttaggagtttasaaaacaggataatcatctttccca

SEQ ID NO: 2275 - DNA, 50 bp, homo sapien
aatttggtattaatatggatctaaawgcaagaccctttcatttatatcaa

SEQ ID NO: 2276 - DNA, 50 bp, homo sapien
taaccttagtatttctgattggacargccagttatgtgggctatgattca

SEQ ID NO: 2277 - DNA, 50 bp, homo sapien
ttcagtgagactcaggattattacayctcagggtcagatgcgccaatcag

SEQ ID NO: 2278 - DNA, 50 bp, homo sapien
tctgtcttctggaatttttatgtcarctctcaggaattagactatgcagc

SEQ ID NO: 2279 - DNA, 50 bp, homo sapien
gtcagatgcgccaatcagacagatgracctgaaacaccaaggtgtatcct

SEQ ID NO: 2280 - DNA, 50 bp, homo sapien
ataggctttttgtgaaactgttatcrgacaacatgtgtgtatgcctagta

SEQ ID NO: 2281 - DNA, 50 bp, homo sapien
ttgttttcagtttataaaagttggaygcaaccagccgggcgcagtggctc

SEQ ID NO: 2282 - DNA, 50 bp, homo sapien
cgcgtaaagtgattaaggagccttgsaattataaatacacattcagatta

SEQ ID NO: 2283 - DNA, 50 bp, homo sapien
tttatctgcttcatcacacatggcayctttctcctttcacttctggtatc

SEQ ID NO: 2284 - DNA, 50 bp, homo sapien
agtgaaaatcactggcctagatccamatcagcagtactacatagcaatgg

SEQ ID NO: 2285 - DNA, 50 bp, homo sapien
tctgcccagtttatgccctctttacygaacagatcgtcattgaactcagt

SEQ ID NO: 2286 - DNA, 50 bp, homo sapien
ccatagctacactctgggagaccaayacattaatcaatttcaagtaccat

SEQ ID NO: 2287 - DNA, 50 bp, homo sapien
gataaaaaccagaaacttgataatcmgacaagatgatggatgccctccca

SEQ ID NO: 2288 - DNA, 50 bp, homo sapien
ctcacagtccactagaatctctgaarcacttctttgcatgagaaaagccc

SEQ ID NO: 2289 - DNA, 50 bp, homo sapien
atcctgtgtcaacaacatccttcaartccttcgaaacacctgattggaac

SEQ ID NO: 2290 - DNA, 50 bp, homo sapien
tgtaataaaatactttatgaggtacygataaatgcaagtctgtatgtgta

SEQ ID NO: 2291 - DNA, 50 bp, homo sapien
gcaactctaggaaacagtctttcccrcatccagcataagggctaccaaga

SEQ ID NO: 2292 - DNA, 50 bp, homo sapien
tgaatatattcctcttatcttattayatgtttgtaccctttaacccattt

SEQ ID NO: 2293 - DNA, 50 bp, homo sapien
tgctgcaaggcttttcgcaattcctkaattaaacatattacctttttaaa

SEQ ID NO: 2294 - DNA, 50 bp, homo sapien
ctaacattcattaaacctctaacacyatagctaaagttgttacatttttt

SEQ ID NO: 2295 - DNA, 50 bp, homo sapien
aaagcattagtctcctttgaattccygctgtcctcatccttgctcagacc

SEQ ID NO: 2296 - DNA, 50 bp, homo sapien
ctctcctctgctgtgtccagtgtacygtaaaattccaactaccaagattt

SEQ ID NO: 2297 - DNA, 50 bp, homo sapien
tttatttccctgttggtacttgagcyatttccccaacattttcctgagtc

SEQ ID NO: 2298 - DNA, 50 bp, homo sapien
tatttttataacttactatctctcamtgaataaactattaaaaacccata

SEQ ID NO: 2299 - DNA, 50 bp, homo sapien
tatttttctagtacaggagataggcraaggccagtctgtggcatgtgcag

SEQ ID NO: 2300 - DNA, 50 bp, homo sapien
agagagaggcagaggggataaagtcrgaatggtagtcccgcaaatccctt

SEQ ID NO: 2301 - DNA, 50 bp, homo sapien
tctctcatctcccggccactctagakataatcagttttgcatatctttct

SEQ ID NO: 2302 - DNA, 50 bp, homo sapien
taggttattgcaccttgggcccttayaagttggattagtgatagtcagtc

SEQ ID NO: 2303 - DNA, 50 bp, homo sapien
aagccaagaaacagactctggactaygttatctccctgtaggtgctgtct

SEQ ID NO: 2304 - DNA, 50 bp, homo sapien
atggtcagtatttgcggtacaaggaycaggtcttagagtgttggggatga

SEQ ID NO: 2305 - DNA, 50 bp, homo sapien
agtgctggagtagaaaatcttgaacwataactggtgaattgctgaaggtt

SEQ ID NO: 2306 - DNA, 50 bp, homo sapien
taccgcaaatactgaccataaatcakccaaggtttagtgaacggtcatag

SEQ ID NO: 2307 - DNA, 50 bp, homo sapien
ccctctcttttcttcacccttgctayaagacacatgtatcatgccccaaa

SEQ ID NO: 2308 - DNA, 50 bp, homo sapien
aacatatatttttagggagtaagacraactaatctaatatctaattaaca

SEQ ID NO: 2309 - DNA, 50 bp, homo sapien
tgacagtcttaaggcatttatgaggraaaaaataggtcattatggtttat

SEQ ID NO: 2310 - DNA, 50 bp, homo sapien
actgtgcccggagctggatacacagrctgaacggcatggtccctgtcctc

SEQ ID NO: 2311 - DNA, 50 bp, homo sapien
gaggaggctccagcagtgctgataaygttcttaagctgagtacttggata

SEQ ID NO: 2312 - DNA, 50 bp, homo sapien
ttgaggataagtgtgatgttcataargtgccaaaactcaatgagagaaga

SEQ ID NO: 2313 - DNA, 50 bp, homo sapien
aatttgaaaaaccaaataatgcgaayagtgcaagttcccacccaacttcc

SEQ ID NO: 2314 - DNA, 50 bp, homo sapien
tattagaataaaacctcataccatcragattgcggggaaccttgcctgtt

SEQ ID NO: 2315 - DNA, 50 bp, homo sapien
ggttttaagcttcattgtgcaggaasactacttgctttcacttcttgtgg

SEQ ID NO: 2316 - DNA, 50 bp, homo sapien
atcttgccctatagcaccacagaatsaacagtaaataagatactattagc

SEQ ID NO: 2317 - DNA, 50 bp, homo sapien
ttgttttagtctctccaacaaaagarcagattcctaaagccaggtgcagc

SEQ ID NO: 2318 - DNA, 50 bp, homo sapien
agctagtggtatttcatggttagagsctaaagagataggcagaaaacact

SEQ ID NO: 2319 - DNA, 50 bp, homo sapien
ctccagatacattctatgtttcctgyaaggcatttagtacagttcagaat

SEQ ID NO: 2320 - DNA, 50 bp, homo sapien
cagcctagcacctgccaatatcccakcggtaaggaatgaacccagggccc

SEQ ID NO: 2321 - DNA, 50 bp, homo sapien
cccttttaaaggagaaaaattttcayaggatcccaggaaacatatatgca

SEQ ID NO: 2322 - DNA, 50 bp, homo sapien
agtgcaataggagccatacgcaaaasagtgtgagaaaaatgataaataat

SEQ ID NO: 2323 - DNA, 50 bp, homo sapien
ccttagattgctgaatttggtcataygaatagaaaaggaattcaggttag

SEQ ID NO: 2324 - DNA, 32 bp, homo sapien
agagactaaaggataayaggtgaagggagaga

SEQ ID NO: 2325 - DNA, 50 bp, homo sapien
tttttgtggtgatgttacttagaacygttattacttagaacattttttga

SEQ ID NO: 2326 - DNA, 50 bp, homo sapien
ttcaaagtcagagcaattggcgctcrcatgtatgacacagtctctagagt

SEQ ID NO: 2327 - DNA, 50 bp, homo sapien
tggggtggggagctcattcaatataytatagacctgagtagaataaaaag

SEQ ID NO: 2328 - DNA, 50 bp, homo sapien
gcttgaaaactttcttagaagtcaaygaagtttctggaaaacattgtttt

SEQ ID NO: 2329 - DNA, 50 bp, homo sapien
ggcaaggaacgagggcactgtcagtraaaaggcttcagctttcagtgctt

SEQ ID NO: 2330 - DNA, 50 bp, homo sapien
gaggaaataaggtagtaagaggaagraaagtaattccataagaagggcaa

SEQ ID NO: 2331 - DNA, 50 bp, homo sapien
gctttctagagctgaacaagttgtayggcaatatagggtacacatacaaa

SEQ ID NO: 2332 - DNA, 50 bp, homo sapien
ggacattttaacaatattttcctaawccatgaacacaaaatgtttttgcc

SEQ ID NO: 2333 - DNA, 50 bp, homo sapien
tttaccacagtaaatatgtcaaaacycccagtaggctggatgtggtagct

SEQ ID NO: 2334 - DNA, 50 bp, homo sapien
atgacacaatcagagctgtcatttasgcaatttactttggaaccagtata

SEQ ID NO: 2335 - DNA, 50 bp, homo sapien
ataatcagaatcctaaactaaagaakgcttaagatttcctaatttctaca

SEQ ID NO: 2336 - DNA, 50 bp, homo sapien
cactgatattttattatgttctggcsaaaacttaaatgaacataaataac

SEQ ID NO: 2337 - DNA, 50 bp, homo sapien
gagctcatttaatccaatttcctcakgtaataggcaaagaaaatgagaga

SEQ ID NO: 2338 - DNA, 50 bp, homo sapien
aatctgggagagcaattggaaagcamatccggttggatctgctttcaaaa

SEQ ID NO: 2339 - DNA, 50 bp, homo sapien
cttgaaaacatattaattgtttaccratctttctcctaaaaataaagctt

SEQ ID NO: 2340 - DNA, 50 bp, homo sapien
gggtttgtcctagcccaggaagaatragcggacttctttgctctgaggag

SEQ ID NO: 2341 - DNA, 50 bp, homo sapien
gtggactctcctctatccttagtggrcagtgattacttagagaaaaacca

SEQ ID NO: 2342 - DNA, 50 bp, homo sapien
atgataacgtaaagttcctgattcargcatccaaattagaatcaaaagat

SEQ ID NO: 2343 - DNA, 50 bp, homo sapien
gtctatttagcagatacttattaaaygctccatgtgccaggcatggcaaa

SEQ ID NO: 2344 - DNA, 50 bp, homo sapien
actagattacttctcaggtcctttcratgttttatgtattatttgctgag

SEQ ID NO: 2345 - DNA, 50 bp, homo sapien
taccactggaaagttgatagtaatayagaaaatgtgttacaatcaacgca

SEQ ID NO: 2346 - DNA, 50 bp, homo sapien
gagtgatcttctaaaagagatgccarcatagtaacaaacaagcttttagt

SEQ ID NO: 2347 - DNA, 50 bp, homo sapien
atgataattctgtcacaaatacaaasacaggttttatattatagatctag

SEQ ID NO: 2348 - DNA, 50 bp, homo sapien
aataatattgctgcaggaatcttggmagtaaagactaaactgggctttct

SEQ ID NO: 2349 - DNA, 50 bp, homo sapien
cggtgatctttcttattactctaggkcaccatgagcaagcagtcatagat

SEQ ID NO: 2350 - DNA, 50 bp, homo sapien
aaaatttatttcatttgaagcctaartaatatgtttttgatagatatatt

SEQ ID NO: 2351 - DNA, 50 bp, homo sapien
tttatcagtcacaagttgggcacaaragttggtgtgaaaatgggaattca

SEQ ID NO: 2352 - DNA, 50 bp, homo sapien
gagttggggcctcactgttttaatcragatgaattcaaaacctttgctta

SEQ ID NO: 2353 - DNA, 50 bp, homo sapien
atgagataagaagttcaggaaaataygtaatagctcaagacaaaaccacg

SEQ ID NO: 2354 - DNA, 50 bp, homo sapien
agggagcactttatctgctctgtagracatttagcagcttctggatcttt

SEQ ID NO: 2355 - DNA, 50 bp, homo sapien
agtgttccataaaagttttaaaaacragtgagtgaatgaatgaatgaatg

SEQ ID NO: 2356 - DNA, 50 bp, homo sapien
ttccaaaaaggtttttataaactccmatacgagaaactcatcaaatattt

SEQ ID NO: 2357 - DNA, 50 bp, homo sapien
aaatatttaagaacactacggcctayatctataacataaaagtattttct

SEQ ID NO: 2358 - DNA, 50 bp, homo sapien
atcaaaggtggcaatcgaacaccaasgaattggactagacagtggagggt

SEQ ID NO: 2359 - DNA, 50 bp, homo sapien
aaacaagcatttgggaaggtttatayagcactgttgaaggaggaagcatt

SEQ ID NO: 2360 - DNA, 50 bp, homo sapien
aaaatactagttctgaaagtgactgragagttcatgtagtccaactccca

SEQ ID NO: 2361 - DNA, 50 bp, homo sapien
aatgaggggggcagccatgaataaaractcattaaaccgtgtggcaatag

SEQ ID NO: 2362 - DNA, 50 bp, homo sapien
ctaagcttccattcagatcctgttgyatagggataactcttctggcctag

SEQ ID NO: 2363 - DNA, 50 bp, homo sapien
acaccaataagctggaactcaaagaycctaagtagcaggtttttttttca

SEQ ID NO: 2364 - DNA, 50 bp, homo sapien
aattctttctaaaacatgttttcacraggaactaaacatcaagggcatag

SEQ ID NO: 2365 - DNA, 50 bp, homo sapien
atcaaataactccgaatctagtaatsaccaaaaaaaccatgatttatgaa

SEQ ID NO: 2366 - DNA, 50 bp, homo sapien
caaaagattgcttttgaaaaattacygcttattgacaaatgtacctagtc

SEQ ID NO: 2367 - DNA, 50 bp, homo sapien
tttagggagaaaaataacattagacwccaaaagaaatgaggttatgtcat

SEQ ID NO: 2368 - DNA, 50 bp, homo sapien
taagcgtaaaccaagagtaaaaataygcaagagaccaaaatagatttatt

SEQ ID NO: 2369 - DNA, 50 bp, homo sapien
cagtagtggaagagaaacgaaatacrcttaggaaatagtgagaaaatagg

SEQ ID NO: 2370 - DNA, 50 bp, homo sapien
cattttaacataaccgcaaaatagakgttgtaatattgatgggaatattt

SEQ ID NO: 2371 - DNA, 50 bp, homo sapien
tgtaatctacttgtgtcaagccatamaacattactaatagctgtaaaaac

SEQ ID NO: 2372 - DNA, 50 bp, homo sapien
taaagtgtgcaccttcgattagttcrccttaaatgatcttttcagctctt

SEQ ID NO: 2373 - DNA, 50 bp, homo sapien
aagaaactgaactcagatgaagtgamctgctccatggaagatctgggttc

SEQ ID NO: 2374 - DNA, 50 bp, homo sapien
gatctcaagttgttaatcatcaatcmaggtttaaacattttagagtttat

SEQ ID NO: 2375 - DNA, 50 bp, homo sapien
acctacttcagaggacttaccacctwactggagatgtggaaatgcaccca

SEQ ID NO: 2376 - DNA, 50 bp, homo sapien
tgctgacagcaatgaagataataggrccctgaaatagaggccaggtggca

SEQ ID NO: 2377 - DNA, 50 bp, homo sapien
ttaaacagaacatgtcagatcttaaytcctctgactttatgactacgctc

SEQ ID NO: 2378 - DNA, 50 bp, homo sapien
atttgaagtttcccagctagtcaaasaacctaaatgattgtataggttgt

SEQ ID NO: 2379 - DNA, 50 bp, homo sapien
agaggctaggactatgccatttacargaactttcatatattatctcactg

SEQ ID NO: 2380 - DNA, 50 bp, homo sapien
gtggtctgtgtggttcatcactgacmaaaacattgttatgtggcatgtga

SEQ ID NO: 2381 - DNA, 50 bp, homo sapien
ttctagtaaacacccctttgtgtaawcattatgccaattacaatgaatgc

SEQ ID NO: 2382 - DNA, 50 bp, homo sapien
aatgaataatttcagattgcattgaygactttgaggaaattaaaaataat

SEQ ID NO: 2383 - DNA, 50 bp, homo sapien
cactcttcattcaggcttggagtctracttctctaattgttctgcccttg

SEQ ID NO: 2384 - DNA, 50 bp, homo sapien
tgtgactaccataacacaaaggacargggagtaaatataactattttgtt

SEQ ID NO: 2385 - DNA, 50 bp, homo sapien
gtttgctgacactttgctatgaaaawtggattcagacattgcaggcatgc

SEQ ID NO: 2386 - DNA, 50 bp, homo sapien
agttctggatgaacagcagtaaattraacacgcaaggagtttgaggcttc

SEQ ID NO: 2387 - DNA, 50 bp, homo sapien
tcgtgaacttgtgtgtaaaattaacraagctactcaacatcaagaaagaa

SEQ ID NO: 2388 - DNA, 50 bp, homo sapien
atgtcactaactcatgaacgacaaaktccctctagggtgaacaaccaagt

SEQ ID NO: 2389 - DNA, 50 bp, homo sapien
tttcttctgtccagatgtctctggarggtcattcttaactgtcttgcttc

SEQ ID NO: 2390 - DNA, 50 bp, homo sapien
taaaatgtcttgactcattcagtgaygctaccattttatcagctgcccag

SEQ ID NO: 2391 - DNA, 50 bp, homo sapien
caggtgtagacaaagacttaggactraagaagcaataggcataactctgg

SEQ ID NO: 2392 - DNA, 50 bp, homo sapien
gattctgattctgaagtcttaactgycagcagaaaaactccatactgttc

SEQ ID NO: 2393 - DNA, 50 bp, homo sapien
attacaatcctatgaagttggtatayaggaggaaaattgaggtactaaca

SEQ ID NO: 2394 - DNA, 50 bp, homo sapien
tcagtagtcagtgtatcctatgtaarcaacatttttttcttgactttgca

SEQ ID NO: 2395 - DNA, 50 bp, homo sapien
aagaggagctccctgtttgtttcagraacggtgtacataaataaattaat

SEQ ID NO: 2396 - DNA, 50 bp, homo sapien
gggattgaacatataattgaatatayggcagatggtgagagcctgatttc

SEQ ID NO: 2397 - DNA, 50 bp, homo sapien
ctatagttgccagcctgggtttccayctatatcttaataaccagagttgc

SEQ ID NO: 2398 - DNA, 50 bp, homo sapien
gcacattttgattttgtgtagccagsaagagttatatacctcccagacca

SEQ ID NO: 2399 - DNA, 50 bp, homo sapien
cagcaaacctaaggcagaactaggaraaccaatcaggagagggtgtagct

SEQ ID NO: 2400 - DNA, 50 bp, homo sapien
gggagacttgtcatcaagtttttcamaaatttttcaccattcaaaaagag

SEQ ID NO: 2401 - DNA, 50 bp, homo sapien
ctctgcaagattaaaatttcatccgraaagtcttaatctctttgttagta

SEQ ID NO: 2402 - DNA, 50 bp, homo sapien
tcttcatccagtacctctcttcttaygccagctgagaaacagcagtgaaa

SEQ ID NO: 2403 - DNA, 50 bp, homo sapien
cactaggactcaccttccaacaacamcatattgggaataaaatttcaaga

SEQ ID NO: 2404 - DNA, 50 bp, homo sapien
aaaacttccttttggactacacatcyatatcttcctgagaagtgcaagta

SEQ ID NO: 2405 - DNA, 50 bp, homo sapien
gaaaaaagttgaaaaggtggttgtgycaaactgattggtgaagtctccat

SEQ ID NO: 2406 - DNA, 50 bp, homo sapien
agggctgagtgaagttctatcaggasctagggaccccataaattcaactc

SEQ ID NO: 2407 - DNA, 50 bp, homo sapien
cttaatgtgtcctctctctggtgagyagctcaatattcaacactgtgacc

SEQ ID NO: 2408 - DNA, 50 bp, homo sapien
gcccgctcccacccagggttttagamaactcaaggattggaaagacctca

SEQ ID NO: 2409 - DNA, 50 bp, homo sapien
gtctgtaaagaagaaagtatgaatargctagtgagaactggcaaaaatcc

SEQ ID NO: 2410 - DNA, 50 bp, homo sapien
atgtattagtggggtcatcaccaaakatggattagatatacactcaatga

SEQ ID NO: 2411 - DNA, 50 bp, homo sapien
tgccaccaagaatacactttctctawcattgttcaaagtatccttcctat

SEQ ID NO: 2412 - DNA, 50 bp, homo sapien
tcaaacatacaaacagcttgacataygacgtacaaagcccttctaaagcg

SEQ ID NO: 2413 - DNA, 50 bp, homo sapien
tggaaccttactaaatggaaagcacygtgcaaagaactggataatgttcc

SEQ ID NO: 2414 - DNA, 50 bp, homo sapien
tgccataatcaccacatcaccttcamgtctcataattttgctgtgggaac

SEQ ID NO: 2415 - DNA, 50 bp, homo sapien
tttatttcactctttatgattagaayagtaatacatgcatttttaaaaaa

SEQ ID NO: 2416 - DNA, 50 bp, homo sapien
cattatttatgaatattgacttctckaattgacttttgataaccatttgt

SEQ ID NO: 2417 - DNA, 50 bp, homo sapien
aggacaagacattattaataaagctraaatgtatctactctctccaatct

SEQ ID NO: 2418 - DNA, 50 bp, homo sapien
tttcattccaggaaagtgtttctaamgtgtgctttgtggattgtaatagt

SEQ ID NO: 2419 - DNA, 50 bp, homo sapien
cccaaactgcaaagaacatggactaygtgccccaagaagttcacttaaaa

SEQ ID NO: 2420 - DNA, 50 bp, homo sapien
ttagataaatctcaatatggaggaawctttatatacgaccccagtcaaaa

SEQ ID NO: 2421 - DNA, 50 bp, homo sapien
ccttgtacaagaactaaataaatackgattggttgattgattattgatcc

SEQ ID NO: 2422 - DNA, 50 bp, homo sapien
tgtcttggcatagcaccaactgtcaygaggaaaccggggaaagacgcttc

SEQ ID NO: 2423 - DNA, 50 bp, homo sapien
gctgacatcactctctctatctctawacttttacactgatttttaaaaag

SEQ ID NO: 2424 - DNA, 50 bp, homo sapien
gctaagatcatatgcagaactttaasaatctcttctaaactgccttttgt

SEQ ID NO: 2425 - DNA, 50 bp, homo sapien
aaagcagggagaacgttagtgggaayttagtgtaggagagtaaagatagt

SEQ ID NO: 2426 - DNA, 50 bp, homo sapien
agtgcttgaatacatgagtcgcctaygaatgaatgaacggtgcagacaca

SEQ ID NO: 2427 - DNA, 50 bp, homo sapien
ctctgacccattcatctgcatattayagggcaatgtctctgatagagctg

SEQ ID NO: 2428 - DNA, 50 bp, homo sapien
ttgttgatattcctcatttattcacyattccactgaatcctatccagctc

SEQ ID NO: 2429 - DNA, 50 bp, homo sapien
tatagatgacggcatgtacatgtgaktatttcctgtgatcccaaactgtg

SEQ ID NO: 2430 - DNA, 50 bp, homo sapien
tcccttttgagtttgatttctggcgmaccttggcctaaatcaggattaga

SEQ ID NO: 2431 - DNA, 50 bp, homo sapien
ttccaagacatgatgttgctaaaatmaggcaagcgttcatcaaactttga

SEQ ID NO: 2432 - DNA, 50 bp, homo sapien
tacaatggaatattattcagcaatartaaggaatgaaacacagatacaag

SEQ ID NO: 2433 - DNA, 50 bp, homo sapien
aaggaggactaagaattagtcaggamgttagagtgagagtggatatggtg

SEQ ID NO: 2434 - DNA, 50 bp, homo sapien
atctgtgtgtatgaagggcataggayagacgggtccacactgaatgaggc

SEQ ID NO: 2435 - DNA, 50 bp, homo sapien
tgttaaaggatgtcttagaaaatcartccaaagccagcctcataggctac

SEQ ID NO: 2436 - DNA, 50 bp, homo sapien
aacatgtgggcagcatattcgaaacrcgcaagagaaaaaggactattaca

SEQ ID NO: 2437 - DNA, 50 bp, homo sapien
aggcagaagttatttaataagtgctraccacatgttttggatctagtgct

SEQ ID NO: 2438 - DNA, 50 bp, homo sapien
tgaggtgtagcagaatttcacacaastcgggaatgtcaccgaagttttct

SEQ ID NO: 2439 - DNA, 50 bp, homo sapien
actttatgaagtcccaaatgtaacaraggtttagctcattcttttttatt

SEQ ID NO: 2440 - DNA, 50 bp, homo sapien
agtgagattctactcagttacaatgracactgcattaggcttagtgcaaa

SEQ ID NO: 2441 - DNA, 50 bp, homo sapien
cccagagttactaattagtaactagycataaagctggaatcaaacccagg

SEQ ID NO: 2442 - DNA, 50 bp, homo sapien
aataaacacatcaatgaataactttwaaaaagatggcaaatattataaaa

SEQ ID NO: 2443 - DNA, 50 bp, homo sapien
ccaaggaaccttaatctgcgctcgargtttttactatatgtattaaagat

SEQ ID NO: 2444 - DNA, 50 bp, homo sapien
actctcaaatgcattattccaagcaraagaagctattctcaaaagactgc

SEQ ID NO: 2445 - DNA, 50 bp, homo sapien
cccatagactgctcagtgatctggaygaaaaaactgtaacctaacaaggg

SEQ ID NO: 2446 - DNA, 50 bp, homo sapien
actgtacatctctaaggtccagaaasaggacaacagcacctacatcatga

SEQ ID NO: 2447 - DNA, 50 bp, homo sapien
atattaggtaagattcttttgatagmaaataacagaaactaattcaatgt

SEQ ID NO: 2448 - DNA, 50 bp, homo sapien
cttttccataaaccttctagtcccamaaactgctagattatcaactcata

SEQ ID NO: 2449 - DNA, 50 bp, homo sapien
ctgtcctgggatgcaagtgcctctaygaatgtggtgcagaagctacaaat

SEQ ID NO: 2450 - DNA, 50 bp, homo sapien
agaggtgacatgcctgttgtcatggwacttagcaaagaaaaagcttagct

SEQ ID NO: 2451 - DNA, 50 bp, homo sapien
ttataacaatgttgtgaaggatccartagagttaaattaagcatgtgttt

SEQ ID NO: 2452 - DNA, 50 bp, homo sapien
ctaagcagaaagtctttgaaatgtaragtggagtttttagtaggtttatg

SEQ ID NO: 2453 - DNA, 50 bp, homo sapien
actcagtgaatgttaagtagattggrattagaatagagaagtttttaagg

SEQ ID NO: 2454 - DNA, 50 bp, homo sapien
tcttgtaggaagagataagttgagaygaagaagaagaccagggttgttgc

SEQ ID NO: 2455 - DNA, 50 bp, homo sapien
ctacagaattcgatcaattttcttayggacatttaaagagcctctatagc

SEQ ID NO: 2456 - DNA, 50 bp, homo sapien
aagaagttagggtctttaaactgagracattaaggtatattgatagagtt

SEQ ID NO: 2457 - DNA, 50 bp, homo sapien
ttaatttgtttcaaaccatattaaamaccaaactctatataaataggatg

SEQ ID NO: 2458 - DNA, 50 bp, homo sapien
agctcctgcctcaggcagatgaccgwatctcccctgaaatgaatgttcct

SEQ ID NO: 2459 - DNA, 50 bp, homo sapien
tctgtcttcatattcaaaaaggaaamtaatctgcaatttctctactctgc

SEQ ID NO: 2460 - DNA, 50 bp, homo sapien
tgtggagagatgtaaaacaagaaacrcagtatattagcatagatgtatca

SEQ ID NO: 2461 - DNA, 50 bp, homo sapien
agctggatgttgacattcgtaaggcraactaggccatctcttgtaccatt

SEQ ID NO: 2462 - DNA, 50 bp, homo sapien
agtgatgatatattagctgcagaaastagacatgcaaatatatacataga

SEQ ID NO: 2463 - DNA, 50 bp, homo sapien
ataatgaattcttcttcctggttaamaaagacagtgaaactttcatagta

SEQ ID NO: 2464 - DNA, 50 bp, homo sapien
tgacagaaacattaagaataacaccygaatgcaaatccagaaaaaagcgc

SEQ ID NO: 2465 - DNA, 50 bp, homo sapien
ctcagggtcctgacctgtaagatgcraagactctaaggtctgtcttagcc

SEQ ID NO: 2466 - DNA, 50 bp, homo sapien
actaaactgagcaggttttaacaacsaggaagtctccactctcattctcc

SEQ ID NO: 2467 - DNA, 50 bp, homo sapien
catggatgttggaataagggtcagargtagcacaaattggctcctcagct

SEQ ID NO: 2468 - DNA, 50 bp, homo sapien
aacctacacaaagtcctcgtccaagraagtaatcaggtctttacaagaag

SEQ ID NO: 2469 - DNA, 50 bp, homo sapien
caacccaggtagggcagatccgaacsatgagggtaatggaataaggggca

SEQ ID NO: 2470 - DNA, 50 bp, homo sapien
tgggcctgccagggtgaggaatagamctctttgccgatccatgtacctct

SEQ ID NO: 2471 - DNA, 50 bp, homo sapien
aacttgtcattctggtattctgcaayatataaatctaagagttagtagtt

SEQ ID NO: 2472 - DNA, 50 bp, homo sapien
caaagcttacctaaccaagaagggcrcaatccacaatgcacacttgaggt

SEQ ID NO: 2473 - DNA, 50 bp, homo sapien
atcttaattgtcttcttgttccatamaacattacactgaggaaagaagtt

SEQ ID NO: 2474 - DNA, 50 bp, homo sapien
gaatgggattatggtaaaagacaaasagattgcctcaggatattctccag

SEQ ID NO: 2475 - DNA, 50 bp, homo sapien
atccttcttccttggtgacctttaarggcaaaatgtgagaaaagataaca

SEQ ID NO: 2476 - DNA, 50 bp, homo sapien
ttcaaagcctgtctctataactcackagcttttttacttaaggcagatta

SEQ ID NO: 2477 - DNA, 50 bp, homo sapien
taacttaagaaaaaaattcctgaaartgggattcttggattgggttgctt

SEQ ID NO: 2478 - DNA, 50 bp, homo sapien
ttgagttgccaacatctacaaaatayattctaacaaagatgctcagaatg

SEQ ID NO: 2479 - DNA, 50 bp, homo sapien
aatccattgctttctggcttgtttcractccaattattacaataaatata

SEQ ID NO: 2480 - DNA, 50 bp, homo sapien
ttaaatcatcttggatcagtttttayattattatttcttatgtgtaccaa

SEQ ID NO: 2481 - DNA, 50 bp, homo sapien
tctttagcagttataattagctaccrggaataacctaaatattgcacatg

SEQ ID NO: 2482 - DNA, 50 bp, homo sapien
aggagcagatggatatttgagaacargaaggctattctgtggctgaagct

SEQ ID NO: 2483 - DNA, 50 bp, homo sapien
gagccgttccctgtcattcagaaaastcatctggctacagtggagcataa

SEQ ID NO: 2484 - DNA, 50 bp, homo sapien
gacatggagaatggttgatgatagamtattaagtgataaactcagacccc

SEQ ID NO: 2485 - DNA, 50 bp, homo sapien
gagaacatagtaactaccgtgcatayaggaaagtctcttgtgacagatta

SEQ ID NO: 2486 - DNA, 50 bp, homo sapien
tttagggaaacgggcagagttactaragtcctaactcctctaactgtaaa

SEQ ID NO: 2487 - DNA, 50 bp, homo sapien
agggggatactccagttagagagaaragcaattgcgaaaccattgaaata

SEQ ID NO: 2488 - DNA, 50 bp, homo sapien
acactgaagcaacacaaagtggcaaytatcattttatcttcccatcaaga

SEQ ID NO: 2489 - DNA, 50 bp, homo sapien
ggacaattataacacatccttggaaytgttatatggatacttagagaaaa

SEQ ID NO: 2490 - DNA, 50 bp, homo sapien
atacagcaaaaagtttccaattaaasgttgggtatctctaaccttaaaag

SEQ ID NO: 2491 - DNA, 50 bp, homo sapien
gtcctcaacactagtactgcttctayatcttttttcaggttgcttcatat

SEQ ID NO: 2492 - DNA, 50 bp, homo sapien
tctacaaactcttacaaaattatagkcctgatttctccttacagaaaaga

SEQ ID NO: 2493 - DNA, 50 bp, homo sapien
gttcaaataagttttacttgaacaascagtgtggaactatgctttcatcc

SEQ ID NO: 2494 - DNA, 50 bp, homo sapien
tgggcacagaggaaatactccatcayagaattagtgagtaaatgtgcagt

SEQ ID NO: 2495 - DNA, 50 bp, homo sapien
gctgcatctctgaataggtatattargtcagtgggtatatcaggcagagg

SEQ ID NO: 2496 - DNA, 50 bp, homo sapien
agagtattttgaaactatttattgaratacagaatctagataaaagaaca

SEQ ID NO: 2497 - DNA, 50 bp, homo sapien
attgtgaataaagaatcaataggacycgacacctgattatatttgtgcta

SEQ ID NO: 2498 - DNA, 50 bp, homo sapien
ctctaagagctctgccatttctaaayaagccaaaatgaagctgagtctct

SEQ ID NO: 2499 - DNA, 50 bp, homo sapien
catctaacagacgaactcaaccttaygaatctgttacctttaatgttcct

SEQ ID NO: 2500 - DNA, 50 bp, homo sapien
agatctgtagtgtgtagaccagagasgatagaacaactcacagagatgct

SEQ ID NO: 2501 - DNA, 50 bp, homo sapien
tctccattatttgctatgcataagaygatctacacataagccagtcttct

SEQ ID NO: 2502 - DNA, 50 bp, homo sapien
tgtgaaaggatcatccttgaaacaartctgctgtttgccatgcttgtagt

SEQ ID NO: 2503 - DNA, 50 bp, homo sapien
tcccatcagtctctaccatcacttcycaagagtgtattattgtcagcccc

SEQ ID NO: 2504 - DNA, 50 bp, homo sapien
ctggctgaacagtaatgatgcagtcrgacagtttggttttgtgccttgga

SEQ ID NO: 2505 - DNA, 50 bp, homo sapien
tggaagaccaagcacgactagctatyaaacttgtgaggatttagtggcat

SEQ ID NO: 2506 - DNA, 50 bp, homo sapien
tcacataaaatatcacacttttagartaataagacagcaagagagtatga

SEQ ID NO: 2507 - DNA, 50 bp, homo sapien
ggtttaggcacaatggtaaccaagaygggtatgatatctacaataattgg

SEQ ID NO: 2508 - DNA, 50 bp, homo sapien
ggctgcaatgagaaaattatgaaaastgagacgtgcaatgttctccacac

SEQ ID NO: 2509 - DNA, 50 bp, homo sapien
cttctatctacatgcatttatacacrcacttcagtccagactatttccaa

SEQ ID NO: 2510 - DNA, 50 bp, homo sapien
agataatctaagcctgttccaaaaakagcctggttagaagaactttcacg

SEQ ID NO: 2511 - DNA, 50 bp, homo sapien
tgatttgacaaaaatgcttagttaargaatgagtagatgatgtgtttgtt

SEQ ID NO: 2512 - DNA, 50 bp, homo sapien
atagaaaaagctgggaatcgagggaygaagtaaaagtgaagcgctaagaa

SEQ ID NO: 2513 - DNA, 50 bp, homo sapien
caaaagccagggagagaaacagcackaaggtcaaggagaggagccccttg

SEQ ID NO: 2514 - DNA, 50 bp, homo sapien
ttttaagcttggggttttcaagaccrcaaatccaatatggacttttccag

SEQ ID NO: 2515 - DNA, 50 bp, homo sapien
tattgctgctctaacaaatcatcacraacacaaagtaacacaaatttatt

SEQ ID NO: 2516 - DNA, 50 bp, homo sapien
gacaagtatttgctccttaaaacaaygcagattagtgaacgtggattcct

SEQ ID NO: 2517 - DNA, 50 bp, homo sapien
agcaggaaaaagagagggatgataasaggatttggcagcaaattaatact

SEQ ID NO: 2518 - DNA, 50 bp, homo sapien
catgattctttacttcaagaagagartattagggacctttgtatatctag

SEQ ID NO: 2519 - DNA, 50 bp, homo sapien
tttgttgaaggaatacatgaatgaakttacagcaaatagagacaagagca

SEQ ID NO: 2520 - DNA, 50 bp, homo sapien
gaaggcccaaaggcaagtgagagcayggtgttgctgaaagaagcccagct

SEQ ID NO: 2521 - DNA, 50 bp, homo sapien
acaacaaaattaattaggtcatgtasagtggtatcaacacaggaaagttt

SEQ ID NO: 2522 - DNA, 50 bp, homo sapien
ggcaaaaggttttttgccaatagcayggtgaagggcattcttgacctcct

SEQ ID NO: 2523 - DNA, 50 bp, homo sapien
acccagactatgactgactatatgtyaaactgatgaagattctaggcaaa

SEQ ID NO: 2524 - DNA, 50 bp, homo sapien
ataacaatcagctactccttgcttaygattccctacagctttgcccctgt

SEQ ID NO: 2525 - DNA, 50 bp, homo sapien
cacccacttttctgctttcaacaaaygataacaatcagctactccttgct

SEQ ID NO: 2526 - DNA, 50 bp, homo sapien
caggaaaccaatgcctcagggtaaayctcttaagaatgtagctgtaatac

SEQ ID NO: 2527 - DNA, 50 bp, homo sapien
acatggttggtgtacagggtgtcttsaaaacagtcaaaactaccttccca

SEQ ID NO: 2528 - DNA, 50 bp, homo sapien
gatgtagaacacaaaaatcaacacamacatatcaatggtgtttctataca

SEQ ID NO: 2529 - DNA, 50 bp, homo sapien
tctgtgatggttttgtgtttaaacartcatcttcttttaaataatatcca

SEQ ID NO: 2530 - DNA, 50 bp, homo sapien
cataagcttgtgccatcattatgcarcatgcaagaaggaatgagccccag

SEQ ID NO: 2531 - DNA, 50 bp, homo sapien
agtgcaactctctctgctggccacamtgactttcgttcttttaggtcctc

SEQ ID NO: 2532 - DNA, 50 bp, homo sapien
ataatagagtagaggaaattttaaayaggtgctcagtgagaaaaacgagg

SEQ ID NO: 2533 - DNA, 50 bp, homo sapien
aatgcaaactcagatgccatattaastactcagaattctcccatgttcac

SEQ ID NO: 2534 - DNA, 50 bp, homo sapien
gtccctggaaggggatataggagtargttctgagcatgcagttgtctctc

SEQ ID NO: 2535 - DNA, 50 bp, homo sapien
aaaattattagacagatctaatctaycaattctaagtgtcttgagcagat

SEQ ID NO: 2536 - DNA, 50 bp, homo sapien
tggaacaaatgagtgaccaacagaartggaggaattatgtattctattgg

SEQ ID NO: 2537 - DNA, 50 bp, homo sapien
gggaagtcagtgggccatgcttacaycctggctaactcttacctgtggct

SEQ ID NO: 2538 - DNA, 50 bp, homo sapien
cagagatgtggaaggaacagaggaayggcagtaagccaaggttaacttaa

SEQ ID NO: 2539 - DNA, 50 bp, homo sapien
agtatgaagctgagcaaattcatccrataaaaacataagcccagtgctac

SEQ ID NO: 2540 - DNA, 50 bp, homo sapien
cataggctttctagagaagataaacscttcatctaggtttggagggaaga

SEQ ID NO: 2541 - DNA, 50 bp, homo sapien
atttgcagcaggacctgattttgaaygtgggtaacagcatcccccactga

SEQ ID NO: 2542 - DNA, 50 bp, homo sapien
agttggtaactgacagaactagaacygataccaacattcaccaaccaact

SEQ ID NO: 2543 - DNA, 50 bp, homo sapien
gttgtacctgtcagtccagaattaayggtgtgctcggggatgttcctcag

SEQ ID NO: 2544 - DNA, 50 bp, homo sapien
gccccaaactaagaaactgtaacaayctcatgtgaggaattgtggccatt

SEQ ID NO: 2545 - DNA, 50 bp, homo sapien
tgtggcagatctagaaacccaggaaygtatctgtgctgcagcccttaggc

SEQ ID NO: 2546 - DNA, 50 bp, homo sapien
atgcctaggttccattctcatgaccyaactttctgaattgcgcgaccttt

SEQ ID NO: 2547 - DNA, 50 bp, homo sapien
gaatctttgttttttgggccaattaygcaaaaggtaaaggaagacctttc

SEQ ID NO: 2548 - DNA, 50 bp, homo sapien
ctttatttgtgggagatacatttcartatgcccagcaggtgccagaaact

SEQ ID NO: 2549 - DNA, 50 bp, homo sapien
tgtaaaagagaagagagtggatcaaygtcgagcaggagaacacggcttca

SEQ ID NO: 2550 - DNA, 50 bp, homo sapien
ctttgtcattataattattagtacargtataacacagtagcttcaccaca

SEQ ID NO: 2551 - DNA, 50 bp, homo sapien
aaagacacaggttctgttcttcaaayaacacctgcataaactatggaggg

SEQ ID NO: 2552 - DNA, 50 bp, homo sapien
gcatatacttccagaaactggagtcratgttaggaaagattccattctaa

SEQ ID NO: 2553 - DNA, 50 bp, homo sapien
attcatgggacatgtgtttgattcakatttatatacccacaatggcctaa

SEQ ID NO: 2554 - DNA, 50 bp, homo sapien
gcagcaaagcaatgtgacataaagcrgaagacaattaccacttattaagg

SEQ ID NO: 2555 - DNA, 50 bp, homo sapien
gcataaagaaaggctccatttacacratgtggaagaaatcaactttacct

SEQ ID NO: 2556 - DNA, 50 bp, homo sapien
tcaaagactttactctgcatttatamcattcgtcttttatacagtttctt

SEQ ID NO: 2557 - DNA, 50 bp, homo sapien
actgcaaaaaatacaataagattccyaatgacaatgaatatgtagataac

SEQ ID NO: 2558 - DNA, 50 bp, homo sapien
tatttgtatgtgttttcatgttgtasgtaggtttttagatgtaccaggaa

SEQ ID NO: 2559 - DNA, 50 bp, homo sapien
ttgttttgttacagaaatatcacaaygtaagtggtatgaaaaatgaaaag

SEQ ID NO: 2560 - DNA, 50 bp, homo sapien
ggccagaggtactgtgttaagatatragtaaactgacagaagacaagaag

SEQ ID NO: 2561 - DNA, 50 bp, homo sapien
cctattgaatttgaggttgtgatgaytattatcccttgtgtatccatctt

SEQ ID NO: 2562 - DNA, 50 bp, homo sapien
tggccctatgctccagtagaaccaaygaccaggcttgttccagaaggacc

SEQ ID NO: 2563 - DNA, 50 bp, homo sapien
tgctatgttttttctttttatctatmactttatgtctcctttagatcaat

SEQ ID NO: 2564 - DNA, 50 bp, homo sapien
aacccttatttccgcttactgggaamatgatcagcctttgggtttaaagg

SEQ ID NO: 2565 - DNA, 50 bp, homo sapien
aggacttcaataggaggtagaagaaygtacctaaaacttactgtgtttgg

SEQ ID NO: 2566 - DNA, 50 bp, homo sapien
tcttcaggagctagatgtgcacaacrgagtttacccttggaaaagaaaag

SEQ ID NO: 2567 - DNA, 50 bp, homo sapien
agtgcaaacatggagccaagatgcasatgtaatccctggggtctgcagga

SEQ ID NO: 2568 - DNA, 50 bp, homo sapien
tcgcctcaaaccaggatatctcaacrattggcgtttgaaagtgggtgatt

SEQ ID NO: 2569 - DNA, 50 bp, homo sapien
agggatacactgccatagaacatcaraaagacactaagatgggcggcaca

SEQ ID NO: 2570 - DNA, 50 bp, homo sapien
gtgccttccaaatcacagccaataaygccaaccttgtttttctttatttc

SEQ ID NO: 2571 - DNA, 50 bp, homo sapien
tgaatttctgagagactaagtttccyagagtaacatggttagtaggtggc

SEQ ID NO: 2572 - DNA, 50 bp, homo sapien
gactagggtaaaggaggggtccacaratggccaggtagcgatcataggcc

SEQ ID NO: 2573 - DNA, 50 bp, homo sapien
ctgggaccttctgatacaaatgaaastttatgaatcatttattttttaca

SEQ ID NO: 2574 - DNA, 50 bp, homo sapien
acttcagcttagtggaacactgagcraagaacctaatcatgctattcctg

SEQ ID NO: 2575 - DNA, 50 bp, homo sapien
tatcaggggagtaataggcttttaaratcataaagtgactattaaaatgc

SEQ ID NO: 2576 - DNA, 50 bp, homo sapien
acctagagaatgtttgattggaaaayggagaaaatatatatgtacaacat

SEQ ID NO: 2577 - DNA, 50 bp, homo sapien
aactgaattaattgaatcagcaatargcatggggtagtgactttgtatat

SEQ ID NO: 2578 - DNA, 50 bp, homo sapien
cgatgctccaatatctcgaaatatayacttggaccaatcacttccttcct

SEQ ID NO: 2579 - DNA, 50 bp, homo sapien
gcaactcagcaaatgcataaataagmaattgaagaaaatgaaacaaaatg

SEQ ID NO: 2580 - DNA, 50 bp, homo sapien
attagcccttctgtttcctcaagctraatttcttgtttttaaaaaagtaa

SEQ ID NO: 2581 - DNA, 50 bp, homo sapien
catttcctacataaattcctatcaakgttaccagccctccccagtttatt

SEQ ID NO: 2582 - DNA, 50 bp, homo sapien
cagtagggtctgaatataggctgcaytcaaatacttttctaggaacagtg

SEQ ID NO: 2583 - DNA, 50 bp, homo sapien
ctcaacacctccaggaagtatgtcaygatgcaatggagaaatttcaaagc

SEQ ID NO: 2584 - DNA, 50 bp, homo sapien
agggtagaagacaaggccaccaaaasgataaatcagcttagtagcctttt

SEQ ID NO: 2585 - DNA, 50 bp, homo sapien
taaaagtcacaataaattatttttcrctgttaaacatcctctcttgttct

SEQ ID NO: 2586 - DNA, 50 bp, homo sapien
caacagctaattccaccacttgtaaygtcctggctaaccagaggtcctga

SEQ ID NO: 2587 - DNA, 50 bp, homo sapien
agattcccccaaaaaaatatgtggaragtcttactgagtatgtgtggaat

SEQ ID NO: 2588 - DNA, 50 bp, homo sapien
accaccaccaccaccactatcttcayggtgcttgttccctccaaagtgga

SEQ ID NO: 2589 - DNA, 50 bp, homo sapien
acatttgagacaataccattatccamaacacaaaggttaaataaaaataa

SEQ ID NO: 2590 - DNA, 50 bp, homo sapien
tgcctactagacctcctgaatagaaygtcaagaatctacatcttacttgc

SEQ ID NO: 2591 - DNA, 50 bp, homo sapien
ttattcaaatagctctcgtaatcatsagtttcttaagtcattgagtcctc

SEQ ID NO: 2592 - DNA, 50 bp, homo sapien
aactgctttctttccacctgattctraaaaataaaagtacatttggggct

SEQ ID NO: 2593 - DNA, 50 bp, homo sapien
acactcccatttggatatcccaaagrcaccttaaattcaatatgtcaaaa

SEQ ID NO: 2594 - DNA, 50 bp, homo sapien
caaagaataaaaagcatggaattcasaattactagatttgtagttaaggc

SEQ ID NO: 2595 - DNA, 50 bp, homo sapien
aacaaaaagaatatagcactagaagragaaccagtttttactcaagatta

SEQ ID NO: 2596 - DNA, 50 bp, homo sapien
gatgaagcttcacattcatgtatgcrcgttcttccatagaggaaccagag

SEQ ID NO: 2597 - DNA, 50 bp, homo sapien
ggctactaaagtgattctttaaacayataagtcagatcatgttgttcctc

SEQ ID NO: 2598 - DNA, 50 bp, homo sapien
attatgttatcatccctatcttagayctgaaaatactaaagcacatatag

SEQ ID NO: 2599 - DNA, 50 bp, homo sapien
cagagcaatatattcatctggagaamcttttggccaggtcttactttgat

SEQ ID NO: 2600 - DNA, 50 bp, homo sapien
tatatgaaaggaatctgacctagacrgagaaagtttacctgaggaagtaa

SEQ ID NO: 2601 - DNA, 50 bp, homo sapien
acaattgaggtcttagctccaatatyacctccttagaaaagtcttccctg

SEQ ID NO: 2602 - DNA, 50 bp, homo sapien
acaacacaatttcattgtagatgaartgctggatccttattttacaagaa

SEQ ID NO: 2603 - DNA, 50 bp, homo sapien
ccccattatcctaatcagtattaccsagtgagcaggtgtgggagagaaca

SEQ ID NO: 2604 - DNA, 50 bp, homo sapien
aagtataaggtgtgattttcaaccargtacgtgttatgcaaaccactgaa

SEQ ID NO: 2605 - DNA, 50 bp, homo sapien
agctttctccccagaccatttcaagsatgaattatttggtcaggtcctaa

SEQ ID NO: 2606 - DNA, 50 bp, homo sapien
acttatgagtatccaagggaaataaygtgacagcaatgcaggaaaaattc

SEQ ID NO: 2607 - DNA, 50 bp, homo sapien
cagtcacttaacgtctcatgagtctyacctttaaaatgaaaggatcagat

SEQ ID NO: 2608 - DNA, 50 bp, homo sapien
ctagacgcaaaccacaacactaccasgtcatgatcttctctcttcaaacc

SEQ ID NO: 2609 - DNA, 50 bp, homo sapien
gctatattcttaatctgaaactaaamtcctggaaataaaagaattgtaag

SEQ ID NO: 2610 - DNA, 50 bp, homo sapien
atttcaggcgttggtttgcagattayaagtatcatactcggggatagaat

SEQ ID NO: 2611 - DNA, 50 bp, homo sapien
aaaacagccttattactgatacgaaraaagtttggtctggatagaatatc

SEQ ID NO: 2612 - DNA, 50 bp, homo sapien
ttcaaatccaaggataccttgatccraaagccattctctttaccgaataa

SEQ ID NO: 2613 - DNA, 50 bp, homo sapien
ggatcacacaatgagagacaatgccyggactgtccaagtattatacaaaa

SEQ ID NO: 2614 - DNA, 50 bp, homo sapien
ctcaatattcaacaggccaaggggaytactacaaaagatgtttccattct

SEQ ID NO: 2615 - DNA, 50 bp, homo sapien
tgtaggcacaaggcagaggcgaatgragatcatgggaggtcctttggtgt

SEQ ID NO: 2616 - DNA, 50 bp, homo sapien
tgacaaactgggatcacattacggaygctcaacttatgatggggctacat

SEQ ID NO: 2617 - DNA, 50 bp, homo sapien
tgtttgaagtggaggatatgacagcracggtgatagacaaagctggaaag

SEQ ID NO: 2618 - DNA, 50 bp, homo sapien
cagagcccacattctagagtagatasataaacagatatatccattccccc

SEQ ID NO: 2619 - DNA, 50 bp, homo sapien
ttgagattcagaggtcagtgcaacayctaagtgaaaatggccaggctctt

SEQ ID NO: 2620 - DNA, 50 bp, homo sapien
cagactggctataaacacacccgtgracaccaacttgaatactgggaacg

SEQ ID NO: 2621 - DNA, 50 bp, homo sapien
atgccagaagcaggttgtctctctayctcaacttcaactttccaataagt

SEQ ID NO: 2622 - DNA, 50 bp, homo sapien
gtctgattttccaggctcttcttaaytatccaccatattcccctctaaaa

SEQ ID NO: 2623 - DNA, 50 bp, homo sapien
aagctcagcagataatacatgagaartgaccttacagatcattttgcaga

SEQ ID NO: 2624 - DNA, 50 bp, homo sapien
caaatgaaccaatcattcaaactggycacctaggtcaatcctgagtggcg

SEQ ID NO: 2625 - DNA, 50 bp, homo sapien
taaataagtagataacttaaaaaaawctctttgagcagaaagaatcattt

SEQ ID NO: 2626 - DNA, 50 bp, homo sapien
tcaagaagtaagacataataagtacmgctactgctcataaagagcatatt

SEQ ID NO: 2627 - DNA, 50 bp, homo sapien
taggagggagatagaacagtgctagragcagatacaggcctggtattggc

SEQ ID NO: 2628 - DNA, 50 bp, homo sapien
ctatgagtaagaccttgtttagtctraattaacttagaattggtatagat

SEQ ID NO: 2629 - DNA, 50 bp, homo sapien
ttttcttcaattattccctgaaataygtttcccagacttactgtgttctc

SEQ ID NO: 2630 - DNA, 50 bp, homo sapien
agtttattctcattttagaactcaargtgattaggcaaattacctaaact

SEQ ID NO: 2631 - DNA, 50 bp, homo sapien
aaatgtagaaatgcaggaaatttaayagtaaccaagactgacatcttctg

SEQ ID NO: 2632 - DNA, 50 bp, homo sapien
ttagaaacaacactcataatgccaaygctcatatacgggtgattaggggg

SEQ ID NO: 2633 - DNA, 50 bp, homo sapien
gggggttacatagtaaaggctcagamgacattgttgaactgaactgaaat

SEQ ID NO: 2634 - DNA, 50 bp, homo sapien
gtttttttttaaaattctgtctatartacaatgatccagtatacatacta

SEQ ID NO: 2635 - DNA, 50 bp, homo sapien
tgttccaattgatagaagcctagtargtactatatagctcaaaactgaaa

SEQ ID NO: 2636 - DNA, 50 bp, homo sapien
ctgatcaagaacttcctgtctttaaytattactataccttcacttccttt

SEQ ID NO: 2637 - DNA, 50 bp, homo sapien
gtccctgatagaccaaagctccataygtagaatgacaagagggtcacagc

SEQ ID NO: 2638 - DNA, 50 bp, homo sapien
cacccatctctggagccagaaaggasgttttcaaactttaggcccaattc

SEQ ID NO: 2639 - DNA, 50 bp, homo sapien
ccctctcatgacaatgagggtgacayactcactcagttttacttacaaga

SEQ ID NO: 2640 - DNA, 50 bp, homo sapien
tctctcttaactgaggtgaactggawcgaatgaggctgcccagagttgga

SEQ ID NO: 2641 - DNA, 50 bp, homo sapien
ttcttcattatggatctttctaagcygagaataacctgagtcttgtcagc

SEQ ID NO: 2642 - DNA, 50 bp, homo sapien
tgaggcaaagagcacatgttcactamgtccttgctgatattaaaggaact

SEQ ID NO: 2643 - DNA, 50 bp, homo sapien
caagcttgggttttgttgggcttgasagcttttgtttggcttatataaaa

SEQ ID NO: 2644 - DNA, 50 bp, homo sapien
gaaaaaatatccacagaaaaagagamcagtttcaaaacatgaaaggagag

SEQ ID NO: 2645 - DNA, 50 bp, homo sapien
acaattgttaacattgataatttgaytaaagctgaccttgaagataagct

SEQ ID NO: 2646 - DNA, 50 bp, homo sapien
atgaagaatgagaggtagtcaaggaycaagtcatgatgtacacgtggacc

SEQ ID NO: 2647 - DNA, 50 bp, homo sapien
gatgtatctaaagatctttctacgayaacccagtatgagcccatcagtca

SEQ ID NO: 2648 - DNA, 50 bp, homo sapien
cagtttcttacaacactaaacatacycttatcatacaatccagcaattgc

SEQ ID NO: 2649 - DNA, 50 bp, homo sapien
tatattatttcaacaaaggttttgaygctagccacatgtttggcagtcac

SEQ ID NO: 2650 - DNA, 50 bp, homo sapien
ttcaagatgcacagaagaatgattaytaagagtgctggtaaagaaaaatt

SEQ ID NO: 2651 - DNA, 50 bp, homo sapien
cagagggctggtggtctgagtgaagrataactgactgcaggcgtaggcga

SEQ ID NO: 2652 - DNA, 50 bp, homo sapien
atagcactacttggctatggtaagayagtaaatacgaatgcacattcaga

SEQ ID NO: 2653 - DNA, 50 bp, homo sapien
ttctgcccttcacatgatgaagtctyactttgacatttattaaatgggcc

SEQ ID NO: 2654 - DNA, 50 bp, homo sapien
ctgcctgtttactccaaatccacatraaactgattatacagtcaaaggcg

SEQ ID NO: 2655 - DNA, 50 bp, homo sapien
tattagaggcggtaaggaaatagaarggcctccacaaattgagaaaatac

SEQ ID NO: 2656 - DNA, 50 bp, homo sapien
tattggactagaatctggaaaaagasacaaattttcagtcagatccaagt

SEQ ID NO: 2657 - DNA, 50 bp, homo sapien
ttaagtttgtctgaatactatcatcmaagtttcagtataaaacaccaaaa

SEQ ID NO: 2658 - DNA, 50 bp, homo sapien
aaagatgtaaattataacatcaaaarcataaagtctgaaaaatattaaaa

SEQ ID NO: 2659 - DNA, 50 bp, homo sapien
ccatgtctccattcaaggagatgtcraccttattagggaatcagtatgtg

SEQ ID NO: 2660 - DNA, 50 bp, homo sapien
gtgtgggaccccagggcgatatacaygaccatgtctccattcaaggagat

SEQ ID NO: 2661 - DNA, 50 bp, homo sapien
tatttgcaaatcatataacatatacrggtctagtatctaggatatataaa

SEQ ID NO: 2662 - DNA, 50 bp, homo sapien
tgtacgaggcatactttaaactctakggcttttccgattataaaatgata

SEQ ID NO: 2663 - DNA, 50 bp, homo sapien
tgaatctgaaggttaatgagtccaaygagtccaagacgtttgtggaggaa

SEQ ID NO: 2664 - DNA, 50 bp, homo sapien
tgacaaaagctcataggttaaaacayactgtacatgacagtaattgaggc

SEQ ID NO: 2665 - DNA, 50 bp, homo sapien
ggtcccttaagataaataaggacaaragttttcaagtcatgaccagcaga

SEQ ID NO: 2666 - DNA, 50 bp, homo sapien
tcatgctatttaaggaagtagtaaasataataatgcataggcaagggtag

SEQ ID NO: 2667 - DNA, 50 bp, homo sapien
tggaagagacaaagtgacaagaacgyagaagttgaatgactcagagcccc

SEQ ID NO: 2668 - DNA, 50 bp, homo sapien
tatttctcctttgaagtgtgagtgasagatagtaatacaagtatgaggta

SEQ ID NO: 2669 - DNA, 50 bp, homo sapien
aaaacccttaaggtttagaacttcamgtaaacacacaaatagctttatgt

SEQ ID NO: 2670 - DNA, 50 bp, homo sapien
accagactacccatcctgttctgaaytccaacacaagaagcccaggacac

SEQ ID NO: 2671 - DNA, 50 bp, homo sapien
tattcttaaaacacctaaacacatcwcaactgttctaaaaatcattagcc

SEQ ID NO: 2672 - DNA, 50 bp, homo sapien
atgtcatgtccatctaatactcaaawctgcaaatgttaagtcttgtaagc

SEQ ID NO: 2673 - DNA, 50 bp, homo sapien
catagataagccttctatgaccaagmcacaaacattttgtgcaagatagg

SEQ ID NO: 2674 - DNA, 50 bp, homo sapien
caccaaattatccccttactaatagycaaagtgccctcctttttacccta

SEQ ID NO: 2675 - DNA, 50 bp, homo sapien
aagaaagtatccaaaaataacaacartgattatacatttggctccaaacg

SEQ ID NO: 2676 - DNA, 50 bp, homo sapien
atccaaggaaaaactactgtgctctwaataatgtatgtcaggaaaaatca

SEQ ID NO: 2677 - DNA, 50 bp, homo sapien
taagttaagagggctgtgattacaastgtctttaatgttattagccccaa

SEQ ID NO: 2678 - DNA, 50 bp, homo sapien
aacacatatatatttgtttttcatgrcactgtaaggtagcaaaaatcaat

SEQ ID NO: 2679 - DNA, 50 bp, homo sapien
aacaaacatataacaataccatttawaggatttagattgatttttgctac

SEQ ID NO: 2680 - DNA, 50 bp, homo sapien
agttgtagcactctagtttgcaaagmagttttaaccatcagagctcaaag

SEQ ID NO: 2681 - DNA, 50 bp, homo sapien
ttttctcatcttttcaaaagtaagargtacgtatgaagaaacagcgactt

SEQ ID NO: 2682 - DNA, 50 bp, homo sapien
tttgggaagccatagaaaattcataygttagaaagatcaattcaggcatg

SEQ ID NO: 2683 - DNA, 50 bp, homo sapien
ccctccacgttgcactaatgacatcraattatactttgtctctttgctta

SEQ ID NO: 2684 - DNA, 50 bp, homo sapien
ggtgtccctgagtctacaattctcaycatatagtctattttcaatcaata

SEQ ID NO: 2685 - DNA, 50 bp, homo sapien
aatagtgctagaggaagaactttcayggttgaatttgctgttgtccttga

SEQ ID NO: 2686 - DNA, 50 bp, homo sapien
ctctgtggtctcttctccttatagcrgccaattgatatttttaaaatgta

SEQ ID NO: 2687 - DNA, 50 bp, homo sapien
attctcctctcagggatatcaataartaagttagacatagtgcttagaga

SEQ ID NO: 2688 - DNA, 50 bp, homo sapien
gatttttgtcacagtggtttcgctamatttcagttatattaaacaagaga

SEQ ID NO: 2689 - DNA, 50 bp, homo sapien
ccacatggagtgagccacttgtctaratcatgggcaaaacttctcatagt

SEQ ID NO: 2690 - DNA, 50 bp, homo sapien
atattgtgtttggtatgataaacaayccctatgctttgtttctttcttgt

SEQ ID NO: 2691 - DNA, 50 bp, homo sapien
agcactctatctgaacttctcttccrgctataattacttctcccttctga

SEQ ID NO: 2692 - DNA, 50 bp, homo sapien
ttggtggaggcaagaactttgagaakaagtaacaggaaaaagaaagctct

SEQ ID NO: 2693 - DNA, 50 bp, homo sapien
ccaaagatgatataattagcaataargtcaataaaatctggatttttttc

SEQ ID NO: 2694 - DNA, 50 bp, homo sapien
accaacacagcctatatgagttcagrcaatatttagatgtggtatctcca

SEQ ID NO: 2695 - DNA, 50 bp, homo sapien
atatgagcgttactcaagtataaccragacatatgaagcagggggaacat

SEQ ID NO: 2696 - DNA, 50 bp, homo sapien
atcaagtacaaggaggactgttcagratggggacaaatatcagtaagtga

SEQ ID NO: 2697 - DNA, 50 bp, homo sapien
ctggaaggaaaaggtatgagaaccascatttatcaaatacctagtatacc

SEQ ID NO: 2698 - DNA, 50 bp, homo sapien
taccatctcaagtgaagaaagaggcragaaccagacttactttgctcaca

SEQ ID NO: 2699 - DNA, 50 bp, homo sapien
gggttgaaacaaactgctcacagaayggcagagttagaaagcttttccga

SEQ ID NO: 2700 - DNA, 50 bp, homo sapien
gcttaataggtataagagtcattcarggagtttgttaaattacaggtttt

SEQ ID NO: 2701 - DNA, 50 bp, homo sapien
tagctctcatgagcctgataatctgwattttaacaagtgcctaggtagtt

SEQ ID NO: 2702 - DNA, 50 bp, homo sapien
cctttaaaactgtctctacagttccraattctctctgctccagtttaaat

SEQ ID NO: 2703 - DNA, 50 bp, homo sapien
tgctgcctcaggagatgagttcaacygtgagatacttttcctggagctgc

SEQ ID NO: 2704 - DNA, 50 bp, homo sapien
tatgatggtgcttaactacctctagrccaaacgactcctctgggattgga

SEQ ID NO: 2705 - DNA, 50 bp, homo sapien
ctttctcaaattctcatacaccaagycaatacttccctgccttaaattac

SEQ ID NO: 2706 - DNA, 50 bp, homo sapien
agggtttcaaacctaggtctaatccraattgaatgcctctttccattttt

SEQ ID NO: 2707 - DNA, 50 bp, homo sapien
gtggcatacataatgtcaaatacaasagtcctaccatcagaggtcctcag

SEQ ID NO: 2708 - DNA, 50 bp, homo sapien
ctgcttctctcacaaggatgtccaawtcttagatagaaaacagggactgt

SEQ ID NO: 2709 - DNA, 50 bp, homo sapien
agcaattccaagaacatcactgctasattgagcaactatccatctttaaa

SEQ ID NO: 2710 - DNA, 50 bp, homo sapien
cctcatcagctggttattcttctacsgacagtgacttccttcccctctgc

SEQ ID NO: 2711 - DNA, 50 bp, homo sapien
cataaagaggaatgtttaaaaagacrccaaggacataagatcccattttt

SEQ ID NO: 2712 - DNA, 50 bp, homo sapien
gcttataaattcaacagggatgacaraaaccagccatcaccaataatatg

SEQ ID NO: 2713 - DNA, 50 bp, homo sapien
caccggcactagaatttcttgcagcwcttatgacatgcacagattgttga

SEQ ID NO: 2714 - DNA, 50 bp, homo sapien
catgatttccctctcatgctctaaaraaaagaatcagagtcagttgtact

SEQ ID NO: 2715 - DNA, 50 bp, homo sapien
ctgcacttttgcacagtctttaaaaygctttcaatttgcattaccttgtc

SEQ ID NO: 2716 - DNA, 50 bp, homo sapien
ctcaacttattaacctcactttaagraatttccctaagtgtagtagttaa

SEQ ID NO: 2717 - DNA, 50 bp, homo sapien
aaattttcagaagtggataataggartaataatgctttagggatgtagag

SEQ ID NO: 2718 - DNA, 50 bp, homo sapien
tccttattaaatatccaaacatacartatattcacataaatatagaaatg

SEQ ID NO: 2719 - DNA, 50 bp, homo sapien
tggatatttaataaggattgaatgcrctagttattacttacatgcttcca

SEQ ID NO: 2720 - DNA, 50 bp, homo sapien
tctatacagccaatatgggtatgtaygatactgcagataaacagcaataa

SEQ ID NO: 2721 - DNA, 50 bp, homo sapien
accaacgccttgccttcttggcctartaagttccaggtatagttgtgaag

SEQ ID NO: 2722 - DNA, 50 bp, homo sapien
tcacctttaacagataagaacactgraaactagaactacagtttggtttt

SEQ ID NO: 2723 - DNA, 50 bp, homo sapien
agctgagttcagtaaacactccccasacttcagctccttccaggctgtgg

SEQ ID NO: 2724 - DNA, 50 bp, homo sapien
gtgaggtaaaaatttaaaaaaaatasattccagattaggagttatgacta

SEQ ID NO: 2725 - DNA, 50 bp, homo sapien
acttatgacatgcacagattgttgasctttcttccaaaccacatctctgg

SEQ ID NO: 2726 - DNA, 50 bp, homo sapien
atggtttgaatacgtcgctttcaaarttcaagtggtgccaatatgacagt

SEQ ID NO: 2727 - DNA, 50 bp, homo sapien
aattttgaaagcgacgtattcaaacyataacagaaacccacattctattt

SEQ ID NO: 2728 - DNA, 50 bp, homo sapien
ctacctgtgagccatgtcagaccaayaccaagagagatcttctcagataa

SEQ ID NO: 2729 - DNA, 50 bp, homo sapien
ttgtgtgggttgccaaaaagttgcayggtcagtttgacaactgttattgc

SEQ ID NO: 2730 - DNA, 50 bp, homo sapien
ccttaaggggcctttcttgtgatgayacttttggcggctcgatttggtct

SEQ ID NO: 2731 - DNA, 50 bp, homo sapien
aaaaatttgctcttctagatttttcyaaaacattccaatgcttgacttaa

SEQ ID NO: 2732 - DNA, 50 bp, homo sapien
attttacaagagaactgagttttcargagactgacggtgtgaccaaaaga

SEQ ID NO: 2733 - DNA, 50 bp, homo sapien
tttaattctcgtagataccctgttgmaaaagttctgaaacattgtgagaa

SEQ ID NO: 2734 - DNA, 50 bp, homo sapien
ggtaaaagtcttaaatacatccacamgtgttagaagtagtgatcatcaga

SEQ ID NO: 2735 - DNA, 50 bp, homo sapien
ctgtaagacatgtggccatatgctcyactcttacgactgctagccaggat

SEQ ID NO: 2736 - DNA, 50 bp, homo sapien
gattcggcaacatggaaatcacagaygaacttagcaagagcagtttcaga

SEQ ID NO: 2737 - DNA, 50 bp, homo sapien
aagaaaaggagggaaatcgagacccrctgcattaattcaacaacaaatat

SEQ ID NO: 2738 - DNA, 50 bp, homo sapien
gtcctgtagccccttctcttgctcaygtaattatgtttctatgtctgtga

SEQ ID NO: 2739 - DNA, 50 bp, homo sapien
gccctgggtaacactgtaacctccarggtagattgaataggaaaaactta

SEQ ID NO: 2740 - DNA, 50 bp, homo sapien
ctgtaaacatagtgtaaagcaatgcraacgtgtatgtgaaatttggctcc

SEQ ID NO: 2741 - DNA, 50 bp, homo sapien
ctagtcaatatgccttaatctcacarcctaggtctggcttacctatggac

SEQ ID NO: 2742 - DNA, 50 bp, homo sapien
acattaaacagatgaacgtagaatcrattaattataccaataagtgctaa

SEQ ID NO: 2743 - DNA, 50 bp, homo sapien
taagaaaaacactagctatatgaaaygctaacttatttatgaaatacatg

SEQ ID NO: 2744 - DNA, 50 bp, homo sapien
gagaggggactggtttaaaatgacartctcaagttcatttagaaagagaa

SEQ ID NO: 2745 - DNA, 50 bp, homo sapien
taaagccatctcctattttgattcaytagcaacaggagcagctaaaatgt

SEQ ID NO: 2746 - DNA, 50 bp, homo sapien
gtatatgaagaagttagcaataacamgtatgtcctataccatatgtataa

SEQ ID NO: 2747 - DNA, 50 bp, homo sapien
atattcagttgactctgttagtatgyaatcaaagcggcatctcctgagcg

SEQ ID NO: 2748 - DNA, 50 bp, homo sapien
tgtctttgtcacatttgctcaccacrataaagacttaaatatatggaaag

SEQ ID NO: 2749 - DNA, 50 bp, homo sapien
ggctcttgatctgtcagtctgttctraacattggtataaaattaatgaat

SEQ ID NO: 2750 - DNA, 50 bp, homo sapien
ttgccacactctcagtgtcttacaamagaaatgtaactctcacacgtgtg

SEQ ID NO: 2751 - DNA, 50 bp, homo sapien
ataaaattagagcattcaagcaaaarttagaatgtagaaaaacttgtgtc

SEQ ID NO: 2752 - DNA, 50 bp, homo sapien
aagtaaggtccacttttgcacaaagyagagttaaaaatgtatgatattct

SEQ ID NO: 2753 - DNA, 50 bp, homo sapien
gctttcagcaaaggaactgtcttctyaaagtaaaccttgtcaaactcagc

SEQ ID NO: 2754 - DNA, 50 bp, homo sapien
atgggcagcaaaaaaattggagataygtcaccaaagatgatatgtaaatg

SEQ ID NO: 2755 - DNA, 50 bp, homo sapien
tcatcttccagtcaaggcccagctcrgaataaatttcagaagctttccct

SEQ ID NO: 2756 - DNA, 50 bp, homo sapien
ttcataagtcagcatgaagtttcgaytcacttctcaacaagtctttttga

SEQ ID NO: 2757 - DNA, 50 bp, homo sapien
ggagagtttctgacacctcaggatcyatttggcagttgggatttaagatt

SEQ ID NO: 2758 - DNA, 50 bp, homo sapien
ttgggataaaagctgtcagggttacmataaggaattagcatggtagattc

SEQ ID NO: 2759 - DNA, 50 bp, homo sapien
aatggaatattaatttcaaaattaargtaatctctgaataatcctttctg

SEQ ID NO: 2760 - DNA, 50 bp, homo sapien
gttctcatttttaaagatgattttarggtctctatttactagtgaccaga

SEQ ID NO: 2761 - DNA, 50 bp, homo sapien
ttttataatttaacggtagataaaaycatatgtaaaaagagctaaaaaaa

SEQ ID NO: 2762 - DNA, 50 bp, homo sapien
aaattacatacatcttgcattagacwattgataaatatcagtttccttca

SEQ ID NO: 2763 - DNA, 50 bp, homo sapien
ctttggaaagttatttgagcccatcrgaaaattacaatttcacaggcgtg

SEQ ID NO: 2764 - DNA, 50 bp, homo sapien
ggccttgtccttgagggtacacttayggtgactagagttaagtcttacta

SEQ ID NO: 2765 - DNA, 50 bp, homo sapien
aattttagcataattgttatggaaartgggtagaagaaatgggtatatat

SEQ ID NO: 2766 - DNA, 50 bp, homo sapien
caatttttaacatatattaatatcaytcactaaaacccaatgagaaaatt

SEQ ID NO: 2767 - DNA, 50 bp, homo sapien
aattgacttcatattcagaaattaaragaagctggaatctcaacaggatt

SEQ ID NO: 2768 - DNA, 50 bp, homo sapien
aaataatttaaattcagttagtaaargaaccacacaatctgaaaatataa

SEQ ID NO: 2769 - DNA, 50 bp, homo sapien
gggaataataaaataacagatttctracacttaggcatttcacaacttat

SEQ ID NO: 2770 - DNA, 50 bp, homo sapien
tcattgccctgattggttgcctgatraaacagttcagtcacaatggctga

SEQ ID NO: 2771 - DNA, 50 bp, homo sapien
aatggacaagttcagcaaatagataygttttgaagaatggtttaggaaat

SEQ ID NO: 2772 - DNA, 50 bp, homo sapien
ttgagcttcttgggagaaattattaygcaacactcttttgtaaatctttt

SEQ ID NO: 2773 - DNA, 50 bp, homo sapien
gaaaggttgactgagatgttccctawgactcattatctatgatttgtcta

SEQ ID NO: 2774 - DNA, 50 bp, homo sapien
gtttcctttaaacaatctgaggttgkattttctatcataactcaagatga

SEQ ID NO: 2775 - DNA, 50 bp, homo sapien
ggggcagaaggttgattccttgctgkattttttgggagaaaccctgagtg

SEQ ID NO: 2776 - DNA, 50 bp, homo sapien
attcaacatagaagaaatgtctcagraagtatcctaaataaacataatgc

SEQ ID NO: 2777 - DNA, 50 bp, homo sapien
agagtagaccaaacacttcctaaaayggctctgttatttgctctatggcg

SEQ ID NO: 2778 - DNA, 50 bp, homo sapien
taggtgaaatattaggcctttatccracatttattcacatacctttgaac

SEQ ID NO: 2779 - DNA, 50 bp, homo sapien
tagagatactataaaaataaaatgasgtaatatattcgtttgccagggct

SEQ ID NO: 2780 - DNA, 50 bp, homo sapien
aggtataaagataaaaagagtttgamgataaaacatttccaagtcttata

SEQ ID NO: 2781 - DNA, 50 bp, homo sapien
cataatttctctgattcagttctgayaataattagccaacagggtgagta

SEQ ID NO: 2782 - DNA, 32 bp, homo sapien
ggcctagataacatcartcacccaaggtgact

SEQ ID NO: 2783 - DNA, 50 bp, homo sapien
ttggccgaattgcctttgaaagtagyaggagtcagtctctcaggcattaa

SEQ ID NO: 2784 - DNA, 50 bp, homo sapien
tcatgtcctgcacaacctgctgctaycatataaaatgaaaatgagttttc

SEQ ID NO: 2785 - DNA, 50 bp, homo sapien
tcatcctgaatcataaatcagacaaygtgactctcttcctgtcctcaaga

SEQ ID NO: 2786 - DNA, 50 bp, homo sapien
aaatacattttatattgtaatgctcracaaacatttcacgaagtaatgct

SEQ ID NO: 2787 - DNA, 50 bp, homo sapien
aaattacataaaatcctgagaatatragaaaacattcccagtttcacact

SEQ ID NO: 2788 - DNA, 50 bp, homo sapien
tcaaatcaaaataaatccaggaaaayctaaggccaataagaccagtagaa

SEQ ID NO: 2789 - DNA, 50 bp, homo sapien
ttttaagaaggatgtactaaaaaacygttagtgtgaaactgggaatgttt

SEQ ID NO: 2790 - DNA, 50 bp, homo sapien
tgtaggaacaaataaaatataacaargatataaagtgtgaagaaattact

SEQ ID NO: 2791 - DNA, 50 bp, homo sapien
ttcaaggtgcaagtcagggttgagcwatgataacgtggataaaaagaaag

SEQ ID NO: 2792 - DNA, 50 bp, homo sapien
tattaagaatctgtagctgaaaacartgagatggcttaccaaggtcactg

SEQ ID NO: 2793 - DNA, 50 bp, homo sapien
tgaacctgttgcagttccctggtackgagcattataattctattaatctg

SEQ ID NO: 2794 - DNA, 50 bp, homo sapien
gagctgagctaaggaaagatacgtgratgcaaatctgaccctcattcaac

SEQ ID NO: 2795 - DNA, 50 bp, homo sapien
cctttcagtttaatttcactatagamgaccatctggaaaatgaattaaca

SEQ ID NO: 2796 - DNA, 50 bp, homo sapien
tttcttgaagaccaggcaataatcartgatcaagaagtcaatacatactg

SEQ ID NO: 2797 - DNA, 50 bp, homo sapien
gcagaaatagtgataataatgtgaawgatcccaggtaacatttattgagc

SEQ ID NO: 2798 - DNA, 50 bp, homo sapien
aagttaatgatcagtgacacacagakaattagagaaataaagacgatgta

SEQ ID NO: 2799 - DNA, 50 bp, homo sapien
taaaaatgctagtttataattaggaygatcttggcttgaacaataatgtt

SEQ ID NO: 2800 - DNA, 50 bp, homo sapien
cgtacaccagccaccagatcatggcrcttaaaaacttgtactattgtttt

SEQ ID NO: 2801 - DNA, 50 bp, homo sapien
aaaggtttacagagcttttatttacrctagagaagtagagacaagctttc

SEQ ID NO: 2802 - DNA, 50 bp, homo sapien
cccaaaatcatcttggatagcctaakcctttatgcattctcactgcttaa

SEQ ID NO: 2803 - DNA, 50 bp, homo sapien
gactcagcacaggtaaggagttcaaytggataaggccacttagtttttgt

SEQ ID NO: 2804 - DNA, 50 bp, homo sapien
cgtcgtaccaaagattttttaaaagyctactccaatagttttcatgtggt

SEQ ID NO: 2805 - DNA, 50 bp, homo sapien
ttgagaatgagactcaaaaataagcycttgctccaaagttatggtctagc

SEQ ID NO: 2806 - DNA, 50 bp, homo sapien
tgcagcctctatatgtatttttaaaygagcaaaacttggctaatattcag

SEQ ID NO: 2807 - DNA, 50 bp, homo sapien
tgcggctcatctcacttttacagacmgctatgacatgtggactgccacat

SEQ ID NO: 2808 - DNA, 50 bp, homo sapien
tgtggggatttctccgcacatacaamgaagcaattctgtagtagattgtc

SEQ ID NO: 2809 - DNA, 50 bp, homo sapien
ccattgccagccctcattctatttarcctcttagcaatatctggcactgt

SEQ ID NO: 2810 - DNA, 50 bp, homo sapien
tgtttgtttgtttgctatcctttgargagggagctttataacaaactcca

SEQ ID NO: 2811 - DNA, 50 bp, homo sapien
ttgagacaatttgtgaataacaaaakagacaaaagtggctactaaaaggc

SEQ ID NO: 2812 - DNA, 50 bp, homo sapien
aagaaagtgagacccagagagattayatgaattgtggaaagtcccacagc

SEQ ID NO: 2813 - DNA, 50 bp, homo sapien
taatcagaatttcattttcttcttaygtaccatcctcatgagtcacaatc

SEQ ID NO: 2814 - DNA, 50 bp, homo sapien
gttaaaacagaagtttcctggaaatsagtcaaagaaaggttggggaatgg

SEQ ID NO: 2815 - DNA, 50 bp, homo sapien
cttattcctatgtcattcctgaaaartccatgtgcttattatagattgta

SEQ ID NO: 2816 - DNA, 50 bp, homo sapien
acttcccaactctcctcatctttgargttgatccagtacagtctgcccct

SEQ ID NO: 2817 - DNA, 50 bp, homo sapien
ctaggtttgcaagttacgcaagtcaygttcggaaactcagaagtcttgtc

SEQ ID NO: 2818 - DNA, 50 bp, homo sapien
tgcctcttttctatttacctttatawccaatgatacttttttaaagcttt

SEQ ID NO: 2819 - DNA, 50 bp, homo sapien
tgcacggtgtcagaacggtaagaacrgttcaccatcttttctcaggatta

SEQ ID NO: 2820 - DNA, 50 bp, homo sapien
tatcctgaaatacatttttttccccrgcagtggctttcatatgttcaaaa

SEQ ID NO: 2821 - DNA, 50 bp, homo sapien
catatcttcacccttgaaaaagcccrcattctatcactgtgatgtatggt

SEQ ID NO: 2822 - DNA, 50 bp, homo sapien
ttaagtgttttattcattttagccartgattaacaagaaaaaatggtagc

SEQ ID NO: 2823 - DNA, 50 bp, homo sapien
gaacttgataaagaatccaggaaacrgcttcctcctcaatcttagcagta

SEQ ID NO: 2824 - DNA, 50 bp, homo sapien
ggaaggagtggagtaagcaacttggwattcgagagtgatttggtacctgt

SEQ ID NO: 2825 - DNA, 50 bp, homo sapien
ggagggaagaaaaagagaagtaaaaratgaagactttttgagtgtctgat

SEQ ID NO: 2826 - DNA, 50 bp, homo sapien
cgttatacaggaggtactaaaggacrcatcagttacaatccccaacatgc

SEQ ID NO: 2827 - DNA, 50 bp, homo sapien
aaaattaaactctaatttctaccacrgataaagcaggcttattcttccaa

SEQ ID NO: 2828 - DNA, 50 bp, homo sapien
atcctctagacagaaaacctgggaasagaacacattaaattctgctctgc

SEQ ID NO: 2829 - DNA, 50 bp, homo sapien
ctaaagcctcttgaatcaagtgcgakcataacaagacattatgcttgatg

SEQ ID NO: 2830 - DNA, 50 bp, homo sapien
tatggttaactacatgatatctgtayacttcttctccaaactaattgagt

SEQ ID NO: 2831 - DNA, 50 bp, homo sapien
attctttgttggaaaaaaatgataamgtgattagttaaaaggatatatat

SEQ ID NO: 2832 - DNA, 50 bp, homo sapien
gattgacttctttcaggatcattgayattggaggtatctggtcccttcag

SEQ ID NO: 2833 - DNA, 50 bp, homo sapien
agagagaaaaaaagcattttctttayggtttacaaagtgctttcatatga

SEQ ID NO: 2834 - DNA, 50 bp, homo sapien
agttcttactgtttggggatttcccrgagagaataatcgtgttcagaatg

SEQ ID NO: 2835 - DNA, 50 bp, homo sapien
aaacatatatcacatcactttcatarctttctctctctgttttcaatttc

SEQ ID NO: 2836 - DNA, 50 bp, homo sapien
tttgttcagattctgtactcatgaarctatctgattattaactaggtctc

SEQ ID NO: 2837 - DNA, 50 bp, homo sapien
caactgtctgatctccctattaaaastgtgactggttctcttgccaatac

SEQ ID NO: 2838 - DNA, 50 bp, homo sapien
caatctgttataattgctgtaaagargccatttaattttgtgcctgtttg

SEQ ID NO: 2839 - DNA, 50 bp, homo sapien
ttatcatttaaaccaaagatttagaytcattttctgccctcatattcatc

SEQ ID NO: 2840 - DNA, 50 bp, homo sapien
aatctctgatttgagcctgatttgasagtttgatcttttgtgttagctca

SEQ ID NO: 2841 - DNA, 50 bp, homo sapien
atcagaagggctgtcttaagccaaawccaccacggctaatccatgggaat

SEQ ID NO: 2842 - DNA, 50 bp, homo sapien
ggcactgaaaaacacctgaatgaggkaatgaaagaaggaataaggggatg

SEQ ID NO: 2843 - DNA, 50 bp, homo sapien
caggtatttaaaaacacacacaaaartatattactcacatatgtatctga

SEQ ID NO: 2844 - DNA, 50 bp, homo sapien
tttttgctaagagaaatattctgagycctgagatccaattcagttttatc

SEQ ID NO: 2845 - DNA, 50 bp, homo sapien
agtttagtcaagtaactggtttgaargtatacgagactgtgtacttagta

SEQ ID NO: 2846 - DNA, 50 bp, homo sapien
ttaaagtgggaacaagaacaggttgycaacaggagtaacttatttacttt

SEQ ID NO: 2847 - DNA, 50 bp, homo sapien
cacttcatatggcaccatttaaacarccatatcaccaagaaaaagcacaa

SEQ ID NO: 2848 - DNA, 50 bp, homo sapien
aaaaaggtagaattggaagggcaagkcataaactatacactatacctttt

SEQ ID NO: 2849 - DNA, 50 bp, homo sapien
cagggtagtgactgacagcataaaawatctctttgcctggctataatcta

SEQ ID NO: 2850 - DNA, 50 bp, homo sapien
tttgttcaaatgctagactagcccartgatgaactttggaatgcctagat

SEQ ID NO: 2851 - DNA, 50 bp, homo sapien
ttttggacttgatatgaaaggcttgsataattaccctgattttgaataaa

SEQ ID NO: 2852 - DNA, 50 bp, homo sapien
gtttttaacttttaacaatgacttaragtagtttgaaagtgaaatgaaaa

SEQ ID NO: 2853 - DNA, 50 bp, homo sapien
ggttgcaaaagtctaatgacatgaarcaacagctggccttgtaattccta

SEQ ID NO: 2854 - DNA, 50 bp, homo sapien
aaatgcctaacttgtaagattgccaygacaagtcagtaagatgctttgca

SEQ ID NO: 2855 - DNA, 50 bp, homo sapien
gaatagcttctcatcacatttctaaragggagatcatcataattacaacc

SEQ ID NO: 2856 - DNA, 50 bp, homo sapien
tgtaacatgggtgacctttgctccayggctgataacctccttatttctat

SEQ ID NO: 2857 - DNA, 50 bp, homo sapien
caataaatgctatttaagctcaagawcccccacttgtaggtcagagagga

SEQ ID NO: 2858 - DNA, 50 bp, homo sapien
caagtaaccctgtcctcacatcaagmagttatactagaaatcacagatct

SEQ ID NO: 2859 - DNA, 50 bp, homo sapien
ataacatatttgcacaggcagagtamacggaaaagaggtaacaaaatctg

SEQ ID NO: 2860 - DNA, 50 bp, homo sapien
tgaataataatagcagaagtcaccaygtaagataagtcagtaatgggcca

SEQ ID NO: 2861 - DNA, 50 bp, homo sapien
tatagaagcatattaaaatttctcastcagacacggtagctcatgcctgt

SEQ ID NO: 2862 - DNA, 50 bp, homo sapien
cccatccttcaagtcgtggtttcaamcctatctcttctgtcaaagcttcc

SEQ ID NO: 2863 - DNA, 50 bp, homo sapien
gctgagattatgcacctcattttackcacaaggaaactaaagccaaagaa

SEQ ID NO: 2864 - DNA, 50 bp, homo sapien
aacacaaatcagtcggaaaaatgagyctatgcagagggcaggatgaagca

SEQ ID NO: 2865 - DNA, 50 bp, homo sapien
cttatataatcctttaacttttcaamgcacgttcataccaattattttct

SEQ ID NO: 2866 - DNA, 50 bp, homo sapien
gctatttgtgacagtatttagctccratttggatatgttcaattcctttg

SEQ ID NO: 2867 - DNA, 50 bp, homo sapien
agaagttctccctggccagctttacraggaacctggtggcatttgatttc

SEQ ID NO: 2868 - DNA, 50 bp, homo sapien
acaaaaaatgtttgtggttatgcctkaatttactacaacgtatttttgag

SEQ ID NO: 2869 - DNA, 50 bp, homo sapien
aggttcttgaatgcgactatttggckgaaaactctagattattcttggaa

SEQ ID NO: 2870 - DNA, 50 bp, homo sapien
gacagaaaagggtttgaataaataaygccacactcccttgggttcgcata

SEQ ID NO: 2871 - DNA, 50 bp, homo sapien
acaatagtatgtttgcctaagtggasgtcttttacagtcaaccactatgc

SEQ ID NO: 2872 - DNA, 50 bp, homo sapien
gaaagcaagatgtgcaaatgcccaargctgtcaaacacttgtttctttta

SEQ ID NO: 2873 - DNA, 50 bp, homo sapien
aggaagaatctggaaagactagtcayaattctacaacacaatcttcctca

SEQ ID NO: 2874 - DNA, 50 bp, homo sapien
actcctcacaatgaccctaagagcaytatttgattacgtgattttgcaag

SEQ ID NO: 2875 - DNA, 50 bp, homo sapien
aatgaatagcgctactttcataaaaycaatttcgtcatgccaatattaaa

SEQ ID NO: 2876 - DNA, 50 bp, homo sapien
attgtaggaactcagtgaatatttcraataaatgaatgaatagcgctact

SEQ ID NO: 2877 - DNA, 50 bp, homo sapien
taatgcatgtgaaagtatcttgcacraagcctggcacataccagacataa

SEQ ID NO: 2878 - DNA, 50 bp, homo sapien
acccaaataaaccagaaattggtaartcatcacatggaaatcaaatcagt

SEQ ID NO: 2879 - DNA, 50 bp, homo sapien
aaactgctcacctctgttggagagakaaattctttcaagtggcaaagatt

SEQ ID NO: 2880 - DNA, 50 bp, homo sapien
tccatcataatgactgagaaaaatcyaaccgatgatgactcaacaacatt

SEQ ID NO: 2881 - DNA, 50 bp, homo sapien
tttaaagaagaaactttaacaccaartagagtaaaaggacctaatctcag

SEQ ID NO: 2882 - DNA, 50 bp, homo sapien
caagaatgcttattatggcgaaaagracttgaaatgtaattttcagtcct

SEQ ID NO: 2883 - DNA, 50 bp, homo sapien
aatacactgcaataccatttaaggaytacagatgatttatgaaaactgcc

SEQ ID NO: 2884 - DNA, 50 bp, homo sapien
ttaggaaaataaggttaaccactgtsaaataatataccagaactcttagg

SEQ ID NO: 2885 - DNA, 50 bp, homo sapien
aggtgggatgtgaatgtgtcattaayaggcaagcaagcctgacagccagt

SEQ ID NO: 2886 - DNA, 50 bp, homo sapien
tctctgaggtacagggagtcagagcrctgatatgataactttgttagtct

SEQ ID NO: 2887 - DNA, 50 bp, homo sapien
attatagtttggggataagacagagmagaaataaccgaataagagctgag

SEQ ID NO: 2888 - DNA, 50 bp, homo sapien
ttaggagctaaactgtcagtccaaarcacttatactaccaagtcttgcag

SEQ ID NO: 2889 - DNA, 50 bp, homo sapien
attcctgaatggtaatctgaccaaawcactaaacaactcctgtggttaaa

SEQ ID NO: 2890 - DNA, 50 bp, homo sapien
tatcttctatgtttacctcttgtaayggagacagtcattcaacattgcac

SEQ ID NO: 2891 - DNA, 50 bp, homo sapien
tgaagtgttagaagccagttagttamggagaaatttcttcatccagggta

SEQ ID NO: 2892 - DNA, 50 bp, homo sapien
cttaaggaatgttccaactttttgargtgccctgatgaagtaagggtggc

SEQ ID NO: 2893 - DNA, 50 bp, homo sapien
gtttgtaaaacagtgttaatagcaaycatcctgtagagttgtggtgagga

SEQ ID NO: 2894 - DNA, 50 bp, homo sapien
gtgcttaattaccaacacagattaaraaacccacttaagtttgccttctt

SEQ ID NO: 2895 - DNA, 50 bp, homo sapien
agaacaggtaatacctaatctaaacygggagaataactactgttcaatcc

SEQ ID NO: 2896 - DNA, 50 bp, homo sapien
tgctcatcagaagcataatggaaacyctattgtcactcagggctaatgtg

SEQ ID NO: 2897 - DNA, 50 bp, homo sapien
aaactctattgtcactcagggctaaygtggtggccttttcttacagagag

SEQ ID NO: 2898 - DNA, 50 bp, homo sapien
accacttgtcaatattattattctaygtgcagtctggcagtacacgttca

SEQ ID NO: 2899 - DNA, 50 bp, homo sapien
agaaaagaaagtgaggttgattaagkatgggagtaggatggtgaagatga

SEQ ID NO: 2900 - DNA, 50 bp, homo sapien
tcaagtcagtagtaaagaaagttagsaattagaagacgttttattcttta

SEQ ID NO: 2901 - DNA, 50 bp, homo sapien
gttccgcaaatctcgtggcatctctyaagtcagtagtaaagaaagttagg

SEQ ID NO: 2902 - DNA, 50 bp, homo sapien
tgtggcattggtaaaggaataaatasactaatgaaacagaatagaggacc

SEQ ID NO: 2903 - DNA, 50 bp, homo sapien
tgctagaggaaataagattaaaggargcatttcaagtgaccagaacttcc

SEQ ID NO: 2904 - DNA, 50 bp, homo sapien
agtgtccttcttagcaatccatttaycatccttttttttctctctgtaat

SEQ ID NO: 2905 - DNA, 50 bp, homo sapien
aaagagaaaccagaagtataatccakgatgtggtacaaattaagagtctc

SEQ ID NO: 2906 - DNA, 50 bp, homo sapien
aaggaagcatgaaggaaaataaacaygagaaggaaacatgaaggaaaata

SEQ ID NO: 2907 - DNA, 50 bp, homo sapien
ctcatctttaaaagtcactagaagawcaggggcattcctttcagcactag

SEQ ID NO: 2908 - DNA, 50 bp, homo sapien
caatatgccttatcttctaaactatraattccttgaaaactatggtattt

SEQ ID NO: 2909 - DNA, 50 bp, homo sapien
tttaaaaataaactcaattaaagcawtcctctggtttcctaaccattctc

SEQ ID NO: 2910 - DNA, 50 bp, homo sapien
gagagtgattcaacacggatttacayataacagctcttctgactggtcct

SEQ ID NO: 2911 - DNA, 50 bp, homo sapien
tggtactcttatcagggcatttcaasgctgacattagctgtgattctggc

SEQ ID NO: 2912 - DNA, 50 bp, homo sapien
tgtctaggttctgattaaccaaaaartctggagaaagaactaaaatgcca

SEQ ID NO: 2913 - DNA, 50 bp, homo sapien
ctgctactacagatcactaaagaccmaactgtctaggttctgattaacca

SEQ ID NO: 2914 - DNA, 50 bp, homo sapien
cctagccagaactgtgactctcacaratttatttttacctgcagccaaag

SEQ ID NO: 2915 - DNA, 50 bp, homo sapien
ttcttatctttctggctagaatgtayagtaaaatgttgagtagaagtgtc

SEQ ID NO: 2916 - DNA, 50 bp, homo sapien
gaaatctgttatggctgttaataackctcctaaagtgaatggctctttca

SEQ ID NO: 2917 - DNA, 50 bp, homo sapien
agtcattttataatgacaaaatctgwaaatacaccaaactgttatatgca

SEQ ID NO: 2918 - DNA, 50 bp, homo sapien
tgaagacagcttacagaatttatgasacaacatcaaaagaacaaatgttg

SEQ ID NO: 2919 - DNA, 50 bp, homo sapien
atcatttgacaccaagataagattasaatacagtttttcctcaatatgga

SEQ ID NO: 2920 - DNA, 50 bp, homo sapien
aacattttcacttgtgccaaatgaaygtaatgtacataatagtcgaggga

SEQ ID NO: 2921 - DNA, 50 bp, homo sapien
tcctgatcactaagccaatccaaacyaaggcgaaaggtgaacaattgtca

SEQ ID NO: 2922 - DNA, 50 bp, homo sapien
ttatataatagctaacattgataaawtagtatgcattatttcaaaacctc

SEQ ID NO: 2923 - DNA, 50 bp, homo sapien
tggaacacagatcactgtactgtgaygggtgaatggtctggtatgtcagt

SEQ ID NO: 2924 - DNA, 50 bp, homo sapien
catttcactgccactcaggaggagastacaaaagctatagagacaataac

SEQ ID NO: 2925 - DNA, 50 bp, homo sapien
ttcagtgactgatttgtaaagggaawcacttgcccataaccaagcccagt

SEQ ID NO: 2926 - DNA, 50 bp, homo sapien
gagattggggttttttgactgtgagracatccttctgtctgagaggagat

SEQ ID NO: 2927 - DNA, 50 bp, homo sapien
aaataaagcctctttataaatttgamtagtttgatgtttctactacttgc

SEQ ID NO: 2928 - DNA, 50 bp, homo sapien
acgtgggggaaggcacctcagctgaygtcttagtggatagcgtgtattag

SEQ ID NO: 2929 - DNA, 50 bp, homo sapien
ttttaagcccaattatcaattatcartaaacccaagtatttccattaatt

SEQ ID NO: 2930 - DNA, 50 bp, homo sapien
tatgcatttggagataatggaatgayggtatccttttcaatgcaacccag

SEQ ID NO: 2931 - DNA, 50 bp, homo sapien
gagtgtgtcagatgggacatttcagragaaaaggtgctgaagtttgactc

SEQ ID NO: 2932 - DNA, 50 bp, homo sapien
cgcaggaacaccaccaaaatagtaasagcttaacagaacaaaggctaact

SEQ ID NO: 2933 - DNA, 50 bp, homo sapien
ttctttcacaggctctgtgatggtcrattctggatttcttgggtctaaaa

SEQ ID NO: 2934 - DNA, 50 bp, homo sapien
ttttcgtgcttcaaagtattccatckataaaatgaaaatagcagtaggat

SEQ ID NO: 2935 - DNA, 50 bp, homo sapien
atcaaaaagaagccacaaggtagatsaaaagcataaaacatatccccttt

SEQ ID NO: 2936 - DNA, 50 bp, homo sapien
atattaacatcataagaagatactaygaacaaccaatgaatataaaaaat

SEQ ID NO: 2937 - DNA, 50 bp, homo sapien
aagttttctagcatgtgccagtctarcctactttggaatattatcagcag

SEQ ID NO: 2938 - DNA, 50 bp, homo sapien
atgaagttaatatggtccaggaatayagttttttgaagagccaacaagag

SEQ ID NO: 2939 - DNA, 50 bp, homo sapien
ctaggataattagcaaatattatagraattcagtcattgaaggcacccac

SEQ ID NO: 2940 - DNA, 50 bp, homo sapien
ttctggcatcatatcagcaggctcgrcccatcagtttctttcacctgagc

SEQ ID NO: 2941 - DNA, 50 bp, homo sapien
gagcaactcaaattaggaagaactgragcccgcaatgagtagagcatttc

SEQ ID NO: 2942 - DNA, 50 bp, homo sapien
tgcgactactcatgatttactgcaayggttatcaaatatgttgctttcgc

SEQ ID NO: 2943 - DNA, 50 bp, homo sapien
ctggtagctgagtttactaagcaaaygtactttagataatgaaatattac

SEQ ID NO: 2944 - DNA, 50 bp, homo sapien
tcattttggtcatcttctgagactaytaactaatcatttaagacttactt

SEQ ID NO: 2945 - DNA, 50 bp, homo sapien
tgagagtcatttcaaccagagcttayggtcaaatctgtctacagcatctg

SEQ ID NO: 2946 - DNA, 50 bp, homo sapien
tatctggaggcatttttggttgtcayacttgaaagaagggagctactggc

SEQ ID NO: 2947 - DNA, 50 bp, homo sapien
aaaacaactcctccctagtgacttaycatagttcctgaaattccatcatt

SEQ ID NO: 2948 - DNA, 50 bp, homo sapien
agggaagtgtctctgagctcctcaarctatgttaaaactagagcttccca

SEQ ID NO: 2949 - DNA, 50 bp, homo sapien
aaattgttaaattgaattttctggamtcatagaaataaagctttagtttc

SEQ ID NO: 2950 - DNA, 50 bp, homo sapien
gtccatctacttgttagcacacttaycagattaaagtgaatattatgaac

SEQ ID NO: 2951 - DNA, 50 bp, homo sapien
tttcaaatatagacaatacaaacatmataaatggaaggaaaggttcatct

SEQ ID NO: 2952 - DNA, 50 bp, homo sapien
ctcccacagccaggccctctccagaygcctttactcctatgtttctattc

SEQ ID NO: 2953 - DNA, 50 bp, homo sapien
acataacaggtctttgtgttaacagraagtatactagataaaatgcacag

SEQ ID NO: 2954 - DNA, 50 bp, homo sapien
atctacacagctgctttcaaatgagwctaaaagcattatacagcataact

SEQ ID NO: 2955 - DNA, 50 bp, homo sapien
tttccttaaaggaaaatccacgggascataatctgtgtgtggctttatca

SEQ ID NO: 2956 - DNA, 50 bp, homo sapien
tagactttgacatatctctaattacygcttcgtttcagactaatggtaaa

SEQ ID NO: 2957 - DNA, 50 bp, homo sapien
tattattgttttgtgcaataaaaaasggccacacctgtttgaaaagttcc

SEQ ID NO: 2958 - DNA, 50 bp, homo sapien
aggagaagagcattccacgctgaagraagaggaaattcaaaattctcagg

SEQ ID NO: 2959 - DNA, 50 bp, homo sapien
attgtggcggtagttcccagatgtcygaaaagatgaagttatcagtgcac

SEQ ID NO: 2960 - DNA, 50 bp, homo sapien
ggctgcaaaacgggagaaagtagtayggtacttcaaaacctgtctgcagt

SEQ ID NO: 2961 - DNA, 50 bp, homo sapien
tttttaaaaagatccttctggatgcygcacaaagaatggaatttaatggg

SEQ ID NO: 2962 - DNA, 50 bp, homo sapien
aattggatgggcttaagatggggaamcttgtgttacgctgacccctgaac

SEQ ID NO: 2963 - DNA, 50 bp, homo sapien
acacttatcaagccaaatagatatakcctttcaacttaatacccttccgt

SEQ ID NO: 2964 - DNA, 50 bp, homo sapien
tgtttaggtaaatatattcttacagrcaaacaaaccgagttatctgcttg

SEQ ID NO: 2965 - DNA, 50 bp, homo sapien
aatagctgatagattagtaactccayggtcctgatattcaatattgcagc

SEQ ID NO: 2966 - DNA, 50 bp, homo sapien
cagtccagatgagaactcacagaccraatgaaaactttcaaaagcaagca

SEQ ID NO: 2967 - DNA, 50 bp, homo sapien
tcacttaatgaattggagacaatttwaaatcattttgaacatcaattatc

SEQ ID NO: 2968 - DNA, 50 bp, homo sapien
tcatttgtttgtcataataagctaaygtagaaatgttgtaggttaaccat

SEQ ID NO: 2969 - DNA, 50 bp, homo sapien
ttgtatggatcatgttggaaataaasactatgaatcaagtgggactttgg

SEQ ID NO: 2970 - DNA, 50 bp, homo sapien
ggggagaaaagtagggattacagcartagctagggctcaggttttgtcag

SEQ ID NO: 2971 - DNA, 50 bp, homo sapien
tcatttttaatataatgggagtatarcattcactcttcagatatatagta

SEQ ID NO: 2972 - DNA, 50 bp, homo sapien
tctgcctcatttgtgatctctactaygaagctctcatcaactaataacaa

SEQ ID NO: 2973 - DNA, 50 bp, homo sapien
acctggaacctggagccatgtttggmaatcccttcatacctcttctcaag

SEQ ID NO: 2974 - DNA, 50 bp, homo sapien
taagtgcttaataaacacgtgttaartggctgaatagatgaatacatatc

SEQ ID NO: 2975 - DNA, 50 bp, homo sapien
cccaaccaaactaggcacctggctayccccagaattaaatcttgaaactc

SEQ ID NO: 2976 - DNA, 50 bp, homo sapien
tcaattccaagcctatctgctctcckcaatcagtatattcctcctgcaat

SEQ ID NO: 2977 - DNA, 50 bp, homo sapien
ttttttaaaccaatgtttaagtccartctaacctacttaactattaacag

SEQ ID NO: 2978 - DNA, 50 bp, homo sapien
cccttctgtgagcctaaaaaagtgawaacaaccagaacattttaagctta

SEQ ID NO: 2979 - DNA, 50 bp, homo sapien
agcttaaccagtatcgtttaaaatasagaagcagagtgactcagacacct

SEQ ID NO: 2980 - DNA, 50 bp, homo sapien
tttttcattatcactgctttctgtaraatttttgtcttttgtcacaggat

SEQ ID NO: 2981 - DNA, 50 bp, homo sapien
ctatagtatacaatacgaccagagayatttcctttaatctagttcctgtg

SEQ ID NO: 2982 - DNA, 50 bp, homo sapien
gaaggtccagataaataatgtgagtyaccccaatttattaccaatcatcc

SEQ ID NO: 2983 - DNA, 50 bp, homo sapien
tcatattcttccaggattatcttaamcactgggagtatattcagatgtac

SEQ ID NO: 2984 - DNA, 50 bp, homo sapien
tctcaataaagctgttctctccttawaattgcatatgaaatgtctcttca

SEQ ID NO: 2985 - DNA, 50 bp, homo sapien
taaaaagcaaactttgggctccttcraatgctaatataaattcagtaact

SEQ ID NO: 2986 - DNA, 50 bp, homo sapien
aaatgattgcactgattttgaactaygcaactaggagataagagtcacca

SEQ ID NO: 2987 - DNA, 50 bp, homo sapien
gttttgttttgtgatttattctaacrgtctctatttttaaattggattta

SEQ ID NO: 2988 - DNA, 50 bp, homo sapien
gggtattaagggattataaggtctaygcaataaagaactaggtctgttta

SEQ ID NO: 2989 - DNA, 50 bp, homo sapien
gagggcaaatgggataaaaccaataygttcaagcatttttattgcccagt

SEQ ID NO: 2990 - DNA, 50 bp, homo sapien
tttgatgtaaaagagttaatggcaayctaaatttttcttagtggtgcatt

SEQ ID NO: 2991 - DNA, 50 bp, homo sapien
cagcctcaacctcagctccacttccrgcaaccttaactccagttccagcc

SEQ ID NO: 2992 - DNA, 50 bp, homo sapien
ataatgttcccataagtttgtactcrgagaaatgtgcacttatcaaactg

SEQ ID NO: 2993 - DNA, 50 bp, homo sapien
tattatctcttttctctactaaaaaytgtcctttgttagcaaacaccatg

SEQ ID NO: 2994 - DNA, 50 bp, homo sapien
aattcatgagtaaatgttcccattasctgcaataaaagaagcttgtgcct

SEQ ID NO: 2995 - DNA, 50 bp, homo sapien
aaaaaaaaaaagcatttatattgagyctattgcagttataatttaaaagg

SEQ ID NO: 2996 - DNA, 50 bp, homo sapien
tatcacaaataagcatttcagtacartgattagaaataaccttctttgat

SEQ ID NO: 2997 - DNA, 50 bp, homo sapien
catttctgtgacaaatatgtggtaaygacctgctgacaagagtagccctg

SEQ ID NO: 2998 - DNA, 50 bp, homo sapien
caaagtagtgaaaagcagtgacctargaatatgttcaatacctgcttcag

SEQ ID NO: 2999 - DNA, 50 bp, homo sapien
tcatatgtggagttcatttaagccamagtctataaagaatgtttaagacc

SEQ ID NO: 3000 - DNA, 50 bp, homo sapien
ctctatagctcttatacctactatayggtctgtcgcttagtagattctca

SEQ ID NO: 3001 - DNA, 50 bp, homo sapien
taggaatagtactcgagcagagttgyacccccattgtttcttttcatagc

SEQ ID NO: 3002 - DNA, 50 bp, homo sapien
ctgacagaaaaaacgggggtaacatsagttaaggaccagtcaggatggcc

SEQ ID NO: 3003 - DNA, 50 bp, homo sapien
tattaaactgctcaaagaagtgagarataacaaaaacaaatgaaaaattg

SEQ ID NO: 3004 - DNA, 50 bp, homo sapien
aattttaaagatgatagctgctttcraattaaggaatgtattcaaagtct

SEQ ID NO: 3005 - DNA, 50 bp, homo sapien
gtatttggtcttctgagactcttccraatgagggaaaatggctaaacaag

SEQ ID NO: 3006 - DNA, 50 bp, homo sapien
taggcttagaaattgttacaccttakcccatgttactggcaggcaatgta

SEQ ID NO: 3007 - DNA, 50 bp, homo sapien
tcattggctttgaagtggtttattasagatatgtcttctccttctcttcc

SEQ ID NO: 3008 - DNA, 50 bp, homo sapien
ctcccagctcacatatcatgtgttcmatccaatgtttcccagtctcctga

SEQ ID NO: 3009 - DNA, 50 bp, homo sapien
actttaaaaatattacttatcaaaasctgggtgaaaggataatagctgac

SEQ ID NO: 3010 - DNA, 50 bp, homo sapien
ttcccacggaagacggagcatcgagycgtcaatgccttttggtaaacaag

SEQ ID NO: 3011 - DNA, 50 bp, homo sapien
gatggccgcctaagccatctttggcygaacattatgtcttcacacaacta

SEQ ID NO: 3012 - DNA, 50 bp, homo sapien
tcttgtttgtaaatatttgttcatckcttggtatgtgccatgttacctaa

SEQ ID NO: 3013 - DNA, 50 bp, homo sapien
acctcttacaggtcgtacctttcaayactgtcacattgcggattaagttt

SEQ ID NO: 3014 - DNA, 50 bp, homo sapien
gcagaaacaagttattttttaaggaygattatagaaactatgtttcagaa

SEQ ID NO: 3015 - DNA, 50 bp, homo sapien
cactggaaagcttaggagcacctaaygtggacgcatggccaagtacacta

SEQ ID NO: 3016 - DNA, 50 bp, homo sapien
tgagcaacagtgaagctgccataaakatttctcaactgaggttcttggga

SEQ ID NO: 3017 - DNA, 50 bp, homo sapien
tgtgttacccttagactatctaaaaytaatgtcagtatgaagggtacctg

SEQ ID NO: 3018 - DNA, 50 bp, homo sapien
atatatttaaaactttatcttgaccwcttgatttagagtaatggaaattg

SEQ ID NO: 3019 - DNA, 50 bp, homo sapien
caatatcttataactattccaagtaygataataatacaatcaatttatat

SEQ ID NO: 3020 - DNA, 50 bp, homo sapien
ctgtttcactatttatctactctgcrattgatcttgaactatttaatgat

SEQ ID NO: 3021 - DNA, 50 bp, homo sapien
gagaggaactcttgtcttaatccccratacatcagtgtagtttgaagcac

SEQ ID NO: 3022 - DNA, 50 bp, homo sapien
tatggatcaggtaatcaatggatacygcacaaaagaatgcttaacatagg

SEQ ID NO: 3023 - DNA, 50 bp, homo sapien
gagagaaagctgaacaagactgggaratgtaatgactgtcacaccatatg

SEQ ID NO: 3024 - DNA, 50 bp, homo sapien
tgttacaaatagtaccttgcatacamattatcacaaaacgtgaaaaatta

SEQ ID NO: 3025 - DNA, 50 bp, homo sapien
tattcatttcttttggcccttagaaktacacataactgaaactgaagtta

SEQ ID NO: 3026 - DNA, 50 bp, homo sapien
agtatgtgcccagcattgtaatagtsactatattttgtacatcatttaaa

SEQ ID NO: 3027 - DNA, 50 bp, homo sapien
gcagacaaataaatatatccacgtasagagatacataaatgtatgtagat

SEQ ID NO: 3028 - DNA, 50 bp, homo sapien
tagtgacacaggagacatccaagaaytgaccttttgatgtcagtcatact

SEQ ID NO: 3029 - DNA, 50 bp, homo sapien
aatctgaacatttaatatcaacatcwccacctaatttggagctaaaaata

SEQ ID NO: 3030 - DNA, 50 bp, homo sapien
tttaggctagttgggaaagcataacmatctacaattatttgaagctataa

SEQ ID NO: 3031 - DNA, 50 bp, homo sapien
atgggtcacacttactaattactaakttactctcttaaaaaagcatcttc

SEQ ID NO: 3032 - DNA, 50 bp, homo sapien
ttcaaatatgctatgacttcccttaygtactccaatatttacaacattta

SEQ ID NO: 3033 - DNA, 50 bp, homo sapien
ccataggctggagaaacttcatacarcatatagctttagactctctattc

SEQ ID NO: 3034 - DNA, 50 bp, homo sapien
ctgcttggactatgatagatgctggmaatggaggatcctgagggaaaaag

SEQ ID NO: 3035 - DNA, 50 bp, homo sapien
tccatgaataacttgggcaaatcacrgtcaaatttaagcaagcatacaag

SEQ ID NO: 3036 - DNA, 50 bp, homo sapien
acaaagaaaaatcgggaaatgtctaratagtgagatagccttcatatgaa

SEQ ID NO: 3037 - DNA, 50 bp, homo sapien
ttgacttaaaatccagaatgaaaacmaatccttttccaggaacctacata

SEQ ID NO: 3038 - DNA, 50 bp, homo sapien
ctggcacatactaactgctcattaawcattagctatgtggattcacctta

SEQ ID NO: 3039 - DNA, 50 bp, homo sapien
aatgatttaagcaggaaatgatccawgactgaagggagaggcagacaaat

SEQ ID NO: 3040 - DNA, 50 bp, homo sapien
acaaaagagttttcatattcttagawccatatcagagagccactgagaga

SEQ ID NO: 3041 - DNA, 50 bp, homo sapien
caatgaaataagccacagccaactasaagttatgagaatgcattagatgc

SEQ ID NO: 3042 - DNA, 50 bp, homo sapien
tgagctaaggcaattctcctccccgkcacggaactgtcccttaagtggca

SEQ ID NO: 3043 - DNA, 50 bp, homo sapien
acttttgaactgcttctctgactcaraaaattgatcatctatcagttcaa

SEQ ID NO: 3044 - DNA, 50 bp, homo sapien
attgcagtaaaacactgaaagagttmaaaaaataccaccccaaaatatga

SEQ ID NO: 3045 - DNA, 50 bp, homo sapien
tgtctaatctatagtgaaggattgargcattttttcctgttatttctaag

SEQ ID NO: 3046 - DNA, 50 bp, homo sapien
gttggctatttacatgggtagtgcayatttaatatagtccccatcattat

SEQ ID NO: 3047 - DNA, 50 bp, homo sapien
ctgcacatttcaagcacttaatccaygtgaaataatgatacttcaccctc

SEQ ID NO: 3048 - DNA, 50 bp, homo sapien
actatatgcacaaagtgtgtaaagargcaaatgagaggatctctgcactc

SEQ ID NO: 3049 - DNA, 50 bp, homo sapien
tctgcaatctttaacacttccagaaratatagtcatcatttccacattat

SEQ ID NO: 3050 - DNA, 50 bp, homo sapien
cagacccttcggctttctcgtaacamtatgacaaggttcacaacactggg

SEQ ID NO: 3051 - DNA, 50 bp, homo sapien
gtatcagtgacatttttcagcaccartggtaagaatgatgtcatatttta

SEQ ID NO: 3052 - DNA, 50 bp, homo sapien
atgtcatgctttttaagaagttaaartgtactaaattaagatcttgaatt

SEQ ID NO: 3053 - DNA, 50 bp, homo sapien
cctttaagatttcccttctgttaaargtattttcttaatgttcacttaaa

SEQ ID NO: 3054 - DNA, 50 bp, homo sapien
gctacttctgtgtctgcagtgtctcygactaagcagctcaaaacatgctc

SEQ ID NO: 3055 - DNA, 50 bp, homo sapien
gcatatagtacatgctcaataaatascagttctaagactcccaagtctgg

SEQ ID NO: 3056 - DNA, 50 bp, homo sapien
gaatcacctggaaggctttttaaaayaagattgctcagtctttgttccca

SEQ ID NO: 3057 - DNA, 50 bp, homo sapien
aaaaatatgaacctgaaaatttaatsaagagaggtagtggcaattcttat

SEQ ID NO: 3058 - DNA, 50 bp, homo sapien
aacatctacttcctcactttatgcamgtctcccaaatgtcactagagatg

SEQ ID NO: 3059 - DNA, 50 bp, homo sapien
cccagggcagtgcctcttctgtacaygatggttatatatggccatatgct

SEQ ID NO: 3060 - DNA, 50 bp, homo sapien
aaggaatcgtattgtaagttcgctayccagaacctccactcttttgaccc

SEQ ID NO: 3061 - DNA, 50 bp, homo sapien
gaagtcacagatgtggttccaaataragagtaatcacctttgtttatcag

SEQ ID NO: 3062 - DNA, 50 bp, homo sapien
atttttagttttgttataacaatgcyctgaatctaggaataaaattatca

SEQ ID NO: 3063 - DNA, 50 bp, homo sapien
tggggccacataggaatgaatggtcrattattttttggaaggtggtttgt

SEQ ID NO: 3064 - DNA, 50 bp, homo sapien
gtgttacttccctagagccagaatcrccttataacaagcatgagttcatg

SEQ ID NO: 3065 - DNA, 50 bp, homo sapien
gattccttcatttttacataaacaamcactgtactgttaagttcaattac

SEQ ID NO: 3066 - DNA, 50 bp, homo sapien
ttattttctgcaggtttgctcaaaaktatgactattagatcagtgaaagt

SEQ ID NO: 3067 - DNA, 50 bp, homo sapien
agtggacagggcaattcctttcagaragtggaacaagcaactgaaagaca

SEQ ID NO: 3068 - DNA, 50 bp, homo sapien
gagcctaaatagaagagcacagaatmagatttgtaggatgtgtagttggc

SEQ ID NO: 3069 - DNA, 50 bp, homo sapien
agtgaccaaaaaatctctgtgcatamccataggacatattcacctcttag

SEQ ID NO: 3070 - DNA, 50 bp, homo sapien
tgactcagaaggttgcagtatgacargattagagggtatagaaggtatag

SEQ ID NO: 3071 - DNA, 50 bp, homo sapien
tgtttttaatcacaggcaatcaaaartaccttcaagcagaagaaatttcc

SEQ ID NO: 3072 - DNA, 50 bp, homo sapien
acatcatgaaatccaaatataggagsaagtacatattgatgcacaatgta

SEQ ID NO: 3073 - DNA, 50 bp, homo sapien
aaggggaaaataaccacgtttaaacrgtcttaatatcagaagttatttac

SEQ ID NO: 3074 - DNA, 50 bp, homo sapien
tatatgcatgtatgtggtagacagcractgagaagggtgttttttattct

SEQ ID NO: 3075 - DNA, 50 bp, homo sapien
aatataaacagaacatcagactccargaaggatcacaaaacttcaaagtt

SEQ ID NO: 3076 - DNA, 50 bp, homo sapien
gtggagtgaatgtcttcgaaaagaargggtctttattcaggagtcactgg

SEQ ID NO: 3077 - DNA, 50 bp, homo sapien
gtggagtggggaggagtggaagccaraatcagctaagatgttctttgagt

SEQ ID NO: 3078 - DNA, 50 bp, homo sapien
acccacagcagcagtatatgttgacsgaaaaaaatgaataaatggtttga

SEQ ID NO: 3079 - DNA, 50 bp, homo sapien
gaatatttctaagtacatttccttaygccagatacctgtccctctaaaat

SEQ ID NO: 3080 - DNA, 50 bp, homo sapien
aagggaaataaatgattctccaaatraaaattatgtaaactatcccagta

SEQ ID NO: 3081 - DNA, 50 bp, homo sapien
acacatactgcagctagatggtgcckcaaaaagccagtgactcatccttt

SEQ ID NO: 3082 - DNA, 50 bp, homo sapien
tggtatagaccatacagaatttatasattcttccctgatatagcctaact

SEQ ID NO: 3083 - DNA, 50 bp, homo sapien
gactgggctccaaaaaaaatgttcakgagtctagaacccactccctggta

SEQ ID NO: 3084 - DNA, 50 bp, homo sapien
tgtgaataaatcttggttattagtayatggttaatttcagatacataaac

SEQ ID NO: 3085 - DNA, 50 bp, homo sapien
tggttaaacattgacaattataaagkaaaaatgagtaatactgaagatat

SEQ ID NO: 3086 - DNA, 50 bp, homo sapien
cagctccagtcattatatttttatawctcaaccattatctcaaaaggggc

SEQ ID NO: 3087 - DNA, 50 bp, homo sapien
gacaagggagacctactgtatattcratcatgctaatattttccctccca

SEQ ID NO: 3088 - DNA, 50 bp, homo sapien
tcctattttttttagaattatatgcrcttattcactcatttactcattta

SEQ ID NO: 3089 - DNA, 50 bp, homo sapien
ttttgataaagtctatgttactgaayacgtgtagactgttagacaacttc

SEQ ID NO: 3090 - DNA, 50 bp, homo sapien
tacattgtctgtggtttccttagaaratgtttggagccaaatctaaaatg

SEQ ID NO: 3091 - DNA, 50 bp, homo sapien
gacaacttctgaactctagctgttcrcctcatagattctaaataactcta

SEQ ID NO: 3092 - DNA, 50 bp, homo sapien
gtaagtatttatttaaaacaataacrgtctccacaaagtaaaaagatact

SEQ ID NO: 3093 - DNA, 50 bp, homo sapien
ggaaccagaaacttctactctataawcgttgctcacatctatgtttttgt

SEQ ID NO: 3094 - DNA, 50 bp, homo sapien
gcaactagaaactactcctatagcasaaaacccaccaaaagtgttcaaac

SEQ ID NO: 3095 - DNA, 50 bp, homo sapien
aaagaccagagaacgatctcagatarcatgtgtagtatagaagtgacata

SEQ ID NO: 3096 - DNA, 50 bp, homo sapien
tccttttcctttagtcagtgaagcaytctcaaggtatttagaagaaaaag

SEQ ID NO: 3097 - DNA, 50 bp, homo sapien
ttccctttatcaaaacttcttatagkccatttcagtttaggtgataagat

SEQ ID NO: 3098 - DNA, 50 bp, homo sapien
cagaaggctggttcagggttgctcaytcaccctttcaaaaattctacaat

SEQ ID NO: 3099 - DNA, 50 bp, homo sapien
tttagtcattgctttttggctatcaytcaattgctgtcttcagaatacat

SEQ ID NO: 3100 - DNA, 50 bp, homo sapien
tggcagggaggatctcttggataacygacacattttaaagtcattcattg

SEQ ID NO: 3101 - DNA, 50 bp, homo sapien
ctattaagcagggctttcaaataatyatgccaattaacaaatttatacat

SEQ ID NO: 3102 - DNA, 50 bp, homo sapien
gcttctctcagtgttcctagtgataygtttatgcaataaggaattgacag

SEQ ID NO: 3103 - DNA, 50 bp, homo sapien
actctgctgatcttattttgcttatyactgaccacaaagacataaaagag

SEQ ID NO: 3104 - DNA, 50 bp, homo sapien
acatcttgtcctgctacctctctaamcttatctcctatttgtgtctcttt

SEQ ID NO: 3105 - DNA, 50 bp, homo sapien
tgaaggctgtgtttggggaacactamgaaataaggctgcttgagagacag

SEQ ID NO: 3106 - DNA, 50 bp, homo sapien
actggagaccctaaaattctgatcaytaatcttgatggagttcttaggta

SEQ ID NO: 3107 - DNA, 50 bp, homo sapien
ctgtgactgaaggtctatttgtccaytattatatctccagtacctagagc

SEQ ID NO: 3108 - DNA, 50 bp, homo sapien
attgttctaatcaggtcacattcaamaattggcttttctcttcctctgtc

SEQ ID NO: 3109 - DNA, 50 bp, homo sapien
tgtcagactataacaacccttgaggwcatgaaatgcgtcttctttatctc

SEQ ID NO: 3110 - DNA, 50 bp, homo sapien
gggaaaagatttgaatagcgtaaacyagtctggctcagaaagaaaattga

SEQ ID NO: 3111 - DNA, 50 bp, homo sapien
tcaacatttgagactcaggtttatawgaagtagataaaggttttatggat

SEQ ID NO: 3112 - DNA, 50 bp, homo sapien
ctgtctgcacacacatctggagagamcttgctttggagtcatatggacct

SEQ ID NO: 3113 - DNA, 50 bp, homo sapien
ctaaagcttagagaagtggaatacawggcccaattacacaaccagcaaga

SEQ ID NO: 3114 - DNA, 50 bp, homo sapien
gtccaagtccacaggccactagccayctaggaacttattaaaaatgtgga

SEQ ID NO: 3115 - DNA, 50 bp, homo sapien
tttgtactaacattgaaaagtttcayataaaagtatggattttggccagg

SEQ ID NO: 3116 - DNA, 50 bp, homo sapien
tgatgactagaacatgtatgcaaagwctttagaggtttcagagctgtttt

SEQ ID NO: 3117 - DNA, 50 bp, homo sapien
cctatgccaggtattagagatataaygataaatgaaatcaacattgttgc

SEQ ID NO: 3118 - DNA, 50 bp, homo sapien
cttgggaaaaccagcgagaaatgaaragagtggttttaatattttggcaa

SEQ ID NO: 3119 - DNA, 50 bp, homo sapien
tttatcaaggccaaagcctctgtggkagtttgagtaggaaaccatagctc

SEQ ID NO: 3120 - DNA, 50 bp, homo sapien
ccatacacgaaacttggatttctacrctttcaaaaacagatttctgttgt

SEQ ID NO: 3121 - DNA, 50 bp, homo sapien
aaaccttaatgtcatattattatcaygcttgtattatctacccactcaat

SEQ ID NO: 3122 - DNA, 50 bp, homo sapien
gtgaaataactcagaaatggaaagtsaagtattgcatgttctcagttaca

SEQ ID NO: 3123 - DNA, 50 bp, homo sapien
tagcaaagcaacaactaagatagcayagaaacgtaatagggaaaacagag

SEQ ID NO: 3124 - DNA, 50 bp, homo sapien
tgttggatttgtttatacctgagacyataattcttcgtgtagccagcacc

SEQ ID NO: 3125 - DNA, 50 bp, homo sapien
gccaaacgtcgtcttctctacttacrattttctcgtctctagttatgaaa

SEQ ID NO: 3126 - DNA, 50 bp, homo sapien
attatatttccctaagtgttgcctayataatgttgatttattgtctttat

SEQ ID NO: 3127 - DNA, 50 bp, homo sapien
tttagcagcaccatcatcaacagaargtgcaaaaatgcaaaaatcatggc

SEQ ID NO: 3128 - DNA, 50 bp, homo sapien
tcatgtgaatctgaatgcagaaaaakaatcaagatcataacactaagtct

SEQ ID NO: 3129 - DNA, 50 bp, homo sapien
gcaacccccaaaatgggttcaagaawtaacacacccttagagctaggttc

SEQ ID NO: 3130 - DNA, 50 bp, homo sapien
gtcatctgccgtctgtctgtccaccyagaagagaaagaatagacccttat

SEQ ID NO: 3131 - DNA, 50 bp, homo sapien
gtctttctcccttattgacctttgamggtatctaaaattccaagcttcag

SEQ ID NO: 3132 - DNA, 50 bp, homo sapien
ggctgtcagacgacccaccaggcgaycctaacacacagaggcgaccctaa

SEQ ID NO: 3133 - DNA, 50 bp, homo sapien
aactaatcaggaaaacattcacatayaaggccttttataatatataagcc

SEQ ID NO: 3134 - DNA, 50 bp, homo sapien
caatagggcaggagaaggcaggtgayatatttacagaagagtcctaaggt

SEQ ID NO: 3135 - DNA, 50 bp, homo sapien
attggtaaattgtctgatctctaackaggtacttaataaatgtttgttga

SEQ ID NO: 3136 - DNA, 50 bp, homo sapien
ccttttgacatgtaaagtttataaaragctactggcttaaaaaaagaaaa

SEQ ID NO: 3137 - DNA, 50 bp, homo sapien
tacattttaatcttcaaaggcaccastctcattatcaattttctcttagt

SEQ ID NO: 3138 - DNA, 50 bp, homo sapien
gctcctccctcagaatgaatgagacragaaatcagatgtttatgcccaag

SEQ ID NO: 3139 - DNA, 50 bp, homo sapien
ccgcatggcaaaaataattaaaacaycgcttctactatttcccagataac

SEQ ID NO: 3140 - DNA, 50 bp, homo sapien
ttaatgaattttgaggtttagttatwaggtgaatacacatttaggaatgt

SEQ ID NO: 3141 - DNA, 50 bp, homo sapien
tttatcctataaatatgtttacagamgtgtgaaatgatgtatatacaaga

SEQ ID NO: 3142 - DNA, 50 bp, homo sapien
gctgagatttggcaacgtgaaatgayccattcgattgcttcattttctga

SEQ ID NO: 3143 - DNA, 50 bp, homo sapien
aactaaaacacagtaacaatatagasagtgactctggctggcagggaggg

SEQ ID NO: 3144 - DNA, 50 bp, homo sapien
actgatatttacttactataccacawgaaataatataaggaaggagaaag

SEQ ID NO: 3145 - DNA, 50 bp, homo sapien
agtctgttccattcactgtgaagaaygcgtaaccgggtatgagagtcact

SEQ ID NO: 3146 - DNA, 50 bp, homo sapien
tttgtctgccctgatgtctgaatttyaaattatgcaccagagattcttga

SEQ ID NO: 3147 - DNA, 50 bp, homo sapien
agataatgtggaattggaagttttaraaaatgtaactgcttagtttttaa

SEQ ID NO: 3148 - DNA, 50 bp, homo sapien
gagactgtcatctattagatactccrgctttaattacttgattaaagcaa

SEQ ID NO: 3149 - DNA, 50 bp, homo sapien
ttcttttcatgttgagtaactattcrcctactactgtctgtttggttact

SEQ ID NO: 3150 - DNA, 50 bp, homo sapien
gggtgaactgtctacctagtgtaaaragtgttgagaaagaaatcatgcaa

SEQ ID NO: 3151 - DNA, 50 bp, homo sapien
atttttccctctgcttagatacttakacatcatgagatagcttttagaac

SEQ ID NO: 3152 - DNA, 50 bp, homo sapien
tccctatctgacgatgatttagccastcttcatgcttatctgtttcatgc

SEQ ID NO: 3153 - DNA, 50 bp, homo sapien
ttcaaatgtcattaatgttgacagartattacagtttacacagaatttca

SEQ ID NO: 3154 - DNA, 50 bp, homo sapien
ccaaagatttgctaaaatgacttcaragaaccagggatacttggcttcag

SEQ ID NO: 3155 - DNA, 50 bp, homo sapien
ttaagtacatttttattgccattaartaatttgcctaaaatttgcctcaa

SEQ ID NO: 3156 - DNA, 50 bp, homo sapien
ttttaagtgaccttgaagacattaaycacataatttcactgattgaattc

SEQ ID NO: 3157 - DNA, 50 bp, homo sapien
aacttctggggccagagtggtagaamggctttacagaacaatgatatttt

SEQ ID NO: 3158 - DNA, 50 bp, homo sapien
gcaattcaacctaacacaattgatgmagtatttacaacactcagtaccaa

SEQ ID NO: 3159 - DNA, 50 bp, homo sapien
tgacctaccattgaacaaacaataamtatagatccacaattccttttcca

SEQ ID NO: 3160 - DNA, 50 bp, homo sapien
cttgtcttaggaagttaaaaatgaaytgatgtggctagaaagattccaaa

SEQ ID NO: 3161 - DNA, 50 bp, homo sapien
gatattacatttaaagaaggaggtakctatgaaacaagaaaaggataaat

SEQ ID NO: 3162 - DNA, 50 bp, homo sapien
tttagagttgcatgatatttattgcwctagtaactttgattgcgtccttg

SEQ ID NO: 3163 - DNA, 50 bp, homo sapien
tagaaagattccaaagggggaaaaaygaactgataatgtggggaagtttg

SEQ ID NO: 3164 - DNA, 50 bp, homo sapien
ctcataagctcattcccttcaaaaaycggggtgtgtctgtcaccccaggc

SEQ ID NO: 3165 - DNA, 50 bp, homo sapien
tcttaggtctttggaaaaaggttacraataatgaagctgggatgtattgt

SEQ ID NO: 3166 - DNA, 50 bp, homo sapien
tatctgccagttggcctttccacacraaacaattcccttcttttcaaatt

SEQ ID NO: 3167 - DNA, 50 bp, homo sapien
gaataaaaataataggcacaatataratttctagtcccatgcagattcag

SEQ ID NO: 3168 - DNA, 50 bp, homo sapien
tttaaaagacaacatgtcacggatamctttgcagaaaaaaactaacatat

SEQ ID NO: 3169 - DNA, 50 bp, homo sapien
gaatgaattaatgaaggaataagaaygaacgtatgtgtgaagagtgagta

SEQ ID NO: 3170 - DNA, 50 bp, homo sapien
gggagggaaagtttccgggaagtaargtatactgtgtgaaatatacagtc

SEQ ID NO: 3171 - DNA, 50 bp, homo sapien
ctagtatttttatgtgctacagtgayaaattataccaagacccgtttgtc

SEQ ID NO: 3172 - DNA, 50 bp, homo sapien
actgttgggaaagaaatagaaggaamcttaacaggagatccatgaacctg

SEQ ID NO: 3173 - DNA, 50 bp, homo sapien
tattcagattccttggcctctctaamgtaagtattttggcagataaagga

SEQ ID NO: 3174 - DNA, 32 bp, homo sapien
cctcacgcaatgggtcyattaaaatgcgtgat

SEQ ID NO: 3175 - DNA, 50 bp, homo sapien
tttttgagtaccaaaacagtacccaratgagttccagggccatagtaggt

SEQ ID NO: 3176 - DNA, 50 bp, homo sapien
attaaaaggaaattttcagctccaaytgagttttagcaatgaatctatag

SEQ ID NO: 3177 - DNA, 50 bp, homo sapien
aattctgactgcaggctataaacaakgaccaggaaacaagagggggatgt

SEQ ID NO: 3178 - DNA, 50 bp, homo sapien
gatacaatctcagagaattgaaatgmacgataacaatgtatcaatattat

SEQ ID NO: 3179 - DNA, 50 bp, homo sapien
gcctgcatgactcacttggattttayatcttcagaaaaagtactttatag

SEQ ID NO: 3180 - DNA, 50 bp, homo sapien
ctatgaagctggcctctaaggaagcmgacagatacataagtcagacagga

SEQ ID NO: 3181 - DNA, 50 bp, homo sapien
ctcatcgtctttggaatgtgttgtamcaagatttcatccatactcagaag

SEQ ID NO: 3182 - DNA, 50 bp, homo sapien
ttaaaattttgctcctattccatcartcattttcaggacagcagtttctc

SEQ ID NO: 3183 - DNA, 50 bp, homo sapien
cactctgacagtaatgataaaggagmcatagctgcatctgaattagtcct

SEQ ID NO: 3184 - DNA, 50 bp, homo sapien
tgtttgtcatgcttatggttcagaaygcacttatcacatttgctatttta

SEQ ID NO: 3185 - DNA, 50 bp, homo sapien
aagctttgcttcttggatactataamagtgcacaacactactcgggaggc

SEQ ID NO: 3186 - DNA, 50 bp, homo sapien
gaaattgcaaggtatatggaaagaarccttaaatcatatataatataaaa

SEQ ID NO: 3187 - DNA, 50 bp, homo sapien
aaagaaagctatcacagacaagctakaatccacatatccactgagtgcca

SEQ ID NO: 3188 - DNA, 50 bp, homo sapien
gagtgattttgcaatgttgagaagascaaataaaagactatatcaactcc

SEQ ID NO: 3189 - DNA, 50 bp, homo sapien
tgttctttgccacttgcttatgtaarccatcttattcaacaatatattac

SEQ ID NO: 3190 - DNA, 50 bp, homo sapien
attcttttgtttgaaagcccataaarttcttgcacaaataactataagtt

SEQ ID NO: 3191 - DNA, 50 bp, homo sapien
aatttgttgaaggcaatgtaagtaamgctgtcaatggatttaaaataact

SEQ ID NO: 3192 - DNA, 50 bp, homo sapien
tgtacaaaaatggagaataggaagarctataacatccatactctcattta

SEQ ID NO: 3193 - DNA, 50 bp, homo sapien
aaattataattttcaatatacatcartaagaaaactgtttatgacagcta

SEQ ID NO: 3194 - DNA, 50 bp, homo sapien
acttataagaaaagcaattgaaaaaragtattcaagtagttcctataagc

SEQ ID NO: 3195 - DNA, 50 bp, homo sapien
agtcttacaaaggttaaacaaggaaratcacatagggcctatgatatagt

SEQ ID NO: 3196 - DNA, 50 bp, homo sapien
aggggagtcttcttgcttcctaacaytgacagaattaagagtaatgagga

SEQ ID NO: 3197 - DNA, 50 bp, homo sapien
attacaagcgagagccactgcgcacsgcggcttcaggattatttttaaaa

SEQ ID NO: 3198 - DNA, 50 bp, homo sapien
ttatcttatggaatcggataagatayggaattacctattaacatcttgag

SEQ ID NO: 3199 - DNA, 50 bp, homo sapien
caataaatgcagcatatatacaagamgtagtaattaagtgaaacaggata

SEQ ID NO: 3200 - DNA, 50 bp, homo sapien
gtttaacttttagagtcaataagatmagtcaatatgtctttgttattcag

SEQ ID NO: 3201 - DNA, 50 bp, homo sapien
catgaaatgagtgtagcatagtaacraaaaaatagagaactataaatttt

SEQ ID NO: 3202 - DNA, 50 bp, homo sapien
acaagtcagtttagcatatttaaacraaatcatttatatcactgcatgga

SEQ ID NO: 3203 - DNA, 50 bp, homo sapien
gcatgagctaccatgcctaactccayaaagattaatttttggtgatgaga

SEQ ID NO: 3204 - DNA, 50 bp, homo sapien
ttgcaccacaaacaccttgagatgarcttataataaaggttgacttgttt

SEQ ID NO: 3205 - DNA, 50 bp, homo sapien
cttttgataacatgtcccagtaacaygtccagctttaattttaccatctc

SEQ ID NO: 3206 - DNA, 50 bp, homo sapien
agagggttcatttatactattcaaaycatacatatatacataaaaatgaa

SEQ ID NO: 3207 - DNA, 50 bp, homo sapien
atcttgttttcccttgattatattamaatctgcaacccatgactctccat

SEQ ID NO: 3208 - DNA, 50 bp, homo sapien
tcccccattctaattttcacaaagaygcggtgatatggtatgaatgttgt

SEQ ID NO: 3209 - DNA, 50 bp, homo sapien
ttaagatttgttctaatgtttgacawccttcaattgaagtaaatagtaag

SEQ ID NO: 3210 - DNA, 50 bp, homo sapien
ttaatcagaatagcagggatcttaayaatacagccatattgaaagaattc

SEQ ID NO: 3211 - DNA, 50 bp, homo sapien
tctatagcaaatattctatgtcacawctcacaattcatgtttctaaagga

SEQ ID NO: 3212 - DNA, 50 bp, homo sapien
taccaaatggagctcactgttcagaytcgttgcaaaatctggctaaaatt

SEQ ID NO: 3213 - DNA, 50 bp, homo sapien
agggtgagctcttcaaaagcataatrataaaatagcctgtctttcattgg

SEQ ID NO: 3214 - DNA, 50 bp, homo sapien
gtcaagtgattgatgtattcgaagawaaataggatggaaaaagtacagat

SEQ ID NO: 3215 - DNA, 50 bp, homo sapien
ttgaatataattaaaatttggaaacragtgactgatttctgtagtaagct

SEQ ID NO: 3216 - DNA, 50 bp, homo sapien
aatagaactattaaatataccataamctttctctcatgattcacaatcta

SEQ ID NO: 3217 - DNA, 50 bp, homo sapien
acaaataaagataatattttaaacaytgactaaaaatactatcccaacag

SEQ ID NO: 3218 - DNA, 50 bp, homo sapien
taagtttatatgctaatttaacagascttatttaacatgttattattatg

SEQ ID NO: 3219 - DNA, 50 bp, homo sapien
tttctattcataatttaatcatctgrataactactagaagaaaaaacgct

SEQ ID NO: 3220 - DNA, 50 bp, homo sapien
ggataactttcctttttacacgttawcaattatgcatgtttgatctttcc

SEQ ID NO: 3221 - DNA, 50 bp, homo sapien
gtaagtcatctgatgacaggactaartgttattttctagcaccaagaaca

SEQ ID NO: 3222 - DNA, 50 bp, homo sapien
acaatatagtctccaactcactgtamcatcaaatcaaatattagctttgt

SEQ ID NO: 3223 - DNA, 50 bp, homo sapien
ctttttctaagtgtcctaacttacaytagtcaagtaaaatagaatctatt

SEQ ID NO: 3224 - DNA, 50 bp, homo sapien
gcatcccattagtggctttcatttcyatcctatcagtcaattgtgttttg

SEQ ID NO: 3225 - DNA, 50 bp, homo sapien
aaaggaaagacatttatatatacacrcgccttgcattttaagcctcaaat

SEQ ID NO: 3226 - DNA, 50 bp, homo sapien
aacaaataaagcattagtttcctgcwaagttgaaataaatattttatttt

SEQ ID NO: 3227 - DNA, 50 bp, homo sapien
caaattctacgttggtatatgttatsagtgaccatctattcagggatttt

SEQ ID NO: 3228 - DNA, 50 bp, homo sapien
atgtgagggatatagattccatgccrcttaggagacagaatctaatgcct

SEQ ID NO: 3229 - DNA, 50 bp, homo sapien
catttcttcctgctattattccgtaygtcccattatcatctagtaattac

SEQ ID NO: 3230 - DNA, 50 bp, homo sapien
tttcacggctctcaaactctcagaayattggttttgaacaggacatatct

SEQ ID NO: 3231 - DNA, 50 bp, homo sapien
gctgaaaagtgccaggactattaagmaaacttcaagaaggccagtataac

SEQ ID NO: 3232 - DNA, 50 bp, homo sapien
atgaggtaataacaatagtagaagaygaactaaaatatatactgtaatga

SEQ ID NO: 3233 - DNA, 50 bp, homo sapien
cccagagaattgtgctgcaccctatwagagcaactgttactttattattt

SEQ ID NO: 3234 - DNA, 50 bp, homo sapien
gtatacaccacatagataaaagtgcsaactggggataaataacacttctg

SEQ ID NO: 3235 - DNA, 50 bp, homo sapien
ttttccagaaagctgattagtactayatgttgtcaaagaagaaaatgtat

SEQ ID NO: 3236 - DNA, 50 bp, homo sapien
tgaccaggtgtctccatacaggaaaytcccttcataacgatatgtggcaa

SEQ ID NO: 3237 - DNA, 50 bp, homo sapien
acagcagggcttggggagaattaacygcacttcatgcattccactgcttc

SEQ ID NO: 3238 - DNA, 50 bp, homo sapien
gagatctgagcaacaacaggcattarataatctaagaggaggctatcatt

SEQ ID NO: 3239 - DNA, 50 bp, homo sapien
ttccttagcataggacatatataacsaaaagacaatctgaattattaatc

SEQ ID NO: 3240 - DNA, 50 bp, homo sapien
gttgacctgtgctttgattctatgayaataaaaatgtcatatgtcacaca

SEQ ID NO: 3241 - DNA, 50 bp, homo sapien
agatagtgtcaaggggtatagatackaggtggaatgaaaaatagactatt

SEQ ID NO: 3242 - DNA, 50 bp, homo sapien
tgcttacttccccaattggactacarattctttaaggattagaaggctaa

SEQ ID NO: 3243 - DNA, 50 bp, homo sapien
tctaattaaccaaaatctctacttaygtcgtattgccatgtccatagtct

SEQ ID NO: 3244 - DNA, 50 bp, homo sapien
gatatttagcataaagtagacatatraagacttagcacatcagtactaat

SEQ ID NO: 3245 - DNA, 50 bp, homo sapien
attacattagaatttattatagttcwctgccatgtaagaattattctctc

SEQ ID NO: 3246 - DNA, 50 bp, homo sapien
cttttatatgattaaacaaattaaamtgataccacttcatcgggttgttt

SEQ ID NO: 3247 - DNA, 50 bp, homo sapien
ttttgtataatgcaaactacaacaarccaattaattagaacaaagtgaga

SEQ ID NO: 3248 - DNA, 50 bp, homo sapien
ggagaataaagttatcctaatttaaygccatattttacattgcaacatac

SEQ ID NO: 3249 - DNA, 50 bp, homo sapien
tccacatttaaactctatgcgttcawgatcccacgaaagctgttctttct

SEQ ID NO: 3250 - DNA, 50 bp, homo sapien
aaagctattctttttgttaactgcamctctttgagatttaaggtttctgt

SEQ ID NO: 3251 - DNA, 50 bp, homo sapien
ctgagtcactactgtgaacggtgtamccttttctaagaagaatgctttct

SEQ ID NO: 3252 - DNA, 50 bp, homo sapien
atagttcgttgcaggtttgggcataygatgctaaatacttttatactttt

SEQ ID NO: 3253 - DNA, 50 bp, homo sapien
tattcctagaaaggtaaaactggaaktggattctcatttagtagtggaaa

SEQ ID NO: 3254 - DNA, 50 bp, homo sapien
tctcattcatagaataaatatggaaratgtagtaatcaaaaaccttatta

SEQ ID NO: 3255 - DNA, 50 bp, homo sapien
agaatggaacagaagctctaacagaygaaatattgatggggagctgacaa

SEQ ID NO: 3256 - DNA, 50 bp, homo sapien
caaacatgtattttgtggtttttaartccagtcaccattaataattccta

SEQ ID NO: 3257 - DNA, 50 bp, homo sapien
tgatgccgagtttttgaaattttgaygtatctgggcattaattgaaaaag

SEQ ID NO: 3258 - DNA, 50 bp, homo sapien
taggagtcagcagtagagtcttcagraagagattatctggggaagccaaa

SEQ ID NO: 3259 - DNA, 50 bp, homo sapien
ttaaatgagcaaatacttgaccagayattgtatattaagatgaatcacag

SEQ ID NO: 3260 - DNA, 50 bp, homo sapien
tattataatatacgatgctagccaaytgttgatgtaatgcacatctgtac

SEQ ID NO: 3261 - DNA, 50 bp, homo sapien
ttttctgtgtcaagctgtgtaaggcraagactgagacctaaacagtacaa

SEQ ID NO: 3262 - DNA, 50 bp, homo sapien
cccaaatcataagtgacctgcctaawgaaaagtaaatgttaacatgctta

SEQ ID NO: 3263 - DNA, 50 bp, homo sapien
agcaatcaattataaatgacagttawactgattatagttattattttttc

SEQ ID NO: 3264 - DNA, 50 bp, homo sapien
tgattaaactggcccactccaaatayagttgttggacacaagccttataa

SEQ ID NO: 3265 - DNA, 50 bp, homo sapien
atgttgttcatacattaaaagttgcrccttgattagctgaaatcataaaa

SEQ ID NO: 3266 - DNA, 50 bp, homo sapien
attggacagatatacttgaagtggcraaggaggaaaatattatacaacca

SEQ ID NO: 3267 - DNA, 50 bp, homo sapien
ctcatgtactaagtataacgctgaamaaatgagtatacgcattctatagg

SEQ ID NO: 3268 - DNA, 50 bp, homo sapien
ccttcaaataaactcacgtgaaagtraataggaccttaatgcaatatagt

SEQ ID NO: 3269 - DNA, 50 bp, homo sapien
atctatgaaaagctcacagctgaaakcataattagtgaaagaaaagctta

SEQ ID NO: 3270 - DNA, 50 bp, homo sapien
aagttaatccagaaactactcacaayttctatgtatgtatgcatccatat

SEQ ID NO: 3271 - DNA, 50 bp, homo sapien
tctcagcatttgtctgtctttttaartattattatctcacccttcaactc

SEQ ID NO: 3272 - DNA, 50 bp, homo sapien
aatatatacccagtacgtaaatgaartgagcttcccaactgctagtcccc

SEQ ID NO: 3273 - DNA, 50 bp, homo sapien
ggggtaatgcctaaaatgtcctttawacttgatccattataagtggttca

SEQ ID NO: 3274 - DNA, 50 bp, homo sapien
ccaagtatttcattattttatactcwactttaatccatagaaaatatata

SEQ ID NO: 3275 - DNA, 50 bp, homo sapien
gattgaaggagagactctctttaggkattttccaactccaaaatttgtct

SEQ ID NO: 3276 - DNA, 50 bp, homo sapien
ctaaaatttgcatttgattatgctamaatggatgttatggctagttttgt

SEQ ID NO: 3277 - DNA, 50 bp, homo sapien
ttgtatgtgcaaaatgttccaaaaaytgtgaaatgattctaatctataaa

SEQ ID NO: 3278 - DNA, 50 bp, homo sapien
agttagctttgccccagtagtggccygaaaacacctacctaatgcctgtt

SEQ ID NO: 3279 - DNA, 50 bp, homo sapien
tgttgttaggctaaatgtttcacagmcaaccgaactcaactaaccacgat

SEQ ID NO: 3280 - DNA, 50 bp, homo sapien
aaacaaatgagtacataattcacaaytggagcttaggaaaaattcccagt

SEQ ID NO: 3281 - DNA, 50 bp, homo sapien
aaatggaagactatccatttaaagamgtgttttgagaaaaaaatgtttaa

SEQ ID NO: 3282 - DNA, 50 bp, homo sapien
atgcaaattattcgaaagggtaaaayaccagaaactcagaatgtcatttg

SEQ ID NO: 3283 - DNA, 50 bp, homo sapien
aaacgtacttttgcaaattttattcratggcaatgacaatcctataacca

SEQ ID NO: 3284 - DNA, 50 bp, homo sapien
atgcccttacttccaaacatgcttasaagccaatactatggcacaggctt

SEQ ID NO: 3285 - DNA, 50 bp, homo sapien
gtcccaagaacagaaattctaattaygaaaggatgcagaaatgcacatgg

SEQ ID NO: 3286 - DNA, 50 bp, homo sapien
tacacagacagaaatcttgggataamcttctatcttcttttctcctttat

SEQ ID NO: 3287 - DNA, 50 bp, homo sapien
gagctcctagtcactggaaacagaarttaaataatcaatactaaattgta

SEQ ID NO: 3288 - DNA, 50 bp, homo sapien
ataattttgagtttatctaattttcwcttttagctgacagtgtacgatca

SEQ ID NO: 3289 - DNA, 50 bp, homo sapien
tttaatgttatgcttccagatgacayattttacccatatttctcctgtat

SEQ ID NO: 3290 - DNA, 50 bp, homo sapien
ttaattaaagagtatgcataaattargtcaaatggttcccatgttcaaat

SEQ ID NO: 3291 - DNA, 50 bp, homo sapien
tatcaacaatgcctagttttataccsaatgaataaatgacacaatgaata

SEQ ID NO: 3292 - DNA, 50 bp, homo sapien
agttagacattcagcatattacgtcraaactgtgcttacatatattttcc

SEQ ID NO: 3293 - DNA, 50 bp, homo sapien
caatctcttcaactcaggcaatctcyaagagggcgtatgatttctcttgt

SEQ ID NO: 3294 - DNA, 50 bp, homo sapien
tattctagacaagtaagaagaaatcraatataatgaagaatgcttcagaa

SEQ ID NO: 3295 - DNA, 50 bp, homo sapien
acttcactcctgtaacactattgagsaaagtgaagatttttttcccccca

SEQ ID NO: 3296 - DNA, 50 bp, homo sapien
ttattttaaggtcagttcaataacakgagacaaagattttggtgtgaaat

SEQ ID NO: 3297 - DNA, 50 bp, homo sapien
gccacagtttttgtttacaaaggcayctggtgaattctaatgtactttct

SEQ ID NO: 3298 - DNA, 50 bp, homo sapien
aattagattaatataagatgttgaaytgtcattaccaagtttcactttaa

SEQ ID NO: 3299 - DNA, 50 bp, homo sapien
tatggagaaggagaccagaccttccrcgtaatatggaggattatcattat

SEQ ID NO: 3300 - DNA, 50 bp, homo sapien
tggcatgacatgttgactacatcaartaaaatagaaatagaaaaaagtgg

SEQ ID NO: 3301 - DNA, 50 bp, homo sapien
tttttacttttattgaaggattgaargtcatatatacaatacaacataat

SEQ ID NO: 3302 - DNA, 50 bp, homo sapien
aagcttacagctctggacgaaattargcataggtatgtatgtacctttct

SEQ ID NO: 3303 - DNA, 50 bp, homo sapien
gccacaaggcagaacatcatttaatkagaatacatggcagatggtgattt

SEQ ID NO: 3304 - DNA, 50 bp, homo sapien
tacatctcagatggctcctcggtggyagcgtgcacttcccggctcatcac

SEQ ID NO: 3305 - DNA, 50 bp, homo sapien
actaggaaattgtaaagaaatatcargtacaaaatttagtatattcttat

SEQ ID NO: 3306 - DNA, 50 bp, homo sapien
gtggatctcttctcgctgtcaataaygtcccactggtcagctactttctg

SEQ ID NO: 3307 - DNA, 50 bp, homo sapien
tcaaccttgatttactgtctataaarcaggaatagtaacacctttttcta

SEQ ID NO: 3308 - DNA, 50 bp, homo sapien
ccttgcctctccataggatggactaratatcttttacagctttttcactt

SEQ ID NO: 3309 - DNA, 50 bp, homo sapien
catcccaagattatatggtctttagkaatttctcattcacactaatcccc

SEQ ID NO: 3310 - DNA, 50 bp, homo sapien
cttgctttctcagactccctcaaaargacaggaacattttaattgtgtat

SEQ ID NO: 3311 - DNA, 50 bp, homo sapien
tgatcaaccatgatatcatctatcamctactattgcaaaactgaatgttt

SEQ ID NO: 3312 - DNA, 50 bp, homo sapien
agaaatcaacagaagagaatagagayggtctaagttgatctccacatgta

SEQ ID NO: 3313 - DNA, 50 bp, homo sapien
caaggtcatacattaattaacattayagcagtaacagataatgtcttatt

SEQ ID NO: 3314 - DNA, 50 bp, homo sapien
aatatataaattaagctgaaataaaygaatgagatcaagatgagccttcc

SEQ ID NO: 3315 - DNA, 50 bp, homo sapien
ataaataaatatgttgcttccaaackccaattttcaactttaagatatat

SEQ ID NO: 3316 - DNA, 50 bp, homo sapien
ctgattaaagtaacccacagatttayaattgctaagcctaaaagagtaac

SEQ ID NO: 3317 - DNA, 50 bp, homo sapien
tggaaactaaacatcttatgggttayagtctttattggcctaatgtgaag

SEQ ID NO: 3318 - DNA, 50 bp, homo sapien
gacacaactcaggtttggttctgcargtaagcaaacatagagaaaggatc

SEQ ID NO: 3319 - DNA, 50 bp, homo sapien
aatgatatagtgtcaaaaataataaygatgatttgctctgctaaaagttg

SEQ ID NO: 3320 - DNA, 50 bp, homo sapien
catttattaagtttcatgtgattcartatgattcttttaggtctagttaa

SEQ ID NO: 3321 - DNA, 50 bp, homo sapien
cctggcaatacttttaatcaagctasggtagaataaacctccatatcacc

SEQ ID NO: 3322 - DNA, 50 bp, homo sapien
gcctgtgtaactgaactgctattccsaacatatgtagtttagtaatgtgt

SEQ ID NO: 3323 - DNA, 50 bp, homo sapien
tatctgcatgtagaggatttggaaasgaaggtgatatagtttggatttgt

SEQ ID NO: 3324 - DNA, 50 bp, homo sapien
tagattttatgagaagtaaattcacsattgacatataaaataatttagcc

SEQ ID NO: 3325 - DNA, 50 bp, homo sapien
aaaatcttttcgcagtacatggagasacaaggagcttgaggcagaatata

SEQ ID NO: 3326 - DNA, 50 bp, homo sapien
atttgcttaagcctaaagtattttayaatgcattgctctatatggtagcg

SEQ ID NO: 3327 - DNA, 50 bp, homo sapien
gtcacctcttagtagtgctctaaacratgattaatttaaatgcttaatta

SEQ ID NO: 3328 - DNA, 50 bp, homo sapien
atgtaaaacactttattgtgaatgaygattaatctttatttatacaaatc

SEQ ID NO: 3329 - DNA, 50 bp, homo sapien
ctgaagtcatggaaagaaatctataygttatggacatgtttgcaaatata

SEQ ID NO: 3330 - DNA, 50 bp, homo sapien
ttacactgttgttggaaaatactgayggttgatttttaattctacaactg

SEQ ID NO: 3331 - DNA, 50 bp, homo sapien
tgatactgggcttactaagactgaasagttcctataaccagtaattaaaa

SEQ ID NO: 3332 - DNA, 50 bp, homo sapien
tttgtacaagcttacatagtattatyagcctgaaacaagtagaatttaac

SEQ ID NO: 3333 - DNA, 50 bp, homo sapien
aattaaaacaacaatgtgataccackatacacctattagaatggtcaaaa

SEQ ID NO: 3334 - DNA, 50 bp, homo sapien
atcagaatcctgcctgactcctgaayatgaagtgggaccacagcacaaca

SEQ ID NO: 3335 - DNA, 50 bp, homo sapien
ttttaataagttcatgcttatagtayatgatagcagtttgctctagaaaa

SEQ ID NO: 3336 - DNA, 50 bp, homo sapien
catcattcactgttttctccttataygtaggatgctatagtagatgatgg

SEQ ID NO: 3337 - DNA, 50 bp, homo sapien
ctgccatcacactgtttatgatgagyattgcacttgactggtcatttgtc

SEQ ID NO: 3338 - DNA, 50 bp, homo sapien
agttcacatcataaaagagaagcagratttgacagttcattttttggaca

SEQ ID NO: 3339 - DNA, 50 bp, homo sapien
aatatatatatatatcgaaatttcartcctatatgagaatgtaaaaatgt

SEQ ID NO: 3340 - DNA, 50 bp, homo sapien
gaaacttgaacttcattccatgtaarctaaatgggtaaatatgtaatttt

SEQ ID NO: 3341 - DNA, 50 bp, homo sapien
taatattttgtatgaattgtgacaayagaacataagtcttttattatgtt

SEQ ID NO: 3342 - DNA, 50 bp, homo sapien
agttggtgaaagagcaatataaggamatagatgtttataaactgtcatga

SEQ ID NO: 3343 - DNA, 50 bp, homo sapien
attctgtatttatatcaaagtatgartatcacacaaattgttttgacttt

SEQ ID NO: 3344 - DNA, 50 bp, homo sapien
ctataggattgcactcttctgtatcrcactaattcacaatcatagttaca

SEQ ID NO: 3345 - DNA, 50 bp, homo sapien
acgatgtctgcatttcacagtacaaygtaaatactcagagtgccttcaca

SEQ ID NO: 3346 - DNA, 50 bp, homo sapien
tgctgtactgagaatgtccttgagastaggtgtaactttttgttattcaa

SEQ ID NO: 3347 - DNA, 50 bp, homo sapien
gctttttatttcaattttgtttttayagtctctgtgtactgtcttgacct

SEQ ID NO: 3348 - DNA, 32 bp, homo sapien
agtgcgtaaatagacaygaagaacttaaattg

SEQ ID NO: 3349 - DNA, 50 bp, homo sapien
cattgttacatcctgtggaaaataayagagaaccagactaattgaaatta

SEQ ID NO: 3350 - DNA, 50 bp, homo sapien
acaaaggatttacaatcaggggctayagatttaaggttcagctcctacca

SEQ ID NO: 3351 - DNA, 50 bp, homo sapien
tatcaaaacacattcccagaataaamtatggagagaatgatagaagaatg

SEQ ID NO: 3352 - DNA, 50 bp, homo sapien
ttttctactcaccttggatgcaggarcctctatatgaatttttggatttc

SEQ ID NO: 3353 - DNA, 50 bp, homo sapien
cataatatcttaaaactacatcacawctcaatttttaatactttttatta

SEQ ID NO: 3354 - DNA, 50 bp, homo sapien
agtaggggaacagagccaaattatgkcagcaattattgaaaactatcata

SEQ ID NO: 3355 - DNA, 50 bp, homo sapien
ccacccagggttagattttgggaacrgaggaagagtgaattaaaaagttg

SEQ ID NO: 3356 - DNA, 50 bp, homo sapien
ttcgcctcggctcctgattatttaaygtctcgctatttcattagtaatgc

SEQ ID NO: 3357 - DNA, 50 bp, homo sapien
ctcaagaattattagggaccagaaarcgattttaattatctgcatttcat

SEQ ID NO: 3358 - DNA, 50 bp, homo sapien
cctgatgatgatgatgatgatgaacmagatttgaaggtgttgaaaaaagg

SEQ ID NO: 3359 - DNA, 50 bp, homo sapien
aaattgaggtagataggaacacaacmatgaatattctacaagtacagaag

SEQ ID NO: 3360 - DNA, 50 bp, homo sapien
gctgtcctgtctctgagtagttgccrcagtagccttgctggtgccggagg

SEQ ID NO: 3361 - DNA, 50 bp, homo sapien
acatcagtcctgccacattatggggratataaactgttaagttattccct

SEQ ID NO: 3362 - DNA, 50 bp, homo sapien
tcttgaatggagcgaataagttaaastgtaataagagataagatcagaga

SEQ ID NO: 3363 - DNA, 50 bp, homo sapien
gccttgtatcattaggagttatgccragagcaacctcctctacctaagta

SEQ ID NO: 3364 - DNA, 50 bp, homo sapien
tttttggatgtataaaactgaaatartaattctaccttctatgatttttc

SEQ ID NO: 3365 - DNA, 50 bp, homo sapien
tgcaaactaagagaaatacaacacaratgcaggtatatatgataatacag

SEQ ID NO: 3366 - DNA, 50 bp, homo sapien
gaaacgatggaagtagtaatgctcascgaacagttgactatgccacctga

SEQ ID NO: 3367 - DNA, 50 bp, homo sapien
ctacaattaattcttgttgttctacygagatggcaattgtttttgttgca

SEQ ID NO: 3368 - DNA, 50 bp, homo sapien
acaattcttattcatagtgagaaaaytcaaagataaatcaatggtacaaa

SEQ ID NO: 3369 - DNA, 50 bp, homo sapien
agtgatttatttacatgtacacttaygtttattacaccaagaagttcaaa

SEQ ID NO: 3370 - DNA, 50 bp, homo sapien
gttagtagcagtataagacaatatasgaataggctaagagcttaaaatac

SEQ ID NO: 3371 - DNA, 50 bp, homo sapien
cactgaaaaggatttctgagaacaastaacagattttaactttagaggca

SEQ ID NO: 3372 - DNA, 50 bp, homo sapien
agtataatttcaaaacagactgtgartagttcctaaaatattaggttcaa

SEQ ID NO: 3373 - DNA, 50 bp, homo sapien
cttaagcttgaggtgagttatcggaygtttattttattctaagttgtaca

SEQ ID NO: 3374 - DNA, 50 bp, homo sapien
caggaaaagacacccccatacattawagcgttcaataaatacaggggagg

SEQ ID NO: 3375 - DNA, 50 bp, homo sapien
agagtagagattgcaacttcaaaacygcaagaaggaaaaaatacaatgaa

SEQ ID NO: 3376 - DNA, 50 bp, homo sapien
ctgtaccagaagataaatgttgaaaytaagcaagaactgtattttactca

SEQ ID NO: 3377 - DNA, 50 bp, homo sapien
aaatctaaattataatatggtagtaygaaacatctgtatatccttaaata

SEQ ID NO: 3378 - DNA, 50 bp, homo sapien
ctgaggggattctctatgtttatatwaaaattatcaaaatctaagacaga

SEQ ID NO: 3379 - DNA, 50 bp, homo sapien
ttatgttaatcttttgtattgagaaractcctctctaaggtaatatcaag

SEQ ID NO: 3380 - DNA, 50 bp, homo sapien
taaggtaacacctgaaactgtacaaktactagacaaaaacataggggaaa

SEQ ID NO: 3381 - DNA, 50 bp, homo sapien
ccactctcaccacatctgtccaatayagcactggaagttctagacagagc

SEQ ID NO: 3382 - DNA, 50 bp, homo sapien
tattctagatggtgataatattctaratagtcactcctttcccccctcct

SEQ ID NO: 3383 - DNA, 50 bp, homo sapien
cacaatttgaaatactttaacttaayaggtattgccattttgtgggaagg

SEQ ID NO: 3384 - DNA, 50 bp, homo sapien
aataaacgaatagatatataataacrgtgtacgataaatttaaaaaaata

SEQ ID NO: 3385 - DNA, 50 bp, homo sapien
gttaactaaagtttcagattgaactragacttgagatctagcatttaaga

SEQ ID NO: 3386 - DNA, 50 bp, homo sapien
tataggaaatagtaatgatcttaaaygctagatctcaagtctcagttcaa

SEQ ID NO: 3387 - DNA, 50 bp, homo sapien
agataagaatctttatgaggggttayctacgctactagcagtatttcttt

SEQ ID NO: 3388 - DNA, 50 bp, homo sapien
tcctgacacattcagtaaatatccayggaggactctgatttagccaggcc

SEQ ID NO: 3389 - DNA, 50 bp, homo sapien
atcatcgattcatgattcacctgcartaacataaatagaatagccacggt

SEQ ID NO: 3390 - DNA, 50 bp, homo sapien
tttgacagcaagaaaatcgagatgaygggaaaggccagttctgtagagaa

SEQ ID NO: 3391 - DNA, 50 bp, homo sapien
aatatctgcaaggtttccattttcckgacagaaacaattacaaatgccat

SEQ ID NO: 3392 - DNA, 50 bp, homo sapien
aatgtaaaaagaaagccaaatagaargataggtagaacctgttcagaaaa

SEQ ID NO: 3393 - DNA, 50 bp, homo sapien
actgggtgggcttctgtcaaaaaccrggcctctatcagaactacaatgca

SEQ ID NO: 3394 - DNA, 50 bp, homo sapien
agcagtcacggaaggcaaaccacaayctttgtagcaattagccccagtgg

SEQ ID NO: 3395 - DNA, 50 bp, homo sapien
aaaacataacaggaagtaaaatgacmacatggtttaccctagaaattttt

SEQ ID NO: 3396 - DNA, 50 bp, homo sapien
tagatcctaaaggatggatttagatraaggtgcgatatttgagtcaggca

SEQ ID NO: 3397 - DNA, 50 bp, homo sapien
ggtgataaatgcaggattagggaaargttttgattattataatgggtccc

SEQ ID NO: 3398 - DNA, 50 bp, homo sapien
gaaaatattgattgaaagtgttagaygtaaatgaatgaaagtgctattat

SEQ ID NO: 3399 - DNA, 50 bp, homo sapien
ctgaaagggactttgggtactaataygatcagggcaaataggaatgtctt

SEQ ID NO: 3400 - DNA, 50 bp, homo sapien
agcatagcaatttctttttcatctayacaaagtcagaaagtaaagtggct

SEQ ID NO: 3401 - DNA, 50 bp, homo sapien
ggaaaaaagaagcaacctataaaacygtcctgtagcggcctagatgcaat

SEQ ID NO: 3402 - DNA, 50 bp, homo sapien
tcagaataataataaaaatatcacamaatttcacaaaaagcttagcaatg

SEQ ID NO: 3403 - DNA, 50 bp, homo sapien
caagctgcagatacatttagctgcawcaaaaataaaatacccattgcctt

SEQ ID NO: 3404 - DNA, 50 bp, homo sapien
tgtccctctctgcagcctctaagccrctcattgtttccttcatagcattt

SEQ ID NO: 3405 - DNA, 50 bp, homo sapien
tttaccatggaaagaaagtcacattraaagaattctgatgagggtcagaa

SEQ ID NO: 3406 - DNA, 50 bp, homo sapien
ggtggcctgcctgaggatgagcctcrcttatttgttttactatctgggtg

SEQ ID NO: 3407 - DNA, 50 bp, homo sapien
ttatatgaaaagtgtttttgacacayctcagtattttccatttaatatat

SEQ ID NO: 3408 - DNA, 50 bp, homo sapien
aaatattcattgtctttgacccataygttgttattgctttaaaaaattca

SEQ ID NO: 3409 - DNA, 50 bp, homo sapien
atacacgtttgtagctacactttaaracatttcagctcttttctcatttt

SEQ ID NO: 3410 - DNA, 50 bp, homo sapien
catggtgtcatccctcctagtgacarggtttggagacatttagtccattc

SEQ ID NO: 3411 - DNA, 50 bp, homo sapien
tttcaagggcacttagcagctagaaraagattataaatacagacagattt

SEQ ID NO: 3412 - DNA, 50 bp, homo sapien
gtatatatacagttttcagtttacaycaaatgctactcagttaaggttga

SEQ ID NO: 3413 - DNA, 50 bp, homo sapien
atttctttccctctgggtatttttcwacattgagttcttcaagcttaact

SEQ ID NO: 3414 - DNA, 50 bp, homo sapien
cctgggctttagtccttcgaattcarctggagacatttcatatgctgtga

SEQ ID NO: 3415 - DNA, 50 bp, homo sapien
atgcataaaaatagccgtgagagaartaacaggtggaaggatcaggagtg

SEQ ID NO: 3416 - DNA, 50 bp, homo sapien
ttaacgtataccaaacattacagaayttaggtctaaaagtaaggttctgc

SEQ ID NO: 3417 - DNA, 50 bp, homo sapien
agttaaaatgaatcagtaggaataaytcaatcaaaagtaaaggaaaaatc

SEQ ID NO: 3418 - DNA, 50 bp, homo sapien
gggagctactgaataattttcagccraagagcgacttgacctgacgtgaa

SEQ ID NO: 3419 - DNA, 50 bp, homo sapien
tttcttaatataaactcttcttctawgtttagcaactaatgaatttaatt

SEQ ID NO: 3420 - DNA, 50 bp, homo sapien
aggcttgatgcatttagaaattttamagtgaactgagacccagcacctaa

SEQ ID NO: 3421 - DNA, 50 bp, homo sapien
attccacattctctggagtatctaarggtcattatcttccaatgttaaag

SEQ ID NO: 3422 - DNA, 50 bp, homo sapien
atacaattttttgtagcaataaaccmactcttgcttgcaaatagaatcta

SEQ ID NO: 3423 - DNA, 50 bp, homo sapien
tacatgctctgatgtgtatgaagtawctgcgaacactgattcatttacca

SEQ ID NO: 3424 - DNA, 50 bp, homo sapien
atattttttattgtatgctcatttawccacaacgataattctttcactgg

SEQ ID NO: 3425 - DNA, 50 bp, homo sapien
aaaatctgtgtgtgtttgcagaatartagagtgaaaaggatgctcggggg

SEQ ID NO: 3426 - DNA, 50 bp, homo sapien
agaggaaataataaagcattagaaamctgattggctagaatgaaacatta

SEQ ID NO: 3427 - DNA, 50 bp, homo sapien
ggatagatagttttagtgaaatacayaaagcattcatattacatttttaa

SEQ ID NO: 3428 - DNA, 50 bp, homo sapien
aataaaaaatttacagtaaacactcrcatatttaatttgtacactgaaac

SEQ ID NO: 3429 - DNA, 50 bp, homo sapien
agcagacagaccagagctgggaaaaygcaagtccatttgtaggaaattca

SEQ ID NO: 3430 - DNA, 50 bp, homo sapien
tgattgttaacctgaagttacaccawggcaatttgatcttttggtgcttt

SEQ ID NO: 3431 - DNA, 50 bp, homo sapien
ctaatttctagggctcttcattggcyataaagtgaaggtttagaaaaatg

SEQ ID NO: 3432 - DNA, 50 bp, homo sapien
acatgtttaggtgtaaagtgaacgartagcacagcagttgggaaatgaac

SEQ ID NO: 3433 - DNA, 50 bp, homo sapien
ttgagctctgcttcaggtaatgtcasgtaatgatgatatcccaagaaatc

SEQ ID NO: 3434 - DNA, 50 bp, homo sapien
accttttaatgcttaaagacagagartaaggcttcctggcaaagggaaca

SEQ ID NO: 3435 - DNA, 50 bp, homo sapien
agaggccctccacagatagagaaccygatattggactttctagtctctgt

SEQ ID NO: 3436 - DNA, 50 bp, homo sapien
taagaaaaattgacatggacaaaaakactctgatttcctcatgtttacat

SEQ ID NO: 3437 - DNA, 50 bp, homo sapien
aatattttagttcaggcgaagcggaragacaaattatttgtaaaaaatgt

SEQ ID NO: 3438 - DNA, 50 bp, homo sapien
tcgggcatctactataacaggaactsaacatatgattctaataacattgt

SEQ ID NO: 3439 - DNA, 50 bp, homo sapien
ctttattatttcctctcttcacctargaaatacatctaatgcttctatca

SEQ ID NO: 3440 - DNA, 50 bp, homo sapien
tattaaataaaagaaaatttgagacsgctataaatatggacaatgtgtct

SEQ ID NO: 3441 - DNA, 50 bp, homo sapien
actaggggtttacaatcttctgtaartgtaaggcagacatgagttttttc

SEQ ID NO: 3442 - DNA, 50 bp, homo sapien
tgactgagaaaatattttgctgaaartctgatttaaacactacctttctg

SEQ ID NO: 3443 - DNA, 50 bp, homo sapien
aagttgctagttctgtgacattgaaygaattatctaatctctctggactt

SEQ ID NO: 3444 - DNA, 50 bp, homo sapien
agttgtaaatgtttaaatcttggtaygatacagagatgattaaagtccta

SEQ ID NO: 3445 - DNA, 50 bp, homo sapien
ctggttggccaaattgtctctacgawccagaataagaactgaacaattgt

SEQ ID NO: 3446 - DNA, 50 bp, homo sapien
tatgagaatttccctcactgtgaaargttttcctgtccatcttctgtact

SEQ ID NO: 3447 - DNA, 50 bp, homo sapien
agagggccttcaccagaaacaagacrctgaattgactggcaccttgatct

SEQ ID NO: 3448 - DNA, 50 bp, homo sapien
ataatcagcatttagtgttatgttargacgaaggatttattccacaatat

SEQ ID NO: 3449 - DNA, 50 bp, homo sapien
atgcagaaaaactagcacttttttayggaatgtgatatggtcaattaaaa

SEQ ID NO: 3450 - DNA, 50 bp, homo sapien
ccttgaatgcaacaaaaatttggtakatatctttgtggcttagacaacag

SEQ ID NO: 3451 - DNA, 50 bp, homo sapien
ccaggaggcagagtctgggaattcayaagtctcctctcaagacatatact

SEQ ID NO: 3452 - DNA, 50 bp, homo sapien
gttgcttttgtatttgacttacagaygaactcttgtattaaaattttgat

SEQ ID NO: 3453 - DNA, 50 bp, homo sapien
taaagccagcattgctcttactaaaygtgatgagaacagatcttttgttt

SEQ ID NO: 3454 - DNA, 50 bp, homo sapien
ccagatcaaaactaagtacatattayagagaattcaaatacacaagatag

SEQ ID NO: 3455 - DNA, 50 bp, homo sapien
cagcataaattttatatcattacagrcctattaatacatcttccctagga

SEQ ID NO: 3456 - DNA, 50 bp, homo sapien
aaacatattttattgcttaaaaataytaaccgtcatctgagccttaagtg

SEQ ID NO: 3457 - DNA, 50 bp, homo sapien
tgattttatttgatttatatttgaaygacaatggtttcagagctctgaat

SEQ ID NO: 3458 - DNA, 50 bp, homo sapien
gaattagtcattgctgagaccataarcattgtagtatgaattcaatttgc

SEQ ID NO: 3459 - DNA, 50 bp, homo sapien
ttccaggacaggaaaggttttgaacragtgattgattaatactattagaa

SEQ ID NO: 3460 - DNA, 50 bp, homo sapien
attcttttaacatttagaacaattcygaagctaatatcaagaaacttttt

SEQ ID NO: 3461 - DNA, 50 bp, homo sapien
tttcttcttaatcaacagtttggtayaattcatgaacctgaatatttctc

SEQ ID NO: 3462 - DNA, 50 bp, homo sapien
aaaggacgtctgagcccagggattaygcctaatgctgctggaatcccagg

SEQ ID NO: 3463 - DNA, 50 bp, homo sapien
taatttcaaggaaataatttgattgmagtagacttaaggcaatattgtat

SEQ ID NO: 3464 - DNA, 50 bp, homo sapien
tgacattgaagaacaaagtgaaaagkatcataatgatgcagaagaagaac

SEQ ID NO: 3465 - DNA, 50 bp, homo sapien
atcgcaacagttatgctgaggtaaamatgattatgtgtattccagactta

SEQ ID NO: 3466 - DNA, 50 bp, homo sapien
gtaagatacataggttctagataatraggcaccaaatcaaagccaaggag

SEQ ID NO: 3467 - DNA, 50 bp, homo sapien
atgatctaatgatgtgtcactgggasatgaagaaaagtaaaggctaatat

SEQ ID NO: 3468 - DNA, 50 bp, homo sapien
tacatatacttctctggtacttttayggacaaattttcaatcttggatgt

SEQ ID NO: 3469 - DNA, 50 bp, homo sapien
tattgacactctggagtctttcatarcaaatacatgatctaatgatgtgt

SEQ ID NO: 3470 - DNA, 50 bp, homo sapien
tagtatttatcactggaattaaaccrgcatataaatcaaagctctacatg

SEQ ID NO: 3471 - DNA, 50 bp, homo sapien
aagtctgtttttcttggacagtagtraagtttaaattgtgtatttctaag

SEQ ID NO: 3472 - DNA, 50 bp, homo sapien
ctcatgactccgggaggtgatcagtyacacatcttggtctggagtagagg

SEQ ID NO: 3473 - DNA, 50 bp, homo sapien
cataaaacgtgcatgcaaggcattcraaattcgccaagaaaaaaatattt

SEQ ID NO: 3474 - DNA, 50 bp, homo sapien
agaaaattaaagatttgcctgctaawgtgcatgaattctagtcacaaata

SEQ ID NO: 3475 - DNA, 50 bp, homo sapien
tgagaacactgccagcctatgtgtasaggcccagtccagaatgatgtctg

SEQ ID NO: 3476 - DNA, 50 bp, homo sapien
cccacaaggcatggtgataattgaayattttgatgggcaattaaaagaca

SEQ ID NO: 3477 - DNA, 50 bp, homo sapien
aaactcatgcatgttaatgatgtccraagaaaccagaaaaaataagacag

SEQ ID NO: 3478 - DNA, 50 bp, homo sapien
tgttttgtaccataattctaatggawaagctccataactccatgcccagt

SEQ ID NO: 3479 - DNA, 50 bp, homo sapien
tgaggtatttttatatgcacatttcratttttcataagatcaggaaagta

SEQ ID NO: 3480 - DNA, 50 bp, homo sapien
aacaaaactattagataatctatacygtaagtgtttagttttccctagtt

SEQ ID NO: 3481 - DNA, 50 bp, homo sapien
tcttctctagcagtaataaacaaaaygaatccgaaaattataaaagaaaa

SEQ ID NO: 3482 - DNA, 50 bp, homo sapien
ctcattgggggtgagtggagatgcarctacaaagtctgtattgggatgta

SEQ ID NO: 3483 - DNA, 50 bp, homo sapien
tctttcaagttctatatattgtacckggagtagaaaactttgtaagaaca

SEQ ID NO: 3484 - DNA, 50 bp, homo sapien
tacagtccagaatttctatgtaagtmaacccatttggataaattcatcct

SEQ ID NO: 3485 - DNA, 50 bp, homo sapien
ttcatttctagttatcaagataacayaatgaatctacagtccagaatttc

SEQ ID NO: 3486 - DNA, 50 bp, homo sapien
aaagttgagttgatcaatctacttayagaaaacgacttatgcaattgaga

SEQ ID NO: 3487 - DNA, 50 bp, homo sapien
actatcaatacgttagagctaaaagrctttatatcagatcttcccaatca

SEQ ID NO: 3488 - DNA, 50 bp, homo sapien
attgtagaaacaaatttgtcgtaagkatctgagtaagtcacaatttataa

SEQ ID NO: 3489 - DNA, 50 bp, homo sapien
aaggatttcccaaatggctatatcawatatcaatttacaacattttccaa

SEQ ID NO: 3490 - DNA, 50 bp, homo sapien
tccagacattcctttttattcataayaactcaatcaattgccaatcagaa

SEQ ID NO: 3491 - DNA, 50 bp, homo sapien
cagtaataagtgtattcattttttasgaaaggcttcaactggtacaaagg

SEQ ID NO: 3492 - DNA, 50 bp, homo sapien
acataatttatttcacacaattaaayactgacagctaaaaagaaaatagc

SEQ ID NO: 3493 - DNA, 50 bp, homo sapien
aggaaatgacaaccctttgtccaaamctccttatttctaaaagtttctaa

SEQ ID NO: 3494 - DNA, 50 bp, homo sapien
ccatgcaaagcctaagtgcataaaawttgaattaataactaaaaaattat

SEQ ID NO: 3495 - DNA, 50 bp, homo sapien
tggtttgtggttcatcttaggctaayatacgcctttatgtgtacctcttt

SEQ ID NO: 3496 - DNA, 50 bp, homo sapien
ctcaatagaaatgttaatctcataasagttctggctgtagtcatggccag

SEQ ID NO: 3497 - DNA, 50 bp, homo sapien
agactgttactcaatcgtaaaagtcygacacggctggtcacagtggctca

SEQ ID NO: 3498 - DNA, 50 bp, homo sapien
ttacaaagggtcattgtgtcacatamcttgcccgtatcctgaatagatcc

SEQ ID NO: 3499 - DNA, 50 bp, homo sapien
gcatgccaactccacaggcattgcamaacaaaataatatgagccactgga

SEQ ID NO: 3500 - DNA, 50 bp, homo sapien
ataattttcatcagagcaggttatayacagaatagtttagctaacaattt

SEQ ID NO: 3501 - DNA, 50 bp, homo sapien
agtacctgagctcccaggatgagaartaccaggccattggggcctattac

SEQ ID NO: 3502 - DNA, 50 bp, homo sapien
tcaatatttattgagtatctattacragcaatcccctcttctaggtatct

SEQ ID NO: 3503 - DNA, 50 bp, homo sapien
tactgcacagccttggggatggtcarcccactgcactcgatgtcctcact

SEQ ID NO: 3504 - DNA, 50 bp, homo sapien
ggaaaagatgcagactcgcaggacamagaagaccctgaagataggagact

SEQ ID NO: 3505 - DNA, 50 bp, homo sapien
tctcactataacaaatggctttcaaycattctttgcatcgatgacttcct

SEQ ID NO: 3506 - DNA, 50 bp, homo sapien
ctagtagtcaagatatttttatcaaygtatctgcaattaccaaagaaata

SEQ ID NO: 3507 - DNA, 50 bp, homo sapien
aaaaaacctgagccccagacacttaygtgagattgaccctttatgaactg

SEQ ID NO: 3508 - DNA, 50 bp, homo sapien
catgttctctatacattaattattasagactacacaaatagaaagcaatt

SEQ ID NO: 3509 - DNA, 50 bp, homo sapien
ggagaaagaggatttcaaaggctcawaaaaggtcaattgtttgcccaagg

SEQ ID NO: 3510 - DNA, 50 bp, homo sapien
gacttcccatcatgaactttaaaaaraaacatgattcagcaattaaatgt

SEQ ID NO: 3511 - DNA, 50 bp, homo sapien
ggagcacgcaggccacccaaggatgraaagcacttactcctcccgcgcca

SEQ ID NO: 3512 - DNA, 50 bp, homo sapien
tttctgatttcagtaaaatatctaargctcgttgcagtgctgaaataaat

SEQ ID NO: 3513 - DNA, 50 bp, homo sapien
ccgtcttcgagtgagggggatgaaaygcaggactgaccaccaagacggtg

SEQ ID NO: 3514 - DNA, 50 bp, homo sapien
tttctctagcatgaaagactttctargtaagaactctccctgttatatat

SEQ ID NO: 3515 - DNA, 50 bp, homo sapien
gctgtgaagttcagccatctgatttsaaaagtgcatttatagatggaaat

SEQ ID NO: 3516 - DNA, 50 bp, homo sapien
tactattttatatgcatcaaaagaaygggcaagaagttgattttattcat

SEQ ID NO: 3517 - DNA, 50 bp, homo sapien
ttctagtcagaagcactgagagaaamtaaatggtcttctaaattattgtt

SEQ ID NO: 3518 - DNA, 50 bp, homo sapien
gagaggcataacctctaaagatgaasagtccagcagagataagcttgggg

SEQ ID NO: 3519 - DNA, 50 bp, homo sapien
ctggagattcagggaattgtaggagmacatggaacatgcctgaatctgaa

SEQ ID NO: 3520 - DNA, 50 bp, homo sapien
gaagtgcagaggaggagcatgatcasatttgggttttaaaaagcttgagg

SEQ ID NO: 3521 - DNA, 50 bp, homo sapien
gtatcttgccacctaaactcctaaasgtcaatgatgatgttttgatcata

SEQ ID NO: 3522 - DNA, 50 bp, homo sapien
gttcattaagcatccatggacagaargaagaatgaataagtgaaagcttt

SEQ ID NO: 3523 - DNA, 50 bp, homo sapien
tctacctatggcaaatggagcccgaraatacaggtgcgggtccttgggat

SEQ ID NO: 3524 - DNA, 50 bp, homo sapien
atagagtttgtgatctcagtgatcartattattttttctgctcaaactcc

SEQ ID NO: 3525 - DNA, 50 bp, homo sapien
aatacgtgtgagactgaagtttcccragatgaaagaatgctaggcattat

SEQ ID NO: 3526 - DNA, 50 bp, homo sapien
ctcctctttggccattaacatttacrgaattaaaggaagtttcagttaca

SEQ ID NO: 3527 - DNA, 50 bp, homo sapien
actgaagtttctttgtgagtcttatmaaacaaatttctgctatcatgtgg

SEQ ID NO: 3528 - DNA, 50 bp, homo sapien
aatggcccccaaaatacacaaaactraaattgctggactacagggaaaaa

SEQ ID NO: 3529 - DNA, 50 bp, homo sapien
tgaatagaaactactgttgctctaakgtggagataatgcttccttatttt

SEQ ID NO: 3530 - DNA, 50 bp, homo sapien
gcctcaatatgttttagttatgtaaygcacattgcgaatggacccttgtg

SEQ ID NO: 3531 - DNA, 50 bp, homo sapien
ctacatttatctaaggcctcttctcmacctgtcatctccaaaaggcctgt

SEQ ID NO: 3532 - DNA, 50 bp, homo sapien
atatactaaaatgttggtatatttgraatttatttcgttgttaggtctgg

SEQ ID NO: 3533 - DNA, 50 bp, homo sapien
caatacagaagctgtaaaaactgccrccaactgaccagggcaccataatg

SEQ ID NO: 3534 - DNA, 50 bp, homo sapien
agtctgcaattaccttgtttgctatsaggttctcctgtttaaaacatgtg

SEQ ID NO: 3535 - DNA, 50 bp, homo sapien
ctggcccctctctagattgtgaatayagttgttttggaatgatagcatta

SEQ ID NO: 3536 - DNA, 50 bp, homo sapien
ttgtgttttttgttgttattgtgtcmaaaaatgttaaggagcagtgtcta

SEQ ID NO: 3537 - DNA, 50 bp, homo sapien
ttaaaattgctaagtggaatagataygatttcctcaaaatcattaggtca

SEQ ID NO: 3538 - DNA, 50 bp, homo sapien
gatccaagttggcaataaatcaaaakaggtcgctagtaagaacagcaaag

SEQ ID NO: 3539 - DNA, 50 bp, homo sapien
gttagttattagcacagctcagtcargaaagtctatggcctgctccaggg

SEQ ID NO: 3540 - DNA, 50 bp, homo sapien
agagaattgttggttatctgtaaatsatcttccctcttcaaatcccaaac

SEQ ID NO: 3541 - DNA, 50 bp, homo sapien
ctgtctcataaaaacataggtgacaytgattaacatattttctactatct

SEQ ID NO: 3542 - DNA, 50 bp, homo sapien
cagtattatattcttgacttcctaaktgagatagtagaaaatatgttaat

SEQ ID NO: 3543 - DNA, 50 bp, homo sapien
tcttccctcatctgaacaactaatgracctcatgtggataactataaaat

SEQ ID NO: 3544 - DNA, 50 bp, homo sapien
tggggaaagactgtgtggtaaagcaygttatttcccagattgggtttata

SEQ ID NO: 3545 - DNA, 50 bp, homo sapien
ttaggggcttcaggagaatcaacacragagcttatacaccagggaacagt

SEQ ID NO: 3546 - DNA, 50 bp, homo sapien
ggtaccatttgggctgcttatttcartcctacctcttacctttcagtcta

SEQ ID NO: 3547 - DNA, 50 bp, homo sapien
tatgaaagccattgtataaagaaaargcagcatttaatgattttggaagc

SEQ ID NO: 3548 - DNA, 50 bp, homo sapien
gtatgatttttcttaatacaatgaarcaccttagcatcttaatattcaag

SEQ ID NO: 3549 - DNA, 50 bp, homo sapien
agggattattaaataaccaggtgcckcgggttggagcacttctcccttga

SEQ ID NO: 3550 - DNA, 50 bp, homo sapien
tttaaattatatcttctttgaaaaartgtgaatcaactcatgagaatgat

SEQ ID NO: 3551 - DNA, 50 bp, homo sapien
gtgaatttgactctgagcttcctagyatccaaagcaaagttgcatcagct

SEQ ID NO: 3552 - DNA, 50 bp, homo sapien
ttattagtttttcttcaaaaatgccrataaactgacttaactcagttaaa

SEQ ID NO: 3553 - DNA, 50 bp, homo sapien
gaaggacaggtgggctttattcaaawgtagaatatgctagaagaagcatc

SEQ ID NO: 3554 - DNA, 50 bp, homo sapien
ttggggaaaataactggcgtgatagrataaacaaatatctcaagttgaat

SEQ ID NO: 3555 - DNA, 50 bp, homo sapien
tgacatattctatcacctgtttggaygttgttatttcttatatataaact

SEQ ID NO: 3556 - DNA, 50 bp, homo sapien
caatagtgtctattcaatgacactcraaaatagtttctatactatataat

SEQ ID NO: 3557 - DNA, 50 bp, homo sapien
aaacttattttgataattaagcatargatgccagaaaaatgcttgaaact

SEQ ID NO: 3558 - DNA, 50 bp, homo sapien
aagtaatttatgatgaagattttaaygggaaaacagtagataattgcatg

SEQ ID NO: 3559 - DNA, 50 bp, homo sapien
gtgagccaccttgccaggccaaatcrcaatcttttttacatatagcctca

SEQ ID NO: 3560 - DNA, 50 bp, homo sapien
cctgtcaaattatgaaatcttcaaaygtgaatatattttcatatatattt

SEQ ID NO: 3561 - DNA, 50 bp, homo sapien
taatatatctatatacttcggtagcrattatagtatattgttttcaatgc

SEQ ID NO: 3562 - DNA, 50 bp, homo sapien
taactcagcaaaatactgagattcamatcaatatgaaatataaaccaaat

SEQ ID NO: 3563 - DNA, 50 bp, homo sapien
cataaaaaaagttggacttaaaaaayagagatgctatagtatatgcagac

SEQ ID NO: 3564 - DNA, 50 bp, homo sapien
ctgaatgggttgttacgctgataaakttaattgtgttagaaacataatta

SEQ ID NO: 3565 - DNA, 50 bp, homo sapien
aaatttattgaaatatctactatacrctaggcattaatgttagatgttgt

SEQ ID NO: 3566 - DNA, 50 bp, homo sapien
cgcagaccacatatgggtactttaaraatataagcagtctgggccaggtg

SEQ ID NO: 3567 - DNA, 50 bp, homo sapien
tttaggtaatttagaagcggaatcayatataaacatttccaaattgtatt

SEQ ID NO: 3568 - DNA, 50 bp, homo sapien
caagtactcaaagagaatagaaataragtcaagataacttatggcacaat

SEQ ID NO: 3569 - DNA, 50 bp, homo sapien
gaatatgcccatatactttaaatagycccttctctctctacagtacataa

SEQ ID NO: 3570 - DNA, 50 bp, homo sapien
tctaagattctgcagtttataaccarcaggcccagagtttaggttttcag

SEQ ID NO: 3571 - DNA, 50 bp, homo sapien
ttttctcatgctgtgctcaaccaacrattgctaaatgatgttgaagttca

SEQ ID NO: 3572 - DNA, 50 bp, homo sapien
aatctgattttacccatagttcttaygactcaggtgaaatacatattgct

SEQ ID NO: 3573 - DNA, 50 bp, homo sapien
tttttatttctctatatgccaaacaratgtgaaagagcttagtttgattt

SEQ ID NO: 3574 - DNA, 50 bp, homo sapien
ttgctcttactaaggtcttggcttamcaagaaggtgcttctgaaaccatc

SEQ ID NO: 3575 - DNA, 50 bp, homo sapien
taatgattttaaaagtgcatgttaartacttgatggattggatcaattca

SEQ ID NO: 3576 - DNA, 50 bp, homo sapien
aacaagagtgaagactccttactcargtgaaatggacttactaggagaga

SEQ ID NO: 3577 - DNA, 50 bp, homo sapien
tactctgacttctttatctttccgasgtttcaccaaaagtctatacagtc

SEQ ID NO: 3578 - DNA, 50 bp, homo sapien
taatcttattactagtggcccaagcyattgatataaaatatcatcttaaa

SEQ ID NO: 3579 - DNA, 50 bp, homo sapien
tgtggaaagatacactccagagacawcctagtgatataactttccaaaat

SEQ ID NO: 3580 - DNA, 50 bp, homo sapien
gatgtggctgtgcagttggaagatgyagacgcgcctcgcttggtgctgcc

SEQ ID NO: 3581 - DNA, 50 bp, homo sapien
tcaaggaagtaaggttctggaaaaartgtattcaggtgagttcaacatct

SEQ ID NO: 3582 - DNA, 50 bp, homo sapien
atcttagtaatttttgctagcctaakgtagtgtgtaatggtacctcattg

SEQ ID NO: 3583 - DNA, 50 bp, homo sapien
agtgtattatacttattttcaagcayatttctggtaatttcaatatcttc

SEQ ID NO: 3584 - DNA, 50 bp, homo sapien
agaattaggagcaaaacaaatctacraatcaagaaatgcctaatagccaa

SEQ ID NO: 3585 - DNA, 50 bp, homo sapien
tccatagtaacaccagaaagaggacygaaatatatgaagattaaaagcta

SEQ ID NO: 3586 - DNA, 50 bp, homo sapien
gatgaacaaaaactattttaggctaygtgaaaacaagaatgcaacttatc

SEQ ID NO: 3587 - DNA, 50 bp, homo sapien
cttacgtgcacacagtcaattcaacyatatgggagtcaaaaataaggaag

SEQ ID NO: 3588 - DNA, 50 bp, homo sapien
agtaaatagtaaacagtcatatgtayagaaccaaataaagttatatgctg

SEQ ID NO: 3589 - DNA, 50 bp, homo sapien
gccaaaaggaatactgttgagttcartaatagtaaaattgaaagtctcaa

SEQ ID NO: 3590 - DNA, 50 bp, homo sapien
cagacaagtaaaaattacacacagaraaagtgacattaatagaaaagcac

SEQ ID NO: 3591 - DNA, 50 bp, homo sapien
atactttaccattctctttggtttaygatacatgggaaaggacacaacta

SEQ ID NO: 3592 - DNA, 50 bp, homo sapien
gcaagcattatctcagaagaacaaamagcacatttctccttgacatgttt

SEQ ID NO: 3593 - DNA, 50 bp, homo sapien
ctgggtaacataatgtccaaataaarttgattaaatcaaagaagttgata

SEQ ID NO: 3594 - DNA, 50 bp, homo sapien
tgtataaaaatcattaaaattagacragactgttaccaattacagtaact

SEQ ID NO: 3595 - DNA, 50 bp, homo sapien
acttgtttgaagagtgacacaagaaycgagagcagagaaatgaagagtta

SEQ ID NO: 3596 - DNA, 50 bp, homo sapien
gaggacagtaaaaacatgtaagtaargttagtcaaatgtttgagactatt

SEQ ID NO: 3597 - DNA, 50 bp, homo sapien
atcttaggttataagatcagtgatarcattacctttctttaccacctatt

SEQ ID NO: 3598 - DNA, 50 bp, homo sapien
aaaccctgacactttggacatttcaraagttaaaataattgtataccctt

SEQ ID NO: 3599 - DNA, 50 bp, homo sapien
aaagaaaagagaaaacatttgaggaratcatgtctgaggatttttcagaa

SEQ ID NO: 3600 - DNA, 50 bp, homo sapien
cttgtgtataagaagtgattgataartaattgctggattcttttaagcat

SEQ ID NO: 3601 - DNA, 50 bp, homo sapien
tgttctggcctacagttcctctcaayctgagtagtgctcttttgcgactg

SEQ ID NO: 3602 - DNA, 50 bp, homo sapien
taacatattttttcttgctttcaaartctctggatatctatgtgcatgga

SEQ ID NO: 3603 - DNA, 50 bp, homo sapien
aactagatattatttttgttgtatawcactttccagattatttttacttt

SEQ ID NO: 3604 - DNA, 50 bp, homo sapien
tgaacatcctgcaacagaatcttaarggaagaaaactgaacttaaagagg

SEQ ID NO: 3605 - DNA, 50 bp, homo sapien
aataatttcgaggcattcattttcaytagaaagcaccaagttagagactc

SEQ ID NO: 3606 - DNA, 50 bp, homo sapien
gcaattttcttcgacaaagtacatcratggctcaaataactgaacatgta

SEQ ID NO: 3607 - DNA, 50 bp, homo sapien
gaattactcaggctgttgagaaatasactaaaggttccttattagcatta

SEQ ID NO: 3608 - DNA, 50 bp, homo sapien
tttcttagcatctattctctccttaycaactttgagagtcagagaggtag

SEQ ID NO: 3609 - DNA, 50 bp, homo sapien
ccgaacattttaactaatgtgcaaayatattctcaaacggcctccgaaac

SEQ ID NO: 3610 - DNA, 50 bp, homo sapien
atgaaagcatctgcttggtgctgggyacgtagagcttgagttctgggtct

SEQ ID NO: 3611 - DNA, 50 bp, homo sapien
atctagacttgtatttgactaaacarctgggtatcgtagcctagccaagt

SEQ ID NO: 3612 - DNA, 50 bp, homo sapien
acccctcttattccagtactttacayctatgcctagtttattctaagtcc

SEQ ID NO: 3613 - DNA, 50 bp, homo sapien
taataaaaaatggaaaaataaagacwcatatccagttagaagaaaaatta

SEQ ID NO: 3614 - DNA, 50 bp, homo sapien
gaggttgctatagttgattgttagartactgggagtaaggaggtatttag

SEQ ID NO: 3615 - DNA, 50 bp, homo sapien
aatgccccctgtcctttgtttatcaygctgtgccacatttgtctcctcta

SEQ ID NO: 3616 - DNA, 50 bp, homo sapien
aaggtaaaataaaaagcatatggaaygtccttagaaaagaaaagacacag

SEQ ID NO: 3617 - DNA, 50 bp, homo sapien
tgcagttaaatgaagtcaagggctayacaaagcaaggccacgaagcaagc

SEQ ID NO: 3618 - DNA, 50 bp, homo sapien
aggtaagcattgctcttttcctgtaygtattttttaaatgcccatgttcc

SEQ ID NO: 3619 - DNA, 50 bp, homo sapien
ccaataatagctggtcattttgagcygaattttcctacctgttacattac

SEQ ID NO: 3620 - DNA, 50 bp, homo sapien
ttagtagatacggaaactaaggctcrgagaagtagctttcccaaggtcta

SEQ ID NO: 3621 - DNA, 50 bp, homo sapien
taattcagataaacccctttgtccartagaagttgagcaatcattttcaa

SEQ ID NO: 3622 - DNA, 50 bp, homo sapien
tgatggggatagtctctgtttagcayggctgtagtctagacctctttttt

SEQ ID NO: 3623 - DNA, 50 bp, homo sapien
tgctaatagtttccatgacttcaackctcacttttgcttctatcactgac

SEQ ID NO: 3624 - DNA, 50 bp, homo sapien
cctctcttcttcccaatgtcatggaygatgaaaagaactggcctcatatg

SEQ ID NO: 3625 - DNA, 50 bp, homo sapien
ccaaggatgagatcagcctggactcrcgtacccctgagagctgccagctt

SEQ ID NO: 3626 - DNA, 50 bp, homo sapien
tcttggtgtttgtatgaaattctgargccctgatttaaatctttcattgt

SEQ ID NO: 3627 - DNA, 50 bp, homo sapien
ctactcagtctatttttctcattcaraggatctgctgttcctaaagcttt

SEQ ID NO: 3628 - DNA, 50 bp, homo sapien
catcttacggaagccaaagcaaagasgatggctatttttaacttgaggca

SEQ ID NO: 3629 - DNA, 50 bp, homo sapien
ttaaaacatgaacaaagcctttgagragtatcaagttatgtaaaacacca

SEQ ID NO: 3630 - DNA, 50 bp, homo sapien
tttacttaaaaccaattactagttcmatctaccaggaagaaagcctaagg

SEQ ID NO: 3631 - DNA, 50 bp, homo sapien
ggaagcaatcatggtcaaagatgacraaaagttaaacctaagaggaagca

SEQ ID NO: 3632 - DNA, 50 bp, homo sapien
atgactcataaaaatgtagactcagmcatagattttaatttatatgcctt

SEQ ID NO: 3633 - DNA, 50 bp, homo sapien
gtaatatgaaatgctggggtagtcayactagaagggaactttcaagtttc

SEQ ID NO: 3634 - DNA, 50 bp, homo sapien
gaagctttgtttgattattccaatamacaatgtctgttctttccttttat

SEQ ID NO: 3635 - DNA, 50 bp, homo sapien
tacaaaggtgaacctggcaatgcttraaaactggctctaaatgcagccaa

SEQ ID NO: 3636 - DNA, 50 bp, homo sapien
cactcgacacagcccatggcacataraaagactccaaaagcctgagctat

SEQ ID NO: 3637 - DNA, 50 bp, homo sapien
ttaagtttctctcatacactgaagaygttagactcccttggggattttat

SEQ ID NO: 3638 - DNA, 50 bp, homo sapien
ccttgagaggaggaaatgatacttayaaagttttggacacacggcaattg

SEQ ID NO: 3639 - DNA, 50 bp, homo sapien
ctagtgaaccccacacaaaccaaccyggtcctgagagatggacacacagg

SEQ ID NO: 3640 - DNA, 50 bp, homo sapien
cttggccagcaaaccatcttcctacygaagttgtgagcatgttgacagca

SEQ ID NO: 3641 - DNA, 50 bp, homo sapien
atcaggcctgaaatcctaccttagakattcagttcttgaagataaaggct

SEQ ID NO: 3642 - DNA, 50 bp, homo sapien
atttctgaaaggaaagtattctccargtagggttctcatgaatgaccatg

SEQ ID NO: 3643 - DNA, 50 bp, homo sapien
aatcagagcttataaagcagggaaaraggaattatgtgtatgaaaaccag

SEQ ID NO: 3644 - DNA, 50 bp, homo sapien
tcagagaaatgtcacaacaatcttaygcattaggtgctattgttagtgcc

SEQ ID NO: 3645 - DNA, 50 bp, homo sapien
attgcaaagtttggttattgttctcyattaggatggaaggagctgataca

SEQ ID NO: 3646 - DNA, 50 bp, homo sapien
tcctctaatgtggtacatgcaatcaragatggtggttttacccatgtgcc

SEQ ID NO: 3647 - DNA, 50 bp, homo sapien
cagcaatagaggcagccactaccaaytgatctgtgaactggcagttaggg

SEQ ID NO: 3648 - DNA, 50 bp, homo sapien
tgaactaaataaggtaccagggatcratgctggaaaaacagagatgtgtg

SEQ ID NO: 3649 - DNA, 50 bp, homo sapien
tacattatcaaaattagaagtataaracctacatatgccaatcacggctg

SEQ ID NO: 3650 - DNA, 50 bp, homo sapien
tcttacttctgtaacatgaggacacyggactatttgaattcagaacttag

SEQ ID NO: 3651 - DNA, 50 bp, homo sapien
cccttagcgcacagaggacaatcctyaccaacacgccaccaaccactcca

SEQ ID NO: 3652 - DNA, 50 bp, homo sapien
tttcaaatgatatgctataacttcartcttccctccaaattcatcccacc

SEQ ID NO: 3653 - DNA, 50 bp, homo sapien
ataaaggacattattacaccttattraaacttcacctagatgtccaggca

SEQ ID NO: 3654 - DNA, 50 bp, homo sapien
ggggctcaacatgaactcagtatcarctttacccaagctgctcctgcccc

SEQ ID NO: 3655 - DNA, 50 bp, homo sapien
ttctccccacaattattaaacctgamatagaaagaattcacttcgtttta

SEQ ID NO: 3656 - DNA, 50 bp, homo sapien
agattcacatccgcaacacagagtcratgtttcaggttacagaataggta

SEQ ID NO: 3657 - DNA, 50 bp, homo sapien
agagacatgaccttaattttacctayaaagaaacagacttaggggagtga

SEQ ID NO: 3658 - DNA, 50 bp, homo sapien
accggcagcccaagttcctgcggackatggacgtgtttgacatggaacag

SEQ ID NO: 3659 - DNA, 50 bp, homo sapien
ttttttggctgagaaaaatccgctamgtctgtttgccagttggactgttg

SEQ ID NO: 3660 - DNA, 50 bp, homo sapien
tagcaacatgtcacaggtaaattaaygagaagccaggtgcttggggggtg

SEQ ID NO: 3661 - DNA, 50 bp, homo sapien
gtccactgactctttatgctagaacrccttgagttgagcaattaacatga

SEQ ID NO: 3662 - DNA, 50 bp, homo sapien
ggttagatgagacatggtgatcaacygtacataaggtaaacggagggaaa

SEQ ID NO: 3663 - DNA, 50 bp, homo sapien
gaaaaggcagggtaagattacgtacsagtgaaactaccaccttcacccta

SEQ ID NO: 3664 - DNA, 50 bp, homo sapien
tcccacagccattgcctcagtttagycagtgtcatttccccagggttgct

SEQ ID NO: 3665 - DNA, 50 bp, homo sapien
ttcttcctacttttgaactgtgacaygggctttttcctgcctttggactt

SEQ ID NO: 3666 - DNA, 50 bp, homo sapien
tcactggagtgaggtgggatagccargagagtgtgcaatgtggagacact

SEQ ID NO: 3667 - DNA, 50 bp, homo sapien
tttggaatacgttaacaaggtatcartgacgacagtaaaagtctaagcca

SEQ ID NO: 3668 - DNA, 50 bp, homo sapien
agctttccttactgaccatcagctayaatacaatgctaggagttgagttt

SEQ ID NO: 3669 - DNA, 50 bp, homo sapien
cttttgcagacatgggaaagatccartgcaagtttacttactttacaact

SEQ ID NO: 3670 - DNA, 50 bp, homo sapien
gcaaataagaaattcctcagtattckccttgagcagtcaatgttccatta

SEQ ID NO: 3671 - DNA, 50 bp, homo sapien
catttggaagtgctgtattcacatcratcctggttcaaaagcaccagaca

SEQ ID NO: 3672 - DNA, 50 bp, homo sapien
gccataatgaagaggagcatgtaagrcccataatcagaaaagatcacctg

SEQ ID NO: 3673 - DNA, 50 bp, homo sapien
cagatagaaaaataagaggtagacaygactgtaacgatttaactcatttg

SEQ ID NO: 3674 - DNA, 50 bp, homo sapien
ggagacttctcagatgcaatcttgawgtaactggatttacttctggtatg

SEQ ID NO: 3675 - DNA, 50 bp, homo sapien
gggtacatagagtgatggaagagaaygaggatttcagaaggggaagaggg

SEQ ID NO: 3676 - DNA, 50 bp, homo sapien
ttattggctaggagaagtaaagaaakgtctgattcgaggtgaagatgctc

SEQ ID NO: 3677 - DNA, 50 bp, homo sapien
ctgcctcatggggtccttgtaaggaycaagagatactatattaaaaaatg

SEQ ID NO: 3678 - DNA, 50 bp, homo sapien
ccccacaacatacatttactgcttasaactggaggaagattatggaagta

SEQ ID NO: 3679 - DNA, 50 bp, homo sapien
ttgggctagctagaatattaaaccaygacacgagttttgcaaaaacattt

SEQ ID NO: 3680 - DNA, 50 bp, homo sapien
tcatgcccacgaaacaaagcccatgraaatccaaaggttggagaagtgtg

SEQ ID NO: 3681 - DNA, 50 bp, homo sapien
cttagggccaggggactactttgcartacaaataagcattttctgtccct

SEQ ID NO: 3682 - DNA, 50 bp, homo sapien
aagcaaaaccaaaatctacaaaagamtaacttagctcaaagctggcttga

SEQ ID NO: 3683 - DNA, 50 bp, homo sapien
gccagcacacagtcatagtgaacaaytgagctaaggagaacaggaagctg

SEQ ID NO: 3684 - DNA, 50 bp, homo sapien
aacactgagttagttactgttgctaycaaacattcaacctaccagcaaca

SEQ ID NO: 3685 - DNA, 50 bp, homo sapien
aaaacgaaaagtttctcagaaagcartaatagtgagctgacttcacagta

SEQ ID NO: 3686 - DNA, 50 bp, homo sapien
caagagagtgaatgatttgcaaagaygtaagtggcagaataatttcacca

SEQ ID NO: 3687 - DNA, 50 bp, homo sapien
ataagctccacagctgagtgccctgmaataacagactcctttctcgctca

SEQ ID NO: 3688 - DNA, 50 bp, homo sapien
aatagtcattctagaaaaggataaaygttcagtaagatatagggcaaatt

SEQ ID NO: 3689 - DNA, 50 bp, homo sapien
gctggaagacaaaaggaagaccagarcctgctgtccacaaacaggtacat

SEQ ID NO: 3690 - DNA, 50 bp, homo sapien
tcaaccagggacagtgtcctgactcmaaataagggacgtctaattgcaac

SEQ ID NO: 3691 - DNA, 50 bp, homo sapien
cttctggagagactatcctcaaatcsatcagaggaaggcagccaggagtt

SEQ ID NO: 3692 - DNA, 50 bp, homo sapien
ataaaggatggttaaatttgaaaggraagtgagtcataattatcagatta

SEQ ID NO: 3693 - DNA, 50 bp, homo sapien
tgcccggttgggaagaatccagtcaytatttggttcccagactttagtaa

SEQ ID NO: 3694 - DNA, 50 bp, homo sapien
tcttggctactagatattactaaacraacagaaaactcaatttccctgct

SEQ ID NO: 3695 - DNA, 50 bp, homo sapien
aagaatggcagtaattcctgcatgamcttgagacataatattagttttga

SEQ ID NO: 3696 - DNA, 50 bp, homo sapien
tttgctagaaggcagagtggaggcaygtagggtctcaaattgtagtggca

SEQ ID NO: 3697 - DNA, 50 bp, homo sapien
gccctggctactccttatcttgtccrgaaagaactgactgacaggtgctg

SEQ ID NO: 3698 - DNA, 50 bp, homo sapien
ttaaaatagtcttgtaacctagctgsatttgtgatagggccttagtcttt

SEQ ID NO: 3699 - DNA, 50 bp, homo sapien
ggagaagagcagatccttatgagtasagacaaggctttccagggacaagt

SEQ ID NO: 3700 - DNA, 50 bp, homo sapien
agaagacattccagcagtaaaaagaytcaaagaataaagattaagtgaat

SEQ ID NO: 3701 - DNA, 50 bp, homo sapien
ggtggaactcagagtgggaagaacargtaaggtctggattggcaggaagc

SEQ ID NO: 3702 - DNA, 50 bp, homo sapien
catatgttccttttttgggctactaygcaaatttatattattacctatac

SEQ ID NO: 3703 - DNA, 50 bp, homo sapien
cctctgctgtatctttggcagagatwaaaaaaatatttgtcaaaagtttc

SEQ ID NO: 3704 - DNA, 50 bp, homo sapien
gggtcaagttatgtcacagacagaargaaaatgtacacaagctttttgat

SEQ ID NO: 3705 - DNA, 50 bp, homo sapien
ggtatttactgttggtcaggtactawgaataaaaacaccattgaaatgct

SEQ ID NO: 3706 - DNA, 50 bp, homo sapien
gacacaagtataagcaaataactacmatacacggacacatccctgaagaa

SEQ ID NO: 3707 - DNA, 50 bp, homo sapien
gatctagcttcttccagttctgaagycctctgatttgatgtctggaaagc

SEQ ID NO: 3708 - DNA, 50 bp, homo sapien
tgactgaacaaattacttgactatcsagcctgttttcctcacctgcaaat

SEQ ID NO: 3709 - DNA, 50 bp, homo sapien
ggtctccagtgcttaacctttgttcwctccctggtaggaggaggagcagg

SEQ ID NO: 3710 - DNA, 50 bp, homo sapien
ctgctgcccaggaccattcactagtmaacattttcagatccagttaattg

SEQ ID NO: 3711 - DNA, 50 bp, homo sapien
tttgttgataatatctcaagtgtcaygtgctttgtttcattcttccatgc

SEQ ID NO: 3712 - DNA, 50 bp, homo sapien
ttccacttgaaaagcagattctgaayttattctttgtcaagccaggctat

SEQ ID NO: 3713 - DNA, 50 bp, homo sapien
cacccatccaaagttttacattggasgcaactaatcccagcagggattta

SEQ ID NO: 3714 - DNA, 50 bp, homo sapien
agagtttctttattgggtaattaaaygtgatcctcttacatgtagaacct

SEQ ID NO: 3715 - DNA, 50 bp, homo sapien
accgaattgaaaagtgataagtgccygaacttaggtcgtcttgtggaaac

SEQ ID NO: 3716 - DNA, 50 bp, homo sapien
tatgtagccacacatgcacaaaaaakaattccattggtaaatgctgtagg

SEQ ID NO: 3717 - DNA, 50 bp, homo sapien
agttgtgtgttcctgttggcacttaygcaagaattaagaaacaattacat

SEQ ID NO: 3718 - DNA, 50 bp, homo sapien
agtgttagcttatcaaggtgggtaasattatgattacattttcatcttcc

SEQ ID NO: 3719 - DNA, 50 bp, homo sapien
tttagtgggattctaatatatacaasagtttcgtgtaggtgattcttttt

SEQ ID NO: 3720 - DNA, 50 bp, homo sapien
agtgctctttcttctttcttgaaaamaagtaatgataatattttcgttaa

SEQ ID NO: 3721 - DNA, 50 bp, homo sapien
actaatgtttcctagtatcaactgayggaataagactatggggagaagaa

SEQ ID NO: 3722 - DNA, 50 bp, homo sapien
tttgttacactgccatagaaaactamtactccagtaatggccattaagct

SEQ ID NO: 3723 - DNA, 50 bp, homo sapien
attaacgtttttaagacttccaggcraatgaatactcatgtgcacgcagg

SEQ ID NO: 3724 - DNA, 50 bp, homo sapien
agcctgggaggacttcccaaccacayaaaatgacttcctactttagggct

SEQ ID NO: 3725 - DNA, 50 bp, homo sapien
aaacccagtccagccacctctcaaaytgtgaccttaaataggttatttca

SEQ ID NO: 3726 - DNA, 50 bp, homo sapien
ttaggaatgatggatccgtcagaggyaatgctctttttatttagatcgaa

SEQ ID NO: 3727 - DNA, 50 bp, homo sapien
aacactttgagaaagatcgaggaacsctttagtcttcattatgcaccaac

SEQ ID NO: 3728 - DNA, 50 bp, homo sapien
atgaccacagcaggagctaacatacrgatcataattagtttatcagataa

SEQ ID NO: 3729 - DNA, 50 bp, homo sapien
caccaaccttgtgttctctcttaacyatcctgacgagctttccccagtca

SEQ ID NO: 3730 - DNA, 50 bp, homo sapien
tttcctgttagatgggtggtaagaaycagtcagagtttgtaaacccacca

SEQ ID NO: 3731 - DNA, 50 bp, homo sapien
caaaatacatagaaaagctgggtaartctatcaaatttcttaacaatgaa

SEQ ID NO: 3732 - DNA, 50 bp, homo sapien
gttgatttattgagcacctactataygtgagaagctagaccctgtgctgt

SEQ ID NO: 3733 - DNA, 50 bp, homo sapien
ccctcccccaggggctgccaatcacrcctctttccccaagcacaaaattc

SEQ ID NO: 3734 - DNA, 50 bp, homo sapien
aacatttttttttaaagaattaacaractgaagaacaggagcagactttc

SEQ ID NO: 3735 - DNA, 50 bp, homo sapien
ttaattgtagaaagcctagcctaagraaatgctcaagtttctcctttttg

SEQ ID NO: 3736 - DNA, 50 bp, homo sapien
aaaaatacttcccaagccaagtagayctgacctgaaaacaccaccatctg

SEQ ID NO: 3737 - DNA, 50 bp, homo sapien
gcagaagtggagctccgactaacccraggaagacatagctgaaaccaggg

SEQ ID NO: 3738 - DNA, 50 bp, homo sapien
gagtatggtgatagaggcgtagtgcygagacctgtttgaatgacaagtga

SEQ ID NO: 3739 - DNA, 50 bp, homo sapien
tctgtagagctctgaaaaggttgackatatagaggtcttgtatgttttta

SEQ ID NO: 3740 - DNA, 50 bp, homo sapien
atggcagtaataactaaaaatgttargagctgactctaagtcataatcct

SEQ ID NO: 3741 - DNA, 50 bp, homo sapien
gctgaaggggactgtgagaaaaaaartgttcatgaggctcgagtcctgaa

SEQ ID NO: 3742 - DNA, 50 bp, homo sapien
tttatagcctagttttatatctgaaycagctatgtctgctaacagactat

SEQ ID NO: 3743 - DNA, 50 bp, homo sapien
caagcatatctgagccaatcaatagyattcatcatgctgaaaggagctag

SEQ ID NO: 3744 - DNA, 50 bp, homo sapien
tgaatgaattttatcatctatgatawgagtgagataattatgggagtggt

SEQ ID NO: 3745 - DNA, 50 bp, homo sapien
ggtgaactgaaagcagtttaatctcrccagagccactgaaggagtttgca

SEQ ID NO: 3746 - DNA, 50 bp, homo sapien
agacccagaaggaaaacgttctgccraataagatataatactgcattcct

SEQ ID NO: 3747 - DNA, 50 bp, homo sapien
caaatatctgtcttttcagggacgcragtatggtgatcaggcagcaatta

SEQ ID NO: 3748 - DNA, 50 bp, homo sapien
tacctgataccattgcaaggaataamtgtatgaagtttaaaaaaaaagtg

SEQ ID NO: 3749 - DNA, 50 bp, homo sapien
aattttaaatgagataacatatttgsatctcgtagcataacagttgacac

SEQ ID NO: 3750 - DNA, 50 bp, homo sapien
aacatatctcaaggtcaccaatgacractttcatagctaagggccctggg

SEQ ID NO: 3751 - DNA, 50 bp, homo sapien
agatgaaaaatacatttgaaatggaragtatactgcatgggattaagaac

SEQ ID NO: 3752 - DNA, 50 bp, homo sapien
gtgataaactccttcaaatacaaacrggaatatatgacaatgaagtcata

SEQ ID NO: 3753 - DNA, 50 bp, homo sapien
tcccacaaattaaaattcactcacaraacaatactcccagggagatggga

SEQ ID NO: 3754 - DNA, 50 bp, homo sapien
caaaacagtaaagcatagtggtttcragaaagagcttcaaagacctaaat

SEQ ID NO: 3755 - DNA, 50 bp, homo sapien
actgtcggagagtttctgttcatcargactaagttgcaagtggtagaaat

SEQ ID NO: 3756 - DNA, 50 bp, homo sapien
atttttggaatttagacattaaaatrattgagtctggatttcattaccag

SEQ ID NO: 3757 - DNA, 50 bp, homo sapien
tgcagtgtgaatatctgtcccaattkaaggatactccagtacccaccttt

SEQ ID NO: 3758 - DNA, 50 bp, homo sapien
aagaggataatccattacagtggtakaagtgctttgaaaaggggaaataa

SEQ ID NO: 3759 - DNA, 50 bp, homo sapien
aacccactaccacaatgactgttggmacaatgatcttttgcttctgactt

SEQ ID NO: 3760 - DNA, 50 bp, homo sapien
gaggctaaggaaaaggagatgaagtyaaggactggctgcatttgccataa

SEQ ID NO: 3761 - DNA, 50 bp, homo sapien
cagatgacttatgtgatctaatttakcttagtgaagctgggagaacctcc

SEQ ID NO: 3762 - DNA, 50 bp, homo sapien
tttaatcagcagggaagaaatgtaaygacatgtaagaaaacaggaaccag

SEQ ID NO: 3763 - DNA, 50 bp, homo sapien
agctaatctcaagggatctcagtaawcctccaaacaaaagagactgatct

SEQ ID NO: 3764 - DNA, 50 bp, homo sapien
catatttaaaagcagagttgagactwaagtgaggcaagtgagatacctag

SEQ ID NO: 3765 - DNA, 50 bp, homo sapien
gaggtatctaggtcttcgtcagttayacagtagttactgggtgcatgtta

SEQ ID NO: 3766 - DNA, 50 bp, homo sapien
tggccccttgcacctctgaccttacraagctatccatgaatcctctatga

SEQ ID NO: 3767 - DNA, 50 bp, homo sapien
ccagctgttttcatggtgtactttamccataggtctcacagggatttttt

SEQ ID NO: 3768 - DNA, 50 bp, homo sapien
aaagattgaaaaggaagaaataaaasaggaattgcttggaaatgatatgg

SEQ ID NO: 3769 - DNA, 50 bp, homo sapien
gacataagaaccaagcagtctaggarcattaaagagagagcaactaactg

SEQ ID NO: 3770 - DNA, 50 bp, homo sapien
gctgttgtgtgctaattgccttccawattaagcccaacaccttcagcttg

SEQ ID NO: 3771 - DNA, 50 bp, homo sapien
gagtctagtgacagttcatcacaacmgttccattaaccaaacaactgtat

SEQ ID NO: 3772 - DNA, 50 bp, homo sapien
aataggtcttcagacaaatttgatcyctctaaggcagtttgaccaaacca

SEQ ID NO: 3773 - DNA, 50 bp, homo sapien
ggaaaagtcccacatgagtgtatccmggaaaataaaggaataaggtggga

SEQ ID NO: 3774 - DNA, 50 bp, homo sapien
agttttctcatgtgtaaatgaggtaycttctaactacatgaaataatagt

SEQ ID NO: 3775 - DNA, 50 bp, homo sapien
acgtggctaatctctataattcaccmgattgcagatacaagtgacagctg

SEQ ID NO: 3776 - DNA, 50 bp, homo sapien
caagcttctgccctgatggttcctcrctttgccaggtctgtctgatccaa

SEQ ID NO: 3777 - DNA, 50 bp, homo sapien
accactttacccccgactttccctcraggagcttactgtcaagatgagaa

SEQ ID NO: 3778 - DNA, 50 bp, homo sapien
acctggggccacctgactatttgacsgagcgaggctcaacccctgacctc

SEQ ID NO: 3779 - DNA, 50 bp, homo sapien
acccacttctctgcccctcctttggrataagtatgaggtggattcttcac

SEQ ID NO: 3780 - DNA, 50 bp, homo sapien
ggaaatttttatggagaaactgacaytgaattttactgtctatccagagg

SEQ ID NO: 3781 - DNA, 50 bp, homo sapien
ttccctgtctcactttcaccatgccrctaccagtacttcccagcatcgcg

SEQ ID NO: 3782 - DNA, 50 bp, homo sapien
agacaagacagtccattcagcaccawggcctcagcatagccacacgagag

SEQ ID NO: 3783 - DNA, 50 bp, homo sapien
gcctgccttaagttctgctaaaggcmatgttgttattaaggacgggtgag

SEQ ID NO: 3784 - DNA, 50 bp, homo sapien
gaatagaggaatggtaacaaatttamgtggtattgtatctacatggtgac

SEQ ID NO: 3785 - DNA, 50 bp, homo sapien
aattttacaggtgaaagaaaagggayatttcagacagagggaacagagcg

SEQ ID NO: 3786 - DNA, 50 bp, homo sapien
catccagcctaatgttttatccacartaacacacattatgttccctgaag

SEQ ID NO: 3787 - DNA, 50 bp, homo sapien
actgtgcccagtctctaatttcaacwagtgatactaacagcgtattgggg

SEQ ID NO: 3788 - DNA, 50 bp, homo sapien
cgtaaaattgtagcattgaagaatascaagtgatttgcctaagatcatac

SEQ ID NO: 3789 - DNA, 50 bp, homo sapien
tcaagtgaagggattatgggtatttmaaaagataaccaagtaatatgaaa

SEQ ID NO: 3790 - DNA, 50 bp, homo sapien
tgtaaatggtaaactataatgtgackcatgttataatgtgtcatggcagg

SEQ ID NO: 3791 - DNA, 50 bp, homo sapien
ccttaaaggatggggaggactttgaygagaagaggagtgaggcaggcagt

SEQ ID NO: 3792 - DNA, 50 bp, homo sapien
tatagcaaactttgctcttaggaaartaacctggtttcaattatctcctc

SEQ ID NO: 3793 - DNA, 50 bp, homo sapien
gaagtgtcctcagagccaatgatcastccttaaaaagctcccacacatcc

SEQ ID NO: 3794 - DNA, 50 bp, homo sapien
ggtattaataacattctattctacargataaatactaccatgggaattca

SEQ ID NO: 3795 - DNA, 50 bp, homo sapien
aggagaaggaaactgctatcagtaaygcactaacaggctgggtgtggtgg

SEQ ID NO: 3796 - DNA, 50 bp, homo sapien
cgaacaagagttgtacagataataayagtagttaacctttactactgagt

SEQ ID NO: 3797 - DNA, 50 bp, homo sapien
tcccaggcatagtcctttagtgaaaygacaccattaaattaatgggaatg

SEQ ID NO: 3798 - DNA, 50 bp, homo sapien
ttgactcatttctcataaaaaaatayatgtggagctagctgaatcatctt

SEQ ID NO: 3799 - DNA, 50 bp, homo sapien
tatagcccatctccatgatttaagcygcacaagtgatccctttggctaaa

SEQ ID NO: 3800 - DNA, 50 bp, homo sapien
agcctcgagcccttctcccataatcrcagcggtttctaccctggctagtt

SEQ ID NO: 3801 - DNA, 50 bp, homo sapien
tttgtgaagagacaagattgtatgaygaccattctggagcaaaaggtgcc

SEQ ID NO: 3802 - DNA, 50 bp, homo sapien
ttccatactgatgttagatcagtgaygctactttctgagaagccagactt

SEQ ID NO: 3803 - DNA, 50 bp, homo sapien
ctccccttaattccacaccaaccgargatagcaatttcaatcacttttat

SEQ ID NO: 3804 - DNA, 50 bp, homo sapien
gagacttgaaaatgatgaagaaatcratactttgctgtcagagaagcaag

SEQ ID NO: 3805 - DNA, 50 bp, homo sapien
cacctgaaactaattttcaaaacaarataattatatagcattctttcttg

SEQ ID NO: 3806 - DNA, 50 bp, homo sapien
aacccattccaggaatttcaaccatwaatagggactaactgggtgctggt

SEQ ID NO: 3807 - DNA, 50 bp, homo sapien
ttcttgctaaactgttaactgataaytgataatcctcggggtatttgtat

SEQ ID NO: 3808 - DNA, 50 bp, homo sapien
tttttgcacaattataacttgtttcwcaatccgtaatgttgcttcaaact

SEQ ID NO: 3809 - DNA, 50 bp, homo sapien
acgtatcctcccactctttttccacraattcatatccatcactttcttca

SEQ ID NO: 3810 - DNA, 50 bp, homo sapien
tgtttgaaattttggattctaggaaracagcattttaagaataaggagga

SEQ ID NO: 3811 - DNA, 50 bp, homo sapien
tatagagagccattatctagaccagraagaagaagtgagtttgggtaatg

SEQ ID NO: 3812 - DNA, 50 bp, homo sapien
cctaaagcttggggagatattaatarctagagatctaggaagagaattcc

SEQ ID NO: 3813 - DNA, 50 bp, homo sapien
atatcctgtcttagtgaggaaattayggaatatgttgaaaaaaaattgag

SEQ ID NO: 3814 - DNA, 50 bp, homo sapien
tgcttttcataacctgcctttaatamctttaagattgaaagtataatttc

SEQ ID NO: 3815 - DNA, 50 bp, homo sapien
atatttaccatttttatttatgtagragccaaagagatccctttctacag

SEQ ID NO: 3816 - DNA, 50 bp, homo sapien
atgtttaatatctgatttataagaawctaaatgtgtacctaaaagtagct

SEQ ID NO: 3817 - DNA, 50 bp, homo sapien
catctgcataacattagagcaaacaycagctaaaaatctacagatttcca

SEQ ID NO: 3818 - DNA, 50 bp, homo sapien
aggacaatgaagttctagcccatcartgactaaaattctaccattagaga

SEQ ID NO: 3819 - DNA, 50 bp, homo sapien
taagaataaataattagaaatgttcmattggttattcctcctaaaggcat

SEQ ID NO: 3820 - DNA, 50 bp, homo sapien
aaaataattgggctcaaagttaatayaattcattagatagttctgtcttc

SEQ ID NO: 3821 - DNA, 50 bp, homo sapien
gaccacgttttcagggcatcagggcmactatgactctttatgatctgaca

SEQ ID NO: 3822 - DNA, 50 bp, homo sapien
cagtttttaagctttgttcttattcraaactatggaataaacacaaagga

SEQ ID NO: 3823 - DNA, 50 bp, homo sapien
atgatcagttctttgaagacctaacmggcaagattgctagagctgtctcc

SEQ ID NO: 3824 - DNA, 50 bp, homo sapien
aaatgtactgccaaaatgggctttaygcattacacaatggagcagaaggc

SEQ ID NO: 3825 - DNA, 50 bp, homo sapien
cataatatagaacttgcatgagacaytgaccgtgaaatttagtttaaaat

SEQ ID NO: 3826 - DNA, 50 bp, homo sapien
acctgaaaatctcccaatctgacaawttaatgtaacttcagatccatttt

SEQ ID NO: 3827 - DNA, 50 bp, homo sapien
gggaagatataggtgatccatgcgartactgtctatttgcagaaaatatg

SEQ ID NO: 3828 - DNA, 50 bp, homo sapien
ataatagacaaataaaatataggacrgtcagcaaatcaggaattgagttt

SEQ ID NO: 3829 - DNA, 50 bp, homo sapien
aacttgttaaatgaattaatatcaascagcttcatatcaaagtaaagacc

SEQ ID NO: 3830 - DNA, 50 bp, homo sapien
gtagaacaagaccaatgaaagtgatyaggaaatgattgtcatatcagctg

SEQ ID NO: 3831 - DNA, 50 bp, homo sapien
agaaataattctagaagggatgtaakgacatgaggacacattaccccata

SEQ ID NO: 3832 - DNA, 50 bp, homo sapien
cattattgcaattattttacctaagwaattatctgatacttctaacccta

SEQ ID NO: 3833 - DNA, 50 bp, homo sapien
cctgtcccttaggcattgtcttctaygtattgcataaacatactttgcac

SEQ ID NO: 3834 - DNA, 50 bp, homo sapien
taaaataaaaggttgttaatcaacartgtatcaagtaccaggtacccttc

SEQ ID NO: 3835 - DNA, 50 bp, homo sapien
agtgtccagcacacagttaggcccaygattggtttctggctggacctgca

SEQ ID NO: 3836 - DNA, 50 bp, homo sapien
aggattttccaggcaacactgggaawtatgtcctaagaaatgggccagtg

SEQ ID NO: 3837 - DNA, 50 bp, homo sapien
catgcccaactattccttaattccaytccatttgtgtatttactcaggct

SEQ ID NO: 3838 - DNA, 50 bp, homo sapien
attgtgtaagctttaggcccctgagyaatatcttagagcatgtgagtaat

SEQ ID NO: 3839 - DNA, 50 bp, homo sapien
cattgggaaatcgtgagaaagcagaygccggttgccctgccactgaaacc

SEQ ID NO: 3840 - DNA, 50 bp, homo sapien
gcataaaagaaaggactgggtcttaycttcatctgtattcctaacatgta

SEQ ID NO: 3841 - DNA, 50 bp, homo sapien
aaattgtgggtgataagtgcatacayagaattgaaccaaattgttccaag

SEQ ID NO: 3842 - DNA, 50 bp, homo sapien
tattttttaaagctctcatcctgccrcgtgaagaaaacttaatctccatc

SEQ ID NO: 3843 - DNA, 50 bp, homo sapien
ttccaaacagggtagaaatgttacaytgaacaaccaagagagaaccaaac

SEQ ID NO: 3844 - DNA, 50 bp, homo sapien
aaattaagttaggtaatttatctaaygtgcctagcttctaacttctgcta

SEQ ID NO: 3845 - DNA, 50 bp, homo sapien
actgaatgactggtaatatctgttgkaatggagctgattagaggaggtca

SEQ ID NO: 3846 - DNA, 50 bp, homo sapien
ggatgtggcaataccaagatttgaaygagggtctctaactacaaagacag

SEQ ID NO: 3847 - DNA, 50 bp, homo sapien
agagaggagacgtacattatatagargttaatgcatattataaatgctga

SEQ ID NO: 3848 - DNA, 50 bp, homo sapien
cattagtcttatttttatgtttgtgkattcactcaggtctaatcttaata

SEQ ID NO: 3849 - DNA, 50 bp, homo sapien
atattcacaagaaagtcggctagtgmaaatttttggataaaactttagag

SEQ ID NO: 3850 - DNA, 50 bp, homo sapien
taaaacacttagaagagtgcctaggwcattagtaaacagtcaataaatgt

SEQ ID NO: 3851 - DNA, 50 bp, homo sapien
agaggaagcacgttgtgtcactagcractatattgtgtcactaattacaa

SEQ ID NO: 3852 - DNA, 50 bp, homo sapien
acttttacttccttctttcatttctractcaaaggtgcatctttctctct

SEQ ID NO: 3853 - DNA, 50 bp, homo sapien
tgagctcttaacccctatgctataamtctctagtcatctaaagcttctca

SEQ ID NO: 3854 - DNA, 50 bp, homo sapien
aaatgactgtttttaatcttcttgaraggatttcttgcagaagtatcctc

SEQ ID NO: 3855 - DNA, 50 bp, homo sapien
cagaagtatcctcttaaagaaccaaycaattttcagtgggtgccacattg

SEQ ID NO: 3856 - DNA, 50 bp, homo sapien
cagctccatgtgttttactttgctcmgaaaattaatctctcttaaaaaca

SEQ ID NO: 3857 - DNA, 50 bp, homo sapien
gcaaatcaaaaattaaactaacttarccactgaattttaatgtacagcat

SEQ ID NO: 3858 - DNA, 50 bp, homo sapien
gaactgtgctacaaacagagctaaamcatggtagagggactttgaagcta

SEQ ID NO: 3859 - DNA, 50 bp, homo sapien
ttttatgctgttcttaaactctataygcatggttgttctgaaaccatttg

SEQ ID NO: 3860 - DNA, 50 bp, homo sapien
agattactattccttaaaatgcggaygaggcctgatcatgtctgatggat

SEQ ID NO: 3861 - DNA, 50 bp, homo sapien
tcaagacttcagtggacaaagtcaaygcagatgtagtagaaatagcaaga

SEQ ID NO: 3862 - DNA, 50 bp, homo sapien
gaggctcagaaagtgtaatatttgaygataatagagatatggagctgctg

SEQ ID NO: 3863 - DNA, 50 bp, homo sapien
tgggggattagtagagatccaagaastgataagatactgcctgataatga

SEQ ID NO: 3864 - DNA, 50 bp, homo sapien
gagctgcctctctctttctcttccastgcagaatgccctttcttcctcct

SEQ ID NO: 3865 - DNA, 50 bp, homo sapien
ttgtccaaggctatttattatacaarcatccttaaaaagaaagttttgaa

SEQ ID NO: 3866 - DNA, 50 bp, homo sapien
gacttatgaatgtaccatttgcatasagaggactggaccaggttagattt

SEQ ID NO: 3867 - DNA, 50 bp, homo sapien
aaggaattgagaatatattctgagayaatcctccatgaattgtcttcgag

SEQ ID NO: 3868 - DNA, 50 bp, homo sapien
tcatttgcaacactagtttgatttckatttccatctcaatttactttgat

SEQ ID NO: 3869 - DNA, 50 bp, homo sapien
acaaacaaaaattgggtggagaaagkaatgtcagatgataaaaatccaga

SEQ ID NO: 3870 - DNA, 50 bp, homo sapien
tttaggttcttgagagctcttgaagraagataaaaacaaaagatggcatt

SEQ ID NO: 3871 - DNA, 50 bp, homo sapien
atagagtgaggtagttcccagttgawtagtcttcagatgcagtagggcaa

SEQ ID NO: 3872 - DNA, 50 bp, homo sapien
accctgtaccaaagtctttgatggawcccatgccttactgaatcaaggcc

SEQ ID NO: 3873 - DNA, 50 bp, homo sapien
gttgttgtatgtgtttgttgctaaartatgattctcagcaagacataaga

SEQ ID NO: 3874 - DNA, 50 bp, homo sapien
gcaagagttcgacagcaggttttacygattgcgctctgacttagacaatg

SEQ ID NO: 3875 - DNA, 50 bp, homo sapien
tgacaaatgattccataaagtaaaamttgattttgccattataattggta

SEQ ID NO: 3876 - DNA, 50 bp, homo sapien
tgggaaagaattgatgcaagaatgtmaagaggaaatatgggtaaatgaca

SEQ ID NO: 3877 - DNA, 50 bp, homo sapien
ttacaccttggggcgtctaatccacygaaaccattaggcaccgagctgcc

SEQ ID NO: 3878 - DNA, 50 bp, homo sapien
ggacttggttgtcatttgttgatgaraaataaaatagcaaaaacaacagc

SEQ ID NO: 3879 - DNA, 50 bp, homo sapien
gaagataatgaggatcttagacatgraacaactaatctaacatggtcatt

SEQ ID NO: 3880 - DNA, 50 bp, homo sapien
tgatataaaaagttcttttccatcaytgatcttacggtatttaaaatttg

SEQ ID NO: 3881 - DNA, 50 bp, homo sapien
ctttccaaaaaaattctcattctaaygtgtaacctgagggcaagggctaa

SEQ ID NO: 3882 - DNA, 50 bp, homo sapien
ttttcctgtggttgcacaccaactaktaattatgtctttcttctcttcta

SEQ ID NO: 3883 - DNA, 50 bp, homo sapien
tatttattcagtcagatatctcagtraaagttgtgtaagccatgctcttg

SEQ ID NO: 3884 - DNA, 50 bp, homo sapien
attttctaagaattttggggttttgkataccttgcaagagatggcagtca

SEQ ID NO: 3885 - DNA, 50 bp, homo sapien
atagctattaacatatgaagttgacyggaatcaaatagattaaatataaa

SEQ ID NO: 3886 - DNA, 50 bp, homo sapien
ttagagtctattggggaatacggacragcaaggaggcatttataacagtg

SEQ ID NO: 3887 - DNA, 50 bp, homo sapien
aacacaccctagaagccatgagtgcyctgttggttacaaatctatcagta

SEQ ID NO: 3888 - DNA, 50 bp, homo sapien
gagagtgaaggcaagagatgagaagragaataaactcaggtagcactctc

SEQ ID NO: 3889 - DNA, 50 bp, homo sapien
gtagaagtggggcctaatcaaggaayattttctattggcaatgtttgctt

SEQ ID NO: 3890 - DNA, 50 bp, homo sapien
gtctttctaggtgattgttttgctarccaacccacgtagctcaaggaacc

SEQ ID NO: 3891 - DNA, 50 bp, homo sapien
cagtggcaagaacagttgccactctraatcacaattccttttttaaaata

SEQ ID NO: 3892 - DNA, 50 bp, homo sapien
tgggtcacttggcagtcaagcagcartctctaattacctttcttggccca

SEQ ID NO: 3893 - DNA, 50 bp, homo sapien
taagagcttgaacttacatctgaaaygaaatgtaattttcttgaatgtag

SEQ ID NO: 3894 - DNA, 50 bp, homo sapien
ctttgcacatcgcatagcagagatamcctaatacatgagaattagacaaa

SEQ ID NO: 3895 - DNA, 50 bp, homo sapien
agactatgaggtgagatttgcacacrcctgttttctaaagcctaactttt

SEQ ID NO: 3896 - DNA, 50 bp, homo sapien
tgataattaaattagaaaattcaaaratgctaaagttctgtgtcttttaa

SEQ ID NO: 3897 - DNA, 50 bp, homo sapien
aatactaataaaaataatgtcttaaytgaatacttgccatgtggccattg

SEQ ID NO: 3898 - DNA, 50 bp, homo sapien
ttatttttattagtattgtccaaaamccactattattatgagaatttatg

SEQ ID NO: 3899 - DNA, 50 bp, homo sapien
agaaactatctaagatgatcaagtcraagttaatttcacaacttcttaga

SEQ ID NO: 3900 - DNA, 50 bp, homo sapien
atttaaattctataagggtgtccctsagaggttcccaaatgtctgaatgt

SEQ ID NO: 3901 - DNA, 50 bp, homo sapien
ctagaatctgtggccacatgttatgyaatgagaaaatatcaagtgcatca

SEQ ID NO: 3902 - DNA, 50 bp, homo sapien
gaagaaaaggagggagcgtatgtaasatcacacgagcctctggatggaga

SEQ ID NO: 3903 - DNA, 50 bp, homo sapien
ccattgtcaattctaatgccgttaaraagaacttgagcatagcttacatt

SEQ ID NO: 3904 - DNA, 50 bp, homo sapien
tgtaaattggttagagagagcataargttctggtacaaagcttcaaaggc

SEQ ID NO: 3905 - DNA, 50 bp, homo sapien
tgaacaaatttattactaagtataaytccttaatgcttatagctcttata

SEQ ID NO: 3906 - DNA, 50 bp, homo sapien
tacaactatcttagctatggatagargtcttcagggagacagtttgcatt

SEQ ID NO: 3907 - DNA, 50 bp, homo sapien
tatattgtactctttagatcgcccaygtgtaaccaccaatgtgttcatat

SEQ ID NO: 3908 - DNA, 50 bp, homo sapien
aatcagggtaggaatcaggtaggaayttaattaaagcattcattcattca

SEQ ID NO: 3909 - DNA, 50 bp, homo sapien
ccagacccactgtggtttatttgtcrctctggcttctcaatcatgaggct

SEQ ID NO: 3910 - DNA, 50 bp, homo sapien
tggagtatgcctataatacacaatcyacagggttgttgtaaaaataaatc

SEQ ID NO: 3911 - DNA, 50 bp, homo sapien
tatcttttattaaagttcatgttacygacatcatagaattaacctttata

SEQ ID NO: 3912 - DNA, 50 bp, homo sapien
gggcaaagtagtcttttgttctggaraaaaacatctgaatgcttattata

SEQ ID NO: 3913 - DNA, 50 bp, homo sapien
cctgaaatataaaataccagtctatyataccagtatcaaccatcaaacac

SEQ ID NO: 3914 - DNA, 50 bp, homo sapien
tggaaggtagaccctactttagtcartatgagatcagaagcagttcatat

SEQ ID NO: 3915 - DNA, 50 bp, homo sapien
tccccagtccattctgtctaccatamgtggatgaacagaagtcagcaaag

SEQ ID NO: 3916 - DNA, 50 bp, homo sapien
catgagattggaagatgaatgctcawgtaaattagaactcaggaaaagta

SEQ ID NO: 3917 - DNA, 50 bp, homo sapien
tgataatatctacatgttattgctaraacagagtcaaataaaaattaaaa

SEQ ID NO: 3918 - DNA, 50 bp, homo sapien
aaatgttgtgaagagtcaatgtaaargtaatcataaaagtaatataaact

SEQ ID NO: 3919 - DNA, 50 bp, homo sapien
caaacaaacaaacaaacaaaggagakagaaggagactaaggaacaaagaa

SEQ ID NO: 3920 - DNA, 50 bp, homo sapien
aactcagctttctgctgtagctccayataagctagtttctgggtctctac

SEQ ID NO: 3921 - DNA, 50 bp, homo sapien
aataaacaatccttagtttagatagkaatttggaaaggagaggtgaaagg

SEQ ID NO: 3922 - DNA, 50 bp, homo sapien
tagaactcttgaacctgtaccataakactattcaagagctctgattaaat

SEQ ID NO: 3923 - DNA, 50 bp, homo sapien
cacagttaatgaagtggttaaccaaygacttgaattaaatttgttactgc

SEQ ID NO: 3924 - DNA, 50 bp, homo sapien
cctgtctctgctgtcctgacctacastgtactatattttaacagaagctt

SEQ ID NO: 3925 - DNA, 50 bp, homo sapien
ggtcctgagccacgaaccttgaccayagcttacagtgccatggcttccac

SEQ ID NO: 3926 - DNA, 50 bp, homo sapien
gtaacattaatagccactcatgaatyactgtgcaggccccagagtagaac

SEQ ID NO: 3927 - DNA, 50 bp, homo sapien
cagcatgcaaacattttggctaattyaaaatccttgtgcagccgaatcaa

SEQ ID NO: 3928 - DNA, 50 bp, homo sapien
agctcacaggaagtgcagctccctarggaaaaacagactctctcttatgc

SEQ ID NO: 3929 - DNA, 50 bp, homo sapien
catacatgagaagcatctaacattgwacctggtgtgttgtatgccatcaa

SEQ ID NO: 3930 - DNA, 50 bp, homo sapien
gtaaagactcaattctgacatattcrcagcacaattttagaaacaaaaca

SEQ ID NO: 3931 - DNA, 50 bp, homo sapien
acagaccttcatttactaccaacccyctccttactagatatgtgaccttg

SEQ ID NO: 3932 - DNA, 50 bp, homo sapien
aagttgaggagtagagtggagtggamgaattaagtggcgaagtactgagg

SEQ ID NO: 3933 - DNA, 50 bp, homo sapien
tgatgaaatccttgttcaaaaatgasaagaatatggaacccaggggggct

SEQ ID NO: 3934 - DNA, 50 bp, homo sapien
aactatatcctgtctatagaagatayacattgattcaaagaagcaaccag

SEQ ID NO: 3935 - DNA, 50 bp, homo sapien
ggaaacaatgtctccagaagggttaygatgtaaaaatatgtggcctttaa

SEQ ID NO: 3936 - DNA, 50 bp, homo sapien
tggactgtgtagtttacatatacaayttagttttatcaaaatcttactcg

SEQ ID NO: 3937 - DNA, 50 bp, homo sapien
ggtttatagtgacaccatatttatckaagtcaatgagaatttgccagatt

SEQ ID NO: 3938 - DNA, 50 bp, homo sapien
gcacctctctattataaaactcctamatttactgtttactcttatgtgta

SEQ ID NO: 3939 - DNA, 50 bp, homo sapien
ttactcaccagccactatctattgargactctctatttttattaaaagag

SEQ ID NO: 3940 - DNA, 50 bp, homo sapien
tttgttgcctccaaatggataaaccratttttttgcactgaaactttaca

SEQ ID NO: 3941 - DNA, 50 bp, homo sapien
tggcaatcagaattttgtgataaaawtgtctgcttcttggatacttgctc

SEQ ID NO: 3942 - DNA, 50 bp, homo sapien
tatatatttcaaataaatctaagtgratacagagcagatgaaaaatggaa

SEQ ID NO: 3943 - DNA, 50 bp, homo sapien
attcagagggtagaaggaaagatgasattaactgctttttataatgtaaa

SEQ ID NO: 3944 - DNA, 50 bp, homo sapien
gcttttaatatactgaaggtaaagamaaaccatctgtttatgtggtagaa

SEQ ID NO: 3945 - DNA, 50 bp, homo sapien
atcacaaaatcactcactcagtatcraactgaaaaatcagagagacgcct

SEQ ID NO: 3946 - DNA, 50 bp, homo sapien
gttgtttaaatgatcgttgttgtcaycgcactaagtaagaacacactaag

SEQ ID NO: 3947 - DNA, 50 bp, homo sapien
atgtggagggaaagccagagatcaaytgtggttaaaatatcttgctatag

SEQ ID NO: 3948 - DNA, 50 bp, homo sapien
ttagaaagcaaaaagctaagcaagartcatacaaatgtataccagtcctt

SEQ ID NO: 3949 - DNA, 50 bp, homo sapien
ctatgtagtggtctttaccatcgtgmagtgtatgctttatatttggggaa

SEQ ID NO: 3950 - DNA, 50 bp, homo sapien
ggggggcagtcaggactgttggtagyaaaactcttagagggtaaatgtat

SEQ ID NO: 3951 - DNA, 50 bp, homo sapien
agaaggctaatgtaatctgactacaytgaagtatttctctggaataataa

SEQ ID NO: 3952 - DNA, 50 bp, homo sapien
aaagatctaaatataagttgaagaamctggagggagaatagtactgctag

SEQ ID NO: 3953 - DNA, 50 bp, homo sapien
cgggagttccaattggtcaaagtaarccaacagcgtatttataaatgagt

SEQ ID NO: 3954 - DNA, 50 bp, homo sapien
ctatactaataaacagcaaactacawtattatttttgcaaacagaaatga

SEQ ID NO: 3955 - DNA, 50 bp, homo sapien
ctggtgcatccctggtgatccaaggwaagtgttttactgcttcatatagg

SEQ ID NO: 3956 - DNA, 50 bp, homo sapien
ttatctaagtcaatgagaatttgccrgattttgttgcagtcatttgctta

SEQ ID NO: 3957 - DNA, 50 bp, homo sapien
gaggagcaaatgcaacaaccagttcmactacattgaaggagggcactaag

SEQ ID NO: 3958 - DNA, 50 bp, homo sapien
aaagcaggagccttcaaaggatacaraggtctccctcactgcccttggga

SEQ ID NO: 3959 - DNA, 50 bp, homo sapien
atgagatcacatatctcctgcctacrggttcttatttgttttcctttcct

SEQ ID NO: 3960 - DNA, 50 bp, homo sapien
agtttgccagctcttaacctagtcayaaactaacttcacatgtaggtact

SEQ ID NO: 3961 - DNA, 50 bp, homo sapien
ccattagctcctagtttgactaccayagatttttactggttaagcttgca

SEQ ID NO: 3962 - DNA, 50 bp, homo sapien
agcaccattgattatcaaactcagcrgagagcattttatgatcatatatc

SEQ ID NO: 3963 - DNA, 50 bp, homo sapien
ggctgtctaatgttcatgtgagagaratatatacttacttgaacatgtat

SEQ ID NO: 3964 - DNA, 50 bp, homo sapien
aaagagagaagtattcgaggagggaygtgtaatcaaaaaggtaactcagc

SEQ ID NO: 3965 - DNA, 50 bp, homo sapien
gccaattaatatcgactaatgttacmactgcttgctgctgactgccgcct

SEQ ID NO: 3966 - DNA, 50 bp, homo sapien
ttagcagaggcttggttattagcacygatcaactgttaattaaaataaaa

SEQ ID NO: 3967 - DNA, 50 bp, homo sapien
ttcctgatgtgcatgggggctgaaaytgaattcgttgactcataacaggg

SEQ ID NO: 3968 - DNA, 50 bp, homo sapien
gggtttggtaattgatttcctccaastgttagctattttgtatagattat

SEQ ID NO: 3969 - DNA, 50 bp, homo sapien
gacaaagaaaaagtgaacccagacastgcatgataaactagacaggtggt

SEQ ID NO: 3970 - DNA, 50 bp, homo sapien
aaaataatatagcataaaacatatcraacaagtatgtgctggcagaaaaa

SEQ ID NO: 3971 - DNA, 50 bp, homo sapien
ctggaagttatcttccgtatttgcasaagccaatagaaacaactcattta

SEQ ID NO: 3972 - DNA, 50 bp, homo sapien
taagtaatcaaactctaattatgtayatttgaaaagacaattacaacgca

SEQ ID NO: 3973 - DNA, 50 bp, homo sapien
actgtctcttgccattttctcttcartctctaaactgtcattaggtgtag

SEQ ID NO: 3974 - DNA, 50 bp, homo sapien
agttagcataacgattacaagttacygattttcatatataagttccatca

SEQ ID NO: 3975 - DNA, 50 bp, homo sapien
ttaccaagaggaatacagctgataartaagtgtccaagtagaaaggaaat

SEQ ID NO: 3976 - DNA, 50 bp, homo sapien
ttttttcttacattaagcacgcaatraaagatacaaattataaccagatt

SEQ ID NO: 3977 - DNA, 50 bp, homo sapien
tgaacatgtatatatttttactataygttgcttaaatgttacccttaata

SEQ ID NO: 3978 - DNA, 50 bp, homo sapien
ctatacaatttttaaagagcagttaygttaaaataatgttgctattttac

SEQ ID NO: 3979 - DNA, 50 bp, homo sapien
tatggatgacaaaaagttttagaacracatatattaaagccacaattgat

SEQ ID NO: 3980 - DNA, 50 bp, homo sapien
agtccttttgcttaagatttcatcakcctggtaatctgtagatttcctaa

SEQ ID NO: 3981 - DNA, 50 bp, homo sapien
ccatggtatgtgttggaattctcaayctctctctttttatgtctctctct

SEQ ID NO: 3982 - DNA, 50 bp, homo sapien
ttctttcctaggaatgtagcatagargataggaatgttagtcccagagtt

SEQ ID NO: 3983 - DNA, 50 bp, homo sapien
agtgaaaagaagcagggaaaaacagsctcatcggtttgtagtgtcactct

SEQ ID NO: 3984 - DNA, 50 bp, homo sapien
tatacattccttatccctgagaagargatgtgctattaatgctttaattg

SEQ ID NO: 3985 - DNA, 50 bp, homo sapien
gttggggattgctggtatagataacractaaaataaatgtccagattatc

SEQ ID NO: 3986 - DNA, 50 bp, homo sapien
tgttttttcctccttcaattgtgtayaccgtgtctttaatttccatataa

SEQ ID NO: 3987 - DNA, 50 bp, homo sapien
aactacaaatttgtaatctcagaaakatcatagtctaccctggaccttga

SEQ ID NO: 3988 - DNA, 50 bp, homo sapien
tggttaattggtatgcatagtattaygtcagaacgaccttcctcgtgttt

SEQ ID NO: 3989 - DNA, 50 bp, homo sapien
cgccacgtgaggggaggatgaaatarctgtaaaagatgtatttcctggtt

SEQ ID NO: 3990 - DNA, 50 bp, homo sapien
actctgcctgccatttggaaatgagraactaaatcttagaagagaagacg

SEQ ID NO: 3991 - DNA, 50 bp, homo sapien
aacagtaatagtaataacagcaatarcagtgtgtccttgaggaagtaagc

SEQ ID NO: 3992 - DNA, 50 bp, homo sapien
attatcactattttatagatgaagawtctgatgcttagcttacttcctca

SEQ ID NO: 3993 - DNA, 50 bp, homo sapien
gaatacttatatttaaatttgctaayctcagaggacttggagctctccag

SEQ ID NO: 3994 - DNA, 50 bp, homo sapien
tggcagatacagtcacttaccagtayattgagttgagtttatagttctca

SEQ ID NO: 3995 - DNA, 50 bp, homo sapien
ccatctttaatattttgagaaacacyaagccattttccaaagtcggtgca

SEQ ID NO: 3996 - DNA, 50 bp, homo sapien
ccaaaaagtataaaactctcttaaawctaaattacactaatgagaatttt

SEQ ID NO: 3997 - DNA, 50 bp, homo sapien
tataaatgtaccttattctttgtaaygactgtatagaattctattgtggg

SEQ ID NO: 3998 - DNA, 50 bp, homo sapien
aataccagatcgctggaggcattatragaaccaaatcggtgcttgttggc

SEQ ID NO: 3999 - DNA, 50 bp, homo sapien
tggtaagtactttaagggattgagaygaatctttatatatctgacacata

SEQ ID NO: 4000 - DNA, 50 bp, homo sapien
tttgtcatgctgaggctgtaggtaakgtacttgaatttgtctccaataaa

SEQ ID NO: 4001 - DNA, 50 bp, homo sapien
agaaagatcatgcaagaaaggaacastacgttggaacagaagttcagcag

SEQ ID NO: 4002 - DNA, 32 bp, homo sapien
gacacctaattggttaygatttcaccccccct

SEQ ID NO: 4003 - DNA, 50 bp, homo sapien
cctggggagagcatgagggttgatasaaaatgtgtgatgtataggtctca

SEQ ID NO: 4004 - DNA, 50 bp, homo sapien
tactgagagaacagtggctggaataraggagaaactttacagaggaccta

SEQ ID NO: 4005 - DNA, 50 bp, homo sapien
ctcaaatgcagcaacaacttgacagwagatgaaaatggagagagaagaaa

SEQ ID NO: 4006 - DNA, 50 bp, homo sapien
cacaccttgaagatacagaggcttcsaaacaggagagaagaaggcaaagg

SEQ ID NO: 4007 - DNA, 50 bp, homo sapien
ttagaatgacttatttctgataatamattgtttttcgccagtagaagcca

SEQ ID NO: 4008 - DNA, 50 bp, homo sapien
acctacttttatctgtctggcatackggctttcaaattcattttttgtaa

SEQ ID NO: 4009 - DNA, 50 bp, homo sapien
tttctctgagtgtgttgtatatcacragttagtaaattatggcccacggc

SEQ ID NO: 4010 - DNA, 50 bp, homo sapien
gatccttaagttgccactgggaaagragctgacctggaaagctgcaggac

SEQ ID NO: 4011 - DNA, 50 bp, homo sapien
agaagttttttttgggcttcaggtascacattagggagaaacatctgcat

SEQ ID NO: 4012 - DNA, 50 bp, homo sapien
agaacagataactcgtgaaacagaakaaggattgacacagcaataatgta

SEQ ID NO: 4013 - DNA, 50 bp, homo sapien
cttactccggatttaaactattgcayggcttttgctatgtctcttgtttg

SEQ ID NO: 4014 - DNA, 50 bp, homo sapien
ccctggataaagattgagaaagctcraaccctagaagaaggaggagaaag

SEQ ID NO: 4015 - DNA, 50 bp, homo sapien
aggagaaagcctggaacaaagtaacygcaaggtcaggtggtgttagtgtt

SEQ ID NO: 4016 - DNA, 50 bp, homo sapien
gcttctccaatcagaattaacaaaaygagagatttaacttgtctttctca

SEQ ID NO: 4017 - DNA, 50 bp, homo sapien
aaagtgaaactttgtgaggttaagtwactggatcacagtggtgtgaggga

SEQ ID NO: 4018 - DNA, 50 bp, homo sapien
ttacaaatttggttacagtgtgctayggtgcatttgtaacactcagattt

SEQ ID NO: 4019 - DNA, 50 bp, homo sapien
ccatctgggcttagtgtcttattcasaaagattccctcctattctcctcc

SEQ ID NO: 4020 - DNA, 50 bp, homo sapien
aagttttcaattaatagctatggatsagaaaatcctgcgatcagtttctc

SEQ ID NO: 4021 - DNA, 50 bp, homo sapien
tcccaggtcatgtaaaatagagaacycagtatcatacctcatgaatgcct

SEQ ID NO: 4022 - DNA, 50 bp, homo sapien
gagagtggactgatcttaaacactgraaagggatgaatattgctagatgc

SEQ ID NO: 4023 - DNA, 50 bp, homo sapien
cctctctggaccacacagatctttgsattaggaacttaattctatttatt

SEQ ID NO: 4024 - DNA, 50 bp, homo sapien
actgtgtatcagtactgtttcatcascttgaaataaaacactcttacttc

SEQ ID NO: 4025 - DNA, 50 bp, homo sapien
gatacaaatctcatcttaaatatacrgctaaggaacagaaaaaaattcaa

SEQ ID NO: 4026 - DNA, 50 bp, homo sapien
taactgaaacaattaataacgaaaamtgaaatagcatgctccaaggaaag

SEQ ID NO: 4027 - DNA, 50 bp, homo sapien
gctgacctcctcactcagccatgtaygtaaattttaaccccaagtaagct

SEQ ID NO: 4028 - DNA, 50 bp, homo sapien
aatttcttaaattttaagtatctacmcaattacataatcccatttccact

SEQ ID NO: 4029 - DNA, 50 bp, homo sapien
ggatcatgagatgtctgtagagccamgaattaatcagaggtgaaacagtg

SEQ ID NO: 4030 - DNA, 50 bp, homo sapien
tttactttggccctcctggcattcaygggagagtaagaagttatattgca

SEQ ID NO: 4031 - DNA, 50 bp, homo sapien
tatgagtaaaaatcaatgaaaaataygaaggactgaaaacagagataaat

SEQ ID NO: 4032 - DNA, 50 bp, homo sapien
agaaggcaactggaaagcaatataamaatttcagagtccaatccaaataa

SEQ ID NO: 4033 - DNA, 50 bp, homo sapien
gcttcgatcctgttaagtaaaccacsaggatgcttcagtgtttggagcgg

SEQ ID NO: 4034 - DNA, 50 bp, homo sapien
atttctttatagttttctgtatttayccaatgatctgtaatggacatgtc

SEQ ID NO: 4035 - DNA, 50 bp, homo sapien
tctctaaagttcattattttagaacygatatgagagtcaaaaattttagc

SEQ ID NO: 4036 - DNA, 50 bp, homo sapien
ctttatcatagagtgacaagatagayacagtcattttatgagagaaccac

SEQ ID NO: 4037 - DNA, 50 bp, homo sapien
taaaaaaaagaaagacatgttgccartcaatagtagagtctagatttgga

SEQ ID NO: 4038 - DNA, 50 bp, homo sapien
catcttattccttttcttactcatasaagactttgactttgtgtggacaa

SEQ ID NO: 4039 - DNA, 50 bp, homo sapien
tccctcaaactacatttgaatgatayctctgttggcaatcaagaagcatt

SEQ ID NO: 4040 - DNA, 50 bp, homo sapien
ctttgttaattacagtgcaaatacaraattttaaaaactggcaagagtat

SEQ ID NO: 4041 - DNA, 50 bp, homo sapien
tctctgccaaagagagagaatctcaygataaatacacactgatttggtca

SEQ ID NO: 4042 - DNA, 50 bp, homo sapien
aaaaatctagaaaaaaacaacgactracatcatatttgggggtggaacac

SEQ ID NO: 4043 - DNA, 50 bp, homo sapien
aaatattttatgactttccattgaayaatttgcttatattcccatgtctt

SEQ ID NO: 4044 - DNA, 50 bp, homo sapien
tttctagattttttttttcagaatayctaagttgccttcaatttttggtt

SEQ ID NO: 4045 - DNA, 50 bp, homo sapien
tcacaatgagggagggccctcgaaayggaaacaggagattaacgattcct

SEQ ID NO: 4046 - DNA, 50 bp, homo sapien
atttgtatctaagtgagccaagacartataagcattaatataagatggtg

SEQ ID NO: 4047 - DNA, 50 bp, homo sapien
tctcctccaaggaattactttgaccygaacctgttaatttcattcctctt

SEQ ID NO: 4048 - DNA, 50 bp, homo sapien
gtgtctgggacataggaaatgctcaraaatctagtgatggttattgccaa

SEQ ID NO: 4049 - DNA, 50 bp, homo sapien
tccctggtgatgtagggaaaaagcayatactctaaaatggctcaacactg

SEQ ID NO: 4050 - DNA, 50 bp, homo sapien
acatatatgttacacagatgacacaktctggatgttgaagcccagacact

SEQ ID NO: 4051 - DNA, 50 bp, homo sapien
agccttgacaactgcactctgttcayctgattgttatgactttattctta

SEQ ID NO: 4052 - DNA, 50 bp, homo sapien
acttcttggcattggtttagtctcamaatggactgtcagattggttgtat

SEQ ID NO: 4053 - DNA, 50 bp, homo sapien
tttaagagcatttgcttggccataayaatacaactaacagtgatcgaaaa

SEQ ID NO: 4054 - DNA, 50 bp, homo sapien
tcttcagaggtatatattattcagargtatgtatttttctttggaggtat

SEQ ID NO: 4055 - DNA, 50 bp, homo sapien
ttatttcactgattgttcacatatgrcagattctcaatatacatacattt

SEQ ID NO: 4056 - DNA, 50 bp, homo sapien
ataggaattgaggtcaaaaaatgggyatgattaaagcagtattcaaagtg

SEQ ID NO: 4057 - DNA, 50 bp, homo sapien
aacgaggaagttgggaacaatcatamctgtggagacttctattcctgatt

SEQ ID NO: 4058 - DNA, 50 bp, homo sapien
tatatttttattgcagaaaactgccratgaactaaaaagtgtgctgccag

SEQ ID NO: 4059 - DNA, 50 bp, homo sapien
atatatataattaatttgaatagccsaaaggtgtatgtttttaataggag

SEQ ID NO: 4060 - DNA, 50 bp, homo sapien
actttctctaccactcactattcaamacaaggaagcaaactatttaaaaa

SEQ ID NO: 4061 - DNA, 50 bp, homo sapien
cttttacactcaatgcaagtgtgtckctctttaactgtcttagtctgttc

SEQ ID NO: 4062 - DNA, 50 bp, homo sapien
agatacactgctttgtattggaacargattttgaggctaggggatgtaag

SEQ ID NO: 4063 - DNA, 50 bp, homo sapien
ggcagggcccagaggatggagagaayactgcccagtgggtaggtcccacc

SEQ ID NO: 4064 - DNA, 50 bp, homo sapien
gaacattttccccaagttgacctaarataggaatataagaagacatactg

SEQ ID NO: 4065 - DNA, 50 bp, homo sapien
gtatggaacaagaagttggatttcasaattaaatagatttaaaatgatca

SEQ ID NO: 4066 - DNA, 50 bp, homo sapien
cactaggccatgaggcagctcaccaytaaatgtagcagtgtgtggtcaaa

SEQ ID NO: 4067 - DNA, 50 bp, homo sapien
tgaattttagaactagaagtgtgcaygtatgtcaaaagattatgcagagc

SEQ ID NO: 4068 - DNA, 50 bp, homo sapien
agccctggaagcagctgctccaatcrcattccctgacaaagaccacacgc

SEQ ID NO: 4069 - DNA, 50 bp, homo sapien
gtagtctatacaacactattttctgragagggtttggtgaataaaggggt

SEQ ID NO: 4070 - DNA, 50 bp, homo sapien
aaatccttaccgctcagtggcaccasggatagatgtggggataatagctt

SEQ ID NO: 4071 - DNA, 50 bp, homo sapien
gaatgaaatggctgtggtgagaactraaattaacactatattgaaacaaa

SEQ ID NO: 4072 - DNA, 50 bp, homo sapien
cgcttggtaaggagtcagtccgtcaraattcctgggaagaagttaaaagc

SEQ ID NO: 4073 - DNA, 50 bp, homo sapien
ctccagaatatgttcctgctatccarctaaaactttgtatcttttgacca

SEQ ID NO: 4074 - DNA, 50 bp, homo sapien
attcatcatcactctttgtgtgtaaygcatgaaatatttactgtagtcat

SEQ ID NO: 4075 - DNA, 50 bp, homo sapien
tctattaggagtttgttttgctaaayggtatgacatgagattgatttttg

SEQ ID NO: 4076 - DNA, 50 bp, homo sapien
ctgagaaccaacaatagtgaaatagsccaattaatagccctgcaatagac

SEQ ID NO: 4077 - DNA, 50 bp, homo sapien
ttttatctctgtatgaggatagaagratctactgtatgtgtttcttgggg

SEQ ID NO: 4078 - DNA, 50 bp, homo sapien
gagcagcacataagtaagtgtgccayaataagagtaagaagcaaaagtaa

SEQ ID NO: 4079 - DNA, 50 bp, homo sapien
tgagcatacatgaagcagtatggaayggcccacaacagcataaagtgtat

SEQ ID NO: 4080 - DNA, 50 bp, homo sapien
tcagagaggaagtaaatgtggagaastgattttattatgcagaataatgc

SEQ ID NO: 4081 - DNA, 50 bp, homo sapien
atagtaaattaaaactaggttacgawaattcttgatagcattacaaggag

SEQ ID NO: 4082 - DNA, 50 bp, homo sapien
tgcacagtatttgtcatgtgctaacractggaaagggcagggcgcagtgg

SEQ ID NO: 4083 - DNA, 50 bp, homo sapien
cacaactccttgaattgtcttcccaraatgagaaagagaatccagacagc

SEQ ID NO: 4084 - DNA, 50 bp, homo sapien
ctgccagaggtcccttctttaggtawcatatttcaattcaagatagaaga

SEQ ID NO: 4085 - DNA, 50 bp, homo sapien
gattctgtttacaataattcataaaytggtaaaagtcattctaagaaaac

SEQ ID NO: 4086 - DNA, 50 bp, homo sapien
gggactaagcaaaactatgagaatargtcagtaattcaatcacgcttgat

SEQ ID NO: 4087 - DNA, 50 bp, homo sapien
accattaggttccattcttcatttayattggtgaccttctcttactcttt

SEQ ID NO: 4088 - DNA, 50 bp, homo sapien
ttctagaggtaagtctgaaagaaccragaatctcaaggaagagctgatca

SEQ ID NO: 4089 - DNA, 50 bp, homo sapien
aggaatggcttttggtgctacctgaraatgttagcatgaaagatgcaaac

SEQ ID NO: 4090 - DNA, 50 bp, homo sapien
gtgaagcaacatgggaatttctatcratattattcagataaatgtctatt

SEQ ID NO: 4091 - DNA, 50 bp, homo sapien
aagtttgtaaagagattttgagatgsaaatgtttgtgaaccactggctta

SEQ ID NO: 4092 - DNA, 50 bp, homo sapien
gctaccaaagcatctattacaccaasatacagagtaaaggcagaaagtgg

SEQ ID NO: 4093 - DNA, 50 bp, homo sapien
aggtatactatattccagattaaacrgactattttctgctccctgaaggg

SEQ ID NO: 4094 - DNA, 50 bp, homo sapien
ttaaattaaaataatccttcagcaaygttatttctagtttgtctactact

SEQ ID NO: 4095 - DNA, 50 bp, homo sapien
taggtcattgagaataacaaaatgasgtaaagaagttaagaatgttgaga

SEQ ID NO: 4096 - DNA, 50 bp, homo sapien
taagtgggtgacttgagagattcaartgtatgatttaacctttgacttgg

SEQ ID NO: 4097 - DNA, 50 bp, homo sapien
atgggaggagacaggacctttttcarcttgacaaataggtatagctactt

SEQ ID NO: 4098 - DNA, 50 bp, homo sapien
agaaaaatttatggcaccttaatacyataatctctccccttgtcacagca

SEQ ID NO: 4099 - DNA, 50 bp, homo sapien
ccattttgtagttttcacacacttcyctgaggtatctaatcaaatacaaa

SEQ ID NO: 4100 - DNA, 50 bp, homo sapien
tcccagtgaaaagtcagtcttgttamatgaggagattgcattattattaa

SEQ ID NO: 4101 - DNA, 50 bp, homo sapien
catttattggtaaataataactgaartgcatagctatactaatataagga

SEQ ID NO: 4102 - DNA, 50 bp, homo sapien
ttttcactttcagtatagtattcaakaaattacactagatattcaatgct

SEQ ID NO: 4103 - DNA, 50 bp, homo sapien
gcctttatcctttccatattttttarcgtatctgtttatgtcatctaagc

SEQ ID NO: 4104 - DNA, 50 bp, homo sapien
gaaggaaactaaatcatgctgtctcratcataagtcctccctggctagac

SEQ ID NO: 4105 - DNA, 50 bp, homo sapien
caggtgcatctttgcaaaccaagaaktgcacatataaactcctcgaagtc

SEQ ID NO: 4106 - DNA, 50 bp, homo sapien
cctctggcaaaaatattttttaatargcaaaccatgaaatacaaacagaa

SEQ ID NO: 4107 - DNA, 50 bp, homo sapien
actagcaacactataaatatatccaytgaaaataattacaagatcagaca

SEQ ID NO: 4108 - DNA, 50 bp, homo sapien
gacatactgttgtaggctttcctacratacagcttctaataaaactaggc

SEQ ID NO: 4109 - DNA, 50 bp, homo sapien
tatgcctgtttgtcacataacaatayagtcttcaaaaacttattccttgc

SEQ ID NO: 4110 - DNA, 50 bp, homo sapien
cccaaagtcggcagcagggagtatcracttccatcttaatggaatcattg

SEQ ID NO: 4111 - DNA, 50 bp, homo sapien
gcattgtggtattgtgatcacaagasagcttcattaaaatgcactttttg

SEQ ID NO: 4112 - DNA, 50 bp, homo sapien
ttgtattcccctgccatagccaatgraatgaagtagaaattattcacact

SEQ ID NO: 4113 - DNA, 50 bp, homo sapien
tattttttcctcactaaaccacttcyaaaggtatatttttatgtgtccag

SEQ ID NO: 4114 - DNA, 50 bp, homo sapien
atcagataccttcggcaattattacrcttgatctgattatgaagttgaca

SEQ ID NO: 4115 - DNA, 50 bp, homo sapien
ggtgagtgactcattttaagtaaaakaagatagtgcttgatgtagggagg

SEQ ID NO: 4116 - DNA, 50 bp, homo sapien
atttgtacatgtttaatacagagaartcaactgagccagatgcacacaga

SEQ ID NO: 4117 - DNA, 50 bp, homo sapien
tcattttaagttacagatcccaaaayaattgccataattagcataagctt

SEQ ID NO: 4118 - DNA, 50 bp, homo sapien
catgagaagaaattcagaaaagacaygattctaacagaaatatatcgaga

SEQ ID NO: 4119 - DNA, 50 bp, homo sapien
tagaattcacagtattttcaagttaraggtacatgtaataaggaagttgt

SEQ ID NO: 4120 - DNA, 50 bp, homo sapien
aatacctgtgatgtaagttacaaaamcacctgtgatgaaagtgctccagg

SEQ ID NO: 4121 - DNA, 50 bp, homo sapien
tgaactgcaaacagcaagatcctgasaaactcttatagatgcagtaagta

SEQ ID NO: 4122 - DNA, 50 bp, homo sapien
agtgctactaacactgtcttcataaycaattcatgctgtcaagatgcttc

SEQ ID NO: 4123 - DNA, 50 bp, homo sapien
gtccctttctattataacgttcagaktctacaatgaactgtgagacttgg

SEQ ID NO: 4124 - DNA, 50 bp, homo sapien
atactccattttatggtacctattaygtgtaggcattttacaaaggaatg

SEQ ID NO: 4125 - DNA, 50 bp, homo sapien
agaaaggaaatgttacttggtcttaygaggagtgaacctatatattcaac

SEQ ID NO: 4126 - DNA, 50 bp, homo sapien
gtatggtggacagcaaaagctacacrgtcattgcctttggggagcttctg

SEQ ID NO: 4127 - DNA, 50 bp, homo sapien
ttatgaagtatggccttcatttagarcttacctaacatggtacctaaaaa

SEQ ID NO: 4128 - DNA, 50 bp, homo sapien
atatgcatattagtgtttgagtgtayatatagaatctcactaaaaataaa

SEQ ID NO: 4129 - DNA, 50 bp, homo sapien
tttcttcttaatcaacattgtattayattcactgagactactaattccaa

SEQ ID NO: 4130 - DNA, 50 bp, homo sapien
aggagccatcaaggcttaaactggamagcagaatctcccagactctgact

SEQ ID NO: 4131 - DNA, 50 bp, homo sapien
tgcaaggacatatactgtacctatastaaccatttttattattcctgaaa

SEQ ID NO: 4132 - DNA, 50 bp, homo sapien
tgctgctctctacatggctagaatgmatagataatgtttgaccgtttcta

SEQ ID NO: 4133 - DNA, 50 bp, homo sapien
ttgtacttggagtgacagtcaactaygaatccatcacccatccttttggg

SEQ ID NO: 4134 - DNA, 50 bp, homo sapien
gagaagaaacatttactactattagmattcggagaaaaaatatacggagt

SEQ ID NO: 4135 - DNA, 50 bp, homo sapien
ttattctaccaattattccaacataytataaagctcagctcatgttccag

SEQ ID NO: 4136 - DNA, 50 bp, homo sapien
tttcaaagagaacaattggttttaaytacaatgtcaattgaactggcccg

SEQ ID NO: 4137 - DNA, 50 bp, homo sapien
taaaactctagcccctgttcaaggayacaaagtggaattagggtcgtctt

SEQ ID NO: 4138 - DNA, 50 bp, homo sapien
tgactagtgttatccgttatctatgyacctatacttgagcctgtacatat

SEQ ID NO: 4139 - DNA, 50 bp, homo sapien
tcatgatggtatggtttgatgagtaytaaataggatattttgatatttta

SEQ ID NO: 4140 - DNA, 50 bp, homo sapien
attgttttaaataactaatgaataawccataaactatcttctattaatgc

SEQ ID NO: 4141 - DNA, 50 bp, homo sapien
gcaaattgaaagatgtggaatgaacyggccatccagactcagattctgtg

SEQ ID NO: 4142 - DNA, 50 bp, homo sapien
atcagctgtgtacaactattaatgayagcaatgtctcaacctagaaaaag

SEQ ID NO: 4143 - DNA, 50 bp, homo sapien
ctccaggatgcttgttcagaatgcartatgtataaagccattggttttca

SEQ ID NO: 4144 - DNA, 50 bp, homo sapien
attttcaacttactgttctaacttayattttgaattagaacattttaact

SEQ ID NO: 4145 - DNA, 50 bp, homo sapien
gcaataacaagatacgctttatagayaagaaaataaaaggccaggctttt

SEQ ID NO: 4146 - DNA, 50 bp, homo sapien
tcccctaggactatctaaaacatgargttgctcatatggtatgttttcta

SEQ ID NO: 4147 - DNA, 50 bp, homo sapien
atgtgttggtttgtgcagtgcataarctaagtacaaaataatttttgtag

SEQ ID NO: 4148 - DNA, 50 bp, homo sapien
aatttggagagagcaaactgctaagkctgaggccctcaaactgatggttt

SEQ ID NO: 4149 - DNA, 50 bp, homo sapien
acccataaagagtgcttagttgttaygtaaaatgaataatgtgaacatgc

SEQ ID NO: 4150 - DNA, 50 bp, homo sapien
ctttgcctgtaatttctatcttcctwaaatgtataaaatcaagttgtaac

SEQ ID NO: 4151 - DNA, 50 bp, homo sapien
cttataccaacaagtcctaaacctarctgatcatctttggagtcacctgg

SEQ ID NO: 4152 - DNA, 50 bp, homo sapien
ttcaagtgtcctgaaagttcccgaartgagccatgctgttttgttgttgt

SEQ ID NO: 4153 - DNA, 50 bp, homo sapien
tattaagtgcactaaaaggtgatagmataatgttgactcaaacccacaaa

SEQ ID NO: 4154 - DNA, 50 bp, homo sapien
taggtctaactgctggaaaccgtcamtctccataatgaaacaaaacaact

SEQ ID NO: 4155 - DNA, 50 bp, homo sapien
gaagagatttgataaatagcgaaaaygtgaacttacagtcttcaaacaaa

SEQ ID NO: 4156 - DNA, 50 bp, homo sapien
tatactccctgaagtcaagttgaacrgtcaatccctgtgttgttagaaac

SEQ ID NO: 4157 - DNA, 50 bp, homo sapien
ctggattctacctccttcattctacygataagactctttgaaggtcacca

SEQ ID NO: 4158 - DNA, 50 bp, homo sapien
gaaaagcttcctggtgtcattttaartacccaggaaagagctcttgttgc

SEQ ID NO: 4159 - DNA, 50 bp, homo sapien
aatgaaaagaatagatgcaaagccartgctctgtggacaggaaacaaagc

SEQ ID NO: 4160 - DNA, 50 bp, homo sapien
cacaagatggggacaagcaggtctamccacagcaggtctgctgtgaagat

SEQ ID NO: 4161 - DNA, 50 bp, homo sapien
ttcatgggttcattaaatattcaacrctccttgttcagtttctacttatg

SEQ ID NO: 4162 - DNA, 50 bp, homo sapien
catcttatattatcaaatgagatgamataaaatataatgctaaaatgatg

SEQ ID NO: 4163 - DNA, 50 bp, homo sapien
catgtaacttctctccaaataattawgacaaacttagaaattattctagt

SEQ ID NO: 4164 - DNA, 50 bp, homo sapien
aggctatattaaaacctcatcactayctacaaggcttaaaagcatctagt

SEQ ID NO: 4165 - DNA, 50 bp, homo sapien
ttcccaggagtatttgcttaaagtaractccatttagaaataactgatat

SEQ ID NO: 4166 - DNA, 50 bp, homo sapien
taaaccaaaagtttataatccaacasaagtatcatgtatctggcctttga

SEQ ID NO: 4167 - DNA, 50 bp, homo sapien
ggtagcaagctgtatttgttcttccygcagtaatttatagtcccctaatt

SEQ ID NO: 4168 - DNA, 50 bp, homo sapien
acagggaggtcactgccttgagacaygggaccaaagttcaggacaagact

SEQ ID NO: 4169 - DNA, 50 bp, homo sapien
aatgccaaaaggatagtaacccaaartggcgtctaacaatggagacagca

SEQ ID NO: 4170 - DNA, 50 bp, homo sapien
tgaatatttacatttgtggtactaaygattagcaatttgagatatttaaa

SEQ ID NO: 4171 - DNA, 50 bp, homo sapien
tggggatagctgtggtttaaaatgawaaattaggattaaatagagagtaa

SEQ ID NO: 4172 - DNA, 50 bp, homo sapien
cagaaaacaacatttcagtagagatraaaacctagtttggtaggcaaaaa

SEQ ID NO: 4173 - DNA, 50 bp, homo sapien
cagaaagctctttgttgccgaaggamgtttctgaatagcagaaaatagcc

SEQ ID NO: 4174 - DNA, 50 bp, homo sapien
tatttatttccttcctgtcattcacygcaatcttgtacttgtttcttgat

SEQ ID NO: 4175 - DNA, 50 bp, homo sapien
tttgttaaacgttttaacgtgcaaasttatagaaaatgcaaacattaaca

SEQ ID NO: 4176 - DNA, 50 bp, homo sapien
tattaaatcttagtattacttaagaraaaacattactaaggactgaatat

SEQ ID NO: 4177 - DNA, 50 bp, homo sapien
ttgatctgggtaaaacgggaactccratgggcgtgttcagccccagtcta

SEQ ID NO: 4178 - DNA, 50 bp, homo sapien
catagtgtgtatgtttgggttttaaytacacattttatatatgagccatt

SEQ ID NO: 4179 - DNA, 50 bp, homo sapien
gcaaaataaaaaaactgcttgcacayattagcactgataaaacaatgaca

SEQ ID NO: 4180 - DNA, 50 bp, homo sapien
ctgttaatattttgctcctagttcaygttttgtctagtcctagtgtggca

SEQ ID NO: 4181 - DNA, 50 bp, homo sapien
ggtatgggagtgtgtgtttgcctcaytcaggacttactgttatgttataa

SEQ ID NO: 4182 - DNA, 50 bp, homo sapien
aaagcttgcttacattataactttgyagcaaggttgtggtggaatagtag

SEQ ID NO: 4183 - DNA, 50 bp, homo sapien
gcactgaaaaaaaacgtcaaatttayggcaaagtgtctttttctgttact

SEQ ID NO: 4184 - DNA, 50 bp, homo sapien
attctgctagaaaggttagcctaagraaaaggagacagcattctagaggt

SEQ ID NO: 4185 - DNA, 50 bp, homo sapien
aaccttaaaaaatggcttagggaaawctctgacctgtgttatgttttcag

SEQ ID NO: 4186 - DNA, 50 bp, homo sapien
tttggttacttagaaaaaaatcagaygtaaatagtgtactttgttcttct

SEQ ID NO: 4187 - DNA, 50 bp, homo sapien
aggcagtattttctaattttaatgcragaaagtagaagacagtatgccca

SEQ ID NO: 4188 - DNA, 50 bp, homo sapien
gaaattccctctctgcttaggtctawaaggccagggacacaacccgctgc

SEQ ID NO: 4189 - DNA, 50 bp, homo sapien
tagcagcttcacaatgaacattagawgaccggattggtagaatagaaaca

SEQ ID NO: 4190 - DNA, 50 bp, homo sapien
cttcaaatagtccatttagccaccawctctttctacttttctttgtattt

SEQ ID NO: 4191 - DNA, 50 bp, homo sapien
aattcttgcaatgtgtataatcttaygaaaactaggaggaggagattttt

SEQ ID NO: 4192 - DNA, 50 bp, homo sapien
aaataatataacttagcctccttgawtattaaattactttgagtaaatta

SEQ ID NO: 4193 - DNA, 50 bp, homo sapien
gttggagagccaggcctgtatcccawctcaagtccaaattcagcactatt

SEQ ID NO: 4194 - DNA, 50 bp, homo sapien
tgttgtcaagttcatctgagaaatcraaaaattgttctggcagcctcagc

SEQ ID NO: 4195 - DNA, 50 bp, homo sapien
acatccctccattaatacaaagtaargacaggtctaataattgtgtgtgt

SEQ ID NO: 4196 - DNA, 50 bp, homo sapien
cctacaactcttctttttggagaaayttggaagaaggaaatctgcagata

SEQ ID NO: 4197 - DNA, 50 bp, homo sapien
caagttctcatctgaaagtttaaaargtggaccgactgactccatgtttc

SEQ ID NO: 4198 - DNA, 50 bp, homo sapien
atgaggaaatgccataagttacagargaatgagatgttccataaaatttc

SEQ ID NO: 4199 - DNA, 50 bp, homo sapien
gccaaaattattggcatttcttcatragttacagaggaaatggggtgttc

SEQ ID NO: 4200 - DNA, 50 bp, homo sapien
attttctactggtattactgtagtaraacccagatgtcactcaggcaact

SEQ ID NO: 4201 - DNA, 50 bp, homo sapien
gtctagttactggatgatcataagaygccaagagatggagtttccagcta

SEQ ID NO: 4202 - DNA, 50 bp, homo sapien
gctaatctcccctctgctactttaaygaccacgtaagactgtaaaagcaa

SEQ ID NO: 4203 - DNA, 50 bp, homo sapien
attcagtcatttacttaacagatacygaatgtttgctaccgtgagtctat

SEQ ID NO: 4204 - DNA, 50 bp, homo sapien
cacagctgacaaagcagcattaacayaccaccatatatatttgaaagcaa

SEQ ID NO: 4205 - DNA, 50 bp, homo sapien
ttgggttattgtagctgtcactaacrgaatggaattgccagttgcctagc

SEQ ID NO: 4206 - DNA, 50 bp, homo sapien
gcctgcaggttcaatgtacgctacawctgtttttgctcaccattgtatcc

SEQ ID NO: 4207 - DNA, 50 bp, homo sapien
tcagcttctgtttctcaggcatacartgaggtggttgcagttcctttttg

SEQ ID NO: 4208 - DNA, 50 bp, homo sapien
tttcactcttttaaatcccagagccratacttgaacagaagtaagtttgc

SEQ ID NO: 4209 - DNA, 50 bp, homo sapien
cagtggttcttaggatctagagagaygggaaaataacatgttggcagtga

SEQ ID NO: 4210 - DNA, 50 bp, homo sapien
aaagatctttgcagaaactcaaacawgtcagactggagagcatgcgtgac

SEQ ID NO: 4211 - DNA, 50 bp, homo sapien
ctgtggttgttgatgaaagcactcamtaatgatttgttcctctacctggg

SEQ ID NO: 4212 - DNA, 50 bp, homo sapien
gagaaaaaggtaatactcaataccgmccccagtgtaaaactttcatagtc

SEQ ID NO: 4213 - DNA, 50 bp, homo sapien
tattgactgttatacacataaaataygaatggcgaaagaataagaggggt

SEQ ID NO: 4214 - DNA, 50 bp, homo sapien
atattaaatcacccgaagacactaayttacagaagacacaactccttccc

SEQ ID NO: 4215 - DNA, 50 bp, homo sapien
atgattgtctaaggcctatgttacaycttcatacccatgtacgacactca

SEQ ID NO: 4216 - DNA, 50 bp, homo sapien
cagattttttttggtaaaactgtgargagctaggatatatacttggtgaa

SEQ ID NO: 4217 - DNA, 50 bp, homo sapien
tgggtgttctcagtccttgccatgamgtatggtggtgtctagcactgaat

SEQ ID NO: 4218 - DNA, 50 bp, homo sapien
gttgggccaattgctatttttgtagyacttagcatgaaatgggaatgata

SEQ ID NO: 4219 - DNA, 50 bp, homo sapien
taaactattaaataataactgcctasatgatcactgaaagagaaaaagag

SEQ ID NO: 4220 - DNA, 50 bp, homo sapien
ctggtttcctgtctcaaagttaaaayttcattgtattatgtcattcaagt

SEQ ID NO: 4221 - DNA, 50 bp, homo sapien
aggtgcatgacaccgtgctcagctamgaaatgcgttctgttgttgtgggg

SEQ ID NO: 4222 - DNA, 50 bp, homo sapien
tggtcccaaagcttaactgagactaraaagcaaagtagtcctaaattctc

SEQ ID NO: 4223 - DNA, 50 bp, homo sapien
ggattcagttcctcatcctcaaaagmcctaactgaaaaggaactgatgac

SEQ ID NO: 4224 - DNA, 50 bp, homo sapien
ggcttctccttaaccggtcataaaaytagaggcataaggaagtcctgact

SEQ ID NO: 4225 - DNA, 50 bp, homo sapien
ttctgccttaggtatttattgttctkactctttcaatacatacagaccat

SEQ ID NO: 4226 - DNA, 50 bp, homo sapien
cacgtggaagtcagtttaattgccasagagaaggatgcaatcactaggta

SEQ ID NO: 4227 - DNA, 50 bp, homo sapien
ggatctgtgctcacctgagaactaaygcagaatggtcatgttgtaacttt

SEQ ID NO: 4228 - DNA, 50 bp, homo sapien
gattactattgtatcttcaaatgaayttaatattgtgagatggaactgcc

SEQ ID NO: 4229 - DNA, 50 bp, homo sapien
atttttttttcacattagtttgatayggaatccactaagactcatataaa

SEQ ID NO: 4230 - DNA, 50 bp, homo sapien
cacctgtggcattaacattatccaamattatgtggccattcccaggtgtg

SEQ ID NO: 4231 - DNA, 50 bp, homo sapien
accaaacactttcttgaagaataaartatcagacaaaaggaagcttttct

SEQ ID NO: 4232 - DNA, 50 bp, homo sapien
atctgtttccaaaacaccggtatgckctagaactaggatgaactgacgtc

SEQ ID NO: 4233 - DNA, 50 bp, homo sapien
tcttgtgaggaaacagatatgcaaaragataattattactgcagtataga

SEQ ID NO: 4234 - DNA, 50 bp, homo sapien
acataaataatacatagcatgtgctyaaaaacgtgtgcaattattatgtg

SEQ ID NO: 4235 - DNA, 50 bp, homo sapien
gcatatatttttttctttcaaaacgratcatagtcaggcgcggcctgtaa

SEQ ID NO: 4236 - DNA, 50 bp, homo sapien
ttaagcacatgctatgtattatttaygttaactgttttacataaataatt

SEQ ID NO: 4237 - DNA, 50 bp, homo sapien
ctaaatgtgataaaactgctaaaaaygtacaaatgcttgttttaagattt

SEQ ID NO: 4238 - DNA, 50 bp, homo sapien
cggctataggtttcaatgcatatgayaagtttatgtgaatgtctttcact

SEQ ID NO: 4239 - DNA, 50 bp, homo sapien
attatcacaagtctcagaaaaacgaygtggctatatttcaataattggag

SEQ ID NO: 4240 - DNA, 50 bp, homo sapien
atctcaggttacacctatttccccartcctctgtagccacagaagcttca

SEQ ID NO: 4241 - DNA, 50 bp, homo sapien
gtcatatgcattgaaacctatagccrgaaactaagcatttaccaacaatt

SEQ ID NO: 4242 - DNA, 50 bp, homo sapien
gagtggcattgctattgccgttgtayatgacaatacctgctgtaatgcag

SEQ ID NO: 4243 - DNA, 50 bp, homo sapien
tttgaacagacatttctcgaaaggcracatacagatggcaaacaggcata

SEQ ID NO: 4244 - DNA, 50 bp, homo sapien
ttaaaggacttggggaatattaaaaygtgtgcagagaacagaggggagca

SEQ ID NO: 4245 - DNA, 50 bp, homo sapien
cccggtcccaccataaacttaaccasgttcttggcctggcagagacagag

SEQ ID NO: 4246 - DNA, 50 bp, homo sapien
gggggactgcatcctggtgcgtaaayagccgcctagagctccatttgaga

SEQ ID NO: 4247 - DNA, 50 bp, homo sapien
accccacagaatctgtttccatcaayggctatgaaaaaacagagagtgat

SEQ ID NO: 4248 - DNA, 50 bp, homo sapien
atagaacagaattctcagatcgtcaractcgaagccatttaaaattatat

SEQ ID NO: 4249 - DNA, 50 bp, homo sapien
attatgaattgagacaagtatgtacrgaggttggaagcaaatggaggtgg

SEQ ID NO: 4250 - DNA, 50 bp, homo sapien
tcttaaaggcgagtgtaaaatgttaycgtgcttgaactttcatttgtgtt

SEQ ID NO: 4251 - DNA, 50 bp, homo sapien
ctccaagggttctaatggattctatmaagcacagattcgagaactgtatg

SEQ ID NO: 4252 - DNA, 50 bp, homo sapien
cactctgcaggttagggatctttacyagatgtttattattctgaagaaaa

SEQ ID NO: 4253 - DNA, 50 bp, homo sapien
tagttagaatggctgttatcaaagasacgaaaaatagtaaatgttggtga

SEQ ID NO: 4254 - DNA, 50 bp, homo sapien
ttaaacacactaatgcttgcagggaygacaaggaaagcaagtgcatattg

SEQ ID NO: 4255 - DNA, 50 bp, homo sapien
tagcacagcaacttgtatttacacayaagaaaaaccagtaatcagacatc

SEQ ID NO: 4256 - DNA, 50 bp, homo sapien
cctatgtgttatatgtattatatatyagagtgctcggacggattctagtg

SEQ ID NO: 4257 - DNA, 50 bp, homo sapien
gtctgttactatggcccgtatgccastgctctaggttggagttatattat

SEQ ID NO: 4258 - DNA, 50 bp, homo sapien
atctctgtcacatgtgggactgtagratacctgcccgcccagcctctgta

SEQ ID NO: 4259 - DNA, 50 bp, homo sapien
agcttatgttgtttctcaacaagccmaacggtagaactgcctgtattatt

SEQ ID NO: 4260 - DNA, 50 bp, homo sapien
acatccttcccagctttctgaattcsaaaccaatatccacaacttcaggg

SEQ ID NO: 4261 - DNA, 50 bp, homo sapien
agtcatcagtggctcagaacggtgasaacagcatcacctgatagcttcta

SEQ ID NO: 4262 - DNA, 50 bp, homo sapien
acaacagcaattcattgagtcagaaytgaggcagtagcatcactaaacaa

SEQ ID NO: 4263 - DNA, 50 bp, homo sapien
ttactaaaagcatgaatatcaggcgraatagatagcaatgtgacattcgt

SEQ ID NO: 4264 - DNA, 50 bp, homo sapien
tgggttcttgaggactcatcaaaacycgttactaaaagcatgaatatcag

SEQ ID NO: 4265 - DNA, 50 bp, homo sapien
atgggactcacatgacaccataatayaaaacttaaaatcacagctataac

SEQ ID NO: 4266 - DNA, 50 bp, homo sapien
tttattcagattaagaaagaaatacrctactgaaatggtatgaaactcac

SEQ ID NO: 4267 - DNA, 50 bp, homo sapien
tgccatttctaatggggttgagagaygagaatgagtaactatggaaccga

SEQ ID NO: 4268 - DNA, 50 bp, homo sapien
ccccatgagggttctgtgggacatamaatcaagtgccagctcctgcacca

SEQ ID NO: 4269 - DNA, 50 bp, homo sapien
acagctcccttgctctctgagatacsctctattttgcccctagacgtttc

SEQ ID NO: 4270 - DNA, 50 bp, homo sapien
gaacagtccagctgagccctgctccratcattgacccacacaatcatgag

SEQ ID NO: 4271 - DNA, 50 bp, homo sapien
gactttgttcagtaaaagaaaagaayagtgatgctacttactggtaaccc

SEQ ID NO: 4272 - DNA, 50 bp, homo sapien
aagaaatgatcaatttattttatccraactttgctatttacttaaaaaga

SEQ ID NO: 4273 - DNA, 50 bp, homo sapien
tagattactctacctaaggaagtcawcatgggactcacatgacaccataa

SEQ ID NO: 4274 - DNA, 50 bp, homo sapien
aagtcaggtgggaacccatttgtgamtcaagcccccacctatcaatagag

SEQ ID NO: 4275 - DNA, 50 bp, homo sapien
tggtctgttttgtgtttagccttccygaaaattctatgggttgtctagac

SEQ ID NO: 4276 - DNA, 50 bp, homo sapien
tataaatatggcaacctgtcagtccragagtctttattacaaataacaga

SEQ ID NO: 4277 - DNA, 50 bp, homo sapien
gctttttttctctaaatacacctaasaaagtaccatgccctaaaatactt

SEQ ID NO: 4278 - DNA, 50 bp, homo sapien
ttatggttatcaataatgatgatacrgaatctgctgagatgaaaattgct

SEQ ID NO: 4279 - DNA, 50 bp, homo sapien
caacgttctggcttcgtcttataaasaaacatagtgaaagacagaagagc

SEQ ID NO: 4280 - DNA, 50 bp, homo sapien
tgttgcaggcctcggggtctttgtckcaacaagtcaactctaacgtgata

SEQ ID NO: 4281 - DNA, 50 bp, homo sapien
ttacatgttgggatttttgaaaaatsaatctccatcactaccctaaggag

SEQ ID NO: 4282 - DNA, 50 bp, homo sapien
tagcatgtgtctacaaaagattaccygatgctcaaacaattaggctgagc

SEQ ID NO: 4283 - DNA, 50 bp, homo sapien
acaggtaaactgatcaatgggaagaragctatcgtgacagtttagccagc

SEQ ID NO: 4284 - DNA, 50 bp, homo sapien
ggtcatggtggtggtgatttgttacrcaggaaagggtaattcatgcacaa

SEQ ID NO: 4285 - DNA, 50 bp, homo sapien
cttttcctcactctcactccctgcawctatctgggcaccaaatcccatcg

SEQ ID NO: 4286 - DNA, 50 bp, homo sapien
ataggacttaatatactaattacagycctttactccctaaatatgctaat

SEQ ID NO: 4287 - DNA, 50 bp, homo sapien
tatctgcttaaagaaagagatgtcamgagaaagaccagacatgtaacaga

SEQ ID NO: 4288 - DNA, 50 bp, homo sapien
gaatgacagttcattaattgatgagwactgtgcctcgctgagaaagccag

SEQ ID NO: 4289 - DNA, 50 bp, homo sapien
tatttctgatttaacatctgatttargattcattgaccaggggagaaaaa

SEQ ID NO: 4290 - DNA, 50 bp, homo sapien
caaatgaacaagttcagaattattasagtgttacagttgactccgcatca

SEQ ID NO: 4291 - DNA, 50 bp, homo sapien
gggcattttatgttgctgaaactacwaatcttattaagaagcttttcaca

SEQ ID NO: 4292 - DNA, 50 bp, homo sapien
tgtgctgtgagtgtttacttaatcartcttcaaagagctttccagatggg

SEQ ID NO: 4293 - DNA, 50 bp, homo sapien
catcccaagagctaccatgcagtgawctggaaggtaatctacacgaacat

SEQ ID NO: 4294 - DNA, 50 bp, homo sapien
cagctttctggcctcacagagtatayagcgatttcagtaaaaaaaaaaaa

SEQ ID NO: 4295 - DNA, 50 bp, homo sapien
ccaaatggacaggggcttgtgtactyagaacaattaggccatctttcttt

SEQ ID NO: 4296 - DNA, 50 bp, homo sapien
agtggtccctgaatgactggcagaayaagaacatgaaatggtctccacgc

SEQ ID NO: 4297 - DNA, 50 bp, homo sapien
aaggaccaacggtatttgaggactayactgtattaacacagtgaatgcag

SEQ ID NO: 4298 - DNA, 50 bp, homo sapien
acttaagacctatctagcgcgtaaartcgccagggcttgagaaccaactg

SEQ ID NO: 4299 - DNA, 50 bp, homo sapien
ttctctttactatgcttctgaaaaaygcataattaagtagtgctctaatg

SEQ ID NO: 4300 - DNA, 50 bp, homo sapien
cgtcccccgttaaacatggtaatggraacaaacccgaccagaaaacctgg

SEQ ID NO: 4301 - DNA, 50 bp, homo sapien
tagcgaagttgttgctgtacgtaggratataagttttttctggatgtgta

SEQ ID NO: 4302 - DNA, 50 bp, homo sapien
catcgcagctgggttatgagagggtwacagagtcagggaagaatttaggg

SEQ ID NO: 4303 - DNA, 50 bp, homo sapien
gcatttctttgggaggacaggtaaargtgccaaataatataatcaaattc

SEQ ID NO: 4304 - DNA, 50 bp, homo sapien
tgcgatgactactgcctgtaacaccragacgagctctccagactgtcatg

SEQ ID NO: 4305 - DNA, 50 bp, homo sapien
cctgccccagatacatgccagatggracatccaagtacgaggctagttga

SEQ ID NO: 4306 - DNA, 50 bp, homo sapien
ttcatacagtggcatttgggacacawtcgttggaacctgaagaatctgaa

SEQ ID NO: 4307 - DNA, 50 bp, homo sapien
cgttccaccttagccagatctgctcrcacaggaaagaaaaccgaaggggc

SEQ ID NO: 4308 - DNA, 50 bp, homo sapien
ccctgctatgcaaatttcttaggccraggaacgcacattgggaaatgccg

SEQ ID NO: 4309 - DNA, 50 bp, homo sapien
tcagcttgtaagcgataacaaaaccyatcttctggttcccttggttcctg

SEQ ID NO: 4310 - DNA, 50 bp, homo sapien
gttccctgagtctgaacttgcctacyaatatgctatcatatgcccaaatt

SEQ ID NO: 4311 - DNA, 50 bp, homo sapien
atgttaagtgtatagtgcttaacaaytacagaaaggcttaacaggaacag

SEQ ID NO: 4312 - DNA, 50 bp, homo sapien
tggcagcccccaaacacaaacaatcyagaggaaaaggcacaaggtgggga

SEQ ID NO: 4313 - DNA, 50 bp, homo sapien
ctgtgtgtgtggggtattgatgccaygttttaattttggctgtattcatc

SEQ ID NO: 4314 - DNA, 50 bp, homo sapien
gaatttgaatactaatctgagacttwaacacactaaacctttaccttaaa

SEQ ID NO: 4315 - DNA, 50 bp, homo sapien
tagggctcactgggtaggaggacccragggtagacaggcagattttaagc

SEQ ID NO: 4316 - DNA, 50 bp, homo sapien
ctggaattaaataaccttttttcctsagatggtttgtgcttttgagcctc

SEQ ID NO: 4317 - DNA, 50 bp, homo sapien
ataatgctctctgtacataaaccagsacataagtaatataatttcatggg

SEQ ID NO: 4318 - DNA, 50 bp, homo sapien
attttctgagtataaaagcagcacawaataatagtaggaaacgtggaaaa

SEQ ID NO: 4319 - DNA, 50 bp, homo sapien
ttcccttaaggttgtacatcttgaawtaagataccttggctctatctagg

SEQ ID NO: 4320 - DNA, 50 bp, homo sapien
aaatgagcaaacatcagtgaagaaartatggcttaagagtagttgggaat

SEQ ID NO: 4321 - DNA, 50 bp, homo sapien
caaggtgaccaaacctggatttgttyaaaaatatcagcaagtcaggtgcc

SEQ ID NO: 4322 - DNA, 50 bp, homo sapien
tcacaaagctttatctggatgcctcyaaattattcttgtttacccatgtg

SEQ ID NO: 4323 - DNA, 50 bp, homo sapien
tgatgaaatcaacagaaaactcaaasagagactgcgtgcatcaatttcaa

SEQ ID NO: 4324 - DNA, 50 bp, homo sapien
ttaatgaactcaagaaaaccaaaaaktctgtacatgaatagctaccactt

SEQ ID NO: 4325 - DNA, 50 bp, homo sapien
tgttgcctgcttctataaacagaatmatattccatgctctgctgcttcat

SEQ ID NO: 4326 - DNA, 50 bp, homo sapien
gaatttaaaagcagtgatttaggggkaagttaatcaaattgagcttgctc

SEQ ID NO: 4327 - DNA, 50 bp, homo sapien
agtgagtttgtgaggacttggagtcrataagcacagggaaacaaggaagc

SEQ ID NO: 4328 - DNA, 50 bp, homo sapien
agcccttacccagagaaataacagakatactctaagaataccctcatgga

SEQ ID NO: 4329 - DNA, 50 bp, homo sapien
caagaaggtgagatatataatgacastaacattttattttgccaagtaaa

SEQ ID NO: 4330 - DNA, 50 bp, homo sapien
aggccagactccggataacatgaaayttgagttgaaccatttttagatta

SEQ ID NO: 4331 - DNA, 50 bp, homo sapien
tgaatcttccagctgtatcaatgggmaaattcaaaatttaatagggattc

SEQ ID NO: 4332 - DNA, 50 bp, homo sapien
ctcgttcgacacctgattatgaagayagatggatcagggcagatctgcca

SEQ ID NO: 4333 - DNA, 50 bp, homo sapien
attgtgatgagaacatgactaaagasaagattccttcaaggtagtgctct

SEQ ID NO: 4334 - DNA, 50 bp, homo sapien
attctgcacatctaaattttgccagsaatattctgtttgtttgtttgttt

SEQ ID NO: 4335 - DNA, 50 bp, homo sapien
tttcattgaatgaaaacgtgagagcrctaccttgaaggaatcttgtcttt

SEQ ID NO: 4336 - DNA, 50 bp, homo sapien
tttgtgtggtgtatctgacctttcayaatgggttcataccagagtccact

SEQ ID NO: 4337 - DNA, 50 bp, homo sapien
aggtcccactcaccatttaaggctasagtcatttcagagagactaaatta

SEQ ID NO: 4338 - DNA, 50 bp, homo sapien
ttctgctttctggcatcaagagagcrcttagaagttcttcctaaagacac

SEQ ID NO: 4339 - DNA, 50 bp, homo sapien
ccagcctcaagcagtggtccctaaartggatacccaccaccagcagcagc

SEQ ID NO: 4340 - DNA, 50 bp, homo sapien
gagtcagatcatggtgtgctaaagargttttttatcctatggacagtggg

SEQ ID NO: 4341 - DNA, 50 bp, homo sapien
gatccattctctagtccaaagtctamatcagccaactgaaattcaggaca

SEQ ID NO: 4342 - DNA, 50 bp, homo sapien
atatgtagatggatacatcgacaaartggtaaaagaatatgcatcaagta

SEQ ID NO: 4343 - DNA, 50 bp, homo sapien
agtctgaagaggtaacaaaagaccasatcacaaggaatttatatgcagat

SEQ ID NO: 4344 - DNA, 50 bp, homo sapien
cttccagctcaatctgactctaacgragatagcaacttagaggaaagaaa

SEQ ID NO: 4345 - DNA, 50 bp, homo sapien
atcaactttgatctacattaacttgwacctatattcaggccttctctgta

SEQ ID NO: 4346 - DNA, 50 bp, homo sapien
ccccaacttcttcctattaaattaaygcttgcaagatgtgccaggatgat

SEQ ID NO: 4347 - DNA, 50 bp, homo sapien
atgccacttttatcatggtgtatcaytcgtttcacagcctagttaacatt

SEQ ID NO: 4348 - DNA, 50 bp, homo sapien
aatacgagtttaatgaagtgttttasagaccatcttgaaaatccgattat

SEQ ID NO: 4349 - DNA, 50 bp, homo sapien
ttctgtgtgctttcaaccaatcgtaratgtttttgctgttccattctgtg

SEQ ID NO: 4350 - DNA, 50 bp, homo sapien
tctgctattagtgattacatgaaggratgacaaaaaacaagttataggaa

SEQ ID NO: 4351 - DNA, 50 bp, homo sapien
taagtctgcttgaatgagagttgtcrcaatagagaggtgtgttctgtttg

SEQ ID NO: 4352 - DNA, 50 bp, homo sapien
agactgcacatgtaataattctggakaagccagggtacataaagccatgt

SEQ ID NO: 4353 - DNA, 50 bp, homo sapien
ctatttctgtgaagaaggtcattgayatcttgatcagaattgcattgagt

SEQ ID NO: 4354 - DNA, 50 bp, homo sapien
aaatattatcttgaatagaatgatcsactcatgctacagagtggtagaaa

SEQ ID NO: 4355 - DNA, 50 bp, homo sapien
aaaattaaaaaaataaaatatcagaygaaatggtcagtgtattaaacact

SEQ ID NO: 4356 - DNA, 50 bp, homo sapien
aatgtttacatgggagaatgagtgasacttaaattcatgctcttaaaaaa

SEQ ID NO: 4357 - DNA, 50 bp, homo sapien
tgtgaaatgtggatagcaacactaarcctaatgaaagacctttagctaat

SEQ ID NO: 4358 - DNA, 50 bp, homo sapien
aagatagttgaatttggcaacaagamcttgagtggagctatagcatggca

SEQ ID NO: 4359 - DNA, 50 bp, homo sapien
acggatttttcacagaatcccagacracaaagtgaaatgccattcaaatg

SEQ ID NO: 4360 - DNA, 50 bp, homo sapien
cctccaggctttgttcttacttctcragactgttctggctatttgtggtc

SEQ ID NO: 4361 - DNA, 50 bp, homo sapien
aaaatccaccattcttatctttcaaygtcttccttagaagtaaagcatat

SEQ ID NO: 4362 - DNA, 50 bp, homo sapien
catttcctattttaatctctcataargtacaatcagttacagttaagttt

SEQ ID NO: 4363 - DNA, 50 bp, homo sapien
ttgctcaagtgccctttttgggaacyggataatgagtcttagacatcata

SEQ ID NO: 4364 - DNA, 50 bp, homo sapien
gggaaacaaggagttggagaaactcragctactgttgcaaagatcccaaa

SEQ ID NO: 4365 - DNA, 50 bp, homo sapien
cagccacatgccaggaattgtgctaratacaaaaatgcactgatgtgtaa

SEQ ID NO: 4366 - DNA, 50 bp, homo sapien
gcggaagtgtgggatgacactaggaygctgatgaatgtcattagagcata

SEQ ID NO: 4367 - DNA, 50 bp, homo sapien
ttttaaaaaattgaggcaaaaagaawtgaagcaaattgatagaacataca

SEQ ID NO: 4368 - DNA, 50 bp, homo sapien
aagttaatgataaacgatgctcttaygattgtagaggggacggaagggac

SEQ ID NO: 4369 - DNA, 50 bp, homo sapien
tatacttaaagtaccgtacagtgaartcatcactaaaccactgaaaagaa

SEQ ID NO: 4370 - DNA, 50 bp, homo sapien
aggctttcctcaagacaaatgacgaygaatgaggtagaaaacaaaggcct

SEQ ID NO: 4371 - DNA, 50 bp, homo sapien
aaaaattatttgggaacttaagacamtgaagacctctgatttgaactaga

SEQ ID NO: 4372 - DNA, 50 bp, homo sapien
attttataagttaagtctcagtatgyatggtttattttctttcctttgtt

SEQ ID NO: 4373 - DNA, 50 bp, homo sapien
gaagaatatgaagatattagacaggrccattatgagtctctcaaggtaag

SEQ ID NO: 4374 - DNA, 50 bp, homo sapien
agctaccctatttccttcagtagtayctagctatgaaaccagaaaaagaa

SEQ ID NO: 4375 - DNA, 50 bp, homo sapien
gaaaagttgtttctcatcagctaaayagagcaagagagttttaagcagtc

SEQ ID NO: 4376 - DNA, 50 bp, homo sapien
tagtggagaaaataaggtagatactmaaatgagcctatgagtacacgttg

SEQ ID NO: 4377 - DNA, 50 bp, homo sapien
taaaaatccatttctgttgttgtcaycgtgagttcatgattgcccaacat

SEQ ID NO: 4378 - DNA, 50 bp, homo sapien
tgtctcctgatgagttgcaattggarctacatatcacctgtaaagtcttc

SEQ ID NO: 4379 - DNA, 50 bp, homo sapien
cattgttcattgaattagaatttagraataggcagatccaaggtgttttt

SEQ ID NO: 4380 - DNA, 50 bp, homo sapien
ggcaatttgttacaaagcaaatggcraatcttaaaaagacaaaatcaaat

SEQ ID NO: 4381 - DNA, 50 bp, homo sapien
gtgaagttggtggtcattacgaaccragtatatccgtattttacatatgt

SEQ ID NO: 4382 - DNA, 50 bp, homo sapien
tgcttaatattagtgtaattaaaggrcactgatgtaggtaggtatgcata

SEQ ID NO: 4383 - DNA, 50 bp, homo sapien
caaatgtccatgtgtaggggactgaytaatgattatgaaacatctctcaa

SEQ ID NO: 4384 - DNA, 50 bp, homo sapien
gatgtttgtgatttagaaatgaaaarcgaattgtaagatgaaatatttgc

SEQ ID NO: 4385 - DNA, 50 bp, homo sapien
agaaagcgttgactctgtctccagcygaatggtcacttcttcatcagcca

SEQ ID NO: 4386 - DNA, 50 bp, homo sapien
gcaaagaaggctgagaaatattctcraagatgagacacacagaagccacg

SEQ ID NO: 4387 - DNA, 50 bp, homo sapien
taagtgaccttcttttgctcatttawacaaattcaatgaccaagacttca

SEQ ID NO: 4388 - DNA, 50 bp, homo sapien
tgctagaagggtcctctggtctcaasaaaagtttcaatagaagaaatggt

SEQ ID NO: 4389 - DNA, 50 bp, homo sapien
tggatattcacaggcacaaggatagyatgcttgattgaactcctggcccc

SEQ ID NO: 4390 - DNA, 50 bp, homo sapien
ttcattgaaatcataggaggtaggcratataataatcccatcttacagag

SEQ ID NO: 4391 - DNA, 50 bp, homo sapien
ttctatatttgttgacacataggatraactctaagatagattattcagtg

SEQ ID NO: 4392 - DNA, 50 bp, homo sapien
cagtttacatttaaaaatgtcataasatgcaattacaaatgccctaagat

SEQ ID NO: 4393 - DNA, 50 bp, homo sapien
cccacctttctaggtcaatcccatgyagagctttcatgtattgatttatg

SEQ ID NO: 4394 - DNA, 50 bp, homo sapien
aagacagtgtactctatcctcctaarctccgtacatcctatatctcatgg

SEQ ID NO: 4395 - DNA, 50 bp, homo sapien
ccaagaggggcttaagttggcatgayacattcttagtaaatctgagctgt

SEQ ID NO: 4396 - DNA, 50 bp, homo sapien
taactccgaggtttgtggtctaaaakatagggttgatgtgaaaagaactt

SEQ ID NO: 4397 - DNA, 50 bp, homo sapien
tggcacctaagtagggttctgaaaaytgaacaggaatgtaccatgctgac

SEQ ID NO: 4398 - DNA, 50 bp, homo sapien
tgtcttactcgtattcatacttaaartgtctgtcatagtgtgtaaaatat

SEQ ID NO: 4399 - DNA, 50 bp, homo sapien
tagaaaccctaatgtccaacattccrataacctctgggtaaactaagtga

SEQ ID NO: 4400 - DNA, 50 bp, homo sapien
ttccgataacctctgggtaaactaartgacagcaaaatctaagtagtctg

SEQ ID NO: 4401 - DNA, 50 bp, homo sapien
taattcatttgtacacacaattggamaaagccacttttagaaacaaatta

SEQ ID NO: 4402 - DNA, 50 bp, homo sapien
cttaggtttgattgcttaccttaaawtctaacctcagctttggtttttca

SEQ ID NO: 4403 - DNA, 50 bp, homo sapien
ctttagcagcccttatctttgctccrgactaacctgtggctgtgcccatt

SEQ ID NO: 4404 - DNA, 50 bp, homo sapien
acagggagaaaaagtggcgcctacawattgaggaaggccccagaagcagc

SEQ ID NO: 4405 - DNA, 50 bp, homo sapien
gcatgtgtttttaatgagctcatgayggtttctaacaaaggccaggttgt

SEQ ID NO: 4406 - DNA, 50 bp, homo sapien
acactattctgttaagaaaagacgaygggaactgcagaggaaaagggaga

SEQ ID NO: 4407 - DNA, 50 bp, homo sapien
ccctggtcctctgtatatactactaygattttccctatcttatcttgtac

SEQ ID NO: 4408 - DNA, 50 bp, homo sapien
caggcatttcgtcgctattaaaataygataactggctttcttcaggtaat

SEQ ID NO: 4409 - DNA, 50 bp, homo sapien
gcgagcaggacacgatgacaaatgayactagtcaggtatgagggagggta

SEQ ID NO: 4410 - DNA, 50 bp, homo sapien
agcaagtaaaggaaaagtgtaaggargaatttgtagaagaaatcaagaag

SEQ ID NO: 4411 - DNA, 50 bp, homo sapien
actgaaaaaagacctacttaggaaayagaaatacttctgagatattgata

SEQ ID NO: 4412 - DNA, 50 bp, homo sapien
tatcaccacggatctcaaagaaatayaagttaccatcagagaatactata

SEQ ID NO: 4413 - DNA, 50 bp, homo sapien
aaccatgccaaaggcaccgcctcacygaaagggatgattaagcatctttc

SEQ ID NO: 4414 - DNA, 50 bp, homo sapien
tacctactcaatcaaaccttttagcrccagcctgagaaacagaaaacatg

SEQ ID NO: 4415 - DNA, 50 bp, homo sapien
agccctggtcactctagtgcaagtcrcgttctgttcctgacttctgattg

SEQ ID NO: 4416 - DNA, 50 bp, homo sapien
ttcagaagcagaacctgagagatagrcaagtccattaaaatccattcaga

SEQ ID NO: 4417 - DNA, 50 bp, homo sapien
atgtgcagtacagatttcccttcctsaatcagaaaaatgttgctactatc

SEQ ID NO: 4418 - DNA, 50 bp, homo sapien
taaaatgttctgtatttgatcaaccyaaaatattataaccagaatgggct

SEQ ID NO: 4419 - DNA, 50 bp, homo sapien
gtacctcacccagtaatcataaataygtatagtaaattgtagaaatcaga

SEQ ID NO: 4420 - DNA, 50 bp, homo sapien
gggatagttaggaacaaggattagayggtttgcctaagtatgttgtagta

SEQ ID NO: 4421 - DNA, 50 bp, homo sapien
ataggattactcactcattcacgcaytcattcattggccagatctgtagt

SEQ ID NO: 4422 - DNA, 50 bp, homo sapien
atgccaagttttagcaatccagtaasaacctgatgatcaagagaagccta

SEQ ID NO: 4423 - DNA, 50 bp, homo sapien
tttacggctgaaatggtgcagtaaargagtaaagcaaaaaggagaaagag

SEQ ID NO: 4424 - DNA, 50 bp, homo sapien
tcactactaagccattatcttgcaayggtaaaaatcagaacagccataag

SEQ ID NO: 4425 - DNA, 50 bp, homo sapien
ggagatctctgcttaatcttttccaygtagctgacagatcaggtcatggg

SEQ ID NO: 4426 - DNA, 50 bp, homo sapien
tgcctgcatgcacgaatgtttgtaartaaatattaatgtgttggcatata

SEQ ID NO: 4427 - DNA, 50 bp, homo sapien
tttgttaccacttgcaatggtgaaartcccacagtgaatgggcacacagt

SEQ ID NO: 4428 - DNA, 50 bp, homo sapien
tctaaagctatgtgaagtatgattcmagacttttttttcaagcatatgca

SEQ ID NO: 4429 - DNA, 50 bp, homo sapien
atctttgctttgtttttatcaagacyactttattaacctatgtatttttt

SEQ ID NO: 4430 - DNA, 50 bp, homo sapien
tggaagagaaatcacagtataccaamgtcctggtccagttataagaatct

SEQ ID NO: 4431 - DNA, 50 bp, homo sapien
agtgaaaaacgccatgctgagaataygtaataatggactaggtagctata

SEQ ID NO: 4432 - DNA, 32 bp, homo sapien
atctctatcttaagccrcacatgttggaacta

SEQ ID NO: 4433 - DNA, 50 bp, homo sapien
acatttatcatgtctttgcggtaacrgcattcaaaatctcctcttctagc

SEQ ID NO: 4434 - DNA, 50 bp, homo sapien
tcttcttctgtggaagtacattctgsacagtaaagtgagaagactgaacc

SEQ ID NO: 4435 - DNA, 50 bp, homo sapien
gaggggtgtgatgggaatattgagaragtgtcatcaacattagactcacc

SEQ ID NO: 4436 - DNA, 50 bp, homo sapien
atagaaaggaggaagttgctttgatyagtaatttagttcactagtttgat

SEQ ID NO: 4437 - DNA, 50 bp, homo sapien
gaatctttaaaattactttgggacckgaaactgtctgaagtattacttta

SEQ ID NO: 4438 - DNA, 50 bp, homo sapien
ggtagtgttttggtgtctaggttaarcaactcaagtatacatgtaactta

SEQ ID NO: 4439 - DNA, 50 bp, homo sapien
agtagggtgggctacatggaattctraaatattgatataaagttatcttc

SEQ ID NO: 4440 - DNA, 50 bp, homo sapien
ctagataaagtgagtagaaaaattargaatcagtacatacgtgatcccag

SEQ ID NO: 4441 - DNA, 50 bp, homo sapien
tgaaatgagaacagtaactgaaatgmacagtccaaaaagaagcttttaaa

SEQ ID NO: 4442 - DNA, 50 bp, homo sapien
gaattaggttatttgacttaggaaasaatgagagcagatatcactaattg

SEQ ID NO: 4443 - DNA, 50 bp, homo sapien
gtgtgagtgtcgctatctagaaccgscatgaggaccaaacggaatttagg

SEQ ID NO: 4444 - DNA, 50 bp, homo sapien
ggtagagtgacccagtgctctcttayacttcgatgctgccaaacatccac

SEQ ID NO: 4445 - DNA, 50 bp, homo sapien
aaaagatccttaaacggagtaaaaaygtctataatgtcaaagtcagttat

SEQ ID NO: 4446 - DNA, 50 bp, homo sapien
aaagcagcctcattgtctggggtgayattcaacgttcactgtctcatagc

SEQ ID NO: 4447 - DNA, 50 bp, homo sapien
ctgacaacagctaacttaccaacagycctttacagagattaacagcaatt

SEQ ID NO: 4448 - DNA, 50 bp, homo sapien
caaccaaacttcgtgtgacctaaacygaaaaagagttcctgttatttgag

SEQ ID NO: 4449 - DNA, 50 bp, homo sapien
tctagtctttactcttcaccatgctmacaattctgaaatggttaactagt

SEQ ID NO: 4450 - DNA, 50 bp, homo sapien
ctttcaatgagacactaatatgaaayggctgctttttattaacaagtaac

SEQ ID NO: 4451 - DNA, 50 bp, homo sapien
gcactgaggcgtgtgctagcgcccartgcgtcgacccaggcacggacttg

SEQ ID NO: 4452 - DNA, 50 bp, homo sapien
ctctctatgctgtttctattataagrcaatgacagcttggttgaagttga

SEQ ID NO: 4453 - DNA, 50 bp, homo sapien
ctgtgatttacgatgactaacatcaraataaaccttggggacaggagaag

SEQ ID NO: 4454 - DNA, 50 bp, homo sapien
gataaatgatcaatatcaagaatgaraggagacatcactatagaccccgt

SEQ ID NO: 4455 - DNA, 50 bp, homo sapien
aggatggatagatttcacacatggakgccagtctgcagggtatggcactg

SEQ ID NO: 4456 - DNA, 50 bp, homo sapien
aaactgaaattgaaagactgagtaamatatcccatttaacaacataacta

SEQ ID NO: 4457 - DNA, 50 bp, homo sapien
tgctctcccatgaggcctttcaggtkacactcaaaattagcctcctatag

SEQ ID NO: 4458 - DNA, 50 bp, homo sapien
tacaagtatattccgttgattcatargcacacctgagttatgtgaatttt

SEQ ID NO: 4459 - DNA, 50 bp, homo sapien
atttgaaaagttattgacatttacaytctcatatttaacatgttgtcagg

SEQ ID NO: 4460 - DNA, 50 bp, homo sapien
aaagaacaaagcctctgaacctagcrataataggtcttcctcaggaagaa

SEQ ID NO: 4461 - DNA, 50 bp, homo sapien
ctgcaaaaggtctgactgatataccsaggtaccaatacttcagaataaat

SEQ ID NO: 4462 - DNA, 50 bp, homo sapien
atttttcatttgctattgatttatayactattctggtgaagttacctttt

SEQ ID NO: 4463 - DNA, 50 bp, homo sapien
caaatatacttacaatgactgaaatyagagtccacaatcattgccagaaa

SEQ ID NO: 4464 - DNA, 50 bp, homo sapien
tggcacaatttagaaactagcaatcragacaaataaggatagttgatata

SEQ ID NO: 4465 - DNA, 50 bp, homo sapien
atgattggtttttaaatgtccatcargaacaatgcagggacagcttaggg

SEQ ID NO: 4466 - DNA, 50 bp, homo sapien
attttttaatagccaaaaattatcaygtaaggactgtcaaatcatatttt

SEQ ID NO: 4467 - DNA, 50 bp, homo sapien
ctttctactcctcacttattcttaayatcgtcaggctttccatctcattt

SEQ ID NO: 4468 - DNA, 50 bp, homo sapien
agctgtttctacagcatcctgtctgrattcccaatctgcagaacttgtga

SEQ ID NO: 4469 - DNA, 50 bp, homo sapien
tggtaatacagggctgcatcagagtsaattgtccaagtcacaggattctt

SEQ ID NO: 4470 - DNA, 50 bp, homo sapien
atgactcagaactgtggcaacttcastacaaatcacccttttgatccaca

SEQ ID NO: 4471 - DNA, 50 bp, homo sapien
tacaaaactgtctgtaaacaatctcyattgcattctgttcattaaccccc

SEQ ID NO: 4472 - DNA, 50 bp, homo sapien
gtgatgtaaaagtagtaatcctcctraaatggacctttactttcataaag

SEQ ID NO: 4473 - DNA, 50 bp, homo sapien
ccctgagacaggagacagacattgaytagtaaagaacctcaaataattgc

SEQ ID NO: 4474 - DNA, 50 bp, homo sapien
agcacttgggtgagcctggaataacrctgtcattatttgaactgagagag

SEQ ID NO: 4475 - DNA, 50 bp, homo sapien
ggttttgagaggaagtataacaagasagtgtggacaacacaagagaataa

SEQ ID NO: 4476 - DNA, 50 bp, homo sapien
ccatgctgataaaccagtaccaaaarcatatcaagaaaactataaagggg

SEQ ID NO: 4477 - DNA, 50 bp, homo sapien
aagcaatataagaattcctgcataaygtctttgagaagaatattctcctt

SEQ ID NO: 4478 - DNA, 50 bp, homo sapien
aggaactctctggtttgacgtaatcycacttatctatgtttgcttttgtt

SEQ ID NO: 4479 - DNA, 50 bp, homo sapien
aattatttgccatttataataatgcwgcactttcataataaaatatagca

SEQ ID NO: 4480 - DNA, 50 bp, homo sapien
ttagttaagaagacaaacattgtcargaacagaaaggtggtgctgtcaca

SEQ ID NO: 4481 - DNA, 50 bp, homo sapien
ctacgatgattttgttctcatgttcrcaaaactactgttagtagccttct

SEQ ID NO: 4482 - DNA, 50 bp, homo sapien
ttaggaaaatatgacacaaagaaaargagaagattgaaaaaataaataga

SEQ ID NO: 4483 - DNA, 50 bp, homo sapien
atttctaatataaattaaactagtcyataaaccaccggccacatgtagcc

SEQ ID NO: 4484 - DNA, 50 bp, homo sapien
gctcacaggctagatgggaaaatagrattatacagaaggagttactgtag

SEQ ID NO: 4485 - DNA, 50 bp, homo sapien
agacaccaggacacccttctgaaagrcatctttaaaatttatgcggaatt

SEQ ID NO: 4486 - DNA, 50 bp, homo sapien
aatttggtatccaagcaatttgaaaraaagctgagacattgagagaaggg

SEQ ID NO: 4487 - DNA, 50 bp, homo sapien
gtcacagacacacacaccctgccgargacagtgcacaggttaaatgtcaa

SEQ ID NO: 4488 - DNA, 50 bp, homo sapien
cacagttctgagtcatgagatttccygatgagagtgtctgttataaacaa

SEQ ID NO: 4489 - DNA, 50 bp, homo sapien
ctttctttcaaattgcttggataccraatttaacatggcttgtttcttcc

SEQ ID NO: 4490 - DNA, 50 bp, homo sapien
attcaaaaggcactgctaagataaawatcaaatgcatataaaatagaagc

SEQ ID NO: 4491 - DNA, 50 bp, homo sapien
cttaatgccagggttaagtagttaawtcaatagcagcaactaccttcttc

SEQ ID NO: 4492 - DNA, 50 bp, homo sapien
acttagactagaatgtgctattcgaygaacaatgtaaaaagctttggttt

SEQ ID NO: 4493 - DNA, 50 bp, homo sapien
cttcacccacttccctacttccaaarccatggaaaacatcactaatcagc

SEQ ID NO: 4494 - DNA, 50 bp, homo sapien
aatatgtctgctgaaaaaaattggartatatcaaaacacatccatcctga

SEQ ID NO: 4495 - DNA, 50 bp, homo sapien
cacatggaagacagaacagcaaatawcaaattacaaggaagctgcaggtc

SEQ ID NO: 4496 - DNA, 50 bp, homo sapien
atttttacacggccagaaagggaccragcaaacaagttccagcccctgct

SEQ ID NO: 4497 - DNA, 50 bp, homo sapien
cttcggagaggacattcagtcacttkaagggtgtcctcacagggtgtcct

SEQ ID NO: 4498 - DNA, 50 bp, homo sapien
taactgtattactactatgttatcgyccatactatccaggtccacaactt

SEQ ID NO: 4499 - DNA, 50 bp, homo sapien
ttctttgttttgtgtattcacctgamgttgtggacctggatagtatggac

SEQ ID NO: 4500 - DNA, 50 bp, homo sapien
ggtttatctaaaataatacttttacractccttattggctgacgtctctc

SEQ ID NO: 4501 - DNA, 50 bp, homo sapien
acagaaaataaactaggctatgttckcaaggaattcactgaataaactga

SEQ ID NO: 4502 - DNA, 50 bp, homo sapien
gtaaagccaaagagcaaatatagccraaagcactaatcacactcaagtaa

SEQ ID NO: 4503 - DNA, 50 bp, homo sapien
taattttaaatggcccagtctaagartcacatgcagttgaaagatcctta

SEQ ID NO: 4504 - DNA, 50 bp, homo sapien
tgcagccaagaatttaagaagtttcrccaataaagaggcaaagaatccct

SEQ ID NO: 4505 - DNA, 50 bp, homo sapien
gtcagaatgtactacaaacagaaaawtcgtttcataaattattgctgtta

SEQ ID NO: 4506 - DNA, 50 bp, homo sapien
accaagctcatcggccatcatgacartcacgcatgctcagttagtcccac

SEQ ID NO: 4507 - DNA, 50 bp, homo sapien
taaatatatctcattttgatataacratttgattcttagctcctttgtca

SEQ ID NO: 4508 - DNA, 50 bp, homo sapien
gctcctaagaatgaaggtgttctaayaggtctgtcagggatactacagga

SEQ ID NO: 4509 - DNA, 50 bp, homo sapien
ctcctcaaattgtgttatttcttccmattaattaaactgattatcttcta

SEQ ID NO: 4510 - DNA, 50 bp, homo sapien
ctttataacttaaggtaactttctgyatcttccatatgctaaataattta

SEQ ID NO: 4511 - DNA, 50 bp, homo sapien
actaagttatatactgtggagtaacsgtgtagctcatggtatgagttaaa

SEQ ID NO: 4512 - DNA, 50 bp, homo sapien
atttaaaatgctgttactatgaaaarcaccaaataaacccattcaaagtt

SEQ ID NO: 4513 - DNA, 50 bp, homo sapien
attcccaataactccattaattctaraagtctgctctgagtgtctcagtt

SEQ ID NO: 4514 - DNA, 50 bp, homo sapien
cttcagtaaagctagccagttaataygaaggtcaagttatcttgctctgc

SEQ ID NO: 4515 - DNA, 50 bp, homo sapien
tcaggtgagccttacttggatttcaygtgtccttgaaggagcaacatgtt

SEQ ID NO: 4516 - DNA, 50 bp, homo sapien
aaagaaaattttgaaaaatagagtcracaaagttctactgtcacattgga

SEQ ID NO: 4517 - DNA, 50 bp, homo sapien
ccacacatttaatgggactgattagmaattaaaaaatgtagccatttctc

SEQ ID NO: 4518 - DNA, 50 bp, homo sapien
tgatggatctgatcagaatatccaasagtagtggagaaatcataaactta

SEQ ID NO: 4519 - DNA, 50 bp, homo sapien
ttttctaatgggtcttaagactatamaactctaataggcccacattttct

SEQ ID NO: 4520 - DNA, 50 bp, homo sapien
ctcactcactaaaaatgctacttaartgacagaaaaggaataagacaaat

SEQ ID NO: 4521 - DNA, 50 bp, homo sapien
ttttaaaaacattgttatgaatcagyattataaaagcaggtttttttttt

SEQ ID NO: 4522 - DNA, 50 bp, homo sapien
ttggtgctccttgcgaagtgattgamctacacagatgatgccttttatgt

SEQ ID NO: 4523 - DNA, 50 bp, homo sapien
cagaatcttctgtttgtcttcatcaytaatcttgccttgaagtttctcat

SEQ ID NO: 4524 - DNA, 50 bp, homo sapien
tttttatatttttataagaagctaartagaagaataattgtatctctgac

SEQ ID NO: 4525 - DNA, 50 bp, homo sapien
gaaaaacaacaaaccatggatttaasaagctcagagagaacccaggcagg

SEQ ID NO: 4526 - DNA, 50 bp, homo sapien
tggaagggataattcttttggaacakgcttctcggttacttgccttagta

SEQ ID NO: 4527 - DNA, 50 bp, homo sapien
atttctgtatactgctctttgaaacwaagggaaggaatttagttgaagct

SEQ ID NO: 4528 - DNA, 50 bp, homo sapien
catgtcactattaattctggctctaygggattaaaaacaacaggccaaag

SEQ ID NO: 4529 - DNA, 50 bp, homo sapien
atttgtacatatcccttactcaaaawagatccattagttaaactattata

SEQ ID NO: 4530 - DNA, 50 bp, homo sapien
gagaagaaaaggagggatagaaagayatcaaacagctattctctattaaa

SEQ ID NO: 4531 - DNA, 50 bp, homo sapien
tatcaagtttagtgttaaccctgcgraataagttcagcatataggctaca

SEQ ID NO: 4532 - DNA, 50 bp, homo sapien
aaataaatagttgaaaaacattgacmgcttctaattctattaattataac

SEQ ID NO: 4533 - DNA, 50 bp, homo sapien
atatctttcgggagaccatttttcawtctactacatatatacccaatgtc

SEQ ID NO: 4534 - DNA, 50 bp, homo sapien
taaaatttgatggttagcaagaataygtatgggtagaggacacttactta

SEQ ID NO: 4535 - DNA, 50 bp, homo sapien
ttaaatgctacctgcagtatttttaycacactctcaatcatcactgtact

SEQ ID NO: 4536 - DNA, 50 bp, homo sapien
attgcagaagcataccttgggaatayggttaccaatgctgtggtcacagt

SEQ ID NO: 4537 - DNA, 50 bp, homo sapien
cctgatgttcaaatccaccgataagsaagttcatcatttactgtgctata

SEQ ID NO: 4538 - DNA, 50 bp, homo sapien
accacacatctccctttttcagaccrctgttcagacaacaaaatctctca

SEQ ID NO: 4539 - DNA, 50 bp, homo sapien
tgttgcctgcctcttttgcttctacragttgagatttaaatacatttttg

SEQ ID NO: 4540 - DNA, 50 bp, homo sapien
aatttcccaaacatacttaacaacaraacacttttgagctcatggaacta

SEQ ID NO: 4541 - DNA, 50 bp, homo sapien
cttgtagaaatgccatataaagtgarctcctgtattgatttgggcatgaa

SEQ ID NO: 4542 - DNA, 50 bp, homo sapien
ttatccttcaatttgtaggcaatgargtaggcgcttatatggactcccag

SEQ ID NO: 4543 - DNA, 50 bp, homo sapien
cgcggacagtttgcaatcaggtgtayatggttctaaattgtctacttact

SEQ ID NO: 4544 - DNA, 50 bp, homo sapien
atgcacataaatactcatatagtcaygcatttcaaaatagcaaaacgatg

SEQ ID NO: 4545 - DNA, 50 bp, homo sapien
tggagaaaccccgtctctaccaaaartataagattagccaggcctggtgg

SEQ ID NO: 4546 - DNA, 50 bp, homo sapien
ggtacacacacaagctggtcaactcrcttttcctagtgaaaggcgggcag

SEQ ID NO: 4547 - DNA, 50 bp, homo sapien
ctccagagataaacaccacaataacyatcaagaccacgacttaaacaagc

SEQ ID NO: 4548 - DNA, 50 bp, homo sapien
agatagcattacaaaaacataataayccatgccatacagtttatcttttt

SEQ ID NO: 4549 - DNA, 50 bp, homo sapien
accatcctgcccttggaaagaacaasactttacaggagctgcctcatttt

SEQ ID NO: 4550 - DNA, 50 bp, homo sapien
tatcttaatgttccaatgaaattaayggagaagtcaaaataaaagttaaa

SEQ ID NO: 4551 - DNA, 50 bp, homo sapien
tccatcaccaatacagataagttacyactttgtttgattatcataaacta

SEQ ID NO: 4552 - DNA, 50 bp, homo sapien
ttgaagcaatttaaaatgttttctcyatctacactagttggattttcttt

SEQ ID NO: 4553 - DNA, 50 bp, homo sapien
gcaagagatgacagtgaaggtcatartagagcagttatctgagccagaca

SEQ ID NO: 4554 - DNA, 50 bp, homo sapien
ttctgagaataagacctcgatttacrcagaaatgtttaatttgacagaat

SEQ ID NO: 4555 - DNA, 50 bp, homo sapien
atgcctttagaggaaggaaacagaaytagaagaagttggagggagactta

SEQ ID NO: 4556 - DNA, 50 bp, homo sapien
catttcccacattttggtcaaatgcygagcctagttctaccttttccaac

SEQ ID NO: 4557 - DNA, 50 bp, homo sapien
cagagatgtttaaataaatgtgatckaagttcatctctctaacacccaat

SEQ ID NO: 4558 - DNA, 50 bp, homo sapien
tatgctccctgtagttggatatctayaagacacattctcatagttgccac

SEQ ID NO: 4559 - DNA, 50 bp, homo sapien
cactccagggctttactcccataaargactcaccacactgctctgtaatc

SEQ ID NO: 4560 - DNA, 50 bp, homo sapien
ccacctagaagcaaactgcaaaagargtaggatggagtgacaggaaagca

SEQ ID NO: 4561 - DNA, 50 bp, homo sapien
atacctttcttctgctcatgctaacrctctcgataaaacccgttgacttt

SEQ ID NO: 4562 - DNA, 50 bp, homo sapien
tctggatgaagccattccttcttaaygtaattatgcccaatttcctgggt

SEQ ID NO: 4563 - DNA, 50 bp, homo sapien
agctgcatctactgcccataaactcratgtggctatttccacagggaagg

SEQ ID NO: 4564 - DNA, 50 bp, homo sapien
ggaccctcttccatgcaattattcaragaccaatctttttccatctcggc

SEQ ID NO: 4565 - DNA, 50 bp, homo sapien
agccaagcatatcaagaggcaatcarcattacaccaagatataaggttgg

SEQ ID NO: 4566 - DNA, 50 bp, homo sapien
taaataaataaaataaaacaagggawgtctcaatagaccatagataacat

SEQ ID NO: 4567 - DNA, 50 bp, homo sapien
cagtgacaaattttagaaggcagcayggttgtagagtaagagtgacatag

SEQ ID NO: 4568 - DNA, 50 bp, homo sapien
tgaagaaagctaaaaccgagggcatyatatcatcctttctcacacacacg

SEQ ID NO: 4569 - DNA, 50 bp, homo sapien
tgtgttagggaggtttcttactctayctctcattgtatgcttatggcata

SEQ ID NO: 4570 - DNA, 50 bp, homo sapien
accttttccaaaattccaatatctayagacaactactgaaattcttatat

SEQ ID NO: 4571 - DNA, 50 bp, homo sapien
tgtccttgagcttacagtaagggcaygatatacttcagtttaaagccctc

SEQ ID NO: 4572 - DNA, 50 bp, homo sapien
ctgaatcatcagtatagaatggttgyaattcaattagctgtcagggtata

SEQ ID NO: 4573 - DNA, 50 bp, homo sapien
atctaatacctcttctgtgagtcaaygaatttattaaagacaaatagtca

SEQ ID NO: 4574 - DNA, 50 bp, homo sapien
tgcaagcttaccgggaataatttaamccacaagaaagcaaattagcaacc

SEQ ID NO: 4575 - DNA, 50 bp, homo sapien
aagccaacagatacccaggaatccawgacaattcaaatcaaacatcacat

SEQ ID NO: 4576 - DNA, 50 bp, homo sapien
cacatagattttaagtcttggttagraggccattccctactctgagatta

SEQ ID NO: 4577 - DNA, 50 bp, homo sapien
ttcttatgagagtaggttatctccawtgaattttctaataatcaaattct

SEQ ID NO: 4578 - DNA, 50 bp, homo sapien
tctgctttcctctgacagaaggacargattcattataccatggttgaaaa

SEQ ID NO: 4579 - DNA, 50 bp, homo sapien
tagttattaaatatttttagcatcamccttggtcaagtaattgcattgtg

SEQ ID NO: 4580 - DNA, 50 bp, homo sapien
tacaagctactgtttaaagtggacargtataaccaagagcaggggactaa

SEQ ID NO: 4581 - DNA, 50 bp, homo sapien
aaatattacttattaggtgacaatcrcttctctagggatggggccacaaa

SEQ ID NO: 4582 - DNA, 50 bp, homo sapien
attgaagaaaacacaaggaaagaatmaacttgaagtcattcagaagtaac

SEQ ID NO: 4583 - DNA, 50 bp, homo sapien
caacttgtggtacctgtaaataggayggtttaaggcttccaaagtcctta

SEQ ID NO: 4584 - DNA, 50 bp, homo sapien
atgacactccttagaactatgcaagyaggcttcaaaaaaaaaagaatgga

SEQ ID NO: 4585 - DNA, 50 bp, homo sapien
ttgtatcccgtgcccctcagaccttsaagatggatgaactcctggctgag

SEQ ID NO: 4586 - DNA, 50 bp, homo sapien
tgcctgggttgaccattcacaagacragtaaacacagctgcccttgatag

SEQ ID NO: 4587 - DNA, 50 bp, homo sapien
tccattttatgctaacctagaataasgaatgtttgccgcacttaaattga

SEQ ID NO: 4588 - DNA, 50 bp, homo sapien
acgatgataaaaatttactctagtgmaacaaatggaaaaatatttaagca

SEQ ID NO: 4589 - DNA, 50 bp, homo sapien
gaaagtgtgaggacagcacagtaaayagaaggaaaattcccttagcagtc

SEQ ID NO: 4590 - DNA, 50 bp, homo sapien
tcatttcatgtttatatttattggcyattaaactttaaagaccagttgta

SEQ ID NO: 4591 - DNA, 50 bp, homo sapien
aggcaggggataaagagtcctctcawgaatcagagctgtcacaatagagc

SEQ ID NO: 4592 - DNA, 50 bp, homo sapien
tgagaacgtgtgggctttcttgcacycaatttattcacacaatttcatca

SEQ ID NO: 4593 - DNA, 50 bp, homo sapien
tacctattatttagtaacatgtttgraaataaatatgactaagactccca

SEQ ID NO: 4594 - DNA, 50 bp, homo sapien
aagtctgaggccatttatcaagaccyagttcagacacaagcacagtaggt

SEQ ID NO: 4595 - DNA, 50 bp, homo sapien
tcgtttctagatttatttactacacrcagactggaagtttttgacagaag

SEQ ID NO: 4596 - DNA, 50 bp, homo sapien
cggccactgtaggctccgtgccaaaractgagtgccaaaatgtgtgaaag

SEQ ID NO: 4597 - DNA, 50 bp, homo sapien
ttctctagaagtacaatgttctaatyactcctgagagactccatctgagg

SEQ ID NO: 4598 - DNA, 50 bp, homo sapien
tggttgcattggattctcattgaaartcctattccattctgttgtttttc

SEQ ID NO: 4599 - DNA, 50 bp, homo sapien
gtctaaaagcagtggccgaaaacacrcggggtggtcctaatcacaagctt

SEQ ID NO: 4600 - DNA, 50 bp, homo sapien
caacgaggcccatgcagttatcatckatttttatttttctctttaatcat

SEQ ID NO: 4601 - DNA, 50 bp, homo sapien
aatctccccaaatgttaaaagctgayagacacttaatttaaaagcctaag

SEQ ID NO: 4602 - DNA, 50 bp, homo sapien
ccttctttctaaagttatgtgaggartacagccttatcccagaagcacat

SEQ ID NO: 4603 - DNA, 50 bp, homo sapien
tgaggagtacagccttatcccagaascacatatatttcttctcaatggct

SEQ ID NO: 4604 - DNA, 50 bp, homo sapien
ttccaaaatgttagatgcctaaagartaaggtccaaatgctacaagccta

SEQ ID NO: 4605 - DNA, 50 bp, homo sapien
tgtcagtgaaacttgtacaatttaayatttgcaaacacgtaggatctcag

SEQ ID NO: 4606 - DNA, 50 bp, homo sapien
acaatcacagtgttaataggaatcckgactgttgaagctcctcactaaag

SEQ ID NO: 4607 - DNA, 50 bp, homo sapien
gcattaagtcagtgcagacggaatgraattgctgactttgcatctgcact

SEQ ID NO: 4608 - DNA, 50 bp, homo sapien
ttccctgggagccttctgacatttarcatttggtgattttatcatctcac

SEQ ID NO: 4609 - DNA, 50 bp, homo sapien
tatcagaacaagaagtctacagagasagtgaagtaattttttaaagaaac

SEQ ID NO: 4610 - DNA, 50 bp, homo sapien
gtttgaaattctaaatgagctactcrgagatttgccttagagtgcaggga

SEQ ID NO: 4611 - DNA, 50 bp, homo sapien
gataattctcttttattgcaataacrcttcaaataaataggctgacctat

SEQ ID NO: 4612 - DNA, 50 bp, homo sapien
ttataactatttgatgatgactttcwagggtctcctgcaacctaatgagc

SEQ ID NO: 4613 - DNA, 50 bp, homo sapien
gctaaagcagtcactcaggccagaartgttcagttcacacctccaggttc

SEQ ID NO: 4614 - DNA, 50 bp, homo sapien
aagcacaggtcatgttatttgcttcraaggattgtgctgaggctcaagga

SEQ ID NO: 4615 - DNA, 50 bp, homo sapien
aatactatataaccattttaaatgawgatgtaaatgcttaaacatcaata

SEQ ID NO: 4616 - DNA, 50 bp, homo sapien
acctagccttgatactataatgcagraagtccatattgaagcgtttacat

SEQ ID NO: 4617 - DNA, 50 bp, homo sapien
taaatgatgcaattgtgactaaagaragttttaagttggagatggttaaa

SEQ ID NO: 4618 - DNA, 50 bp, homo sapien
ctataggggtgtttgatatgaaagargagatttttaaccagagccattcc

SEQ ID NO: 4619 - DNA, 50 bp, homo sapien
gctaatattagatggcatactaggayggaagttaaagtaattcatcctaa

SEQ ID NO: 4620 - DNA, 50 bp, homo sapien
gtgctttcatttcattctgtttctaytaaaaaacctcctcagaaacgcaa

SEQ ID NO: 4621 - DNA, 50 bp, homo sapien
ttcaattgcaactgagagcgtatttyaaaaaggaatttggcttcaatgtc

SEQ ID NO: 4622 - DNA, 50 bp, homo sapien
gcaggatgtttgctgatagaacacartggctttcacgtaagcagcctagc

SEQ ID NO: 4623 - DNA, 50 bp, homo sapien
tccgggcgggtggtccactcacgtarctgctctctttacttctgttcaat

SEQ ID NO: 4624 - DNA, 50 bp, homo sapien
actactttggatactggtagttgcaytaggataatcagaatgggtttgga

SEQ ID NO: 4625 - DNA, 50 bp, homo sapien
cgccttcttccaagtgctgctcttcrctttagacgattaaaaatcatctc

SEQ ID NO: 4626 - DNA, 50 bp, homo sapien
ttaagtatcatacatttctaagacgsaagcacaatgccatcagtcagctg

SEQ ID NO: 4627 - DNA, 50 bp, homo sapien
cagcttttatgcagataaatgaggcyatctttcctgtccaccccaccacc

SEQ ID NO: 4628 - DNA, 50 bp, homo sapien
tttcttgagatgctaacctgaggcaytgataaactgaatgacctccccaa

SEQ ID NO: 4629 - DNA, 50 bp, homo sapien
cactgagagggcaactacgcaaaagrctgacaactagaccatatgtgaaa

SEQ ID NO: 4630 - DNA, 50 bp, homo sapien
tctcataagtgaaggccagctatacrccatgcaaaacagggtgacatatt

SEQ ID NO: 4631 - DNA, 50 bp, homo sapien
tggggctcaaaaagtgaatgctccartggacaaggggacaaggcggatgt

SEQ ID NO: 4632 - DNA, 50 bp, homo sapien
taatagatttttacaccatgatcgarcccgtacacacacacggaaaagtt

SEQ ID NO: 4633 - DNA, 50 bp, homo sapien
taccgtaagtttattataccactgaygaggagtccatttctctcgtgact

SEQ ID NO: 4634 - DNA, 50 bp, homo sapien
gcatccaacttgattcaattaatcartccggtattaacagtattatgtga

SEQ ID NO: 4635 - DNA, 50 bp, homo sapien
tataaaggccaatgacaaagatagayaatttgtttggcaataataatgat

SEQ ID NO: 4636 - DNA, 50 bp, homo sapien
aaaatcactttaattaacacaagaaktattcaagtgaatgactaaagtga

SEQ ID NO: 4637 - DNA, 50 bp, homo sapien
cctctggcagcactcagaatggtgaytaaaggcagcagctaggcaagtgg

SEQ ID NO: 4638 - DNA, 50 bp, homo sapien
tatctgtaggtctttacttctgacamcaggggaaaagagtcttgtcttcc

SEQ ID NO: 4639 - DNA, 50 bp, homo sapien
cccatcacctttggaccatgcaagawcatttttgggaagacaagactctt

SEQ ID NO: 4640 - DNA, 50 bp, homo sapien
taaattcaggtgactggcaattaccrctctgctaacatgatataaaagga

SEQ ID NO: 4641 - DNA, 50 bp, homo sapien
taagtacacagtttattgacaactamgtagagaaagagacatctgcctag

SEQ ID NO: 4642 - DNA, 50 bp, homo sapien
gaaagttggttcggacaaagacatcrgacgaaatctgtcagacatttttt

SEQ ID NO: 4643 - DNA, 50 bp, homo sapien
tcagctctaaggaagggctaagaatsaaggagtgctgtctcttagaagct

SEQ ID NO: 4644 - DNA, 50 bp, homo sapien
agctgaagggtcttctctctgtagcrctttaatcatatcagaagtcctaa

SEQ ID NO: 4645 - DNA, 50 bp, homo sapien
tgtttgtttctccataattctgtaaygtcttcgagagtttggaattttaa

SEQ ID NO: 4646 - DNA, 50 bp, homo sapien
gatcacccaaggagaaaaacctcacsatgtgcttatctctgcattggatg

SEQ ID NO: 4647 - DNA, 50 bp, homo sapien
tggtatatggggagtacaattaagakagatcctgtacctcaagcgtgtgt

SEQ ID NO: 4648 - DNA, 50 bp, homo sapien
agagtcaatgatgcattatcagaagrccataaaggatatcaatcttgcag

SEQ ID NO: 4649 - DNA, 50 bp, homo sapien
catactatctgtcctagtaagaaaayagatcaacgctgagtagaaactat

SEQ ID NO: 4650 - DNA, 50 bp, homo sapien
tgtagacctgtcctgaagctgagaarattggggccaagtgaggccatgca

SEQ ID NO: 4651 - DNA, 50 bp, homo sapien
tgtcaaatgaatgagaaatcctgagycataagtgaagttttctcattagg

SEQ ID NO: 4652 - DNA, 50 bp, homo sapien
caagaagtcctcatgagacctctgasagtataattgttaggctggcataa

SEQ ID NO: 4653 - DNA, 50 bp, homo sapien
cctgtgattccacataacccctaaayatccccgtggcacaggccatgtag

SEQ ID NO: 4654 - DNA, 50 bp, homo sapien
ctgtctttatgcccatatgaatccamtatttagcaccgactcatatgtga

SEQ ID NO: 4655 - DNA, 50 bp, homo sapien
ttaatggcatacttggaattataackgtgtgggcttgccatatccgcctt

SEQ ID NO: 4656 - DNA, 50 bp, homo sapien
ctttgcctgtttccagacacagtcaytatttatctgggcatagaatatga

SEQ ID NO: 4657 - DNA, 50 bp, homo sapien
tttatctgggcatagaatatgagaarctccctgaattcatgtggtggaaa

SEQ ID NO: 4658 - DNA, 50 bp, homo sapien
tgtgttttttatggcatcctttgacratttaaagtcatattataggaaac

SEQ ID NO: 4659 - DNA, 50 bp, homo sapien
tggggccagcgagcaggctaaagaamgaaaatgagcggaatagtcagacg

SEQ ID NO: 4660 - DNA, 50 bp, homo sapien
agttaatatgtggggacattcacgayggaaggcaatttgccaatattctg

SEQ ID NO: 4661 - DNA, 50 bp, homo sapien
agttaggctcataactactattgcaytgaaaattcctcaaacctactcct

SEQ ID NO: 4662 - DNA, 50 bp, homo sapien
aaagcttaaaagtcaagaaagcagayggtaaaaggagcagagttgagaag

SEQ ID NO: 4663 - DNA, 50 bp, homo sapien
acccccagccaggcaaggttcttaaygtctacgagccacagtttccttat

SEQ ID NO: 4664 - DNA, 50 bp, homo sapien
cagaattagcattagctgtaccaatsaaatcaacatgaacatgcgctttt

SEQ ID NO: 4665 - DNA, 50 bp, homo sapien
gcttggatgcagtattttgcaggaamctacagtaggcaggtcttgctagt

SEQ ID NO: 4666 - DNA, 50 bp, homo sapien
gacagcagatacttgtgcctctttarggatacagtaagaggtatactgcg

SEQ ID NO: 4667 - DNA, 50 bp, homo sapien
tttttgccaagtcatacaacatactkaatgcagggctacactgaacctcc

SEQ ID NO: 4668 - DNA, 50 bp, homo sapien
cattaaaaagtcaaatggaggaagayggtgcacctagcatggggccgtcg

SEQ ID NO: 4669 - DNA, 50 bp, homo sapien
tttgtgaacttctaaaaatgcatgaygtttttggctggaaataatatatt

SEQ ID NO: 4670 - DNA, 50 bp, homo sapien
ctgtcctgtacgtcagaaagtataamgtgactccatttcaaagttccaga

SEQ ID NO: 4671 - DNA, 50 bp, homo sapien
cctatgagctagaagaacaacacaasggcaacgtataatggtgcgagggg

SEQ ID NO: 4672 - DNA, 50 bp, homo sapien
gggttacaacataatgatgttttcgracctgcccaacgccaacactccat

SEQ ID NO: 4673 - DNA, 50 bp, homo sapien
ccctgccaatgaacaacctatttaamagcaaatacactatgaggattttt

SEQ ID NO: 4674 - DNA, 50 bp, homo sapien
tcttgagattttctatgtagacaatsaagtcgtgtgtaaaatagagagtt

SEQ ID NO: 4675 - DNA, 50 bp, homo sapien
ttttggaaacaagctctcctagcacractttctgggccagggacctcacc

SEQ ID NO: 4676 - DNA, 50 bp, homo sapien
aacataacatccatggtaaatataaygatacaaaaatctgttacatttag

SEQ ID NO: 4677 - DNA, 50 bp, homo sapien
tttgcaatcctcatgctgaaaatgartaacgagcccttttctgtgcttgc

SEQ ID NO: 4678 - DNA, 50 bp, homo sapien
tgacatggcattctctacctaatgarcaattgcatttgattcttcacagc

SEQ ID NO: 4679 - DNA, 50 bp, homo sapien
caagaagagagtctttgtcagcgggmatgtaaccaagtatccccatttat

SEQ ID NO: 4680 - DNA, 50 bp, homo sapien
tgcaaaaatatgtgtaaagacaagasagaaaatattgttgtctagtacta

SEQ ID NO: 4681 - DNA, 50 bp, homo sapien
tggaacccagcaaatgtagtaactcyagcggaccatgctgtgcctggcag

SEQ ID NO: 4682 - DNA, 50 bp, homo sapien
tattttagttcaaataagtgccagarggttgagtttttgaataaatgtgg

SEQ ID NO: 4683 - DNA, 50 bp, homo sapien
gagcaggaatagagatgggattggcratagtctattagtccagggctttg

SEQ ID NO: 4684 - DNA, 50 bp, homo sapien
ttactgctttcttcctgaataaaccygacctatagaggacaacaaaccac

SEQ ID NO: 4685 - DNA, 50 bp, homo sapien
aagctttagtgttgaattgttaatayactaatcttctttgacctaaaaca

SEQ ID NO: 4686 - DNA, 50 bp, homo sapien
ttgattttatctagaaattatcagaytagaaatggctctccatagacaga

SEQ ID NO: 4687 - DNA, 50 bp, homo sapien
tctgcagactgagctaagccaaaaaratgtgtgacatgctcttgtacatt

SEQ ID NO: 4688 - DNA, 50 bp, homo sapien
taaaaacagatcctctttatattgasagaaacccatttttgtttgagaat

SEQ ID NO: 4689 - DNA, 50 bp, homo sapien
aagaaacagaaaactcaattcaaacrggcttaaagttgattcatttatag

SEQ ID NO: 4690 - DNA, 50 bp, homo sapien
ttaatgccaaaaagctgtaccgttamaatggttacaatggtaaattgtat

SEQ ID NO: 4691 - DNA, 50 bp, homo sapien
agtatcttacagcttctagagcaacmaagacccaaactttctataaatga

SEQ ID NO: 4692 - DNA, 50 bp, homo sapien
aagaaggatcctaataaagataagaraatagctgataaaatattgatacg

SEQ ID NO: 4693 - DNA, 50 bp, homo sapien
ggatgtcacgtctccttagcaatccragttatatggaataatctagaaca

SEQ ID NO: 4694 - DNA, 50 bp, homo sapien
aaaaagtatagaatgaataataactsagatgcaaagaggcttaagattta

SEQ ID NO: 4695 - DNA, 50 bp, homo sapien
agccaaacaaccctcatgatacttcrcagatacggaaaagataatccatt

SEQ ID NO: 4696 - DNA, 50 bp, homo sapien
gtattacattttctatatttactaamgatccttttcactacaaacatcat

SEQ ID NO: 4697 - DNA, 50 bp, homo sapien
tctcaaaatagaagcattttttaccrgaagtgtcaggggtcatttgaaaa

SEQ ID NO: 4698 - DNA, 50 bp, homo sapien
catttgcattttcttttttggaagarcatcgctttgctttaaactattaa

SEQ ID NO: 4699 - DNA, 50 bp, homo sapien
aacaaaatgtcaagggaataagaacrctcctcaaggaataaattaattcc

SEQ ID NO: 4700 - DNA, 50 bp, homo sapien
gtgtttcttcttcatatgttagtgaytattttaatggatttttaatcctc

SEQ ID NO: 4701 - DNA, 50 bp, homo sapien
aattttattttgcctgaaataattarattgtttgtttctgagaagctgta

SEQ ID NO: 4702 - DNA, 50 bp, homo sapien
gcgaataacaaggtaatttttgaagmctgagtatataaaataccttattc

SEQ ID NO: 4703 - DNA, 50 bp, homo sapien
cgatgtgtcatacagagacggaagasaggaatcggggaaaagggagaggg

SEQ ID NO: 4704 - DNA, 50 bp, homo sapien
tgaaatcttaatgcttaggtaagaargacagcagttttggaggagaaaag

SEQ ID NO: 4705 - DNA, 50 bp, homo sapien
atgactaacttgaggtggtagatacrgaatttgttttgggtgtattgagt

SEQ ID NO: 4706 - DNA, 50 bp, homo sapien
ccctggtttacctttgtttgctccamgtgtttcagttcctacctttttcc

SEQ ID NO: 4707 - DNA, 50 bp, homo sapien
gaagcacctaaacttaataaaaagayggagagtatataagataagaacaa

SEQ ID NO: 4708 - DNA, 50 bp, homo sapien
acagatacacctacacttacaaaaawtgctagataaacagcacattattg

SEQ ID NO: 4709 - DNA, 50 bp, homo sapien
catagtaaattgctcagtttaccaaygtcctccgttaacaacaacagcaa

SEQ ID NO: 4710 - DNA, 50 bp, homo sapien
accacttaacacaaaagaatgattayggagcttcacatgcaacattatcc

SEQ ID NO: 4711 - DNA, 50 bp, homo sapien
taatttatcccaagatcacaagttasatgttagctcccctattggagggc

SEQ ID NO: 4712 - DNA, 50 bp, homo sapien
gtattgattttctaaattttagcggrcaattattttagactcatgaacat

SEQ ID NO: 4713 - DNA, 50 bp, homo sapien
tcttaagaccattggctgcaaagtakgttgtatggaaagtaattgctggc

SEQ ID NO: 4714 - DNA, 50 bp, homo sapien
gccaatgacagtaaaagctctgttaycagaccactgggggagtgaccgca

SEQ ID NO: 4715 - DNA, 50 bp, homo sapien
tcccttccaggaattccactctttawctcctaaacaggaaggagtacatt

SEQ ID NO: 4716 - DNA, 50 bp, homo sapien
tagttttggtagtaaaatcaactccraagtattagataccattttaaaaa

SEQ ID NO: 4717 - DNA, 50 bp, homo sapien
gtgttctgtgacatgagctcagaaaygtcttcccactatctttgatttca

SEQ ID NO: 4718 - DNA, 50 bp, homo sapien
agcagcatggaaaagtgagctccaakaagtagcagagattggcaggagcc

SEQ ID NO: 4719 - DNA, 50 bp, homo sapien
aattccaaaaacaaaccaaatcctascagactagtggcacaaaataccgg

SEQ ID NO: 4720 - DNA, 50 bp, homo sapien
atgccacgtgatccttcaccaaactkagttataatctcgggaaaacaaac

SEQ ID NO: 4721 - DNA, 50 bp, homo sapien
tagagttgtcctgcgttaagtcataygaaggagtttgatccttttctaag

SEQ ID NO: 4722 - DNA, 50 bp, homo sapien
tgcttgggtgctttgagaacatgtaraagggaaccaagtcctgattcgga

SEQ ID NO: 4723 - DNA, 50 bp, homo sapien
ggtgcattcatcaagtcatcattcasaaaaaagtatataagatagcaact

SEQ ID NO: 4724 - DNA, 50 bp, homo sapien
atgttccaaatatgggaacttgctcrctgagattttttgtttgttttcct

SEQ ID NO: 4725 - DNA, 50 bp, homo sapien
gactccttgaaaatacgatgtgaccragttttcagtgttaacaggaaccg

SEQ ID NO: 4726 - DNA, 50 bp, homo sapien
gctctgggacatgagttatgttcttsaaaattctgagtttgggctacatt

SEQ ID NO: 4727 - DNA, 50 bp, homo sapien
cccgtgaactgtaaacagattctcastatgcagcaggcaaatcgccttgg

SEQ ID NO: 4728 - DNA, 50 bp, homo sapien
acatgctacatgctttatgattccawctttatatcattctgaaatgtgga

SEQ ID NO: 4729 - DNA, 50 bp, homo sapien
gctatatgatctgacaagatacacayggtaaaatgaaagaaaattggttt

SEQ ID NO: 4730 - DNA, 50 bp, homo sapien
cttaaagacaatgcctgtcgatccaygggcaaccaatttcactgttattc

SEQ ID NO: 4731 - DNA, 50 bp, homo sapien
tcaagactggtctaagattcaaatamagtgagaacatgaaataatattgt

SEQ ID NO: 4732 - DNA, 50 bp, homo sapien
actgtgtttttctggaaatttgccckcttaatctatgtatgtatttaaaa

SEQ ID NO: 4733 - DNA, 50 bp, homo sapien
ctatggagacatccttgtgaaattaraatagctcttctcagtttatttat

SEQ ID NO: 4734 - DNA, 50 bp, homo sapien
actccatgggccacacttgggagaaygctagtctagactttaaccactct

SEQ ID NO: 4735 - DNA, 50 bp, homo sapien
ttttgattcacgcccattctgtaaarcattaggaggtcaaaggtgtatgg

SEQ ID NO: 4736 - DNA, 50 bp, homo sapien
tagctcaaagatctactggaaaaccmgaacttttagagctagaacatgcc

SEQ ID NO: 4737 - DNA, 50 bp, homo sapien
atcagtggccaacactgtttagaagraaaaattctagctctcttccccca

SEQ ID NO: 4738 - DNA, 50 bp, homo sapien
ggtgctatatttcctgcttacctgtraaatatataatgagttccaaagtc

SEQ ID NO: 4739 - DNA, 50 bp, homo sapien
agatttgaattacccatctgggcaartaaaaggaagcagcaacttaaatg

SEQ ID NO: 4740 - DNA, 50 bp, homo sapien
aaaggattgatggtttaatccgaaartgtaagtaattggatgtgcagtgt

SEQ ID NO: 4741 - DNA, 50 bp, homo sapien
tcttcacccagatcaccgtgatacakacttcctttgttttgctcgaatgt

SEQ ID NO: 4742 - DNA, 50 bp, homo sapien
gatgattaattttacatagagcagayatttaaccaagaatatagcactta

SEQ ID NO: 4743 - DNA, 50 bp, homo sapien
gggagtagtcataaaacatttattgragagcttacaactggaaatgccta

SEQ ID NO: 4744 - DNA, 50 bp, homo sapien
tcatggaaagttgattaagttttcasagtactttaacaaccaaagaaatt

SEQ ID NO: 4745 - DNA, 50 bp, homo sapien
ataaatgaacacaacagctctcacartctcaacccttggagatcatgact

SEQ ID NO: 4746 - DNA, 50 bp, homo sapien
ccagtaagaatgaaagagaagccaasagttaccaattgcaaggcttaatg

SEQ ID NO: 4747 - DNA, 50 bp, homo sapien
tcccaaatgctgagctcacctcttaraatttgcatcttctctcagatttt

SEQ ID NO: 4748 - DNA, 50 bp, homo sapien
ttctatttcttggaaaggcgtaaaayagcatggagttcagggatcagcac

SEQ ID NO: 4749 - DNA, 50 bp, homo sapien
gagaagttctcattattaagatttcsagacgttcatctgccttctttttg

SEQ ID NO: 4750 - DNA, 50 bp, homo sapien
atagcttatcctctgcagccaagggmaaaaagtgcttcgtttttgtttgg

SEQ ID NO: 4751 - DNA, 50 bp, homo sapien
tgtggcatggcagtttattatgggarcttattgcttaatgcctataaaaa

SEQ ID NO: 4752 - DNA, 50 bp, homo sapien
ctttacataatggacagtcaagtacrcagaaagcacagctgaaaataaaa

SEQ ID NO: 4753 - DNA, 50 bp, homo sapien
ggacttggagttaatttaacaaacartaggaagctcttatgactttggga

SEQ ID NO: 4754 - DNA, 50 bp, homo sapien
cacatttctggcaactaaggattgamaactgttaaaaaatatcatttccc

SEQ ID NO: 4755 - DNA, 50 bp, homo sapien
gtgcattcatttcaatgtgctttaasaggaaatgtgtagtcgtttgtaaa

SEQ ID NO: 4756 - DNA, 50 bp, homo sapien
tcaatatcctaattttggtgtcagaygttaaaaatgatagggaaatgaga

SEQ ID NO: 4757 - DNA, 50 bp, homo sapien
cacattatataaacaatgaggactaygttttttgacaaatgttaaaattt

SEQ ID NO: 4758 - DNA, 50 bp, homo sapien
tgagaaaattacttccattaggttcmaaaggatttattgagatcctaaaa

SEQ ID NO: 4759 - DNA, 50 bp, homo sapien
caaaatagctgatgcagagacctaartattcatagaacaaaaagtgaaaa

SEQ ID NO: 4760 - DNA, 50 bp, homo sapien
acccttgtagaggaaatgatagggaygtaaacatatttattactggcatg

SEQ ID NO: 4761 - DNA, 50 bp, homo sapien
ccccatactgttcctgtggcacctartaagtcttatgagatctgatgggt

SEQ ID NO: 4762 - DNA, 50 bp, homo sapien
taccaggtatacacatcctatcagasgtttgcaagagaggactttctaat

SEQ ID NO: 4763 - DNA, 50 bp, homo sapien
caagtatttgctaatggaattcaacragggaatactaggggaagtaagtt

SEQ ID NO: 4764 - DNA, 50 bp, homo sapien
gtgtatttctgagaaatagtctaagratatctagcttagcaattcttttc

SEQ ID NO: 4765 - DNA, 50 bp, homo sapien
atttgggtgaatagcaagatttatcraaatgaaaagcacagtaaatattg

SEQ ID NO: 4766 - DNA, 50 bp, homo sapien
acaaacaaaaaaagtagcaatgcaakttctccaccctctcaatccctcta

SEQ ID NO: 4767 - DNA, 50 bp, homo sapien
ctgttctgcacagataggggatcacrctctttcagatttcagaggcaact

SEQ ID NO: 4768 - DNA, 50 bp, homo sapien
agcaattccaaaattctatgttgcartataataagctcagaattttgtat

SEQ ID NO: 4769 - DNA, 50 bp, homo sapien
aagagaaaatctgtttcccaggttcrataggaaagaatggaatatgcacc

SEQ ID NO: 4770 - DNA, 50 bp, homo sapien
agtcaccttgaattgggattgaaatragcatacgtagcactcctcccttc

SEQ ID NO: 4771 - DNA, 50 bp, homo sapien
catagctgagggctgtaaatcgggayggatcagtcggtctgcccaccagc

SEQ ID NO: 4772 - DNA, 50 bp, homo sapien
ttataataattattaataaaacaacrcatgagttagaccaagagaaaagc

SEQ ID NO: 4773 - DNA, 50 bp, homo sapien
aacattgtttatctggatagttgaamagagctttttattaggaggatgta

SEQ ID NO: 4774 - DNA, 50 bp, homo sapien
gaccagccttggaaaactcactgaaraaagctcaattggactatgttgac

SEQ ID NO: 4775 - DNA, 50 bp, homo sapien
ctgatccaacattattttccttccamtctaatccagtatccctttgatcc

SEQ ID NO: 4776 - DNA, 50 bp, homo sapien
ctgggaaaggttgttataatgactcyatatccttgcataatttctcacgt

SEQ ID NO: 4777 - DNA, 50 bp, homo sapien
ctctatatccttgcataatttctcaygtgaatcagtcaggggcccaatcc

SEQ ID NO: 4778 - DNA, 50 bp, homo sapien
ttcagttttaaaatgaatgcaaataktaaaaaacaactcaaagctgttga

SEQ ID NO: 4779 - DNA, 50 bp, homo sapien
tttctcaagatcacagggaaaaatayggcagaactgcagttgaaacattt

SEQ ID NO: 4780 - DNA, 50 bp, homo sapien
cccaccaacagtgtaaaagtgaagcrattattaatgccattatatctgaa

SEQ ID NO: 4781 - DNA, 50 bp, homo sapien
tggtgtttatcggtcgcactaagccrcgtgagatgttctcagttcctatc

SEQ ID NO: 4782 - DNA, 50 bp, homo sapien
catcaatagttactgcagaaggagcrataggaactgagaacatctcacgc

SEQ ID NO: 4783 - DNA, 50 bp, homo sapien
tttaacgtatagaatagtttttaaaygtgaagtgctacagggaccactat

SEQ ID NO: 4784 - DNA, 50 bp, homo sapien
ttccatggcattatactgaggcgtasatgatctatcaaattaaatgaacc

SEQ ID NO: 4785 - DNA, 50 bp, homo sapien
gtgtctcagacattcgtgcagcaaaygtggtaccaaaggactcacacaag

SEQ ID NO: 4786 - DNA, 50 bp, homo sapien
gagaaacgaaaacaagctattttccrcgcccccctgtgaaaggcaggtcc

SEQ ID NO: 4787 - DNA, 50 bp, homo sapien
agctccacctggggaagtaaatctcrctgagctagaaaaggaccacactc

SEQ ID NO: 4788 - DNA, 50 bp, homo sapien
ttttgttacaataaacttgtacatayaattctgacacacatattttcata

SEQ ID NO: 4789 - DNA, 50 bp, homo sapien
agtagtctattaagtcttttctgcayagtcattctggctacacaacagaa

SEQ ID NO: 4790 - DNA, 50 bp, homo sapien
tacttacccctcttttaccactgtgratagggtacttagtgcttttaaat

SEQ ID NO: 4791 - DNA, 50 bp, homo sapien
tgctattaattcatgggtaaaaagasagtgttaacaggtataactgggaa

SEQ ID NO: 4792 - DNA, 50 bp, homo sapien
ttatttatatttttgtcattaaaaawtacctttcaaatctttatccaaat

SEQ ID NO: 4793 - DNA, 50 bp, homo sapien
attattgtaatgaacataccctatamtagattttaagacccatgttcgat

SEQ ID NO: 4794 - DNA, 50 bp, homo sapien
ttcactcaatcacttcccagatacartgagaggctactgaagggtccagg

SEQ ID NO: 4795 - DNA, 50 bp, homo sapien
tttccatctgtatatattttgtaacrcacatgggatatttgcatataaat

SEQ ID NO: 4796 - DNA, 50 bp, homo sapien
caatattgctactcagtgtgtttccratatttagagctcttagaagagaa

SEQ ID NO: 4797 - DNA, 50 bp, homo sapien
taagtacttccccatgcatcatctcrcgcgttctccatctgtgcatcctt

SEQ ID NO: 4798 - DNA, 50 bp, homo sapien
taaaatttgaaagttgtcataataawaattgagtaaaactaatattaaaa

SEQ ID NO: 4799 - DNA, 50 bp, homo sapien
cagagggcttgtctgatctatcttayatctgctattgttgggggacatat

SEQ ID NO: 4800 - DNA, 50 bp, homo sapien
catctttccactgaagccactggtaratctctatgttaccaaataccaag

SEQ ID NO: 4801 - DNA, 50 bp, homo sapien
aaaacgagagctataatcatcctaaygcaaaaacgaaaacagtacttaga

SEQ ID NO: 4802 - DNA, 50 bp, homo sapien
aaagcctaacagcaaatattctccaygctaagtacaaatttgggtaaata

SEQ ID NO: 4803 - DNA, 50 bp, homo sapien
agcgaccccatgaagcagacaagaarttactgtcatctccattttagaga

SEQ ID NO: 4804 - DNA, 50 bp, homo sapien
gcataggtggatatgtgtggaagaayaaatatcttggtttgtgtttgctt

SEQ ID NO: 4805 - DNA, 50 bp, homo sapien
aaaaatcaattcttcattcaattacyattcttggctgtgctatgatagct

SEQ ID NO: 4806 - DNA, 50 bp, homo sapien
tcaacagtctgtcttgttccagaacrgatttagaataggtgatttctgga

SEQ ID NO: 4807 - DNA, 50 bp, homo sapien
gccaaagacaagtctctaagtgaacrctaaaccaacattcactgtagacc

SEQ ID NO: 4808 - DNA, 50 bp, homo sapien
tgatagctactcctggtaaataatcrcgtcaaaataaaaccaatattaat

SEQ ID NO: 4809 - DNA, 50 bp, homo sapien
actgagtggtgatcttttctatgacygctcatcctgcagaagtggtgttg

SEQ ID NO: 4810 - DNA, 50 bp, homo sapien
cagccttctgtatgtcaatgaaacargactacaggggtatcaaagcatgc

SEQ ID NO: 4811 - DNA, 50 bp, homo sapien
tgaaggagtcacgaaggcttgaccaygttcggtagagtttttgagccaag

SEQ ID NO: 4812 - DNA, 50 bp, homo sapien
cctccattagacgataaactccttgkaggcaaagctctttttttgtgttt

SEQ ID NO: 4813 - DNA, 50 bp, homo sapien
gaacattaaaaaactcaagttcacargatttggatgtgaaggaaaggaaa

SEQ ID NO: 4814 - DNA, 50 bp, homo sapien
ttttatttaaggcaacttaatctgayggtaactagcttgtgttagacaat

SEQ ID NO: 4815 - DNA, 50 bp, homo sapien
ctgtatgctggcagaatgtctaattraaaggggcagcttaaaacatgggg

SEQ ID NO: 4816 - DNA, 50 bp, homo sapien
tattaatttgaaaaatgtttagtcartatagtctgcaaactgaagtttca

SEQ ID NO: 4817 - DNA, 50 bp, homo sapien
gctttcgtctgtgaagctgccactargtaggttttaagtagggagtagta

SEQ ID NO: 4818 - DNA, 50 bp, homo sapien
ccaagttctttctgctatgtctctaygcaaacttttacataaactgagaa

SEQ ID NO: 4819 - DNA, 50 bp, homo sapien
ttcttgaataaatgctaggtatactkaaaaaaaaatcactcctcggggag

SEQ ID NO: 4820 - DNA, 50 bp, homo sapien
atttcaaagaatagcaggtaatttawcccatagtgaatattaattaggca

SEQ ID NO: 4821 - DNA, 50 bp, homo sapien
ctaagcatttatatagtatttcattkaatcctcatgacaatctctgaggt

SEQ ID NO: 4822 - DNA, 50 bp, homo sapien
actggcacttttaaagaggatagggwcatgcaaattatattacaggcaaa

SEQ ID NO: 4823 - DNA, 50 bp, homo sapien
actactcttctgactggattttaatmaacaggccactggctcataaagac

SEQ ID NO: 4824 - DNA, 50 bp, homo sapien
gccccaactggagagtaagttgtatmataaaaggcacaattttcagtccc

SEQ ID NO: 4825 - DNA, 50 bp, homo sapien
ggaagagagatggattgtaaaggtcmacaaggttaagagatctcagaagc

SEQ ID NO: 4826 - DNA, 50 bp, homo sapien
ctttccaggccacattgttcccagayctctgaatgccctgggaagcttgt

SEQ ID NO: 4827 - DNA, 50 bp, homo sapien
ttccaagaatacatttctgattgaargacaagagatgggccaggtgcggt

SEQ ID NO: 4828 - DNA, 50 bp, homo sapien
tcattgttcccttctcgttccaagartacatttctgattgaaagacaaga

SEQ ID NO: 4829 - DNA, 50 bp, homo sapien
ttcatggagatgttgactttagaaaygcaaagcacgttttcctccaaacc

SEQ ID NO: 4830 - DNA, 50 bp, homo sapien
atatatgcctcctgtagacagaaaartattcctattcacactggtacagt

SEQ ID NO: 4831 - DNA, 50 bp, homo sapien
gattaaaaatgacaaagcgcaagtcrgacaactggcttccgaggagaagc

SEQ ID NO: 4832 - DNA, 50 bp, homo sapien
caatgtctacacaggtaaatgagaawttcaaatgatccgaaaaacaaatt

SEQ ID NO: 4833 - DNA, 50 bp, homo sapien
gcaattacattggtaatcaacctgamgaaataactctctctctctttttc

SEQ ID NO: 4834 - DNA, 50 bp, homo sapien
gtacaattaactagaaagaaggatcyactatgattgactataaaatgtgc

SEQ ID NO: 4835 - DNA, 50 bp, homo sapien
cagtcagtaatgtatcatgaatccasaagtaaactttagttctttctctt

SEQ ID NO: 4836 - DNA, 50 bp, homo sapien
ctcattaggttatagtatgtttataratttcaagactgtgattttatagt

SEQ ID NO: 4837 - DNA, 50 bp, homo sapien
ccatctgccttttttaaaatttgcaktattaccattgagcagctacaatg

SEQ ID NO: 4838 - DNA, 50 bp, homo sapien
ctagccccatggtttcaaatacaacsagcaatgaaatattttcacagcct

SEQ ID NO: 4839 - DNA, 50 bp, homo sapien
acatagacaccctccctgaaagtaaytggctttgcattcaagaaaaacac

SEQ ID NO: 4840 - DNA, 50 bp, homo sapien
ctgggaaatgacatgaaggtcactgraagatagatacttaaacattttga

SEQ ID NO: 4841 - DNA, 50 bp, homo sapien
cataaaatactttctctggttactaraatggaaatgttaagcatattttc

SEQ ID NO: 4842 - DNA, 50 bp, homo sapien
gtgtagttggtggtttggtcctaacrctattaactgcagaatttataaca

SEQ ID NO: 4843 - DNA, 50 bp, homo sapien
gcccaaagtggcagaggaagcataaratctgggtgtagaactttgggaaa

SEQ ID NO: 4844 - DNA, 50 bp, homo sapien
gtaaaggagcttcaaaacaattctcsagttaaataaagggatgccccagt

SEQ ID NO: 4845 - DNA, 50 bp, homo sapien
acttggcctttggtaatgctttgtayctttatttgagtgctagctacatg

SEQ ID NO: 4846 - DNA, 50 bp, homo sapien
gaaatcctgtctcatctgtgcattcrcttaaaaaacagtcgattgcatac

SEQ ID NO: 4847 - DNA, 50 bp, homo sapien
tgtaaatgtatacagcactatagtargatacttccaaattctgatgacag

SEQ ID NO: 4848 - DNA, 50 bp, homo sapien
tagacgaatttttcatcatctctctsaaactagtcgctcagtttgtaact

SEQ ID NO: 4849 - DNA, 50 bp, homo sapien
attaaaattaagagcttctgtccatyaaaaggcaacagagtgtgtaagac

SEQ ID NO: 4850 - DNA, 50 bp, homo sapien
cctcctccctctgcctcatgtatgcragtaaaagctaatcaactgctgat

SEQ ID NO: 4851 - DNA, 50 bp, homo sapien
ttgaataacaaccttttagtacccastgatttttggtcatgtcagagagg

SEQ ID NO: 4852 - DNA, 50 bp, homo sapien
gataaaacatgctgggtacttaataygtgcttgacattttgcatgacaat

SEQ ID NO: 4853 - DNA, 50 bp, homo sapien
ccccagttttaatgctgcaacacaartatagtaatcccatgcgctgcatt

SEQ ID NO: 4854 - DNA, 50 bp, homo sapien
actgcctctttccacggcacccaacsatccaaaagttactacccctcccg

SEQ ID NO: 4855 - DNA, 50 bp, homo sapien
tcagtttgtaactatagattttcackcagggcacgcaccaggcactcagt

SEQ ID NO: 4856 - DNA, 50 bp, homo sapien
aaagctctccagagggactaaggccygagatcggtttgttttcttgtgtg

SEQ ID NO: 4857 - DNA, 50 bp, homo sapien
ttgtgaacttctaaattgtttgcttkaagatagccttggtttgtatgggc

SEQ ID NO: 4858 - DNA, 50 bp, homo sapien
ttggaatgatctgcagtatatggcaygtcaaacaagaaagcttagcttcc

SEQ ID NO: 4859 - DNA, 50 bp, homo sapien
gcagcctatttgagaagctgcaggaygataagcaaccattagcatcagct

SEQ ID NO: 4860 - DNA, 50 bp, homo sapien
actgttcacctgataacaaatggcartgcaattaaatcattcaataagtg

SEQ ID NO: 4861 - DNA, 50 bp, homo sapien
ggaagggagggaaggaggaagaataragaacatgagattataaaactact

SEQ ID NO: 4862 - DNA, 50 bp, homo sapien
aacacaaaaaaaacaaattgagagarctagaaagtaccactatctatagc

SEQ ID NO: 4863 - DNA, 50 bp, homo sapien
cgaaaaaaccaaaaacctaccatagragtcttggtcaagcaacattccca

SEQ ID NO: 4864 - DNA, 50 bp, homo sapien
atatagtgtacctcacctgggtgtgkagcgttccagattctttaagatga

SEQ ID NO: 4865 - DNA, 50 bp, homo sapien
gcaaaatgtcctgaaatgtgcgtaaytcaaagccataataatgtcactga

SEQ ID NO: 4866 - DNA, 50 bp, homo sapien
agaggagtgttcttccaagactccaygaacaggaaaaagtcctggatagc

SEQ ID NO: 4867 - DNA, 50 bp, homo sapien
cccccatcttggccaagggaaccccraagaaatgtgaaaaactagtttag

SEQ ID NO: 4868 - DNA, 50 bp, homo sapien
attatggatgcttttcttagagttargatcacaaggcattgaaaagatta

SEQ ID NO: 4869 - DNA, 50 bp, homo sapien
aagtgcagccctgccaagagaataaraaaatggatcactgatcatgagct

SEQ ID NO: 4870 - DNA, 50 bp, homo sapien
caggacttctgtgatcttatattaaytactgttgagctgatattaattat

SEQ ID NO: 4871 - DNA, 50 bp, homo sapien
tctaatatggttcaaattaaccccartaggttcagtgtatttgtcgggaa

SEQ ID NO: 4872 - DNA, 50 bp, homo sapien
caagtgaaacacacccctaggcatayacgatggacagggaaatttaattt

SEQ ID NO: 4873 - DNA, 50 bp, homo sapien
tgaaaataaaaagcaataatgtagaygcttaggagtgaattctctaatac

SEQ ID NO: 4874 - DNA, 50 bp, homo sapien
atatgtaagttttcgattacactaayggacaagatcaacagatcataaaa

SEQ ID NO: 4875 - DNA, 50 bp, homo sapien
catgttcaagttgagttgaaatacascagtaactaagtagatatgctttg

SEQ ID NO: 4876 - DNA, 50 bp, homo sapien
cattgattataagctaagtttagggwatatttagttcaaattgctgctgg

SEQ ID NO: 4877 - DNA, 50 bp, homo sapien
tcttcttggcagatgttctttcttgsatgacgatggaattctctttccct

SEQ ID NO: 4878 - DNA, 50 bp, homo sapien
aaaactcgcaatccctgagtagagaraaggctccataaatgttgaatgaa

SEQ ID NO: 4879 - DNA, 50 bp, homo sapien
cggcctgtttcattcattttagaaakgaccaaattgtgagctgagatgaa

SEQ ID NO: 4880 - DNA, 32 bp, homo sapien
gaaaagcagagtggaayatagataagttcaag

SEQ ID NO: 4881 - DNA, 50 bp, homo sapien
acagtcggagagaagggccaagttcragggatgtttgttgtctttgattc

SEQ ID NO: 4882 - DNA, 50 bp, homo sapien
attaaaccagtacgtaagtatggaayagaattgacgtattatgttgagtt

SEQ ID NO: 4883 - DNA, 50 bp, homo sapien
agctgccagcagatacttatttgatyagtgaatgacctgacagtgtgtga

SEQ ID NO: 4884 - DNA, 50 bp, homo sapien
aagtatctgctggcagctggaattayggatgtcattttgcaggtgctatg

SEQ ID NO: 4885 - DNA, 50 bp, homo sapien
tgttttaatgtcagtcattccagatkagttattcaagaagatgtgaggat

SEQ ID NO: 4886 - DNA, 50 bp, homo sapien
gtggtggtggtgcactgctccattasgtcaggttgaatctggtatgatcc

SEQ ID NO: 4887 - DNA, 50 bp, homo sapien
ctaacaactattgttatacttcatamaatttttgtaacacctagaacagc

SEQ ID NO: 4888 - DNA, 50 bp, homo sapien
aatgtcaactgaacaagtgtttcaartatgcaatcaaggggactttagcc

SEQ ID NO: 4889 - DNA, 50 bp, homo sapien
tgaattggaacacttgctagataacyggcatcaaaattgtagatccagaa

SEQ ID NO: 4890 - DNA, 50 bp, homo sapien
actttttttcctcccaaatctatcamattgtaagtctgcagacattttaa

SEQ ID NO: 4891 - DNA, 50 bp, homo sapien
ttctttgcttttacaaatgttcaaamgtctgacatcatgagcacagccta

SEQ ID NO: 4892 - DNA, 50 bp, homo sapien
gcatcacagaaaccctagaatagaaytgagtgcatcaggaattgacaagg

SEQ ID NO: 4893 - DNA, 50 bp, homo sapien
ttttactgggtgcgaatgtctttcarcaaagtcctgctttataggctctt

SEQ ID NO: 4894 - DNA, 50 bp, homo sapien
cactgagtccttgctacttagaaggkaatacagtcctatacaaagatatt

SEQ ID NO: 4895 - DNA, 50 bp, homo sapien
gagcgaaataaacaatgggtctgacratataataattccgaacaatcctt

SEQ ID NO: 4896 - DNA, 50 bp, homo sapien
tagcttcccctttacaaatgaggtcracgaaagtaaagttaatgaagcaa

SEQ ID NO: 4897 - DNA, 50 bp, homo sapien
tattgagaaaaaaatagacctcttayaacaatagtgtgtaaaacataaag

SEQ ID NO: 4898 - DNA, 50 bp, homo sapien
tggcctgtagaactgcgatgtgatayatttgttgttttaagccacccaat

SEQ ID NO: 4899 - DNA, 50 bp, homo sapien
ttcatgttcgagtgctacctctcaartatcccctagatgatttcaattgt

SEQ ID NO: 4900 - DNA, 50 bp, homo sapien
tagtgattttgcagtcagacttaaarcgtctattatgcatcacggtctcc

SEQ ID NO: 4901 - DNA, 50 bp, homo sapien
cgagttcaagatacgttataggagaycgtgatgcataatagacgctttaa

SEQ ID NO: 4902 - DNA, 50 bp, homo sapien
ccactcttgactgagctctctaaggrcacagactatgtactaatcagctc

SEQ ID NO: 4903 - DNA, 50 bp, homo sapien
ggctgtaagttaaaccagatggtaaygaatagaagacattaaggtatgta

SEQ ID NO: 4904 - DNA, 50 bp, homo sapien
gtttttatctgtagaagtaacctaayctaaaatcactaacttttcaaaat

SEQ ID NO: 4905 - DNA, 50 bp, homo sapien
aaataagaccctcgtgaagccgagamcttgaggaatgacactcttgttaa

SEQ ID NO: 4906 - DNA, 50 bp, homo sapien
aggaccgggaggaactggaaaactayggatgtacaatgtatttgccctta

SEQ ID NO: 4907 - DNA, 50 bp, homo sapien
cgcgggaagtctgttatccttataastagcagattatcggagagaaagtg

SEQ ID NO: 4908 - DNA, 50 bp, homo sapien
atgatttacttttaaacctttgtcgsaattgtgattaagaatttgtgcct

SEQ ID NO: 4909 - DNA, 50 bp, homo sapien
acttgtaatcttggattacaggtgayggtttggtaacgactgctggtata

SEQ ID NO: 4910 - DNA, 50 bp, homo sapien
ctgaattctttagactgcattgaagratatttccattaatttactaatgc

SEQ ID NO: 4911 - DNA, 50 bp, homo sapien
tagccttgtgtacaaatgtacttaaytatctccagcttggggaaaggaga

SEQ ID NO: 4912 - DNA, 50 bp, homo sapien
aaacaggagactaactcaaattcgaygaacacttactgagccgtattcaa

SEQ ID NO: 4913 - DNA, 50 bp, homo sapien
ttttattataacttgtttatccttcyagtgtttcttgatgcaaatataag

SEQ ID NO: 4914 - DNA, 50 bp, homo sapien
aatctgagattctcatgtgaaagtayattgtttcctcatgccttctccag

SEQ ID NO: 4915 - DNA, 50 bp, homo sapien
cccaccgtgccaaggcccggtgataygaagagtcagggactttctcagca

SEQ ID NO: 4916 - DNA, 50 bp, homo sapien
tctcctgtgactaaccaatgtcttayacgaagcagcattctcttatgcag

SEQ ID NO: 4917 - DNA, 50 bp, homo sapien
ttctcatagtaccagcatttattacrgcacttatcttgtggttatggatt

SEQ ID NO: 4918 - DNA, 50 bp, homo sapien
tgtgctgatggctactgccttgcacrctgcaggtataggcaaatctggct

SEQ ID NO: 4919 - DNA, 50 bp, homo sapien
gggcaattgcactagcacgcacctaygtgaaacagacaagaattaggatg

SEQ ID NO: 4920 - DNA, 50 bp, homo sapien
tataacattgctatagtctatacctsaaagcctacacttttgagtttgaa

SEQ ID NO: 4921 - DNA, 50 bp, homo sapien
atctcccacattaccattagccaatraccctagatttacttaatagagga

SEQ ID NO: 4922 - DNA, 50 bp, homo sapien
tgttgtcattattgtgcaagcataaytccatttctaatttcatacacaca

SEQ ID NO: 4923 - DNA, 50 bp, homo sapien
cagaactaagcaccatccaatctcayctggattatcaaaatcacctccgc

SEQ ID NO: 4924 - DNA, 50 bp, homo sapien
ataagtgggtccagttgaaggtaaakagtgtacatttgtcatgatagtga

SEQ ID NO: 4925 - DNA, 50 bp, homo sapien
ttcaaaaacaatcagcaacacaagaygtggaaactaccttttggcagaat

SEQ ID NO: 4926 - DNA, 50 bp, homo sapien
agttgctgtaaatgtcaattctaagracagtcagttaacctaatcaataa

SEQ ID NO: 4927 - DNA, 50 bp, homo sapien
aggacagtcagttaacctaatcaatractcatactccatccaccaaagac

SEQ ID NO: 4928 - DNA, 50 bp, homo sapien
tatgatcagctctgttaaatatggcrcttcaggtaaggtagggtagtcga

SEQ ID NO: 4929 - DNA, 50 bp, homo sapien
tttatgacattgattcatgttgttgyatgtaaaagttgttcgttttttcc

SEQ ID NO: 4930 - DNA, 50 bp, homo sapien
cttatggcaggttatcctaaagttgrataattttgaggatttgaggggac

SEQ ID NO: 4931 - DNA, 50 bp, homo sapien
aatggtattaaacataaaactttcaygcttatataaacctgagagctcat

SEQ ID NO: 4932 - DNA, 50 bp, homo sapien
aataccaacctagtctaagatactawcatctgtcttctagacttcaactg

SEQ ID NO: 4933 - DNA, 50 bp, homo sapien
ctctctctctcccttgtctcgttaartggcagtccattccatccatgcac

SEQ ID NO: 4934 - DNA, 50 bp, homo sapien
caagtaaggctgcgaagtgctttacygaaaaaatatgtgttagataagct

SEQ ID NO: 4935 - DNA, 50 bp, homo sapien
gacatgacactctctcgggtcccaamtgccaagcaggacaaacggctcct

SEQ ID NO: 4936 - DNA, 50 bp, homo sapien
gctgtgaacattcattcaaacgtacygatcatgttttattcctatgagta

SEQ ID NO: 4937 - DNA, 50 bp, homo sapien
ggtcccaaatgccaagcaggacaaayggctccttattctcagctgaaaaa

SEQ ID NO: 4938 - DNA, 50 bp, homo sapien
ctgactttttattgtgctctaggtayacgtctcctttggtcagtaggaaa

SEQ ID NO: 4939 - DNA, 50 bp, homo sapien
ctgcagtgtgagcacagaggattaayggtagtcacagagagcctgagcag

SEQ ID NO: 4940 - DNA, 50 bp, homo sapien
aacatcaggtaaaactcctttaggarcaagacatctaataggctattgtt

SEQ ID NO: 4941 - DNA, 50 bp, homo sapien
caagtacaaagagtccctgacttacrgatgaaatggtgactgactgactt

SEQ ID NO: 4942 - DNA, 50 bp, homo sapien
tgtcagagagattgttattcctgaartatctcagtttatgtaacccaaaa

SEQ ID NO: 4943 - DNA, 50 bp, homo sapien
aaggatttggtaaatgcatgtgttarattcatcttttcagtcattgtata

SEQ ID NO: 4944 - DNA, 50 bp, homo sapien
ttttacttggagaacactttagtggraatgaccctttcaaaggatttggt

SEQ ID NO: 4945 - DNA, 50 bp, homo sapien
aaatgtgcaccttctggagaaaacartgttatattttacttggagaacac

SEQ ID NO: 4946 - DNA, 50 bp, homo sapien
tggctgtgcctgggcaggccctcacyggtaaacaatagggattctaaaaa

SEQ ID NO: 4947 - DNA, 50 bp, homo sapien
ctttataggcttcttatgaaacaatwatctactccattagaagaagccac

SEQ ID NO: 4948 - DNA, 50 bp, homo sapien
ccctggaagcacagagtaagaaatckccagacaattaatagctaatagtg

SEQ ID NO: 4949 - DNA, 50 bp, homo sapien
tacaaaatcggacttttgtgtgctaygaaccttctccagcttgcaaaaag

SEQ ID NO: 4950 - DNA, 50 bp, homo sapien
aagcaaggagatgggtctggagttasaagtcaataaaggatcaagggaag

SEQ ID NO: 4951 - DNA, 50 bp, homo sapien
taacagcaggatcaaggctagatagmagtagagttatcagaatgggagtg

SEQ ID NO: 4952 - DNA, 50 bp, homo sapien
gatactaaaacaataatacgtgtgaytaaaatagaatgatgtgactgcca

SEQ ID NO: 4953 - DNA, 50 bp, homo sapien
tggggccctaaacggaggtaattgaygagtgtcctgctgggtttaatatt

SEQ ID NO: 4954 - DNA, 50 bp, homo sapien
cagtgaaattgaatcactgtctctaycagaaaagcacattgccagcctcc

SEQ ID NO: 4955 - DNA, 50 bp, homo sapien
aaaccaagcatgctttctcaccgaaycctggatgcagcctcagaatcctc

SEQ ID NO: 4956 - DNA, 50 bp, homo sapien
caactattctaatgtataactacgasgaagatattatcacctgtatatta

SEQ ID NO: 4957 - DNA, 50 bp, homo sapien
cctatgttttaattttaggacactgmatatttgtgaaaagagctctgact

SEQ ID NO: 4958 - DNA, 50 bp, homo sapien
ggtatagtcttgtttacagttagaakttagcacatagtctgggttcaata

SEQ ID NO: 4959 - DNA, 50 bp, homo sapien
tccctttctggcttgtagacagcaaycttctccttatgcacccacatggc

SEQ ID NO: 4960 - DNA, 50 bp, homo sapien
agaatggtctcttcacaaaaaaatgrcactgaaaacagtgggtatccata

SEQ ID NO: 4961 - DNA, 50 bp, homo sapien
tctggagggactctgactgacataakcgtcactaaatcttaaagtgaaat

SEQ ID NO: 4962 - DNA, 50 bp, homo sapien
taattttgttatctgggctttatcartaaatttcaacttggaaagattac

SEQ ID NO: 4963 - DNA, 50 bp, homo sapien
aatcacatctggaagtgagcccatcragagagtgttctctacttcctaca

SEQ ID NO: 4964 - DNA, 50 bp, homo sapien
gcttcaaataaatgcaggtcaacatraggctacttgtttgtttttgcaaa

SEQ ID NO: 4965 - DNA, 50 bp, homo sapien
atgtgtcattaagataggacctttawgattttgatgttaaacaaatgtaa

SEQ ID NO: 4966 - DNA, 50 bp, homo sapien
ctatcttcataaatttttatccccaygagctaattgttttctccttcatt

SEQ ID NO: 4967 - DNA, 50 bp, homo sapien
aatgattgggaagattgatacaacamtacacaaacatttcttagacatca

SEQ ID NO: 4968 - DNA, 50 bp, homo sapien
ctcgtagaccaagtctcactttccgraacccattccttatggagatagat

SEQ ID NO: 4969 - DNA, 50 bp, homo sapien
cagtaccatgtggacattgaatctcygagaactcatatcgactgttgtgt

SEQ ID NO: 4970 - DNA, 50 bp, homo sapien
gagcacattgaaggagtgcagccaakttcaccttaaaatatggctccctg

SEQ ID NO: 4971 - DNA, 50 bp, homo sapien
ctgaggtggccttgggtctagaacayatgtgattgattgcctctgagttt

SEQ ID NO: 4972 - DNA, 50 bp, homo sapien
atagaaaaatataatctaggatcagmaaaaaattgaataaatcgaaccat

SEQ ID NO: 4973 - DNA, 50 bp, homo sapien
gatcctagattatatttttctatcartaagctgcaatatattctacttta

SEQ ID NO: 4974 - DNA, 50 bp, homo sapien
tgtcaaattggtaattatttcagaarcaaattaagataacatcttagaaa

SEQ ID NO: 4975 - DNA, 50 bp, homo sapien
agagacatcccagtgatattccacartcggtgtgttcaagcaggattgct

SEQ ID NO: 4976 - DNA, 50 bp, homo sapien
attactcacctcacattgtatgagcraaataaaattataccatgtaaaaa

SEQ ID NO: 4977 - DNA, 50 bp, homo sapien
gtatcttcttcgcaggaccatgtcayacgaccaaccctaactgcaaaagg

SEQ ID NO: 4978 - DNA, 50 bp, homo sapien
aatagagaaacttccaaatgttagtwaaacaatcaagtaatcaaagagat

SEQ ID NO: 4979 - DNA, 50 bp, homo sapien
agaggccaagctgattccagaaggcyatttaggttgaagggtgtttttag

SEQ ID NO: 4980 - DNA, 50 bp, homo sapien
taggatgccatggtacataagatgayatctgcctgatgagtgtttaataa

SEQ ID NO: 4981 - DNA, 50 bp, homo sapien
ttctgctcctaatatactgggatacraacaccgcctgaatccctggacct

SEQ ID NO: 4982 - DNA, 50 bp, homo sapien
tttaataactgaatagcatttcacaktatggctatagcacattattctgc

SEQ ID NO: 4983 - DNA, 50 bp, homo sapien
ctaattttacacataaaaacatcaargtccagggattcaggcggtgttcg

SEQ ID NO: 4984 - DNA, 50 bp, homo sapien
acactttcccgaccagaatgtgggayggatggataatagcccagaaccag

SEQ ID NO: 4985 - DNA, 50 bp, homo sapien
atggaaggatgaccctcaggggacasgattgtgcgcaccatcaatgctca

SEQ ID NO: 4986 - DNA, 50 bp, homo sapien
ggcttacacttactttgaggacgaasagaaaaaactccctttgtaattcc

SEQ ID NO: 4987 - DNA, 50 bp, homo sapien
tatctttaatgcctaccgtaaatctraagtgttatgagtatcatatatac

SEQ ID NO: 4988 - DNA, 50 bp, homo sapien
ctctcttgttgtctctgtcccgcgarcaagtaagtgttactttcccacca

SEQ ID NO: 4989 - DNA, 50 bp, homo sapien
agacataaatgcgaataagtgatagrcattttttactaaaatcaaaatat

SEQ ID NO: 4990 - DNA, 50 bp, homo sapien
cccttcttaagcttaaattattgcamccaaggtaaaatttcccaatgggt

SEQ ID NO: 4991 - DNA, 50 bp, homo sapien
aaaaattaccttggtggcattaaaamaattcattgatacggtggacaaac

SEQ ID NO: 4992 - DNA, 50 bp, homo sapien
ataggaaaacaaacttgaggatagartactgaagatggtaaacaaatact

SEQ ID NO: 4993 - DNA, 50 bp, homo sapien
atgctgatctttggctatcgacttaycattcaaaggctacttctctaatc

SEQ ID NO: 4994 - DNA, 50 bp, homo sapien
tgaccacctctggacaatcagctaaygcttttagaaaaacagatgttcct

SEQ ID NO: 4995 - DNA, 50 bp, homo sapien
atcactcaattaacagcacttggtaraacataccactggtttctcacctt

SEQ ID NO: 4996 - DNA, 50 bp, homo sapien
aaaatagatgcctagtaacctaacaytaattcggaaggctagcaatttgt

SEQ ID NO: 4997 - DNA, 50 bp, homo sapien
atactagtacagagctaaaattaaamatcaggtacatatgggaaagctta

SEQ ID NO: 4998 - DNA, 50 bp, homo sapien
aggaggcaattaaatttggaaggagmataatcgtggctttgtggaaggca

SEQ ID NO: 4999 - DNA, 50 bp, homo sapien
atttgtttttaaatattgctttgcasactcttctgtattgtggcaaatcc

SEQ ID NO: 5000 - DNA, 50 bp, homo sapien
gctgggaaggggccacttactttacrattgcttgacctcttgtctgaccg

SEQ ID NO: 5001 - DNA, 50 bp, homo sapien
aaatgggtaagcttttaatcttaccrgaagaggagtgattccgctctgta

SEQ ID NO: 5002 - DNA, 50 bp, homo sapien
ttaaggctgactcctacttgatttayatttttgccaataatttggtttta

SEQ ID NO: 5003 - DNA, 50 bp, homo sapien
gaacactgaagaaaattgaaggaaaraagtagagctcttagaaagaaagg

SEQ ID NO: 5004 - DNA, 50 bp, homo sapien
ccattccaggaatttttaatgatgargtccttgaagtcaatgtataaagt

SEQ ID NO: 5005 - DNA, 50 bp, homo sapien
ggcttgtatgtgtaagcatttcctcractggtatgagaatatagtgctgg

SEQ ID NO: 5006 - DNA, 50 bp, homo sapien
agaatcaacaggatgtgtgtatatayagaaggagatttattataaggaat

SEQ ID NO: 5007 - DNA, 50 bp, homo sapien
atgtccagtcaacattacgaaaacawcctcattagcctttatggggttgc

SEQ ID NO: 5008 - DNA, 50 bp, homo sapien
tatttgtgatgctaattttatgtgtsaaattggagatgttttggatgaga

SEQ ID NO: 5009 - DNA, 50 bp, homo sapien
caaattgtcaaaagttgcattaaaamtaagagaaattaacaatgtccagt

SEQ ID NO: 5010 - DNA, 50 bp, homo sapien
catcttgccctgtctcccttaactaygagccttgaaagtcattaagaagc

SEQ ID NO: 5011 - DNA, 50 bp, homo sapien
agctattcgaaagagtggatcacaaycttttttctacagagaggagtggg

SEQ ID NO: 5012 - DNA, 50 bp, homo sapien
gaagataaacttgacagtgtgcttgmaacaagtttatatttcttagcatt

SEQ ID NO: 5013 - DNA, 50 bp, homo sapien
ctgactggctaactcttgtcccatawaataactcttaattacttgtggga

SEQ ID NO: 5014 - DNA, 50 bp, homo sapien
aaagcttacatttgaaagagtcaacygttctaaaacgtttgtgaaatacc

SEQ ID NO: 5015 - DNA, 50 bp, homo sapien
tgtcaaatcggtaacttaaggtgtgratacaaagcagataggtactgtaa

SEQ ID NO: 5016 - DNA, 50 bp, homo sapien
tctcttgaaggaaacaaactattcartccctacaaaataatgccatcagt

SEQ ID NO: 5017 - DNA, 50 bp, homo sapien
taacaaacaaaacatgtgacaaattmaatccaatctggtatcttgatgaa

SEQ ID NO: 5018 - DNA, 50 bp, homo sapien
ctccagccatctgtcaagtctcttakggggttaccactattaatagtttc

SEQ ID NO: 5019 - DNA, 50 bp, homo sapien
gatgacttctgttgtagaattgtgarctttagaattaacagactagagtt

SEQ ID NO: 5020 - DNA, 50 bp, homo sapien
tcttaaatttgtctgaagatattatsataaaaataaactatcttgccatg

SEQ ID NO: 5021 - DNA, 50 bp, homo sapien
cagaccatttattatcaacttaacaytggaataatctgggaattaaaaaa

SEQ ID NO: 5022 - DNA, 50 bp, homo sapien
tgaaattgaaggaatgcaggtttgartaatatttctaaatagaagtatga

SEQ ID NO: 5023 - DNA, 50 bp, homo sapien
tgatttctcctgaagaattgtaagcmagggatttctactgggaaaccatt

SEQ ID NO: 5024 - DNA, 50 bp, homo sapien
taatgacctttacattcctattcaaratgtcatataaatactcaaagtta

SEQ ID NO: 5025 - DNA, 50 bp, homo sapien
tatacacagacaaacggtggctgaayacatttcttgtaactatcacatat

SEQ ID NO: 5026 - DNA, 50 bp, homo sapien
taaaccacagaaatgaataagtgcasaggtatgcctgcaaacacttcacc

SEQ ID NO: 5027 - DNA, 50 bp, homo sapien
gctaagcttcagagcccaactttcarccagacaggacctggatgcatact

SEQ ID NO: 5028 - DNA, 50 bp, homo sapien
cattgcgtagttagacactttgcagsatgacagagaatgtgttggataat

SEQ ID NO: 5029 - DNA, 50 bp, homo sapien
ttgagttaagggcactccaatgtccmggaatttaacctttttgtcagatc

SEQ ID NO: 5030 - DNA, 50 bp, homo sapien
tttattcatgggatttcaggacaccraactttttctcattttctacttag

SEQ ID NO: 5031 - DNA, 50 bp, homo sapien
cacatttttatggtttggtaatacaragtggtggacatcagagagaaaag

SEQ ID NO: 5032 - DNA, 50 bp, homo sapien
aagagaagcatcccattttattgatkacctatacccgaggtgaaaaccaa

SEQ ID NO: 5033 - DNA, 50 bp, homo sapien
tgtagcaaagggggaaagaaagtcartatgaagcattattaatcacaaat

SEQ ID NO: 5034 - DNA, 50 bp, homo sapien
acaaacaaaataaaactatagacaarttaaagttttcagagtttaactga

SEQ ID NO: 5035 - DNA, 50 bp, homo sapien
attattattattatgtattgtcttcrcttctatctggtgtacaactccct

SEQ ID NO: 5036 - DNA, 50 bp, homo sapien
ccttatcattaggttttgttggtaaygtttggagagtccatttttgacaa

SEQ ID NO: 5037 - DNA, 50 bp, homo sapien
ttttgttatttttttatttgttagasacgaattctgttgcctaggctggt

SEQ ID NO: 5038 - DNA, 50 bp, homo sapien
tagcaaagacatagctaagcattacraaactatcacgatgcctttatgat

SEQ ID NO: 5039 - DNA, 50 bp, homo sapien
aaggtaaattatcatccatcaagtasctaaggctgttgagaagaatttag

SEQ ID NO: 5040 - DNA, 50 bp, homo sapien
tctaaagtcacatgttgttcttttaygacttgttaaccttgtgtaagttg

SEQ ID NO: 5041 - DNA, 50 bp, homo sapien
tcatagacatctagtccaatttgtayagcttaactggaagaggcgtcttc

SEQ ID NO: 5042 - DNA, 50 bp, homo sapien
aaattttactgagacttcaaagagasagtatcgtggctggtgttttcctt

SEQ ID NO: 5043 - DNA, 50 bp, homo sapien
cgtttactgagtactctttaatggaratagcctgtatcgtataaccacaa

SEQ ID NO: 5044 - DNA, 50 bp, homo sapien
agcagtatataattttgctttaccgmagatttctaaactttacttgataa

SEQ ID NO: 5045 - DNA, 50 bp, homo sapien
tgaagtctttgcggaaaagaaccttsaactccaactcagaaaatacccac

SEQ ID NO: 5046 - DNA, 50 bp, homo sapien
aatgacttctatgacttttgtgacaratctttaatttttatctattatct

SEQ ID NO: 5047 - DNA, 50 bp, homo sapien
ttgggataaataaaatgatgttctaygtgacaaggattccttctgtaatt

SEQ ID NO: 5048 - DNA, 50 bp, homo sapien
aacagcagtaacataacattgactayaacaaagacaacaataacaatatt

SEQ ID NO: 5049 - DNA, 50 bp, homo sapien
actcactttaaatatcttaagaaaakcgttctataaagataatcgtgggt

SEQ ID NO: 5050 - DNA, 50 bp, homo sapien
ttggctttagctatgaaattgaactyaatgtaatactgttgaatctgatt

SEQ ID NO: 5051 - DNA, 50 bp, homo sapien
tttgtctaaagatatgggtggaagayatttaccttatattgactggttaa

SEQ ID NO: 5052 - DNA, 50 bp, homo sapien
aggtaagaaaatcttccataatcaasctacttatgttcgtcaagagtctc

SEQ ID NO: 5053 - DNA, 50 bp, homo sapien
tatttattctggtacaggatgtgttkaaaggcataggcaaaggccacatt

SEQ ID NO: 5054 - DNA, 50 bp, homo sapien
aatacatcccataccactgctgttcyctggatatttacagagctcaagac

SEQ ID NO: 5055 - DNA, 50 bp, homo sapien
tggtaataaactagcaaaaatataayggttgcctgaactaaaggattagg

SEQ ID NO: 5056 - DNA, 50 bp, homo sapien
gagtatttttttaagtatcaaataawgaccgatagaatttagtgatatac

SEQ ID NO: 5057 - DNA, 50 bp, homo sapien
ggggcaaggacatttattaagtagtracaacttgtatcttttgcaatgct

SEQ ID NO: 5058 - DNA, 50 bp, homo sapien
atagccaccaagatgataaagcacawattggtataaaccttgttagataa

SEQ ID NO: 5059 - DNA, 50 bp, homo sapien
atctaaattgcttgcctgtctctaawtggtagtggaaagaactctgtcca

SEQ ID NO: 5060 - DNA, 50 bp, homo sapien
ggctttaaatggggagatttgtaaayaggaaaagtcagtggaagtaagtc

SEQ ID NO: 5061 - DNA, 50 bp, homo sapien
tttcaaagtgatgtctacataataayctatcaattagcaagctactttat

SEQ ID NO: 5062 - DNA, 50 bp, homo sapien
ttttgaatttctatacaaataatcawactatatgtgactagcaataactt

SEQ ID NO: 5063 - DNA, 50 bp, homo sapien
agggatgacatggatgatactaagaraatacttcaaacactttaaataca

SEQ ID NO: 5064 - DNA, 50 bp, homo sapien
tacttatgggtgtttttaatgtcgawtcataggaaaccaaactattggca

SEQ ID NO: 5065 - DNA, 50 bp, homo sapien
aaacatttatgataaatctattccaygatactttctggatctcttttgta

SEQ ID NO: 5066 - DNA, 50 bp, homo sapien
tgttcaatctataactaagaaattayggcatgtaaagaaaaaaagaaaga

SEQ ID NO: 5067 - DNA, 50 bp, homo sapien
ctcattctgtatcaaggcatgcgtasagtactaaagtagaaaagtaaaca

SEQ ID NO: 5068 - DNA, 50 bp, homo sapien
atagtttcttgaataatttctagaaygaaaactgttgagaagtctttata

SEQ ID NO: 5069 - DNA, 50 bp, homo sapien
atttagtatatgtatcctactgctayggcattttataagataagggatca

SEQ ID NO: 5070 - DNA, 50 bp, homo sapien
gtaaaataaggatctttaaggaagartaaagaaaatagatggcaccaata

SEQ ID NO: 5071 - DNA, 50 bp, homo sapien
ttattatgttttgtcatgttcttaamtgtcttgttccaaatataggcttt

SEQ ID NO: 5072 - DNA, 50 bp, homo sapien
taaagatattgcgtaagaattgtcaracaactaactctttctgtggatcc

SEQ ID NO: 5073 - DNA, 50 bp, homo sapien
cttcatgttatagctaagttctagcycattttgttaaacagtttaccaga

SEQ ID NO: 5074 - DNA, 50 bp, homo sapien
cagaatgttcaaatgggaaagctcarattgattcctcttcatttgatgaa

SEQ ID NO: 5075 - DNA, 50 bp, homo sapien
ttagaagatacaactctcccaggaaraaagacgggcatctcatatgctta

SEQ ID NO: 5076 - DNA, 50 bp, homo sapien
cccggccctatacaaataatgttaayacacaggagtaaagtgtggcttta

SEQ ID NO: 5077 - DNA, 50 bp, homo sapien
tagttcctagtagtggatggtagcayggacatcaaattcaaacaaatctg

SEQ ID NO: 5078 - DNA, 50 bp, homo sapien
ctttcgttagccattttgattttcarcagtaaacttgagtcataccatgg

SEQ ID NO: 5079 - DNA, 50 bp, homo sapien
ttaattcatatccttgttctaaggaytaaaaatggaggaactagaatata

SEQ ID NO: 5080 - DNA, 50 bp, homo sapien
cactacaatttgcttaatttttacaygaattttctcttaaccagttttat

SEQ ID NO: 5081 - DNA, 50 bp, homo sapien
tatgacaagctcatggcataaaatakgaatttccaactatataagaaata

SEQ ID NO: 5082 - DNA, 50 bp, homo sapien
gatacgtaaccacaggatgtctttasgatacatattagaataggttagaa

SEQ ID NO: 5083 - DNA, 50 bp, homo sapien
aatggactcagtgatctaactcctcrctctgtaagttcactgtaacacat

SEQ ID NO: 5084 - DNA, 50 bp, homo sapien
ttgatattgggcatgtgaatttttcyatgcagtacttgaggaaagcaatt

SEQ ID NO: 5085 - DNA, 50 bp, homo sapien
aaagatccttagaaatacattagtcyatgtggaaggttctagactcttgg

SEQ ID NO: 5086 - DNA, 50 bp, homo sapien
ataccacctgggatcatactgaaaaygtttagaagccaagtcctgataac

SEQ ID NO: 5087 - DNA, 50 bp, homo sapien
agaatttctggaaatgaaggacatastaggtaattacaaaattcagcggg

SEQ ID NO: 5088 - DNA, 50 bp, homo sapien
atatcgcacagcatgttattggaccraatgctatacgcaattgtaacaca

SEQ ID NO: 5089 - DNA, 50 bp, homo sapien
acattcttcatagcgacagtcattayggaaaagaaactgcaaatatagac

SEQ ID NO: 5090 - DNA, 50 bp, homo sapien
gagcctggcacggtgcctgacattgraaggtaccctataaatatttattt

SEQ ID NO: 5091 - DNA, 50 bp, homo sapien
taaagatggaggcaatgtatgtctaygtagggtagcaaggaagagcaaac

SEQ ID NO: 5092 - DNA, 50 bp, homo sapien
ctgaaatctatagccaggttggtcaygaatgaagatgctcagaatcgtgt

SEQ ID NO: 5093 - DNA, 50 bp, homo sapien
gatatcagtagttgctaacgttacarggaaaggaagaacctggcagtgtg

SEQ ID NO: 5094 - DNA, 50 bp, homo sapien
gcttttatggggctctacattttacyacttcttttgtgtgtctagtaagt

SEQ ID NO: 5095 - DNA, 50 bp, homo sapien
tcagctccgattctaatgaagccacmaaagtaattaatttcaatgttctg

SEQ ID NO: 5096 - DNA, 50 bp, homo sapien
caccaagacccaaaaagcgaatccaytgaaataaaagtgtaatgaaaaac

SEQ ID NO: 5097 - DNA, 50 bp, homo sapien
gcaattttaatgttccagactaagcycaatatacaggcaagaatgattgc

SEQ ID NO: 5098 - DNA, 50 bp, homo sapien
atgcatgcgtcctgctcagttgataycttgcagtgaacaagaggaaaggg

SEQ ID NO: 5099 - DNA, 50 bp, homo sapien
tgtcagcccctgtgtagacatctcaratatgcaatataatacagataatt

SEQ ID NO: 5100 - DNA, 50 bp, homo sapien
ggtagtagtgatgtaacctctgcaayttaaagaatacaataaatccctcc

SEQ ID NO: 5101 - DNA, 50 bp, homo sapien
atgaatctgttattttacttctgtcrcatacaacaattaaaaaataatga

SEQ ID NO: 5102 - DNA, 50 bp, homo sapien
ctcccactactctcaattcttccaamaacagatgtgggttgttttccccc

SEQ ID NO: 5103 - DNA, 50 bp, homo sapien
gggtttcaatttcttattctaaaaartacaacattcatagaaccaatctg

SEQ ID NO: 5104 - DNA, 50 bp, homo sapien
aaattgtgaaataacttagcttccartaacctttagactggggggagggg

SEQ ID NO: 5105 - DNA, 50 bp, homo sapien
tcaaattaggataactaaagtgagtsaaattaagtgaagcaactaaaaac

SEQ ID NO: 5106 - DNA, 50 bp, homo sapien
ataaactatgcaactataaaaattakggaaattgcccatgcctgtgtcct

SEQ ID NO: 5107 - DNA, 50 bp, homo sapien
tgtatgaaatgtcatgatcagagatractccagtgtcaaatttgttttct

SEQ ID NO: 5108 - DNA, 50 bp, homo sapien
atgcagacattaatagtcctttcacratttcaccctgcattttttacatg

SEQ ID NO: 5109 - DNA, 50 bp, homo sapien
atgaagagtttataacagtatacgaraaatgactagccacactctggcac

SEQ ID NO: 5110 - DNA, 50 bp, homo sapien
tctcccctctggagttggccttaaayataagagcataagaatcagaagag

SEQ ID NO: 5111 - DNA, 50 bp, homo sapien
aatgctaagccattgttttcttgtawccagcattgctattgaaaagtttg

SEQ ID NO: 5112 - DNA, 50 bp, homo sapien
ataatggtggtatccagagtaacaayagtggatcatacagatgaggccag

SEQ ID NO: 5113 - DNA, 50 bp, homo sapien
ctaatttcatcccagacaaatgtgaragccactaaaatgttctattattc

SEQ ID NO: 5114 - DNA, 50 bp, homo sapien
atgagggagagcttggaagtaaatargcccatggttaatttggatcagtc

SEQ ID NO: 5115 - DNA, 50 bp, homo sapien
aattcatttcacagaacatggacaaycttaaagagagcagtcaaaatcag

SEQ ID NO: 5116 - DNA, 50 bp, homo sapien
aagagaaatctgaaaaacacattcawattaactggaagaacaccaaaagc

SEQ ID NO: 5117 - DNA, 50 bp, homo sapien
taaatgttgagtgggtggccagttcyacttcaccgtatgcaagctgggtc

SEQ ID NO: 5118 - DNA, 50 bp, homo sapien
cataaaatatgaccaagtataaatamctaaataaatttttcccacatcac

SEQ ID NO: 5119 - DNA, 50 bp, homo sapien
agtatttaaatatacacgtgtaataygaagaaaattgcattagatcataa

SEQ ID NO: 5120 - DNA, 50 bp, homo sapien
gacacaaagtctatgtttctcattcmattctaccaaatctagtcaacagt

SEQ ID NO: 5121 - DNA, 50 bp, homo sapien
tgtaacatgattttaacagatacccrcatagcaataattaacacttacag

SEQ ID NO: 5122 - DNA, 50 bp, homo sapien
ccatctctacaaaaaattatttaaamattagctgttgtggcggtgcacac

SEQ ID NO: 5123 - DNA, 50 bp, homo sapien
tgcagtgcaagatacaaaggagaaasagtttatagagaaatgaactacac

SEQ ID NO: 5124 - DNA, 50 bp, homo sapien
ttaccacaggaagcaaacctcaaackagtctacctggctcagatagtcca

SEQ ID NO: 5125 - DNA, 50 bp, homo sapien
tatgtttttgagtgaatcacttaagyctgctcaagagtcatataaaggaa

SEQ ID NO: 5126 - DNA, 50 bp, homo sapien
catgtcctgtgtctttgtttaagtargcagtggtgtgcagatgtttgcat

SEQ ID NO: 5127 - DNA, 50 bp, homo sapien
tttccatcagtgttctgaactcttamgctcaatatgaaagcaaaagattt

SEQ ID NO: 5128 - DNA, 50 bp, homo sapien
tttaggctaacatctgactctattarcttctgaagagaagaaccataaat

SEQ ID NO: 5129 - DNA, 50 bp, homo sapien
ttatacaaaaactgactaaatcctaygattccaaaatgaaagggcccttt

SEQ ID NO: 5130 - DNA, 50 bp, homo sapien
aggattatatgtgcacaagggcaagkcagaaacatgggctaatgagaaga

SEQ ID NO: 5131 - DNA, 50 bp, homo sapien
catgcattgcatcaactacatgaatracttaaccatcgttttatgctctt

SEQ ID NO: 5132 - DNA, 50 bp, homo sapien
gatttatttgtacattacagtctaasaagcaaagtcctaagctatgtcta

SEQ ID NO: 5133 - DNA, 50 bp, homo sapien
gtttgtttatatcttggctactttcmaagacgacttaagatttttataat

SEQ ID NO: 5134 - DNA, 50 bp, homo sapien
ggaatcttaagctaaattattcaagyagatggagtcaggaaaacacaagt

SEQ ID NO: 5135 - DNA, 50 bp, homo sapien
atcaccataaatattttaagcagaaygtaattttatggagagaattttac

SEQ ID NO: 5136 - DNA, 50 bp, homo sapien
gaagcttggattttattaagagcaaygcggagggacacaggagagaggag

SEQ ID NO: 5137 - DNA, 50 bp, homo sapien
atagtggtgctttctgaagggtcacrgtaaggatgttactaggtttttga

SEQ ID NO: 5138 - DNA, 50 bp, homo sapien
gaactttgtcattttgtgtaataaamgtacctctcccaagccccattctc

SEQ ID NO: 5139 - DNA, 50 bp, homo sapien
tttttaaaaagtctctaagtaaccaytgaacaaatagtttttaaaacagc

SEQ ID NO: 5140 - DNA, 50 bp, homo sapien
ccagtcctgtctcccatccatctacraggctatgatttatcattcactct

SEQ ID NO: 5141 - DNA, 50 bp, homo sapien
accgataatttgtagccttggaaaaygtgaccgacaggtgtggaagtact

SEQ ID NO: 5142 - DNA, 50 bp, homo sapien
tgctgtttgaattacaaagaggaacratggtttcgtacatcctagaaaaa

SEQ ID NO: 5143 - DNA, 50 bp, homo sapien
tttcagaaaatccgtggtcttacacraatctactttcctcctccactgcc

SEQ ID NO: 5144 - DNA, 50 bp, homo sapien
tctccttagcctccaggtgcaatccragctggagattttggcaactggaa

SEQ ID NO: 5145 - DNA, 50 bp, homo sapien
caatctgttcatttctcttctctackaccattgactttgatccaagctta

SEQ ID NO: 5146 - DNA, 50 bp, homo sapien
gatccacatgctggcacattctcagygtttaatgcctaactaagcaggca

SEQ ID NO: 5147 - DNA, 50 bp, homo sapien
cacttatcaagtctaatactctttcyctctgatattaaaaaaatttttga

SEQ ID NO: 5148 - DNA, 50 bp, homo sapien
tttctttttttcttggaagttgtagwccaaagatactattcaaaaatttt

SEQ ID NO: 5149 - DNA, 50 bp, homo sapien
acacacgctacttccatgtattatasgaagctcttcacaacctgcttctg

SEQ ID NO: 5150 - DNA, 50 bp, homo sapien
cagagaaatttggaaattcgtttggscacttttctacagtaatgcatttc

SEQ ID NO: 5151 - DNA, 50 bp, homo sapien
tactatttttcattattatgtgctaygtaactaggatatttaactgaatg

SEQ ID NO: 5152 - DNA, 50 bp, homo sapien
cctcacagattctgcagttggtagarattccttccttccagagcccagca

SEQ ID NO: 5153 - DNA, 50 bp, homo sapien
ggacctttgtctcatcaggttttgayaatgagatgtctctcccctagttg

SEQ ID NO: 5154 - DNA, 50 bp, homo sapien
tgtcttttcctagtggtttatacaastgtctctcacacacacattcttgt

SEQ ID NO: 5155 - DNA, 50 bp, homo sapien
ttgccgcttcggagttttccttccarataaagcatctgcagctaagcttg

SEQ ID NO: 5156 - DNA, 50 bp, homo sapien
tgtatagctagtaaagacatttatawtacctacactacacaacaagtatg

SEQ ID NO: 5157 - DNA, 50 bp, homo sapien
cttggtacttatagttgttcttaaakagagtatgacaaagagtccataaa

SEQ ID NO: 5158 - DNA, 50 bp, homo sapien
ttagggcaactacttatgttttatamctgtcattactctcaataagatta

SEQ ID NO: 5159 - DNA, 50 bp, homo sapien
attctctaaatttcccaggagagtascactaatttgcaactatgttctaa

SEQ ID NO: 5160 - DNA, 50 bp, homo sapien
tagtagttattcaatcaataacttgmaattaattgtcttatttccactgg

SEQ ID NO: 5161 - DNA, 50 bp, homo sapien
ctttccacatttgaaacacaaataartatcgtcactaaaaacacctcatt

SEQ ID NO: 5162 - DNA, 50 bp, homo sapien
tccaaatgaaagacatgctaccttcwctatagtagttattcaatcaataa

SEQ ID NO: 5163 - DNA, 50 bp, homo sapien
gtagcatgtctttcatttggatgtasaatgatgtgcaaggtaagactggt

SEQ ID NO: 5164 - DNA, 50 bp, homo sapien
aaaataatcttacaagctaataataygtattgttttaaagaccagctctg

SEQ ID NO: 5165 - DNA, 50 bp, homo sapien
atgatgttaaatagcattgagaaaaraattatagatttgttatagtctcc

SEQ ID NO: 5166 - DNA, 50 bp, homo sapien
ccaatccatagcatgaacataaatayaaaagtctcaacaaaatattagca

SEQ ID NO: 5167 - DNA, 50 bp, homo sapien
agctgtgtcttccaggtaagatggtyaatgtgctaaagtgggagaatgaa

SEQ ID NO: 5168 - DNA, 50 bp, homo sapien
gattggatatttgggtactcacttayggcattatggcagggtttttattg

SEQ ID NO: 5169 - DNA, 50 bp, homo sapien
tctaataaattattttaaatcaaacmgataataggacattaatttgccat

SEQ ID NO: 5170 - DNA, 50 bp, homo sapien
tacgaacagacacaagtctacacaaratgacaagcgcacatttcggtggc

SEQ ID NO: 5171 - DNA, 50 bp, homo sapien
cgcccgtatagactcatacctaagamatcagtgatcaccaccaagacatg

SEQ ID NO: 5172 - DNA, 50 bp, homo sapien
gtttaattttaacttagtgacaatcrcaattttttttagtgtgtacttca

SEQ ID NO: 5173 - DNA, 50 bp, homo sapien
taataatatgtattgttttaaagacmagctctgagtcaaactgcctgagt

SEQ ID NO: 5174 - DNA, 50 bp, homo sapien
ttaccctgatcctgaaaccagacaaygatacaacaacaacagcaaaacta

SEQ ID NO: 5175 - DNA, 50 bp, homo sapien
tgcacttcataaatacctgttgatgmatgagcgaaagaaatcaatgaaag

SEQ ID NO: 5176 - DNA, 50 bp, homo sapien
ggcaagtttgaaactgtctatccccwaatccttttttctaccatcaaaac

SEQ ID NO: 5177 - DNA, 50 bp, homo sapien
atacagacagttgaataaatgttacyagtggtcatgattataacaattga

SEQ ID NO: 5178 - DNA, 50 bp, homo sapien
catttattcaactgtctgtatgcaayttcaggcaataaatcttgcttaaa

SEQ ID NO: 5179 - DNA, 50 bp, homo sapien
attttacagtattttgcctctgctasagtagaaacgccttccttactcaa

SEQ ID NO: 5180 - DNA, 50 bp, homo sapien
tgggaatccgggaaagcagtgtaaayggcagcatggtacccttcctctca

SEQ ID NO: 5181 - DNA, 50 bp, homo sapien
acatcagtgttcgaatccttctcttyaaatcttacatcgttttcaaagtg

SEQ ID NO: 5182 - DNA, 50 bp, homo sapien
atgacctcataaaaattattgaaaasaaattactaggaaaggacagtaag

SEQ ID NO: 5183 - DNA, 50 bp, homo sapien
taatcacatgagtcttcaacaatgaygacttactctgaatctatgaagct

SEQ ID NO: 5184 - DNA, 50 bp, homo sapien
tatgttgagccttcttaatcacttgraaaatggtagtactgcaagcagga

SEQ ID NO: 5185 - DNA, 50 bp, homo sapien
tgtgatgattaaaatatgaaacagaraattcttagtacctgatctggggc

SEQ ID NO: 5186 - DNA, 50 bp, homo sapien
aaaataattttaatcatatggcttaygtagttacacagcatcagcaactc

SEQ ID NO: 5187 - DNA, 50 bp, homo sapien
ccctggatggtatttggatgtctgascattgacttgagggatactttctt

SEQ ID NO: 5188 - DNA, 50 bp, homo sapien
caacccgtaggaactcacaaaaagastatcaaagtgaaaatgtgtttcaa

SEQ ID NO: 5189 - DNA, 50 bp, homo sapien
gttaagggccaggaatgaggggccaragaaatgtattataaagaggcatc

SEQ ID NO: 5190 - DNA, 50 bp, homo sapien
catagccagatcgacgtgggactaascaaggaacactttcgtcatgaacc

SEQ ID NO: 5191 - DNA, 50 bp, homo sapien
gggaagaagtgattaaaaaattgagwctaatgcaaaattgcaaaaagtat

SEQ ID NO: 5192 - DNA, 50 bp, homo sapien
ttatccacttcaaattaattcttaasgtctcattgggtcaattatgattt

SEQ ID NO: 5193 - DNA, 50 bp, homo sapien
cagttgatttgtaggcaacgattggrcacatctcatatcagaatcccgct

SEQ ID NO: 5194 - DNA, 50 bp, homo sapien
tatttattattgcatgtagtaagtawcctctgtctcagtttgctaatgtt

SEQ ID NO: 5195 - DNA, 50 bp, homo sapien
tgttctgtaaatgttctttattcggraatgccccctgacaggcactttct

SEQ ID NO: 5196 - DNA, 50 bp, homo sapien
ctgcagatgtggttacattaagaaayatgagatgtgcagattatcccggc

SEQ ID NO: 5197 - DNA, 50 bp, homo sapien
aaagtagcccagacagttacgaggayctctgaattttcagtctaacttaa

SEQ ID NO: 5198 - DNA, 50 bp, homo sapien
gcttttaaaatcttacttatttctcyagtgtgtattcatgttggataaat

SEQ ID NO: 5199 - DNA, 50 bp, homo sapien
tccacagagcaaatggtgatcatcamtgatagtaaataagacacataaaa

SEQ ID NO: 5200 - DNA, 50 bp, homo sapien
ataaattctcctaagatatagtgtcraggacgtgataatttcatagatct

SEQ ID NO: 5201 - DNA, 50 bp, homo sapien
tctaaatcctagttgaaggttagaaytacctggcgagctttaaaaacttt

SEQ ID NO: 5202 - DNA, 50 bp, homo sapien
tctcaagttttaatataacatgaacraatcacaagtacatgtgttagtgt

SEQ ID NO: 5203 - DNA, 50 bp, homo sapien
tttcccccattttggtttcaggaggwcatgaatagtgtgtttattgtaac

SEQ ID NO: 5204 - DNA, 50 bp, homo sapien
agtacagtgtaaaatccaattcttaygaaactcttcttataatgaaaatg

SEQ ID NO: 5205 - DNA, 50 bp, homo sapien
tggcctgggctcccagaatgctaaargtgatgcctggcctcttctcctgc

SEQ ID NO: 5206 - DNA, 50 bp, homo sapien
tatgtcattgcatataaatttgaaargataactatcattgcttcaggtac

SEQ ID NO: 5207 - DNA, 50 bp, homo sapien
gacaactaaaaattactgggtaggamattcttcaaatctatgaggagtct

SEQ ID NO: 5208 - DNA, 50 bp, homo sapien
aataaaactgaggacaagcacaaagmaactagagtgcagactcctcatag

SEQ ID NO: 5209 - DNA, 50 bp, homo sapien
gatgttcccataaagagctaaagacraaaccaaatcaactgctaacacct

SEQ ID NO: 5210 - DNA, 50 bp, homo sapien
tctctttttcccctttctccttgccrctggtaataaccattctactactt

SEQ ID NO: 5211 - DNA, 50 bp, homo sapien
gtctcctagattgcaggaatagaacsaatttgctgagaaggaacacaaag

SEQ ID NO: 5212 - DNA, 50 bp, homo sapien
atgtctgactttccactgttcatcaraatgtttcggtatggcatctatag

SEQ ID NO: 5213 - DNA, 50 bp, homo sapien
tttttgtgtgtgtatgtctttcacasaaattagtatcattctgtcatagc

SEQ ID NO: 5214 - DNA, 50 bp, homo sapien
tttttctgcttatacccaactgtaaygctaaagatggccctacgcatatt

SEQ ID NO: 5215 - DNA, 50 bp, homo sapien
gtgtagaaactgtagatgtggtagawataggaagagaactagaattagaa

SEQ ID NO: 5216 - DNA, 50 bp, homo sapien
actcgggtggctgaggaggagaaccrattgaatgaacctaggaggcagag

SEQ ID NO: 5217 - DNA, 50 bp, homo sapien
aatgttgatattttgactttccacartgaaacataaatgtccttaatggc

SEQ ID NO: 5218 - DNA, 50 bp, homo sapien
taataatgttatgctaatttatctaygtatttccaaaccaaatacacgaa

SEQ ID NO: 5219 - DNA, 50 bp, homo sapien
agatggaaaggtttccttcaaaataytagtgctcattgacagtgcacctg

SEQ ID NO: 5220 - DNA, 50 bp, homo sapien
gtatttccaaaccaaatacacgaacmgataacaacaatgatggaagctgg

SEQ ID NO: 5221 - DNA, 50 bp, homo sapien
cagggagtcagtgtgtagaaggaaasctctatgggatgaaatgctgtcca

SEQ ID NO: 5222 - DNA, 50 bp, homo sapien
ctctgggtctgcagaaattagcatcyatacggagtcctccagctcctttg

SEQ ID NO: 5223 - DNA, 50 bp, homo sapien
taagacaaaataagatttctcataayagctcggttgaacattaaaatcat

SEQ ID NO: 5224 - DNA, 50 bp, homo sapien
gccagtttttccctggctattccgasatgtttattttccatagaagcttt

SEQ ID NO: 5225 - DNA, 50 bp, homo sapien
agaacctttctagttcattctcttamgacagcacatttatctttctcttt

SEQ ID NO: 5226 - DNA, 50 bp, homo sapien
gttcatatatttcataatcttaaaamgtatgctattgtagctgtaatctg

SEQ ID NO: 5227 - DNA, 50 bp, homo sapien
atcaaagggcttgctctgtgaagaaygtgacttaggatgatctttatttt

SEQ ID NO: 5228 - DNA, 50 bp, homo sapien
ctacatcgacgcctacagagattcartaataaacatcctttactccactg

SEQ ID NO: 5229 - DNA, 50 bp, homo sapien
aataaggttgattgttcatctgtcascaggaggaaactatgatgcttaca

SEQ ID NO: 5230 - DNA, 50 bp, homo sapien
acttagtccctcactttcaatccacraaatttacaaacgagatcttgcct

SEQ ID NO: 5231 - DNA, 50 bp, homo sapien
tattcattcatggagaagttggctargagagatcgactgcagtcacatgc

SEQ ID NO: 5232 - DNA, 50 bp, homo sapien
aatagcaacagttctatgctctgtgyaaaatctgatgagttcatctttgg

SEQ ID NO: 5233 - DNA, 50 bp, homo sapien
tttatttctgaaacattgaggtgccrgattctagcacgatatgaacattc

SEQ ID NO: 5234 - DNA, 50 bp, homo sapien
gaaacaaggtaaggcaagataaataygaaatgcacttatgtatggattgt

SEQ ID NO: 5235 - DNA, 50 bp, homo sapien
ctttgtttattagcagcatctaatcrgacagacttaatttcaaagcttca

SEQ ID NO: 5236 - DNA, 50 bp, homo sapien
taaaataactgataaataaacactargaaatatgtggcctcatatgatgg

SEQ ID NO: 5237 - DNA, 50 bp, homo sapien
caccatgatgctgtttgcaaacctcrgaagaaatgaccaaagtacccaca

SEQ ID NO: 5238 - DNA, 50 bp, homo sapien
atctttgatgatgacacctcaccatratgctgtttgcaaacctcagaaga

SEQ ID NO: 5239 - DNA, 50 bp, homo sapien
attatacttccctgaggcattgttawacttgtcttttaaggacttttagt

SEQ ID NO: 5240 - DNA, 50 bp, homo sapien
ggcacttaagacatagtaaaggacartaacaaataatcagttaataataa

SEQ ID NO: 5241 - DNA, 50 bp, homo sapien
ttggtcttatgttcctcactccctgmaaaatggtaaaaatcatatgctat

SEQ ID NO: 5242 - DNA, 50 bp, homo sapien
ttagtcaccatgaaatcctatataaytgttttgcaagatatctctggatt

SEQ ID NO: 5243 - DNA, 50 bp, homo sapien
tcccatgtgactcctatccacaggamggcctagactccatgtcaccccaa

SEQ ID NO: 5244 - DNA, 50 bp, homo sapien
gagcaaggcagtgaactcctaagaarattattcaacaattacaaatgaaa

SEQ ID NO: 5245 - DNA, 50 bp, homo sapien
ttaacattaagatggtgtcattttargtattttctatctacaaaaccatg

SEQ ID NO: 5246 - DNA, 50 bp, homo sapien
tctaagaaaaggatgctattgggaaygacttggtttagggagaagagcag

SEQ ID NO: 5247 - DNA, 50 bp, homo sapien
ctctaaatccttaaaaggcacattakcgggtaattacaacaagtaaagac

SEQ ID NO: 5248 - DNA, 50 bp, homo sapien
ctttactagtaacatctacaaaaaartcatgcaatctcctaagagtgtat

SEQ ID NO: 5249 - DNA, 50 bp, homo sapien
aaaggacttttgatctttcctgttawgtacaatttaaaatgataaaaatg

SEQ ID NO: 5250 - DNA, 50 bp, homo sapien
ggccaaggaagagaccgaggaagccrctgcgcatactgtgtaagtgggac

SEQ ID NO: 5251 - DNA, 50 bp, homo sapien
tctggcaatgtctggggacattttcratcatcacagcttggggaatgcta

SEQ ID NO: 5252 - DNA, 50 bp, homo sapien
ttctttgttgtgggagcctgtcctaygcattgtatgatatttaacagcgt

SEQ ID NO: 5253 - DNA, 50 bp, homo sapien
ttcatttcctcttttattccaacackagtcttcatgaggctttccaaact

SEQ ID NO: 5254 - DNA, 50 bp, homo sapien
acacaaatgagcacacacacgagacrgataagagtacttcatccactctc

SEQ ID NO: 5255 - DNA, 50 bp, homo sapien
taaaatgaatatagtttaaacctagycaaatagtagaatatgtagacctc

SEQ ID NO: 5256 - DNA, 50 bp, homo sapien
tgtgtcttgtgtcatgcagaccaagkatattgaaagaaagctactatgag

SEQ ID NO: 5257 - DNA, 50 bp, homo sapien
gctcaattcttatcttgggtatctaygggttttggaaaagtaatactggt

SEQ ID NO: 5258 - DNA, 50 bp, homo sapien
catctcccttgatgccttggaagaaygttaattaggctgaaaagagtcaa

SEQ ID NO: 5259 - DNA, 50 bp, homo sapien
tttctgggatgaaactctctttgagycccattttcgtggaagagaacttc

SEQ ID NO: 5260 - DNA, 50 bp, homo sapien
attacagaaccaaaggtgataataaytggctatctggctgcctggagcat

SEQ ID NO: 5261 - DNA, 50 bp, homo sapien
gagacctcccgtgaagaagaggttgsaatcatcctttcctggagcacaag

SEQ ID NO: 5262 - DNA, 50 bp, homo sapien
ttagaaataaaggatgtataaaataygcatggaaaattatttgaaagctg

SEQ ID NO: 5263 - DNA, 50 bp, homo sapien
acaaaagggagggattaaagtctcayggaaaagctatcatggatgaattg

SEQ ID NO: 5264 - DNA, 50 bp, homo sapien
accacctcacatctgctcacaccatrataactgtgcaggtcatccagggg

SEQ ID NO: 5265 - DNA, 50 bp, homo sapien
ccctcaggaaagtctagtctaataawtacgcagccacctgtaacatgaaa

SEQ ID NO: 5266 - DNA, 50 bp, homo sapien
ctatctctttcctaatgatcacgtcrgaaaagcagccaaaaagtaaaaca

SEQ ID NO: 5267 - DNA, 50 bp, homo sapien
gttcagtaacaaaggaaatcaggacmatttaggccactgttggacattcc

SEQ ID NO: 5268 - DNA, 50 bp, homo sapien
aggactgagttcacgggccatggtgragaaaagtatgaagagtcttcttg

SEQ ID NO: 5269 - DNA, 50 bp, homo sapien
gaggtagatagaattgaatagaagtraagagctaaaaggctgcctacaca

SEQ ID NO: 5270 - DNA, 50 bp, homo sapien
aatcaagcaagtaagaacagaaatamcagcatttggcttttgagttaatg

SEQ ID NO: 5271 - DNA, 50 bp, homo sapien
gtcagcagtaggtacagatttaaacmatcaacaattgtccattagaagaa

SEQ ID NO: 5272 - DNA, 50 bp, homo sapien
ctttatagaagtaaccacagggaaayggctcagcgctggtggttgtagga

SEQ ID NO: 5273 - DNA, 50 bp, homo sapien
atattaataatctctacaatattggmaatagacatatttagtgttcctct

SEQ ID NO: 5274 - DNA, 50 bp, homo sapien
tatgattcctagaaatgtttataaaktgagaaagcatcaacatacagcca

SEQ ID NO: 5275 - DNA, 50 bp, homo sapien
aacaactgatccagacatatataccraagtgttcatgaaataaagcgtag

SEQ ID NO: 5276 - DNA, 50 bp, homo sapien
aggctatattttttttattggcttargtatgggctctgaaagcctttccc

SEQ ID NO: 5277 - DNA, 50 bp, homo sapien
tgctttttcccactgacttgatttawggtataattcttttctctctattc

SEQ ID NO: 5278 - DNA, 50 bp, homo sapien
agtagctctttgtactccttctccastaaacttaatttcagatcatcggt

SEQ ID NO: 5279 - DNA, 50 bp, homo sapien
gtgggtgctcaattgatgcttattamgagaagagatacaaatgaatgggg

SEQ ID NO: 5280 - DNA, 50 bp, homo sapien
taaacatttcagatatcctgtgctcraaaatgtttaaaccctgtgatatg

SEQ ID NO: 5281 - DNA, 50 bp, homo sapien
tgttcatgctataatgctaataatakgatctggaaaagaggttctagcta

SEQ ID NO: 5282 - DNA, 50 bp, homo sapien
atccaagttagtggtaagttgtccaygcagtttttgggtccgggaatatt

SEQ ID NO: 5283 - DNA, 50 bp, homo sapien
ggtaagagcttcataaatgtttaggyatttttatgagtaggtcaagaaga

SEQ ID NO: 5284 - DNA, 50 bp, homo sapien
gccaccccttcttttgaattcctacyatgacttttagactatatgcttct

SEQ ID NO: 5285 - DNA, 50 bp, homo sapien
aagggctgacaagtgagcgagaacgraaggaggaacaggcttaagtgttc

SEQ ID NO: 5286 - DNA, 50 bp, homo sapien
taactgaatccacagtctgttttaaytcaagatccaagacacattcctac

SEQ ID NO: 5287 - DNA, 50 bp, homo sapien
aaatggcaaccattgcttcagaacartctacccgtgactcatggtttcca

SEQ ID NO: 5288 - DNA, 50 bp, homo sapien
actgaaaggcatacaaatgcttctaygcacctctttttattgagacaggg

SEQ ID NO: 5289 - DNA, 50 bp, homo sapien
agaaacaaaactgtgataggacaatragactctctggtccgcagctgtat

SEQ ID NO: 5290 - DNA, 50 bp, homo sapien
ttgtgaatttggactgttaattagcrcagaatcaatctcctaccccaaat

SEQ ID NO: 5291 - DNA, 50 bp, homo sapien
ccaaatttccttattagtaaaatcasgtaattgccattataagaaaaaac

SEQ ID NO: 5292 - DNA, 50 bp, homo sapien
gtcgtttcgattgtgcctttcctaartgtccgcggttggcagaacgtggg

SEQ ID NO: 5293 - DNA, 50 bp, homo sapien
cagtgtagggtagcagccagatatcrataatcatgaaaataaatgcaaag

SEQ ID NO: 5294 - DNA, 50 bp, homo sapien
ttatagtgtgatattcccattcccarataacggttgggtctgtaattagc

SEQ ID NO: 5295 - DNA, 50 bp, homo sapien
ttctgtccatgcagcgagtgggctamattattgcaatttctataaaactg

SEQ ID NO: 5296 - DNA, 50 bp, homo sapien
atgtcatggaatattctgcatgggargaaagacggaaatacaattttaga

SEQ ID NO: 5297 - DNA, 50 bp, homo sapien
tcgaaattgtacatatacgcacatcygaaagctctatacaactgactgtg

SEQ ID NO: 5298 - DNA, 50 bp, homo sapien
atttacgtcactgcactcatttctasagcctcgtttgttcacaaaatgct

SEQ ID NO: 5299 - DNA, 50 bp, homo sapien
ttcttgcctgctcaatgataatggasaatctttggcccaaggaacccaac

SEQ ID NO: 5300 - DNA, 50 bp, homo sapien
tgtgtctttaattttaccattactaygctgtctcaaacatgccaataaat

SEQ ID NO: 5301 - DNA, 50 bp, homo sapien
agaaacagaatcattacagatgagcraggcttaaggtgtttgctttgtaa

SEQ ID NO: 5302 - DNA, 50 bp, homo sapien
gtatagaattgattaatcctcagcaratacttaccatgttctaattttag

SEQ ID NO: 5303 - DNA, 50 bp, homo sapien
tataaaacggagaaattggaaaaaamtgttattcagaaaaaaactttctt

SEQ ID NO: 5304 - DNA, 50 bp, homo sapien
tggctcccaactttatgtttaaaccrcagcgtttttctggcgctcacatg

SEQ ID NO: 5305 - DNA, 50 bp, homo sapien
cagtattaatgggttgagcgtggaasaggtatcgcctgtgaaatcatttt

SEQ ID NO: 5306 - DNA, 50 bp, homo sapien
gtgtgtaatgagctccttgtcacagkagattttcaagaacataccaaaat

SEQ ID NO: 5307 - DNA, 50 bp, homo sapien
tagcttttttttttttgatagttgaytatagtaatgtagaaccatttatg

SEQ ID NO: 5308 - DNA, 50 bp, homo sapien
catgagctctgtagtctggaggttcratgtggtggttcctgatcagagcc

SEQ ID NO: 5309 - DNA, 50 bp, homo sapien
gttatttacatggcttaaggtcaaakggtattgtttcacattttgctcaa

SEQ ID NO: 5310 - DNA, 50 bp, homo sapien
ctgtgagaaaccagcaatttggtgamaaaaatcaaaaatgatttcacagg

SEQ ID NO: 5311 - DNA, 50 bp, homo sapien
gctaaattgactgatccagagcatasataggaccaggttatcctgattgt

SEQ ID NO: 5312 - DNA, 50 bp, homo sapien
attcagggcaagacttgctaacacartaaagctcactatgtgccaggaac

SEQ ID NO: 5313 - DNA, 50 bp, homo sapien
ttctacctgaacagtggtggttctcraagaattgtctttttggtgatgct

SEQ ID NO: 5314 - DNA, 50 bp, homo sapien
acacccataaaatctggttgcaggasaggacttgtttgaaccacttagaa

SEQ ID NO: 5315 - DNA, 50 bp, homo sapien
taagtgccaggctgaaaaattggaakgtagttagttggtttgcaaaaaca

SEQ ID NO: 5316 - DNA, 50 bp, homo sapien
aataaataatatccaataaagcagamgatcatgcaaactaactacccatt

SEQ ID NO: 5317 - DNA, 50 bp, homo sapien
tttatgcatagaactgcagtgattcyaactaaagtgaataataattcaag

SEQ ID NO: 5318 - DNA, 50 bp, homo sapien
tcttactaaaggagttgtgtgcagaygccctctttcttttcattttggaa

SEQ ID NO: 5319 - DNA, 50 bp, homo sapien
cccattatataactaccaaaaaactsagatcttcgctattttatttgaaa

SEQ ID NO: 5320 - DNA, 50 bp, homo sapien
gtgccccagccgagtctgcattagaraaagggcattaatctggtgacggt

SEQ ID NO: 5321 - DNA, 50 bp, homo sapien
gtttagcaatggtatctcaaatcagratgaagttatagtcataggaccag

SEQ ID NO: 5322 - DNA, 50 bp, homo sapien
ataatgaagttaaattgtaagcctawgcctcctaaaagtaaaacaaatgt

SEQ ID NO: 5323 - DNA, 50 bp, homo sapien
attgtgttagcaagtcttgccctgartacgttccttaatgacctatgttg

SEQ ID NO: 5324 - DNA, 50 bp, homo sapien
aaaacaattcacaagacaattgagartagatattgaagaaaaatggtacc

SEQ ID NO: 5325 - DNA, 50 bp, homo sapien
cattataatagcaacctgatgataaygaatgcaacataggtcattaagga

SEQ ID NO: 5326 - DNA, 50 bp, homo sapien
tgctttgaacaaaggaatgagagaamgcgtagatcgtaaggctgtacagc

SEQ ID NO: 5327 - DNA, 50 bp, homo sapien
ccggtgtaactgtcacttggctttarattttggcttgcacgggattgttt

SEQ ID NO: 5328 - DNA, 50 bp, homo sapien
aggaaagtagagtatagtaacatcaygtatttaaatggaaaaatcagtat

SEQ ID NO: 5329 - DNA, 50 bp, homo sapien
aatgtagattttatgctagtaaagasactattggttgtgattatctacat

SEQ ID NO: 5330 - DNA, 50 bp, homo sapien
ctaattttgccatgttaaaatgtaawcctatttgaactatgaactttgaa

SEQ ID NO: 5331 - DNA, 50 bp, homo sapien
tccaaacaagcttttagaaaggcaaygtttagctggtaatggggaccaga

SEQ ID NO: 5332 - DNA, 50 bp, homo sapien
attcctgttgttgacttgatttacayagaaaaaaaaatcgtacctgaaaa

SEQ ID NO: 5333 - DNA, 50 bp, homo sapien
atgattaatgactgaaggagcatagraagccaccgggcactgagatctaa

SEQ ID NO: 5334 - DNA, 50 bp, homo sapien
cacatgcacatcctaacttgagaacraattgtgtattgaggtcgaaggca

SEQ ID NO: 5335 - DNA, 50 bp, homo sapien
tgtaaccccgaatgaatactctactkagaaaccaataaatatcatataga

SEQ ID NO: 5336 - DNA, 50 bp, homo sapien
actatcagaactttcaatcgaagtasgttccaccaaagttaatccaatca

SEQ ID NO: 5337 - DNA, 50 bp, homo sapien
tgatacaatttccagcacctactaayggctctaagatgttcataaagtta

SEQ ID NO: 5338 - DNA, 50 bp, homo sapien
taggtgatgaaggactctgcaaggamatctataggcatcctctaatgtgg

SEQ ID NO: 5339 - DNA, 50 bp, homo sapien
ctcagaaaatgaatggttggattaaytcaggttgaagtttcgccagacac

SEQ ID NO: 5340 - DNA, 50 bp, homo sapien
ccataaactaaactgctaaggtgatsagtatgagtctacccaaacgaaac

SEQ ID NO: 5341 - DNA, 50 bp, homo sapien
gaaatccatcataaaatgtgacaatragaatctatgctgaacaatatagg

SEQ ID NO: 5342 - DNA, 50 bp, homo sapien
acacattaaaactttattaacactartagactagaaatgcaataaataaa

SEQ ID NO: 5343 - DNA, 50 bp, homo sapien
tgaaaaagtacattctcactaaagtyaagaggcacacacccaaagcagcc

SEQ ID NO: 5344 - DNA, 50 bp, homo sapien
ttgtcattttaaataactgggatcakcaaagctaatgaaaatgtttaaat

SEQ ID NO: 5345 - DNA, 50 bp, homo sapien
gctctcccgccttttaacttctagcrcccttgaatgttcccagatcaaag

SEQ ID NO: 5346 - DNA, 50 bp, homo sapien
tgaatctggtgttttgatgacattgraggtatcatattcgtggcttgtaa

SEQ ID NO: 5347 - DNA, 50 bp, homo sapien
tccttcaaatcagattccaacttaawtctacatctaaccagacctgaatg

SEQ ID NO: 5348 - DNA, 50 bp, homo sapien
gcttatgtgaagccaaaatggagggwccaagatccaaggtaaaaaaaaaa

SEQ ID NO: 5349 - DNA, 50 bp, homo sapien
gcattttaaaagtgtttttaggataktaaatcgaagtacattattcagtg

SEQ ID NO: 5350 - DNA, 50 bp, homo sapien
agcatctcgtgtctatactttcttcmatctcactttaaaaaaaaaaccca

SEQ ID NO: 5351 - DNA, 50 bp, homo sapien
ccaccgtgcctggccctaaagataaytgtatattggctaacacgggagaa

SEQ ID NO: 5352 - DNA, 50 bp, homo sapien
aaaaaagtgttagaagcaggagggaycttacaaataatctagttcagaga

SEQ ID NO: 5353 - DNA, 50 bp, homo sapien
aacatgtatagaacgagttgataacrcaagacataaatataatttcatgg

SEQ ID NO: 5354 - DNA, 50 bp, homo sapien
agtctgtgatttgaacttttagaaayaatcttgctgggaaagtggggaaa

SEQ ID NO: 5355 - DNA, 50 bp, homo sapien
aggctacagggctctgagtgtgaacrcatgcaccgtctactcaaagctgc

SEQ ID NO: 5356 - DNA, 50 bp, homo sapien
tatcatttgaatttgtcctggcaacmagaatacctcaaagcaattaagta

SEQ ID NO: 5357 - DNA, 50 bp, homo sapien
tctctctgagattttgtcttcctgaktatttttctagccccaaacttgat

SEQ ID NO: 5358 - DNA, 50 bp, homo sapien
gaaagtaaaaataaaaccttatcagsctgagcaaagaggaatgaagcaca

SEQ ID NO: 5359 - DNA, 50 bp, homo sapien
tgagttgtctgagaaataaaggtaakgtatgaaagattcctggtatagtg

SEQ ID NO: 5360 - DNA, 50 bp, homo sapien
aacacaggattactcagcaattccakagaaagttcccaagccaccttttt

SEQ ID NO: 5361 - DNA, 50 bp, homo sapien
atggacctggaatatttgtgaacaayactagagacaatcacaccaagcct

SEQ ID NO: 5362 - DNA, 50 bp, homo sapien
cttatgccctcagattcagcacggawtatgctgtctcaacccgcttgtcc

SEQ ID NO: 5363 - DNA, 50 bp, homo sapien
gtgtccttgggaattagcaactcackgcctcttagtttgctcattgtact

SEQ ID NO: 5364 - DNA, 50 bp, homo sapien
tttgaacctctaggctatttacgcargggcgattagtccatctatctgtt

SEQ ID NO: 5365 - DNA, 50 bp, homo sapien
tttcctaccacctcaaagctaaacakcctcgatttctgaagtctaagtga

SEQ ID NO: 5366 - DNA, 50 bp, homo sapien
tacagctttattgactctacgactcycggttgctaaatgctagaagtcaa

SEQ ID NO: 5367 - DNA, 50 bp, homo sapien
tgtaatcattttgcatgtaagaatayggtccctaggtggagagaggaaat

SEQ ID NO: 5368 - DNA, 50 bp, homo sapien
ttacctgtcatttttattcacgtccrcttttgttgctctctctctctctc

SEQ ID NO: 5369 - DNA, 50 bp, homo sapien
acatcacattccaaactgtgaaagayacgatgtccctttgaagaatacca

SEQ ID NO: 5370 - DNA, 50 bp, homo sapien
aagggaaacataagaaaaattgcagrcaactttggattcacaccgtgact

SEQ ID NO: 5371 - DNA, 50 bp, homo sapien
gcttttacctacgtttccgcacatcygatcactgtcaagggcccccagtc

SEQ ID NO: 5372 - DNA, 50 bp, homo sapien
ttcaagcttggcttcttacaagtcaygatgattttacaagcatttattaa

SEQ ID NO: 5373 - DNA, 50 bp, homo sapien
gttgttcataaagtatctcttttaawtaccacattctagttgttaatctc

SEQ ID NO: 5374 - DNA, 50 bp, homo sapien
cccaaatcaacggatagactgaaacyggaacataactgagcatgtatata

SEQ ID NO: 5375 - DNA, 50 bp, homo sapien
tttgctttctcctatagatgaaacaygagcaaaaacagggaaatggagac

SEQ ID NO: 5376 - DNA, 50 bp, homo sapien
aaagaaagctaaagcattatctaacrcactacaattaaatttagggaaaa

SEQ ID NO: 5377 - DNA, 50 bp, homo sapien
catattgaagtatttaaatttctcaraatgtatgtgtgctctctaacatc

SEQ ID NO: 5378 - DNA, 50 bp, homo sapien
ttattatacaaagcagcaatatagartagcattttagaacataaatgtgc

SEQ ID NO: 5379 - DNA, 50 bp, homo sapien
ctgtattgaaagtgagttgacattayatacaacttatgcatatactttct

SEQ ID NO: 5380 - DNA, 50 bp, homo sapien
atgaggaacagagaactgctcctcawccgggtgagtcattgtcttgtcca

SEQ ID NO: 5381 - DNA, 50 bp, homo sapien
attttagaggttttgataatgataargtccagagaaggtagaggggaaaa

SEQ ID NO: 5382 - DNA, 50 bp, homo sapien
acatgtgatggttcaaatatttatawagtccaagaataagaagcaataac

SEQ ID NO: 5383 - DNA, 50 bp, homo sapien
cagtttagtgacagcagttcaagtaygtttttgactaagacttcatctcc

SEQ ID NO: 5384 - DNA, 50 bp, homo sapien
tgctgtcactaaactgtagaagatcrgatcagtgtttcccagatttgaaa

SEQ ID NO: 5385 - DNA, 50 bp, homo sapien
agttatcttcacataaaattttccasaagtataactagtcccaggcagca

SEQ ID NO: 5386 - DNA, 50 bp, homo sapien
attgggtagtattgacagcataatamattaagtctttcaatctatgaaca

SEQ ID NO: 5387 - DNA, 50 bp, homo sapien
aagttttagtcattgtctacacacaratgttgaattgtttttaatgtcac

SEQ ID NO: 5388 - DNA, 50 bp, homo sapien
atagatggtgaaatatgtaataaaaygaatgtggcagaatgttaattaga

SEQ ID NO: 5389 - DNA, 50 bp, homo sapien
ttcagtacaacttaacagctagatayactccaaggtctttaatgtgtatt

SEQ ID NO: 5390 - DNA, 50 bp, homo sapien
gtttttatcaggagtgaagctaaggratgcctaattacacatcagaccct

SEQ ID NO: 5391 - DNA, 50 bp, homo sapien
gccctttcaactcccttttctaatgycaattttatccactaatgaaacac

SEQ ID NO: 5392 - DNA, 50 bp, homo sapien
agataaatgtatgtggtgatgactaygttaaataccccgatttgatcatt

SEQ ID NO: 5393 - DNA, 50 bp, homo sapien
agagagttcacaattattgttgatawcagttgggatgtgatcttgtctgt

SEQ ID NO: 5394 - DNA, 50 bp, homo sapien
caaatgtttgtgagaatgtggaaaarttggtacccttgtgcattgttggt

SEQ ID NO: 5395 - DNA, 50 bp, homo sapien
cataattaataagtaggtgagctaaratttaacaccaaatggatctgctt

SEQ ID NO: 5396 - DNA, 50 bp, homo sapien
gctatcacaggacagcaccctctgtwaagtacctatcagcaactctgact

SEQ ID NO: 5397 - DNA, 50 bp, homo sapien
aggaatgtcgctctctgtagaaataygtgtcctaaaagtcccttggctac

SEQ ID NO: 5398 - DNA, 50 bp, homo sapien
tactcagaaagtcaatctaaaaacaygaaggctagtggccttgctgctgt

SEQ ID NO: 5399 - DNA, 50 bp, homo sapien
cagttggctgtattcaaaatcagcckatagtaagcaggtaccttgtcctc

SEQ ID NO: 5400 - DNA, 50 bp, homo sapien
taaaataagaatatatgaaattatarctacttgtatgagcatagccacgg

SEQ ID NO: 5401 - DNA, 50 bp, homo sapien
atatcgggtgttaccctttctggcckagagaatacttgatagaaatgggc

SEQ ID NO: 5402 - DNA, 50 bp, homo sapien
cactgcctgccaagcccagaatgtgwatgagccttcaagacgccactccc

SEQ ID NO: 5403 - DNA, 50 bp, homo sapien
tctgttaatcacagaataaatcgacsctcttttttattaaaggcctgaaa

SEQ ID NO: 5404 - DNA, 50 bp, homo sapien
caaactcactacaaatattcatacaytcatgtgtgcgcgtgcacacacac

SEQ ID NO: 5405 - DNA, 50 bp, homo sapien
ctctgataaggtaaatactacaaccrcctactgctgttttatgaatttta

SEQ ID NO: 5406 - DNA, 50 bp, homo sapien
gcttcagactatatcaaacaccgaargaaagacttattattctacctcac

SEQ ID NO: 5407 - DNA, 50 bp, homo sapien
ggaggatttttttgcctctaaaacargaatccaatggaaagacactgctg

SEQ ID NO: 5408 - DNA, 50 bp, homo sapien
ataggttgactccaaactggaggaartggcacgagttgtgattttatcat

SEQ ID NO: 5409 - DNA, 50 bp, homo sapien
ctctatcatgagtgccactgttacaytggtatccacccatgaggttacaa

SEQ ID NO: 5410 - DNA, 50 bp, homo sapien
aacacctcacaggtccttgagatgaygtaagtacagccaagttgcttaac

SEQ ID NO: 5411 - DNA, 50 bp, homo sapien
ttttccaggtttctgatttcactgcraaagtgcctgtgtgcctcagttga

SEQ ID NO: 5412 - DNA, 50 bp, homo sapien
agtggttacaaaatcactctagaaakgcttttcaactaggctatgcatca

SEQ ID NO: 5413 - DNA, 50 bp, homo sapien
gcacctgcctcatttgagacttctgyatgatctgtatgtaaggcgtgcta

SEQ ID NO: 5414 - DNA, 50 bp, homo sapien
gtattttcaataggagaaatacagakaagttaatggcattgagcggttcc

SEQ ID NO: 5415 - DNA, 50 bp, homo sapien
atcctgtacattctcatctgctaggratcctaatttatgattctggcata

SEQ ID NO: 5416 - DNA, 50 bp, homo sapien
tctgtttgtaaaatgtaggtaacaaygatgtctatcgaaccaaggtaata

SEQ ID NO: 5417 - DNA, 50 bp, homo sapien
tgatgaatactattataagccaaagkaccaaaaaacgaagaaagcataaa

SEQ ID NO: 5418 - DNA, 50 bp, homo sapien
ctaacaaaatatcttcaaattacaayttctaagtcagtgatcttgaataa

SEQ ID NO: 5419 - DNA, 50 bp, homo sapien
ttagtcaattaatatccttaccttasaatcataaatttaccccataataa

SEQ ID NO: 5420 - DNA, 50 bp, homo sapien
gcttgtatattttcaaaaattaggcrccagttacctcatatgaaagtact

SEQ ID NO: 5421 - DNA, 50 bp, homo sapien
tttcaaatcctggttattgataaacyctaccaaatggaacatacacataa

SEQ ID NO: 5422 - DNA, 50 bp, homo sapien
caaggcaggaaacaccaacaattgcyaagtggacaaaagaagagtatgta

SEQ ID NO: 5423 - DNA, 50 bp, homo sapien
catttaagcttcctttccaaataacraaagtcctgatgcattgttaagaa

SEQ ID NO: 5424 - DNA, 50 bp, homo sapien
ttaatactcttgatgagaatactcasgttctccatagtcaagcctgagag

SEQ ID NO: 5425 - DNA, 50 bp, homo sapien
tactttcaatatttaagccaatcaakttataaaatattttctcccgtgac

SEQ ID NO: 5426 - DNA, 50 bp, homo sapien
agtcataaagaaaggatccacagaartagttgtgtgaaagacactctcca

SEQ ID NO: 5427 - DNA, 50 bp, homo sapien
gttacccattcatggcttgagactayggccaagaaactctcaggcttgac

SEQ ID NO: 5428 - DNA, 50 bp, homo sapien
ttacaaaagcgctatcaagttgtcaygtaccctttctaaggctcctctct

SEQ ID NO: 5429 - DNA, 50 bp, homo sapien
aagattttatccaagatatttaacargcgaccaaatcttgcctcatccat

SEQ ID NO: 5430 - DNA, 50 bp, homo sapien
acatttggagtgtcactgcatttagwaaggttggcaggatcctgtgaatg

SEQ ID NO: 5431 - DNA, 50 bp, homo sapien
atgaagttccatctcttaagctggayatgaattttttggtgtgtgtgggg

SEQ ID NO: 5432 - DNA, 50 bp, homo sapien
gaatggcttccaaaaacaatggaaaycgtggcttatctcagctgcttttc

SEQ ID NO: 5433 - DNA, 50 bp, homo sapien
gagctggagctcaggatgagtcaacsaggagctgccatgtggcaatggac

SEQ ID NO: 5434 - DNA, 50 bp, homo sapien
gatagataaacacacatcatccaagkaacaaagaattgagggcagcagct

SEQ ID NO: 5435 - DNA, 50 bp, homo sapien
caagttgcagttaagtggaatgttaygccctgagtttcccattatgacaa

SEQ ID NO: 5436 - DNA, 50 bp, homo sapien
aaaacaacattagtcttctcgtacawctccatcagagctcttgggtaact

SEQ ID NO: 5437 - DNA, 50 bp, homo sapien
ttcaattagtagatgctcagtaaackctagcccactgagataattctctt

SEQ ID NO: 5438 - DNA, 50 bp, homo sapien
gatcaacttccctcatccatacaaayttagctcatcctgcctcagctgcc

SEQ ID NO: 5439 - DNA, 50 bp, homo sapien
agccccacctgaatgaggtttatgayatagaatggagaacagaaattaaa

SEQ ID NO: 5440 - DNA, 50 bp, homo sapien
ctccttattgaaaataacttaactcyaggaactgcacagcctctccacag

SEQ ID NO: 5441 - DNA, 50 bp, homo sapien
tacattatagcccgtttatgtctgasgttgcacaaattttttttaatttt

SEQ ID NO: 5442 - DNA, 50 bp, homo sapien
atagctcaaggcattcagtcactgckaagtattcgttgccattctgataa

SEQ ID NO: 5443 - DNA, 50 bp, homo sapien
ccattttcagttgcctaattcagacyattcttcccctatcagctcacaga

SEQ ID NO: 5444 - DNA, 50 bp, homo sapien
tcacttaatttcttccttcctgctayactacattgcttaatttactcttg

SEQ ID NO: 5445 - DNA, 50 bp, homo sapien
tcacaagaatgaccgtatatctcagycaagggcatcatgaagacaggcag

SEQ ID NO: 5446 - DNA, 50 bp, homo sapien
ggttccttttctgcttaactgttctraacacctttttcagaatcttagtt

SEQ ID NO: 5447 - DNA, 50 bp, homo sapien
aagtcatgtgattctatcagttgacrcaggaaaagcatttgacaaccaac

SEQ ID NO: 5448 - DNA, 50 bp, homo sapien
tacataagagaacacacagaggggakaaatcttattactgtaataaatgt

SEQ ID NO: 5449 - DNA, 50 bp, homo sapien
gctgaaagcatacacacgggagatcrcaaaacggagcagggaagccacgt

SEQ ID NO: 5450 - DNA, 50 bp, homo sapien
cgaagtggagctgtgcacgtgaagaragtggaagttggaatgggggagag

SEQ ID NO: 5451 - DNA, 50 bp, homo sapien
tgtctctaaaggataatgttgggaartaatatataagtaatgtctgttag

SEQ ID NO: 5452 - DNA, 50 bp, homo sapien
ctcagtggtctcactttccaataaamatggctttgaaaaccagcaccaat

SEQ ID NO: 5453 - DNA, 50 bp, homo sapien
ttgacaattttctcctcagtgtaaaygctaacataatcctatttgtagtt

SEQ ID NO: 5454 - DNA, 50 bp, homo sapien
tacaatcttgtattacaacatatgamtaggtaagtgtaacagtctgcaaa

SEQ ID NO: 5455 - DNA, 50 bp, homo sapien
ctgttattagctgcacaaacacttaygatgttatgtcttatcttttattt

SEQ ID NO: 5456 - DNA, 50 bp, homo sapien
tgaaaaagttcctacttcagatctcrgagacaaaagtgaatagccaagca

SEQ ID NO: 5457 - DNA, 50 bp, homo sapien
tgtcttctgggatgtgtgtctcaacmaaagtcctcctccattctcaccta

SEQ ID NO: 5458 - DNA, 50 bp, homo sapien
ctttgaatttgtaacatctttatacmggcaagtcccagctaggaaaagtt

SEQ ID NO: 5459 - DNA, 50 bp, homo sapien
ttaggctaaaactagtgatgggttaygcaactatgcagagaaatagaagt

SEQ ID NO: 5460 - DNA, 50 bp, homo sapien
gctccattttgtatctctacaatcartgactagctgaacacctagataaa

SEQ ID NO: 5461 - DNA, 50 bp, homo sapien
aaaaagctactacattttctgctaastgaaatgacattcagcaatgcaag

SEQ ID NO: 5462 - DNA, 50 bp, homo sapien
gatcaaattattcttgaaatttaatmagctaaatgggatgattgtgtgac

SEQ ID NO: 5463 - DNA, 50 bp, homo sapien
cagaccaatcagcaacagcttctaarttaacatatcccagtaacatcttc

SEQ ID NO: 5464 - DNA, 50 bp, homo sapien
agaaaatgagtcactctatctgtgaygtaggtggtttgtgccctcacttt

SEQ ID NO: 5465 - DNA, 50 bp, homo sapien
atttttagaaaaaacaaaatcaaacmgtggagtactatgtccttgaaata

SEQ ID NO: 5466 - DNA, 50 bp, homo sapien
agaataacataaatcagctcatttargtggaaccaactgctccttcctca

SEQ ID NO: 5467 - DNA, 50 bp, homo sapien
tatagggacaatcagttctctagtaytaatgaaagatttggttaactcta

SEQ ID NO: 5468 - DNA, 50 bp, homo sapien
caaatgtgtatttccatctctaaaayatcttctaagttaaaatctcattt

SEQ ID NO: 5469 - DNA, 50 bp, homo sapien
tgaaaagaatttctgcctaaccagtraaagaagtagcagctgttctaatg

SEQ ID NO: 5470 - DNA, 50 bp, homo sapien
acaaacacctgggatgggcctgatgmagtaaccactactaaattaggata

SEQ ID NO: 5471 - DNA, 50 bp, homo sapien
agtcctgaggccagaatgagactagsacatggttcctttgcctacgtaaa

SEQ ID NO: 5472 - DNA, 50 bp, homo sapien
gctgagaatctgtttttcaatgaacmatgagctaagattgggggatgggg

SEQ ID NO: 5473 - DNA, 50 bp, homo sapien
gcaagtccattatgtgacgtgcctcyatttcaaggatatgagatgtgttg

SEQ ID NO: 5474 - DNA, 50 bp, homo sapien
gagaatacactcctaattctgagaaygctttggtgcagtggagaagctta

SEQ ID NO: 5475 - DNA, 50 bp, homo sapien
gtcttatgaaatctgttaatcattaygaaattgtattgtctcaaatctca

SEQ ID NO: 5476 - DNA, 50 bp, homo sapien
aagggaagtcagagagattgataccrcaagtgggctttgaagatgggaag

SEQ ID NO: 5477 - DNA, 50 bp, homo sapien
catttggagatgaggatgtggggtcmcaaaagtagcaaagtgcagagctc

SEQ ID NO: 5478 - DNA, 50 bp, homo sapien
tcaaatgtgtttacgtagattcccaygagtcattttcaattacatgtaac

SEQ ID NO: 5479 - DNA, 50 bp, homo sapien
tggttcagggaattgagtgtgaaaayggatatgagaaatataaaaaggag

SEQ ID NO: 5480 - DNA, 50 bp, homo sapien
ggggttgagttaaggcattgactcakggacatgttgatctgatcagttaa

SEQ ID NO: 5481 - DNA, 50 bp, homo sapien
tagccaatcacatcctgtatctataygttagcctttgtatggaaaatgtt

SEQ ID NO: 5482 - DNA, 50 bp, homo sapien
acaaagccataaattggtgttaatamcctgactgatctggacaattaaag

SEQ ID NO: 5483 - DNA, 50 bp, homo sapien
tctgaaaacagcagtcgggggaccayatttacaactgttaggaaggagca

SEQ ID NO: 5484 - DNA, 50 bp, homo sapien
aggcatcccaacagtttcgaactaartgtggactgtttctgcactcatcc

SEQ ID NO: 5485 - DNA, 50 bp, homo sapien
cactgtatgtaataggcttgtcccayggcaaagaattgctaagaatagcc

SEQ ID NO: 5486 - DNA, 50 bp, homo sapien
tggggagcttctacagaactcaaacmcttgcttcctccccagcctactaa

SEQ ID NO: 5487 - DNA, 50 bp, homo sapien
tataaaaactgtcattatctcctaargtcacagtcctgacatctgttaag

SEQ ID NO: 5488 - DNA, 50 bp, homo sapien
aagatagagagaaaaatagcagtcaygtggtaaaagtgttaaggtttgta

SEQ ID NO: 5489 - DNA, 50 bp, homo sapien
tccccacaaagccctgcataaaacgycattgtagggcccagctctgtctg

SEQ ID NO: 5490 - DNA, 50 bp, homo sapien
caaatgcccccacttcatcattcacrgtccatgcatgtaacaaaatatca

SEQ ID NO: 5491 - DNA, 50 bp, homo sapien
ctcagaatgttgttctagggttcaaygcaatcctaggtattaaatacgac

SEQ ID NO: 5492 - DNA, 50 bp, homo sapien
tcagaggaaagtctaagaacaacaasctgattctgtaaaatgaaactgaa

SEQ ID NO: 5493 - DNA, 50 bp, homo sapien
acttcccacaatgctttcactgaccragtaaaccttagtaaaaagatgtt

SEQ ID NO: 5494 - DNA, 50 bp, homo sapien
ccaggagcctccatgagaactgtaargtcttaacttgcttagaaagcaca

SEQ ID NO: 5495 - DNA, 50 bp, homo sapien
cttgtttttgtgaagaaactgaaaaygactggctgaagtttgtccaagaa

SEQ ID NO: 5496 - DNA, 50 bp, homo sapien
atttgtaaaccaaaatggttcaataygcctttcttacctggggcttctga

SEQ ID NO: 5497 - DNA, 50 bp, homo sapien
agataaatcacacagaattaaacagraattaagtatgatgaaggtgcatt

SEQ ID NO: 5498 - DNA, 50 bp, homo sapien
gattctgtaactacaaggaaacttcyatatgtccaaactctaggcaggcc

SEQ ID NO: 5499 - DNA, 50 bp, homo sapien
ttagcattttttatctttcttaatcwagtcattcattcatttagcaacta

SEQ ID NO: 5500 - DNA, 50 bp, homo sapien
aactgctgcagccagtttgcaaccckgaagaaccagccttagaatgaacc

SEQ ID NO: 5501 - DNA, 50 bp, homo sapien
agcacaggttcaaaaatatttgtcayaagagaagttattccctccttgat

SEQ ID NO: 5502 - DNA, 50 bp, homo sapien
aagaataagttgctgcatttgaccaytccttcaaccaagaaaggcacaat

SEQ ID NO: 5503 - DNA, 50 bp, homo sapien
ttcagacacaataaacggtacactgraatatttaacaagttagatggcag

SEQ ID NO: 5504 - DNA, 50 bp, homo sapien
gaagatggcagtgccctccgtgagawgcggaccctgtctaggtagaacag

SEQ ID NO: 5505 - DNA, 50 bp, homo sapien
aactcatttgacattttaaattgtayatgtagttcactgcacagttgtcg

SEQ ID NO: 5506 - DNA, 50 bp, homo sapien
cattatgatgcatcttttgtgatcartctggttttttagacattattttg

SEQ ID NO: 5507 - DNA, 50 bp, homo sapien
gccagataggcaaggtggccggaccygatatagtagagctagtatactta

SEQ ID NO: 5508 - DNA, 50 bp, homo sapien
aattctgatggagaaaagatggagtraaaaagccatgtataaaatggtca

SEQ ID NO: 5509 - DNA, 50 bp, homo sapien
ttgggtgctctcctaccgctaaggcmgacaacagctgcttccaaatctga

SEQ ID NO: 5510 - DNA, 50 bp, homo sapien
aacagtatatgagaatcaggaagaamatgactaagtttagatgacatttg

SEQ ID NO: 5511 - DNA, 50 bp, homo sapien
tacgttaaatatgaattacatgaggkatatattcaaggtacttgagaagc

SEQ ID NO: 5512 - DNA, 50 bp, homo sapien
cccaggtgcaagctggctatggtgaygaggtccggggataattatgctgg

SEQ ID NO: 5513 - DNA, 50 bp, homo sapien
atcatacgtcacagcttggaaatcayagacaaaaactgactcttacaaaa

SEQ ID NO: 5514 - DNA, 50 bp, homo sapien
ttcacctaacaaaattttgatgaaamacaactggaagtatgcacagaacc

SEQ ID NO: 5515 - DNA, 50 bp, homo sapien
gtggcttcgtagcgggactcactgaygtttcctattctcatggccaaaca

SEQ ID NO: 5516 - DNA, 50 bp, homo sapien
tggttcacatagctaatgatgtggaratttgaacttaggctgtttgtctc

SEQ ID NO: 5517 - DNA, 50 bp, homo sapien
agccacgtgtggaacattggaaacartctagcacttcactctgtcaaaca

SEQ ID NO: 5518 - DNA, 50 bp, homo sapien
tcacatttattttctctattgctcaragtaaacagacatctgcttgggac

SEQ ID NO: 5519 - DNA, 50 bp, homo sapien
agtgaagttgagagaacagcactatsagtgttttaaaaatctattcagta

SEQ ID NO: 5520 - DNA, 50 bp, homo sapien
agttactgaacattcaggatgtcatsagggctttctccacagtgtgaata

SEQ ID NO: 5521 - DNA, 50 bp, homo sapien
aggttctattgacttgggcaaaaggyatcttgttcttgataagttcgcat

SEQ ID NO: 5522 - DNA, 50 bp, homo sapien
ttcagaaatggcatgagtattcattraaattgagtgtccctaagcataaa

SEQ ID NO: 5523 - DNA, 50 bp, homo sapien
tttactggagattgaatatgccagartatcatggttcaaatgctacggtg

SEQ ID NO: 5524 - DNA, 50 bp, homo sapien
cttaccttacactgacaattctctawcaggaagtaacttgaagtaacaga

SEQ ID NO: 5525 - DNA, 50 bp, homo sapien
aggttgcttcatgatcattgcccagractaaacatttttcaagatggatt

SEQ ID NO: 5526 - DNA, 50 bp, homo sapien
actttgcatattttggagaatgtcarctatccttttatcagctgattcgt

SEQ ID NO: 5527 - DNA, 50 bp, homo sapien
attaggagccaggaaagccagggtartaatgaagtagcctcagaaggctg

SEQ ID NO: 5528 - DNA, 50 bp, homo sapien
tattgtcatcctcagtctgcatctcrcgttatttttgggtgaattccaga

SEQ ID NO: 5529 - DNA, 50 bp, homo sapien
ttattcttaccatttcatttgctccrgatccactgccagtttgaaagctc

SEQ ID NO: 5530 - DNA, 50 bp, homo sapien
aatcatctcatacattttctgtccaracctaaattcaggcatttctccaa

SEQ ID NO: 5531 - DNA, 50 bp, homo sapien
tgaggaatcttttaagtatgttgtaragaaaatcagtaattaatcttttc

SEQ ID NO: 5532 - DNA, 50 bp, homo sapien
aaaactcagatttgttgagataaggwatattttctgacaaacagctctaa

SEQ ID NO: 5533 - DNA, 50 bp, homo sapien
caaatgtttgattacccttttgggamgatgagattataattttattttat

SEQ ID NO: 5534 - DNA, 50 bp, homo sapien
atggcatctctgctctggaaactacwgtagctcattttactggaagtggg

SEQ ID NO: 5535 - DNA, 50 bp, homo sapien
cagttgttcattctgattagtgagaragaaagacattaattccccatcct

SEQ ID NO: 5536 - DNA, 50 bp, homo sapien
aatggaataggtaattccaaaattcyatcccaaactaaagcaacaattaa

SEQ ID NO: 5537 - DNA, 50 bp, homo sapien
aaaataaataaatcataaatcataamctgtgatagctttcacagacattg

SEQ ID NO: 5538 - DNA, 50 bp, homo sapien
ttgctctcatgttttgttttcctaaktcatgcttgttcacaacttttaag

SEQ ID NO: 5539 - DNA, 50 bp, homo sapien
gtgtattgaaagtttgaaaataaggwcagaagagattcctgtgagataag

SEQ ID NO: 5540 - DNA, 50 bp, homo sapien
caaagcccactgctacttccttgaaygacaatacacttccatagcattta

SEQ ID NO: 5541 - DNA, 50 bp, homo sapien
tctacactagcccaccagcccttaasaaccagcctggactcacaattaac

SEQ ID NO: 5542 - DNA, 50 bp, homo sapien
gattttgggcagatttcttgagccaytctcttggacacagcttgtgcttg

SEQ ID NO: 5543 - DNA, 50 bp, homo sapien
tcaaaagagaaggtccaagaaggagraaccaagtcaaggtgttttattcc

SEQ ID NO: 5544 - DNA, 50 bp, homo sapien
atacaaactactatatattttttgcyctttagttcacagtttaattaggg

SEQ ID NO: 5545 - DNA, 50 bp, homo sapien
agcaacccatcttagtctgcaaaaartgatgtattcagcaatgaggcccc

SEQ ID NO: 5546 - DNA, 50 bp, homo sapien
tggttacttccggagatgaaagtgcwattttcacaacatactttttcaaa

SEQ ID NO: 5547 - DNA, 50 bp, homo sapien
aggtgcctctttaccatagatctcckaaaactatgcctgtttaaaagatg

SEQ ID NO: 5548 - DNA, 50 bp, homo sapien
cagggtgagcctccttggcatccttsaacaccacaaacaattcaggacca

SEQ ID NO: 5549 - DNA, 50 bp, homo sapien
aggaacatgtacatgctatattaacwgtattaaaccctcctttacaagag

SEQ ID NO: 5550 - DNA, 50 bp, homo sapien
gcactctgtagctgaattgtaaaacrcaccaacgagcactctgtagctgg

SEQ ID NO: 5551 - DNA, 50 bp, homo sapien
ttcaatgtttttatctaggattttaycaagaatgctcctgatttgagagc

SEQ ID NO: 5552 - DNA, 50 bp, homo sapien
ccgtaacaaattgccacaaacttcayggtttaaaagaacagaaatttatt

SEQ ID NO: 5553 - DNA, 50 bp, homo sapien
aacaacttctgcaattctttttaccragtctcctgataaaatcctccaca

SEQ ID NO: 5554 - DNA, 50 bp, homo sapien
tcactccaaaacctatctcttccaakaagccttaccagagaagaaaggac

SEQ ID NO: 5555 - DNA, 50 bp, homo sapien
ggtttgtaattactgtgacattgccrcttaggtagaacacagacaggtgt

SEQ ID NO: 5556 - DNA, 50 bp, homo sapien
tcatatttagcaaaaaataattggaratcatacagtattccatgttctca

SEQ ID NO: 5557 - DNA, 50 bp, homo sapien
agcagctcctggaagacctccgcaayggtaagagtgtttgggggcagtca

SEQ ID NO: 5558 - DNA, 50 bp, homo sapien
tggattatggcagcttggtaaagaastgatgatttatgtagaattgtaat

SEQ ID NO: 5559 - DNA, 50 bp, homo sapien
ggatgattctatttggtgtagtacawgttgattttattctttaaaaaaaa

SEQ ID NO: 5560 - DNA, 50 bp, homo sapien
caaaaggagaaggagagagtccgggwaatgttgttactgactccattttt

SEQ ID NO: 5561 - DNA, 50 bp, homo sapien
tgtgagttaatgtaaagctctcaaaygctttcctatttcccttagaataa

SEQ ID NO: 5562 - DNA, 50 bp, homo sapien
cttttttgatttctgtcatcagatayggacagtttatgaaattacataac

SEQ ID NO: 5563 - DNA, 50 bp, homo sapien
tctctaagttctgaggtttgtaaaargatgttcccatttgtaggtagtag

SEQ ID NO: 5564 - DNA, 50 bp, homo sapien
caaatgacattttctattttgcaagragtattgagctattttgtctttct

SEQ ID NO: 5565 - DNA, 50 bp, homo sapien
aaacggttttaaaaatcagataaaaytcttggacagagaagtgttggcag

SEQ ID NO: 5566 - DNA, 50 bp, homo sapien
acattcgctgataaacaggctacaayaggtgtagaaagatgtgggtaatg

SEQ ID NO: 5567 - DNA, 50 bp, homo sapien
gattcccaataacattaaatcagcaytataccttgccaaaattgttacct

SEQ ID NO: 5568 - DNA, 50 bp, homo sapien
ctttgtatgttatctttgtcataaaygtcgattacgtcgtagagcatttc

SEQ ID NO: 5569 - DNA, 50 bp, homo sapien
ccgtcaagttattaagtatagtaaamcattaaccaaaatcaattctatgc

SEQ ID NO: 5570 - DNA, 50 bp, homo sapien
gtatagtggtctgtataataagaaargactgaaggaagtaacaagaccaa

SEQ ID NO: 5571 - DNA, 50 bp, homo sapien
tggaagttgaagaactgaatattgargattttattcccttgtgttcctgc

SEQ ID NO: 5572 - DNA, 50 bp, homo sapien
gtaaatagcgaggcagtacatcatarcagataagagcagaggcgctggag

SEQ ID NO: 5573 - DNA, 50 bp, homo sapien
taaaggctgaattgcccactcgaagragaggagaaatggaatctgcctgc

SEQ ID NO: 5574 - DNA, 50 bp, homo sapien
tagggaaatacctgcgcaggcataaytgtaataactctggagattcacca

SEQ ID NO: 5575 - DNA, 50 bp, homo sapien
ctttgaaattaaaaatgatgtttackggaaacttctgctgttcagaagca

SEQ ID NO: 5576 - DNA, 50 bp, homo sapien
atttcagacacagagtaatccttcartacaagtaatgccctgtgtaactt

SEQ ID NO: 5577 - DNA, 50 bp, homo sapien
tcttttcatacacagctggtaggacygcaaattacgatacaattttgtga

SEQ ID NO: 5578 - DNA, 50 bp, homo sapien
atttattctttttaaaattatgcacrcaacaaatgtctgggtgagccgac

SEQ ID NO: 5579 - DNA, 50 bp, homo sapien
ctttgggctttaaaactctctgatayattccacactggaaggataggatt

SEQ ID NO: 5580 - DNA, 50 bp, homo sapien
atgctttcacttttgtgggctgactyacagacatgtggacccagacaaac

SEQ ID NO: 5581 - DNA, 50 bp, homo sapien
caaaagtaggtattcctcactaggargcatttacatagatctttaagtga

SEQ ID NO: 5582 - DNA, 50 bp, homo sapien
gagaagagaaacctgcaatggaatgraatgcataggtataacacatagca

SEQ ID NO: 5583 - DNA, 50 bp, homo sapien
gcttcaacaatatagtatgcacataygataagtactctgcccttaacttt

SEQ ID NO: 5584 - DNA, 50 bp, homo sapien
tgtaatgtaggtaaatatatgtgaartaactgctagtagagtaagtagta

SEQ ID NO: 5585 - DNA, 50 bp, homo sapien
gaagaaagtttcaagagaatggtcartattataaaatgctgcagaggacc

SEQ ID NO: 5586 - DNA, 50 bp, homo sapien
tgtggttccatttttccttcttagakctcttcatctttatttattacaaa

SEQ ID NO: 5587 - DNA, 50 bp, homo sapien
caactaatgcagaaatgcttataaaygatcttgtgatatgtactaataag

SEQ ID NO: 5588 - DNA, 50 bp, homo sapien
cctgtatttaccaaaagaatcttgasgaaatgattacttaaaagtcactt

SEQ ID NO: 5589 - DNA, 50 bp, homo sapien
tttataaaagtcttgaaaaagatagrccaacctgttaataatgtttttcc

SEQ ID NO: 5590 - DNA, 50 bp, homo sapien
tattctcaaatcttctaaccctgcakgctttctaatgtgtttagcaggga

SEQ ID NO: 5591 - DNA, 50 bp, homo sapien
tgagcaagcagtctcaaactatgtcmaagaaacacattttggggtaaaat

SEQ ID NO: 5592 - DNA, 50 bp, homo sapien
taaggatccttttggattttttacaygcacaaaacatgtcatctttataa

SEQ ID NO: 5593 - DNA, 50 bp, homo sapien
cacacacgtacgtatgcatatacacrgatatacacgtatcaccaccacac

SEQ ID NO: 5594 - DNA, 50 bp, homo sapien
gccccagttatgagaagaatgaaaaygctattgcagggagcactaagcat

SEQ ID NO: 5595 - DNA, 50 bp, homo sapien
taaacctctctatttaggtctttaaygtctctcagcaatgttttgtagta

SEQ ID NO: 5596 - DNA, 50 bp, homo sapien
tcatctccaagtcagttcttctaaayaccagaccccatttaatgacattc

SEQ ID NO: 5597 - DNA, 50 bp, homo sapien
atccttaaaattcttatatcctctcratgaattagcctctttatcataat

SEQ ID NO: 5598 - DNA, 50 bp, homo sapien
tgccgtagcattactgttgattccaygcctataatgtaccctttgctagt

SEQ ID NO: 5599 - DNA, 50 bp, homo sapien
atctaagaggggagctcgcagaaagkcttaaaatagggaaagggaagtga

SEQ ID NO: 5600 - DNA, 50 bp, homo sapien
gtgccttcctccatgttcacataaamcagggcttaggtttttctaagtct

SEQ ID NO: 5601 - DNA, 50 bp, homo sapien
tgggaatgtagaagtttagtctgatyaaaaaacatacactagactatatt

SEQ ID NO: 5602 - DNA, 50 bp, homo sapien
tttcaaagaaagccttactgaataaraagccaatgagttaaaagtgttct

SEQ ID NO: 5603 - DNA, 50 bp, homo sapien
cagtgaaagaaattacaaagtaggcraaaaagttatttggaaagtgtttt

SEQ ID NO: 5604 - DNA, 50 bp, homo sapien
gtagtgatatcctagcagttcttaartgtgcatacttgatttatatattt

SEQ ID NO: 5605 - DNA, 50 bp, homo sapien
atagcaagccgtttgccacatcttcrcataacggggtccctgtttttcaa

SEQ ID NO: 5606 - DNA, 50 bp, homo sapien
aaaagacatgaacaaactgtaaattsaaaataccaaatggaaaaaggcaa

SEQ ID NO: 5607 - DNA, 50 bp, homo sapien
tctaactctgtaaatatgtgtagcarcttttcactcattcatcacgagca

SEQ ID NO: 5608 - DNA, 50 bp, homo sapien
tactatagtcataaacttttgctgayaggtcatttataagaaggaatgaa

SEQ ID NO: 5609 - DNA, 50 bp, homo sapien
tggatacgaatacaatgcataaaaakactctcagagaacttcactgtgtt

SEQ ID NO: 5610 - DNA, 50 bp, homo sapien
acttcacatcatagtatttaagctaygggatatcaatgaggtgagtaaac

SEQ ID NO: 5611 - DNA, 50 bp, homo sapien
tgggatgagagagcaataaaaactgmatttgcataaatatggggatcaaa

SEQ ID NO: 5612 - DNA, 50 bp, homo sapien
attcaaaactggattcaatgttagaygagtagatggagtgtgaatggatg

SEQ ID NO: 5613 - DNA, 50 bp, homo sapien
atagagaaaggcttttcatcagtcayggacctaaaagcgtgctctgtaat

SEQ ID NO: 5614 - DNA, 50 bp, homo sapien
ttctgccttctttacacgattggtayaaaatgagataatttgtataatgt

SEQ ID NO: 5615 - DNA, 50 bp, homo sapien
ggaagaaatttcacaccggtaagtcsatctccctggtctttgttagccag

SEQ ID NO: 5616 - DNA, 50 bp, homo sapien
atcttctttttttacaaattggttargtgaaacagagaaattaagtgact

SEQ ID NO: 5617 - DNA, 50 bp, homo sapien
tagttaagtatagaaacaccataggractttgcaggatcagttgagtctc

SEQ ID NO: 5618 - DNA, 50 bp, homo sapien
ggtaggacaataaacagtggtagcayatcacaaaattataccttttttca

SEQ ID NO: 5619 - DNA, 50 bp, homo sapien
caactgtggagaactaacctcgtaayagaaaattttgtgtaaaggttacc

SEQ ID NO: 5620 - DNA, 50 bp, homo sapien
ccaacacagtaacattctttttgaaycactttagctaacttgaccaccac

SEQ ID NO: 5621 - DNA, 50 bp, homo sapien
aaatactatcttgtctacagtgacartcttgaggtttggtgagtatatat

SEQ ID NO: 5622 - DNA, 50 bp, homo sapien
tagacctatctttctggccaatgatyaactgataaactagtttgtgtctg

SEQ ID NO: 5623 - DNA, 50 bp, homo sapien
tggttctctaagccttcctactagcsaagatgactgacagctggacctcc

SEQ ID NO: 5624 - DNA, 50 bp, homo sapien
aaaatacagtatattttgtatctcargagtggtttgctttatttaaagta

SEQ ID NO: 5625 - DNA, 50 bp, homo sapien
tgttcttctactcagataattttaaygtgcaggaagattgatagccttac

SEQ ID NO: 5626 - DNA, 50 bp, homo sapien
aaactatatacttaaaaatgattaargtgataaattatgttatgtatatt

SEQ ID NO: 5627 - DNA, 50 bp, homo sapien
ccattcattgatggtcatgttttgartatgagcttttatacccacggata

SEQ ID NO: 5628 - DNA, 50 bp, homo sapien
aaggcaatatgacaaggctgtatackctatgatttcacctatttgacatt

SEQ ID NO: 5629 - DNA, 50 bp, homo sapien
tggtacacttgttacagttgatgaamcttcatttacacatcattatcact

SEQ ID NO: 5630 - DNA, 50 bp, homo sapien
acgttggtgggggatgctgataatamaagttatgcatgggtggggacagg

SEQ ID NO: 5631 - DNA, 50 bp, homo sapien
gacatctgagttaagataatcacaarctatagcaagttgtggtaaaatat

SEQ ID NO: 5632 - DNA, 50 bp, homo sapien
aacagtttcacttcatttgagtcaayatgatgcacaaggagaaaaggaac

SEQ ID NO: 5633 - DNA, 50 bp, homo sapien
acctctaaattattcatatgtattayccattatccaacctttttagacta

SEQ ID NO: 5634 - DNA, 50 bp, homo sapien
tcactctggggctgtttgtcatagcrcagttttccttagaagatgcagtt

SEQ ID NO: 5635 - DNA, 50 bp, homo sapien
tgttaaattctaccaagcatttgagrattaaactctgacttttaatcctt

SEQ ID NO: 5636 - DNA, 50 bp, homo sapien
caaatgcttggtagaatttaacagcraatctacctagccctggagttttc

SEQ ID NO: 5637 - DNA, 50 bp, homo sapien
tgttattgttatctacatacattagsataaacttcagttatgggaatatt

SEQ ID NO: 5638 - DNA, 50 bp, homo sapien
aacctctccaagtgtcaacgattaaygatgagaactctgcctccacccac

SEQ ID NO: 5639 - DNA, 50 bp, homo sapien
aaactacttttgtatttttatgtatyaacctttctacaaatgctagctat

SEQ ID NO: 5640 - DNA, 50 bp, homo sapien
tcatttgattagtataatcacataaytaacagtttcactttaccaataat

SEQ ID NO: 5641 - DNA, 50 bp, homo sapien
ctttaccaataataaatcattgagartaacagaatcaggagtcaaaaact

SEQ ID NO: 5642 - DNA, 50 bp, homo sapien
actatgttcatgaggagtaaattagwcatgctttggattttcttttttta

SEQ ID NO: 5643 - DNA, 50 bp, homo sapien
atttcataaaacaccagttgcaacartatgggagtgatgtgcattgtggg

SEQ ID NO: 5644 - DNA, 50 bp, homo sapien
ctgcgtattggttcctggtagaaaargattgtgtattccagaaaaggaat

SEQ ID NO: 5645 - DNA, 50 bp, homo sapien
tgagagaaatataaagaatgatataygctttttccttcaggctatggagc

SEQ ID NO: 5646 - DNA, 50 bp, homo sapien
aggctcttactactaataaggctaamtattcaaccatctaaagctttctg

SEQ ID NO: 5647 - DNA, 50 bp, homo sapien
agtacctacataactcagataaatayctcaaactttctttgcccaagtta

SEQ ID NO: 5648 - DNA, 50 bp, homo sapien
aattcaacaaagcatgtacacattcrcttaatatacaaactacttagttc

SEQ ID NO: 5649 - DNA, 50 bp, homo sapien
aagtacgcatacatatcacatgcacrcatatactccctgattacctagca

SEQ ID NO: 5650 - DNA, 50 bp, homo sapien
acaaagagggacatttggggttggayggaaatagcgatttttcattcttt

SEQ ID NO: 5651 - DNA, 50 bp, homo sapien
ctacaataaagagttttattccaaayaccagtgaaggactataaaaaggg

SEQ ID NO: 5652 - DNA, 50 bp, homo sapien
ttctacattatcacgtttactaaaartgtttgtcaagtagatgttatata

SEQ ID NO: 5653 - DNA, 50 bp, homo sapien
gaagaagttaacatgaaaaaatgtgycacaaacttgtcattttcttgcct

SEQ ID NO: 5654 - DNA, 50 bp, homo sapien
agcttaattttttaagaattcccggraaaatctcatcattatttagataa

SEQ ID NO: 5655 - DNA, 50 bp, homo sapien
ttgacatgcataccacacgaagacaygttatgcaagatgcactcatcaaa

SEQ ID NO: 5656 - DNA, 50 bp, homo sapien
ttatcaaaatatcccaagtgttatckcatgtaagcagagttaaaatgcat

SEQ ID NO: 5657 - DNA, 50 bp, homo sapien
aacctatcaactgaaaatcaacagargagttttttaatataagtaacctg

SEQ ID NO: 5658 - DNA, 50 bp, homo sapien
atagaaaacagtatgcttacaagaayaagaattaaatctgtgtatatttg

SEQ ID NO: 5659 - DNA, 50 bp, homo sapien
cagcaaaagaaaagacaaagtatagyattagctcaaatcttgtttagaaa

SEQ ID NO: 5660 - DNA, 50 bp, homo sapien
gaaattctttgattaaggaagtgaaygcccagaagtgcatacaatttctt

SEQ ID NO: 5661 - DNA, 50 bp, homo sapien
tgtaaaatggaaaaagtacatcggaraatgacttcattgacaaacagaac

SEQ ID NO: 5662 - DNA, 50 bp, homo sapien
tttatccaaaagaatcaaaattacastctcagatacaatcatatactagt

SEQ ID NO: 5663 - DNA, 50 bp, homo sapien
tactcatcaaaaaatctagacccggmaaagagattattcagtgcttttcg

SEQ ID NO: 5664 - DNA, 50 bp, homo sapien
taagtccattatgtcagcccatatascaaagtttattagggagtttttag

SEQ ID NO: 5665 - DNA, 50 bp, homo sapien
ttccccttagcatttaactcagcacrctttctaaatgtcaggcatgtaac

SEQ ID NO: 5666 - DNA, 50 bp, homo sapien
tggtcttggtccttcagccaagagtwaaatagaaactataagggcgactc

SEQ ID NO: 5667 - DNA, 50 bp, homo sapien
caagagactagattactctgaataaygaaacagataatagagaaatgttg

SEQ ID NO: 5668 - DNA, 50 bp, homo sapien
gtcagttttaatttttatgcattaawttaacccaacttgttagacatctc

SEQ ID NO: 5669 - DNA, 50 bp, homo sapien
tccacaagaagtagatgtgaataacwcccaaggattactgtgtatgatac

SEQ ID NO: 5670 - DNA, 50 bp, homo sapien
ccccctcattctctctttaaagccaygactacctaagtgatgtaacttct

SEQ ID NO: 5671 - DNA, 50 bp, homo sapien
tctttcgtggcattattaagagtctyaaacgtaaagcacttgatacattg

SEQ ID NO: 5672 - DNA, 50 bp, homo sapien
tgcatcaagattttccacaaaattcmatcctgactttaattgtaaattaa

SEQ ID NO: 5673 - DNA, 50 bp, homo sapien
gattttaaaccaaatggctttgctayggtagcggaaggagcttctcgccc

SEQ ID NO: 5674 - DNA, 50 bp, homo sapien
agagaaggcactatgagatttagaaycaagttaggactgcagatacaggt

SEQ ID NO: 5675 - DNA, 50 bp, homo sapien
tatcaccaacaagaaaccaatatcarctgacataatagaagttttaaaaa

SEQ ID NO: 5676 - DNA, 50 bp, homo sapien
ctgggattccagaatattctcctgargtacagagtccttaacctaggctt

SEQ ID NO: 5677 - DNA, 50 bp, homo sapien
aattaagttgtggtttgaatatgtcrctgaaatgctatgtggacaacaaa

SEQ ID NO: 5678 - DNA, 50 bp, homo sapien
taagagaaacgtggatggggttttarcatagcttggaactggcctgcagg

SEQ ID NO: 5679 - DNA, 50 bp, homo sapien
tctttgctcacattaaagtcccttargtgagtataattcttctctgatga

SEQ ID NO: 5680 - DNA, 50 bp, homo sapien
agaaactgaataaaaagaaacaaccrggaagcatgttaccttagcagaat

SEQ ID NO: 5681 - DNA, 50 bp, homo sapien
ccttagcagaatttttacagtcttayaggatttggaagaaaaaaaatgaa

SEQ ID NO: 5682 - DNA, 50 bp, homo sapien
tggttgtaaaaatagtgagaaaatayatatgaaagaagctgccagcatga

SEQ ID NO: 5683 - DNA, 50 bp, homo sapien
aagagaaaacttctttgagaatctargacgaaatacagcccctcatttta

SEQ ID NO: 5684 - DNA, 50 bp, homo sapien
gatgaaatcatgatgataatgattaygataatgcctcccattattttctc

SEQ ID NO: 5685 - DNA, 50 bp, homo sapien
tgtctggtatgcaaagaatttgctayggtgattctagttactttcataca

SEQ ID NO: 5686 - DNA, 50 bp, homo sapien
ttaaatttaaaaatgtgcaatcaaaygttatatgtagcatgagcctacca

SEQ ID NO: 5687 - DNA, 50 bp, homo sapien
actaatctctccttaagtgagaagaracagtgatcatgagcttggacatg

SEQ ID NO: 5688 - DNA, 50 bp, homo sapien
tctttaaaggtgcctgatgtaactcragtcaaagcagttctgttttgcaa

SEQ ID NO: 5689 - DNA, 50 bp, homo sapien
ttagtttactttacctaagacataaygtggtgcaactgaaccatactaac

SEQ ID NO: 5690 - DNA, 50 bp, homo sapien
gaacattcggaagcctacattttcaractactaagacagtaaatttattg

SEQ ID NO: 5691 - DNA, 50 bp, homo sapien
tcaaatggacttaattgttcttatcygaaagttactgtgcatgtaacgta

SEQ ID NO: 5692 - DNA, 50 bp, homo sapien
taaacaaaaacaaggaggaataaaaycttgctctctttatgtcctcatgc

SEQ ID NO: 5693 - DNA, 50 bp, homo sapien
tacatattcagaaatggatcagataygaaatgtttgattttacaccttgc

SEQ ID NO: 5694 - DNA, 50 bp, homo sapien
ctcacaggaacacttcatcctaatgwacacttcattttattatagcacct

SEQ ID NO: 5695 - DNA, 50 bp, homo sapien
actcaaatcaaagaccagatctgatraaggaatcaagcagcagaattatt

SEQ ID NO: 5696 - DNA, 50 bp, homo sapien
caaactcccacagatttggatcataycatgtttatagtaaagtctgcaaa

SEQ ID NO: 5697 - DNA, 50 bp, homo sapien
aagaccaaatccaatacacgaatcargtaacaggatcaggaggaggaatg

SEQ ID NO: 5698 - DNA, 50 bp, homo sapien
atacattatgtgaaggaaaataataraacaagtcctagagctcaaaaaca

SEQ ID NO: 5699 - DNA, 50 bp, homo sapien
cagttcttataggacaaatatgagayggctgaaaacagcatgtctcaact

SEQ ID NO: 5700 - DNA, 50 bp, homo sapien
tatgagagagaggcagtatgagaccratgcagtacatgggaatgagtgct

SEQ ID NO: 5701 - DNA, 50 bp, homo sapien
ggtaaaacacaaaactcatgtacaawtaagtaacaagcatgttaaaaata

SEQ ID NO: 5702 - DNA, 50 bp, homo sapien
aaacttatgagaataaatggaaaggrcatagaaatagtaacatgtaaatt

SEQ ID NO: 5703 - DNA, 50 bp, homo sapien
tactgttgctaataatacacagaaaygataaaattcacttaacttttgga

SEQ ID NO: 5704 - DNA, 50 bp, homo sapien
ggtgtttctttatagcaatacaagargagcataacatactacagaaaatt

SEQ ID NO: 5705 - DNA, 50 bp, homo sapien
tggccacacagtcactgaagcaggartactgacccatcctccactgacta

SEQ ID NO: 5706 - DNA, 50 bp, homo sapien
tagctatttatgaacataaagaccarggtttgaaggcatagtgcatgccc

SEQ ID NO: 5707 - DNA, 50 bp, homo sapien
atgtagaaatttcctgtgtgtatacragctgttactggatccactctggt

SEQ ID NO: 5708 - DNA, 50 bp, homo sapien
tagtctcctttattgatgacttttaycttttctgaggatatagtgaaaca

SEQ ID NO: 5709 - DNA, 50 bp, homo sapien
gtaaaaataattcatgtgcccataaytgagtcccaagaaactagaatata

SEQ ID NO: 5710 - DNA, 50 bp, homo sapien
atttactcatattgggctaagataasattcctccaaataataactaagaa

SEQ ID NO: 5711 - DNA, 50 bp, homo sapien
tactttaaggattaatcatctgtcamatggctcaaagtcacaataattag

SEQ ID NO: 5712 - DNA, 50 bp, homo sapien
tatattatcagagacaaaacactaaytattgtgactttgagccatgtgac

SEQ ID NO: 5713 - DNA, 50 bp, homo sapien
ctgtgaaatgaggatagcaataaaakttaacttctaaatttaagtattca

SEQ ID NO: 5714 - DNA, 50 bp, homo sapien
tttacaaagattaaagggatgaaaarttctaaagtctttccatcctgatg

SEQ ID NO: 5715 - DNA, 50 bp, homo sapien
gagtggggctactgtcacaaagaacrgatgctgataaaaagcttaatcaa

SEQ ID NO: 5716 - DNA, 50 bp, homo sapien
aataatgttgatggtaacttttaaaygttagatatctagtaaacaaaaag

SEQ ID NO: 5717 - DNA, 50 bp, homo sapien
atgagatttaagtaaagctaattctraatgacggaagatattaacagtaa

SEQ ID NO: 5718 - DNA, 50 bp, homo sapien
tagagaaaaagtttctggcattttaygtaattaggtgtatctcaaaaatt

SEQ ID NO: 5719 - DNA, 50 bp, homo sapien
gttacaatgagctatactggctgaaytgataatatgttggctattatatc

SEQ ID NO: 5720 - DNA, 50 bp, homo sapien
tttctctcttaatggttcactaccartaggcgtaacatgaaggcttcttt

SEQ ID NO: 5721 - DNA, 50 bp, homo sapien
cctatacggcattttactatactgaytatttgaggtaattgtaacacaat

SEQ ID NO: 5722 - DNA, 50 bp, homo sapien
tataaatactgccaagccagtaacasctgttcaagacattaaaagaaaat

SEQ ID NO: 5723 - DNA, 50 bp, homo sapien
attgaatcttagacagcaatttgcaytacagaaagaaatagaagattggg

SEQ ID NO: 5724 - DNA, 50 bp, homo sapien
cagccatagtgtgtctaatctatcawcatcaatattctgaccccaagaga

SEQ ID NO: 5725 - DNA, 50 bp, homo sapien
tgttatttattggaatgatgatcccrcaggcaaagttaattgcataatcc

SEQ ID NO: 5726 - DNA, 50 bp, homo sapien
ttttgttacccagtgtttcaagttamgaacaaagcctttaggacatcagc

SEQ ID NO: 5727 - DNA, 50 bp, homo sapien
gcactctgtagttcacacagcactaytacacactctttctctgtgttgcc

SEQ ID NO: 5728 - DNA, 50 bp, homo sapien
ataaaaataaatcaagtaaaagagakgaacaaaattttgagacttgcatg

SEQ ID NO: 5729 - DNA, 50 bp, homo sapien
agtaatgttaaatatttcacaactawggaaaaatattacaaaaccataca

SEQ ID NO: 5730 - DNA, 50 bp, homo sapien
ttgctagatgtaaagagtgcatacamcaataacttgacttagtaggttga

SEQ ID NO: 5731 - DNA, 50 bp, homo sapien
ttttctctctctttcacatttgttaragggcatcactagatcttgagagg

SEQ ID NO: 5732 - DNA, 50 bp, homo sapien
tttctttctcagtgtccctattgcaytgaattgtgtaaacctcacataaa

SEQ ID NO: 5733 - DNA, 50 bp, homo sapien
agtcatcaccttttatagaacgtaayataaaggttgaagttttcacagaa

SEQ ID NO: 5734 - DNA, 50 bp, homo sapien
tggttaactgtagttacattgataartatctgaatcaattcctttggagt

SEQ ID NO: 5735 - DNA, 50 bp, homo sapien
ctaattccttctgttcaaacacatargcatataaagacatgattaaaata

SEQ ID NO: 5736 - DNA, 50 bp, homo sapien
agagcaaaccaagtcttgtagaggargtagtatcttagggaaaaagaggt

SEQ ID NO: 5737 - DNA, 50 bp, homo sapien
tctatgcttcctttgctattgtctaygttcttcaaattatgttttaaatg

SEQ ID NO: 5738 - DNA, 50 bp, homo sapien
gacttgtagcacgtatgcagaaagcmattgttaactagagtataatatga

SEQ ID NO: 5739 - DNA, 50 bp, homo sapien
acagtgactggaatttgcactttgcmctttggaaatttcctcagaaacta

SEQ ID NO: 5740 - DNA, 50 bp, homo sapien
aatgacagacaagggagacttctcaygtctgaaaatgtacttctctagaa

SEQ ID NO: 5741 - DNA, 50 bp, homo sapien
acggctctgaacactgtgaaaattcrgaagtaaacaatgtatggttcctg

SEQ ID NO: 5742 - DNA, 50 bp, homo sapien
tcagcagcatctcttggtacaaatarcaatcctcatcagaaagcaccatc

SEQ ID NO: 5743 - DNA, 50 bp, homo sapien
tttcatctgtgacaggattttaagayggaattggacttttaaaattggtg

SEQ ID NO: 5744 - DNA, 50 bp, homo sapien
ctcatttatgcaaaaaaagagtcaayatacttatcaaggtatctcaactt

SEQ ID NO: 5745 - DNA, 50 bp, homo sapien
atcttatttcctagggttatgataaytgaattagataatacatgtagcaa

SEQ ID NO: 5746 - DNA, 50 bp, homo sapien
tagcttcatttaaacatttaagcaayggtctattttgaaaattactcata

SEQ ID NO: 5747 - DNA, 50 bp, homo sapien
cttaaatgtttaaatgaagctaaaasaagtatgaacccattggttagagt

SEQ ID NO: 5748 - DNA, 50 bp, homo sapien
tgtaccgccactctgttagctcacarggaaaataaggaaaagccaggcct

SEQ ID NO: 5749 - DNA, 50 bp, homo sapien
cacaaagtaattaggaaacaccttasagtgaaagaaaatatcagctcagt

SEQ ID NO: 5750 - DNA, 50 bp, homo sapien
gctcaaaatatgcctcttttacagaytatttgtttctctaatgttaagca

SEQ ID NO: 5751 - DNA, 50 bp, homo sapien
ccaacaattataatgatgattataaygaaaggttcactaaaatctgttct

SEQ ID NO: 5752 - DNA, 50 bp, homo sapien
aaacaaacaaacaaaaaacccaagaytctctatttcactgggctgcatac

SEQ ID NO: 5753 - DNA, 50 bp, homo sapien
aggggtttgagggaaggcatgacaarcgtggtcagaagtcagatcataca

SEQ ID NO: 5754 - DNA, 50 bp, homo sapien
cccaatagcttaggtattagggaaaytgtaatgagatgtgtgcattttct

SEQ ID NO: 5755 - DNA, 50 bp, homo sapien
tagataataggatcatgtacaaatcyattgaaataactgaatcataatga

SEQ ID NO: 5756 - DNA, 50 bp, homo sapien
agatcaaccattaccttctgtaaacrcattcttttctccatagtgcatac

SEQ ID NO: 5757 - DNA, 50 bp, homo sapien
atatcctgacccctctattctttgaygtacctaagcagtagatcttccct

SEQ ID NO: 5758 - DNA, 50 bp, homo sapien
tgacttaggttttcataaggagataytataggccaggcacagtggctcat

SEQ ID NO: 5759 - DNA, 50 bp, homo sapien
ggtcaggatatgatgaaggagtgatraggaaagttaaaaggcaggagatt

SEQ ID NO: 5760 - DNA, 50 bp, homo sapien
gtgcagagccatgatgaaatgagccrcttgtcagtaagactcagaaagtc

SEQ ID NO: 5761 - DNA, 50 bp, homo sapien
tgtcaacaagatgttgcttcaatcasagattacatgtcctttttctaagt

SEQ ID NO: 5762 - DNA, 50 bp, homo sapien
tgttttaaaacaaagaacaaactaaratgaagaataaccacataccctgc

SEQ ID NO: 5763 - DNA, 50 bp, homo sapien
taaagaaactcctcctccattaagcraaattttaggattgtacactactc

SEQ ID NO: 5764 - DNA, 50 bp, homo sapien
agggtaagaaaaaactgctgaacaaycctctatttggcagtcaaggaaga

SEQ ID NO: 5765 - DNA, 50 bp, homo sapien
catcagttgataaagctcttcttacrcattagtctaccatcttccttgac

SEQ ID NO: 5766 - DNA, 50 bp, homo sapien
attctttaaggagataaactggagaktcagccttgtatcagcattaaatt

SEQ ID NO: 5767 - DNA, 50 bp, homo sapien
cctatgctggattgataaaataaacrgcaatatgtagaggaacttgtggc

SEQ ID NO: 5768 - DNA, 50 bp, homo sapien
tcagaacaaagaatacccattagagragttttgctcaggcaggaatggcc

SEQ ID NO: 5769 - DNA, 50 bp, homo sapien
cttcccagctaaagagattattccarctacacaaggttcagtgcacatac

SEQ ID NO: 5770 - DNA, 50 bp, homo sapien
ccttccaaagcatccccttgttacayacctctaatacacaagctgaaacc

SEQ ID NO: 5771 - DNA, 50 bp, homo sapien
gtttacaatgactttcaggctgttaraccctaatactctaagttgttttt

SEQ ID NO: 5772 - DNA, 50 bp, homo sapien
agtactcaaagtgctcagaacaggtraaattaaagagaggttgggggaag

SEQ ID NO: 5773 - DNA, 50 bp, homo sapien
taattacgagcccaacgtataagtcragtatgattaaattacactcttga

SEQ ID NO: 5774 - DNA, 50 bp, homo sapien
tacctgtactgtgagtgtcagtttaygaaatgtatcttaaaatttgaaaa

SEQ ID NO: 5775 - DNA, 50 bp, homo sapien
tcaaacattaataataattgagaatsagtttataggagaagcagtgcaaa

SEQ ID NO: 5776 - DNA, 50 bp, homo sapien
ttatgcccaactctttctatcagaaktgagaaaacacaataaaaatctct

SEQ ID NO: 5777 - DNA, 50 bp, homo sapien
tctctccacccttctttgcgggaacmattctgccaggtccaagttggaaa

SEQ ID NO: 5778 - DNA, 50 bp, homo sapien
aatggtagggttatatttatatgtcyctatgctttccaatctttctaaaa

SEQ ID NO: 5779 - DNA, 50 bp, homo sapien
aaacttacactacctatctttaaaaygatgatcatgccaggaatggtggc

SEQ ID NO: 5780 - DNA, 50 bp, homo sapien
aggtagaatgctttaagactgtcagwagaaataagagacaaaaaattgtg

SEQ ID NO: 5781 - DNA, 50 bp, homo sapien
gattgctgttagaataaaatcaaaaygtgtcatctcttaggtcttgcaga

SEQ ID NO: 5782 - DNA, 50 bp, homo sapien
tactaatgttatgtttaactatgacsatattcatccttgcgcctttattt

SEQ ID NO: 5783 - DNA, 50 bp, homo sapien
tggaagcatcgccaaagggcttaccraactccaagtccttaatgttgcag

SEQ ID NO: 5784 - DNA, 50 bp, homo sapien
agggcctcatttaatagtttttgcarggaattgatgagcaggtgaagagg

SEQ ID NO: 5785 - DNA, 50 bp, homo sapien
attaaggaaaaagtagaatgtgatcraaaaaactctcagttgcagctgaa

SEQ ID NO: 5786 - DNA, 32 bp, homo sapien
aaatactctggatctarattgttgtgaatgaa

SEQ ID NO: 5787 - DNA, 50 bp, homo sapien
aagggccgaatagagggcatttaaarcattctgacaaagtcaacatagga

SEQ ID NO: 5788 - DNA, 50 bp, homo sapien
atatgatatgaatacgattcaagtayattgtgtgcatacagaagtattgt

SEQ ID NO: 5789 - DNA, 50 bp, homo sapien
aatactttacatgttgaactcggtaraagtctttctgtttatgctcaatg

SEQ ID NO: 5790 - DNA, 50 bp, homo sapien
atcttcaatattcattaaccaccaamcataaagtagataatgtgctacag

SEQ ID NO: 5791 - DNA, 50 bp, homo sapien
tgggggtacaggcattggataaataygccagttccaaatggaagaaatta

SEQ ID NO: 5792 - DNA, 50 bp, homo sapien
taaaatagaatttggcattgtggtayagggacttgatttcttagcatata

SEQ ID NO: 5793 - DNA, 50 bp, homo sapien
acttttgtacttttatcttgaaaaaraagctgcaatattttaattagagg

SEQ ID NO: 5794 - DNA, 50 bp, homo sapien
gtcagacttttccaataaataagtayaggtctggtcaagtttttctacca

SEQ ID NO: 5795 - DNA, 50 bp, homo sapien
tgcaggctcaaggtaaaattcaggasgtgatatccactaacagagaggtc

SEQ ID NO: 5796 - DNA, 50 bp, homo sapien
aaagaagcttaaatatgttaatatcrctgaaaaaattgacctagccaaca

SEQ ID NO: 5797 - DNA, 50 bp, homo sapien
gtcgatttttcttttttgcctcaccrgatgtgtttaagtgtgggatgaaa

SEQ ID NO: 5798 - DNA, 50 bp, homo sapien
agatgagaacacatctcagtgtatcwcaattcagcaagaaaatataaaca

SEQ ID NO: 5799 - DNA, 50 bp, homo sapien
acttgaagcttttgataggttctatracagtagaattgtgaaaattaaac

SEQ ID NO: 5800 - DNA, 50 bp, homo sapien
ttaattaattaggacaacctatctcraatatttctaagtaaagctgacca

SEQ ID NO: 5801 - DNA, 50 bp, homo sapien
tcattcattgaaatgggattagtcakcctgacagattattgacattctgg

SEQ ID NO: 5802 - DNA, 50 bp, homo sapien
ttctgaaaaaactggaatgattgaaygtacccaaatcattcctggttatc

SEQ ID NO: 5803 - DNA, 50 bp, homo sapien
atcaggagctggaaatctcagagacragagcatattaaaaacattatttt

SEQ ID NO: 5804 - DNA, 50 bp, homo sapien
atcaccatcagagccaccggcattaygtgagccttaagaaagtgaaatgg

SEQ ID NO: 5805 - DNA, 50 bp, homo sapien
tgctgcttaactgaaaaataatctaracagtctctttcattcatggttgt

SEQ ID NO: 5806 - DNA, 50 bp, homo sapien
agaattgataatcaagtatgttttcrctctaattcatgtcaattcaatat

SEQ ID NO: 5807 - DNA, 50 bp, homo sapien
gccagtattgatatctagcatctaarccactagagttgcagggcaggaaa

SEQ ID NO: 5808 - DNA, 50 bp, homo sapien
aatagcatgtctaagtacaaagaatyagtggaaaggaaggtacatattga

SEQ ID NO: 5809 - DNA, 50 bp, homo sapien
ggttatgttattttgggagctggaarttacaactaggtaccataatgtga

SEQ ID NO: 5810 - DNA, 50 bp, homo sapien
gcaagagagcaatactttaagaccasagaaatgttcaccagcaaaacgac

SEQ ID NO: 5811 - DNA, 50 bp, homo sapien
tatatgtgtttttgtgtgtgtgtccracatatttaacttatacagtcttc

SEQ ID NO: 5812 - DNA, 50 bp, homo sapien
tgtgttataatttttgtttaaagcaytattaatctgattcttcaggtatt

SEQ ID NO: 5813 - DNA, 50 bp, homo sapien
tgcctttttgtcaaatccttctgaargaaacaacgaagaacactgcagaa

SEQ ID NO: 5814 - DNA, 50 bp, homo sapien
taattgatatttgaggtaactgtggkaagcaacgtaatgggttttgagga

SEQ ID NO: 5815 - DNA, 50 bp, homo sapien
gatatgtctcttattttgatcaaagyattggagtttacacaagttccatg

SEQ ID NO: 5816 - DNA, 50 bp, homo sapien
gcttattcctctaaggtcaccggaaktaaaaaggactgccagcaatgtct

SEQ ID NO: 5817 - DNA, 50 bp, homo sapien
aaaaggtacaaccacttaagaaaaartatgtgtagctttctagtacagct

SEQ ID NO: 5818 - DNA, 50 bp, homo sapien
tttgccacatacaggttttattaagkcactctgggcaggtagtcctagta

SEQ ID NO: 5819 - DNA, 50 bp, homo sapien
gtataataaagagctaagccagagasaaacgaggtaagacacaaggaatt

SEQ ID NO: 5820 - DNA, 50 bp, homo sapien
agccaacgatagaactcctcagacaycttatttggcttgtttatgtagca

SEQ ID NO: 5821 - DNA, 50 bp, homo sapien
tttattttactctgtagtttgtagamtataacctaattacagaaacctaa

SEQ ID NO: 5822 - DNA, 50 bp, homo sapien
ttacatggtctgtttctgtggagcayatgaagttgttattagggatttta

SEQ ID NO: 5823 - DNA, 50 bp, homo sapien
gagaaatatgagtagcactgcccaawtaaaactcatttaactgattatgt

SEQ ID NO: 5824 - DNA, 50 bp, homo sapien
agaatagttctgaagaataaacaacrcttttactccactgagaacatttc

SEQ ID NO: 5825 - DNA, 50 bp, homo sapien
atgcaagtaaactttggcaaccttasagtgtgaagaaaacaagtgtaatg

SEQ ID NO: 5826 - DNA, 50 bp, homo sapien
agaagtatcttcttccaaaattaccmatggagcatgaagcgaaaagacag

SEQ ID NO: 5827 - DNA, 50 bp, homo sapien
tacaaatatgcaacatggtaaaggaratcattggcagagcaatttcctaa

SEQ ID NO: 5828 - DNA, 50 bp, homo sapien
gaagattgtaattgaccaaaccatcrcttctgtacatttcagtattttaa

SEQ ID NO: 5829 - DNA, 50 bp, homo sapien
atttttcctgatatttattatcagarcattttttaagaatagtaattttc

SEQ ID NO: 5830 - DNA, 50 bp, homo sapien
aaaaatgaagtgatcagttcagttayagaattaaaaaaaggaagaagttt

SEQ ID NO: 5831 - DNA, 50 bp, homo sapien
tctactatcttctctgacaatgtackaatctccaaaagcctgtatgtaag

SEQ ID NO: 5832 - DNA, 50 bp, homo sapien
agaccctccagtaacacactaaacaytcaaattaactgagaagggggata

SEQ ID NO: 5833 - DNA, 50 bp, homo sapien
ggttgtaaaatggtgatattttaatwacatttgatgctagttttgtccca

SEQ ID NO: 5834 - DNA, 50 bp, homo sapien
aatggtgctatttacaataacgggaractcaactcaacttgtaagctaac

SEQ ID NO: 5835 - DNA, 50 bp, homo sapien
acaattgagtattaggagatgctagmacgtgtttagagaaagtgggaaca

SEQ ID NO: 5836 - DNA, 50 bp, homo sapien
ccagttctttaatgtttaacgtatgyattcatcagaattgtagtgaaggg

SEQ ID NO: 5837 - DNA, 50 bp, homo sapien
cttcttagtctcatttgcagctcaascgtttctcattatgtgatccttta

SEQ ID NO: 5838 - DNA, 50 bp, homo sapien
acaacttctgccttgaggcattgaamtctttggtcccatgctagagaatt

SEQ ID NO: 5839 - DNA, 50 bp, homo sapien
ttcttatacaggtcagcaagttgtarctaagatataaacaatgaaactca

SEQ ID NO: 5840 - DNA, 50 bp, homo sapien
gaggcatatatggatgccaacataartaatttgtatgacaggttgtgttg

SEQ ID NO: 5841 - DNA, 50 bp, homo sapien
agggagttgtgaatggtagatgatcrgacatatagcctcaaagggagctt

SEQ ID NO: 5842 - DNA, 50 bp, homo sapien
gatgttacaacattctatgacaaacrctgcttggtgggcaagagattttt

SEQ ID NO: 5843 - DNA, 50 bp, homo sapien
caaggatgaagaaagctctgaaaaayggaagggaaagttacaaagaagaa

SEQ ID NO: 5844 - DNA, 50 bp, homo sapien
tatgaaacttctccacaatagctaartcaagttgtatgtatgtcaatatg

SEQ ID NO: 5845 - DNA, 50 bp, homo sapien
aacaagagagagccttctagagtgaygttacaagtttatttaattacttt

SEQ ID NO: 5846 - DNA, 50 bp, homo sapien
ttagattcaagactgactttaagaaygcttataaaaagagaaccacggaa

SEQ ID NO: 5847 - DNA, 50 bp, homo sapien
gaatactgatgtatttagattgttayatgctattcttaaaatgctttaga

SEQ ID NO: 5848 - DNA, 50 bp, homo sapien
acatctttctctttaatagaagttcrgaaatagccaaagttgttattccc

SEQ ID NO: 5849 - DNA, 50 bp, homo sapien
tgaagatacacgaggatgaagtagasgatatggaagaaaattaagtgtga

SEQ ID NO: 5850 - DNA, 50 bp, homo sapien
atacaaagaaaatcttacaaaatatwaagaaagtcatatatcaaaagtga

SEQ ID NO: 5851 - DNA, 50 bp, homo sapien
taggactcgaattctcccaacttcamgaaacacgatggtaaccactggac

SEQ ID NO: 5852 - DNA, 50 bp, homo sapien
cttctttcatacagtgccaagtacayggtgtttcaggccctggtggagaa

SEQ ID NO: 5853 - DNA, 50 bp, homo sapien
ttcataaatggaagttaagcccaaaytgactgttttttggggggctaaat

SEQ ID NO: 5854 - DNA, 50 bp, homo sapien
gtgtaaaaaaaaaaagtcatatccarggatgttcatcacattataactta

SEQ ID NO: 5855 - DNA, 50 bp, homo sapien
tttaagctgtggtactttgccactakaattctttcattttgtactcctgt

SEQ ID NO: 5856 - DNA, 50 bp, homo sapien
caagctgagcaatgatccagagcaayagaatcacttgaaggtgacacctc

SEQ ID NO: 5857 - DNA, 50 bp, homo sapien
gataataattggcacttaacggttayagaacactttcactgatattttcc

SEQ ID NO: 5858 - DNA, 50 bp, homo sapien
atcactaaaagcatagtcaagatgayacattgaaaaaagaattcactaat

SEQ ID NO: 5859 - DNA, 50 bp, homo sapien
aatccctgaaaatgacctcatagtayggtggaaaagacagctacataaac

SEQ ID NO: 5860 - DNA, 50 bp, homo sapien
atctggggtttttatgttctcaaaayggaggaagtgtgtgctgactgatc

SEQ ID NO: 5861 - DNA, 50 bp, homo sapien
taataaagtaaaataaatttctctargttgagttcctagtaatatcataa

SEQ ID NO: 5862 - DNA, 50 bp, homo sapien
aggcttacattttagcagagtgtaayaataagagtaatcagtaagtaaat

SEQ ID NO: 5863 - DNA, 50 bp, homo sapien
gctaatagagtcatgtgccatataamatttcagccaatgatgggccacat

SEQ ID NO: 5864 - DNA, 50 bp, homo sapien
agctttctttggaatgaataactaartatagtcacaattttgacattttg

SEQ ID NO: 5865 - DNA, 50 bp, homo sapien
ttgtacattgaaacccatgctctagragtttgttgcatattctgattgta

SEQ ID NO: 5866 - DNA, 50 bp, homo sapien
attgctttaatctgcatattgcaaarttgttttctgtatttaatgcctcc

SEQ ID NO: 5867 - DNA, 50 bp, homo sapien
tcaaagttatagaccattttttctgsaaataactataaggtgtacataat

SEQ ID NO: 5868 - DNA, 50 bp, homo sapien
gtttaataatatttaaactgagtaartcttccaggaatgcttttcttatt

SEQ ID NO: 5869 - DNA, 50 bp, homo sapien
aaaaagactttgagaatatatggaawctcaatcacaatataaaaaataaa

SEQ ID NO: 5870 - DNA, 50 bp, homo sapien
ttctaattttctgtgattaaacagartaaacgtcaggatgaaatctaata

SEQ ID NO: 5871 - DNA, 50 bp, homo sapien
caatagactagaacaagcagaaaacraatttcagaactagatggccagtc

SEQ ID NO: 5872 - DNA, 50 bp, homo sapien
gcacctacaatttgaaagtagattgscaagaaacatataggtggagaacc

SEQ ID NO: 5873 - DNA, 50 bp, homo sapien
tatagttataagaagcaagttaaaarcaatagcacgaattgaccccactt

SEQ ID NO: 5874 - DNA, 50 bp, homo sapien
tgaaaactatctaaaaaatccagaaygatgtgttttttattcctcccata

SEQ ID NO: 5875 - DNA, 50 bp, homo sapien
acaaaagcaagcatttacacaaaagrataataaggtggtgatgaggtagg

SEQ ID NO: 5876 - DNA, 50 bp, homo sapien
catataaagaggtgggatcctaccayggaacaaaagaatttgtacaaatg

SEQ ID NO: 5877 - DNA, 50 bp, homo sapien
ccaataagtaatggtctcagagtaawgtccaaatcaagaaagtagccaca

SEQ ID NO: 5878 - DNA, 50 bp, homo sapien
tgattgtggtgtgtgtgtgttggtaycagagagagaacactaaagcagca

SEQ ID NO: 5879 - DNA, 50 bp, homo sapien
cgtctcctacaactctttgcttgacrcccatgggatcaccagttgtgaat

SEQ ID NO: 5880 - DNA, 50 bp, homo sapien
gttgataagtagtagctgcatattcrcaactggtgatcccatgggtgtca

SEQ ID NO: 5881 - DNA, 50 bp, homo sapien
agggcatttggctgtcccactcatasctttctggagaacttggtggagtc

SEQ ID NO: 5882 - DNA, 50 bp, homo sapien
gcattaattggatttatttattaaamtgtgcagcaggactagcgggtagg

SEQ ID NO: 5883 - DNA, 50 bp, homo sapien
aactgccgaattaaattcaatgacarctttttacataaacaactgtcaca

SEQ ID NO: 5884 - DNA, 50 bp, homo sapien
agtgagttaatttctaagactccaargggaaaaataaaataacctataag

SEQ ID NO: 5885 - DNA, 50 bp, homo sapien
acgtagccttggtttgctctctaacyatgaaaaagccttgatcaatggtg

SEQ ID NO: 5886 - DNA, 50 bp, homo sapien
attcttccaccatttaaggtgaaatsaataccaattttaccaaaatcttc

SEQ ID NO: 5887 - DNA, 50 bp, homo sapien
tgatatgttccttctatggtcaagayaattagttttcttccctttttact

SEQ ID NO: 5888 - DNA, 50 bp, homo sapien
aagccgacttcagggtttactatgaytatgtctccaatagagcttatcta

SEQ ID NO: 5889 - DNA, 50 bp, homo sapien
actttaacttccaatctcggttacaragagtgttaaaactggaagaaata

SEQ ID NO: 5890 - DNA, 50 bp, homo sapien
aaagtttggttcctaaactgttggcrcctttttgagataaaagtggatgc

SEQ ID NO: 5891 - DNA, 50 bp, homo sapien
ggtatctatgactcagtatttcttckcataccctcagtgacttacagtat

SEQ ID NO: 5892 - DNA, 50 bp, homo sapien
aaagttgtaaaagcatcttcattaaktgtaatgtctgcattttagaacat

SEQ ID NO: 5893 - DNA, 50 bp, homo sapien
aaaaaaagtttctctcatttatggawctatattctaaattcaacccagaa

SEQ ID NO: 5894 - DNA, 50 bp, homo sapien
ttcaaagtatccaagacagaattaarggctacttcagaagcactgcctta

SEQ ID NO: 5895 - DNA, 50 bp, homo sapien
taacatagtaacgtcagtcttttaaygttacgtgacataaaatctcaaaa

SEQ ID NO: 5896 - DNA, 50 bp, homo sapien
gggaaccactacgggtaaactagatkaattagagttcctaaactgagata

SEQ ID NO: 5897 - DNA, 50 bp, homo sapien
ctggaagatgatgatgggatttccaytgaagacgagctttccattctcag

SEQ ID NO: 5898 - DNA, 50 bp, homo sapien
gagattgacttatatgcaaaggagartagattttaaaaatctcaacataa

SEQ ID NO: 5899 - DNA, 50 bp, homo sapien
aattgcaaaaaaagtttattttacaytgaatgccataataaaattaagga

SEQ ID NO: 5900 - DNA, 50 bp, homo sapien
aagcaattggcttctctctataacarctaatctttgcctactgacgatgg

SEQ ID NO: 5901 - DNA, 50 bp, homo sapien
aagaaaagaattaaatcctaagcgaygtatttaagtattcaaggtttgtg

SEQ ID NO: 5902 - DNA, 50 bp, homo sapien
ttccctcctttcctgggttaaagaaycgtctcggccaggtgaggtacctc

SEQ ID NO: 5903 - DNA, 50 bp, homo sapien
atagcataatcctacaaaaaaatcaygtgaggccaaccccttacataaag

SEQ ID NO: 5904 - DNA, 50 bp, homo sapien
tagtgtctttgttacaagaatactcratgcactacatttctgtggattca

SEQ ID NO: 5905 - DNA, 50 bp, homo sapien
ttacaacaataaaataaaataataayggcataaatcatagagcaattttg

SEQ ID NO: 5906 - DNA, 50 bp, homo sapien
gcagtcctggggttatattatggcamcttatgttatagttcaatagttag

SEQ ID NO: 5907 - DNA, 50 bp, homo sapien
gggtagtctcattgttctgcctttgraccagtcctctggcctgactgcag

SEQ ID NO: 5908 - DNA, 50 bp, homo sapien
gataaacaatgtgtccaaatataaayggattccaaaggatagctaataat

SEQ ID NO: 5909 - DNA, 50 bp, homo sapien
acccttgtcacacagctactatgaartctactatactatgttatttagca

SEQ ID NO: 5910 - DNA, 50 bp, homo sapien
cttcttaaactctggacttaagtgayaatcattatggaacttagccctgt

SEQ ID NO: 5911 - DNA, 50 bp, homo sapien
cctcaggatatttgttgattgtaaaygacatgaaggatgaaataatcatt

SEQ ID NO: 5912 - DNA, 50 bp, homo sapien
agtttggggtgtatgaaatgatggamtactatgtaagacatttaaaagga

SEQ ID NO: 5913 - DNA, 50 bp, homo sapien
tataggaggtacaggtgttagataaratgctttatgaaatgttagttgta

SEQ ID NO: 5914 - DNA, 50 bp, homo sapien
gaattattttcatagttccaccattraaatttagaaatttaaccactcag

SEQ ID NO: 5915 - DNA, 50 bp, homo sapien
gtacctaacacataactggtactgaraaagaatttaatgaaggaataaat

SEQ ID NO: 5916 - DNA, 50 bp, homo sapien
ttaataaaataaatacctgctgataygtactaatttggaaatctgaaatt

SEQ ID NO: 5917 - DNA, 50 bp, homo sapien
tatgttggcttcagttttaaaatcakacagttagtgagggtaaactttga

SEQ ID NO: 5918 - DNA, 50 bp, homo sapien
aatgtttcatctaaagctctgttccracctgggttaatgaagtgagtggt

SEQ ID NO: 5919 - DNA, 50 bp, homo sapien
ccagtccaatgtacaacttaagtcaygtgtcattggcacaaataatctgg

SEQ ID NO: 5920 - DNA, 50 bp, homo sapien
gtataataatttggaaaggtggagakaaagttaatactctgaagataata

SEQ ID NO: 5921 - DNA, 50 bp, homo sapien
gcttaaatcctagccctactttagaktatacctcatgatctaccttatga

SEQ ID NO: 5922 - DNA, 50 bp, homo sapien
ctgcaaacttgtggatagcctatgamtacaaacttgtggatagcccactg

SEQ ID NO: 5923 - DNA, 50 bp, homo sapien
aaaggagactaaacatgggtaagaartaactgctagaaagatggaggcaa

SEQ ID NO: 5924 - DNA, 50 bp, homo sapien
agttttcacctgtatttgtggttaayagtaatagtcctttgatacactag

SEQ ID NO: 5925 - DNA, 50 bp, homo sapien
ttgccttgctttgagaaagacctagmaaacatgtggtgaagtccacattg

SEQ ID NO: 5926 - DNA, 50 bp, homo sapien
attatacttaaatccaaacttgtgaratgctttttaattttgcctcttta

SEQ ID NO: 5927 - DNA, 50 bp, homo sapien
tgaaaaccacggttcactgtaacaaygccaaatcattacaagacaaccac

SEQ ID NO: 5928 - DNA, 50 bp, homo sapien
accttcttgtgtgttctgttgactayacaaaatttgttttttctttatta

SEQ ID NO: 5929 - DNA, 50 bp, homo sapien
taattataggaatgaatacatatgasagtgataaaaatgaattgcaagct

SEQ ID NO: 5930 - DNA, 50 bp, homo sapien
aagtttatggaaggtaaattcatacsactctttgaactgtatgcttagtt

SEQ ID NO: 5931 - DNA, 50 bp, homo sapien
acagattggtttaacataccagcackattcattttattgtgctttgcaga

SEQ ID NO: 5932 - DNA, 50 bp, homo sapien
gaaagcaagctccattgttcgttacyctcagctcttagccaagtcagggg

SEQ ID NO: 5933 - DNA, 50 bp, homo sapien
tatgcagaattgtggatactgtaaasagagcagtgagagacaataagaca

SEQ ID NO: 5934 - DNA, 50 bp, homo sapien
aaaaagaaagaatgagatacagttaygaagtctacccttagaagaaacac

SEQ ID NO: 5935 - DNA, 50 bp, homo sapien
gaaactttaagtatgaaagaacttasagtataacgtgatagctatgaaca

SEQ ID NO: 5936 - DNA, 50 bp, homo sapien
ctcacactttaatgagagagaactaygtctttacatgaatttcaaaataa

SEQ ID NO: 5937 - DNA, 50 bp, homo sapien
cagaaaaacatgtaatgtctttcatraagagaggcaattcatgagttcag

SEQ ID NO: 5938 - DNA, 50 bp, homo sapien
catagacctaaatatagaaagtaaargtataaaattttgagaactaaaca

SEQ ID NO: 5939 - DNA, 50 bp, homo sapien
ctgttcacttatagaagcaacaggtsaagtgtttaacacaggtaactaga

SEQ ID NO: 5940 - DNA, 50 bp, homo sapien
atcctaaaacttcctcactgtccagragtatagaatgtttacatctttca

SEQ ID NO: 5941 - DNA, 50 bp, homo sapien
tgtgcccataatatagcatagaaacmcttcagcaaaattttcctatctct

SEQ ID NO: 5942 - DNA, 50 bp, homo sapien
catgagagctcgtaagtataggagcrcttggtcactatagatacctctta

SEQ ID NO: 5943 - DNA, 50 bp, homo sapien
aaatcaaagcctgctagtagatacaktataaagcagtaaacacaaccaag

SEQ ID NO: 5944 - DNA, 50 bp, homo sapien
caattccataaatacgttcacattawctgaacattagtagccctggaaat

SEQ ID NO: 5945 - DNA, 50 bp, homo sapien
cactaatcatcagtgaaatctaaackaaaaccacaatgagatatcactca

SEQ ID NO: 5946 - DNA, 50 bp, homo sapien
aagtgaattatagaaataacaccttmaagaacctagaaaatgaaaactat

SEQ ID NO: 5947 - DNA, 50 bp, homo sapien
aattaaaatgaatttgaaatctgagkagaacattaacagtctgatgcatc

SEQ ID NO: 5948 - DNA, 50 bp, homo sapien
tcacagtttttgccatttgccatgaygttgcattagccagatgtcattga

SEQ ID NO: 5949 - DNA, 50 bp, homo sapien
gtacaatgaatttctcagtaaaggartaaaataacatgccaaggtttgtc

SEQ ID NO: 5950 - DNA, 50 bp, homo sapien
gctactaagttactatctaagctacyaagttatacaaatttatattttaa

SEQ ID NO: 5951 - DNA, 50 bp, homo sapien
acagaggccatccgactcatggttayaaataagtaccagctttacaatat

SEQ ID NO: 5952 - DNA, 50 bp, homo sapien
atctctctgctgcttattagaagaarttcaagcctttagctggcacatga

SEQ ID NO: 5953 - DNA, 50 bp, homo sapien
tttaaataatgtatatctggtactaytagctctcctttttaagtctcttt

SEQ ID NO: 5954 - DNA, 50 bp, homo sapien
ggaaggaagagaaaatgttcatgtawcagagagtgatagaaaaacgcctg

SEQ ID NO: 5955 - DNA, 50 bp, homo sapien
gctcatcttagtattctttgtagtayattttgttgctgtaattgcaagaa

SEQ ID NO: 5956 - DNA, 50 bp, homo sapien
aatatactacaaagaatactaagatragcatcaagaaatcctcatcttag

SEQ ID NO: 5957 - DNA, 50 bp, homo sapien
ccatttagctatttgagctttccaakacttcatttttacaatgccatgtg

SEQ ID NO: 5958 - DNA, 50 bp, homo sapien
aatcacatctttgctacacttgtcawaaaaaactcattaactttccccag

SEQ ID NO: 5959 - DNA, 50 bp, homo sapien
gggaaaacaggaccatttattaccaytaccttttagaaaacacccaacac

SEQ ID NO: 5960 - DNA, 50 bp, homo sapien
ttggttgtcctaactgtgaagagtayactaatggcatctagagagtagaa

SEQ ID NO: 5961 - DNA, 50 bp, homo sapien
aagtcattttcatttttaatattacyacattgtgacagtagccttctgta

SEQ ID NO: 5962 - DNA, 50 bp, homo sapien
ttctgattctgcaactttttcttaayagatttgtgaagttatggtttaaa

SEQ ID NO: 5963 - DNA, 50 bp, homo sapien
ctgtgtcagacagcataagaaatagycaaagcaaagagaacatgtgtcag

SEQ ID NO: 5964 - DNA, 50 bp, homo sapien
ataaattgagatgcttgtgagttgayattgatctattgttccctcttttc

SEQ ID NO: 5965 - DNA, 50 bp, homo sapien
aaactattaaatttattgaagactayctgtttgaagctctgtaaataatc

SEQ ID NO: 5966 - DNA, 50 bp, homo sapien
ctgagggcccccaaacaccactaaaygtatagcaattccatgcctgtgag

SEQ ID NO: 5967 - DNA, 50 bp, homo sapien
ttactttcttgtctcatcttaaacawcattgccttcaggttttccctgaa

SEQ ID NO: 5968 - DNA, 50 bp, homo sapien
agaggcagagaagacaggaaactaasaaggaatatcaaatgaagactcac

SEQ ID NO: 5969 - DNA, 50 bp, homo sapien
gatgtaactgaattctgctatgaaawgtagtctgaatctgggtcctaaaa

SEQ ID NO: 5970 - DNA, 50 bp, homo sapien
aactaactgtagtttatgttgttgcmatagaaaatgttatcccaacaacc

SEQ ID NO: 5971 - DNA, 50 bp, homo sapien
tggggcctctatgaaatagaagagaygatgtattaaaacctgttcttaga

SEQ ID NO: 5972 - DNA, 50 bp, homo sapien
atttattacccaatctcacctaaccrcctaatcactcctgggtcatcctg

SEQ ID NO: 5973 - DNA, 50 bp, homo sapien
atagcagaataaaaagtccattcacraaagtaagaaaagttttagatagc

SEQ ID NO: 5974 - DNA, 50 bp, homo sapien
gtactatattaccataatcaactacygtaatgtatgctataggccaagcg

SEQ ID NO: 5975 - DNA, 50 bp, homo sapien
gttcctgagctaatctaagaggctayaaaaaggctagaggcatgaaatca

SEQ ID NO: 5976 - DNA, 50 bp, homo sapien
gaacagattcttactgaacctatgtraataactatattgccatggaaata

SEQ ID NO: 5977 - DNA, 50 bp, homo sapien
ttcagcagaagcaaactgaataaagscctcgagacctggaagtgcatgtc

SEQ ID NO: 5978 - DNA, 50 bp, homo sapien
gagcctccactaaaaagctcaaatamaattaattcatcccattatgactg

SEQ ID NO: 5979 - DNA, 50 bp, homo sapien
acacaggatttcagtttggggcttawgtaagaaactagcaagttatgtga

SEQ ID NO: 5980 - DNA, 50 bp, homo sapien
attgtagtcttaaaaccgaattcacrcttccttctagagtgctttctctg

SEQ ID NO: 5981 - DNA, 50 bp, homo sapien
actacaaaactgattttgtggacaayggtgtacatagcaatacatgttct

SEQ ID NO: 5982 - DNA, 50 bp, homo sapien
cactggataaattttttagggtatcwatgcctgatccccacccccaaata

SEQ ID NO: 5983 - DNA, 50 bp, homo sapien
actctggccagaggtcaccaacagamtacccataagctgaatcccatcag

SEQ ID NO: 5984 - DNA, 50 bp, homo sapien
tatcagagaatgcctgctttcacaaytctagtatacacatgtcattttac

SEQ ID NO: 5985 - DNA, 50 bp, homo sapien
aagtatgcaaattaaagaagtaaaartacaatggtggaagcatgtccaga

SEQ ID NO: 5986 - DNA, 50 bp, homo sapien
gacagaaagatggctctgatattatyaaccacaactggcagtcagcatcc

SEQ ID NO: 5987 - DNA, 50 bp, homo sapien
aggcactcaacaccaatgttctttgyagtaataattattgtacaactgtc

SEQ ID NO: 5988 - DNA, 50 bp, homo sapien
cttcatgcaagtgtgaaaaccagaaygacccttcaaaagttttcctggcc

SEQ ID NO: 5989 - DNA, 50 bp, homo sapien
ctgcctcttaattatcctttacaackgattcagcagagagggtccagaac

SEQ ID NO: 5990 - DNA, 50 bp, homo sapien
gaaatatgtttcatacattgaaaagyactatgcaagtgtaatatactggc

SEQ ID NO: 5991 - DNA, 50 bp, homo sapien
atctctgattatacagtagtcaataygtagttttagagtcaaattgaatt

SEQ ID NO: 5992 - DNA, 50 bp, homo sapien
atgaatatgtatgctggcaccttccmaagctatgagttgtaaatattcta

SEQ ID NO: 5993 - DNA, 50 bp, homo sapien
gaaggagaccagaagccagatgttasagagtttgggttgaaggtttaaaa

SEQ ID NO: 5994 - DNA, 50 bp, homo sapien
ctctgattagaagtcagcctactgaraatagccactactagggtggtcag

SEQ ID NO: 5995 - DNA, 50 bp, homo sapien
ataacacaaataagacattaagcaarctgatgcattagctgagttgacct

SEQ ID NO: 5996 - DNA, 50 bp, homo sapien
tcccagctccctctccattgaatcaytacatgttgggtgcatccttcaca

SEQ ID NO: 5997 - DNA, 50 bp, homo sapien
tacaaatgtattaatggctcaaaaayatatgttgataagctcaggtgagc

SEQ ID NO: 5998 - DNA, 50 bp, homo sapien
gaacaacataaaaaggtgatcttaawccaaagctgaggaattttcttttt

SEQ ID NO: 5999 - DNA, 50 bp, homo sapien
catcacacagaagttgtagcaatagycactaatcaaagttccttctattc

SEQ ID NO: 6000 - DNA, 50 bp, homo sapien
tttgtatcttgctcccaatttcagaygatgaaagtgaatttaatcagcaa

SEQ ID NO: 6001 - DNA, 50 bp, homo sapien
ctaatttaccaattagcaacaggccragagagctggaagagatatcaagc

SEQ ID NO: 6002 - DNA, 50 bp, homo sapien
atcccaagactgctgcccgatgttayggaagctgttaggaaacggggccg

SEQ ID NO: 6003 - DNA, 50 bp, homo sapien
attattataatactctcactaccaascaatgataagattcttgagtggga

SEQ ID NO: 6004 - DNA, 50 bp, homo sapien
ggataagtattattattattctctcyacagcacactctggagactgaggg

SEQ ID NO: 6005 - DNA, 50 bp, homo sapien
tcaataattttcaaaagtaagtcaastaaattcgagctgtctaaaagcga

SEQ ID NO: 6006 - DNA, 50 bp, homo sapien
aagagatagtaagaaaattacatacyaagattcatcaatgattttgttta

SEQ ID NO: 6007 - DNA, 50 bp, homo sapien
aaatgtagacgatataaaagataaastacagtccctgtctgcaaaggatt

SEQ ID NO: 6008 - DNA, 50 bp, homo sapien
ctttttggtaacagccatcctaatakgtgtaaggtaatatcttatcgtgg

SEQ ID NO: 6009 - DNA, 50 bp, homo sapien
attattagcgtaacggtatagtttaygatgtcccaattttgttattttag

SEQ ID NO: 6010 - DNA, 50 bp, homo sapien
gcttacccggctctcaagggactcaygctaactgtggagaccaggctcat

SEQ ID NO: 6011 - DNA, 50 bp, homo sapien
attaagttctttctagaattgaaaaygctcactcagaaatagcacctcca

SEQ ID NO: 6012 - DNA, 50 bp, homo sapien
catgaaaatcaaaatatctacctcawtaaaaaaatgtcattttttccagc

SEQ ID NO: 6013 - DNA, 50 bp, homo sapien
taattatagacctggatattctagaygccatattgtcataatattttgtt

SEQ ID NO: 6014 - DNA, 50 bp, homo sapien
tacaacatcaggaatggtttggaaarttgaattacaaagcaccctgcatt

SEQ ID NO: 6015 - DNA, 50 bp, homo sapien
tttttaaggaggtccctagtaggcaycttaggaaactttgaaaatatatt

SEQ ID NO: 6016 - DNA, 50 bp, homo sapien
tcactgtacgcagacaactctttaaycatagaactgtgtccaagatggcc

SEQ ID NO: 6017 - DNA, 50 bp, homo sapien
atagatctttgagattccattattcrctcttccttatttagggtttcagt

SEQ ID NO: 6018 - DNA, 50 bp, homo sapien
aaaacagtcttgaacagcaaattacmattaagtggaattaattctatgat

SEQ ID NO: 6019 - DNA, 50 bp, homo sapien
aaaccagtccaatcatatgaatttcractttggtccaagacagattccca

SEQ ID NO: 6020 - DNA, 50 bp, homo sapien
gcctggcacataccctagcgatttcrcccgggacacccacttcctgcacc

SEQ ID NO: 6021 - DNA, 50 bp, homo sapien
tgccatacttcctaccttattttcargtactcactcatacgtgcacctct

SEQ ID NO: 6022 - DNA, 50 bp, homo sapien
aacatccctctcgggctccaactacrcaggcaagtgttttccaaataaaa

SEQ ID NO: 6023 - DNA, 50 bp, homo sapien
aatgagaggcaagaagaattaattayggagtcagtaccagacagagtttc

SEQ ID NO: 6024 - DNA, 50 bp, homo sapien
tgaaacatcaggctgtctcagcatawcattcattcctcacttctcttagc

SEQ ID NO: 6025 - DNA, 50 bp, homo sapien
acacatcccgccacctgacccaagamggcaaatcagattttctctcttat

SEQ ID NO: 6026 - DNA, 50 bp, homo sapien
ggggaaggaggaagtgtaaaagaacscagaaagtgcttgcatgatgtggt

SEQ ID NO: 6027 - DNA, 50 bp, homo sapien
gtcatgatgagcttgccttctcgtasctcatgtacctagatctcagagtt

SEQ ID NO: 6028 - DNA, 50 bp, homo sapien
tacggcagttaaaatatccatttcasgtagctgttttattaacaaaggtg

SEQ ID NO: 6029 - DNA, 50 bp, homo sapien
attctgccacctatcagcagcatgamcctaggtgagttactcagttgcta

SEQ ID NO: 6030 - DNA, 50 bp, homo sapien
ggtgatgttgaagatatttgaattaygttggtggtaagtggaggccagag

SEQ ID NO: 6031 - DNA, 50 bp, homo sapien
ttccaataattttgcagcttcaacaratagttagaaataaaccacttaac

SEQ ID NO: 6032 - DNA, 50 bp, homo sapien
agatacaatactggtcaacattgtcyaagatgacttgattatattctacc

SEQ ID NO: 6033 - DNA, 50 bp, homo sapien
ataaaataagttcttgagaatcctcrcaaataatataaagtgaaaatttt

SEQ ID NO: 6034 - DNA, 50 bp, homo sapien
ggcctcctgacttcctgctgtcctcsaggaattatctaaacaccacctgg

SEQ ID NO: 6035 - DNA, 50 bp, homo sapien
actgtgttgtcaaaattgagcctaartgaactatgatgaaaatttaaaat

SEQ ID NO: 6036 - DNA, 50 bp, homo sapien
ggagccaactatagtaatctccaatyatggtgtttaatgattttctgaat

SEQ ID NO: 6037 - DNA, 50 bp, homo sapien
gtctgcatgtttgaatcatccaaaakccatctgaatacacattaacatat

SEQ ID NO: 6038 - DNA, 50 bp, homo sapien
ttcactttattgcactttggagatayggtggtttttacaaatcgaaggtt

SEQ ID NO: 6039 - DNA, 50 bp, homo sapien
gatgcctatgactgttcttgcctcamaaatttctacagtagactcgtcta

SEQ ID NO: 6040 - DNA, 50 bp, homo sapien
ctgttggaaaaaatagtacttgcctraagcaggatttccacaaaccttcg

SEQ ID NO: 6041 - DNA, 50 bp, homo sapien
gaaacagaggcatgaaacgagtttaygctgttggaaaaaatagtacttgc

SEQ ID NO: 6042 - DNA, 50 bp, homo sapien
atgtttggtttaatattctgctatcyctgtctcaaaataggcccaataaa

SEQ ID NO: 6043 - DNA, 50 bp, homo sapien
aacacttaaatgagaattttgaggartatattacttaagcctaaagataa

SEQ ID NO: 6044 - DNA, 50 bp, homo sapien
aacagtagaatcttaatcctttcaamtaatgcttctctcaatgaatattt

SEQ ID NO: 6045 - DNA, 50 bp, homo sapien
acacagctttctatgaaaaatgaaarataaaagttgtagagaccaaggga

SEQ ID NO: 6046 - DNA, 50 bp, homo sapien
aaatggggtcacgagaataagtaaarggattagtctcatcagagtgaacg

SEQ ID NO: 6047 - DNA, 50 bp, homo sapien
tgtcccctaagcacctctcaagtacrgtaataatcgtttgttgtgtcccc

SEQ ID NO: 6048 - DNA, 50 bp, homo sapien
tggcgatcacagtgcttaattgatarcttgttgtgcaaatgaaaagtgaa

SEQ ID NO: 6049 - DNA, 50 bp, homo sapien
catcactgagcctatggtaattacaygagatagtatgagacacttagcac

SEQ ID NO: 6050 - DNA, 50 bp, homo sapien
aatccacactcgcagagggagatgargttctgaaatttattatcatagcc

SEQ ID NO: 6051 - DNA, 50 bp, homo sapien
atatatgtgtgcattaaattccacartggtgcagccctgcatcactatac

SEQ ID NO: 6052 - DNA, 50 bp, homo sapien
gctatcagaaagaaatacgatgaccraagttcacactgttgtgcccctta

SEQ ID NO: 6053 - DNA, 50 bp, homo sapien
gtcaaaaaaccttcaatttgtaaaamttcagtatcaaaaattgagtaaag

SEQ ID NO: 6054 - DNA, 50 bp, homo sapien
acagatgagggtgaggtgcctaggaraaaatgtaaggtggcccttatgag

SEQ ID NO: 6055 - DNA, 50 bp, homo sapien
tagcagtaaaacaatttcttaacatwatgcataaaacaaagtaggaagaa

SEQ ID NO: 6056 - DNA, 50 bp, homo sapien
tgaggatttgctacagaggtaaacgwatgagaaatcgctcctccatcaca

SEQ ID NO: 6057 - DNA, 50 bp, homo sapien
tgatttacattgttttcattattgaygttgtttttagtgctttatttaag

SEQ ID NO: 6058 - DNA, 50 bp, homo sapien
attctaaagtctgctatcagatagtsaaagacaaaacagccattattgtc

SEQ ID NO: 6059 - DNA, 50 bp, homo sapien
gagctggaggatggactactaaatcygaagtgaaagcacgtgtctgatag

SEQ ID NO: 6060 - DNA, 50 bp, homo sapien
tatgacactgtgacagcaattaaacmaccataaatcacaggttaaaactg

SEQ ID NO: 6061 - DNA, 50 bp, homo sapien
agactccgctcattctagtgccttcmaccaaggatatcttcctgagtttt

SEQ ID NO: 6062 - DNA, 50 bp, homo sapien
gaatgtttaataaagaaaaaaacggyaagtgtgaatagatgttgccagtg

SEQ ID NO: 6063 - DNA, 50 bp, homo sapien
cagcctgtctagcaagattggagaartgttcatggattaataataatgtc

SEQ ID NO: 6064 - DNA, 50 bp, homo sapien
aaaaatgagatattagtgtaataaayttcatgtactggaagcttcaggag

SEQ ID NO: 6065 - DNA, 50 bp, homo sapien
gccattattgtctacaattagaataygggctctgataggattaagaaacc

SEQ ID NO: 6066 - DNA, 50 bp, homo sapien
ctttagacacattttatctgacaccrcaagtcattccaagagatgaatat

SEQ ID NO: 6067 - DNA, 50 bp, homo sapien
gtattattactagttgtttgcactcyagtatgtagaaagagcctgagacc

SEQ ID NO: 6068 - DNA, 50 bp, homo sapien
ctggctagaagatttaagagccaatwaataattcaccacactctatctac

SEQ ID NO: 6069 - DNA, 50 bp, homo sapien
caatcagtgtgggctccagaattagragaaatcaagtatattctccagac

SEQ ID NO: 6070 - DNA, 50 bp, homo sapien
ttaactgcagagagataagactcacyggaatggaatttatacagcccgat

SEQ ID NO: 6071 - DNA, 50 bp, homo sapien
gctagcaaagaaaaaaaaatttcaartagctatgagggtcaacatgggaa

SEQ ID NO: 6072 - DNA, 50 bp, homo sapien
tcaagattagaaaagccctgtcttamagtatccctcaaaatttatatatt

SEQ ID NO: 6073 - DNA, 50 bp, homo sapien
aaaaaccaatataattttattaatgsaacattgtgatgctgtaaaagttg

SEQ ID NO: 6074 - DNA, 50 bp, homo sapien
cttatatggaaccacaaaaggcccartacttctactagatctgctaagtg

SEQ ID NO: 6075 - DNA, 50 bp, homo sapien
attaaggtttctaattgcagctcaaytctttcgtttacactctgattttg

SEQ ID NO: 6076 - DNA, 50 bp, homo sapien
ggctgaggcaggaggattattcgaamtcaggagtatgggtccagcctgga

SEQ ID NO: 6077 - DNA, 50 bp, homo sapien
gaaataatttagtccaacctgctaamgtaatgccggaaatctttcgataa

SEQ ID NO: 6078 - DNA, 50 bp, homo sapien
aacagtggtttgtctacgtggtctgwaatgttcatggtgataatgtgttc

SEQ ID NO: 6079 - DNA, 50 bp, homo sapien
tcatatttacaaaaaggatcgtgtcsaaaacatctccttttacttgtact

SEQ ID NO: 6080 - DNA, 50 bp, homo sapien
atagtttttccacaaaaatctgacasctacagaataacactatctaaaac

SEQ ID NO: 6081 - DNA, 50 bp, homo sapien
gaaaagttattgagggctgattttayggaggttttctcatatttgcagca

SEQ ID NO: 6082 - DNA, 50 bp, homo sapien
accatggggactctgggacaaaaaakatagccatctcttattgaaaccgt

SEQ ID NO: 6083 - DNA, 50 bp, homo sapien
ctgctgctaaaaatcaacaagtgagrcccaaaatattccagatccaagaa

SEQ ID NO: 6084 - DNA, 50 bp, homo sapien
attcattaccaaaatcattagttcayataaaatttgccagttcttattga

SEQ ID NO: 6085 - DNA, 50 bp, homo sapien
gtagaaaataaagtaagagatgtagratgagtttaggttttagaaattct

SEQ ID NO: 6086 - DNA, 50 bp, homo sapien
taaatctggatgaaatctggtctgawccacgtatactatggagagccatc

SEQ ID NO: 6087 - DNA, 50 bp, homo sapien
agcagacttaaggcaaggacctgacracgctgaatagaggggaagtaaga

SEQ ID NO: 6088 - DNA, 50 bp, homo sapien
ttgtattgaaaaaaaatgagctgtcyattaccttgcaaagacatgtccca

SEQ ID NO: 6089 - DNA, 50 bp, homo sapien
ggtagtgagccactttccccagctawaggattcttcaccgcttcagcagt

SEQ ID NO: 6090 - DNA, 50 bp, homo sapien
tttgctgaaatttttacaactgctgmagagaataattgttcggaatttag

SEQ ID NO: 6091 - DNA, 50 bp, homo sapien
aattccattaaatatctcctatgctwaactaaaaacacatgtgcataatt

SEQ ID NO: 6092 - DNA, 50 bp, homo sapien
tttattaaatctattttctgtgtaaktaatgtctgtgtgaacccttgtgc

SEQ ID NO: 6093 - DNA, 50 bp, homo sapien
tataccaccaacacttatggtcctayatagcaagtcccataaagcctcag

SEQ ID NO: 6094 - DNA, 50 bp, homo sapien
atcgtgttcaaggtttgctgttatayggacccgatgtcaagcttggagaa

SEQ ID NO: 6095 - DNA, 50 bp, homo sapien
tcatagagagtttagtaaactaggaytaggaatttggattttatctaaag

SEQ ID NO: 6096 - DNA, 50 bp, homo sapien
gctttctagcttgctgctcagctaamaagaaaccactttggctgataaag

SEQ ID NO: 6097 - DNA, 50 bp, homo sapien
gatgacttaaagaagaagaggtacaktagtaggtaaagaagaaataatta

SEQ ID NO: 6098 - DNA, 50 bp, homo sapien
ccgtctttcatcccactggtcaatamctttttctcagaatcaattattga

SEQ ID NO: 6099 - DNA, 50 bp, homo sapien
ttatgtttctttaagttccaatacartattttctaaattagaaaggtatt

SEQ ID NO: 6100 - DNA, 50 bp, homo sapien
tatttgcctaggttaagcctgatacrctgagcacagaacgatgacatgtg

SEQ ID NO: 6101 - DNA, 50 bp, homo sapien
tctacctctgcctgaggtgtcagaakatatacaaaggaatgttctaggta

SEQ ID NO: 6102 - DNA, 50 bp, homo sapien
ctcacacttcttgagctcttcactasgcaccatacccggcctatttcacg

SEQ ID NO: 6103 - DNA, 50 bp, homo sapien
taggcaccatacccggcctatttcaygtaatctccgcgagcatcctacaa

SEQ ID NO: 6104 - DNA, 50 bp, homo sapien
catcaaaaacaagagttacaactgcraagtccaagctcctttatatactc

SEQ ID NO: 6105 - DNA, 50 bp, homo sapien
gcaagacactaagaacgactacccaraaagcactgctgtacctgtgtggt

SEQ ID NO: 6106 - DNA, 50 bp, homo sapien
atgccaattatttacaatcttgttcmgaaattaaaagtagaggaaacact

SEQ ID NO: 6107 - DNA, 50 bp, homo sapien
aagaacacctgtaagtagtgagttgsaatatctcatccatcctgctttgt

SEQ ID NO: 6108 - DNA, 50 bp, homo sapien
attagtgaacagagacagttattcawattaccaggtgagtttaggatgaa

SEQ ID NO: 6109 - DNA, 50 bp, homo sapien
ttcacaaggggcatagggaaatgccygaagactcacaaaaacaagggggt

SEQ ID NO: 6110 - DNA, 50 bp, homo sapien
gaaaccttcagatgcagtgttttagwaaatgaggagtgaaaccatcccac

SEQ ID NO: 6111 - DNA, 50 bp, homo sapien
acagaggtgtcaaagtttatttagckaagcaataccagaagagaactaga

SEQ ID NO: 6112 - DNA, 50 bp, homo sapien
gctttgttatttgagaagtttaaaaytggctacacccagatatattggat

SEQ ID NO: 6113 - DNA, 50 bp, homo sapien
tacttaggtcatctttcatgtttgcragaattcatatagaaagcttctga

SEQ ID NO: 6114 - DNA, 50 bp, homo sapien
cctctcccaaagaattaaaacagacragagatgagaaatagaaatctgca

SEQ ID NO: 6115 - DNA, 50 bp, homo sapien
ctgacaatatcacatttgtgttttasaacaatccgtctgcgtggtatgga

SEQ ID NO: 6116 - DNA, 50 bp, homo sapien
attccctttgctgtgtgtgctacaayatttaaattgctattgtcattaac

SEQ ID NO: 6117 - DNA, 50 bp, homo sapien
atttaggacttacttttcataggacraggaatgatggaattcaaaagaac

SEQ ID NO: 6118 - DNA, 50 bp, homo sapien
ttaataaatggaaattgatttgagarcattactgaattcctagtaggtca

SEQ ID NO: 6119 - DNA, 50 bp, homo sapien
ttgtcaaagtgaacctaccacaatarataaatacttggtttgccccattt

SEQ ID NO: 6120 - DNA, 50 bp, homo sapien
tcatttgaaaaaagggagtctaacakatgctttcaaatctttcctttgtt

SEQ ID NO: 6121 - DNA, 50 bp, homo sapien
tttttgataaagtcagtcagaattakattttctatgattgatcacagaaa

SEQ ID NO: 6122 - DNA, 50 bp, homo sapien
aaaaaggatataaagcacatgatacrgacttttaacagttgaatctaggt

SEQ ID NO: 6123 - DNA, 50 bp, homo sapien
agcttcccaaaggaggaggtgttaartgagcccttaaagctagccagggg

SEQ ID NO: 6124 - DNA, 50 bp, homo sapien
ctgatgaacgaataccttgatgtaaygtgatcatttttagtaagaaaagt

SEQ ID NO: 6125 - DNA, 50 bp, homo sapien
accctcatcagtggcagggctaaaaktcctagtcccagtgggctgcaagg

SEQ ID NO: 6126 - DNA, 50 bp, homo sapien
aattctattttctgatgataatttgsattaatatattcagtttatgtagc

SEQ ID NO: 6127 - DNA, 50 bp, homo sapien
atcttggagacctagttgaaatggaygagccatgaagatatataggattc

SEQ ID NO: 6128 - DNA, 50 bp, homo sapien
atctagcacacacgtaccattcatamactcggtttggttgtgaaaagaca

SEQ ID NO: 6129 - DNA, 50 bp, homo sapien
ctttagccagctctgttcttaaaaasataattacacttcaagttgggaga

SEQ ID NO: 6130 - DNA, 50 bp, homo sapien
tgactgttacttctaaagcacttatsaaattattttgctaaatggtagct

SEQ ID NO: 6131 - DNA, 50 bp, homo sapien
aagacactcagctcagaagattgcawagttaagtagaaatgacaattacg

SEQ ID NO: 6132 - DNA, 50 bp, homo sapien
gaaaatattattatacatcattttaygcaatagagtatgtttaataaatt

SEQ ID NO: 6133 - DNA, 50 bp, homo sapien
ccactgctaggagggggaatgccaaytgtagtgctgctggagtagatttt

SEQ ID NO: 6134 - DNA, 50 bp, homo sapien
tgtaggtttagtcaccttcaggaaayagtagaatctgagatgggcagggg

SEQ ID NO: 6135 - DNA, 50 bp, homo sapien
ttgataagttttgatggtgaacctaygagaaaagatacagattagtatta

SEQ ID NO: 6136 - DNA, 50 bp, homo sapien
cagcacaacctgtatctgctctaacsattagaagataagtttcctcagac

SEQ ID NO: 6137 - DNA, 50 bp, homo sapien
tttttttcaattctccatattggatsagctttgatttagaagacatctca

SEQ ID NO: 6138 - DNA, 50 bp, homo sapien
ccaactggccaagccattatagagaytccctttatgcctctgaagcgtcc

SEQ ID NO: 6139 - DNA, 50 bp, homo sapien
ctatttaattaactatacattgacartattttaaagatgaatcctctctt

SEQ ID NO: 6140 - DNA, 50 bp, homo sapien
tagaaagaaaagggattagttaggasgataaggtatgaagtatgatgtgc

SEQ ID NO: 6141 - DNA, 50 bp, homo sapien
tttttctccatatttctttatttacmagcatatttgattcatgtgaatgt

SEQ ID NO: 6142 - DNA, 50 bp, homo sapien
ttccctatagagaaagcaagcaacaygaatcttctgatttggggcccagc

SEQ ID NO: 6143 - DNA, 50 bp, homo sapien
tttttaatggtaagtccaaagttaartcgtcataacataaatcagtgtga

SEQ ID NO: 6144 - DNA, 50 bp, homo sapien
attatacaaaagcataggtcattagragtcattttagaattctgtatctt

SEQ ID NO: 6145 - DNA, 50 bp, homo sapien
aaaaccacttaagcatcaaaggtcamtacctatcaaggtgctgagagaac

SEQ ID NO: 6146 - DNA, 50 bp, homo sapien
agttcccatcacctgataagaactcrcctttaaacatgtgaaatggagga

SEQ ID NO: 6147 - DNA, 50 bp, homo sapien
caatgagaacataaattgggacatawgaatcagtctgtgaagtaagagag

SEQ ID NO: 6148 - DNA, 50 bp, homo sapien
gttgtcagaaagtggaatttcccgcsagatcagaatttcttcagccttca

SEQ ID NO: 6149 - DNA, 50 bp, homo sapien
agacataccaaaaaacctatggaacrcagaaaaaatagtacaagagggaa

SEQ ID NO: 6150 - DNA, 50 bp, homo sapien
aatttaaaaatgttttgttatgaaakagtcttaatctaaatgtctttaaa

SEQ ID NO: 6151 - DNA, 50 bp, homo sapien
gaacttttatttaaaatcaacaatcmattgaacttgcctatttgccgaac

SEQ ID NO: 6152 - DNA, 50 bp, homo sapien
atagcactgcagactcgttagaaatwaaagctcaaaataaagaattgcct

SEQ ID NO: 6153 - DNA, 50 bp, homo sapien
atatctacaggtagaaatttgcaagrataactctggataagcatagtagg

SEQ ID NO: 6154 - DNA, 50 bp, homo sapien
ttagtaatgcttgtttgtggtaggartaactgtgtcaccaggtggcatgt

SEQ ID NO: 6155 - DNA, 50 bp, homo sapien
agggtggagagcaaatctctgtgtawgaaagcactgtataactaaaagac

SEQ ID NO: 6156 - DNA, 50 bp, homo sapien
agagagggaccttgaataaactatcyagctggttttaccattataattta

SEQ ID NO: 6157 - DNA, 50 bp, homo sapien
aaccccgccatgcccggagtcacaaygctgaaattacatgggcctgtgcc

SEQ ID NO: 6158 - DNA, 50 bp, homo sapien
gaagaaagcaagggtaattatagtcrcccagattattattttacatctaa

SEQ ID NO: 6159 - DNA, 50 bp, homo sapien
actcaaacatgatgaaagacagtaaygcatagaacacacaaccatataat

SEQ ID NO: 6160 - DNA, 50 bp, homo sapien
tgtttgtaatttacttatttttaccygatactatgttctggaaatttttc

SEQ ID NO: 6161 - DNA, 50 bp, homo sapien
agagtgttcccttcatcctataaccrctttacaaacactcaacaatttcc

SEQ ID NO: 6162 - DNA, 50 bp, homo sapien
aaaaaacagccatttatactaagccraatctctgagatctttctgaaaat

SEQ ID NO: 6163 - DNA, 50 bp, homo sapien
aggcattgctgacaacagctattaasagtttgaagacaagtaattgactt

SEQ ID NO: 6164 - DNA, 50 bp, homo sapien
gaatgtaatttttaaatgttagtgargaatgtctttatatcttaatttta

SEQ ID NO: 6165 - DNA, 50 bp, homo sapien
ttgggctcccctctgcaagctgatcygatcacaggcattttctgggggat

SEQ ID NO: 6166 - DNA, 50 bp, homo sapien
atcagtgaaatacggtagttatttgratagtctggtgtgagtttattgcc

SEQ ID NO: 6167 - DNA, 50 bp, homo sapien
cccctggtgagttacagctctcggargtatgacactgaatcaccttatct

SEQ ID NO: 6168 - DNA, 50 bp, homo sapien
ttctaggtttatgagtcaacctgagragtaagaatggaagatgacaatag

SEQ ID NO: 6169 - DNA, 50 bp, homo sapien
gtgatgaagaaactgaggccacagamtaataccaaaatgtgccttccctg

SEQ ID NO: 6170 - DNA, 50 bp, homo sapien
aaagcttgtaagccacttgaaattaygtaaaacctctcaagtcgtttaga

SEQ ID NO: 6171 - DNA, 50 bp, homo sapien
tatttgttttcctgaactattcaacrctcaatactttttccagaaggacc

SEQ ID NO: 6172 - DNA, 50 bp, homo sapien
tgtcgctgttgttttatagctcaaarggcaaaattccaaaggaaaatgct

SEQ ID NO: 6173 - DNA, 50 bp, homo sapien
acaatgatgctgttaatttgtggtawgctaacatccttggactacaggtg

SEQ ID NO: 6174 - DNA, 50 bp, homo sapien
aatgcccttggtcaacgtttgtaaartatcatcaaaccaagatttttatt

SEQ ID NO: 6175 - DNA, 50 bp, homo sapien
gcatctatttgaatgctttggttaayagtaattagttaagaggcaatatt

SEQ ID NO: 6176 - DNA, 50 bp, homo sapien
agcctatgttccatttcttaatccakccattgtttacattatcaaacagt

SEQ ID NO: 6177 - DNA, 50 bp, homo sapien
ggcaacagataaaataggacctatartagtaagcaagtgataatagcatg

SEQ ID NO: 6178 - DNA, 50 bp, homo sapien
gacttcaagaagcaatttcacaataygtctagggagaactcaaatccctt

SEQ ID NO: 6179 - DNA, 50 bp, homo sapien
tgttacttatctgttaacatacatayctcatgagttttaagtggcaaaca

SEQ ID NO: 6180 - DNA, 50 bp, homo sapien
cctgcatgtcacttaactgggctatyactaatcaaatattaaagatcaat

SEQ ID NO: 6181 - DNA, 50 bp, homo sapien
agcttgagagccaagtcataacttakcaagaacaattccacggttactat

SEQ ID NO: 6182 - DNA, 50 bp, homo sapien
actaagctagaaattactaatgtgaraggaaatcttttctgtgattattt

SEQ ID NO: 6183 - DNA, 50 bp, homo sapien
aaagttgagaaagccaaggattatgyagaggaaattttgttatggttgtt

SEQ ID NO: 6184 - DNA, 50 bp, homo sapien
cttaacacaaaacgtgctcatttctyaacatcgggctccagcagaatctg

SEQ ID NO: 6185 - DNA, 50 bp, homo sapien
aggctttaatgctcaggacgtatgcratagaaaaaggtagttgacaagga

SEQ ID NO: 6186 - DNA, 50 bp, homo sapien
catgcattaaaatctgatcatatcaytattgtgctttctaaattaaaatc

SEQ ID NO: 6187 - DNA, 50 bp, homo sapien
ttgtcacattttttcttgatcaatayccagctccttttatcatcaatcac

SEQ ID NO: 6188 - DNA, 50 bp, homo sapien
tccttgctagaattcgaacacctcayggaccaagtcaaagtttttaaacc

SEQ ID NO: 6189 - DNA, 50 bp, homo sapien
tttgtataggactctgtttatgatamggtactactcaaactaaatttgag

SEQ ID NO: 6190 - DNA, 50 bp, homo sapien
cctcattgttttcccatatcacttgragtagaacactgatatcaacccat

SEQ ID NO: 6191 - DNA, 50 bp, homo sapien
cgttatccttgcttctccacctagtkaattccaatttatcctatgccatt

SEQ ID NO: 6192 - DNA, 50 bp, homo sapien
gacttggagtgattctaattatttaygtagacaagggccctacacgactg

SEQ ID NO: 6193 - DNA, 50 bp, homo sapien
aatttctagaatctgatattccacaratgactaatgtggttcaaatatct

SEQ ID NO: 6194 - DNA, 50 bp, homo sapien
ccctcaagatcctacacattccagakaagagagcctacttcagagcttag

SEQ ID NO: 6195 - DNA, 50 bp, homo sapien
ccctctgtcctaaaccataggcaaamataaattagtccaggcctgtcttc

SEQ ID NO: 6196 - DNA, 50 bp, homo sapien
cccatactaaacacttcttaccacayaaacctttgatgctactatttgga

SEQ ID NO: 6197 - DNA, 50 bp, homo sapien
tcagaggactatttttcatctgaaawatgataattctacctagtatctac

SEQ ID NO: 6198 - DNA, 50 bp, homo sapien
gacctaaaaattatgtgcccgttacwctgggagaaagataacaccattga

SEQ ID NO: 6199 - DNA, 50 bp, homo sapien
ccaagcttccttagcaagagatacayaattgcttaccatctgggttccag

SEQ ID NO: 6200 - DNA, 50 bp, homo sapien
atagcaatacaaacagactaagacargctccaaggaaacctgagtgggga

SEQ ID NO: 6201 - DNA, 50 bp, homo sapien
ttctgtggccccagatatcagtttaycagagaacatagctagctgaatgc

SEQ ID NO: 6202 - DNA, 50 bp, homo sapien
actactcttattcaagatagtattaraaattcaagccagggcaaccagtc

SEQ ID NO: 6203 - DNA, 50 bp, homo sapien
attcctctgtgttcagaactttacawaataataacagtctgagacaaaca

SEQ ID NO: 6204 - DNA, 50 bp, homo sapien
tcttaatttatatcctctgactaaaygaaattctgccttgtgtagtgctt

SEQ ID NO: 6205 - DNA, 50 bp, homo sapien
gggggttcataatcatatcaactccygaattgtttagagaaatggttcaa

SEQ ID NO: 6206 - DNA, 50 bp, homo sapien
agaaaatctttatgagcttggtgaayactctctttggtaataaaggaaca

SEQ ID NO: 6207 - DNA, 50 bp, homo sapien
ataatttccatcttctctgtttaaaratatgtcaaaagggaagaaataaa

SEQ ID NO: 6208 - DNA, 50 bp, homo sapien
tgacattgcttccttttatctatgcratttgagctgtgcttgccctcagc

SEQ ID NO: 6209 - DNA, 50 bp, homo sapien
tcaacaagcatagatttttacaaaastaggaatgcatattgacttcaaag

SEQ ID NO: 6210 - DNA, 50 bp, homo sapien
tcaatggaagcttgactttttctcayaggatggttcattgtggttaagac

SEQ ID NO: 6211 - DNA, 50 bp, homo sapien
ccacagaagattcatactagggttcmagacttaggctgggagactggaca

SEQ ID NO: 6212 - DNA, 50 bp, homo sapien
atatatttttctggaaccaaaatccrcattagcattaaacttctctgctt

SEQ ID NO: 6213 - DNA, 50 bp, homo sapien
gagctatagcttagattttagatgarctaatattgcatacatcatgaaga

SEQ ID NO: 6214 - DNA, 50 bp, homo sapien
actctgtcactctgactgcagcatasgttatttcatgcaggctcctgcct

SEQ ID NO: 6215 - DNA, 50 bp, homo sapien
gtttggtaggatgggctgtcaattcraatagtcatggggcttaacggtca

SEQ ID NO: 6216 - DNA, 50 bp, homo sapien
tttgaaatgattgccactctgaccartagcttacctgcagcattgtgaga

SEQ ID NO: 6217 - DNA, 50 bp, homo sapien
tctgattaaggcaatttagattttcrccaatgctctctttaaaggccttc

SEQ ID NO: 6218 - DNA, 50 bp, homo sapien
gcttctttattccttcaaattcccargtttatttacatggaaggggcata

SEQ ID NO: 6219 - DNA, 50 bp, homo sapien
catttcttctgagccctcaccaacawcctcttctaagttaaaaattcaac

SEQ ID NO: 6220 - DNA, 50 bp, homo sapien
accgcagttggaatattccaggttaraaataagaagcaacgtcccaactg

SEQ ID NO: 6221 - DNA, 50 bp, homo sapien
tctgctttttcccttttacgaacacratgaggagggtgtttgaattgcca

SEQ ID NO: 6222 - DNA, 50 bp, homo sapien
tatggtgtcacaggtcataggtgggratattttaataagtgacactagga

SEQ ID NO: 6223 - DNA, 50 bp, homo sapien
tttttaaaggtcaataaagtctacartcctctagaaagatagctgaaaat

SEQ ID NO: 6224 - DNA, 50 bp, homo sapien
ggattgactcaaagaagtttttgatyagaatgttcaacaattctaggaat

SEQ ID NO: 6225 - DNA, 50 bp, homo sapien
cagaggggctacactaataaacaaawgtaatgtgccatttccaagaaaag

SEQ ID NO: 6226 - DNA, 50 bp, homo sapien
gccccttgaaaaactctagagtacarattcacattactcagattgaataa

SEQ ID NO: 6227 - DNA, 50 bp, homo sapien
attgagaaatgaataaataaccgaasctcattcaggcctcaaaaggggta

SEQ ID NO: 6228 - DNA, 50 bp, homo sapien
gtggaaagtatcaagaaatctcaaaygtagttctccctgaagtgaaacca

SEQ ID NO: 6229 - DNA, 50 bp, homo sapien
aactgtaaaggactttgttatttcaygtgattggaagatctgagctcagc

SEQ ID NO: 6230 - DNA, 50 bp, homo sapien
tctcaaatgtagttctccctgaagtraaaccaaaacagtaatgtaaggta

SEQ ID NO: 6231 - DNA, 50 bp, homo sapien
actctcagatgctttaaatcaaacartagagctctaagaagattaagagt

SEQ ID NO: 6232 - DNA, 50 bp, homo sapien
cctgtttctaagatgcaaagaaacaragtgcgaatcgaagtcagcacgta

SEQ ID NO: 6233 - DNA, 50 bp, homo sapien
gcatcttgaggattaactaatccaamtgtatcgctttatagatggtgacc

SEQ ID NO: 6234 - DNA, 50 bp, homo sapien
gtgtcagtcagaactgtgagccagcsaaggtttttctccatctcccctct

SEQ ID NO: 6235 - DNA, 50 bp, homo sapien
tcccctctgctctcttttaaatcccragaacctatagctaactccattca

SEQ ID NO: 6236 - DNA, 50 bp, homo sapien
cattgtgacatctgtaattactcaaygcactaatcctcataagtgtagcc

SEQ ID NO: 6237 - DNA, 50 bp, homo sapien
gattgaaagataggattttggctacrcttatgaggattagtgcattgagt

SEQ ID NO: 6238 - DNA, 50 bp, homo sapien
gcttctgatgtgtttctttctgtccyacaagtactttctgaaccagcttc

SEQ ID NO: 6239 - DNA, 50 bp, homo sapien
agccagctcctttgtagtcggccaasatcagtaccaactacctccttccc

SEQ ID NO: 6240 - DNA, 50 bp, homo sapien
agcacagtggattattagttaaataycatcaatcaattagaaagtgatgg

SEQ ID NO: 6241 - DNA, 50 bp, homo sapien
ctcagtcactgacaacatattgaaawcaggtaacctgccaaagcttcatt

SEQ ID NO: 6242 - DNA, 50 bp, homo sapien
gatcagttattagctgggtccctcgyacattacaggtgcttaggagacat

SEQ ID NO: 6243 - DNA, 50 bp, homo sapien
caagatggcctcaggatttcatacayagcaagcatcaaagcctcagtgtg

SEQ ID NO: 6244 - DNA, 50 bp, homo sapien
acagtgtctttctttaatctcaatamctcttcaacattttgcaaattttc

SEQ ID NO: 6245 - DNA, 50 bp, homo sapien
tctcatcctgcccatttccaaaatcragtttcacctgggaagtgtttcag

SEQ ID NO: 6246 - DNA, 50 bp, homo sapien
atacaaatttagtagaattgactaamaatggaaaatatccataaatacaa

SEQ ID NO: 6247 - DNA, 50 bp, homo sapien
tcaggtctctgtgcagtccctccacraagggtcactgaaacccctccctg

SEQ ID NO: 6248 - DNA, 50 bp, homo sapien
ccagaacagatggggaaaaaattacrctatgccctgaaattttccattct

SEQ ID NO: 6249 - DNA, 50 bp, homo sapien
ggcagagaccagggcttctccaatgraagtgcattcaactcaccctgcca

SEQ ID NO: 6250 - DNA, 50 bp, homo sapien
ctttagtaattgatcatttggggtamtaacctgcaccttatacaataaag

SEQ ID NO: 6251 - DNA, 50 bp, homo sapien
tctctacttcctttttaaggcaaatractcttggatatgcccctttgaga

SEQ ID NO: 6252 - DNA, 50 bp, homo sapien
caagctgttgtcagaaacagtaaaaytgacatccataaaacagtttcttc

SEQ ID NO: 6253 - DNA, 50 bp, homo sapien
gtaaaagtcttattttgccttcttcrcttaattaaatcagaaggctgtgg

SEQ ID NO: 6254 - DNA, 50 bp, homo sapien
gccactgcaaacagccaagataagasagtgctaaagctcttagtcgaaac

SEQ ID NO: 6255 - DNA, 50 bp, homo sapien
ggtaaagaatatttaatgttctctgmaaatttgttcaatgcagcattaaa

SEQ ID NO: 6256 - DNA, 50 bp, homo sapien
gacacaggctattagcagactcaccrcaaaaggatatgccaggagtggat

SEQ ID NO: 6257 - DNA, 50 bp, homo sapien
aacataagcattatctcacaacttawcaatttttgtggtaaggacactta

SEQ ID NO: 6258 - DNA, 50 bp, homo sapien
ttctgcattccttttgcaccttttcmataactgcatggtcttgtaccaaa

SEQ ID NO: 6259 - DNA, 50 bp, homo sapien
ggaagtctgagaggctttgtctgtcmctttcaattaaccaggatcaacca

SEQ ID NO: 6260 - DNA, 50 bp, homo sapien
tgagaacatgactttgtattattccyagctcatggttgcagagccactgc

SEQ ID NO: 6261 - DNA, 50 bp, homo sapien
tctgcagggtttgatcttcctctcartaatttgacatcaaactgtgtgtc

SEQ ID NO: 6262 - DNA, 50 bp, homo sapien
caactgcaagcctaaagctcattgarggttcttccattcaggtcacattc

SEQ ID NO: 6263 - DNA, 50 bp, homo sapien
tcagtagttgggcccgaggttaaaarcagcatatgggaagtgacatttcc

SEQ ID NO: 6264 - DNA, 50 bp, homo sapien
aagtgctcagtgctgaggtagtaagractagggaaccaatagaggctttt

SEQ ID NO: 6265 - DNA, 50 bp, homo sapien
gtaaactatgacactgatcagataaycaaggtgaggtgcaaagtcaggta

SEQ ID NO: 6266 - DNA, 50 bp, homo sapien
aactactcacagtctacaggctctcrgaagttaataaatattcatcaata

SEQ ID NO: 6267 - DNA, 50 bp, homo sapien
agtctgatatccacctgactcgagayagctcctgatgggatagttacaac

SEQ ID NO: 6268 - DNA, 50 bp, homo sapien
agcttaacagagagaaaagtccagaraattgtagaagatccttctttagt

SEQ ID NO: 6269 - DNA, 50 bp, homo sapien
atgataaaaattaaaccttgactcastaactttattatacaaaagtaagt

SEQ ID NO: 6270 - DNA, 50 bp, homo sapien
aaatttactactcattaacctttgawgaattcagctctccaaggaatttt

SEQ ID NO: 6271 - DNA, 50 bp, homo sapien
aaatacccagatgtttcttactggckcctcactaatcaataacacaagtg

SEQ ID NO: 6272 - DNA, 50 bp, homo sapien
gttattaccatttccttggtcaactraaatatttctgggagaactgatga

SEQ ID NO: 6273 - DNA, 50 bp, homo sapien
ccggagggccttatgtaatcacaaasgtcctttaacatggaagagggagg

SEQ ID NO: 6274 - DNA, 50 bp, homo sapien
agaaacttaaagtcattcagcatagragtcatacaatgggcatggctggg

SEQ ID NO: 6275 - DNA, 50 bp, homo sapien
tgattccaatgttcctaaacatctckcagagtattcaatgccatttgact

SEQ ID NO: 6276 - DNA, 50 bp, homo sapien
aaaatggtaggcaatggattccaacrctaacttcgtatcaggagctccag

SEQ ID NO: 6277 - DNA, 50 bp, homo sapien
ctcactctcagtctccttaccctgcratgatatcttctgagtctacatca

SEQ ID NO: 6278 - DNA, 50 bp, homo sapien
atggagtcctttgcatcctagaacasaggaagaatagagaaaggcagatt

SEQ ID NO: 6279 - DNA, 50 bp, homo sapien
aattcctgggtatggtgtggttctamaaattttgtacttaaaagtgaagt

SEQ ID NO: 6280 - DNA, 50 bp, homo sapien
ctttgctttttagatgaaaaatttargctaagacaaataactaacttatc

SEQ ID NO: 6281 - DNA, 50 bp, homo sapien
aatctaaggtacaacagaaaagatgyattttacaagagatttggaaagta

SEQ ID NO: 6282 - DNA, 50 bp, homo sapien
gtttattgagttattcctgatttaasaagtctagctggagttgtttagaa

SEQ ID NO: 6283 - DNA, 50 bp, homo sapien
ctccaaagaaaattaaggaccacackgaaaatctgcctttctctattctt

SEQ ID NO: 6284 - DNA, 50 bp, homo sapien
ggtgagcctaattcccagctcttagrcaatgagatagctaggagcaaacc

SEQ ID NO: 6285 - DNA, 50 bp, homo sapien
tgagtccagaagaacaactgcacaasgttagaactgcattggaagctttt

SEQ ID NO: 6286 - DNA, 50 bp, homo sapien
gactaactgcatgttctgaagtgtayctttttatcttccagtcatttcaa

SEQ ID NO: 6287 - DNA, 50 bp, homo sapien
taatttatccttcagctgtggggagmcaccgaaagtctggcttggtccca

SEQ ID NO: 6288 - DNA, 50 bp, homo sapien
gggaagagccagtggaggaggaagayggcaaactcgcctgtgaagaggct

SEQ ID NO: 6289 - DNA, 50 bp, homo sapien
actggagcagcaccatcgcctcagaycacgtggtggacatgtaggccctc

SEQ ID NO: 6290 - DNA, 50 bp, homo sapien
tgggacttccagttgcttccagcggyagaaagaggacagctccagctgct

SEQ ID NO: 6291 - DNA, 50 bp, homo sapien
ttcacagctggatgaaagcaaaaaasagttcatggatagatcttggtcaa

SEQ ID NO: 6292 - DNA, 50 bp, homo sapien
taaagatagtaaagtgaagcagagayggtttaaataaattatctaagctt

SEQ ID NO: 6293 - DNA, 50 bp, homo sapien
ctatgaaagactgtgtgaggcttacyatatatacactccttttgatccag

SEQ ID NO: 6294 - DNA, 50 bp, homo sapien
agaatcaggactgttgaagtttctcyctagtagtgacactacatgcctga

SEQ ID NO: 6295 - DNA, 50 bp, homo sapien
tctttatgttgcatttaatagaagcrataggccagtgagaaatgatgctc

SEQ ID NO: 6296 - DNA, 50 bp, homo sapien
accatggatgcattaccaaaatgtasataagaaatggtaacgaaagcaca

SEQ ID NO: 6297 - DNA, 50 bp, homo sapien
cttctccaacaattcaacctcatacyactccaccagagctcagtcctggg

SEQ ID NO: 6298 - DNA, 50 bp, homo sapien
gcgtaggccagcaatccccatgttgyaaagagtagaaccaaatataagct

SEQ ID NO: 6299 - DNA, 50 bp, homo sapien
ctaatattagcaaggaaccattccckcagagttggcccagtttcccagag

SEQ ID NO: 6300 - DNA, 50 bp, homo sapien
tattttggagacagcctggttaaaaycttcccactcatgaaatttctagt

SEQ ID NO: 6301 - DNA, 50 bp, homo sapien
tcctgtggggatcaactgcagattamggtacagtggtaggtctggggtgg

SEQ ID NO: 6302 - DNA, 50 bp, homo sapien
aaactatacaaatgttttagaaatgyatttttatagaatgaatagatatt

SEQ ID NO: 6303 - DNA, 50 bp, homo sapien
gaagagacatcaataccaaggataayctctgcctgacttaaattctacct

SEQ ID NO: 6304 - DNA, 50 bp, homo sapien
cttcagttcaattcagtcttcctgartatctactttgtttagagtcatgg

SEQ ID NO: 6305 - DNA, 50 bp, homo sapien
gctgagtagtactttatggtatttayggtatatggtatttctggtgtgtg

SEQ ID NO: 6306 - DNA, 50 bp, homo sapien
gttctgaagtctgtgtttacccagakgtagaagataacaggtacattatg

SEQ ID NO: 6307 - DNA, 50 bp, homo sapien
tattgagactatgcgaaactgagtaragacatccaattaaaaattattat

SEQ ID NO: 6308 - DNA, 50 bp, homo sapien
gtgtttctaggtaaatgctcatctayatcacctaggatctactaaattaa

SEQ ID NO: 6309 - DNA, 50 bp, homo sapien
ggctccatctcatgtcgaaggccaakgctaagagtggctgcctggggtgc

SEQ ID NO: 6310 - DNA, 50 bp, homo sapien
gattacagaaaatgaaatgcctggamtataaatactttattcatggtata

SEQ ID NO: 6311 - DNA, 50 bp, homo sapien
aaattgttcatttattgttaagttaygaaactgtctttccaaaatcatat

SEQ ID NO: 6312 - DNA, 50 bp, homo sapien
tggttactgggtctgtgctcttggamcctgatatattaataaatattgat

SEQ ID NO: 6313 - DNA, 50 bp, homo sapien
tgcaaaggaatgggagttggttttcyaccacaatacacagacatctgaaa

SEQ ID NO: 6314 - DNA, 50 bp, homo sapien
caagcctgatgaagcatctcacatcrcaagagactttcagatgtctgtgt

SEQ ID NO: 6315 - DNA, 50 bp, homo sapien
agaacagtggtcattaatccaacatragcacaatgacaggtctattaaca

SEQ ID NO: 6316 - DNA, 50 bp, homo sapien
tcacctaacgttggcaaaacagctgracctcagagaactgcatgcacgag

SEQ ID NO: 6317 - DNA, 50 bp, homo sapien
caggccatgggtgaatgcttccagasaggtgaaagtcctcacagtccgct

SEQ ID NO: 6318 - DNA, 50 bp, homo sapien
aagaactttaatatacacattaccaycttttcattggtcagaccagtggc

SEQ ID NO: 6319 - DNA, 50 bp, homo sapien
gctgcttgattcagacatgagtccarctagaaatctgggatacagtccaa

SEQ ID NO: 6320 - DNA, 50 bp, homo sapien
agattacatgtctaagttttccataytactacggaatttaaagatatcct

SEQ ID NO: 6321 - DNA, 50 bp, homo sapien
ggtaatcgatttttcacaaggatacsaagacacttcaatggggaaagaaa

SEQ ID NO: 6322 - DNA, 50 bp, homo sapien
gggacttctaatggttgcagtaatgkaatatgttgtagacctcagcagta

SEQ ID NO: 6323 - DNA, 50 bp, homo sapien
accgactgttataatcagtatagctraaattactcatctgaagcctgtga

SEQ ID NO: 6324 - DNA, 50 bp, homo sapien
attcattttctctcatctaacaaaargactacacataccactaatgcact

SEQ ID NO: 6325 - DNA, 50 bp, homo sapien
agaaaagatctatgaacaatgatgaraacctctacaagagaaacagattt

SEQ ID NO: 6326 - DNA, 50 bp, homo sapien
ctgggaagaagcttttcgtgaccaayggtgagcggatgcctttctccaaa

SEQ ID NO: 6327 - DNA, 50 bp, homo sapien
tttttaccaaaaaagagtcaacaaaytgcatacattctctatatctagtt

SEQ ID NO: 6328 - DNA, 50 bp, homo sapien
tgctttgtaaactccatgtaaattaygacacaaatgtaaggtattattat

SEQ ID NO: 6329 - DNA, 50 bp, homo sapien
ttgtcagaaacgtgatagcacaatargcatgatgttagatttaaaaaacc

SEQ ID NO: 6330 - DNA, 50 bp, homo sapien
aaaaacaaggatttactaaggatacrgtagaggcagtatggtgtggaggg

SEQ ID NO: 6331 - DNA, 50 bp, homo sapien
gaaaggggctttctcatattctgaawggtttcttttccttttcataactt

SEQ ID NO: 6332 - DNA, 50 bp, homo sapien
agcaggttgaggaagataccaaacartctttatgaaccaaagttcttaat

SEQ ID NO: 6333 - DNA, 50 bp, homo sapien
gaggagggtgctgtgtggtttaactsaagaatttgtgctgtttctgtgga

SEQ ID NO: 6334 - DNA, 50 bp, homo sapien
gttataagaaaacaccataaggaaawtgtttatatataaaaataaatgat

SEQ ID NO: 6335 - DNA, 50 bp, homo sapien
actatagttcccagaatgcaccagcracgtcagtttcctttaccccacaa

SEQ ID NO: 6336 - DNA, 50 bp, homo sapien
tagagaaaagaaatgccagatgaaartattcacactggctcctcaatctt

SEQ ID NO: 6337 - DNA, 50 bp, homo sapien
atgcaattgtacacactaaatcaaartgagttccatagttcttcatcatt

SEQ ID NO: 6338 - DNA, 50 bp, homo sapien
gcaacatgagtagagttttcttgacrgtagatgtgttaactaaagagaca

SEQ ID NO: 6339 - DNA, 50 bp, homo sapien
gtcttctcaaacatctttcaaggtcrgaactacaatgaccattttatata

SEQ ID NO: 6340 - DNA, 50 bp, homo sapien
tgcatagtgttttagaatttgcaacrggctgctctattcattcctttttt

SEQ ID NO: 6341 - DNA, 50 bp, homo sapien
atgaaacaggagaagctagataaacygtaaacaagaggattaatgtcaga

SEQ ID NO: 6342 - DNA, 50 bp, homo sapien
cctaaaaaagacatttcaaggactarctgtaaactacagtactttatatg

SEQ ID NO: 6343 - DNA, 50 bp, homo sapien
gaatgagtaaaggacttaatgaattyaacttggcagggaaaaaatacaaa

SEQ ID NO: 6344 - DNA, 50 bp, homo sapien
gatgagtgagtgattggccgcctaawattgctcatccttgtatcttcatc

SEQ ID NO: 6345 - DNA, 50 bp, homo sapien
ttttctgatgtctttgaatggcccasaggagacagaagcagacacaattc

SEQ ID NO: 6346 - DNA, 50 bp, homo sapien
tatgctaaattatctattataaaagrctgttgaaattatcaagtgctttt

SEQ ID NO: 6347 - DNA, 50 bp, homo sapien
cccacacatcagtattttcttgaackctatcacaccgcatcagaggtaaa

SEQ ID NO: 6348 - DNA, 50 bp, homo sapien
tctgccaagagatgagagccatagawtcagaagaaaatttggagaataaa

SEQ ID NO: 6349 - DNA, 50 bp, homo sapien
aaaggtcacaggttttactctaagcrccatttgggaacctgggaatttct

SEQ ID NO: 6350 - DNA, 50 bp, homo sapien
tggcttctctatgtatagtctgtgcratcttaggtaagccacttaaatgc

SEQ ID NO: 6351 - DNA, 50 bp, homo sapien
agaatccaacagtgaccttgcttgargaagatgaacaacgcttcagacag

SEQ ID NO: 6352 - DNA, 50 bp, homo sapien
tcctccttacttagtagaagaatacrgagacccagaaatccattcattta

SEQ ID NO: 6353 - DNA, 50 bp, homo sapien
atttggagcaacaaagaagtgtcaakgttaaatctgaatcaaagttatta

SEQ ID NO: 6354 - DNA, 50 bp, homo sapien
gaaagaaatagagaaaaaatcatctraaatcgcacattaaaaaactagca

SEQ ID NO: 6355 - DNA, 50 bp, homo sapien
gtgcaagtgtggacccagaagcaaaratgggtatgctgtgcagaagggtt

SEQ ID NO: 6356 - DNA, 50 bp, homo sapien
cagagagagttttctgtggggtaccrgataaattgactatttttttcttc

SEQ ID NO: 6357 - DNA, 50 bp, homo sapien
cagtaccagagctgcttatatcaccrgaagaaaagttttacatcagccta

SEQ ID NO: 6358 - DNA, 50 bp, homo sapien
atacacctctgtttatggtctgagaygcatacctactacccagataataa

SEQ ID NO: 6359 - DNA, 50 bp, homo sapien
ctggagaatgctgatgtatcctatcracctcagctggactcatcagctat

SEQ ID NO: 6360 - DNA, 50 bp, homo sapien
atcaggaggataaataatttcggagwacaaaacaattcattgaagttgtg

SEQ ID NO: 6361 - DNA, 50 bp, homo sapien
ggcagtcaggaggtataaaagggcaytctgtccaatttcaagcccctgga

SEQ ID NO: 6362 - DNA, 50 bp, homo sapien
ttgtgcctaatcgtggcactcgtccrgatatcgtaggaaaattatgaccg

SEQ ID NO: 6363 - DNA, 50 bp, homo sapien
ccggtacagtactgagaaaatgatartaatattgtatctcatcttaaagg

SEQ ID NO: 6364 - DNA, 50 bp, homo sapien
gtccttcctctccaccaggctaccartcaggataataaatgcaaagctgg

SEQ ID NO: 6365 - DNA, 50 bp, homo sapien
gctgaaacctctgtaaatgggctcarcgtttaataaagatttataatttt

SEQ ID NO: 6366 - DNA, 50 bp, homo sapien
aataggaagggctggtacctaatgayctggtgtcttccaaggagctcata

SEQ ID NO: 6367 - DNA, 50 bp, homo sapien
gaataaggagcagtggaataaaaaascaaatgagcgatttatcaacatag

SEQ ID NO: 6368 - DNA, 50 bp, homo sapien
tcccattttcttaatgcgcataaaaygagagtaactagccatttctcatc

SEQ ID NO: 6369 - DNA, 50 bp, homo sapien
tgtattttgtatattaacctcttacyagacatacaatttgcaaaaatttt

SEQ ID NO: 6370 - DNA, 50 bp, homo sapien
aatgggaaaggagaaatactttgtcygaaattatgttgctaaaaaatgga

SEQ ID NO: 6371 - DNA, 50 bp, homo sapien
tttctcctgagatattctgttcacayactttcatgcaagatttcttttat

SEQ ID NO: 6372 - DNA, 50 bp, homo sapien
acagcagatcatttgatatcagaagrattgggtcttgttttatgttcttc

SEQ ID NO: 6373 - DNA, 50 bp, homo sapien
gaaagagtggatgtcctaaatctaarcagagcaataggattagcagtatg

SEQ ID NO: 6374 - DNA, 50 bp, homo sapien
cggcctgaagatcaatatttttgtarcttctaatctcatctcctggaatc

SEQ ID NO: 6375 - DNA, 50 bp, homo sapien
taacatccctttacatttgttttccmaggcaatgaacacagtctattagc

SEQ ID NO: 6376 - DNA, 50 bp, homo sapien
gctctaaaaaatatttttatataaaygattagtacactttgagtctgagt

SEQ ID NO: 6377 - DNA, 50 bp, homo sapien
ttaaccccttggtttcattaccagargcaacttagaagtgaggagatcca

SEQ ID NO: 6378 - DNA, 50 bp, homo sapien
agtgtactatttaggtgtcagagacygaaaaaatacatagtgaaggtggc

SEQ ID NO: 6379 - DNA, 50 bp, homo sapien
ggtactttttctaaaatgtcagttarggtattacaccagtaatgtaacac

SEQ ID NO: 6380 - DNA, 50 bp, homo sapien
ctctgtgctaaaaattgaggtcaccrctttcttcccattagtcctaatac

SEQ ID NO: 6381 - DNA, 50 bp, homo sapien
ttataaaaaagcatatactcttggcmctttccagctgtcagcctcactgc

SEQ ID NO: 6382 - DNA, 50 bp, homo sapien
gaagaccacatgcaactcatagggckcttgcctccaagaacaggcggctg

SEQ ID NO: 6383 - DNA, 50 bp, homo sapien
gtgtagtatatcacccactattatcrcctagtccataactggcatcatgc

SEQ ID NO: 6384 - DNA, 50 bp, homo sapien
tctgccttagtctgactgattttgcrctactagctgcacatggtgtgtgt

SEQ ID NO: 6385 - DNA, 50 bp, homo sapien
ccctgtcaattaattagcagcttaaytggaatgaaattatgtaattaagc

SEQ ID NO: 6386 - DNA, 50 bp, homo sapien
tattcaaacagtaggtgcttaaccaktatcctatgtggcctctaattgaa

SEQ ID NO: 6387 - DNA, 50 bp, homo sapien
gagtacctgaaaaaacacatttccayaataagacaactggttgttcaaga

SEQ ID NO: 6388 - DNA, 50 bp, homo sapien
cctggcctctaggagtattgagtacrcagccaagtgagctgcctctgagt

SEQ ID NO: 6389 - DNA, 50 bp, homo sapien
ctgaatatgactagttgtgtgatgartaattaatttcagcagcatctttg

SEQ ID NO: 6390 - DNA, 50 bp, homo sapien
ttagtactgtctctctttctagcacygggcaagaccatttttggccccac

SEQ ID NO: 6391 - DNA, 50 bp, homo sapien
gaggatctccccaaggtgaaacagamgtcgcttctcatggagacccagca

SEQ ID NO: 6392 - DNA, 50 bp, homo sapien
ttggcaggatctcatatgaatgagcrcagtactagaagacatcacgatga

SEQ ID NO: 6393 - DNA, 50 bp, homo sapien
gtttcactgaatttctggcttaatgyaacacttaatggagccagtaatca

SEQ ID NO: 6394 - DNA, 50 bp, homo sapien
aaatgaatttgtatgtcaataatagwacaaagaggagtttaagctttgac

SEQ ID NO: 6395 - DNA, 50 bp, homo sapien
caatctgcacactctggagaatagaygtgactctgacaactctcaaccct

SEQ ID NO: 6396 - DNA, 50 bp, homo sapien
gaaaaagagaaaaaggttagaaaaarctctatacatggaaatcagtgctc

SEQ ID NO: 6397 - DNA, 50 bp, homo sapien
tggttgcatcttttgtcagagatacrccttgaaacccctgagaaagctcc

SEQ ID NO: 6398 - DNA, 50 bp, homo sapien
gatcacagttgagaattcattaagckgctctaatagaagtctggggatgg

SEQ ID NO: 6399 - DNA, 50 bp, homo sapien
ccagctcatactgcacaatgaataaygaaacactacaagtaaggacccag

SEQ ID NO: 6400 - DNA, 50 bp, homo sapien
tcagcagtggcgatgatcattgtcargaaggtcccagccctgatccccat

SEQ ID NO: 6401 - DNA, 50 bp, homo sapien
catcctgcctctccaataattataaygtcacttggtcaaatcctacaaag

SEQ ID NO: 6402 - DNA, 50 bp, homo sapien
atatctttcttgtagcctatctagarcacttaacattactgtgtccaagt

SEQ ID NO: 6403 - DNA, 50 bp, homo sapien
tagtattctgtgttactgattgggayagaacagtatctgaatagcactgt

SEQ ID NO: 6404 - DNA, 50 bp, homo sapien
aggatccttcatattgggtaggaaastttattattccctcacatcagaca

SEQ ID NO: 6405 - DNA, 50 bp, homo sapien
tgtactaggtctgatccataagtgcyatgcgtagaaaatgtagttggtag

SEQ ID NO: 6406 - DNA, 50 bp, homo sapien
tgatgtctgaaatgaaaatcctatgratagctgaccagaactcttactgg

SEQ ID NO: 6407 - DNA, 50 bp, homo sapien
aggaaactgctcttgctctttccacrgtaggttttcatttgtaaaatgta

SEQ ID NO: 6408 - DNA, 50 bp, homo sapien
gcaacagcactgtttccaaatgtgaygttattacagagatgtcatacaaa

SEQ ID NO: 6409 - DNA, 50 bp, homo sapien
acccccaaatttgttatccttctcayatctaatttgacagcagttctttg

SEQ ID NO: 6410 - DNA, 50 bp, homo sapien
atcgctatttacaaagcacgttcgcratcatttgcacatttaaactccag

SEQ ID NO: 6411 - DNA, 50 bp, homo sapien
tacccatctcttccagcccaggttaygcttacttaggggcagtctatgtc

SEQ ID NO: 6412 - DNA, 50 bp, homo sapien
aatggattaaatataggacagactcwatagcctacagaaagcccatttta

SEQ ID NO: 6413 - DNA, 50 bp, homo sapien
tgatttccttcctacttgatcctaaygaagaatgaaacacatgacataaa

SEQ ID NO: 6414 - DNA, 50 bp, homo sapien
ttgactctgctcacagttatttaaamacgtggccttgcaggtctagctgc

SEQ ID NO: 6415 - DNA, 50 bp, homo sapien
taaacatctggtcacatataagctarcaaaattgaactaggaagaaatag

SEQ ID NO: 6416 - DNA, 50 bp, homo sapien
acagaatgacctatattacaaccgayataaaacctaggtgtaggatattc

SEQ ID NO: 6417 - DNA, 50 bp, homo sapien
ttaggaacacttaaaacataatggcrgacaaaaccgtgtcctggaaacct

SEQ ID NO: 6418 - DNA, 50 bp, homo sapien
gctctcttaatttaatacttttgcamcattccaatggcttgcttatagag

SEQ ID NO: 6419 - DNA, 50 bp, homo sapien
gtctataaatgtgttaacttctaaawtgctactctgaaacttgcaacaca

SEQ ID NO: 6420 - DNA, 50 bp, homo sapien
taaacattgtatcattaatttatcaygtgtatccaagctcctttgagttt

SEQ ID NO: 6421 - DNA, 50 bp, homo sapien
ttggcaaatgagtttcgattgcccaragtataagttgggactggcccagc

SEQ ID NO: 6422 - DNA, 50 bp, homo sapien
tagaagcttctaccatgataaaatgyaggtgatttcatcaagtcctgtaa

SEQ ID NO: 6423 - DNA, 50 bp, homo sapien
agtaagattttatgttgtttacaaaygaatagaacaaccctaacactgtc

SEQ ID NO: 6424 - DNA, 50 bp, homo sapien
aatttgctaatgtaagtttctaagaytcaaatacagaatggaaagtacac

SEQ ID NO: 6425 - DNA, 50 bp, homo sapien
cctcttctgatatatctccttcacamtggtaatattactccttgaaaata

SEQ ID NO: 6426 - DNA, 50 bp, homo sapien
gaaatagttaccaaatggatacttcyaccacacttatctacttatggtat

SEQ ID NO: 6427 - DNA, 50 bp, homo sapien
atagtgggaagaaacaactgtctcarcttttcttcctacttcagtgctat

SEQ ID NO: 6428 - DNA, 50 bp, homo sapien
gtaactcagagacaatttggcttcargaaggtacagttagaagctgccaa

SEQ ID NO: 6429 - DNA, 50 bp, homo sapien
ctctgtgaagctgaccttctccctcrgaccttagaccaccatctatgcct

SEQ ID NO: 6430 - DNA, 50 bp, homo sapien
attgtttgttcttttctacagaggaractattcagcatccatttcaccct

SEQ ID NO: 6431 - DNA, 50 bp, homo sapien
tgaatacaactgttattctctctcawgcccaaaatttaaacttgctaaga

SEQ ID NO: 6432 - DNA, 50 bp, homo sapien
cactttgttttccaaactcataagarcacaatggattttctctgttgttt

SEQ ID NO: 6433 - DNA, 50 bp, homo sapien
aatgatattctcagaagtatcactcrcaacaattattaaagttttgttaa

SEQ ID NO: 6434 - DNA, 50 bp, homo sapien
ctgaaagctttgcggataactataaygcagaggtaatccaggtttgtggg

SEQ ID NO: 6435 - DNA, 50 bp, homo sapien
ttttgtttgagctaattatttaataygtgatttctttgtcataggtggcc

SEQ ID NO: 6436 - DNA, 50 bp, homo sapien
ttgagaaagtctgtggacatattccrcttttgctggattacagttaaacc

SEQ ID NO: 6437 - DNA, 50 bp, homo sapien
taaacataagaatgttggtatttgayaactggtgcagcactggcactaac

SEQ ID NO: 6438 - DNA, 50 bp, homo sapien
ctgagcatgcagatagcactgagtaygctcacatccctacacatgaactt

SEQ ID NO: 6439 - DNA, 50 bp, homo sapien
aattattacagaagagaaagactacrgattgagtataccaaaatgaaaaa

SEQ ID NO: 6440 - DNA, 50 bp, homo sapien
tggcagtcaaattgaaaaggcaaaartgaaatcaaagggcaattatgtag

SEQ ID NO: 6441 - DNA, 50 bp, homo sapien
acttggtttcagagaaaatgccaaayatttgtgtctgttattaatcatga

SEQ ID NO: 6442 - DNA, 50 bp, homo sapien
tacttctaaacagagggaatatatawcgaactacaaatcaatatgaaaaa

SEQ ID NO: 6443 - DNA, 50 bp, homo sapien
tgtattttaaataaaaaggcttagtyaagggttgtaatgcttatcttttc

SEQ ID NO: 6444 - DNA, 50 bp, homo sapien
taattcactagggattctggttgtcrcttttcttagttatgagttttcgg

SEQ ID NO: 6445 - DNA, 50 bp, homo sapien
gagaagcaaggcatagaaaataatasgtatgcttagaaatatcatgattg

SEQ ID NO: 6446 - DNA, 50 bp, homo sapien
tgggagcagaactcaggcttaagaarcaatacatttatggctttttctaa

SEQ ID NO: 6447 - DNA, 50 bp, homo sapien
cttcctcctatattcctttactccargaaatctgaagttctcttgcacca

SEQ ID NO: 6448 - DNA, 50 bp, homo sapien
cagcatattgactacggtgatgcaayttcccaggaataacatgtgttcca

SEQ ID NO: 6449 - DNA, 50 bp, homo sapien
gaagaggagggatcataaggttgaayttcaaatatcatacacaagtttcg

SEQ ID NO: 6450 - DNA, 50 bp, homo sapien
gcctatataacatttagtcaaatcargtattccataagctagaagcctgt

SEQ ID NO: 6451 - DNA, 50 bp, homo sapien
tgctaacatttctgtctaacctatarccttgtgatcagatgaaattaaat

SEQ ID NO: 6452 - DNA, 50 bp, homo sapien
gggtttactccaataaagaacaaggrattcttagcacttataggaagacc

SEQ ID NO: 6453 - DNA, 50 bp, homo sapien
tggctacatcaaaacagccatgtcaragtatcatgtttcctattagacag

SEQ ID NO: 6454 - DNA, 50 bp, homo sapien
ggaccgtggtgttttccaaattacamgtaggcttatccttaggatccagc

SEQ ID NO: 6455 - DNA, 50 bp, homo sapien
agagaacttcctcattctataaaagrcatctgagaaaaatctacagagga

SEQ ID NO: 6456 - DNA, 50 bp, homo sapien
gaggctttgtggtcgatattatgcarcgccactctgccagtttgtgctct

SEQ ID NO: 6457 - DNA, 50 bp, homo sapien
agataatttgtaaaaccttcactgarcttaaaatccatgtagttaatgaa

SEQ ID NO: 6458 - DNA, 50 bp, homo sapien
gatgagaaaatgctgtttttccatamgctgtcataacatagaccctccag

SEQ ID NO: 6459 - DNA, 50 bp, homo sapien
atatataaaatccctcatgataatcwcattgtaatgccattgctataatg

SEQ ID NO: 6460 - DNA, 50 bp, homo sapien
gacaggcccttaaggaagcaacaatsagcctgagaattctaagggaagag

SEQ ID NO: 6461 - DNA, 50 bp, homo sapien
ataatcaataacagccaactttaacygaacactcactgtgtacaacgcat

SEQ ID NO: 6462 - DNA, 50 bp, homo sapien
cctccagtgctaaagaaaatagtaaygggtctagttcccaaatctgagag

SEQ ID NO: 6463 - DNA, 50 bp, homo sapien
ctctgaggggagtgtgcagaatgctwaacgtgcttgttgacattacacct

SEQ ID NO: 6464 - DNA, 50 bp, homo sapien
tttcttcctcgtgggattgggatgckctattctcattgcacttagggatg

SEQ ID NO: 6465 - DNA, 50 bp, homo sapien
cagaattggctctagattcatagcamcataagtaggacagctgaatgatg

SEQ ID NO: 6466 - DNA, 50 bp, homo sapien
ctattttaatactatctttgatgctsaagtacatagcttgtgtgagaata

SEQ ID NO: 6467 - DNA, 50 bp, homo sapien
aaggtttgaatgctctgcaaaagaartgccgttcagttacccttgaatta

SEQ ID NO: 6468 - DNA, 50 bp, homo sapien
gttcacaaggatataaaagattcaakcaatatttcttggtgcctactatt

SEQ ID NO: 6469 - DNA, 50 bp, homo sapien
gaactgacagtagaaactgtggataygattgaaatcactaggcagaaaat

SEQ ID NO: 6470 - DNA, 50 bp, homo sapien
tctctttatttggctgattaatctaycattacattctcaggtatttcagg

SEQ ID NO: 6471 - DNA, 50 bp, homo sapien
ttatttttcacacatattctcaagaytccagtggtataagtcagtatggt

SEQ ID NO: 6472 - DNA, 50 bp, homo sapien
gatcggaaagtgacattagaactcaraacatgctataacttagttctaga

SEQ ID NO: 6473 - DNA, 50 bp, homo sapien
tttccctgtgtcctttggctgcctawctctatacatcacaaagagctaca

SEQ ID NO: 6474 - DNA, 50 bp, homo sapien
caagagggatcttgatagggttccawcagtttcactttcctttccccttt

SEQ ID NO: 6475 - DNA, 50 bp, homo sapien
aaaacctaggtggtctgtcccattaraagccagaagtaaaggagaccaga

SEQ ID NO: 6476 - DNA, 50 bp, homo sapien
ggcggtggactatgacttataaaacrtatagcaaacatgtggaggcccat

SEQ ID NO: 6477 - DNA, 50 bp, homo sapien
acagcctaacttctataacgcatgcycactaattctgtttgttgtgttca

SEQ ID NO: 6478 - DNA, 50 bp, homo sapien
ttagaaatgctaagttatacatgacyctaatgctgtttggaggtagagaa

SEQ ID NO: 6479 - DNA, 50 bp, homo sapien
ttatgaagcaatctttagagactccrcttacaaaatgtatggcacagtac

SEQ ID NO: 6480 - DNA, 50 bp, homo sapien
ttttaaaaataatacctacagtctakatgaagaaaatacaaaatgctact

SEQ ID NO: 6481 - DNA, 50 bp, homo sapien
cttattcaccttattaatgtcctcaygagtctaagaattgaagccttact

SEQ ID NO: 6482 - DNA, 50 bp, homo sapien
ggtgcaggaggtcatgagtagaatgmcaaaaagcctttaatctaaggcaa

SEQ ID NO: 6483 - DNA, 50 bp, homo sapien
tgaagatgatactaaatctttcacaygtatcagactgcacaataagcact

SEQ ID NO: 6484 - DNA, 50 bp, homo sapien
ccccctttaaaatagctggaaatgaygggaaaaatcaaataagtattctt

SEQ ID NO: 6485 - DNA, 50 bp, homo sapien
aagagtcctaatgacacactactgcyaaataatcttaaagattggccctc

SEQ ID NO: 6486 - DNA, 50 bp, homo sapien
ttatgattagtttctagtgatgtgaytatttctcacgtggcacccaaagg

SEQ ID NO: 6487 - DNA, 50 bp, homo sapien
gcacatgactagaaaaaatactggamattgaatctgttaggaaaaaataa

SEQ ID NO: 6488 - DNA, 50 bp, homo sapien
tttctctgtcttcaagatattcctaragggtgtattttcaattcctcaga

SEQ ID NO: 6489 - DNA, 50 bp, homo sapien
cctcttatctagcctctagttctatyaggaaagcatgtctacccctttct

SEQ ID NO: 6490 - DNA, 50 bp, homo sapien
gtccttgactcagtcaccatggccarggaaagctggtagtagcaaaaagg

SEQ ID NO: 6491 - DNA, 50 bp, homo sapien
tgaaattcacacaatatgtgtcaccyatttcaaatgttaggattaattta

SEQ ID NO: 6492 - DNA, 50 bp, homo sapien
ttatatgccgttagaagctatgaaastgagagacaccttctttaaagttt

SEQ ID NO: 6493 - DNA, 50 bp, homo sapien
ccaggtaagaggtctgcccataaggsatattttgcagcatgtgaagcttt

SEQ ID NO: 6494 - DNA, 50 bp, homo sapien
gcatgaccttatattctaatatttgragtttcaataccaaaatgcaaaag

SEQ ID NO: 6495 - DNA, 50 bp, homo sapien
tacagaatatctacttcattaaggaygattagcctaaaaatatccatcaa

SEQ ID NO: 6496 - DNA, 50 bp, homo sapien
agcctaaaaatatccatcaactttargaaatttctaatatggctgccatg

SEQ ID NO: 6497 - DNA, 50 bp, homo sapien
atgagtacagctgttgaaagagtaayattaggaacgttattcattataca

SEQ ID NO: 6498 - DNA, 50 bp, homo sapien
agattaaaagcttccagagacttcarctgtcccttactcatctttctacc

SEQ ID NO: 6499 - DNA, 50 bp, homo sapien
aaaagtataaatggctgaactttaarctcaaaatactcttcttgtcagag

SEQ ID NO: 6500 - DNA, 50 bp, homo sapien
ctgcccaggctagctacaattcagargttcatacaggtccagtctgtcct

SEQ ID NO: 6501 - DNA, 50 bp, homo sapien
atgattactttgaacacacgttatayagagattggatatagagaagtcaa

SEQ ID NO: 6502 - DNA, 50 bp, homo sapien
attgaaataaggcttattttagagaygacatggttctagccgaaaagatg

SEQ ID NO: 6503 - DNA, 50 bp, homo sapien
ggtgctgaaggcagatattcataccrattgtgcagatgaagatatttaga

SEQ ID NO: 6504 - DNA, 50 bp, homo sapien
gcttgaatttacctattgtctgtaawgtgtcctgggtacaacttagttta

SEQ ID NO: 6505 - DNA, 50 bp, homo sapien
atagtcagtggacaattcagttatargaaaatatgagagggtaaaaagat

SEQ ID NO: 6506 - DNA, 50 bp, homo sapien
gtgagggatcccaagtttatatgtamcactaatgtctcacaaatcaagaa

SEQ ID NO: 6507 - DNA, 50 bp, homo sapien
ccacttgactgctggagctgagataytagtcttttctaaccttcagtctt

SEQ ID NO: 6508 - DNA, 50 bp, homo sapien
acgaataaacgcaaaatcaaataaartgatgaatgtatatatttactaat

SEQ ID NO: 6509 - DNA, 50 bp, homo sapien
cttaggagagaagtttcccgcaagckccctggtatacaatcaagtctcat

SEQ ID NO: 6510 - DNA, 50 bp, homo sapien
cctcttgctgctggtctctgaaggarattgttatatgccttccttgtcat

SEQ ID NO: 6511 - DNA, 50 bp, homo sapien
tgggagatttgtgtccatattttccractctagcaccctcagtgtcagct

SEQ ID NO: 6512 - DNA, 50 bp, homo sapien
tgccgtcaaagaaccatctaaggaasgtccaataagtagaatgggatcaa

SEQ ID NO: 6513 - DNA, 50 bp, homo sapien
cacactgctagcaattcaagtccccyataaagatcactgggagaacaaaa

SEQ ID NO: 6514 - DNA, 50 bp, homo sapien
aatggaacaattggtgaacataggtraaaggtggtatttattttaccatt

SEQ ID NO: 6515 - DNA, 50 bp, homo sapien
ttggccttcaatctgtgagtggtatmaagaagtatcaatctgcttgaaga

SEQ ID NO: 6516 - DNA, 50 bp, homo sapien
tgctgcaatgcttatcaaaatgagcrcttagagctggcatgacctggagt

SEQ ID NO: 6517 - DNA, 50 bp, homo sapien
tattgcaacagcacacagccacatakgaaaatagtcatccaagttctgcc

SEQ ID NO: 6518 - DNA, 50 bp, homo sapien
atgtggctgtgtgctgttgcaataaraccgtctccatcctcctcttaagt

SEQ ID NO: 6519 - DNA, 50 bp, homo sapien
ttcaactctgacaggagagaaattcrcttgtttccagaattaggaatact

SEQ ID NO: 6520 - DNA, 50 bp, homo sapien
ttttatatgattagtgacatactaayaggcattttgaaatattaaaaata

SEQ ID NO: 6521 - DNA, 50 bp, homo sapien
gtttctcttccctctttcgattctasgggagtctcttatctttctcagta

SEQ ID NO: 6522 - DNA, 50 bp, homo sapien
ttatttcttatgcaggttaaagcagyacgctctcaatagatttggctccc

SEQ ID NO: 6523 - DNA, 50 bp, homo sapien
aggcacttgagagcaaatgggtagayagaagtaatcatttttggtaggat

SEQ ID NO: 6524 - DNA, 50 bp, homo sapien
gaaaacatttgttttgttgcacagargtgatgaaagttatcctggattgt

SEQ ID NO: 6525 - DNA, 50 bp, homo sapien
gtcattgaattggctgtggtgctacygtaattagtcatttaagctgccaa

SEQ ID NO: 6526 - DNA, 50 bp, homo sapien
tggtgtaatctggatatcagatgcawtcagcgaacagcctgagttttgga

SEQ ID NO: 6527 - DNA, 50 bp, homo sapien
tgcagctagtctgatgcattaagtgyaaattggtggcagggccaggacta

SEQ ID NO: 6528 - DNA, 50 bp, homo sapien
cacgtgtgacaggaagagtaaagaaytggtgtaaagaaaccatacaagtc

SEQ ID NO: 6529 - DNA, 50 bp, homo sapien
agacaacttatggaagtgccaagaayctggacgcaatggcctcctctggg

SEQ ID NO: 6530 - DNA, 50 bp, homo sapien
ctataaatctaggcatgtaaaaataygtagttctcttcatgttgtcagaa

SEQ ID NO: 6531 - DNA, 50 bp, homo sapien
aagacagttgacctgttgacttaaasacatcatttaagagagtcagccag

SEQ ID NO: 6532 - DNA, 50 bp, homo sapien
aacctttctttatagctcctatcaartcattctacataagaaacatctta

SEQ ID NO: 6533 - DNA, 50 bp, homo sapien
aaaagtgatatttattgacagcttayaatttaagtgagtaggaatatttt

SEQ ID NO: 6534 - DNA, 50 bp, homo sapien
cagtgttggacagcctgtatagtacratggttgaaagcagtctttggagc

SEQ ID NO: 6535 - DNA, 50 bp, homo sapien
gatttaaccattttaataattttgaraaccaagatggatgcatacattct

SEQ ID NO: 6536 - DNA, 50 bp, homo sapien
tgggacctaaacttgacacctaaccraatagactgagcagacatctagag

SEQ ID NO: 6537 - DNA, 50 bp, homo sapien
gcaacaagggaacacacaaaaggcayaagagtgacagaaaaatagcaaga

SEQ ID NO: 6538 - DNA, 50 bp, homo sapien
tctggcagctttagtttcttatctaygtagcacaagaaggctatactttc

SEQ ID NO: 6539 - DNA, 50 bp, homo sapien
aatggaaaagcctaagaagaagctargactataccaaggcaggagtttct

SEQ ID NO: 6540 - DNA, 50 bp, homo sapien
actgaagtttcaccttgcacaatgayggctccctcatgtcgctcataatg

SEQ ID NO: 6541 - DNA, 50 bp, homo sapien
tcctccacctcctgtcatgtgaaaakgggttaataacttggaaaggggca

SEQ ID NO: 6542 - DNA, 50 bp, homo sapien
agagatgaactaccaacatattcacrgagacatttgagcacagcacagct

SEQ ID NO: 6543 - DNA, 50 bp, homo sapien
ctcttgaatgccggttctattggaaytgagagaaagagagggtgctaggc

SEQ ID NO: 6544 - DNA, 50 bp, homo sapien
atatccacacaatgaaatattacacygatctacagacacatgcaaaaata

SEQ ID NO: 6545 - DNA, 50 bp, homo sapien
ggatgcgtcatattctacccatggaygcttcttaaattttagtgcctggg

SEQ ID NO: 6546 - DNA, 50 bp, homo sapien
caaacttacatcaagttaaattaaaygaatgagataaaatggagacatct

SEQ ID NO: 6547 - DNA, 50 bp, homo sapien
ctgaaactgtgttactgtattttgargaaatggtcaaaaggcttatggaa

SEQ ID NO: 6548 - DNA, 50 bp, homo sapien
cccaggagtctccttgaattgaacawatagaaactaaactttagggaaat

SEQ ID NO: 6549 - DNA, 50 bp, homo sapien
aaatagaaactaaactttagggaaaytaagacaactaaaatgtgtaggac

SEQ ID NO: 6550 - DNA, 50 bp, homo sapien
actggttatgtagcatttgggatgaygataaaagtcaaggatcagcaaac

SEQ ID NO: 6551 - DNA, 50 bp, homo sapien
tggatgtcctgtgttttacctgacarccctatcataaggtcacaccaagg

SEQ ID NO: 6552 - DNA, 50 bp, homo sapien
tctatctgttgccatggagagataawgtgaaaagaaggcaaaccctggct

SEQ ID NO: 6553 - DNA, 50 bp, homo sapien
tttcagaagcttagaaactataggcractttatattcttgatgtatagta

SEQ ID NO: 6554 - DNA, 50 bp, homo sapien
actgcctttccctaacgattctctasaggtccaattcttccagtgaagaa

SEQ ID NO: 6555 - DNA, 50 bp, homo sapien
gcatccgatcctgttgtgccgcaccyagttcagagccgccctgcttccat

SEQ ID NO: 6556 - DNA, 50 bp, homo sapien
cgtgcctggccagaatatgttttcaycgaacacatctaacattgtgttat

SEQ ID NO: 6557 - DNA, 50 bp, homo sapien
ttctaatagcactgtatttacataaygaatggcaactgaagctttgtata

SEQ ID NO: 6558 - DNA, 50 bp, homo sapien
tatcaaagtggtggtctcataggctyacgtgaaaaaaatgacatagcact

SEQ ID NO: 6559 - DNA, 50 bp, homo sapien
acaaatgaatggattctttactaacyaatggattcttaaactgatgggcc

SEQ ID NO: 6560 - DNA, 50 bp, homo sapien
aattccactgtctgataaaaggaacmgtgcttgctttaaagtttaaggaa

SEQ ID NO: 6561 - DNA, 50 bp, homo sapien
accttttcctcacatttcagtggacrcatggcaataatgatggttagaga

SEQ ID NO: 6562 - DNA, 50 bp, homo sapien
cagttgcagggccccattgtgagcamcggtcctctaggagaatgctgggc

SEQ ID NO: 6563 - DNA, 50 bp, homo sapien
atccttttaacaagacaagccactcractaatacatgctctgaaggagcg

SEQ ID NO: 6564 - DNA, 50 bp, homo sapien
gttactccaagatggacatacagtaygagaaagaaaaattttcattgtaa

SEQ ID NO: 6565 - DNA, 50 bp, homo sapien
ctcagctcacctcatgacacaaggamgaagtgtttttagcaagatccttg

SEQ ID NO: 6566 - DNA, 50 bp, homo sapien
gattatgatttttactcaaaaaatgkcaagagattccaaccaactaatcg

SEQ ID NO: 6567 - DNA, 50 bp, homo sapien
cactttatccactggttctagttcakcttaggagccacacagaattcatc

SEQ ID NO: 6568 - DNA, 50 bp, homo sapien
tttctcttccacatgcgaattctacmgatctattaagatacgtcttgtac

SEQ ID NO: 6569 - DNA, 50 bp, homo sapien
tgttttcttatacttggttggttcakctttctaactgtatcatcttatca

SEQ ID NO: 6570 - DNA, 50 bp, homo sapien
ccctggtgagaagaggttgtacagcrcatgttccagggaagcttttcaaa

SEQ ID NO: 6571 - DNA, 50 bp, homo sapien
tgattcgccctgccataataatctcscagggttgtggtaagaagggaaag

SEQ ID NO: 6572 - DNA, 50 bp, homo sapien
ctgtaaaatatgagatttgtgtccaytacctacccctaaaacccacaatt

SEQ ID NO: 6573 - DNA, 50 bp, homo sapien
aaaacctacctactttgtcttttaamataagaagcagaagaggagcaggt

SEQ ID NO: 6574 - DNA, 50 bp, homo sapien
gatatgctttctttgaatgactatascgttgaatcatccaaaaagcacat

SEQ ID NO: 6575 - DNA, 50 bp, homo sapien
atcttgaatccacttgtgtgtcctastaaaggtacttccaaacaagctgt

SEQ ID NO: 6576 - DNA, 50 bp, homo sapien
tcaaaggatttccttctttgatttcmatggcacttggtcctcccctggct

SEQ ID NO: 6577 - DNA, 50 bp, homo sapien
tgggctattatctccaggtgccccartagttcagataattccacacagtc

SEQ ID NO: 6578 - DNA, 50 bp, homo sapien
ccttgattcaagacctgagtatggcrcactcatcactggtcaggcacaag

SEQ ID NO: 6579 - DNA, 50 bp, homo sapien
gcctaagccaggcaagtgagattaasctcctggattttcctggaaatatt

SEQ ID NO: 6580 - DNA, 50 bp, homo sapien
atatgttagaagataaatataataakgagatgtatgcctctgcttcatac

SEQ ID NO: 6581 - DNA, 50 bp, homo sapien
gcttatttccctcacttatttaataygactttcccccaaagatatttccc

SEQ ID NO: 6582 - DNA, 50 bp, homo sapien
tagcaatccatataaataaaatgacracagaggtttccatataggacctt

SEQ ID NO: 6583 - DNA, 50 bp, homo sapien
ataaaaggataaatgtagtgaaccaragtcctataaatgtatcatttctt

SEQ ID NO: 6584 - DNA, 50 bp, homo sapien
cgttttattattgatcagtcttgcarataaataagaatgctatttataaa

SEQ ID NO: 6585 - DNA, 50 bp, homo sapien
tcctaagttcagtatgggttgtcccrgataaactccagatttggcatact

SEQ ID NO: 6586 - DNA, 50 bp, homo sapien
agatgatcagaaactgggtctaaacyactgtggcactctagccaaaccaa

SEQ ID NO: 6587 - DNA, 50 bp, homo sapien
tccactactaacctcaatcctgtggycaagaattcaaattttatcctcat

SEQ ID NO: 6588 - DNA, 50 bp, homo sapien
aaatgatcagtacattactttgtaarattagaggggactctgtttctgat

SEQ ID NO: 6589 - DNA, 50 bp, homo sapien
cataacaataataaagcctacaccasaaagtgattagtctatgtaacctg

SEQ ID NO: 6590 - DNA, 50 bp, homo sapien
ctagatttccattacatttaaaaaastggatttagcaaagcttttacatc

SEQ ID NO: 6591 - DNA, 50 bp, homo sapien
tcctttgaccttgaggaggttacaaycattattacagaaaaacaaattca

SEQ ID NO: 6592 - DNA, 50 bp, homo sapien
acgatgtttatcatagttttatgtamcctgttctaaattgaatagtttca

SEQ ID NO: 6593 - DNA, 50 bp, homo sapien
cacgtagagaacttcctcttgggaamcagttgaggctgtgttgggtcata

SEQ ID NO: 6594 - DNA, 50 bp, homo sapien
aagtactggagttggctaagtatggwccactgaagtcaaactagtttaac

SEQ ID NO: 6595 - DNA, 50 bp, homo sapien
tgctgtgaccatgttttgattgaaakatacacatgtccagtgaattcctg

SEQ ID NO: 6596 - DNA, 50 bp, homo sapien
acttacttttatgggtccatatagcratcaacttagttttcacagaaata

SEQ ID NO: 6597 - DNA, 50 bp, homo sapien
ccctttccacattttagacactgaakaatactgttgctatggtctgaatg

SEQ ID NO: 6598 - DNA, 50 bp, homo sapien
atatgattataatgtatcatataacmaatgccctattactagacacacag

SEQ ID NO: 6599 - DNA, 50 bp, homo sapien
aagatgtttcttctacttcggattarataaggtaatacatttggaaatta

SEQ ID NO: 6600 - DNA, 50 bp, homo sapien
ttttctagaatcagtcaagttttcartaatatgcagcagaggtcaagttc

SEQ ID NO: 6601 - DNA, 50 bp, homo sapien
tcactcccttagagctgttggacaamctttggctaataaagattaaacaa

SEQ ID NO: 6602 - DNA, 50 bp, homo sapien
aatgtggcatggtcccagtgagaackggaaagaattgttttaaaaatgaa

SEQ ID NO: 6603 - DNA, 50 bp, homo sapien
gcttggcaaacacaggtgcccaatcracaggcttccttaccaaagtaaag

SEQ ID NO: 6604 - DNA, 50 bp, homo sapien
atttgaacaaattcattaaaagcaaytctatgtgaagcaaaaatacagag

SEQ ID NO: 6605 - DNA, 50 bp, homo sapien
tcttaaaagtgaatttgcagtatgayagatgaattagtggagaaagaata

SEQ ID NO: 6606 - DNA, 50 bp, homo sapien
tatactgagtacagcttagtatgtasagacaaagactcaagaggatcttc

SEQ ID NO: 6607 - DNA, 50 bp, homo sapien
aagctctatgtgtaaagtaggagtayagcattaagcaagtagttgaaacg

SEQ ID NO: 6608 - DNA, 50 bp, homo sapien
acagaaatcacctttttaagacacckcagagttgtgccatcaatgaggac

SEQ ID NO: 6609 - DNA, 50 bp, homo sapien
caggtcttcaggggcttcaactcacratccatgcacaaggcagaaaagtc

SEQ ID NO: 6610 - DNA, 50 bp, homo sapien
taggagcagacagggtaccaacaacyaagtgtccatatgaagctacctga

SEQ ID NO: 6611 - DNA, 50 bp, homo sapien
tcctgacgcagggctgccttcagatyagtgcattctctcccacatctcaa

SEQ ID NO: 6612 - DNA, 50 bp, homo sapien
tggaaataactttgacacaacattcrattatacaagtccaagttgctgtc

SEQ ID NO: 6613 - DNA, 50 bp, homo sapien
gaagacccacagctgctagacccagrcaggctttcaacagactcctaacc

SEQ ID NO: 6614 - DNA, 50 bp, homo sapien
ctaggtaagtttcactttttgcaagmatcccaagtgaccctttgcactat

SEQ ID NO: 6615 - DNA, 50 bp, homo sapien
ggctgaagttctggcttggagtaagragattcacagaactgcagtgctaa

SEQ ID NO: 6616 - DNA, 50 bp, homo sapien
ggctgcggggctgatcacgctgtcaragggaccactctattctcttttgg

SEQ ID NO: 6617 - DNA, 50 bp, homo sapien
ttagaaataatattttttgcagccaygtaaattgtttcatcttctattta

SEQ ID NO: 6618 - DNA, 50 bp, homo sapien
cactgtctaaagtggcctttcaactmaactgggatgtgtaagtggagtcg

SEQ ID NO: 6619 - DNA, 50 bp, homo sapien
gtgagggataaggtgaggcaaaaacrctcagaagcaacagatattggggt

SEQ ID NO: 6620 - DNA, 50 bp, homo sapien
aaagcaaaattaaatttacccaatcrctttaacaacatttttttaagtca

SEQ ID NO: 6621 - DNA, 50 bp, homo sapien
acaatggaagattggttataatttayggtatgactgtaagtgtaagtata

SEQ ID NO: 6622 - DNA, 50 bp, homo sapien
agcaattcttgcatctccatagatckacttcctggccagtcatttcttta

SEQ ID NO: 6623 - DNA, 50 bp, homo sapien
agtttgcagcagggattcgatgagtraacacttggacggtgcctggaata

SEQ ID NO: 6624 - DNA, 50 bp, homo sapien
atcaacagctcgtgcctaaggatcckggaagtcatatcatacagcatatt

SEQ ID NO: 6625 - DNA, 50 bp, homo sapien
ccgttccccagcataaatttttgagracactcttactagttgccaaggat

SEQ ID NO: 6626 - DNA, 50 bp, homo sapien
gcataattactatttgagacatcagmaataggcagagatcaaaagcctaa

SEQ ID NO: 6627 - DNA, 50 bp, homo sapien
aaaactagttacagagataagacaayatgtgaagtaaatacagtaaatca

SEQ ID NO: 6628 - DNA, 50 bp, homo sapien
atggtggtgacttcgtgttaatcaartccttgtttctatgcaaatcattt

SEQ ID NO: 6629 - DNA, 50 bp, homo sapien
ttagaacactgttgttgatggtccartatgaagagagggcaaccaaatag

SEQ ID NO: 6630 - DNA, 50 bp, homo sapien
gaacccagtgtctagcctacgtaggratgtgtgtcatgcctttggagagc

SEQ ID NO: 6631 - DNA, 50 bp, homo sapien
gccaagcatttgtcatggacaaggasaatgacaggatatatgggcacaca

SEQ ID NO: 6632 - DNA, 50 bp, homo sapien
aggctgaaggcaactcttgacaatamctaagctgaagaaattgagagtaa

SEQ ID NO: 6633 - DNA, 50 bp, homo sapien
acatcagtgtctgtctagataagaaytgattcctgaaccaggaaaccaag

SEQ ID NO: 6634 - DNA, 50 bp, homo sapien
atgtggaacgagcagtttctgttccrcgttcacttcgaagatcttgtatt

SEQ ID NO: 6635 - DNA, 50 bp, homo sapien
gacagatgctgtttggagaactaaaytggcctacagaggacaatgctgag

SEQ ID NO: 6636 - DNA, 50 bp, homo sapien
attaattcaaaagagaacagtagaartaagagaaagagaagcaggagctt

SEQ ID NO: 6637 - DNA, 50 bp, homo sapien
tgcacaaatcagtgtaaccctgctayacctctgaaacaatgcacataatg

SEQ ID NO: 6638 - DNA, 50 bp, homo sapien
attcagatatgtctcctcaggaggtmaataggttctaaactaccctggtg

SEQ ID NO: 6639 - DNA, 50 bp, homo sapien
tatttacttggatggagtttattcargtttaatgtcttaactgctgtggg

SEQ ID NO: 6640 - DNA, 50 bp, homo sapien
ttaagattaaaacataaaggaaaaawtaacacattatagcatacaaagta

SEQ ID NO: 6641 - DNA, 50 bp, homo sapien
ctataagatctctctgagataaacaytgattttaacattcttggaaagac

SEQ ID NO: 6642 - DNA, 50 bp, homo sapien
attaggaaaagagaaagcccagaccrcttctaattgataataataatttt

SEQ ID NO: 6643 - DNA, 50 bp, homo sapien
gcttaaatccgtctactgttgtcccraaattcactcatgagacatgcaaa

SEQ ID NO: 6644 - DNA, 50 bp, homo sapien
aggcttaccaataagcctggaacaawttctttctaatacatattaaaggc

SEQ ID NO: 6645 - DNA, 50 bp, homo sapien
gcaaatgacaggtataagagttcacraaataccttgagaaggaagaaatc

SEQ ID NO: 6646 - DNA, 50 bp, homo sapien
tgatgccacttagaccacagattccragcaggctcattggcttttcccag

SEQ ID NO: 6647 - DNA, 50 bp, homo sapien
tttttaagaaatggagcagtataatractttttttcactcatgtgtgaat

SEQ ID NO: 6648 - DNA, 50 bp, homo sapien
tatggagttctggtgttactctagakacttcggaccttcatgcagataaa

SEQ ID NO: 6649 - DNA, 50 bp, homo sapien
  misc_feature (9)..(9): n is a, c, g, or t
atgactcanaacccttttattggtakgtgacatttgaaagtgcaataact

SEQ ID NO: 6650 - DNA, 50 bp, homo sapien
gtgaaaattgaacttctctgaagaawtaatttatgcctgttgtaaaggaa

SEQ ID NO: 6651 - DNA, 50 bp, homo sapien
attttggtttgaataattttggacasgatatttggtgttcagttcaccac

SEQ ID NO: 6652 - DNA, 50 bp, homo sapien
tctggacgagataaacataaaagaamcactctaccaccctcacacattct

SEQ ID NO: 6653 - DNA, 50 bp, homo sapien
atttttaattctatccaaaacaagcyattagaatgacatcaagtgtttga

SEQ ID NO: 6654 - DNA, 50 bp, homo sapien
ctcattaggaaatttagaacaaataygatgatatctttaaagaaaatggc

SEQ ID NO: 6655 - DNA, 50 bp, homo sapien
ggtaccctggttgtagaaagtatcarggtattcagattcagtggtggtgg

SEQ ID NO: 6656 - DNA, 50 bp, homo sapien
cctattactcatcaaccttgtaggcrgaattgactgatgcagcctacaca

SEQ ID NO: 6657 - DNA, 50 bp, homo sapien
tacaccctaaatgtgcttaaaaagasatcattctttcaatttctaattct

SEQ ID NO: 6658 - DNA, 50 bp, homo sapien
cttgaaaatataaacacatttgcaargtcataataacaaggaaagatgaa

SEQ ID NO: 6659 - DNA, 50 bp, homo sapien
cagttatgatggagacctagagttawggaattccaaagccttacagctct

SEQ ID NO: 6660 - DNA, 50 bp, homo sapien
tttctcacctgtctgaggactaacaygggctaacacgaggcagtcatctt

SEQ ID NO: 6661 - DNA, 50 bp, homo sapien
ctatagtgacttgattttgatgggtraaaaatagcatgtaatcacaggtt

SEQ ID NO: 6662 - DNA, 50 bp, homo sapien
ataaaacaagtgtagggattggaaartaactcagactttgtaaaaacaga

SEQ ID NO: 6663 - DNA, 50 bp, homo sapien
gataaggtggtttctgtcattttaasatatgctgaaactttttctcacta

SEQ ID NO: 6664 - DNA, 50 bp, homo sapien
aatcataatggctatgttttccaacycagttttccaggagatacaacaca

SEQ ID NO: 6665 - DNA, 50 bp, homo sapien
caatgtcccactataagaggtcaccmaaaggtttctttgtcaagtaccca

SEQ ID NO: 6666 - DNA, 50 bp, homo sapien
aaataataataatatattgcaacacraatccaaagagaaattatttgaag

SEQ ID NO: 6667 - DNA, 50 bp, homo sapien
gaggaggatgactgagatgagtaaaracagtatggcagtagcaaaataaa

SEQ ID NO: 6668 - DNA, 50 bp, homo sapien
agctcccagtacagatgtgtatggcraagaaaggatctctcttggaaacg

SEQ ID NO: 6669 - DNA, 50 bp, homo sapien
gctctctgcttgtgggagtgaaccargaaacctcagtggttcttcaatgg

SEQ ID NO: 6670 - DNA, 50 bp, homo sapien
tctcacatgtttcctctagactggartattaatatgcagacagccctaaa

SEQ ID NO: 6671 - DNA, 50 bp, homo sapien
tttaatagctaatcaaaatgactcckgctaagtaatagggtatgagccga

SEQ ID NO: 6672 - DNA, 50 bp, homo sapien
agacatcctcagtgtgaggattgaaraagataatataaggcacatggaaa

SEQ ID NO: 6673 - DNA, 50 bp, homo sapien
ctatagaaggatcatcaagtaggcaytgaatgattacaaacgaagcctgg

SEQ ID NO: 6674 - DNA, 50 bp, homo sapien
ccagttacatcatagaaagtttagaygacactgtaatttaatcacaccgc

SEQ ID NO: 6675 - DNA, 50 bp, homo sapien
ctttgtcactctgcagtttcatacartgtacctaggtgtgggcttcttat

SEQ ID NO: 6676 - DNA, 50 bp, homo sapien
gcaaaaagactgtgaagtaagtcggrcccagatggtggagaatcttgaat

SEQ ID NO: 6677 - DNA, 50 bp, homo sapien
aattggctcaccattctgcagactgyataggaaacatggtactggcatgt

SEQ ID NO: 6678 - DNA, 50 bp, homo sapien
cttgaatatgaatgagtcttgcaaayttaaggctgtataaaaaaaaaaaa

SEQ ID NO: 6679 - DNA, 50 bp, homo sapien
ttgattcacagcattttatggatacmaggccctggaaagatagtagctaa

SEQ ID NO: 6680 - DNA, 50 bp, homo sapien
tagataagcaggaatcaggtgttaaygaggaccaccttggcatgagtaga

SEQ ID NO: 6681 - DNA, 50 bp, homo sapien
cgcatatcacattttcctaattctcygactagtgtcaaccctgtgtcatt

SEQ ID NO: 6682 - DNA, 50 bp, homo sapien
caactaaccatgccccatctttacarctgcttctgacattcatttatgac

SEQ ID NO: 6683 - DNA, 50 bp, homo sapien
tgttagtgtaagcctggaaatcagasaatgtcaagctaaggcgctctact

SEQ ID NO: 6684 - DNA, 50 bp, homo sapien
tgttgccatgattgtgtaaaacctgmactgctttacgtctgtcttacaat

SEQ ID NO: 6685 - DNA, 50 bp, homo sapien
aattgatgaagacatggtaagagaarctgttggaagatacttgaaagaaa

SEQ ID NO: 6686 - DNA, 50 bp, homo sapien
gccagagacgggaatgcataagagcraaaggactgggcaggctcatgtgt

SEQ ID NO: 6687 - DNA, 50 bp, homo sapien
actggacggttagatgtaaggatgcyaatatttgacaaaaccaacactct

SEQ ID NO: 6688 - DNA, 50 bp, homo sapien
ctccaaaaggagagggtccatgctcraatgtttgctagtgtgcatgtcaa

SEQ ID NO: 6689 - DNA, 50 bp, homo sapien
aggacttatagggaagaaaccaggcsagctaagtctgtctgtaggacatt

SEQ ID NO: 6690 - DNA, 50 bp, homo sapien
tgcttagtcctgggcctagaatcgtwaacttgagcacaaagtggaactat

SEQ ID NO: 6691 - DNA, 50 bp, homo sapien
cacttttgttcatgctgttcctgtcrcctaagataccctaggataactat

SEQ ID NO: 6692 - DNA, 50 bp, homo sapien
ttcacctacaatcccacagtaaaaayggcagaatcaagtaagtaccaaaa

SEQ ID NO: 6693 - DNA, 50 bp, homo sapien
aaggctgagagtgattcaccccatayataaagactataacttcctcttga

SEQ ID NO: 6694 - DNA, 50 bp, homo sapien
accttatatcacataagtttctcaaygcacataagtaaacataatgatgg

SEQ ID NO: 6695 - DNA, 50 bp, homo sapien
gatgttgcccacaggaatgtttatayatatagtgcacacatagatgtttc

SEQ ID NO: 6696 - DNA, 50 bp, homo sapien
ctccagtctgtgtagcaggaaaaacraatcacattagaataactttaagc

SEQ ID NO: 6697 - DNA, 50 bp, homo sapien
agcacaaggagatcgttggtatggasgaaactgacatagtgggggtagtt

SEQ ID NO: 6698 - DNA, 50 bp, homo sapien
taaaagataaatcaacattcaaataractaaactcttcctattgctgctc

SEQ ID NO: 6699 - DNA, 50 bp, homo sapien
tgtcatgagaaatgagttcagtttgraggattctaaaagtctaggtgagg

SEQ ID NO: 6700 - DNA, 50 bp, homo sapien
cctcccagctgatttattcttaggawctgtaatgctcgcctgcatgtgcc

SEQ ID NO: 6701 - DNA, 50 bp, homo sapien
gggacggaggtgccatcgctttaaaygtggggaatagaagaaacttgcca

SEQ ID NO: 6702 - DNA, 50 bp, homo sapien
agacaagcttccttgaccattctctraattcttctctaggcacccctctt

SEQ ID NO: 6703 - DNA, 50 bp, homo sapien
atgatatatgtcttcagaactggccyatactacaagtctagcagttaacc

SEQ ID NO: 6704 - DNA, 50 bp, homo sapien
ctgtgggaagatagagtcaaagaacygtaaataataataaaattggacca

SEQ ID NO: 6705 - DNA, 50 bp, homo sapien
aagagacctctgaaagaaaatgttayggatcacagagaccagaaagttgg

SEQ ID NO: 6706 - DNA, 50 bp, homo sapien
cctagctgatgagatagctgggttargaatgacaaaattattggttttat

SEQ ID NO: 6707 - DNA, 50 bp, homo sapien
tattaaagattcaggatcattaagastcaggctggattgaaatttatctc

SEQ ID NO: 6708 - DNA, 50 bp, homo sapien
tttgctccaagcttctgtgatacacmaatactgtctttgatagccctgat

SEQ ID NO: 6709 - DNA, 50 bp, homo sapien
agtttctctgtttgcttgtcatagcracatttagaaactcgaacatgctt

SEQ ID NO: 6710 - DNA, 50 bp, homo sapien
gccggtgtataggaaaataaaaatckaaagagatcacaaacatttgccat

SEQ ID NO: 6711 - DNA, 50 bp, homo sapien
ttatagttatggcagtaaacttatayggaattgtagtaaaaaacacacca

SEQ ID NO: 6712 - DNA, 50 bp, homo sapien
tgtacttgcacatataccctggggcygaactcctttgagtctcagttccc

SEQ ID NO: 6713 - DNA, 50 bp, homo sapien
tggtcctgcctgtagcgtaactgaakcaaaggggcaaaccgtcactcagc

SEQ ID NO: 6714 - DNA, 50 bp, homo sapien
ccttaagattgctttgcaaatataaygagaaggtaagagtagaaggagaa

SEQ ID NO: 6715 - DNA, 50 bp, homo sapien
ttagaagatgttaaaggttactggcyatttatcatagtaaccaaggcagt

SEQ ID NO: 6716 - DNA, 50 bp, homo sapien
gaaatcaaagactaaactttggttaygaattggaagacccaattttctta

SEQ ID NO: 6717 - DNA, 50 bp, homo sapien
tgtcacaccacctcaccacagtgacrgcaattcagagtgctggtgggcag

SEQ ID NO: 6718 - DNA, 50 bp, homo sapien
ttcattgaatctgaataacaacaacyctattgtctgagctgaggttcaga

SEQ ID NO: 6719 - DNA, 50 bp, homo sapien
aaacaaggtgatttcccttgaggacratacaatcaggggtattcataaaa

SEQ ID NO: 6720 - DNA, 50 bp, homo sapien
agtgatgatggcagggatcacaggckgattatataaagttcttagtgttt

SEQ ID NO: 6721 - DNA, 50 bp, homo sapien
aagctactgagatggttcagaaacakgcagagataagaatagcttaggat

SEQ ID NO: 6722 - DNA, 50 bp, homo sapien
ccacagttgttgggtctgtgggttayatcggtctccttgatttattcaga

SEQ ID NO: 6723 - DNA, 50 bp, homo sapien
agtatgcactgtactggagtacgatragcaatgcctacagtaaaactatt

SEQ ID NO: 6724 - DNA, 50 bp, homo sapien
gcttaaaagtgtaataactgagattwaaaattcactagtgggattcaaaa

SEQ ID NO: 6725 - DNA, 50 bp, homo sapien
tgataaggcaaaggattaaattaaayggtacatcctgtccctcatatctt

SEQ ID NO: 6726 - DNA, 50 bp, homo sapien
tgtgttgcatgcatgtgaagttataygacatgatgaaggtaggaaagtta

SEQ ID NO: 6727 - DNA, 50 bp, homo sapien
gcaataagcttatgagacaggaacartagcaataaacaaaccgaacaaga

SEQ ID NO: 6728 - DNA, 50 bp, homo sapien
ctttggatccctccctgctccttccrcaatctacagaagcagatagcctc

SEQ ID NO: 6729 - DNA, 50 bp, homo sapien
tcctgttaagagttatttatactcamcatttattttaaaaagcttattta

SEQ ID NO: 6730 - DNA, 50 bp, homo sapien
agcaaagtgaccattctgagtcttgsaactttacctataacagaggagac

SEQ ID NO: 6731 - DNA, 50 bp, homo sapien
agtttcgaagggtggaattaaatacycgtgtctgttgacaaggtctgcaa

SEQ ID NO: 6732 - DNA, 50 bp, homo sapien
ttaataggggtgaggcacacggatayccaataaatcattaaaggatctgt

SEQ ID NO: 6733 - DNA, 50 bp, homo sapien
ttcaggtgtactccactgagatacaytgaggattgtcaacaatcaaagac

SEQ ID NO: 6734 - DNA, 50 bp, homo sapien
ggtagcatggagcgatagatgagagrcagttattttgcctctcaggttca

SEQ ID NO: 6735 - DNA, 50 bp, homo sapien
gaacacccattaaaatgccactgtartaatgtcattgtttgctcgtcatt

SEQ ID NO: 6736 - DNA, 50 bp, homo sapien
ggactggaactatgtaacctagaaakaattaatgtgaacaacatgctatg

SEQ ID NO: 6737 - DNA, 50 bp, homo sapien
gacccagtgaaggaacttgactgacsacctggatatggaggattgagttg

SEQ ID NO: 6738 - DNA, 50 bp, homo sapien
gttaacatagccccctgccctttgcrcatgagaatttgacctttcattga

SEQ ID NO: 6739 - DNA, 50 bp, homo sapien
ttcttcaacttcattccctacttcaratgtttcaactcagctcaactccc

SEQ ID NO: 6740 - DNA, 50 bp, homo sapien
aacattctatatacacatctaaatcyaactcaacaattctaactcgataa

SEQ ID NO: 6741 - DNA, 50 bp, homo sapien
cacacagacacatccatgagggcaartagcccaggccgagctaccacatc

SEQ ID NO: 6742 - DNA, 50 bp, homo sapien
ctgtgaaggcaaagtgaagtgcagaygaatctcattacaagagataggga

SEQ ID NO: 6743 - DNA, 50 bp, homo sapien
gcgaggaggaaaatcctaagtataakgcaaggaggtctggaaggagacag

SEQ ID NO: 6744 - DNA, 50 bp, homo sapien
ctgcggtccaagaatggaaccagaaygacacgtacaacctctacatctca

SEQ ID NO: 6745 - DNA, 50 bp, homo sapien
agtagggtcttgaagtctaagaaagwattgtcattgtctgatttgactcc

SEQ ID NO: 6746 - DNA, 50 bp, homo sapien
ctctgtcactcttgcttttgttccawatcattaaaagaagtagcctcaga

SEQ ID NO: 6747 - DNA, 50 bp, homo sapien
gcatgaaacaagtgtcagaatattasaatgaaggtacatgatgtgaagtt

SEQ ID NO: 6748 - DNA, 50 bp, homo sapien
ttttttaaatctgaaattaaacccaktcttgaacttaaacatacatctct

SEQ ID NO: 6749 - DNA, 50 bp, homo sapien
gtattgctttaattatcataataacygtgttcttccctgaacttcaccag

SEQ ID NO: 6750 - DNA, 50 bp, homo sapien
tcaaagtactttattgtattaactckcaaaatattctcatgagatacaca

SEQ ID NO: 6751 - DNA, 50 bp, homo sapien
atgcagtaagtatacacataagtatraccgtaaattaggaataagattat

SEQ ID NO: 6752 - DNA, 50 bp, homo sapien
gtgaacatcaggacagaaacaagtargaatcatgcctgatgttattttct

SEQ ID NO: 6753 - DNA, 50 bp, homo sapien
cttagttatttctatctgtccaatayatcacaggtgctcagcaaatgtta

SEQ ID NO: 6754 - DNA, 50 bp, homo sapien
catgtctcagtgactggggagaacamagtaatgaggtacacacagactgt

SEQ ID NO: 6755 - DNA, 50 bp, homo sapien
tatattaataatcatcttctgtaaaygcctgcacaatatgagcacatctg

SEQ ID NO: 6756 - DNA, 50 bp, homo sapien
tatccaaaataatctaggggaagtayattctgttagtgataggaaatttt

SEQ ID NO: 6757 - DNA, 50 bp, homo sapien
agctttattcgaattgtaatacagcratgaacttcagactatcctcagct

SEQ ID NO: 6758 - DNA, 50 bp, homo sapien
cttggtatttaaaagtatgctttaawgtaatattgggtgtgtttctctac

SEQ ID NO: 6759 - DNA, 50 bp, homo sapien
aggattaagtgaaatcatagccgtargaactcagaactgttctgccacta

SEQ ID NO: 6760 - DNA, 50 bp, homo sapien
taaacatactggtgtatatgccaaasagtaatagatagcagaaggaaagg

SEQ ID NO: 6761 - DNA, 50 bp, homo sapien
attttaatcatttcctgttatagccrgtttgtgttggataaacgtgtcat

SEQ ID NO: 6762 - DNA, 50 bp, homo sapien
tatataatgaataaagttacattagrcctagattataagaaaatgtttca

SEQ ID NO: 6763 - DNA, 50 bp, homo sapien
ctgtgtcacagatccttggtgtcagycagatcaaagtttgtaatgagact

SEQ ID NO: 6764 - DNA, 50 bp, homo sapien
cttagaggtgacaatgaggatggaayagtcaaggaaatgtgtgggaatct

SEQ ID NO: 6765 - DNA, 50 bp, homo sapien
cgcatctcacaaactaaggaccaaaktctgaaacgagttatctgcaagga

SEQ ID NO: 6766 - DNA, 50 bp, homo sapien
atgcccagccagtaagacccgtctakaataagaggcacaaaataatacaa

SEQ ID NO: 6767 - DNA, 50 bp, homo sapien
agtgtactcctttaaacttccaagayattaaaagcaagtcatctacaaga

SEQ ID NO: 6768 - DNA, 50 bp, homo sapien
gtgttaaaataagaatttttccatawacttcaaagtgcttaaaccaaaag

SEQ ID NO: 6769 - DNA, 50 bp, homo sapien
cctgcataggctgactaaagtgctasggttctcataaactagtacataaa

SEQ ID NO: 6770 - DNA, 50 bp, homo sapien
gatcagcagtctgtgacatttggaaycaagtctagagtgggaatgggtgg

SEQ ID NO: 6771 - DNA, 50 bp, homo sapien
tactttgatttggccctaatggagaycagttggtgtatataactttttgc

SEQ ID NO: 6772 - DNA, 50 bp, homo sapien
tctcctgttccaggctggtaggtaaygtgtactttgtcctttctcattgg

SEQ ID NO: 6773 - DNA, 50 bp, homo sapien
ctcctacaagacacaaactccatccrggactgtatttctgggttcttctt

SEQ ID NO: 6774 - DNA, 50 bp, homo sapien
agatccagcaggaggttagcgtgaargaatcacatcagatataggtaaga

SEQ ID NO: 6775 - DNA, 50 bp, homo sapien
gagagttggactgatgccggaagaartagaagtcttgtgtcgatgttgaa

SEQ ID NO: 6776 - DNA, 50 bp, homo sapien
tgcaagccagggatatggtaaagaayatgatgagatgtactcaaggttag

SEQ ID NO: 6777 - DNA, 50 bp, homo sapien
cagagctctttttacatgagagaaamaggaatgatcaagttcaagcccca

SEQ ID NO: 6778 - DNA, 50 bp, homo sapien
aaatgctagttgaataggatctggartacaggtttattaaaaaactaatt

SEQ ID NO: 6779 - DNA, 50 bp, homo sapien
ttttaatggaaatcaactgtccaacygtatttgtattacaataataacct

SEQ ID NO: 6780 - DNA, 50 bp, homo sapien
acttaaaatttccacatgcagattgsagtttacagcagggaattacaaat

SEQ ID NO: 6781 - DNA, 50 bp, homo sapien
cacactatttacttgaaagtttccamtcttgtaacaattattctcgtttt

SEQ ID NO: 6782 - DNA, 50 bp, homo sapien
ttccaacatgatatccatgggatagmaattcaattaaaaactgcaagtag

SEQ ID NO: 6783 - DNA, 50 bp, homo sapien
gagtttacagcagggaattacaaatkataagggagatcactgctatatat

SEQ ID NO: 6784 - DNA, 50 bp, homo sapien
gttggctctgttctttgccttagcarcttgttaggatccttgctctcagc

SEQ ID NO: 6785 - DNA, 50 bp, homo sapien
taaatgtctaccaacggggagacgamctgacatcctgtttgacaaaggta

SEQ ID NO: 6786 - DNA, 50 bp, homo sapien
cagtttaattgggtagttatatttgwagactatgcaatagtaagtcctat

SEQ ID NO: 6787 - DNA, 50 bp, homo sapien
atgaagggattaaaaatgagatagarcagaaatgctgtgagaatttatgt

SEQ ID NO: 6788 - DNA, 50 bp, homo sapien
caaaagcccttcttgtgaaaatgacrgacacattcgtgtgaccagctctc

SEQ ID NO: 6789 - DNA, 50 bp, homo sapien
ttatattctcctataattttttaaaygagactagctctaggatcctgtgg

SEQ ID NO: 6790 - DNA, 50 bp, homo sapien
gagggttgggacttcttctttgttamcaccacccacatgcaacaaagatg

SEQ ID NO: 6791 - DNA, 50 bp, homo sapien
ccaaaagcacaggaactagagtagcraactgtaacaaaaccacagacctc

SEQ ID NO: 6792 - DNA, 50 bp, homo sapien
ttttttttctttcccagaatcaagartaaaagcaacccagacaactcttt

SEQ ID NO: 6793 - DNA, 50 bp, homo sapien
cctccctcccagacagatggtaagcratttgtcttcatacccatgtggtg

SEQ ID NO: 6794 - DNA, 50 bp, homo sapien
atagtttctatgggctggataaggcygaactcttgacaaagagatcccag

SEQ ID NO: 6795 - DNA, 50 bp, homo sapien
ggaaaagagcgcttgaattctaaaasagcaaagaaaagatatacattcta

SEQ ID NO: 6796 - DNA, 50 bp, homo sapien
ctcagacaagcaaacactgagagaartcatttcaattagaccagccttac

SEQ ID NO: 6797 - DNA, 50 bp, homo sapien
gttttttaaaaaaatctttggactgsatcttactgaagtgcagttgctat

SEQ ID NO: 6798 - DNA, 50 bp, homo sapien
gacatctcttagttttgccagtttgyaagtagaccaatgagaagaaagaa

SEQ ID NO: 6799 - DNA, 50 bp, homo sapien
atgctacttttttaattccaggtgaygacaaaggtacaattcctgacttt

SEQ ID NO: 6800 - DNA, 50 bp, homo sapien
tcctgaagaataacacaagaggaatmacaggttaccagtaaggtgtcagc

SEQ ID NO: 6801 - DNA, 50 bp, homo sapien
ataaagacccatggtgttagagaaaraaagtcatgaatctaaatattaac

SEQ ID NO: 6802 - DNA, 50 bp, homo sapien
catagattcttgttactcctcataaygagtggtagaattaaatcttcctc

SEQ ID NO: 6803 - DNA, 50 bp, homo sapien
aaaaagccaccttcaaacttagaaaycctgctatttaaggtctaagctga

SEQ ID NO: 6804 - DNA, 50 bp, homo sapien
aaaaaagagtagagataatagtaccraataatacgattgttgtgaaaggt

SEQ ID NO: 6805 - DNA, 50 bp, homo sapien
actcacaaacaccctatctgtgaacmaactgctcatgtcatactgcccta

SEQ ID NO: 6806 - DNA, 50 bp, homo sapien
aaagtatgtatagtatcagatgaaasaagacagtcatgttgggccacaat

SEQ ID NO: 6807 - DNA, 50 bp, homo sapien
ttcaaaggatagtttgcataattaartaggaaaagagaagcatgaaataa

SEQ ID NO: 6808 - DNA, 50 bp, homo sapien
ttaattctaccttggacacccgttgragataacaaaactatcttggattt

SEQ ID NO: 6809 - DNA, 50 bp, homo sapien
aagagacaaggtttctacgtaggcaytcttattcccagtatgttcttgat

SEQ ID NO: 6810 - DNA, 50 bp, homo sapien
aagcttccccaaaagtccatcattarcttcttcatatttaagtatatgtg

SEQ ID NO: 6811 - DNA, 50 bp, homo sapien
tattcgggaaaccaataacacaatamaatgggccaccaaccaacttgaca

SEQ ID NO: 6812 - DNA, 50 bp, homo sapien
ctggggtatcaggccttgagagaccrggaccgtattatgaaggaccatca

SEQ ID NO: 6813 - DNA, 50 bp, homo sapien
atttttctgagtactttttctaaacyaacgcaaaggactatcagcttcca

SEQ ID NO: 6814 - DNA, 50 bp, homo sapien
acctgattttcttgtcttttcattcraatagtttttattttgcttttagg

SEQ ID NO: 6815 - DNA, 50 bp, homo sapien
tggtgatttacaagaacataaattasaacattgtggaaatttgtcaacat

SEQ ID NO: 6816 - DNA, 50 bp, homo sapien
tataaaaaaattaaattcacatggasaaaagtaatccccaaaaatcaaga

SEQ ID NO: 6817 - DNA, 50 bp, homo sapien
tcagtactgctttcctaccaaggcaygttcacctgtcatctcattgactg

SEQ ID NO: 6818 - DNA, 50 bp, homo sapien
taggaaagattggagggaatgattayacttaaaagccaggctaaaacaag

SEQ ID NO: 6819 - DNA, 50 bp, homo sapien
gacggctttcagctcggagaaatccygctttatcttcttggctacagagt

SEQ ID NO: 6820 - DNA, 50 bp, homo sapien
tggctatagtttctgttgggcagtaktaacagattaggctgaggtcaggc

SEQ ID NO: 6821 - DNA, 50 bp, homo sapien
aggaaaattttaagtgacttaacaawgattaggcacaggctcatggacca

SEQ ID NO: 6822 - DNA, 50 bp, homo sapien
gcatttgagtgaaatacagactgaargttattggttacccatccagaaag

SEQ ID NO: 6823 - DNA, 50 bp, homo sapien
cacatgtgtaaatagtgtacacataygctcagctcctaattatcacccta

SEQ ID NO: 6824 - DNA, 50 bp, homo sapien
ggagaaagaactctactgaccaactsaaattatttctattctttgaagat

SEQ ID NO: 6825 - DNA, 50 bp, homo sapien
aggctggcaaacatctagactattayaaaattcttcagatctaatgctct

SEQ ID NO: 6826 - DNA, 50 bp, homo sapien
aatatgtgtatttttgaatcaataamctgcatgtaaaaatcaaaaagttc

SEQ ID NO: 6827 - DNA, 50 bp, homo sapien
aacaaaaagtatgcattcattcatamgtgtttacctaattatttgcattt

SEQ ID NO: 6828 - DNA, 50 bp, homo sapien
catcttcactgctgtgagcctttgaygatccaatgttgtcaggtatgatt

SEQ ID NO: 6829 - DNA, 50 bp, homo sapien
ttctatgtcagattttagctcacacratcctcacatcactcctatcagtt

SEQ ID NO: 6830 - DNA, 50 bp, homo sapien
agatgttggaaatcctatccttctaygtgtacgggtgcctcaaacacagt

SEQ ID NO: 6831 - DNA, 50 bp, homo sapien
gccacctcttagcctctgtatttcargctaatttcatgctaagcagggtg

SEQ ID NO: 6832 - DNA, 50 bp, homo sapien
cagttctttggagatgagaccggtargaatcttagtaggtagaggagggt

SEQ ID NO: 6833 - DNA, 50 bp, homo sapien
aaaaaaaccaagattgtggacaaacsacacaaaatgtagtcgtgaacgta

SEQ ID NO: 6834 - DNA, 50 bp, homo sapien
atcaaagctttactagtgacaaataygtggccttgaaaaacatcatttga

SEQ ID NO: 6835 - DNA, 50 bp, homo sapien
gtgttgaaataccaggtgttcaggayatgctgagagcaagaagcaggcca

SEQ ID NO: 6836 - DNA, 50 bp, homo sapien
agtcatagatgctttcaaacaaatgwagggttagagaacaaagcaatgtg

SEQ ID NO: 6837 - DNA, 50 bp, homo sapien
ttgctcagggcagagtagatcataartaccatgacacagaaaccaacaag

SEQ ID NO: 6838 - DNA, 50 bp, homo sapien
gtggaatttagaaggcttttcataayatttaacgaattaagaaaacctga

SEQ ID NO: 6839 - DNA, 50 bp, homo sapien
tacaaagttcataagctccttgttcyatagtatattgttatctccattct

SEQ ID NO: 6840 - DNA, 50 bp, homo sapien
attgaaaaatacttcaatctaataamtcaaaagaaatcatttctgaaact

SEQ ID NO: 6841 - DNA, 50 bp, homo sapien
gttcctcatcttccttcattggctaygcgagtttattccacacagcactt

SEQ ID NO: 6842 - DNA, 50 bp, homo sapien
ctttgactctcttttcctctctaacratgataggttggcatttactcaat

SEQ ID NO: 6843 - DNA, 50 bp, homo sapien
ttctaaagcatctgatgttttcaaayggtaatgaagagtttggccaagat

SEQ ID NO: 6844 - DNA, 50 bp, homo sapien
gcactgggggcaaaatagaaaagacragtgctcaactgcattcagatgaa

SEQ ID NO: 6845 - DNA, 50 bp, homo sapien
ttgcaaggtcccatttatggaggtaraacttcagactctgttctatagat

SEQ ID NO: 6846 - DNA, 50 bp, homo sapien
aggaatcataaaacagccattgcaarttaaatgaatgatgtttagttatt

SEQ ID NO: 6847 - DNA, 50 bp, homo sapien
tctctgaagcccctgtgctctaagayggactctcagttgtgctgacaaac

SEQ ID NO: 6848 - DNA, 50 bp, homo sapien
ctacagaaatctgtccttgtgaaccygaacagagcagcagcttccttcca

SEQ ID NO: 6849 - DNA, 50 bp, homo sapien
tgaataaagaaactctctactattamggttatttggcgtgtttcataata

SEQ ID NO: 6850 - DNA, 50 bp, homo sapien
gagctatttcagttgattactcacarcgcaaaacaagtatatttggtatg

SEQ ID NO: 6851 - DNA, 50 bp, homo sapien
tcaactccctgtcactggatattacygaagattcaccctcagtttaaatt

SEQ ID NO: 6852 - DNA, 50 bp, homo sapien
gacaccgcaattgcatagcggattawaaataagagatttgaatccgtttt

SEQ ID NO: 6853 - DNA, 50 bp, homo sapien
tgtaagccaacattgtatatagcaamtaataaaagggagctatttcagtt

SEQ ID NO: 6854 - DNA, 50 bp, homo sapien
atttatttattcagtggtaatgcaamatatagcaaaatcactcggaatcc

SEQ ID NO: 6855 - DNA, 50 bp, homo sapien
gcaaaatcactcggaatccccatcamtaatttgccaaaataaagataact

SEQ ID NO: 6856 - DNA, 50 bp, homo sapien
atctgcacaatcatgttcagtgtacrattttcaactgtgtaattattgtt

SEQ ID NO: 6857 - DNA, 50 bp, homo sapien
agaaaaacaaatccatagttttacarcaccaaagctcatagacactcagt

SEQ ID NO: 6858 - DNA, 50 bp, homo sapien
aaataacatcagcaacaggtggaatkaacctgagtcagagtaagacagga

SEQ ID NO: 6859 - DNA, 50 bp, homo sapien
gtgaaaacaggtgagttattgtttgyagtttcagtgtgagacaagatctg

SEQ ID NO: 6860 - DNA, 50 bp, homo sapien
tagagtagagtagaagtgagaaaatwattcaatgaagagagctttttcaa

SEQ ID NO: 6861 - DNA, 50 bp, homo sapien
atggttattgtcaaattctcaagaartgttagttgttagtatttgttaaa

SEQ ID NO: 6862 - DNA, 50 bp, homo sapien
tgagatcttatgtttagacactacgratcttttatttttcaatctcattg

SEQ ID NO: 6863 - DNA, 50 bp, homo sapien
gccacactgtgagtgttttaacaacrgcattaacaaactcagacatagag

SEQ ID NO: 6864 - DNA, 50 bp, homo sapien
tatattcccaattgatacagctttgragaacaactaaaatttcagcaggt

SEQ ID NO: 6865 - DNA, 50 bp, homo sapien
acaagattataagctctatgatggcmatgactttgtaataattactacac

SEQ ID NO: 6866 - DNA, 50 bp, homo sapien
taacagtatcttgaacaatcattaargtaagtactcggtacttattattg

SEQ ID NO: 6867 - DNA, 50 bp, homo sapien
ggcatcaggcccttccttggggtcayctcattttaagaacaatagctgtg

SEQ ID NO: 6868 - DNA, 50 bp, homo sapien
attggagatgtttgggagaaagagakattttttacaaggaaaagtgtaaa

SEQ ID NO: 6869 - DNA, 50 bp, homo sapien
aatgtggattcatctaataaaaagaygtaaaagtgatttaaataagctat

SEQ ID NO: 6870 - DNA, 50 bp, homo sapien
ttaaggatttatgtctgcttcttaartcatgtgtttcaatactagatgaa

SEQ ID NO: 6871 - DNA, 50 bp, homo sapien
tgctgacactcttctaagatgaaaayatgattacagaatgctttcttagg

SEQ ID NO: 6872 - DNA, 50 bp, homo sapien
aatttcaacactagaggagatttaaraactaagccatcgcataaacacca

SEQ ID NO: 6873 - DNA, 50 bp, homo sapien
tcttctgcttttgaaattaagtacaytgacttggctttggcttacagaag

SEQ ID NO: 6874 - DNA, 50 bp, homo sapien
gacagtggaataatatctttaatacrctgaaagaaaataatgacaaatct

SEQ ID NO: 6875 - DNA, 50 bp, homo sapien
tgcgtttgactctcactaagcgctayactctgttattgatcacatttcca

SEQ ID NO: 6876 - DNA, 50 bp, homo sapien
ctttggagacaatcagcatagataarctatagcaagggactaatggtgta

SEQ ID NO: 6877 - DNA, 50 bp, homo sapien
aaatcataacgtattatattctcaaytgtcctagtagccttgtttctcta

SEQ ID NO: 6878 - DNA, 50 bp, homo sapien
gcccacaacgtccttcctagatttawgtttcacgatggctttacatgagc

SEQ ID NO: 6879 - DNA, 50 bp, homo sapien
tctgatagagtcttcctagttttaayagatcctttgacaggttttctgta

SEQ ID NO: 6880 - DNA, 50 bp, homo sapien
aaaatgcatggaccagaaatccagaraggccacagtttattccccaatga

SEQ ID NO: 6881 - DNA, 50 bp, homo sapien
ataaaatgttgttggcatacaaaaasttactaaaatgagccacattttct

SEQ ID NO: 6882 - DNA, 50 bp, homo sapien
cctgggaagaggctgggtatgttaartcaggaaaggcttctctgaagagt

SEQ ID NO: 6883 - DNA, 50 bp, homo sapien
ctgacctatatatgacttttagcagsataggcagtatttcctgctttgtt

SEQ ID NO: 6884 - DNA, 50 bp, homo sapien
tttcagaaactttctattattgcacyatctaacatgagacaaggggattc

SEQ ID NO: 6885 - DNA, 50 bp, homo sapien
gtggatttaatccaaacttgtggaargaattagaatgtaattcaaactcc

SEQ ID NO: 6886 - DNA, 50 bp, homo sapien
gtagtatgcagttgctgtgtgccgcraggaaattactgtaactttgtggc

SEQ ID NO: 6887 - DNA, 50 bp, homo sapien
tgagtttgcagcaacttggttcaaaytactaggtcaaaatgacagccgga

SEQ ID NO: 6888 - DNA, 50 bp, homo sapien
aaaatatatgtttgctctgaatttarcccaaggactgactttaatgggac

SEQ ID NO: 6889 - DNA, 50 bp, homo sapien
tttggtcgaattcaacagatgaagasgatgaggcctagctcctcagaggg

SEQ ID NO: 6890 - DNA, 50 bp, homo sapien
tagggtatacatatcttgctaaatakaaatttgatttccagaaacttgat

SEQ ID NO: 6891 - DNA, 50 bp, homo sapien
gattttttttttccagttagagtacrgcagattttcatgttcaccagagc

SEQ ID NO: 6892 - DNA, 50 bp, homo sapien
cctgggcaacataatgagacccttaygctacaaaaaaacaaacaaataaa

SEQ ID NO: 6893 - DNA, 50 bp, homo sapien
aataagattttgtttttctaaaccawtctagctaggttaggattatacaa

SEQ ID NO: 6894 - DNA, 50 bp, homo sapien
attgcatttaagacctatagaataawtgttgctggcaaattctaatacaa

SEQ ID NO: 6895 - DNA, 50 bp, homo sapien
gagcatctgtgtatccagtgtcttcyaaacttctgccaagttcttctcaa

SEQ ID NO: 6896 - DNA, 50 bp, homo sapien
ttaactaatcatctagacaggcttamaaaattgtggtatactttacatgt

SEQ ID NO: 6897 - DNA, 50 bp, homo sapien
aaacttggcttattctactttccatraatgccagtatatagaaattaatt

SEQ ID NO: 6898 - DNA, 50 bp, homo sapien
tcacaaaggcttgtgacttaataaayaaatatggctgtaaacagtgtttg

SEQ ID NO: 6899 - DNA, 50 bp, homo sapien
tggcgggttctgggattgtcctactraagagatccaagatgctttcaaat

SEQ ID NO: 6900 - DNA, 50 bp, homo sapien
tagtttcatggagtcatatagacagmatatcataacataacataacattc

SEQ ID NO: 6901 - DNA, 50 bp, homo sapien
cttttcctctatggtgtttaaatgayatctgattcctcactgtaaccttg

SEQ ID NO: 6902 - DNA, 50 bp, homo sapien
aatttcattgtgaagagatggatcaygtgaggaaagtaattccatctcag

SEQ ID NO: 6903 - DNA, 50 bp, homo sapien
acaccacaatacatggtacttgatgmaagagggctaataacaacattatg

SEQ ID NO: 6904 - DNA, 50 bp, homo sapien
agcttttacagtttggttccagatcyaaatcctccctgtggaactccaaa

SEQ ID NO: 6905 - DNA, 50 bp, homo sapien
tggtttgaatgtgtcttcttcaaaaytcaagggttgctaatgtgataata

SEQ ID NO: 6906 - DNA, 50 bp, homo sapien
gcaggtttgagcacagtgtaaaggakaattgcccagtgaaagaagggtca

SEQ ID NO: 6907 - DNA, 50 bp, homo sapien
atggctggcttatctctcacagttayccacttgaaatttgtcattcctat

SEQ ID NO: 6908 - DNA, 50 bp, homo sapien
tgagtcaagtcagacttcattacagraagagattagtactgaagagcagc

SEQ ID NO: 6909 - DNA, 50 bp, homo sapien
cagtaaactaagatgatgaataagayggcaagtatttttgggaatcaggg

SEQ ID NO: 6910 - DNA, 50 bp, homo sapien
aatgcccagatcttaatgctttccastaactgattatttatttattggat

SEQ ID NO: 6911 - DNA, 50 bp, homo sapien
ccttacaaaggagttggccaaatgcsagttccttcaaggcttgagatgaa

SEQ ID NO: 6912 - DNA, 50 bp, homo sapien
attcttcactttacacaaagaagcartgcagacattttaaaaaatagcag

SEQ ID NO: 6913 - DNA, 50 bp, homo sapien
aattactctaatgtaaaacaaaaatsatggaagccagaagggcagcatat

SEQ ID NO: 6914 - DNA, 50 bp, homo sapien
aattactcattcagtggactctagcsagcgtttgtgttctgtcactctat

SEQ ID NO: 6915 - DNA, 50 bp, homo sapien
actgaagcagtatgggtgtctgatcyatgtgttcatgaaactgactttca

SEQ ID NO: 6916 - DNA, 50 bp, homo sapien
tatgtatcagactagggctccaaaastaggccgcactatcccaggcattc

SEQ ID NO: 6917 - DNA, 50 bp, homo sapien
ttagatatagagtgtcagattaccaytgataaaccctttctttatcttca

SEQ ID NO: 6918 - DNA, 50 bp, homo sapien
cactccggctgaaaaaagtcttaaaytggaagtatgttagagaaaacctt

SEQ ID NO: 6919 - DNA, 50 bp, homo sapien
cccttgttcgtctctttagctgtcartactctgctgtattctagttttgt

SEQ ID NO: 6920 - DNA, 50 bp, homo sapien
tacatatgaaaggagagaggatagcrcaatgaactcccaatttctagcag

SEQ ID NO: 6921 - DNA, 50 bp, homo sapien
gatcctggatcttaaaattattgaayctggaacaaatattctgggtgcca

SEQ ID NO: 6922 - DNA, 50 bp, homo sapien
tgtttattcacaggtctgaagaagtsaactcaattctaaaaagtattatt

SEQ ID NO: 6923 - DNA, 50 bp, homo sapien
caggaagccatatccataggaaaacrgagagaatactacatcaagtgaac

SEQ ID NO: 6924 - DNA, 50 bp, homo sapien
gaagtgaggattaattaaccccttayagttttgagatggaaaaagaacat

SEQ ID NO: 6925 - DNA, 50 bp, homo sapien
acaacgaacacctggggaattcatcrcaataacataatcatctaggcaca

SEQ ID NO: 6926 - DNA, 50 bp, homo sapien
ttttctagtcaattaatgtcttgcayagatctgagaagttgaagataccg

SEQ ID NO: 6927 - DNA, 50 bp, homo sapien
ctacatagaactcacacaactcttamaccttggctttggtttactttttg

SEQ ID NO: 6928 - DNA, 50 bp, homo sapien
aacacaaacttatattttttgacaaytcagtacaagaactattttaaaca

SEQ ID NO: 6929 - DNA, 50 bp, homo sapien
aattttctgagcagggaaaggcccaygaaagacatttggaaagaatcgaa

SEQ ID NO: 6930 - DNA, 50 bp, homo sapien
taactaagaataaataactaatcacrgtaaaacatccaaaaagcacagaa

SEQ ID NO: 6931 - DNA, 50 bp, homo sapien
aaaaaaatacttcattaatctaataygagacaagaaaggagacaaaaagg

SEQ ID NO: 6932 - DNA, 50 bp, homo sapien
tgcgttacatttgggaaaaatcatawtaatgtgttcaataagtaacttgg

SEQ ID NO: 6933 - DNA, 50 bp, homo sapien
tgaaataaggaccaggaaattcacaraagtaggcaatctcataatgcaca

SEQ ID NO: 6934 - DNA, 50 bp, homo sapien
cagtatatgcatttgcatttgacaayccatttactttcagtgtggtacta

SEQ ID NO: 6935 - DNA, 50 bp, homo sapien
actgtaaatctataattccttcaacyataatctaaggcctgaacggtcct

SEQ ID NO: 6936 - DNA, 50 bp, homo sapien
agtttaagagattttaaagcaggtasaagtcaattagatcattgaattgc

SEQ ID NO: 6937 - DNA, 50 bp, homo sapien
agcactgctacttgcacattaaaaarggaatggacaactcattcaatgaa

SEQ ID NO: 6938 - DNA, 50 bp, homo sapien
tttagtgtcacagaaatgttcaatcrgaccctagattaaccatgctggtt

SEQ ID NO: 6939 - DNA, 50 bp, homo sapien
attgcaaaattccacattaaacaatsactttctgtgtccaattttcctgg

SEQ ID NO: 6940 - DNA, 50 bp, homo sapien
ttggccaattccacagagtacatagragatgagtaaggtttatcaggaat

SEQ ID NO: 6941 - DNA, 50 bp, homo sapien
cacagtaggtgatttaagtggcgtawcagagtactggatgttgcaagtgt

SEQ ID NO: 6942 - DNA, 50 bp, homo sapien
gatttgtattacatcaacttaattakgcttgaactgtggtttccagaatt

SEQ ID NO: 6943 - DNA, 50 bp, homo sapien
ggtaagcttgccttcctggagaaaayggtaactcttctcctcaaagtccc

SEQ ID NO: 6944 - DNA, 50 bp, homo sapien
aaaattaaaatcaaattaagcaaaaygtaatcagagaaagtaagtcatct

SEQ ID NO: 6945 - DNA, 50 bp, homo sapien
caagtctatagttggcaattctgacsgactgttgtctgggagactaccaa

SEQ ID NO: 6946 - DNA, 50 bp, homo sapien
tagagcattagagaaatctgctgaaygagagagacctggcattgggtctt

SEQ ID NO: 6947 - DNA, 50 bp, homo sapien
tatttctgtttgaataaagtgggtarcagtagataactggagtgcctaat

SEQ ID NO: 6948 - DNA, 50 bp, homo sapien
gtagaaacatgagccaagtgggaacrataaggacaaataagtaaatcact

SEQ ID NO: 6949 - DNA, 50 bp, homo sapien
ggggagatattatttggggtgactaraatttggaatagtcatggaagatg

SEQ ID NO: 6950 - DNA, 50 bp, homo sapien
acttactgtcaaatagtatcaaataygcttcattgcaggtaaatatttta

SEQ ID NO: 6951 - DNA, 50 bp, homo sapien
tttaaatcagtggactgagtaaaacmgattaccatccataacatgggtga

SEQ ID NO: 6952 - DNA, 50 bp, homo sapien
ccctgaaaactacattgcctttttasaaaagcctgattcgtcctccggta

SEQ ID NO: 6953 - DNA, 50 bp, homo sapien
ttaatgcatgacttgacaagcctcartattaaaaatctgtgttgaaaaca

SEQ ID NO: 6954 - DNA, 50 bp, homo sapien
cattaagttaactagatgccctatakgtactgagccttcctcaaggtatt

SEQ ID NO: 6955 - DNA, 50 bp, homo sapien
ccgcttactagtaagatctccacagraatagggaagttcatggaatactg

SEQ ID NO: 6956 - DNA, 50 bp, homo sapien
ctgaagcttccaaattggataaaaawgtcatgacccattgaaggaaggta

SEQ ID NO: 6957 - DNA, 50 bp, homo sapien
gaagccaaaaataaaaaagccaggasatagatggacagtaatatttgagg

SEQ ID NO: 6958 - DNA, 50 bp, homo sapien
tgagttctagtctcagctctttcagwaatgactgtgaaatttcagtctct

SEQ ID NO: 6959 - DNA, 50 bp, homo sapien
gtatctgtgcattatttcacaataaraagtttaaaagctgacttgttgat

SEQ ID NO: 6960 - DNA, 50 bp, homo sapien
cagaattcccttacacagaaccgagracttgtatcatcagaggctccctg

SEQ ID NO: 6961 - DNA, 50 bp, homo sapien
agtgtgcactttagaagtaggtagamctggatttaaattcttgccaatca

SEQ ID NO: 6962 - DNA, 50 bp, homo sapien
gaaaagtgtttaaataaaatgaacayagtgacaagcatatctgtaataga

SEQ ID NO: 6963 - DNA, 50 bp, homo sapien
tccattcaacacatgactctccttamcattacacaattcagtgaatacat

SEQ ID NO: 6964 - DNA, 50 bp, homo sapien
caccaaataaaagacagtctaatacragcaactggaaatactctccctta

SEQ ID NO: 6965 - DNA, 50 bp, homo sapien
taaatcgcgtttgttggaatgcgagraaaggaggaagagtggtgattgaa

SEQ ID NO: 6966 - DNA, 50 bp, homo sapien
gaaggacgaatctgtctggagggatsaaagaggacttcacggaggaactg

SEQ ID NO: 6967 - DNA, 50 bp, homo sapien
tactcctgttgtgatcagaatagcaycaaggaatgaagtagagagtgtag

SEQ ID NO: 6968 - DNA, 50 bp, homo sapien
aaattttgaattaaagaatcactaaygtcaacactctagtaaaagcctag

SEQ ID NO: 6969 - DNA, 50 bp, homo sapien
tcttctccctcaaaccagaaacttasgtgatatcccgaaaatagcccccc

SEQ ID NO: 6970 - DNA, 50 bp, homo sapien
atgattattctctagcatgcagttgyaatcaagtacttcttccctcagta

SEQ ID NO: 6971 - DNA, 50 bp, homo sapien
tttgaaattttttttgtaagctgagraagtctgatagaggttagtggatt

SEQ ID NO: 6972 - DNA, 50 bp, homo sapien
atatctaggaatgggactacatatcrcatactgcttttgtgcaactgtcc

SEQ ID NO: 6973 - DNA, 50 bp, homo sapien
tactcttaagcttaatgggatactcrcctttatactatagagtgagggat

SEQ ID NO: 6974 - DNA, 50 bp, homo sapien
ggtgttcatcttacaggtgatatgargagcacatacttttcagttttcgc

SEQ ID NO: 6975 - DNA, 50 bp, homo sapien
tgtacaaggcacggcacattgtaatraaagccatgtgacagtttactgtg

SEQ ID NO: 6976 - DNA, 50 bp, homo sapien
ttaaaaacataaaggcagttttgagraatctaatctgtcttgtatttcca

SEQ ID NO: 6977 - DNA, 50 bp, homo sapien
ttgagtctttctgggagattttccaygttgaaacaattccttctttctcc

SEQ ID NO: 6978 - DNA, 50 bp, homo sapien
acctcgcttaggtttactggttgccrgaggtaccaaaatctacagaagtg

SEQ ID NO: 6979 - DNA, 50 bp, homo sapien
atctacagaagtgttggtaagcatartaaatgatgtttactggttaaatt

SEQ ID NO: 6980 - DNA, 50 bp, homo sapien
gccagaaccatcaaatgatcacgtascactttcaggcacaggaagcttaa

SEQ ID NO: 6981 - DNA, 50 bp, homo sapien
ccctggctctgtggctatagaagaarccagctgttaaaaggccaagcttt

SEQ ID NO: 6982 - DNA, 50 bp, homo sapien
aggacaattgacagagtggttaaacyccaagagagaaaagaccataggca

SEQ ID NO: 6983 - DNA, 50 bp, homo sapien
ttcccaacttttgtaaatattctgartcaaacttaaatttcagcagtaga

SEQ ID NO: 6984 - DNA, 50 bp, homo sapien
gttatattccagtttgaaggacatawcaatgaaaacaaaataatttaaat

SEQ ID NO: 6985 - DNA, 50 bp, homo sapien
atgatccctctaaggagaattctcakaatgacttcactgcataatgcatt

SEQ ID NO: 6986 - DNA, 50 bp, homo sapien
gaggcgaagcctgaccagctcagacrgagtattagtcatttaatccacag

SEQ ID NO: 6987 - DNA, 50 bp, homo sapien
aaataaaattgcttcagggcttagaycctataggccaatctttgcttgga

SEQ ID NO: 6988 - DNA, 50 bp, homo sapien
agtgaatatactagtggatcatcacraataataaactagtgactcaaaca

SEQ ID NO: 6989 - DNA, 50 bp, homo sapien
gtttaaattatctgcattaaattgaygtataagtgctgaaaatcagtact

SEQ ID NO: 6990 - DNA, 50 bp, homo sapien
aagtcaaatgctttatctgtgaagcraaacactatgcggaactctggttc

SEQ ID NO: 6991 - DNA, 50 bp, homo sapien
aatttaagtgtacatgaaaaccgccsggatttagatcgttattaaaagtt

SEQ ID NO: 6992 - DNA, 50 bp, homo sapien
aatatctagactccccggtaccataytaccaccatgaagctatggctttt

SEQ ID NO: 6993 - DNA, 50 bp, homo sapien
aatgaagccaatgtctaaagagcaaytgtaaggccaagatgccccatctg

SEQ ID NO: 6994 - DNA, 50 bp, homo sapien
cgttacaatttatctggtctctaacygattccaaccaagtcaacttaatc

SEQ ID NO: 6995 - DNA, 50 bp, homo sapien
tattaactaaattttaaggtgaagaratggagaaattaaagaaattaagt

SEQ ID NO: 6996 - DNA, 50 bp, homo sapien
gatcatagggagaaactgacctaacratttcccttgttccaagatttaaa

SEQ ID NO: 6997 - DNA, 50 bp, homo sapien
ataaaatagttaatgtctgtccaacygtgctactgattctttgatttgtt

SEQ ID NO: 6998 - DNA, 50 bp, homo sapien
tgagttgcctttagcaatctgtatcrctgaggaactaaaagtgggacaga

SEQ ID NO: 6999 - DNA, 50 bp, homo sapien
attctgctggaatattatgccacagragtctactgaattgggctttatat

SEQ ID NO: 7000 - DNA, 50 bp, homo sapien
atacggaaacaagttttagccagaargatgtttactgcagaattttttaa

SEQ ID NO: 7001 - DNA, 50 bp, homo sapien
aaaagaaaaaaagttcattttgaagscttaactcacttatagctttaccc

SEQ ID NO: 7002 - DNA, 50 bp, homo sapien
aatcataagaaatctgagactaaaasctaggattgtaaacttcgcattat

SEQ ID NO: 7003 - DNA, 50 bp, homo sapien
tgcatagttcagcccattatgaaaasatagcaggcagagtctgacattag

SEQ ID NO: 7004 - DNA, 50 bp, homo sapien
gtcaggtgtgggcgttctcctgggaygatctccaataagtagtgttaagc

SEQ ID NO: 7005 - DNA, 50 bp, homo sapien
tcttggtttgaaacaatgtttacacygatctacctgagagagtgggtacc

SEQ ID NO: 7006 - DNA, 50 bp, homo sapien
ttcaattttttggaatagtttgatartaattggtatgagttcatttttaa

SEQ ID NO: 7007 - DNA, 50 bp, homo sapien
cttccttacagggccattgtgaaaaygaaacatgacagtcgatatggaaa

SEQ ID NO: 7008 - DNA, 50 bp, homo sapien
tcagcagaagagcttgcgaaaaatgragtgctgaccctcttgttgggtgg

SEQ ID NO: 7009 - DNA, 50 bp, homo sapien
aaaaagaattcatacttcattgccawatagttttaaatgctatggaatac

SEQ ID NO: 7010 - DNA, 50 bp, homo sapien
gatgttacaaaaatcagagcttggcraaaagtccctcttttcagacattt

SEQ ID NO: 7011 - DNA, 50 bp, homo sapien
gctgattgtaagtgatttttgaaaaygatctggttgtgtttttcttcttt

SEQ ID NO: 7012 - DNA, 50 bp, homo sapien
aaaaccttagggacaggaagtagtayggttcaggaagaaccaaagtaatt

SEQ ID NO: 7013 - DNA, 50 bp, homo sapien
tttcgaaatcagcccatctgatttaygttagtattgctctcatatcctat

SEQ ID NO: 7014 - DNA, 50 bp, homo sapien
ttgaaacattttacataggcacatawgagtctataatttaaaaaaaaaat

SEQ ID NO: 7015 - DNA, 50 bp, homo sapien
acacattcagctttatacatgttaartggacgcctaccatcctctctccc

SEQ ID NO: 7016 - DNA, 50 bp, homo sapien
ttcaaaaacttattgaattatcacayggtagcccctaaatatgtaaaatt

SEQ ID NO: 7017 - DNA, 50 bp, homo sapien
ttgctcctggggaaaagctgtgtaasggtcaaacataaaattaagatctt

SEQ ID NO: 7018 - DNA, 50 bp, homo sapien
aagctgtgtccctaaaatgatactamaattttaaaagcgatatcagtaaa

SEQ ID NO: 7019 - DNA, 50 bp, homo sapien
actacgatttcagctcggccaaagaytctgaaatgtgggtgatcattttc

SEQ ID NO: 7020 - DNA, 50 bp, homo sapien
aatgaattagaatttttaaataatgkagatgttactgctaagacgaatct

SEQ ID NO: 7021 - DNA, 50 bp, homo sapien
gataatgtgtgctttaattttaaacrctcattaccaatatgatttttgcc

SEQ ID NO: 7022 - DNA, 50 bp, homo sapien
gttcctatctctgtgtttctttgcckagactcactcagccaccccactgt

SEQ ID NO: 7023 - DNA, 50 bp, homo sapien
tgaaataatggttacaacatgaaacygtactttgtctgagacaataggga

SEQ ID NO: 7024 - DNA, 50 bp, homo sapien
ctacctcggacagtgatggtacctgraatagcacccaaaatcagggagtg

SEQ ID NO: 7025 - DNA, 50 bp, homo sapien
tacaaacctgagtcgattctacctckgacagtgatggtacctgaaatagc

SEQ ID NO: 7026 - DNA, 50 bp, homo sapien
ttttctttttaacagcaaatatcackcttgttctgtttctattgtgtcat

SEQ ID NO: 7027 - DNA, 50 bp, homo sapien
catcagcctgttggacctcagcttgmagagttaaaagcatatcttgtctg

SEQ ID NO: 7028 - DNA, 50 bp, homo sapien
ttccttgctgcaaattaatttttcaygatgaggaaagaatgacagctaca

SEQ ID NO: 7029 - DNA, 50 bp, homo sapien
aggaaggctgagcactgtcattagarcccaaccgaagaggactggccaag

SEQ ID NO: 7030 - DNA, 50 bp, homo sapien
aatggatgaaatccagttctaaatcycatttatggaaatctgttacaact

SEQ ID NO: 7031 - DNA, 50 bp, homo sapien
cagttggccataccatggtgcctcargtcaacagagagctagtgcattgc

SEQ ID NO: 7032 - DNA, 50 bp, homo sapien
aataacctaattgcaaaggcagtaartagcacaccaagaaatctagtgga

SEQ ID NO: 7033 - DNA, 50 bp, homo sapien
acagcctcgactacattcccagctcyacctcgactatattcccagctcca

SEQ ID NO: 7034 - DNA, 50 bp, homo sapien
ttgcaaattctagcaaatttgtgtcygaaagatggactgctagagccccc

SEQ ID NO: 7035 - DNA, 50 bp, homo sapien
gggaatgtagtcgaggctgtctgacyctagagcatatacttaactgcaaa

SEQ ID NO: 7036 - DNA, 50 bp, homo sapien
cttaggacatttagaaggagatataygttgcaggtgttacaggaccacca

SEQ ID NO: 7037 - DNA, 50 bp, homo sapien
tggagtaacgtgaatcctccttagarcattttaatccgtaatgtagagca

SEQ ID NO: 7038 - DNA, 50 bp, homo sapien
ctccgcaaaggccttcactagactcraaacatattttctctctggggtaa

SEQ ID NO: 7039 - DNA, 50 bp, homo sapien
atttttcctgaagaactaagcaaaaygagaaggacatttatgaaccttaa

SEQ ID NO: 7040 - DNA, 50 bp, homo sapien
gcagacaaaaacaaactcagcatccygaatattatgctattagttcctta

SEQ ID NO: 7041 - DNA, 50 bp, homo sapien
ggtgacaagacttcatggtctaccartcagcccaaatgcccgccaacctt

SEQ ID NO: 7042 - DNA, 50 bp, homo sapien
ctttgtggcttgttttgaccagcagwatgcagcataagttgtgtaagttc

SEQ ID NO: 7043 - DNA, 50 bp, homo sapien
cttacatggtagctgaaacattccaygaggacaaaggcagaacctacatg

SEQ ID NO: 7044 - DNA, 50 bp, homo sapien
ttttaaaaatgtgttttccccataaytgtagcctttatatacacaaacgc

SEQ ID NO: 7045 - DNA, 50 bp, homo sapien
tttaggattgggctgctagcaatacrgaaaggagcacaaatttctgggta

SEQ ID NO: 7046 - DNA, 50 bp, homo sapien
tctccctgaaggcacaaggatggaamaatttacagctgcttgttatgggt

SEQ ID NO: 7047 - DNA, 50 bp, homo sapien
cttcatgtctttcttttatatacaaygtgcatccctgcttgagtaatccg

SEQ ID NO: 7048 - DNA, 50 bp, homo sapien
cctggatgactaaggtgtggaaatcrataatgtgataaaaagatactggg

SEQ ID NO: 7049 - DNA, 50 bp, homo sapien
aaacaaaaaaggcaacctggtcaagratgttaagcagccattaatcatgg

SEQ ID NO: 7050 - DNA, 50 bp, homo sapien
ttcttgctgctgatggaagattctcraggatgaaggcccctctatgggag

SEQ ID NO: 7051 - DNA, 50 bp, homo sapien
gcttgcttgctatattttctaattaytaacaatccatcattttactctaa

SEQ ID NO: 7052 - DNA, 50 bp, homo sapien
ccctgggcttattaagactcgttcaygggaaggttttattgtctgattcc

SEQ ID NO: 7053 - DNA, 50 bp, homo sapien
ccacagtcaatattagcgattgtcaytattatttgtgtatacaataaaca

SEQ ID NO: 7054 - DNA, 50 bp, homo sapien
tgagtctgatgttcttaaatttaccrgattgacaactcaacgcactgctc

SEQ ID NO: 7055 - DNA, 50 bp, homo sapien
atgctatgagactcagatgaaggtgmcaccaattcttcaagctaggtttg

SEQ ID NO: 7056 - DNA, 50 bp, homo sapien
atatgttaccacatttaaccattgaractgatattttctagatttaaaca

SEQ ID NO: 7057 - DNA, 50 bp, homo sapien
ctcgaagcatataagaatagaagaaygagatttaacaggctctctggaag

SEQ ID NO: 7058 - DNA, 50 bp, homo sapien
tgagtggagggtatgtttcagcaaaygtactgtatcagttaggataggag

SEQ ID NO: 7059 - DNA, 50 bp, homo sapien
acagaattaggtctctaaaccggcaragtactgatctgaacatgagagct

SEQ ID NO: 7060 - DNA, 50 bp, homo sapien
agatttggccatataacttcattggycagtgaaatgtgagctctgtgaaa

SEQ ID NO: 7061 - DNA, 50 bp, homo sapien
cagaaatgctgtggatattgacttaycggaccaagtttgggatgggcaag

SEQ ID NO: 7062 - DNA, 50 bp, homo sapien
gataatatggttatttggagaactaytaagtttagtaaaataaattcaaa

SEQ ID NO: 7063 - DNA, 50 bp, homo sapien
gcagacaatgcacattggtcaagagkaagagttctagatagtatgggggc

SEQ ID NO: 7064 - DNA, 50 bp, homo sapien
tgttgctggagttaaaatcagaacamactgtaattaacccacttgagact

SEQ ID NO: 7065 - DNA, 50 bp, homo sapien
tttctagttgccatggcaatgaaccrctttaatgacaaggcaggcaaaat

SEQ ID NO: 7066 - DNA, 50 bp, homo sapien
tccgtttatcatcttctctctaccaycaaaataattgcactgtgcacagg

SEQ ID NO: 7067 - DNA, 50 bp, homo sapien
gacattttaaacagtgatttggtaawgtctaataaagaaggaaatgcatg

SEQ ID NO: 7068 - DNA, 50 bp, homo sapien
ttgaaatagctactaaaaagttctamgaatgaaataattttgattggaaa

SEQ ID NO: 7069 - DNA, 50 bp, homo sapien
tcgcgttgggaaggctatattggaaygtagctgagctctttctcaagggg

SEQ ID NO: 7070 - DNA, 50 bp, homo sapien
aagcattcccctatggaaaccaacaygaactaagctgctcctggaatgca

SEQ ID NO: 7071 - DNA, 50 bp, homo sapien
cttagttagctaacagtacgtacacraatcactccagaatgttgacagtt

SEQ ID NO: 7072 - DNA, 50 bp, homo sapien
cactttgctctttagtcctccaaaamgtcaatgaccataggataaagagt

SEQ ID NO: 7073 - DNA, 50 bp, homo sapien
ttattttttctgttaagttaccggartaattctagttgtgctcagccttc

SEQ ID NO: 7074 - DNA, 50 bp, homo sapien
aagtacaaggctgttttagttctacrggatctcccatttccatattcctt

SEQ ID NO: 7075 - DNA, 50 bp, homo sapien
attgattgccaaagcgtgcttgcacygtaatacctgcaaaaatctgttat

SEQ ID NO: 7076 - DNA, 50 bp, homo sapien
tatttacttaaataaaagcgtactawcttaagaaaaatgttactttgtgc

SEQ ID NO: 7077 - DNA, 50 bp, homo sapien
acattttcacgattattatatctgcyatggttatttgtgatcagttatct

SEQ ID NO: 7078 - DNA, 50 bp, homo sapien
gcaaaggacaataaaatgagtataaratgagtatataaaatgcctgtatg

SEQ ID NO: 7079 - DNA, 50 bp, homo sapien
tctaaatgacatcattagtagtgtawccctgcaggccaccattaattggt

SEQ ID NO: 7080 - DNA, 50 bp, homo sapien
gtcaaaggcatcaacagatgattgaraagtttaactccaagtgccgtttc

SEQ ID NO: 7081 - DNA, 50 bp, homo sapien
ctaggctcaaatttactcaaattgaycctgtgcacataaatgcttgagcc

SEQ ID NO: 7082 - DNA, 50 bp, homo sapien
ttttgttcttgctctctcatagaacygagctgctatgctgtaaggaaggc

SEQ ID NO: 7083 - DNA, 50 bp, homo sapien
tttatttggcattcctaaggagggasctataatctacaactgttctcaag

SEQ ID NO: 7084 - DNA, 50 bp, homo sapien
gccacgcccatccagctctcttccaygactggttcctatgacctctcttt

SEQ ID NO: 7085 - DNA, 50 bp, homo sapien
gactttcaaagtacagttaactctcrctttagacaatgttttctctttgc

SEQ ID NO: 7086 - DNA, 50 bp, homo sapien
aggtggcagcagcaatgactggagaragtgaaggtgcctaggctgccagt

SEQ ID NO: 7087 - DNA, 50 bp, homo sapien
agatcagtagagaagataaaatgaartcatataagctgaatatatagcaa

SEQ ID NO: 7088 - DNA, 50 bp, homo sapien
acccaaatcactgacaataatctcayggaagtatatggccaagaagggtt

SEQ ID NO: 7089 - DNA, 50 bp, homo sapien
tgtactttctaagctcttgagagtasagatttgcaacatcaatatatagc

SEQ ID NO: 7090 - DNA, 50 bp, homo sapien
gctatcctcagaaaggcaagagaaaytattttacccatgaaataagaatc

SEQ ID NO: 7091 - DNA, 50 bp, homo sapien
gtgttgccacagtctgacataataamggtttaacatataagaaacacatt

SEQ ID NO: 7092 - DNA, 50 bp, homo sapien
gtgtgcggcattcattcagaatcaaygcaatatagctagttccatccctg

SEQ ID NO: 7093 - DNA, 50 bp, homo sapien
ctgctaagaagatgcagcttctccaygaggttggaatccgtaccttccac

SEQ ID NO: 7094 - DNA, 50 bp, homo sapien
cccatttaaatagtcaacgtatcacrgaataaaaaataaggcaaactttt

SEQ ID NO: 7095 - DNA, 50 bp, homo sapien
gcccttatattacatactttcaacakgctacatctatgtaactaaaggca

SEQ ID NO: 7096 - DNA, 50 bp, homo sapien
agatgattcataagttaggaatagaragtgaagattaggctcttgaacct

SEQ ID NO: 7097 - DNA, 50 bp, homo sapien
cctataatttgctcctcagtatacasagccagttactctcttggaaggat

SEQ ID NO: 7098 - DNA, 50 bp, homo sapien
aatttcatcaagcagaccctgctcayctctcgtctgtctatattgggaaa

SEQ ID NO: 7099 - DNA, 50 bp, homo sapien
taccaaataaagtcctttttatctamactgtctcacatggcccaggcaca

SEQ ID NO: 7100 - DNA, 50 bp, homo sapien
gactgcatatgtctgtatttcttctkaaaagtttaaatatcatcagtgaa

SEQ ID NO: 7101 - DNA, 50 bp, homo sapien
actgaaatcactttcaaatgttaaaygacaaatccctgatagaattataa

SEQ ID NO: 7102 - DNA, 50 bp, homo sapien
gaaatgttcttaatatgacgtgttcrataacttcacataaacttcctgtt

SEQ ID NO: 7103 - DNA, 50 bp, homo sapien
atacagcatttctgtaactaattaastgtctcctggaaatgcacttatga

SEQ ID NO: 7104 - DNA, 50 bp, homo sapien
tacacagccatgaggtgaggccacartacctattaatagccagattttta

SEQ ID NO: 7105 - DNA, 50 bp, homo sapien
acaagtgacacacaaaccattcacaytagatattttacagatattttcac

SEQ ID NO: 7106 - DNA, 50 bp, homo sapien
gattatagctttgcataggtctacamatcattcattaggctgggctgggg

SEQ ID NO: 7107 - DNA, 50 bp, homo sapien
ggaaggaaagcatagaaaagggtaaygctggtatattagactcatgatct

SEQ ID NO: 7108 - DNA, 50 bp, homo sapien
ccaggtagaaatactttaatgttaaktgacatgaggttattcttaaattg

SEQ ID NO: 7109 - DNA, 50 bp, homo sapien
tatttatggttgagtaacattgaaaytgattataagtgttacttgggata

SEQ ID NO: 7110 - DNA, 50 bp, homo sapien
aaagatggagaccacatatcctgaakaaacgagttcacacatacacagcc

SEQ ID NO: 7111 - DNA, 50 bp, homo sapien
cgtgtctttgccttttaatcagatartagaaatgactgaaagagtaaaga

SEQ ID NO: 7112 - DNA, 50 bp, homo sapien
ttatacacagtgatatcccaaagackgatgaacaatgtaaatgactgaaa

SEQ ID NO: 7113 - DNA, 50 bp, homo sapien
ctattatctactgggttttacttcawgacgcccatccactacattttact

SEQ ID NO: 7114 - DNA, 50 bp, homo sapien
aacaaagtttactgcttataaataaytcaatgcagctattacaactatta

SEQ ID NO: 7115 - DNA, 50 bp, homo sapien
ggagaggaaactgaggcttggagaargaaaggaactcgcatgctggccgc

SEQ ID NO: 7116 - DNA, 50 bp, homo sapien
acgtttgactgaaatctatcaaaaaygatccagttaaccaacctttacaa

SEQ ID NO: 7117 - DNA, 50 bp, homo sapien
gaaaacctaccttctcaatcagcgakgtatattgaccttgtccagtttac

SEQ ID NO: 7118 - DNA, 50 bp, homo sapien
actaaaataggacattaacttttcarcaactggaaagaagactgctgcat

SEQ ID NO: 7119 - DNA, 50 bp, homo sapien
agaggcagagccagtcttttagtaaytcagtaacatcaggtacacaggtt

SEQ ID NO: 7120 - DNA, 50 bp, homo sapien
acgttttgggtgagtgttcttagccrcacttgataatgcaccagggttcc

SEQ ID NO: 7121 - DNA, 50 bp, homo sapien
agctcttggtggttacaaaataggcrctaagctctcagtacagcaatagt

SEQ ID NO: 7122 - DNA, 50 bp, homo sapien
cttgcaggtgggaaaactggatcgayaactcagtggtaatactgggaata

SEQ ID NO: 7123 - DNA, 50 bp, homo sapien
cagactgaccacctgcctaatctctyactctttatgcctacactactggg

SEQ ID NO: 7124 - DNA, 50 bp, homo sapien
tggttgcattgaaaaggttctgtcarattttcttgataaagcttcatcta

SEQ ID NO: 7125 - DNA, 50 bp, homo sapien
gtgttctaacagtatatgtaagatamaggatcatcattctagcacaggtt

SEQ ID NO: 7126 - DNA, 50 bp, homo sapien
gcatgcactgagagattccatccaaygggcaccaacaaggacagcattaa

SEQ ID NO: 7127 - DNA, 50 bp, homo sapien
atgacaaagtgtggaaaacaaggccrctgatactagatgttgttaatttg

SEQ ID NO: 7128 - DNA, 50 bp, homo sapien
gtactcctgtaaggttattaagtgayatacaataattgtctgtattccaa

SEQ ID NO: 7129 - DNA, 50 bp, homo sapien
ctcatcttccactgtccctgaatgcraaataagggtgaccttatttcaga

SEQ ID NO: 7130 - DNA, 50 bp, homo sapien
cactcatgatatcgatgaaaaaccgsatgattcacaagaacaactgtttt

SEQ ID NO: 7131 - DNA, 50 bp, homo sapien
ggtggtgagagcagcctttactaccyaaactttacaaatgacaaaactaa

SEQ ID NO: 7132 - DNA, 50 bp, homo sapien
aattaaacatttctattcatcaaaasatgttatttagaaactgaaaagac

SEQ ID NO: 7133 - DNA, 50 bp, homo sapien
aaagatgactacgtcaaaaaaggcartgcagtactccaatcactgtctca

SEQ ID NO: 7134 - DNA, 50 bp, homo sapien
caagctttgtttataggaaagtgtcrgaagttaattgaagaactgtttgc

SEQ ID NO: 7135 - DNA, 50 bp, homo sapien
aagaagacatgagaaagtggataaamcctacacttagtgaagaggaagat

SEQ ID NO: 7136 - DNA, 50 bp, homo sapien
aacggaagcctttatatctttacctkaggacaacagaattgagtgaaaca

SEQ ID NO: 7137 - DNA, 50 bp, homo sapien
aatttttcacagtcattccatttccrctatgactagatggggcacagagc

SEQ ID NO: 7138 - DNA, 50 bp, homo sapien
gatcttttaaggccaaggaatacacygacaccataaggcatgctggctag

SEQ ID NO: 7139 - DNA, 50 bp, homo sapien
aaatacggataaacagagagaggaastaataaaataacctccagaaaata

SEQ ID NO: 7140 - DNA, 50 bp, homo sapien
gaagatataaacacagaaaaatataygggagtccacacgaagaactagaa

SEQ ID NO: 7141 - DNA, 50 bp, homo sapien
ggcattgataagtcaatatgttaacycaggcagatgtttcatgctttacc

SEQ ID NO: 7142 - DNA, 50 bp, homo sapien
tttgttgtgctcttctgttcggaaamgcagcctgtttgttttatttactt

SEQ ID NO: 7143 - DNA, 50 bp, homo sapien
aaagtgtagcagatttttcatagacyggatagcaatccaagagacagcag

SEQ ID NO: 7144 - DNA, 50 bp, homo sapien
aggaagcttgctcatccaggcactgmagtttatcggtgtgtgcagttcag

SEQ ID NO: 7145 - DNA, 50 bp, homo sapien
tgtggtcaaaatggccctttctgcayggggtatttgaatagacacttgaa

SEQ ID NO: 7146 - DNA, 50 bp, homo sapien
gggttatttactgcatgcttcatcaytgacgatctgcatggagagaacac

SEQ ID NO: 7147 - DNA, 50 bp, homo sapien
gcattgcttccttgatgcttctgcartaaatcaaattaaaagcaaacttg

SEQ ID NO: 7148 - DNA, 50 bp, homo sapien
aattcgttgttcactttgacgatcarattaggctttccattttgttttgt

SEQ ID NO: 7149 - DNA, 50 bp, homo sapien
tgtccaggtgaccagcttgcttaacygatgttgggaagttgtcatgatta

SEQ ID NO: 7150 - DNA, 50 bp, homo sapien
caacactaggtgcttagattggctaygtgcccaagtgtaagacaagcctg

SEQ ID NO: 7151 - DNA, 50 bp, homo sapien
aagcacaaactgaaagatgttaacartaagcctgtggtcccagtgtcctg

SEQ ID NO: 7152 - DNA, 50 bp, homo sapien
aaggacatatcagctgtgtttataartagtgagactaactccacaaacca

SEQ ID NO: 7153 - DNA, 50 bp, homo sapien
gcttttacaggaaaaatacatataaraataagagtgtcatcctaaaatga

SEQ ID NO: 7154 - DNA, 50 bp, homo sapien
gcctccagttgacaatactgatacargccaatttggttgctgtccaagct

SEQ ID NO: 7155 - DNA, 50 bp, homo sapien
ggcatagtgctgagcaaagtagataygggatacgatctctctgagcctct

SEQ ID NO: 7156 - DNA, 50 bp, homo sapien
gttttcctaggcaaaaagttgtaagraggaatagcttccatgtacgcaag

SEQ ID NO: 7157 - DNA, 50 bp, homo sapien
attaaagccaacagctcagctctgamcgtgatatcaggttgtgtttgtcc

SEQ ID NO: 7158 - DNA, 50 bp, homo sapien
tctatgctgccattagccagaaaagsaatacaaggtcagaagacacatac

SEQ ID NO: 7159 - DNA, 50 bp, homo sapien
caacagttatgcttcagtcagtttaygaaatgcaagggccaagtaactta

SEQ ID NO: 7160 - DNA, 50 bp, homo sapien
ctggaaatacaggaggtaaatttcartcttctagcacggagcacttaatc

SEQ ID NO: 7161 - DNA, 50 bp, homo sapien
tgcttcgaatgtgtagagtcatttayaaaggtagtaatttccattcagag

SEQ ID NO: 7162 - DNA, 50 bp, homo sapien
gccaatatttactaagagcctactaygtgtcggcgctctgaaaaaagtat

SEQ ID NO: 7163 - DNA, 50 bp, homo sapien
gagataggatattctttctaaattayggtacgtttgaatgaagccaacta

SEQ ID NO: 7164 - DNA, 50 bp, homo sapien
tccctttggaaaataaggcaatacasataaaaggagaataaccaagactt

SEQ ID NO: 7165 - DNA, 50 bp, homo sapien
tttaatagatagactcacctgcttamagacttcaataggtaatactatat

SEQ ID NO: 7166 - DNA, 50 bp, homo sapien
aactaaagagattcatttaatgttcwcttattatttgatgacataaattc

SEQ ID NO: 7167 - DNA, 50 bp, homo sapien
tgggagacatcttcacctgcataagraaaacactccgattttactgctga

SEQ ID NO: 7168 - DNA, 50 bp, homo sapien
ctccttggagattctcatttagggaytaggtcagtgtttcacaagctcaa

SEQ ID NO: 7169 - DNA, 50 bp, homo sapien
tgtcaaagtctgtatgtatcctttayagactcctcaggatggctgactat

SEQ ID NO: 7170 - DNA, 50 bp, homo sapien
ggaaggagcactttaaaaaagtagayaggattagaccaaagaaaaagaag

SEQ ID NO: 7171 - DNA, 50 bp, homo sapien
ttggggatacataggtgaacaagccrgactaaacttgccctcaggagatt

SEQ ID NO: 7172 - DNA, 50 bp, homo sapien
aataggttgttaacatttctgagcayacctgtgggtctaacccatcctta

SEQ ID NO: 7173 - DNA, 50 bp, homo sapien
atacataatgtctttgcaaataacaytgaaaatatatgaagatgaacttt

SEQ ID NO: 7174 - DNA, 50 bp, homo sapien
tccagcaactccagggtaacatgaamctttcagcttatgatctcaaaggg

SEQ ID NO: 7175 - DNA, 50 bp, homo sapien
ggttatttgttggaatctatcttgaygttatccattactgtagagaacca

SEQ ID NO: 7176 - DNA, 50 bp, homo sapien
gaaagtgctctgaagatgccttaacrgaacctccattcccaatacccggg

SEQ ID NO: 7177 - DNA, 50 bp, homo sapien
cttttggcctctatttctgagatgayattgtccaggtaaaggttgttcaa

SEQ ID NO: 7178 - DNA, 50 bp, homo sapien
ttatgtgataggatgtgtccaaccayggcactgttactctagcaatcacc

SEQ ID NO: 7179 - DNA, 50 bp, homo sapien
aatgatattatccaactgcagataaraggaatagatgtaagaatcccagt

SEQ ID NO: 7180 - DNA, 50 bp, homo sapien
ctatcagttctgaacccttttgtacyaattgaagggaaatacagagccta

SEQ ID NO: 7181 - DNA, 50 bp, homo sapien
tgctatggggactatgtccggtgtgraataagactgctgtggcccctgcc

SEQ ID NO: 7182 - DNA, 50 bp, homo sapien
agctagctaatttgatgtgcatccawtcctatgaaataggtaagtccagt

SEQ ID NO: 7183 - DNA, 50 bp, homo sapien
caataattcaaccacattgtaaggarcatggaaataggtaatatattgaa

SEQ ID NO: 7184 - DNA, 50 bp, homo sapien
agagaccattgctttgtgtaataagrccatttaaggtcacagtcagctgg

SEQ ID NO: 7185 - DNA, 50 bp, homo sapien
aaccattgaaattgacttaacttgamattggctgttgataaagtatttgc

SEQ ID NO: 7186 - DNA, 50 bp, homo sapien
actgtggtcagtattaggatgtaaaygattctgtgttctaatgtgaagta

SEQ ID NO: 7187 - DNA, 50 bp, homo sapien
ctctttctcagtttgctgttttatayagagtggtcgctctgcttccccag

SEQ ID NO: 7188 - DNA, 50 bp, homo sapien
tctcagggggtttacagctaattggraagaaacaaggaaacagctgcaga

SEQ ID NO: 7189 - DNA, 50 bp, homo sapien
aaaatgaaagttaaccttcatgcgaygttatgaaaagcaagaaaaatctt

SEQ ID NO: 7190 - DNA, 50 bp, homo sapien
attatgaaatccattctcgagtggcrattttttatgatgttgtgttatca

SEQ ID NO: 7191 - DNA, 50 bp, homo sapien
gtacttaagacgcttgtcagctaaawgtcaagtggtctttcttccatgtc

SEQ ID NO: 7192 - DNA, 50 bp, homo sapien
gtgcattgaagataagaggaatgtamaaagtttgtggaaaccactcagag

SEQ ID NO: 7193 - DNA, 50 bp, homo sapien
cctgccattctaacactgccaaatgrattaagtttcctgtcactttccag

SEQ ID NO: 7194 - DNA, 50 bp, homo sapien
attagaaatcactttgtgtttaaackgctcaaatctctgcatctactatc

SEQ ID NO: 7195 - DNA, 50 bp, homo sapien
ataatttgtacattggaaacatagaygtagaagacaaaagcttcaagagc

SEQ ID NO: 7196 - DNA, 50 bp, homo sapien
ccccgccaccaaaaaatgattttacsaaggtctatccagagatacaaagc

SEQ ID NO: 7197 - DNA, 50 bp, homo sapien
tgcatccaatcctatgaaataggtargtccagtattacttcagcttacaa

SEQ ID NO: 7198 - DNA, 50 bp, homo sapien
acaggcaaatttattcaccatggaartcttgatatgagcaaactatcaca

SEQ ID NO: 7199 - DNA, 50 bp, homo sapien
taaactcaccgaggaggaaaccagtsaacatcttctgcaatgcagttatg

SEQ ID NO: 7200 - DNA, 50 bp, homo sapien
ttcctgctccaaacatgaccatgcartcgagtaagaacagaaacaaaaat

SEQ ID NO: 7201 - DNA, 50 bp, homo sapien
tacatgaactttgggggacacatgcraaccaaaccagaaattttctttgg

SEQ ID NO: 7202 - DNA, 50 bp, homo sapien
attagaagctcttagaagtcctgccsaaagttagagtggattatgcagcc

SEQ ID NO: 7203 - DNA, 50 bp, homo sapien
aaaatatataaagaattcctataccmataagagaaagatacagaatccaa

SEQ ID NO: 7204 - DNA, 50 bp, homo sapien
tcttatataattgaaagttaatgcaygttaataagcaagagtttagttta

SEQ ID NO: 7205 - DNA, 50 bp, homo sapien
tctctgcacccgtctgcctcgtctarggtttcttttcatgacaaattcga

SEQ ID NO: 7206 - DNA, 50 bp, homo sapien
tccgtttctgaccgtaagaagttgcscttgtgtctgatcaaattgtaaac

SEQ ID NO: 7207 - DNA, 50 bp, homo sapien
cctagagtggatgactgaccttatawaccactactttcaggttcctagag

SEQ ID NO: 7208 - DNA, 50 bp, homo sapien
ctcagtcacaattgcataattttagycctatcatattcaccagtgtccca

SEQ ID NO: 7209 - DNA, 50 bp, homo sapien
ttatctgctaagagaaccatgcttcratgttgttttctcttttccttaat

SEQ ID NO: 7210 - DNA, 50 bp, homo sapien
ctgcttctgaaatggtaaacttaagsagagcttggaaataggataatgag

SEQ ID NO: 7211 - DNA, 50 bp, homo sapien
gtcaactggagctatttggtagcaakgctctctggaagattcaatggggt

SEQ ID NO: 7212 - DNA, 50 bp, homo sapien
tagcaggatagatatagcaatttaaytagacacagaagggacttcaaagc

SEQ ID NO: 7213 - DNA, 50 bp, homo sapien
cgtatttattgaacataataatcaaragtgtactaccatctatgcttccc

SEQ ID NO: 7214 - DNA, 50 bp, homo sapien
cccatgaagctactacagtgagggawcataggatatatacacagcctgat

SEQ ID NO: 7215 - DNA, 50 bp, homo sapien
tcaaaacaatttaggaatgttaaacrctaattcttaattcaaaataatga

SEQ ID NO: 7216 - DNA, 50 bp, homo sapien
tcgtctatcgttttgggatttaggawcttgaagcctctcagagtcagaat

SEQ ID NO: 7217 - DNA, 50 bp, homo sapien
aaagtgttattggtacattcaggtayaagttaaacaaggccaaaatatgc

SEQ ID NO: 7218 - DNA, 50 bp, homo sapien
ggcggtttccagcttgctcttggcaygaaaaggaataaccagggccattt

SEQ ID NO: 7219 - DNA, 50 bp, homo sapien
ccctcttcctaagggcctttgcaacratgatctccaattctaacgtgttt

SEQ ID NO: 7220 - DNA, 50 bp, homo sapien
acgactctttggttgtgaatcaaacrggtttccgagctcaagcccaaatg

SEQ ID NO: 7221 - DNA, 50 bp, homo sapien
aagcctcttaaactcattgatcgctwacatggaaaatatgaaaaattaat

SEQ ID NO: 7222 - DNA, 50 bp, homo sapien
aaagaaactagaacagagacagggcraatagtgaggaaactgttgtaacc

SEQ ID NO: 7223 - DNA, 50 bp, homo sapien
aatgaatctccttctacccaaaatasctagagtgactttagtgttcccga

SEQ ID NO: 7224 - DNA, 50 bp, homo sapien
ctgcaggctaaaaaagataggaaaakaattaaaccctctcaataatttaa

SEQ ID NO: 7225 - DNA, 50 bp, homo sapien
taaagtgggatttatctttggaacaytgatagctgcttatgttgtccttc

SEQ ID NO: 7226 - DNA, 50 bp, homo sapien
caaaatatcagctgtggcttaagggyaccaagataatcacattcgtgaga

SEQ ID NO: 7227 - DNA, 50 bp, homo sapien
aatcagattcagtaactatgaagtawgaagactgctaatagcatgtgtaa

SEQ ID NO: 7228 - DNA, 50 bp, homo sapien
gaaaattcaaatgtctaaggtttaaragtagccacagacagcctatgatg

SEQ ID NO: 7229 - DNA, 50 bp, homo sapien
aaatttctagtacagagatatcgcarccaatactcatgcagatatttccg

SEQ ID NO: 7230 - DNA, 50 bp, homo sapien
tggattaaaaggatactaattgatasgataaaaatacaaaaataaaaaac

SEQ ID NO: 7231 - DNA, 50 bp, homo sapien
gtcaaagcagcatttttactttgcakgtggtatctgctatcgcttgagag

SEQ ID NO: 7232 - DNA, 50 bp, homo sapien
gacattaaattggaagaaactgctcrcgttagaaataattactgctgata

SEQ ID NO: 7233 - DNA, 50 bp, homo sapien
tgagacaatggttgggctgcagatcrattatttggaagaggatctcagga

SEQ ID NO: 7234 - DNA, 50 bp, homo sapien
atcatatacatgtgcataacacataracttttcaacattactatgttaca

SEQ ID NO: 7235 - DNA, 50 bp, homo sapien
ttttctaaatttttctgatcattaamgttgttgagtaaatattgtctgga

SEQ ID NO: 7236 - DNA, 50 bp, homo sapien
aatgactattcctgactacctgatarcaacaggctctcccactctctcct

SEQ ID NO: 7237 - DNA, 50 bp, homo sapien
aaacaaatatgggtgtataactatgyatgtatccaggacaatgcctgcat

SEQ ID NO: 7238 - DNA, 50 bp, homo sapien
ggaaaccatcacttgttcaacaccaygaagttacagaaggtgcacaactc

SEQ ID NO: 7239 - DNA, 50 bp, homo sapien
ttatctactttatttcatttcatacrctcagcaacctttgaggtagatac

SEQ ID NO: 7240 - DNA, 50 bp, homo sapien
acatcaatattgctatatacacaatrataatggaatccaatagtaacact

SEQ ID NO: 7241 - DNA, 50 bp, homo sapien
tattttgttgacaataacagagaaayttgaggatatttctgttggagaca

SEQ ID NO: 7242 - DNA, 50 bp, homo sapien
actttgtcagaggctttgtaagataygtgaaacaaaaaggcaatttgggg

SEQ ID NO: 7243 - DNA, 50 bp, homo sapien
tgtgtttattcatgcattctccctamcatgtgcttgcagagtcttctggg

SEQ ID NO: 7244 - DNA, 50 bp, homo sapien
gcctcatgcaaatgaaatattctcaygaaaaatatattcagagagcaccg

SEQ ID NO: 7245 - DNA, 50 bp, homo sapien
ctagaacagcacgtggtagtccagcrgctcagatacccccagtttcagca

SEQ ID NO: 7246 - DNA, 50 bp, homo sapien
cagacagagaggcagggcccagacasagcatgaaggtttttagtgcccac

SEQ ID NO: 7247 - DNA, 50 bp, homo sapien
atgttagaatgaatttacattggatyagtctgggtcataaaatgatcaat

SEQ ID NO: 7248 - DNA, 50 bp, homo sapien
aaccaccagagcacaactgccaacamcttgattcagacctctagcctcaa

SEQ ID NO: 7249 - DNA, 50 bp, homo sapien
gctctagcatcccaggatgagtaaasttcattttttggtacctttcagag

SEQ ID NO: 7250 - DNA, 50 bp, homo sapien
attaggaaagagagagagtgctatayaggttacaagtattaaggaaacat

SEQ ID NO: 7251 - DNA, 50 bp, homo sapien
ctttgtatctttcccccaaaaaacaygccattgattacgtatagtgcatc

SEQ ID NO: 7252 - DNA, 50 bp, homo sapien
aaatggcttggctgttgctcaccaaytgaattttaaactccaataaacaa

SEQ ID NO: 7253 - DNA, 50 bp, homo sapien
ggccaagctttcacaggataccctcrattttactcaggcccacaaagccc

SEQ ID NO: 7254 - DNA, 50 bp, homo sapien
aagcagagctcagtgtggattttagmagctgggatcatggagtgtgataa

SEQ ID NO: 7255 - DNA, 50 bp, homo sapien
actccagggtccagcacagactctcrcagagtggaaatgaaggacacagg

SEQ ID NO: 7256 - DNA, 50 bp, homo sapien
tatgtccctgtaccctacatgctgcrcctatacccaggaccgatggtaac

SEQ ID NO: 7257 - DNA, 50 bp, homo sapien
gctctgccagaggaggcaacagaggwccctagtatccattgaaatcatct

SEQ ID NO: 7258 - DNA, 50 bp, homo sapien
tgtgttaggaatgaaggacggagacsaaatattataacaaaagatgcacc

SEQ ID NO: 7259 - DNA, 50 bp, homo sapien
cagttcgttttcttttcagctaatgyaatgataagattggcataagttac

SEQ ID NO: 7260 - DNA, 50 bp, homo sapien
cttgacatcactgcctttttcatcargtggttcataggaagaggccaaga

SEQ ID NO: 7261 - DNA, 50 bp, homo sapien
gatctttcttcttcagtctcataaaygggaagctgttgatcaatgcaagc

SEQ ID NO: 7262 - DNA, 50 bp, homo sapien
gctcttgagtgttacataaaagtgayctcaaatttttaatatggcgcaaa

SEQ ID NO: 7263 - DNA, 50 bp, homo sapien
agatcagacgacttcatacaaaatamatcctttatcagaaaccaaggaag

SEQ ID NO: 7264 - DNA, 50 bp, homo sapien
gctgatattacaaaaccgaatgtaayggcaccgaaatatcactttgcatt

SEQ ID NO: 7265 - DNA, 50 bp, homo sapien
ttgctttaagggaatgggattttaaytggaagaggaaagaggaggctggc

SEQ ID NO: 7266 - DNA, 32 bp, homo sapien
acatatttttggtgctsaaacaaaggaaaata

SEQ ID NO: 7267 - DNA, 50 bp, homo sapien
caaaaggagacatagaaatggctaaygagtatatgaaaaaaatgcccaac

SEQ ID NO: 7268 - DNA, 50 bp, homo sapien
tctcttatctggagcctgaaagcaayggttaggtaacaaggggatgtaag

SEQ ID NO: 7269 - DNA, 50 bp, homo sapien
ctgatcagcaataactatctagtaartgaatgtaaggacaaaatactaag

SEQ ID NO: 7270 - DNA, 50 bp, homo sapien
taaagttagaatattcttatgctaastcatgcaaaaaacttcctaacaag

SEQ ID NO: 7271 - DNA, 50 bp, homo sapien
tctgtaagtaaaactgttttgttcartgaaaatgcttgactctagatgaa

SEQ ID NO: 7272 - DNA, 50 bp, homo sapien
ccaccttctaaacagactactggtarcggacgacttcagaggcagccagt

SEQ ID NO: 7273 - DNA, 50 bp, homo sapien
tcaaggaggagattggtaccatccamtaaaacaggcacagggccgatctt

SEQ ID NO: 7274 - DNA, 50 bp, homo sapien
gttatagaccatctggttaaatgcarctattcaagaagaaaaatttaaac

SEQ ID NO: 7275 - DNA, 50 bp, homo sapien
gtgcttagtttgataatgtcatccartaacagaaatgttttccttttcac

SEQ ID NO: 7276 - DNA, 50 bp, homo sapien
agtctcacaggtggtgtcatgcctargagcagtacaggataccaccttct

SEQ ID NO: 7277 - DNA, 50 bp, homo sapien
cggcacaaaaatcttggtgaaggtayaaggacatggaacgtactacgtgc

SEQ ID NO: 7278 - DNA, 50 bp, homo sapien
atttctagatagaggtatcactaacragccaataaaggagatagaatgaa

SEQ ID NO: 7279 - DNA, 50 bp, homo sapien
cctcttctcatttgctctttaccaayttagaaacatagtttaggagtcga

SEQ ID NO: 7280 - DNA, 50 bp, homo sapien
accagatcttgcaaaaactcattctyacgaagacagcaccaagccatcaa

SEQ ID NO: 7281 - DNA, 50 bp, homo sapien
gctctctcttccagattcaaggttamcatttttcatgccttattgttttt

SEQ ID NO: 7282 - DNA, 50 bp, homo sapien
attagggagctttggcttctaaggasatgatgacaaataatttaggttta

SEQ ID NO: 7283 - DNA, 50 bp, homo sapien
tcatcctgagctttaaaatgcttagyagctcctgcacctggtgagccagc

SEQ ID NO: 7284 - DNA, 50 bp, homo sapien
agcagcagcatattagaacacacacmggaagtacgtgagctgctgttgca

SEQ ID NO: 7285 - DNA, 50 bp, homo sapien
tcaaaagtacaatttatctaacaaakaggtatacacttttctctaatgtg

SEQ ID NO: 7286 - DNA, 50 bp, homo sapien
cttttcccttaccaacatcctgaagmattttctctatgtttctttctggt

SEQ ID NO: 7287 - DNA, 50 bp, homo sapien
aatgtgggaagttcacacattctacrgtaatgccttgtcctcactggaga

SEQ ID NO: 7288 - DNA, 50 bp, homo sapien
ttccaggcaaagtgatacagatgcasctagtgataaataaggattcttat

SEQ ID NO: 7289 - DNA, 50 bp, homo sapien
cctgctgaagctggtgacaagagaargatgccagtcagggagagaacaca

SEQ ID NO: 7290 - DNA, 50 bp, homo sapien
attttaaaaatagaaccaaaaaggaygttaaattcaatgacttcattagt

SEQ ID NO: 7291 - DNA, 50 bp, homo sapien
taaacatgcccaggcaagtagctccratatttaacccatcctccccacct

SEQ ID NO: 7292 - DNA, 50 bp, homo sapien
ataatcatcttttcttgcttgcctartaaatgtcatcagtgtagacaaaa

SEQ ID NO: 7293 - DNA, 50 bp, homo sapien
ataagaaaattgtcctgcccagaacrggaaagcgttgtctgtttttattg

SEQ ID NO: 7294 - DNA, 50 bp, homo sapien
ttcctctgtgtaaggttttatatcasaacgtattgatttatagcacatgg

SEQ ID NO: 7295 - DNA, 50 bp, homo sapien
ctggagaaatcatttttcatcaatasaggatctcaagtgtttccccacaa

SEQ ID NO: 7296 - DNA, 50 bp, homo sapien
aatcaaaatagctgtcagccaaagaratctattctgcttagaagtagcca

SEQ ID NO: 7297 - DNA, 50 bp, homo sapien
ggccaaaaaaagccactagaatcacraattgaaatgtgaaatggctgtga

SEQ ID NO: 7298 - DNA, 50 bp, homo sapien
atccactctgattgtcatgatacaayttaaggtgaggaaggtagaaaaac

SEQ ID NO: 7299 - DNA, 50 bp, homo sapien
gtgctttctgatcatgatggatacaratgtcatcttcagattcttgtatc

SEQ ID NO: 7300 - DNA, 50 bp, homo sapien
ccatggccaactgctatgagcataayggagtcctaatgacccagccagct

SEQ ID NO: 7301 - DNA, 50 bp, homo sapien
tgaataaatgtatgagtgaatggatwaaaagagatgaaatgcaataggga

SEQ ID NO: 7302 - DNA, 50 bp, homo sapien
aagcatattgggtgcagtgaaggaaraagtgaatttagaaacaacatgtt

SEQ ID NO: 7303 - DNA, 50 bp, homo sapien
atgcccaaaggcagtaagagggaaasaaaagtattggagaggcctactgg

SEQ ID NO: 7304 - DNA, 50 bp, homo sapien
tacagtccaaaagaacaacacgctawggtatgatacataaccatccagtt

SEQ ID NO: 7305 - DNA, 50 bp, homo sapien
gaatagagagtgacaggaaaatcctracatgagctcgagaaatactgtct

SEQ ID NO: 7306 - DNA, 50 bp, homo sapien
tggggacaggttaactaataagagawggctataatttgggcaagcttctt

SEQ ID NO: 7307 - DNA, 50 bp, homo sapien
ctctgaactgggcttcttggtgagasacaatcagacttggtgcccacttc

SEQ ID NO: 7308 - DNA, 50 bp, homo sapien
gtgtcgctggaaatgctattgcaccrgaatggaacccattagctacagcc

SEQ ID NO: 7309 - DNA, 50 bp, homo sapien
ttagtaccacatgtttattactcaaygtctgaattctcaaattaaatcat

SEQ ID NO: 7310 - DNA, 50 bp, homo sapien
agaatggtgacaagagagtttggaargagttgtcttgagagagaagaaca

SEQ ID NO: 7311 - DNA, 50 bp, homo sapien
aatcctcagatgacaactaaatcaasataaatgacaaagtcgaccagttc

SEQ ID NO: 7312 - DNA, 50 bp, homo sapien
ggcaagtcatttcttgtagatatcarcatggaagagaagcaagatgtgtc

SEQ ID NO: 7313 - DNA, 50 bp, homo sapien
ggattgcatgttaagctaaaagtcasaaccttcttatcatggcttggtct

SEQ ID NO: 7314 - DNA, 50 bp, homo sapien
aagcaatgaattcaaattttatatcsaagggcatagccagaataccaaag

SEQ ID NO: 7315 - DNA, 50 bp, homo sapien
cctgtctgtaaacagaggcagataakatccttgggtcccagccctggctt

SEQ ID NO: 7316 - DNA, 50 bp, homo sapien
gacaaatggaaagaaacacatgaaasaaggaacccaagataaaaaccata

SEQ ID NO: 7317 - DNA, 50 bp, homo sapien
tgagccactgtgcctggccatccaasgtatctttaaaggtgaaattcttt

SEQ ID NO: 7318 - DNA, 50 bp, homo sapien
tgtccacttgtacaagaactgattargccgtggactttcccacattcctc

SEQ ID NO: 7319 - DNA, 50 bp, homo sapien
actgaaatactgtccttttatgaaarcagcctcttgagaaaagccaatac

SEQ ID NO: 7320 - DNA, 50 bp, homo sapien
gccccgcttacctccgagtgatgacrcagctgagttctgattggtcaata

SEQ ID NO: 7321 - DNA, 50 bp, homo sapien
ttcacctgcttgtgccaatcagagaycagctgtatcaaccaatcaaggct

SEQ ID NO: 7322 - DNA, 50 bp, homo sapien
aggtgaagggaaatggaatcactaasagaatgctcctaatggctaaaata

SEQ ID NO: 7323 - DNA, 50 bp, homo sapien
tgcttgggcttctgtgtttagaaaawgtactgtgttggttgggtgtttgg

SEQ ID NO: 7324 - DNA, 50 bp, homo sapien
tgttgagggtcttcttgttcaatgcyatgggaatttcacctaatgcctgc

SEQ ID NO: 7325 - DNA, 50 bp, homo sapien
tttggcctggtttctcagaacttaamctaggaaagcacagacttagagaa

SEQ ID NO: 7326 - DNA, 50 bp, homo sapien
aggaactactatccatatcatagaakataccagagtgaaactcgctattg

SEQ ID NO: 7327 - DNA, 50 bp, homo sapien
ttatgttagtattttcgacaacttaytaaagctaaaatttatattctccc

SEQ ID NO: 7328 - DNA, 50 bp, homo sapien
tggcacatggcacatataatgcttaraacagtagaaaaccaatcaatatg

SEQ ID NO: 7329 - DNA, 50 bp, homo sapien
tacctagtttttgagtgattattackgaaaggtgacattgaggagtgatt

SEQ ID NO: 7330 - DNA, 50 bp, homo sapien
gctatcctgcctcttgatgatgtagsaacagtaccacattttgagtgtgg

SEQ ID NO: 7331 - DNA, 50 bp, homo sapien
acatcaattgtgtgatttgtgttgaygtaacagtagtcatatatagccca

SEQ ID NO: 7332 - DNA, 50 bp, homo sapien
ccgatgtaaaatagaaaatgttgcartacaaaatgaaatgttactgccat

SEQ ID NO: 7333 - DNA, 50 bp, homo sapien
caggctgaagtcttgggctctgcatrataagaaaattgctcccaggtaat

SEQ ID NO: 7334 - DNA, 50 bp, homo sapien
taaaacgcgtatggaaaagttgagasaatagtacaaaaacagtacaagaa

SEQ ID NO: 7335 - DNA, 50 bp, homo sapien
ccctgggaaatgagtgttatgtcaakgcaaaaaaatccaaaatgattgca

SEQ ID NO: 7336 - DNA, 50 bp, homo sapien
agacaaaatatagtgttcaaagatgyatgtttaaaaataaaactcaggct

SEQ ID NO: 7337 - DNA, 50 bp, homo sapien
ctaaggaagcttattaaatataggcrgaatttataatgattgtcttagag

SEQ ID NO: 7338 - DNA, 50 bp, homo sapien
atcctctaaaaaatcacaaaatacartatgaattcacagttaagcttcca

SEQ ID NO: 7339 - DNA, 50 bp, homo sapien
aatctctttgtaaaaatgaaaacatratctgcttagaatttaaaataaaa

SEQ ID NO: 7340 - DNA, 50 bp, homo sapien
tgagaacttattttatgactactgasatgggatcagaattgaatttgcta

SEQ ID NO: 7341 - DNA, 50 bp, homo sapien
ttttctgcagcaatttatccgaacarctaagtacatcttggaggtgtccg

SEQ ID NO: 7342 - DNA, 50 bp, homo sapien
gtggaatataaaaggctctcagcaawtatgtaaagaataaatgtgaatgg

SEQ ID NO: 7343 - DNA, 50 bp, homo sapien
tgctctgtgtaagaatgactttaccrcttaaaatatgagtgaaaagaatg

SEQ ID NO: 7344 - DNA, 50 bp, homo sapien
ggtcttcttggccttgttctctggartaaagatcaagccccatggaagag

SEQ ID NO: 7345 - DNA, 50 bp, homo sapien
agacaaactggaagtgtaagagatgsaatactactgactgactaaattaa

SEQ ID NO: 7346 - DNA, 50 bp, homo sapien
gctataggaagaaaaatatccaaagragactgaagagttggttgaatgag

SEQ ID NO: 7347 - DNA, 50 bp, homo sapien
aagctattgaaatgtccatccagaaygataaaattgtgtataattatgtg

SEQ ID NO: 7348 - DNA, 50 bp, homo sapien
atttcccagggcaaatttggagagtraaagaaaagagtgccaaggaggga

SEQ ID NO: 7349 - DNA, 50 bp, homo sapien
ctcagttgtctttgtacttgtaaaaygcatgaattccttcttcagtagta

SEQ ID NO: 7350 - DNA, 50 bp, homo sapien
atgtagtgtctgaattgggtaattargattttatgttacagtgtttaaga

SEQ ID NO: 7351 - DNA, 50 bp, homo sapien
ttagatcaatagacctgtaacaaaaygagaaagcaactgaaaacatggaa

SEQ ID NO: 7352 - DNA, 50 bp, homo sapien
atcaacattgacttagtgactattakggaaatgcatattaaaaccacaat

SEQ ID NO: 7353 - DNA, 50 bp, homo sapien
cgtgggagtgagttcattatctcaakagtgaatttgttataaaagcaagc

SEQ ID NO: 7354 - DNA, 50 bp, homo sapien
gttctagtgttttcccttgtttttayatactctctgttttaaagatctaa

SEQ ID NO: 7355 - DNA, 50 bp, homo sapien
attattatctatatggcaagaaagartaatcattgtttatatcctgaagt

SEQ ID NO: 7356 - DNA, 50 bp, homo sapien
aaagggcaggaagtgggccctaagakcctgtttggttgaaaatagttttc

SEQ ID NO: 7357 - DNA, 50 bp, homo sapien
tttagaagccaaatttaatcatctasctaaattaacaaattgtacaactg

SEQ ID NO: 7358 - DNA, 50 bp, homo sapien
caattctataataaaatgagtacaaygtcagtatcagtgttctaatagtt

SEQ ID NO: 7359 - DNA, 50 bp, homo sapien
agtttttatatccaaaagatgaattsaatgccatgttttgtctgttgtaa

SEQ ID NO: 7360 - DNA, 50 bp, homo sapien
tccgctgtttgggtcccatgaacgayggaagcctcccagtgagatcttca

SEQ ID NO: 7361 - DNA, 50 bp, homo sapien
aggctgtcatgggatgagataacacygtggagccttactcttgactgcta

SEQ ID NO: 7362 - DNA, 50 bp, homo sapien
aacatggttatctgttttgagaccasggtcactctagcagtcaagagtaa

SEQ ID NO: 7363 - DNA, 50 bp, homo sapien
caaagaagataaacaaatggtcaacragaactttgatactcaatatcatc

SEQ ID NO: 7364 - DNA, 50 bp, homo sapien
ttccagagcctccaagctgtaccgcwcccctagctctagtcctacccatt

SEQ ID NO: 7365 - DNA, 50 bp, homo sapien
atttccacacttgagcctaatctaayggttgctcttcaccaagagtagat

SEQ ID NO: 7366 - DNA, 50 bp, homo sapien
gagaatagcaagtatcacacgaacaytaaaactggagtgtgaagcaaggc

SEQ ID NO: 7367 - DNA, 50 bp, homo sapien
caagacagggccttcaggtgggaacsgccggaggagtcacccagcaggaa

SEQ ID NO: 7368 - DNA, 50 bp, homo sapien
aaaacctaaagtctggacatttaaayacctctatccatttctctcatttc

SEQ ID NO: 7369 - DNA, 50 bp, homo sapien
atgaattactaatatcgactctttaygctccactgagaaagcaattttgg

SEQ ID NO: 7370 - DNA, 50 bp, homo sapien
tttgggttatagttacctgtatccayggtttttcattctagaagagattt

SEQ ID NO: 7371 - DNA, 50 bp, homo sapien
gagttcaggacaaaccagatcaagcrgaagtttgggttgaccacgtcatc

SEQ ID NO: 7372 - DNA, 50 bp, homo sapien
gagtcaacacatgttattaagtttcyaaatgtaatcagcccagatatttt

SEQ ID NO: 7373 - DNA, 50 bp, homo sapien
ggcagatacatcccggttgattctaygccacggactattcggaaggtggc

SEQ ID NO: 7374 - DNA, 50 bp, homo sapien
caaatgaaaggctgaaatgcaatcayaggaaccatgtatctgctgtctga

SEQ ID NO: 7375 - DNA, 50 bp, homo sapien
cgagtgggtcttaggaggacaagcaycatggaaagaagaaagaaggtacc

SEQ ID NO: 7376 - DNA, 50 bp, homo sapien
ttattgtggcaggaacacttgccatyagatctgtccttttagcagagttt

SEQ ID NO: 7377 - DNA, 50 bp, homo sapien
actatacaaaaattccattaagtaarccttccaattaatgttgtacaaat

SEQ ID NO: 7378 - DNA, 50 bp, homo sapien
caccatcatattaaactcttacttayagagatgcactaacatccaactat

SEQ ID NO: 7379 - DNA, 50 bp, homo sapien
ccagtatccacatctctggccacaaygctgtgttcatggcttggcccgtt

SEQ ID NO: 7380 - DNA, 50 bp, homo sapien
cttcttatccttcatgtgggctctayctgcagaattgtatggtgtgttat

SEQ ID NO: 7381 - DNA, 50 bp, homo sapien
ttttctgtttcatgtctttctgtcayatatagtaaatagatcatttaaga

SEQ ID NO: 7382 - DNA, 50 bp, homo sapien
aagcatcctagaaagtgaagtaacaytgagtccttcctgagagaatgttt

SEQ ID NO: 7383 - DNA, 50 bp, homo sapien
ggtgctgaatacaatccattcaactraagtggtaagttcccatttagtgg

SEQ ID NO: 7384 - DNA, 50 bp, homo sapien
ggtctctcaatttccatcaagacaartggaatcagaacctaaatgaacac

SEQ ID NO: 7385 - DNA, 50 bp, homo sapien
tctttattttcttatccttccaaaasagttatattgccaagttttgttaa

SEQ ID NO: 7386 - DNA, 50 bp, homo sapien
tggtcttctcagtgtgcctattatayggttgaacaaagataggactgcca

SEQ ID NO: 7387 - DNA, 50 bp, homo sapien
ggactgccactaaggtaattttttcrctgaggttgtcctctacttcagat

SEQ ID NO: 7388 - DNA, 50 bp, homo sapien
gcttatcttgattcagggtaaaaaaractcctgtgcttcagattgtgatg

SEQ ID NO: 7389 - DNA, 50 bp, homo sapien
ctactctctgccatgaacccttttaygcctatactctagtgttattttcc

SEQ ID NO: 7390 - DNA, 50 bp, homo sapien
cgaaattagggatctaatggaaataygttgcctgacttgacgaggtgata

SEQ ID NO: 7391 - DNA, 50 bp, homo sapien
aaaccctgctctggggcttactaaayactccctaactaatcacggtcttc

SEQ ID NO: 7392 - DNA, 50 bp, homo sapien
tgaaaaagaaatgggattgtttgccygcagtggttactgagggaagaccc

SEQ ID NO: 7393 - DNA, 50 bp, homo sapien
gagccatgtcagtgttggaaggcatmaacaaagctccccaagtcttctct

SEQ ID NO: 7394 - DNA, 50 bp, homo sapien
cctgcttccctaacagttgcataaaygtctatcatgttcagatcacctgt

SEQ ID NO: 7395 - DNA, 50 bp, homo sapien
ctgaaatggcagcaaatatccttaaygttaatccagagtcctactgtact

SEQ ID NO: 7396 - DNA, 50 bp, homo sapien
ggattttctgttcctgacctcaccamgttcaactgcaggccttagggata

SEQ ID NO: 7397 - DNA, 50 bp, homo sapien
tcatggctgtgtttatacatttagaygatggctttcaaaaggatataaat

SEQ ID NO: 7398 - DNA, 50 bp, homo sapien
cgttggatttgttggttttaatggaratgaccgacagccaggagagagtc

SEQ ID NO: 7399 - DNA, 50 bp, homo sapien
ctatgtgggttcattttttgtgctayatgaatttttggattttttttcta

SEQ ID NO: 7400 - DNA, 50 bp, homo sapien
cttaagagaattttcagtcatgttgsaaatgggttgattgcttgtatgtt

SEQ ID NO: 7401 - DNA, 50 bp, homo sapien
tgatgactgtccgtaaggattgacaragttgatgcgtgatcatgaatttc

SEQ ID NO: 7402 - DNA, 50 bp, homo sapien
tttgttgaattaaattgcagacttartaagatccagtgagagtttttaaa

SEQ ID NO: 7403 - DNA, 50 bp, homo sapien
gggccctaagattcagggatacttayagagcaaggcttagagtgctcagg

SEQ ID NO: 7404 - DNA, 50 bp, homo sapien
cctagcacaggtgtcaaaagaaataygatgaaatgaagataatcttgcta

SEQ ID NO: 7405 - DNA, 50 bp, homo sapien
atctaaactcagtggaccttgttgcratttccaatggactttgactattt

SEQ ID NO: 7406 - DNA, 50 bp, homo sapien
tactttgtcctacttttcttttgacscttataacttcctgacttcggtac

SEQ ID NO: 7407 - DNA, 50 bp, homo sapien
tatactatagttttatttggcttacyatactctccctacgaataagccca

SEQ ID NO: 7408 - DNA, 50 bp, homo sapien
ttccaatttagcaaaatgttggctayaataacttagtgaattacgacaat

SEQ ID NO: 7409 - DNA, 50 bp, homo sapien
taacagctttgataattgcattttcragaaacacttactgttaggtggtg

SEQ ID NO: 7410 - DNA, 50 bp, homo sapien
acaaacctgtcttctgatgaacatakactcctgctggatggtgtcaagac

SEQ ID NO: 7411 - DNA, 50 bp, homo sapien
tgtggcttttactcaagtctagaaaraagtagagatcatttttggataag

SEQ ID NO: 7412 - DNA, 50 bp, homo sapien
gatattggatgaaggcgcaaatgccygacagtaggattctatgccatctc

SEQ ID NO: 7413 - DNA, 50 bp, homo sapien
aacttctcacagtgcacagtgaaggycagcaatgagagccagccccgccc

SEQ ID NO: 7414 - DNA, 50 bp, homo sapien
agctgttttatgttgtattctttcaygcctgtccagttactgcgaaattg

SEQ ID NO: 7415 - DNA, 50 bp, homo sapien
cttgcctgtcctttcagtgatggtargagccgaacgtttggccagaacta

SEQ ID NO: 7416 - DNA, 50 bp, homo sapien
gcttttgactatggtggccacggaayttcagaagtagccaacagatgctt

SEQ ID NO: 7417 - DNA, 50 bp, homo sapien
tggtgaggagacaaagaaagaaacargtggttatgatcagtgcgatgagc

SEQ ID NO: 7418 - DNA, 50 bp, homo sapien
ttttcttatatttaccacaaatcacrgataattctcaagtgttcacagtc

SEQ ID NO: 7419 - DNA, 50 bp, homo sapien
agtctttaacttttagttgtcttaaragaatactgtcatatacctgtact

SEQ ID NO: 7420 - DNA, 50 bp, homo sapien
actttgctgtgctgctggtttcttaygtgttacccagtacaagggttagt

SEQ ID NO: 7421 - DNA, 50 bp, homo sapien
tgtcatgaaaaccagaactaaggaaygtgccagagaagtgtgcctgctcc

SEQ ID NO: 7422 - DNA, 50 bp, homo sapien
ctctgggccctgtgctgtttgatccrctagttagttgggtctttctgact

SEQ ID NO: 7423 - DNA, 50 bp, homo sapien
gggcaatatgtgtttgataagtgaaygagaatgaatgaatgaagcttttc

SEQ ID NO: 7424 - DNA, 50 bp, homo sapien
agccagcacaaaatgaacctttatayagtgaagaccattaggattgagac

SEQ ID NO: 7425 - DNA, 50 bp, homo sapien
tgatcctctaaaggcatatggagtamagtgggataattttaacgtttaga

SEQ ID NO: 7426 - DNA, 50 bp, homo sapien
taatagatctcatttgcagacatgaygaaagacctatagagaaagctgaa

SEQ ID NO: 7427 - DNA, 50 bp, homo sapien
ggtggccattattattaaaacaagarcttattccttgaagtgccaaatga

SEQ ID NO: 7428 - DNA, 50 bp, homo sapien
agagatgggctcagagaggtgaggawattataaacttcagcttcttgggg

SEQ ID NO: 7429 - DNA, 50 bp, homo sapien
cactcccagagcaactcttaaacaaygaaggagaggagctggcagataaa

SEQ ID NO: 7430 - DNA, 50 bp, homo sapien
taggctatgtgtgtaaagtgtatatraaaagtaaattttgtgtttaggct

SEQ ID NO: 7431 - DNA, 50 bp, homo sapien
tttgagaatccttgggtgagaattaygtggatttcaagttttctaggaag

SEQ ID NO: 7432 - DNA, 50 bp, homo sapien
tgactgtctgcagacagatggaaackgcataccacattctggcaatcttc

SEQ ID NO: 7433 - DNA, 50 bp, homo sapien
atctacacctgctccagaatcactaygctccagaattacatccaggcctt

SEQ ID NO: 7434 - DNA, 50 bp, homo sapien
aattgtagattcagccatgactgaawacagaattatatctttaatccccc

SEQ ID NO: 7435 - DNA, 50 bp, homo sapien
tgtcacatgataataaactataacartggtcatcttagctataatttatt

SEQ ID NO: 7436 - DNA, 50 bp, homo sapien
tcaatagcaacctcctaatgtggaaycttatcatatgtatacaaacacaa

SEQ ID NO: 7437 - DNA, 50 bp, homo sapien
attgttatagtttattatcatgtgasattcactagatcctgaggtagaag

SEQ ID NO: 7438 - DNA, 50 bp, homo sapien
ttttccacaggacaggaatgagggawgttatcttactggttagatccaat

SEQ ID NO: 7439 - DNA, 50 bp, homo sapien
atttacttaggtctttaatttcaacratggtttgtacttttcagcagaca

SEQ ID NO: 7440 - DNA, 50 bp, homo sapien
attgtccttatcctgttttcttggaygtcaattgcatatatgttggatat

SEQ ID NO: 7441 - DNA, 50 bp, homo sapien
gaaataacaccctgaatcagaggtcygaaagaggaaatcaaagatgccac

SEQ ID NO: 7442 - DNA, 50 bp, homo sapien
gctgtgctgtcgacactatttctaayctttgtcatataaacaatgccaca

SEQ ID NO: 7443 - DNA, 50 bp, homo sapien
atctggtctgccatctgtttttgtayggcccatgaaggaagaatggtttt

SEQ ID NO: 7444 - DNA, 50 bp, homo sapien
cattcaaggaaaggaaaatgctgcaraaaactagtggaggtgtgaaggct

SEQ ID NO: 7445 - DNA, 50 bp, homo sapien
ctctacaactctcaggtcacagctgraatattacctcctctcagaacccg

SEQ ID NO: 7446 - DNA, 50 bp, homo sapien
tcgcacaggagtcttttaactgctcrattgggcttccaggtgccagggct

SEQ ID NO: 7447 - DNA, 50 bp, homo sapien
tgcactttcagggtccttgatcatasgtcctggcctcttcttcagtcaga

SEQ ID NO: 7448 - DNA, 50 bp, homo sapien
atacacatctaagttgccattataaytgttctggggatatccacccaggt

SEQ ID NO: 7449 - DNA, 50 bp, homo sapien
tccctctcttttacttcacttttagrcctatcatttttttctgattgacc

SEQ ID NO: 7450 - DNA, 50 bp, homo sapien
ttatatatgtgtactagatttcccawatgaaactttacaatttatgaaag

SEQ ID NO: 7451 - DNA, 50 bp, homo sapien
atagactttctaagggagtggattgragttagattttgatagattttgat

SEQ ID NO: 7452 - DNA, 50 bp, homo sapien
gcttctttctgacaattttctaatcrcacaggagtcttttaactgctcga

SEQ ID NO: 7453 - DNA, 50 bp, homo sapien
agataattttgaagtagagaatttamatccgaataatctttgatcccacc

SEQ ID NO: 7454 - DNA, 50 bp, homo sapien
atatcttgtgtaacttcaagtattaygattgtgagagagctttttaaagg

SEQ ID NO: 7455 - DNA, 50 bp, homo sapien
ataggaaaactataatttatttaacrcaacacctattatttgactgtggg

SEQ ID NO: 7456 - DNA, 50 bp, homo sapien
agcagatggccatcgaaaacgtaacygattgtttaagtgtgggatgtgac

SEQ ID NO: 7457 - DNA, 50 bp, homo sapien
cagctcccagcccagcacctgaccastaacaataatagtaacaacagccg

SEQ ID NO: 7458 - DNA, 50 bp, homo sapien
aatgattcacgttcaaggtcaggccrgagcaaattggaggcgacatgctg

SEQ ID NO: 7459 - DNA, 50 bp, homo sapien
gagaagtaatgcaagaaaaaatacargatactcaaggaacctgaaccaaa

SEQ ID NO: 7460 - DNA, 50 bp, homo sapien
aattattatttcttcaaggtcgacarccaagataaaagtacgtttccata

SEQ ID NO: 7461 - DNA, 50 bp, homo sapien
tgcttctctgttctttctacagcatratgcactgctacttcattgcaaga

SEQ ID NO: 7462 - DNA, 50 bp, homo sapien
gtgaggctgtgaccagtgaatggtaygagatttcaattcattaccagaaa

SEQ ID NO: 7463 - DNA, 50 bp, homo sapien
tgttgtagcaacaactctactcccartatcaatcttcctggtactgtttt

SEQ ID NO: 7464 - DNA, 50 bp, homo sapien
tggttctgccaggatttggaccatcrcattcaccatggcctaagcccact

SEQ ID NO: 7465 - DNA, 50 bp, homo sapien
ctcacatgcaaggaaactaggttacragaatcccagcaccaggcattcac

SEQ ID NO: 7466 - DNA, 50 bp, homo sapien
ggagatcatgcactctagccaaatargaatacttcaagctccccaaatgc

SEQ ID NO: 7467 - DNA, 50 bp, homo sapien
tcagtttgggttgaataaaatcaggkatgtttctcattagggcctcaaca

SEQ ID NO: 7468 - DNA, 50 bp, homo sapien
atctcgataatgtttttgtgtatcartatgctttgtgaaaaaacttcgag

SEQ ID NO: 7469 - DNA, 50 bp, homo sapien
tgtgaaaaaacttcgaggtagtacarccatatcctatcctgtgcatagac

SEQ ID NO: 7470 - DNA, 50 bp, homo sapien
caagcatactgtagaaatcgctgtgragagatgcatttagatgaaaaggt

SEQ ID NO: 7471 - DNA, 50 bp, homo sapien
tgactgactactaatgagatcaaagsctttatttcttgcttagttgacat

SEQ ID NO: 7472 - DNA, 50 bp, homo sapien
aggattaccctctgggttgagcttasaagtctgtcttaggatctcttttt

SEQ ID NO: 7473 - DNA, 50 bp, homo sapien
ctttgacattaatcttaaagttcaaytggagagctctcacattagttcag

SEQ ID NO: 7474 - DNA, 50 bp, homo sapien
tttctacgagagttcaaagatacaaygaatctattgcagcacttaaatat

SEQ ID NO: 7475 - DNA, 50 bp, homo sapien
catcaacctggaaggcaagttatgcmctaaaagctgggtcagataaaatg

SEQ ID NO: 7476 - DNA, 50 bp, homo sapien
cctatataaatacatgctgtgtaaastgggtacccaagaacagcaagcaa

SEQ ID NO: 7477 - DNA, 50 bp, homo sapien
atcaatgttgagagcaattgtcagakgatatcaggaagaactaatacaat

SEQ ID NO: 7478 - DNA, 50 bp, homo sapien
cactcaggtcacaaggactccataaycaagtcaaaatctttgaaccttgt

SEQ ID NO: 7479 - DNA, 50 bp, homo sapien
tgagaacattaaattttcaagatccygattagatcctccccatgtccttt

SEQ ID NO: 7480 - DNA, 50 bp, homo sapien
atgtttttctattgatatggaaatartagaattgacacatggaaacttta

SEQ ID NO: 7481 - DNA, 50 bp, homo sapien
aaataaatgtatttaatatagctaaytactaaagactactcgtaatttta

SEQ ID NO: 7482 - DNA, 50 bp, homo sapien
gatggggaaagaccttggtgtaggcratgatctttaagcagcaaagatat

SEQ ID NO: 7483 - DNA, 50 bp, homo sapien
gaaaaaggtacacttgaaaacagatsaataaattaccgaatttgaagaac

SEQ ID NO: 7484 - DNA, 50 bp, homo sapien
atgctattagtacgtttggctcacaygcacctctgtacttgtatttattt

SEQ ID NO: 7485 - DNA, 50 bp, homo sapien
gtgcttgaccgcattcttgctttcaycacggaactaaagccgttatgaca

SEQ ID NO: 7486 - DNA, 50 bp, homo sapien
aggtacactcactacttttattaaamcaagcacagataccaagtttttga

SEQ ID NO: 7487 - DNA, 50 bp, homo sapien
cgcttgaagaaaactcagtgacataycttgctcagtagtttcttattcct

SEQ ID NO: 7488 - DNA, 50 bp, homo sapien
agaattatacctttttgtgcctgtcyacctgttggttcatgtggcaacca

SEQ ID NO: 7489 - DNA, 50 bp, homo sapien
cttttaaacatgtaattataacagcyaaagttacaagcacttcatgtgta

SEQ ID NO: 7490 - DNA, 50 bp, homo sapien
tctggtgaagtctttaaggaggcccrataaataacacctctttccttcac

SEQ ID NO: 7491 - DNA, 50 bp, homo sapien
gtaagagaaaaaacaatatatattgsaagtaagttaaccatgtacattta

SEQ ID NO: 7492 - DNA, 50 bp, homo sapien
ccaggagcccttgattcttcaaacaygggcctgctatagccctctttata

SEQ ID NO: 7493 - DNA, 50 bp, homo sapien
acccagaagaaaggagttaagagatsacttgctccctgtctggagttgcc

SEQ ID NO: 7494 - DNA, 50 bp, homo sapien
agctcagtggctccatttgaaattcrcctcaaagtatggagctaatgctg

SEQ ID NO: 7495 - DNA, 50 bp, homo sapien
tcgagttgactagtataattaatccraaaagagggagaaagtacaaacac

SEQ ID NO: 7496 - DNA, 50 bp, homo sapien
gagtcctgtggagggttagcagacamgagctgtgcttctgtttgatgggg

SEQ ID NO: 7497 - DNA, 50 bp, homo sapien
aagaaattttatgtttgcttctaccrctttatttttatttatttatttac

SEQ ID NO: 7498 - DNA, 50 bp, homo sapien
aaaagcaactgctatcattaaaatasagtgttctaaagcaatatgtaccc

SEQ ID NO: 7499 - DNA, 50 bp, homo sapien
aagttggacactgaatggaaaactcragccaaagatttgcagggtctttt

SEQ ID NO: 7500 - DNA, 50 bp, homo sapien
tattctgaggtttaatatagccagarataagacatgatggagctgtgggt

SEQ ID NO: 7501 - DNA, 50 bp, homo sapien
aacagaccgtactgaaatcatgagaygttgtaggggatataatgctattg

SEQ ID NO: 7502 - DNA, 50 bp, homo sapien
ctaattagagaggcaggccaaccaayggacaatgttcaaacaacagggaa

SEQ ID NO: 7503 - DNA, 50 bp, homo sapien
tcaagtctaggtctgtatacttcacratcttttcttcttcaagttttaca

SEQ ID NO: 7504 - DNA, 50 bp, homo sapien
agttctaggtacagctactcagttayacttaaactcaagacatcaactaa

SEQ ID NO: 7505 - DNA, 50 bp, homo sapien
ttggaactatttttctttgatttcargtagaagaggtagacaggaaactg

SEQ ID NO: 7506 - DNA, 50 bp, homo sapien
cagatcactgaagtccaagaaaatargtataacctgggcagttttataaa

SEQ ID NO: 7507 - DNA, 50 bp, homo sapien
gactgcccaatactgggtttgcccamtcaggaggaacctacccatacact

SEQ ID NO: 7508 - DNA, 50 bp, homo sapien
ttggcaactggtaggatggagaaaaytaaacagccatagagttagacatc

SEQ ID NO: 7509 - DNA, 50 bp, homo sapien
gtcatctccttgtaacttagcttaayttaaagtacctttaagctagccag

SEQ ID NO: 7510 - DNA, 50 bp, homo sapien
atgaaattcatagaatatctgatatkaagtaacatactgagagaattttt

SEQ ID NO: 7511 - DNA, 50 bp, homo sapien
cgtgcttgacatatgccctgaaataygcacgtttccttgtaaatatgcca

SEQ ID NO: 7512 - DNA, 50 bp, homo sapien
aagccattcatcagctctaggccaaygtgaaacccgtggtaccggagccc

SEQ ID NO: 7513 - DNA, 50 bp, homo sapien
aggacaggtttaatcaggaaccctasacgaaagcaggaagcagagtcagt

SEQ ID NO: 7514 - DNA, 50 bp, homo sapien
ttcccaattccatgttcagggatacmacaaaattggccctagtgggggta

SEQ ID NO: 7515 - DNA, 50 bp, homo sapien
tggctcagtgtcgggtgcagaggtcragatggtaagttggccaattgact

SEQ ID NO: 7516 - DNA, 50 bp, homo sapien
ttctcctgttgtggcaattgttctaygaaagtgtccactgtgatgtcctc

SEQ ID NO: 7517 - DNA, 50 bp, homo sapien
aatccaggccacacaatggacagtcycaggattctgatgagcaaaccacc

SEQ ID NO: 7518 - DNA, 50 bp, homo sapien
taccccatgtcattataaacaaacgmcgctttctttgcagctaataacca

SEQ ID NO: 7519 - DNA, 50 bp, homo sapien
aaggctgcaacacagccattttttayagttgaagtccctgcttgccactt

SEQ ID NO: 7520 - DNA, 50 bp, homo sapien
aacagtttgggagggagaataagatkaaagagtagattgagagcttggtt

SEQ ID NO: 7521 - DNA, 50 bp, homo sapien
catctttagatcttctctcagtctamaattctccctaggcagtcttactc

SEQ ID NO: 7522 - DNA, 50 bp, homo sapien
tgcaaactgtacaaaactgcataaartagaaagttaaagctccctgtaac

SEQ ID NO: 7523 - DNA, 50 bp, homo sapien
actgagtttatctttcagaaattcamaatgctacatgtatattcagaaat

SEQ ID NO: 7524 - DNA, 50 bp, homo sapien
aaagcatctatgttcactgacctagyccttgtcattacattgaaattatt

SEQ ID NO: 7525 - DNA, 50 bp, homo sapien
taagttatataccaagggcccactaygaaatggaacaagcattttgtgat

SEQ ID NO: 7526 - DNA, 50 bp, homo sapien
gggcagaaggcccctctctatagcaraatatcaaagcactggcaatggta

SEQ ID NO: 7527 - DNA, 50 bp, homo sapien
ccaagcctggcctcatcctgagatcygaaacaaatgtttaactgtctgaa

SEQ ID NO: 7528 - DNA, 50 bp, homo sapien
tcaactagctgctaacttggctctcracttccaaggtttataaacaagtg

SEQ ID NO: 7529 - DNA, 50 bp, homo sapien
ttatgaagatccattagctctaatakgaggaaaccagagatgctattggt

SEQ ID NO: 7530 - DNA, 50 bp, homo sapien
aagaggataccaaccctatgctgaasgatttccctctggggaacaaaatg

SEQ ID NO: 7531 - DNA, 50 bp, homo sapien
agtgtctgtatgcagggaatccaaayctaaaacagagaaactgacccagt

SEQ ID NO: 7532 - DNA, 50 bp, homo sapien
gcctggtaggaaagaccactagagartaactttgcttctctagccagcaa

SEQ ID NO: 7533 - DNA, 50 bp, homo sapien
tctcttggcttaaatgtcaccttgaygaggggctatcactcagtctgtct

SEQ ID NO: 7534 - DNA, 50 bp, homo sapien
agggtaggctcagcttccaccaccamagagtgtctggcagtagcatccag

SEQ ID NO: 7535 - DNA, 50 bp, homo sapien
ggaaatttgtcagctgttggaaaacwcttcaactcatatgaatgaaataa

SEQ ID NO: 7536 - DNA, 50 bp, homo sapien
ggaggtcttgggaaattagaggtccrgataaggagcatgattgtccaagg

SEQ ID NO: 7537 - DNA, 50 bp, homo sapien
gggtgataggggctgctgtaatgaasactcccactgaggagcagtggaga

SEQ ID NO: 7538 - DNA, 50 bp, homo sapien
gacagttggtcctggcggtcaggtasagcatctgttctgtatcaagcctc

SEQ ID NO: 7539 - DNA, 50 bp, homo sapien
gtttcacaaaggtgaaacgagaattmaatgatgtgcaaacactccacacc

SEQ ID NO: 7540 - DNA, 50 bp, homo sapien
tttgaatgaaagacacatgaattacyattgaagatatgagtatttttccc

SEQ ID NO: 7541 - DNA, 50 bp, homo sapien
aattattggcataacttattgtgtaygtaaattccaaaataatctatata

SEQ ID NO: 7542 - DNA, 50 bp, homo sapien
gcaatctcgagtctaaaacgactccraagactaaggtgggaagttcagag

SEQ ID NO: 7543 - DNA, 50 bp, homo sapien
cctagcagatttcaggttatactaaygagaggaaagtaaatagaaaaaaa

SEQ ID NO: 7544 - DNA, 50 bp, homo sapien
cccatgtaagaaatagtctgtttaayggtcacatcaggcatcaatcaaat

SEQ ID NO: 7545 - DNA, 50 bp, homo sapien
aaagtcacaattttctaggcccttcrattgcaggttttccttggtcttca

SEQ ID NO: 7546 - DNA, 50 bp, homo sapien
gcagttgaacatggcaggctgaagaycaaggaaaacctgcaatcgaaggg

SEQ ID NO: 7547 - DNA, 50 bp, homo sapien
tcttgggcatatgggcaaaaccttaracagctacctcatggactctttaa

SEQ ID NO: 7548 - DNA, 50 bp, homo sapien
tcagagccatattaaaagatatgagragtctccccttattttccagaaaa

SEQ ID NO: 7549 - DNA, 50 bp, homo sapien
tgatcaaatttacagggttattctayggtcaaataattttttaatgttta

SEQ ID NO: 7550 - DNA, 50 bp, homo sapien
tcttgattcatccactcaactgtcartacagtcgtcctcctttatcctcg

SEQ ID NO: 7551 - DNA, 50 bp, homo sapien
cgtgtggcttctgagttaattttccyaatgacagtttataatcatgacac

SEQ ID NO: 7552 - DNA, 50 bp, homo sapien
ttgagaatgctgcttagatcgtctgyagaatctctcaaaaaaaagtcgca

SEQ ID NO: 7553 - DNA, 50 bp, homo sapien
gagctgtgttttaagaggctgaaackaaaatcagatggaggaataatagg

SEQ ID NO: 7554 - DNA, 50 bp, homo sapien
ttctgctctctgcggttgtttcccaygaatatttactgaagttttatttc

SEQ ID NO: 7555 - DNA, 50 bp, homo sapien
ccatggttaagtttcccattcaaagrcaatataggcataaaatagatgca

SEQ ID NO: 7556 - DNA, 50 bp, homo sapien
gcttcttaagcaggtattcaatctayataaagaatgtgaaataattattt

SEQ ID NO: 7557 - DNA, 50 bp, homo sapien
agggagactctgtaagagaagataaracaagagcaacgactttgtactgg

SEQ ID NO: 7558 - DNA, 50 bp, homo sapien
ggcctcaactttctcatcgacaaaaygaaggagagtagactgtgctttca

SEQ ID NO: 7559 - DNA, 50 bp, homo sapien
tagtcttactcaacaaacaagcgctraattaaacatctcaaagtaatatg

SEQ ID NO: 7560 - DNA, 50 bp, homo sapien
agtggagctgtcctaggcaacactcrcggtctcaggctgcggtgggcgtc

SEQ ID NO: 7561 - DNA, 50 bp, homo sapien
ggaaatcccctcacagttttacaatsacaggttacagaatcctttacaat

SEQ ID NO: 7562 - DNA, 50 bp, homo sapien
tggataaaggaagtcattggagtgamctctctaatatcccttatctagca

SEQ ID NO: 7563 - DNA, 50 bp, homo sapien
aagggtatctcagacctagggattarcttgtatagagtcattcagtcagt

SEQ ID NO: 7564 - DNA, 50 bp, homo sapien
gagcagaggaaggagagattgaaacragaagagtgagatgtccctgggca

SEQ ID NO: 7565 - DNA, 50 bp, homo sapien
tcaagctgggaagagaatattgatamaggtgtttttgagtacataaagca

SEQ ID NO: 7566 - DNA, 50 bp, homo sapien
ggaattgagggaagagctattgtaaygagtattgtagacctattagtatc

SEQ ID NO: 7567 - DNA, 50 bp, homo sapien
gatctcacttttcttatgacatagartaaactgatgcccaaggagagagg

SEQ ID NO: 7568 - DNA, 50 bp, homo sapien
ttaatatctgtttccaactgtggaayggaattaagctcctaaaacacgcc

SEQ ID NO: 7569 - DNA, 50 bp, homo sapien
actgctgccttgtgtgtcagaggcamgtaagctcactatgaagtttggcc

SEQ ID NO: 7570 - DNA, 50 bp, homo sapien
gctaattcacctgttcctatctcctragaattctgcttatgctcataatc

SEQ ID NO: 7571 - DNA, 50 bp, homo sapien
atgctgttctgtaaatttattgaaamctctggaacatttcacctttagag

SEQ ID NO: 7572 - DNA, 50 bp, homo sapien
ttattactattgctttacatttgcartaaaacaaagatcatcatgtagat

SEQ ID NO: 7573 - DNA, 50 bp, homo sapien
atacatataattatcttgtaaaatayctctgaagaactagaaatcaacct

SEQ ID NO: 7574 - DNA, 50 bp, homo sapien
attatgataataaaattatttgtcascattgttttcttctaaaaagagac

SEQ ID NO: 7575 - DNA, 50 bp, homo sapien
ctcctgaagaatgctgaaatgatcartagtgttaaacaggagtagaacat

SEQ ID NO: 7576 - DNA, 50 bp, homo sapien
aagcttcccaggagcagaaactggarccaaggcagtccttcagacctcag

SEQ ID NO: 7577 - DNA, 50 bp, homo sapien
tatgaaccacttcaaagtaattgtaracttttcattaataaacacttcag

SEQ ID NO: 7578 - DNA, 50 bp, homo sapien
gctattttaaaaactatgtattataracatcttcaagaatacagaaaaat

SEQ ID NO: 7579 - DNA, 50 bp, homo sapien
ctccatttttttgctgctctttcatwaaatgtgaggcagcacagtgcaga

SEQ ID NO: 7580 - DNA, 50 bp, homo sapien
tatttaaaatctccaaacagaaatcyactgaagtgcaataattttattgt

SEQ ID NO: 7581 - DNA, 50 bp, homo sapien
taggatgtcatggaggtgatttgaamagggaactcagtatagaatgagtt

SEQ ID NO: 7582 - DNA, 50 bp, homo sapien
ttaaactaaaagctagatgaatttaygcaactctttcctctctgtttagg

SEQ ID NO: 7583 - DNA, 50 bp, homo sapien
cttcacttcaaaatctttaactgcaygttcacagttggctttatctatcc

SEQ ID NO: 7584 - DNA, 50 bp, homo sapien
tctgatagatgcaaaaatgcgttacygggagccagcagagcacacagggt

SEQ ID NO: 7585 - DNA, 50 bp, homo sapien
caaaagttactcaaaattaaagtaayatgtagtggccttagtcattgata

SEQ ID NO: 7586 - DNA, 50 bp, homo sapien
attgaaacaaagcccctttttgagayatgaggacacaggcctggccaagg

SEQ ID NO: 7587 - DNA, 50 bp, homo sapien
gagtaagaagatgctttaattatgasacttttacctacatcttcatcttc

SEQ ID NO: 7588 - DNA, 50 bp, homo sapien
tgaagattttactgaagatcaataartggtgctaagttaattaaatatca

SEQ ID NO: 7589 - DNA, 50 bp, homo sapien
tttcctctctgaaactagctctccayagcctttgtcccacactcctctca

SEQ ID NO: 7590 - DNA, 50 bp, homo sapien
caaaaactggtggaaagaatgcgaayggtataatgggaatgtttctaaca

SEQ ID NO: 7591 - DNA, 50 bp, homo sapien
ctttgcctgcgtttcttcatggtcaraatggatggctccttgttatctgt

SEQ ID NO: 7592 - DNA, 50 bp, homo sapien
tatgcaacaacaagccctgggcatckacttaaatctgtttgtgtgaattt

SEQ ID NO: 7593 - DNA, 50 bp, homo sapien
acaaaattctctaggttgtataatcrattattgcagtttccactaccact

SEQ ID NO: 7594 - DNA, 50 bp, homo sapien
agtcccttcatagtgacttgctctcyagttctcgggacgctgcaggcctt

SEQ ID NO: 7595 - DNA, 50 bp, homo sapien
acatcactcagaatccaattttgaarcacagtagtagatcatttgttgaa

SEQ ID NO: 7596 - DNA, 50 bp, homo sapien
ccctaagatctctattccatattcargttcttatgttttgttgaagtaat

SEQ ID NO: 7597 - DNA, 50 bp, homo sapien
gatatgccacccgcatccttgttcaygtaaagatattttactcgagccgt

SEQ ID NO: 7598 - DNA, 50 bp, homo sapien
gtggaaggacatgacaagggggttayacaggtggcgaagagaagatagag

SEQ ID NO: 7599 - DNA, 50 bp, homo sapien
cagagaatggcctgctatttagataygaagcatcttttagaatggaagct

SEQ ID NO: 7600 - DNA, 50 bp, homo sapien
tgcagtaggcccagcatgaccaaaaytctgtgactctatcttctcttcgc

SEQ ID NO: 7601 - DNA, 50 bp, homo sapien
ctaaatgttcacatagccagtaaaaytctatgccaccaaactttaaagtg

SEQ ID NO: 7602 - DNA, 50 bp, homo sapien
tctgcctgatcccatagatcccatakatcgtgtttttaagcaccctgcaa

SEQ ID NO: 7603 - DNA, 50 bp, homo sapien
acagaaacactgcaaataatactcamatgtcctgggcctgctgccttgca

SEQ ID NO: 7604 - DNA, 50 bp, homo sapien
tgggtaactaaatgaaatcaccactyagaagaatcgattatttgtgtttt

SEQ ID NO: 7605 - DNA, 50 bp, homo sapien
tacaaagataaagatatttttgaggracgttatttagagtttgtttgtga

SEQ ID NO: 7606 - DNA, 50 bp, homo sapien
tgtaccccaaaatcaccatacgtaawaaatagtctgaaattttatagcta

SEQ ID NO: 7607 - DNA, 50 bp, homo sapien
tttgcttgcttgccaattattgttaygtggcgccagtaaatacaatctta

SEQ ID NO: 7608 - DNA, 50 bp, homo sapien
acacagtattgtcctagaatatagaygagttaattttaggaagcctgaac

SEQ ID NO: 7609 - DNA, 50 bp, homo sapien
tattgatatgtccctttcactttacmaacgtagaaatgagccaaaaatag

SEQ ID NO: 7610 - DNA, 50 bp, homo sapien
tgaaagtttcctgcaaacagtttackagagcatgaggttgttcattgttc

SEQ ID NO: 7611 - DNA, 50 bp, homo sapien
ccaccagaaaagctgacaacttttayagccaacatatctgggtgtattta

SEQ ID NO: 7612 - DNA, 50 bp, homo sapien
tcattttagtttattgctgcaattayctaacaaaagatcccattagcctt

SEQ ID NO: 7613 - DNA, 50 bp, homo sapien
caaggtggcaccagagaaggatgaaractaacttaaataaattaaaggcc

SEQ ID NO: 7614 - DNA, 50 bp, homo sapien
aaatttttataaatcctgttgttccmatctatatatatatatttttgaga

SEQ ID NO: 7615 - DNA, 50 bp, homo sapien
tgctgtcactctattggctctgtgcyattgtaggaaaattgtatgttaag

SEQ ID NO: 7616 - DNA, 50 bp, homo sapien
actaaacagggtttctgtgcattggycatgaaagttatcttcaaattaaa

SEQ ID NO: 7617 - DNA, 50 bp, homo sapien
gcatttaccctaccctgcctaaatcrctagttttcctccaaggcaactgg

SEQ ID NO: 7618 - DNA, 50 bp, homo sapien
agcttcatagattattctttggtcakacaggactgaaaaccacagattta

SEQ ID NO: 7619 - DNA, 50 bp, homo sapien
ttaagttttaagagatgttttatacrccatgtttcatttactcttctcaa

SEQ ID NO: 7620 - DNA, 50 bp, homo sapien
ttcaaaaatattaattgagcatctamcgtgtaataaccactattcttagc

SEQ ID NO: 7621 - DNA, 50 bp, homo sapien
ggcattggtcaatcagacattatccrctgcaatagacatttgtatttgca

SEQ ID NO: 7622 - DNA, 50 bp, homo sapien
tattatatagctttggtaatcaaaayggcctggtactggcagaggaatag

SEQ ID NO: 7623 - DNA, 50 bp, homo sapien
atttattgactcttaattttcttagyacagcttaaaaccttccccttcat

SEQ ID NO: 7624 - DNA, 50 bp, homo sapien
gctttgatcattgtgtccttttgcasatgagaagacggaggcaacagagg

SEQ ID NO: 7625 - DNA, 50 bp, homo sapien
caagctttatagaggtggtgactgcsgatacaagattgtggccctgatcc

SEQ ID NO: 7626 - DNA, 50 bp, homo sapien
gcacctcttcaggtctgtctcatacyattctttccaatcattttctatag

SEQ ID NO: 7627 - DNA, 50 bp, homo sapien
caatatgaatcatgttactataggaygtataaggcataaatgctcttttc

SEQ ID NO: 7628 - DNA, 50 bp, homo sapien
ttccttatattaatataagatttgaygattatgctatttttatactgagt

SEQ ID NO: 7629 - DNA, 50 bp, homo sapien
tattgtttctgttggtactcttttcrcattactataaagtcattttgtga

SEQ ID NO: 7630 - DNA, 50 bp, homo sapien
gattgcaggaaggttgtaactttgayaatatcctttaccttgatttattc

SEQ ID NO: 7631 - DNA, 50 bp, homo sapien
aaaggtaaggtagtgaaaatgttacyatcgacacaactactactaaacaa

SEQ ID NO: 7632 - DNA, 50 bp, homo sapien
aacaaagggtacgtgtgggtaagaayggagaaagagactagaaaggtggt

SEQ ID NO: 7633 - DNA, 50 bp, homo sapien
tcagcagtattgataaaaatggtaaygacttgaagatttcctggttccta

SEQ ID NO: 7634 - DNA, 50 bp, homo sapien
tcttcctctcttgtgtgttaggaccracaggatcattcagggcaaggtga

SEQ ID NO: 7635 - DNA, 50 bp, homo sapien
agctagtaattaccaacatctctaayggttaacaacagtaattttatcat

SEQ ID NO: 7636 - DNA, 50 bp, homo sapien
tttaggtaacaaatatgtgttgatcycgtgtaagaaccaggcactgtaga

SEQ ID NO: 7637 - DNA, 50 bp, homo sapien
aggtcactaaatccctgttttttgaytattaggcacagaacaaatacatt

SEQ ID NO: 7638 - DNA, 50 bp, homo sapien
tacttgcctattaaatgtctgtgaamtgaatcaatttctcacataccaca

SEQ ID NO: 7639 - DNA, 50 bp, homo sapien
aagcctgacagaaaacagcaccagayagatttttccccagcttcaaaata

SEQ ID NO: 7640 - DNA, 50 bp, homo sapien
agggccttcaaatgaatatgctaaayggttatctttcaataaagagagta

SEQ ID NO: 7641 - DNA, 50 bp, homo sapien
tgtgctttcttatgaaataaatctaracaggaagcctggttttgctacgt

SEQ ID NO: 7642 - DNA, 50 bp, homo sapien
agcttccccaaaattttgaaggaaarttgagaaattgagaggggagatta

SEQ ID NO: 7643 - DNA, 50 bp, homo sapien
agaagtactagctcaagagtaaaacrgaatgggaaagcatagtcatttcc

SEQ ID NO: 7644 - DNA, 50 bp, homo sapien
aatagacattccttttgtatttggaraagataactgttgggtactgagct

SEQ ID NO: 7645 - DNA, 50 bp, homo sapien
agcactgacacaccagcccttgctaygtcggtctcctccaaactttgggc

SEQ ID NO: 7646 - DNA, 50 bp, homo sapien
agcagtagactgctgtttttcatcayaagccatgtaacacatatcatatt

SEQ ID NO: 7647 - DNA, 50 bp, homo sapien
agtatcttctcatcagatttttagayaattaaatgcatcaacatatgaga

SEQ ID NO: 7648 - DNA, 50 bp, homo sapien
attgagtttgtttttacaatagtaaytgaatgtgcatagaattattctct

SEQ ID NO: 7649 - DNA, 50 bp, homo sapien
taaaggacatcttggttgtttccaaygaacagaactgctgtaagcatcca

SEQ ID NO: 7650 - DNA, 50 bp, homo sapien
acgtacactattgggcagtaacacartcaactgaaataagagaataattc

SEQ ID NO: 7651 - DNA, 50 bp, homo sapien
aaaatgattataaacaacttagaacrccaaatttacaacaataaagtatg

SEQ ID NO: 7652 - DNA, 50 bp, homo sapien
ccaggactgtaatccagtttcagaayattttcatctccctaatatgatcc

SEQ ID NO: 7653 - DNA, 50 bp, homo sapien
cttatgttgctttaagacaactcccrcttatcagtcaaatcagggaagat

SEQ ID NO: 7654 - DNA, 50 bp, homo sapien
gaaagaatttgtgtgagactggtaamctttcttccctgaatgaggagaat

SEQ ID NO: 7655 - DNA, 50 bp, homo sapien
aggagaattcagaactaaaataatayggcctgcaaatcctttgtgggaaa

SEQ ID NO: 7656 - DNA, 50 bp, homo sapien
cagattctagtgttttgctgagtacmatattgattttagtaaaaacccat

SEQ ID NO: 7657 - DNA, 50 bp, homo sapien
cctgaacttgtgacttgctttgtaaytgatactgtttgattgacaggatg

SEQ ID NO: 7658 - DNA, 50 bp, homo sapien
catggatctcacacaatggctaatayagttaagtctaatgagatgggcct

SEQ ID NO: 7659 - DNA, 50 bp, homo sapien
gatatcatatataatcaagttctacrggcatgtcaaatataatcctgtcc

SEQ ID NO: 7660 - DNA, 50 bp, homo sapien
gctgcagttgatggaacctcgaaacyaacagtattttagaagcttcttct

SEQ ID NO: 7661 - DNA, 50 bp, homo sapien
tgaaattttggaatatccattagtgragcagaaagctaatggaggtactt

SEQ ID NO: 7662 - DNA, 50 bp, homo sapien
tgagcacatcactcattttccatcarctaatccagatgtccttctcccag

SEQ ID NO: 7663 - DNA, 50 bp, homo sapien
cagggacctaactgtggaagaactamggaatgtaaatgtatttttcccac

SEQ ID NO: 7664 - DNA, 50 bp, homo sapien
atcagaatgcaactgtccttagatayaaatgtgtaagaaaaacagtggtt

SEQ ID NO: 7665 - DNA, 50 bp, homo sapien
ttgaagctttgcttttcttatttcawccaggcacaccacaactcatgaat

SEQ ID NO: 7666 - DNA, 50 bp, homo sapien
tgtcgtttggaggaaaaagaaacgayatcatgctttgctaaaacagagct

SEQ ID NO: 7667 - DNA, 50 bp, homo sapien
tgggacaggcttttatctaaaagaargaccacgtgtgttctctcatctct

SEQ ID NO: 7668 - DNA, 50 bp, homo sapien
caccttcacctactgaaatgtacaamccagaaattgtaagatgcggtcta

SEQ ID NO: 7669 - DNA, 50 bp, homo sapien
agtgacgctggaaataagagcaccargatacgaatcaggacacctgggcc

SEQ ID NO: 7670 - DNA, 50 bp, homo sapien
tagaagtgactctgtacttttttaaygttgagctactccatctccaaact

SEQ ID NO: 7671 - DNA, 50 bp, homo sapien
acaaaattaaatgagagttctatcayacatttggctaagttcaggtttgc

SEQ ID NO: 7672 - DNA, 50 bp, homo sapien
tcacagcaggcaacacaagaagaatmaaatgtggtcacaagaattgagca

SEQ ID NO: 7673 - DNA, 50 bp, homo sapien
aaggtaaaataaacaactaaaatcartcatatcgaggaaagaacaaacat

SEQ ID NO: 7674 - DNA, 50 bp, homo sapien
ggctcccccacactgattttctaaakttgggctggacacaggagctggtt

SEQ ID NO: 7675 - DNA, 50 bp, homo sapien
gatggtcattttatttctcttctaayctcggctttttttgttttgttttg

SEQ ID NO: 7676 - DNA, 50 bp, homo sapien
atctgctgcattctgtattctccaartgttgactgtaataaggaaagtgt

SEQ ID NO: 7677 - DNA, 50 bp, homo sapien
cgttctacataattcaagaacaatcmattactactacatcataccaagga

SEQ ID NO: 7678 - DNA, 50 bp, homo sapien
cctttgcaaacttttgtgacttcctyagagattttctttgagctaggtgc

SEQ ID NO: 7679 - DNA, 50 bp, homo sapien
gttcttataaagatatgtggtaatayaagcaaaaaaaaccaacacagcac

SEQ ID NO: 7680 - DNA, 50 bp, homo sapien
catagccctctctagagcactgtccmataaactggtcttcattgctctgt

SEQ ID NO: 7681 - DNA, 50 bp, homo sapien
ttagtggtcatttgcctgtgtaataratgaggtgtatgatagatatctgc

SEQ ID NO: 7682 - DNA, 50 bp, homo sapien
ctgtaccatctaaagcctgagcctawgtctgacctatcttcaagagttct

SEQ ID NO: 7683 - DNA, 50 bp, homo sapien
cccaactacctgaagttcataagaarctaatattgcctgtaaaaacacac

SEQ ID NO: 7684 - DNA, 50 bp, homo sapien
aggtgtcttggcagggcctactccaygttttgaaggtgacattattttag

SEQ ID NO: 7685 - DNA, 50 bp, homo sapien
tttgcatataatgaactgtttcctayctcacaaacttgaaacttttgtct

SEQ ID NO: 7686 - DNA, 50 bp, homo sapien
aaaaaggaattttaacattattagcygagatggaatgcgggtgctactaa

SEQ ID NO: 7687 - DNA, 50 bp, homo sapien
atcaccttcatgttcacaagttgacrcctttcagagcagttatcctaatt

SEQ ID NO: 7688 - DNA, 50 bp, homo sapien
tcagtttataccattattaatttcasctcttgcatatctaataatttcct

SEQ ID NO: 7689 - DNA, 50 bp, homo sapien
taaattagctgctgctttggcttaayagttctcaagatgcattttgtgtc

SEQ ID NO: 7690 - DNA, 50 bp, homo sapien
tttttcttgtggcccttttaccagawacttattctgcagggttctcacat

SEQ ID NO: 7691 - DNA, 50 bp, homo sapien
aaaatgttatttttcaagaataactraaaaaaatgaaatgttacatattg

SEQ ID NO: 7692 - DNA, 50 bp, homo sapien
gcaagatgaaattgaacagtcaaaayggcattaccaaatttgtcaataat

SEQ ID NO: 7693 - DNA, 50 bp, homo sapien
aagaggccagttgttcctaccaaaartgcaatggcctactcaggccttca

SEQ ID NO: 7694 - DNA, 50 bp, homo sapien
atttaaaaagcctgttatctcaaaartgttttaaattcagcattagcatg

SEQ ID NO: 7695 - DNA, 50 bp, homo sapien
aacccagcacctttaggcagaaacasatgtagcagagactttattctaca

SEQ ID NO: 7696 - DNA, 50 bp, homo sapien
attttcagtaataacgttaattagcrgaatgcatgagaagcatctttttc

SEQ ID NO: 7697 - DNA, 50 bp, homo sapien
ttgcaaattagtgacatcagacgaartaatagttgccatcatgttcctcc

SEQ ID NO: 7698 - DNA, 50 bp, homo sapien
agttattttccacttaatatgagcawtatgtaacatttcatttttttcag

SEQ ID NO: 7699 - DNA, 50 bp, homo sapien
ttgaaaaaaaatggtgacaatacccrataaattataagggtatattgtca

SEQ ID NO: 7700 - DNA, 50 bp, homo sapien
atacagaacttccttttttcagtaawgtcagaggcaaacattttaagagt

SEQ ID NO: 7701 - DNA, 50 bp, homo sapien
tgtacaataggcaacaatggctaaakaaactttttgtaaagaaagacgat

SEQ ID NO: 7702 - DNA, 50 bp, homo sapien
ctaggggtgtatttaatgaagccacrcaagaaaggcctagaagctgcaca

SEQ ID NO: 7703 - DNA, 50 bp, homo sapien
ctaatctggctcactggaatgctacrgaatttaagttagggaggaattca

SEQ ID NO: 7704 - DNA, 50 bp, homo sapien
tactagggagtttattattttcaacragaattataggaaactaggcagct

SEQ ID NO: 7705 - DNA, 50 bp, homo sapien
agagaaaaaggaaaaaaataatctcmaaattgtgtccatattgtctcaaa

SEQ ID NO: 7706 - DNA, 50 bp, homo sapien
gtctttcaggcatattgccactcaargagctataagtcttaagtgcaaag

SEQ ID NO: 7707 - DNA, 50 bp, homo sapien
tgtttttgtaatataattggagcacrgtatcaccacttcactggaaacag

SEQ ID NO: 7708 - DNA, 50 bp, homo sapien
taaatatagatatcctgtcaaaaacygtataaacaaaatctatcaaacat

SEQ ID NO: 7709 - DNA, 50 bp, homo sapien
aatcttgtttgacaggatagttttayaagtgaatatattaatgtaagaaa

SEQ ID NO: 7710 - DNA, 50 bp, homo sapien
tacgtcagaatatactctcctctcamattttctgtagtgataaaggaact

SEQ ID NO: 7711 - DNA, 50 bp, homo sapien
ttacttgagatttctattacttccarccaaaataaattcaaccaatggaa

SEQ ID NO: 7712 - DNA, 50 bp, homo sapien
aagatccatccacagctcgagttcartatctatttactactgttttccaa

SEQ ID NO: 7713 - DNA, 50 bp, homo sapien
cttccctgctgctgaggcggattctsagaactaagaatttctgaccttaa

SEQ ID NO: 7714 - DNA, 50 bp, homo sapien
caagattttaacaacacagatagatmataaatagtaaataggcacaaaac

SEQ ID NO: 7715 - DNA, 50 bp, homo sapien
tatatagtacctaccatccctacgamcaattattttaatgaaataaggtg

SEQ ID NO: 7716 - DNA, 50 bp, homo sapien
tgtaaaatggaatttaaaatagtcawcatgtggaataaagaaaataatgt

SEQ ID NO: 7717 - DNA, 50 bp, homo sapien
catattaaggagcttataatttacastatgatctatgagaagccattgaa

SEQ ID NO: 7718 - DNA, 50 bp, homo sapien
atgttgacatacacaagcctactgawctaaatacaactctcgaatcacgt

SEQ ID NO: 7719 - DNA, 50 bp, homo sapien
ctgtactggcgttatagcttcccaaytgatctctgtgctttctatctcca

SEQ ID NO: 7720 - DNA, 50 bp, homo sapien
caccaccctattcccaggagctagamaataatttatggaatatcggctga

SEQ ID NO: 7721 - DNA, 50 bp, homo sapien
gcttgactcagttctaagaaaaaccrgaatgaacagaccctcaccctaac

SEQ ID NO: 7722 - DNA, 50 bp, homo sapien
gcctcttccctctattccattaatasccaattaagtctacccccaaaata

SEQ ID NO: 7723 - DNA, 50 bp, homo sapien
tgtatgactttagagtcgggagaaayttgcgcctgagctagaaatgcact

SEQ ID NO: 7724 - DNA, 50 bp, homo sapien
tgtcttatttttccgcatcggtaaakaatttattccaccagtttttcctc

SEQ ID NO: 7725 - DNA, 50 bp, homo sapien
ttttataaaataattagaactattarattgccgaatgaatctgacatatt

SEQ ID NO: 7726 - DNA, 50 bp, homo sapien
ttccatgctttctgtgcactgtgtcyagcaggataaggtggccaggtaag

SEQ ID NO: 7727 - DNA, 50 bp, homo sapien
aaggccctgttcaacttggtcccaayctttatttccattccatctctcat

SEQ ID NO: 7728 - DNA, 50 bp, homo sapien
tgctctctctctttttttctaactcragagtcaatgttagagcttgattt

SEQ ID NO: 7729 - DNA, 50 bp, homo sapien
aactaaaaatgagccagttttcctaygtgcaatgcaacctcagtacctca

SEQ ID NO: 7730 - DNA, 50 bp, homo sapien
aattattattatcatttaggacagarattaggtatcatctaatctaagaa

SEQ ID NO: 7731 - DNA, 50 bp, homo sapien
gtctgtgactgtctgtgtgttgctayaggaattcagtggaagacctgacc

SEQ ID NO: 7732 - DNA, 50 bp, homo sapien
gaccaaggcaaactttagaccagaartgaaagtttatcaaaaagctttaa

SEQ ID NO: 7733 - DNA, 50 bp, homo sapien
tgttttctgtaccttggtgctcttamataacattgtcaaaaagaaatgct

SEQ ID NO: 7734 - DNA, 50 bp, homo sapien
ctagttggatacaatatcttagtgcwccacattcaatgatccaaatatat

SEQ ID NO: 7735 - DNA, 50 bp, homo sapien
cttactaacttatctttatgctagayattgaatgcttattttactgagca

SEQ ID NO: 7736 - DNA, 50 bp, homo sapien
cccacttcttcttttttctaatcacratttaaaccacttatcaaagctct

SEQ ID NO: 7737 - DNA, 50 bp, homo sapien
catggcttagactagtgcctagcaawttatagttatttaatatgactgtc

SEQ ID NO: 7738 - DNA, 50 bp, homo sapien
aagaaaaacctcttatgattttctaygtaaaggaaccttctgctggaaag

SEQ ID NO: 7739 - DNA, 50 bp, homo sapien
aaattattagtgtacttaaaaatcartgaataactggagcaatatctaac

SEQ ID NO: 7740 - DNA, 50 bp, homo sapien
gtttgtataagggagctgtgggaatrataacttcatcgatatcattgttt

SEQ ID NO: 7741 - DNA, 50 bp, homo sapien
ttttctttgaccactgatttgtaacygtcaccaagtgaaatcctggaaat

SEQ ID NO: 7742 - DNA, 50 bp, homo sapien
caacccaagttaaaaaatcttggaaygtaaaatgaagaaataccttcagg

SEQ ID NO: 7743 - DNA, 50 bp, homo sapien
taatagagtttaaaataggcattcakatatccagctaaaatacatcactc

SEQ ID NO: 7744 - DNA, 50 bp, homo sapien
tttgggttaattaagctgagttcgckctcttttttcacctttttgttagc

SEQ ID NO: 7745 - DNA, 50 bp, homo sapien
tgtgaaaaaagactccttcctgataygccctgaaattcttttttgagagt

SEQ ID NO: 7746 - DNA, 50 bp, homo sapien
cagaaataattttaccagaaatcacrcattgaatcctttctttcacatga

SEQ ID NO: 7747 - DNA, 50 bp, homo sapien
tctttgtggtctcatgtttatttagyaggcatgcactgtttgtataataa

SEQ ID NO: 7748 - DNA, 50 bp, homo sapien
attgatattgccagaaaatgtgccaragtctataatttgcctcttccctc

SEQ ID NO: 7749 - DNA, 50 bp, homo sapien
taatgggaatgggaatgattatagtkaccttgcagaatcaccatgagtac

SEQ ID NO: 7750 - DNA, 50 bp, homo sapien
gtatataaaatgtttagtgcctaggraatagtaagtggagaataaatgga

SEQ ID NO: 7751 - DNA, 50 bp, homo sapien
attaatatgggtacctaacatttagyagagattgcttttcactcagtcat

SEQ ID NO: 7752 - DNA, 50 bp, homo sapien
cccaaccaacccacaggctgatacasgaagccagaaatcatagagaaaac

SEQ ID NO: 7753 - DNA, 50 bp, homo sapien
gcatctcagagagaccaactcactarctgtttttatccctgacattttat

SEQ ID NO: 7754 - DNA, 50 bp, homo sapien
aagaagagagaatacgactgtagaargacagataatagtttgtgcaacaa

SEQ ID NO: 7755 - DNA, 50 bp, homo sapien
agagctgggcatatacagtaggagaygtttgctatattttaggtaattaa

SEQ ID NO: 7756 - DNA, 50 bp, homo sapien
attcctcttgttaaaaaaactgtgarcaatcaagtaaagttctacttttt

SEQ ID NO: 7757 - DNA, 50 bp, homo sapien
aactcacaggtacctacgacgcagamgggaactagggaataaaattaact

SEQ ID NO: 7758 - DNA, 50 bp, homo sapien
gaactgacaaatcattagcaaatcayaggcaataatattacagaacagtg

SEQ ID NO: 7759 - DNA, 50 bp, homo sapien
tctcttttcatatattaactatttawcttacaggtttcagcttaattttt

SEQ ID NO: 7760 - DNA, 50 bp, homo sapien
gagaaatctgttggagtaaatcagastaagtgtttgtgcttgtgctgaaa

SEQ ID NO: 7761 - DNA, 50 bp, homo sapien
cccccagtgttataatgcattgacayagtgtgtatgagaagttaactttg

SEQ ID NO: 7762 - DNA, 50 bp, homo sapien
tgtaattgtgttagtgagttatagaygtagagagaccacaaggactttgt

SEQ ID NO: 7763 - DNA, 50 bp, homo sapien
caaagatagaatttggagaccgagcsactgatgtaattttatcattctta

SEQ ID NO: 7764 - DNA, 50 bp, homo sapien
atggaaggaaggacctcagttgagargactttgcaatcctacagatgagt

SEQ ID NO: 7765 - DNA, 50 bp, homo sapien
ttctcattattttctttatctgcaasaatgtctggctttgtgatctaaat

SEQ ID NO: 7766 - DNA, 50 bp, homo sapien
atggccatcaatgagtgttctcaggwaaattccagaaggaagataagatc

SEQ ID NO: 7767 - DNA, 50 bp, homo sapien
cctccaatagaaggtgcttagaatasaggtgcaccaaatagaataaaagg

SEQ ID NO: 7768 - DNA, 50 bp, homo sapien
cacggatgaagtgatggtatcttackaatcagaaactggagcatgtggtc

SEQ ID NO: 7769 - DNA, 50 bp, homo sapien
cgagttcatcagcaaatgaacttcarcgattcagcaaatgaacttctcag

SEQ ID NO: 7770 - DNA, 50 bp, homo sapien
tatagaaagctttcacattgcagaayctagtcctcataaattagtaacct

SEQ ID NO: 7771 - DNA, 50 bp, homo sapien
cccttcttggattttcacagtagctraatgttagagacaaatttgaaaca

SEQ ID NO: 7772 - DNA, 50 bp, homo sapien
gtagctaaatgttagagacaaatttkaaacacaattgtttgggcctttga

SEQ ID NO: 7773 - DNA, 50 bp, homo sapien
taagggcaactgatttaatttggttmaaaaatgggagaagagactaaggg

SEQ ID NO: 7774 - DNA, 50 bp, homo sapien
actaattaaggcagagctttcaagayggcaaattcccaaagtaaaccttt

SEQ ID NO: 7775 - DNA, 50 bp, homo sapien
cagcatctatatcctaattcagaaaygcaaaggagcccaagcttcagtgg

SEQ ID NO: 7776 - DNA, 50 bp, homo sapien
aggtggcctatgacatggggctgtamaaatggagacccaaatgaagagga

SEQ ID NO: 7777 - DNA, 50 bp, homo sapien
tattaaatcaaaatatcttaaacaasaaagtacagtggattctccatatc

SEQ ID NO: 7778 - DNA, 50 bp, homo sapien
cttagggaaaatgagactatctctcygaccttcttatatcctcctacttt

SEQ ID NO: 7779 - DNA, 50 bp, homo sapien
cacagagatgccctgctgctgatgcrcaatgaaaggagtgtggcagccac

SEQ ID NO: 7780 - DNA, 50 bp, homo sapien
tctctcttacaaagatgagaaatagyattgcagaatcagagctctaactc

SEQ ID NO: 7781 - DNA, 50 bp, homo sapien
cccagagaggtaaagtgacatgtccragattcaggcaaattaaatctatt

SEQ ID NO: 7782 - DNA, 50 bp, homo sapien
tatgttccttcatctaccaagaagamaattttacctgctcactcttctcc

SEQ ID NO: 7783 - DNA, 50 bp, homo sapien
taggaaacccttcttggagattgaayaggccaaagaaaaagtgttgtagg

SEQ ID NO: 7784 - DNA, 50 bp, homo sapien
atctttagaaggcaaacttggacaasgcaaaggtaaaatgcttatgaaca

SEQ ID NO: 7785 - DNA, 50 bp, homo sapien
gaaggacaagacagattttaatctasactgtacccagagaacaaggaaaa

SEQ ID NO: 7786 - DNA, 50 bp, homo sapien
accatgatcagtaagttctgcttagmaattaaaattaaatgagcatgtga

SEQ ID NO: 7787 - DNA, 50 bp, homo sapien
tcccaaccacaatggttcaacttaayggttttttcatgattctgtgaaag

SEQ ID NO: 7788 - DNA, 50 bp, homo sapien
atagtccacataacctatctcggtaracatttgtggaaaactaatgctcc

SEQ ID NO: 7789 - DNA, 50 bp, homo sapien
tgccattttgatcagaggtatgccaytaaatctcagaatctaagttcatt

SEQ ID NO: 7790 - DNA, 50 bp, homo sapien
gaagagatcacacagaactcaaacayggcactttcaatgttattttctgg

SEQ ID NO: 7791 - DNA, 50 bp, homo sapien
gaatatgaagacaatagcaaatggaygtttttaacacagtttcttagtat

SEQ ID NO: 7792 - DNA, 50 bp, homo sapien
cttccaagtatcaaatgtgagaaagsctatttttaaaagtcccctaggta

SEQ ID NO: 7793 - DNA, 50 bp, homo sapien
tgacattcttaatatttatttcactkaatactaaaacgtggagttagatt

SEQ ID NO: 7794 - DNA, 50 bp, homo sapien
cacatgtaatacctatgcagaactcyagggtatacatttctgttgctgat

SEQ ID NO: 7795 - DNA, 50 bp, homo sapien
ttttgtcatctgtaaaaccaggatartaatagttgacaactgtttaccat

SEQ ID NO: 7796 - DNA, 50 bp, homo sapien
tatgagatttcaccaaatatctacartacgatgttatcaaattttaccag

SEQ ID NO: 7797 - DNA, 50 bp, homo sapien
aatggaaaataaaaatctgtctcctkaaatttctatcattatctatttac

SEQ ID NO: 7798 - DNA, 50 bp, homo sapien
ataaaggtagcttttaaggttcttcmatgtcaagaaatagcagactccat

SEQ ID NO: 7799 - DNA, 50 bp, homo sapien
gtgcttgcatcccgcttcatgatgaygtagtgagcctcaccgtcctcctg

SEQ ID NO: 7800 - DNA, 50 bp, homo sapien
agcttgtcttggttttgcaagttcaragaaataactattacccttttaat

SEQ ID NO: 7801 - DNA, 50 bp, homo sapien
attactgccaaatttgctagattacrgaaccagcagaagagttaaataaa

SEQ ID NO: 7802 - DNA, 50 bp, homo sapien
tggaaagatacttaattttgcctgamgagtttactggtagggttgaattt

SEQ ID NO: 7803 - DNA, 32 bp, homo sapien
aaacataatatatctcrcagtgtactagcagg

SEQ ID NO: 7804 - DNA, 50 bp, homo sapien
tattagtagctgtctgttgcttacaytgaaacagccataagaacatattt

SEQ ID NO: 7805 - DNA, 50 bp, homo sapien
tcacttggaatgcactgaatttaaartgatatccacaaatcaatccagtc

SEQ ID NO: 7806 - DNA, 50 bp, homo sapien
accagttccaatatctggtactatcraagtctaccctcaaacagaaatct

SEQ ID NO: 7807 - DNA, 50 bp, homo sapien
tgtctttgggagtacactatcctcaraatcaaaccttgtagcaagcaggt

SEQ ID NO: 7808 - DNA, 50 bp, homo sapien
tgacttgttaaaaacttggaccttgsaatcagagagacctgccttccaac

SEQ ID NO: 7809 - DNA, 50 bp, homo sapien
ttaacaatactgtcatcacacataarccctttctctttttcacatttatg

SEQ ID NO: 7810 - DNA, 50 bp, homo sapien
gtaattgcaccttaaaaaaacattcrcagttatggtggtagaaaaggaag

SEQ ID NO: 7811 - DNA, 50 bp, homo sapien
gagcaagtaggtacaatagtatagayggataagatgtcaaatataaggat

SEQ ID NO: 7812 - DNA, 50 bp, homo sapien
attttcctcagctcataaacaccaaytgcaggaaaaaataatggctgcat

SEQ ID NO: 7813 - DNA, 50 bp, homo sapien
aactttctatactataacatgcctgwatctatcaacaatagactctcttg

SEQ ID NO: 7814 - DNA, 50 bp, homo sapien
tctgtacatagcttcttgtagagcastctatatacctaaaacatcgcatc

SEQ ID NO: 7815 - DNA, 50 bp, homo sapien
ggaataggtgaaatggtttgatcacmatgggaccataatccattacccaa

SEQ ID NO: 7816 - DNA, 50 bp, homo sapien
atcaatatgagtaatctactttttcrcttcttgcacttgagatgaactgt

SEQ ID NO: 7817 - DNA, 50 bp, homo sapien
gcttgtgcagtttgcacataatgaaygatgtctcagagacagctattctt

SEQ ID NO: 7818 - DNA, 50 bp, homo sapien
cagacacagaaacagatgatcaaaartgttaacagtagtgttagacatat

SEQ ID NO: 7819 - DNA, 50 bp, homo sapien
tttaaggaaactctctaacttattcyataatccttcttggtctgcagtga

SEQ ID NO: 7820 - DNA, 50 bp, homo sapien
ggatgaaaaaggaagacagtatgcasagatcatgtaagcagaaatagata

SEQ ID NO: 7821 - DNA, 50 bp, homo sapien
acttttagctcttctaaaaacctaayacgcaggcaatggctatcaggctg

SEQ ID NO: 7822 - DNA, 50 bp, homo sapien
tttcatcaatatttctcatagaagartctcaataatgatggctaacactt

SEQ ID NO: 7823 - DNA, 50 bp, homo sapien
aaaatcttgacaatatgtgaggaaaractttgaagttctcagatcactga

SEQ ID NO: 7824 - DNA, 50 bp, homo sapien
tattttttcacattggaataacctcyaactgttgttaagaacatgacttc

SEQ ID NO: 7825 - DNA, 50 bp, homo sapien
ccagaatggatatgccatgtgctacygattcattgtgtaaaagtattcag

SEQ ID NO: 7826 - DNA, 50 bp, homo sapien
ctaactgaaattgttttgaggttaastaagcaatcactattattagtttg

SEQ ID NO: 7827 - DNA, 50 bp, homo sapien
tttagaatatcttgcttcaaatcatragtttttagcatgttatttatact

SEQ ID NO: 7828 - DNA, 50 bp, homo sapien
ttcatcttcatatacaacagctcaartaataatttacacagaagaaaata

SEQ ID NO: 7829 - DNA, 50 bp, homo sapien
tatcctatatcaggtctattctacaygctttctcaaatttcatctttgta

SEQ ID NO: 7830 - DNA, 50 bp, homo sapien
caaaataatgagaggtatccgatatraatatacaaattaaatgtagctcc

SEQ ID NO: 7831 - DNA, 50 bp, homo sapien
agaagctaaagactttgtttagatamatcaagaaaaatataaagcagatg

SEQ ID NO: 7832 - DNA, 50 bp, homo sapien
tgtagctcttagttacctgctgatayccaaaaagatgtcaagttccttgt

SEQ ID NO: 7833 - DNA, 50 bp, homo sapien
taaagcagccagacaatttatggagrctccagagaagtctggcttcattt

SEQ ID NO: 7834 - DNA, 50 bp, homo sapien
ttgttatattagtatatggatcatcyaaagtactgcatgtacccatagaa

SEQ ID NO: 7835 - DNA, 50 bp, homo sapien
ctgacctaatggagttttcgttctcraccctagttattcaatattggcat

SEQ ID NO: 7836 - DNA, 50 bp, homo sapien
tgtggctgagaacatgaatggcatcsaaaaatccttgactatagtgtgag

SEQ ID NO: 7837 - DNA, 50 bp, homo sapien
aaacctttcattacacttaatctaaycaaaacatattcagtaaaccataa

SEQ ID NO: 7838 - DNA, 50 bp, homo sapien
aaacatgaggctacttagactcaaayactcacatacaaagcaaatgtttc

SEQ ID NO: 7839 - DNA, 50 bp, homo sapien
atatattgaggaatatacaaaataakgcaagctctggaattggaccattg

SEQ ID NO: 7840 - DNA, 50 bp, homo sapien
ggagtttagtcttaggcagtgagaarcccttgaagatttttaagtagaga

SEQ ID NO: 7841 - DNA, 50 bp, homo sapien
gcctaagtgaactacagtgttacaaktatccaatagaattgttattcagg

SEQ ID NO: 7842 - DNA, 50 bp, homo sapien
ttcagggaaataagcattgggaaaakaatcatttgtcagagaccatgttt

SEQ ID NO: 7843 - DNA, 50 bp, homo sapien
attttgagagaaaactggaatttcartaagatactataaggggtttcact

SEQ ID NO: 7844 - DNA, 50 bp, homo sapien
attatgaatctcaatcttttgtaaasttctcattaagtgcactagacaga

SEQ ID NO: 7845 - DNA, 50 bp, homo sapien
aaaattatatcttacagtgggatacyctgaattgttggtgtaggtgcctg

SEQ ID NO: 7846 - DNA, 50 bp, homo sapien
tttgttaagctaacttgtatttgtasgtttcattttaaatacaatttctt

SEQ ID NO: 7847 - DNA, 50 bp, homo sapien
accaggtatagcagtgaataaaatasaccaagttccttcctttgtgtagc

SEQ ID NO: 7848 - DNA, 50 bp, homo sapien
ttagcacaagaattaagaattatgartaacaggaaggcagaaagaagctg

SEQ ID NO: 7849 - DNA, 50 bp, homo sapien
tttctcacataacaagtccattgaaraataacgtctcttatggtaaagca

SEQ ID NO: 7850 - DNA, 50 bp, homo sapien
tatatattggtatagagcattgttgragacagaaaaatatattgcttggg

SEQ ID NO: 7851 - DNA, 50 bp, homo sapien
agcttgaatattattggtgtataaaratattactgatgtttgtacattga

SEQ ID NO: 7852 - DNA, 50 bp, homo sapien
gccttcaacttgaactagtcttgaartattgttgtattcacgatttatat

SEQ ID NO: 7853 - DNA, 50 bp, homo sapien
attatgctggcaggctgcagaatgarccatttcccctgttaataagtcct

SEQ ID NO: 7854 - DNA, 50 bp, homo sapien
gaaagtctcactgatggggcgacaaytgagtatacagacataaataaatc

SEQ ID NO: 7855 - DNA, 50 bp, homo sapien
agggtttcatgaaaaactccttacartgatatacatgtccctttatgctc

SEQ ID NO: 7856 - DNA, 50 bp, homo sapien
gttaatgtatacttctaaaaactcartagaacccaggagtagcagagtga

SEQ ID NO: 7857 - DNA, 50 bp, homo sapien
tcttctttgtcttccttttcttcagyctcatcgtcgctgacttctttatc

SEQ ID NO: 7858 - DNA, 50 bp, homo sapien
ctgccccaggagctgtgggaggagargtttttcacaaagaaatgagagat

SEQ ID NO: 7859 - DNA, 50 bp, homo sapien
taaatgacatcacagagagcaaaaamagggtgtattctatagcagactct

SEQ ID NO: 7860 - DNA, 50 bp, homo sapien
caatatcctttggacaccgtgtttcraactgtacaactgcttttatgagt

SEQ ID NO: 7861 - DNA, 50 bp, homo sapien
attattttgtcaagctgattcagatraaggagagagcatcaccttctagg

SEQ ID NO: 7862 - DNA, 50 bp, homo sapien
tgaaggaacaagatataagaacctaragacaattatagctaagggagagg

SEQ ID NO: 7863 - DNA, 50 bp, homo sapien
aaatatacaggtatataacttcagaraaactttcagcataacttttggga

SEQ ID NO: 7864 - DNA, 50 bp, homo sapien
cacgtgttttgaaatggctaatatarattcttaaacaaggaccaacgtct

SEQ ID NO: 7865 - DNA, 50 bp, homo sapien
tgtagcaagtatgttaacttattcartacattatggtcattattagttat

SEQ ID NO: 7866 - DNA, 50 bp, homo sapien
acataaaaccactccaacttagggakcaagaatctcaaggtttgaggaaa

SEQ ID NO: 7867 - DNA, 50 bp, homo sapien
gttgagttactgattttaccaataayagagtgtggctggaagagactgga

SEQ ID NO: 7868 - DNA, 50 bp, homo sapien
ttgcaacatgacccatgaagcataarctatttactatgtgggactgtaga

SEQ ID NO: 7869 - DNA, 50 bp, homo sapien
ttgcctccaacatccaaacactatawgcctaggacatctaaacagcttag

SEQ ID NO: 7870 - DNA, 50 bp, homo sapien
agttgcatcaggaaagcactattacrgcttggttttgagtagtaaaattg

SEQ ID NO: 7871 - DNA, 50 bp, homo sapien
tccactgaatttactgttactcattsaactttaacaaaatcccctacttc

SEQ ID NO: 7872 - DNA, 50 bp, homo sapien
tatttttaattattcacactttgaawattttgttttatactaagtttttg

SEQ ID NO: 7873 - DNA, 50 bp, homo sapien
ttttaaaaatgttcattcacatgagkaagaagtccatttacatgtgttcc

SEQ ID NO: 7874 - DNA, 50 bp, homo sapien
ttattttctctacaattatatgtacwaatgtttggttgtgagcatgctgt

SEQ ID NO: 7875 - DNA, 50 bp, homo sapien
atagaccttctatttaggatgatgamaagaatttggagatggatagtggt

SEQ ID NO: 7876 - DNA, 50 bp, homo sapien
tggatagtggtggtgaaagtaatcgraagtaatggcaaaaaccgcagtta

SEQ ID NO: 7877 - DNA, 50 bp, homo sapien
aatggtttttaaatagctttccttasaatttcatgatactcatcaataaa

SEQ ID NO: 7878 - DNA, 50 bp, homo sapien
ggtgtgaagttgctctgtgggctaaygcaagacatcttttgaattgtgca

SEQ ID NO: 7879 - DNA, 50 bp, homo sapien
catactttcaaagcctgggtaaacasaaggaaatgttgaaggaaaattat

SEQ ID NO: 7880 - DNA, 50 bp, homo sapien
taattccggtgatttagcatgcctaygaaaaagatcagagtgagcaaagg

SEQ ID NO: 7881 - DNA, 50 bp, homo sapien
ggagtctaagtgttagtgattattayattctgctattgtagtgaacaata

SEQ ID NO: 7882 - DNA, 50 bp, homo sapien
tgtgtgtgtcagatttggataaagaygttgtttgagcatgacacttagca

SEQ ID NO: 7883 - DNA, 50 bp, homo sapien
agtacccaaccctcaattttaatcayggaacctaagtggcagttggagga

SEQ ID NO: 7884 - DNA, 50 bp, homo sapien
cccacatttaataaattatagttaawcttcactacagcaacaataaaact

SEQ ID NO: 7885 - DNA, 50 bp, homo sapien
tttccaaaccatttttaccgcacgaraaagatggtaaatagtaaaattgt

SEQ ID NO: 7886 - DNA, 50 bp, homo sapien
cttataagaaagataatttgttagaraaattgttagtagagaacacaaaa

SEQ ID NO: 7887 - DNA, 50 bp, homo sapien
atgaggcagagcagccaagaggagaraacattagacctcatctgggtttc

SEQ ID NO: 7888 - DNA, 50 bp, homo sapien
acaaaataattcaagaatatttcccrgaactgagtgacttaaaagacaca

SEQ ID NO: 7889 - DNA, 50 bp, homo sapien
cctgcccagaaaatgcttttatgtcrcaagtcagcccatagtcaacactg

SEQ ID NO: 7890 - DNA, 50 bp, homo sapien
aagtggtgctgtctgcctttttcaayaaacggaaatttccaaaagtcagg

SEQ ID NO: 7891 - DNA, 50 bp, homo sapien
atcatcttgcggaccaatcttaggcygaactttgaaggaagaaggggagt

SEQ ID NO: 7892 - DNA, 50 bp, homo sapien
gtgaaaaatcaacctccagaaacaartacctcagaatggctatcccacct

SEQ ID NO: 7893 - DNA, 50 bp, homo sapien
cttcaggaatttaaactgtgaaacargaggtattttataaacaaaaatat

SEQ ID NO: 7894 - DNA, 50 bp, homo sapien
tgttagctacttggctagttcatcaraatgactccacaggtcaccagaat

SEQ ID NO: 7895 - DNA, 50 bp, homo sapien
caaattgccttctcacttcaacgagycatcaaagtttcatgcaaatgtac

SEQ ID NO: 7896 - DNA, 50 bp, homo sapien
ggaatttcaggatatagacagcaacrgtgaaagaactctcaaaacttggc

SEQ ID NO: 7897 - DNA, 50 bp, homo sapien
catatgtaggttttacgatagtaggmaaatattggactgcccattttaaa

SEQ ID NO: 7898 - DNA, 50 bp, homo sapien
cagtcaaaacctttatatcaatacaygagaaacaagtaaactatttccct

SEQ ID NO: 7899 - DNA, 50 bp, homo sapien
tttcacataagagatggtgtgtcacyagataaagagtagaggggactggg

SEQ ID NO: 7900 - DNA, 50 bp, homo sapien
aactgtaccacatcatacacagtacrctatgcaccaaaaaattggactag

SEQ ID NO: 7901 - DNA, 50 bp, homo sapien
cttgggtagcaaatttgaaggagaaraagaaatattgaaactggggattc

SEQ ID NO: 7902 - DNA, 50 bp, homo sapien
tatatggaagcttgttctcttggaasgtggccactatgtaaagaagttta

SEQ ID NO: 7903 - DNA, 50 bp, homo sapien
aattgaattatgttacaataacaagmacaagtggaatcattatttttagg

SEQ ID NO: 7904 - DNA, 50 bp, homo sapien
tacaggcagatttaaatttcttatcraggtcccagcaatatgtctactca

SEQ ID NO: 7905 - DNA, 50 bp, homo sapien
aacctaagaaaagttatcatctgaayttaaatatgcatcacataaaagct

SEQ ID NO: 7906 - DNA, 50 bp, homo sapien
taaaaagttatggatggggtgtaacmgagacctccctcttctaaatcctt

SEQ ID NO: 7907 - DNA, 50 bp, homo sapien
tagtatggaatcagtgagtaaagaawttcaaaactgttgtactgtaaatc

SEQ ID NO: 7908 - DNA, 50 bp, homo sapien
agtcactatgttatactctctctcamctaaaggagtaagtcatcagtgac

SEQ ID NO: 7909 - DNA, 50 bp, homo sapien
atcaagaacacctttcagaaattgcrccaaaggatccacaataggtaggg

SEQ ID NO: 7910 - DNA, 50 bp, homo sapien
ttagccatacagtccatctctatcaygttgacttattttaactctggatg

SEQ ID NO: 7911 - DNA, 50 bp, homo sapien
tgtgtattcagtcatactctaaacaytgctcgaacatctttgtaatctaa

SEQ ID NO: 7912 - DNA, 50 bp, homo sapien
attacaggcaagctcatcaaagaacyacattggctcataactgcccattc

SEQ ID NO: 7913 - DNA, 50 bp, homo sapien
gcaatattcatgtggtgtatagggcrctcagaattctctgagaagctcca

SEQ ID NO: 7914 - DNA, 50 bp, homo sapien
agccagggttaacagtggctcaaacmagagtattaacaattgacatgctg

SEQ ID NO: 7915 - DNA, 50 bp, homo sapien
aagtgaattagaacaggatatggtaragttaaacagaacaacaaagaaac

SEQ ID NO: 7916 - DNA, 50 bp, homo sapien
tgttgagtgaacacttggccaaaggkattaaaacaagtagggcagatgca

SEQ ID NO: 7917 - DNA, 50 bp, homo sapien
tgtctaaacctgttcctcctaaatakctactcttttgcatcacatgacct

SEQ ID NO: 7918 - DNA, 50 bp, homo sapien
ggtctttgctaacctgcttagtcgarcattaatttagacggttaaaccat

SEQ ID NO: 7919 - DNA, 50 bp, homo sapien
aataaggaaagtagtcatttagtccraaaaaaaattgtgaaaactattca

SEQ ID NO: 7920 - DNA, 50 bp, homo sapien
gatgttgtgggctgagaatctgacawgtaatatatactgatttcctccat

SEQ ID NO: 7921 - DNA, 50 bp, homo sapien
aatccattaagctagtcagtccagaragtcagcaataattatgattcaga

SEQ ID NO: 7922 - DNA, 50 bp, homo sapien
gtagacttagtttaattttagtggcrctcatattgttcttttctgacata

SEQ ID NO: 7923 - DNA, 50 bp, homo sapien
ttggagactatcctgatctctaacgwcaagtaggctttcaacactggcca

SEQ ID NO: 7924 - DNA, 50 bp, homo sapien
ttgatttcagtaccagcagaattgasagaatgttctaagccagaattcct

SEQ ID NO: 7925 - DNA, 50 bp, homo sapien
ctttgataattaaattagtacttcaygtagaggactgagtacttggtaca

SEQ ID NO: 7926 - DNA, 50 bp, homo sapien
gctcatgttaattgaatacctcctaygtgccaagaactgaggcctcccac

SEQ ID NO: 7927 - DNA, 50 bp, homo sapien
cttcctttacctctacaatctatcaratatattacacagaagacatctaa

SEQ ID NO: 7928 - DNA, 50 bp, homo sapien
agaatgctgtcaaaaccctcggtaargaggttgaagagaaatgcattatg

SEQ ID NO: 7929 - DNA, 50 bp, homo sapien
aacccacatctgtagcttctgagtcragagatctgaatagagaaatcagc

SEQ ID NO: 7930 - DNA, 50 bp, homo sapien
agattagttatacatatttttaagcmgacatatttacttgtgactctgtt

SEQ ID NO: 7931 - DNA, 50 bp, homo sapien
ataaatgctggtatagaatgtttaawgtaaaagaaatgagaaaataagtc

SEQ ID NO: 7932 - DNA, 50 bp, homo sapien
gtgattaacaaatcatctcttcctaygtatgatttagtggaaacttcagg

SEQ ID NO: 7933 - DNA, 50 bp, homo sapien
gagcaagtagccacttattatgtacyatgccttaacattctgagaagagg

SEQ ID NO: 7934 - DNA, 50 bp, homo sapien
taagtgggaacttacaaaggtatcaygggagcacataacagtgatttcaa

SEQ ID NO: 7935 - DNA, 50 bp, homo sapien
cagacaagtgtgtcccaaatactaayatggtctctaatgtaagaatagaa

SEQ ID NO: 7936 - DNA, 50 bp, homo sapien
tgtatgtgataatttgtgatatgtaygtatggtctggcaagaaaagcatc

SEQ ID NO: 7937 - DNA, 50 bp, homo sapien
gctaaaagctttaacgatggaataamatggaaatatttctgtattagaat

SEQ ID NO: 7938 - DNA, 50 bp, homo sapien
ctggctacttgtggtccatctttgaragaccctatctctatttaagacac

SEQ ID NO: 7939 - DNA, 50 bp, homo sapien
ttttagcttaacaatgcatgtaaatraaaatccattaaataaaccaattt

SEQ ID NO: 7940 - DNA, 50 bp, homo sapien
caaaactagaaagtgtatgctatcayataaaagtaatagtgaagtaaaat

SEQ ID NO: 7941 - DNA, 50 bp, homo sapien
ctattttactacgccttttgagcatmactgttgacaaccagtggcattgg

SEQ ID NO: 7942 - DNA, 50 bp, homo sapien
tttatctgccagggctctctgcttaycaattcttcaattacctaatgcaa

SEQ ID NO: 7943 - DNA, 50 bp, homo sapien
ctaaaatgtacatattagctcttggycaacaaacttggaggaggtcataa

SEQ ID NO: 7944 - DNA, 50 bp, homo sapien
gaaaagaagtagatttctccaaggasgctgacaggaaaataaccaccaag

SEQ ID NO: 7945 - DNA, 50 bp, homo sapien
attaattcattaggagcttttcccaygtatgatctgacacatttctgcct

SEQ ID NO: 7946 - DNA, 50 bp, homo sapien
tgaaaatattgctgatctcaataacrcatcctgtatctactcaggtcaca

SEQ ID NO: 7947 - DNA, 50 bp, homo sapien
gaccacaaaaatatcaggaaaatatraaactgtaaaactaaagttcaatc

SEQ ID NO: 7948 - DNA, 50 bp, homo sapien
cagttggtggggaaagcaagtaaagwcatccgtgaggaagagctatttag

SEQ ID NO: 7949 - DNA, 50 bp, homo sapien
tgtgagatgctggagttaccattaaygctgatcttaggctctgctagatc

SEQ ID NO: 7950 - DNA, 50 bp, homo sapien
ggcatactgtttgctacataaaagamagggtacaggaatgaggaaaaaag

SEQ ID NO: 7951 - DNA, 50 bp, homo sapien
ttaagtaatacacattcatgattaayaaactaacgcttatgaaatttggg

SEQ ID NO: 7952 - DNA, 50 bp, homo sapien
agcttgttaacagctgtctacctcayataccactttttccacacatttaa

SEQ ID NO: 7953 - DNA, 50 bp, homo sapien
atgtgaagaagttttgccaattaacrgatgctacacaaatgtgcacaatt

SEQ ID NO: 7954 - DNA, 50 bp, homo sapien
tccaaaataagttaaatatgtgtcayactagagcactggttcttaaccag

SEQ ID NO: 7955 - DNA, 50 bp, homo sapien
caaatacactggtggatattgaagaygttgttttaagaagtgatgatgaa

SEQ ID NO: 7956 - DNA, 50 bp, homo sapien
cctcatctcctattagtgctgggttsaaaagcaaacttcaaattagttaa

SEQ ID NO: 7957 - DNA, 50 bp, homo sapien
agcaccatccataactttccaccagrcaaatgggtttaagatcagacaga

SEQ ID NO: 7958 - DNA, 50 bp, homo sapien
tcggttagttttttgttgttgtccayctgagccttttttcatgcagttag

SEQ ID NO: 7959 - DNA, 50 bp, homo sapien
tttctatttgtataaaagagataatmatacctcaatgtttgttgcaaagg

SEQ ID NO: 7960 - DNA, 50 bp, homo sapien
cgtaatccataaacaacactctagartccatattattactatttaccttc

SEQ ID NO: 7961 - DNA, 50 bp, homo sapien
atgcattcactatatgttctgattaygggctatgatgttgtagaaaagtg

SEQ ID NO: 7962 - DNA, 50 bp, homo sapien
ctgaaccccctcccatagccaaaaawctattcacccaactggcagaaagc

SEQ ID NO: 7963 - DNA, 50 bp, homo sapien
aatgcttgcaatcttgtaaatttcamaatcctgaagccaaatttacaaat

SEQ ID NO: 7964 - DNA, 50 bp, homo sapien
ggttttgtgtggacatattctttccratttatttgagtctggatctttct

SEQ ID NO: 7965 - DNA, 50 bp, homo sapien
gatgaattgttagaagttcagcatgsacacttttgagagttaaaaactcc

SEQ ID NO: 7966 - DNA, 50 bp, homo sapien
gccatataatgtaacctaatcgctaragtgacatcatcatattcataggt

SEQ ID NO: 7967 - DNA, 50 bp, homo sapien
aaagtttgtcaatgcttgctataggkcccatttttaatctacattgaacc

SEQ ID NO: 7968 - DNA, 50 bp, homo sapien
taaatttagtaagaacatacaaggaragtgttcaataatctattgaattt

SEQ ID NO: 7969 - DNA, 50 bp, homo sapien
gtggtgataatggcagttgtgataasagtatcatcattattaaaaaaaaa

SEQ ID NO: 7970 - DNA, 50 bp, homo sapien
gttatgacatccttaatgccaagtaygatctagaactcctaatagttaaa

SEQ ID NO: 7971 - DNA, 50 bp, homo sapien
taagccccataaaattctcccttgckaaatgaaatgttctttctatttta

SEQ ID NO: 7972 - DNA, 50 bp, homo sapien
aggaagaatacatatgcctgccaaargaattccacaaaaattttcacaga

SEQ ID NO: 7973 - DNA, 50 bp, homo sapien
tcacccctccttttaattcactgtaygctaacaaatttagtaataatgta

SEQ ID NO: 7974 - DNA, 50 bp, homo sapien
taaaaattgtaaaatgagacaaaaakaaaggtaaaatgagtagctgagca

SEQ ID NO: 7975 - DNA, 50 bp, homo sapien
ggctctctagagtcaattagaagtasgttcaaatattagctctgccaaat

SEQ ID NO: 7976 - DNA, 50 bp, homo sapien
tgtgctccatttctattaccttgaaygattatgacccatgggatgtaagt

SEQ ID NO: 7977 - DNA, 50 bp, homo sapien
tttgataaattctttactgcaaccaraaatagcatatttgtaagcttcta

SEQ ID NO: 7978 - DNA, 50 bp, homo sapien
attacaaggggtcctataacatgaarcaagaagtataaaattaccttacc

SEQ ID NO: 7979 - DNA, 50 bp, homo sapien
tagtaatgtgcaaaagtgatactgargtctgggtaacgtagatttaaaag

SEQ ID NO: 7980 - DNA, 50 bp, homo sapien
acaatgaatacacctgattgactagracttggaaagacacaacctttctc

SEQ ID NO: 7981 - DNA, 50 bp, homo sapien
ctctttgaatgatgatgatgtgaaayttagaagaaccattttatgatcaa

SEQ ID NO: 7982 - DNA, 50 bp, homo sapien
gatgaaataattctaagcaagttacrgaggactggacagatttggctagg

SEQ ID NO: 7983 - DNA, 50 bp, homo sapien
tcctttgtccgcaggcaataccaaastccctatgtcaaggtcagggttca

SEQ ID NO: 7984 - DNA, 50 bp, homo sapien
gagaattcagttgaccagtaattaayggagccagatcacaaaaggtaaag

SEQ ID NO: 7985 - DNA, 50 bp, homo sapien
taatccaacctcagatagatgcatcrcttacagagcacagtaaagacgtt

SEQ ID NO: 7986 - DNA, 50 bp, homo sapien
agatactatatttgaatattcatagwagttttctgaaaaaagagccccaa

SEQ ID NO: 7987 - DNA, 50 bp, homo sapien
gctcaagcttagacaattgagtcagkactaagtttgagagcatctgtgat

SEQ ID NO: 7988 - DNA, 50 bp, homo sapien
tattgtactgcttatataattagaartatgtgttacccaagctgggagag

SEQ ID NO: 7989 - DNA, 50 bp, homo sapien
aatgtgggttattcaatatctttcarattcagtttccttagtttcaattc

SEQ ID NO: 7990 - DNA, 50 bp, homo sapien
tctcatcaaaaagtagaataacaacmgtgactttatagggttgctaggag

SEQ ID NO: 7991 - DNA, 50 bp, homo sapien
tactgctctgtttttatggcttctaygacccacataattttcaaattcct

SEQ ID NO: 7992 - DNA, 50 bp, homo sapien
aaaatagctaacaggtacctagataygaagtgccaggcactgtgctcagt

SEQ ID NO: 7993 - DNA, 50 bp, homo sapien
acagccccaatgtaaagtctgctccrctttaaaagcccaagtgcaatttg

SEQ ID NO: 7994 - DNA, 50 bp, homo sapien
atcagcttagtatgtaaatgaaagawgaaactagacaatggttgccatgc

SEQ ID NO: 7995 - DNA, 50 bp, homo sapien
agccagatcacaaaaggtaaagagtwaatggcagaaaatagaaagtaaga

SEQ ID NO: 7996 - DNA, 50 bp, homo sapien
tagtaacccatgatcctatgaagtaygtcatttagatgtcttactttcta

SEQ ID NO: 7997 - DNA, 50 bp, homo sapien
gtttgtagttggcaaaacagaagcamgatcgcataattctaggagaaacc

SEQ ID NO: 7998 - DNA, 50 bp, homo sapien
aaataaaccttcacataatttgtaayatagcaaggagtttcaaaaatata

SEQ ID NO: 7999 - DNA, 50 bp, homo sapien
ctcttgcacaataggtaatattaaayacatgcttatatgcctttgcactt

SEQ ID NO: 8000 - DNA, 50 bp, homo sapien
aaaatgctcagtatactactcataarattccacagtctaaataaaagatc

SEQ ID NO: 8001 - DNA, 50 bp, homo sapien
tggcaaaaaaattagtttctctttasgtctgttgaaaccgcgtacacttt

SEQ ID NO: 8002 - DNA, 50 bp, homo sapien
atgaggaaagacagagattgagtcaycaacatgtgacctggtgatttctg

SEQ ID NO: 8003 - DNA, 50 bp, homo sapien
tatttgatgaaatggcaatgggatascagatttgaaatgggtaattcatc

SEQ ID NO: 8004 - DNA, 50 bp, homo sapien
agggtctccttcgcagtccaagaacmctactgctattcactcttcagatg

SEQ ID NO: 8005 - DNA, 50 bp, homo sapien
aagtttatgctttattggccttcatraatttgagcattcctgaggctccc

SEQ ID NO: 8006 - DNA, 50 bp, homo sapien
tcatgcagggctgacaaaagaagtgrcacgaaactggtttccctcttaac

SEQ ID NO: 8007 - DNA, 50 bp, homo sapien
cccaaaaaagtgattagactaagatsaaattttgtgacttatttgaggat

SEQ ID NO: 8008 - DNA, 50 bp, homo sapien
acacactgaatgcatttggagataasagaatgagctttctaatcctctac

SEQ ID NO: 8009 - DNA, 50 bp, homo sapien
agttgacttataaaattaaccatcayggacctgatatctctctctctctc

SEQ ID NO: 8010 - DNA, 50 bp, homo sapien
ttgttttaaaggatcgtttgtcatayaagtcttctttgttcaaatagtta

SEQ ID NO: 8011 - DNA, 50 bp, homo sapien
acttggacaaggatggtggtaaatcratggtgaaaagcagtcatactgaa

SEQ ID NO: 8012 - DNA, 50 bp, homo sapien
atgttcactataggaccagcatttcragggcagtttctttcacagtttca

SEQ ID NO: 8013 - DNA, 50 bp, homo sapien
ctgctcttggtggaatgctatctacrgaacgtgaatcctgtggctgaccc

SEQ ID NO: 8014 - DNA, 50 bp, homo sapien
ttttgattttaagcacattagaccamctctattcagaaaatacctttgtt

SEQ ID NO: 8015 - DNA, 50 bp, homo sapien
cgagcaccctctataaaggcacaaawaagagtgaattgtgaagaaacagc

SEQ ID NO: 8016 - DNA, 50 bp, homo sapien
agaaacactcacatcaaattccatakactttaaatacttgattaaatatt

SEQ ID NO: 8017 - DNA, 50 bp, homo sapien
atgcactaaaatgtttaacaataaasagagacatttagaggagcagagga

SEQ ID NO: 8018 - DNA, 50 bp, homo sapien
cttatttgcagctaaatcctgagtaygtgtaataggtgctccataaatat

SEQ ID NO: 8019 - DNA, 50 bp, homo sapien
agagaccttgacctgaatcatagtgraaacttagagacttgcagaatgtc

SEQ ID NO: 8020 - DNA, 50 bp, homo sapien
taatatttgcatttgttaattctaarctatatactcattatttacatact

SEQ ID NO: 8021 - DNA, 50 bp, homo sapien
tgaaagggatgcaacagctagctacrccaataagtaggagaagaacattt

SEQ ID NO: 8022 - DNA, 50 bp, homo sapien
ctgagctactgagttgtcaaagaacrattgtaaaccagatacatttgaaa

SEQ ID NO: 8023 - DNA, 50 bp, homo sapien
tatcatcgtcattgtcagtagtaacrcaagatctaacatgatagtactgg

SEQ ID NO: 8024 - DNA, 50 bp, homo sapien
ttcagatttgaacgagtcactactgratcttcttcccccatctccttctt

SEQ ID NO: 8025 - DNA, 50 bp, homo sapien
tgcatggattcacatcctggttcaaycacttactaatgatgtggtcgtag

SEQ ID NO: 8026 - DNA, 50 bp, homo sapien
tggtgtaatgacttcgatagggttaygtaatggaaaccatattatctttt

SEQ ID NO: 8027 - DNA, 50 bp, homo sapien
tgctgggatccagccgtggaataaayagtttgcactgcctttgctgttgc

SEQ ID NO: 8028 - DNA, 50 bp, homo sapien
tgctcatttgtcccattgaccccaargtaagtcacatgaccaagcccaag

SEQ ID NO: 8029 - DNA, 50 bp, homo sapien
tccccaaccaggaagccaggaaataygcagaatccaattagccttttttg

SEQ ID NO: 8030 - DNA, 50 bp, homo sapien
ctatgtaggcctgggattagtgaaakaaaagctggaattccaggcagaga

SEQ ID NO: 8031 - DNA, 50 bp, homo sapien
gatcacactttatctttttttgatamgtcagctaattcatacctcaaaaa

SEQ ID NO: 8032 - DNA, 50 bp, homo sapien
tctacctccaccaagtaaggaatgcraaacagatactctgttgaaaattt

SEQ ID NO: 8033 - DNA, 50 bp, homo sapien
aatttactatggatgtgttaagatawaattttgtcataagtcatagagca

SEQ ID NO: 8034 - DNA, 50 bp, homo sapien
tccaaggatacagagatattatacaragccagacaagtctgactgcaaaa

SEQ ID NO: 8035 - DNA, 50 bp, homo sapien
ctattcaacaagcattggtaacttgwaatgacttctgtatcagttcttca

SEQ ID NO: 8036 - DNA, 50 bp, homo sapien
gatttgattttgaaaatctgaaaaakatgatattcaataattatttgcaa

SEQ ID NO: 8037 - DNA, 50 bp, homo sapien
gttatgttcagacttattacaaaaarcacttcctgaattttaaataatga

SEQ ID NO: 8038 - DNA, 50 bp, homo sapien
tatacatttaatcttgccataatacrcctgtctctttattgaaatattct

SEQ ID NO: 8039 - DNA, 50 bp, homo sapien
caacagctattttattcttgacatcratttctgaaaacatcacctgtgaa

SEQ ID NO: 8040 - DNA, 50 bp, homo sapien
tctgcctaatgctttgatagtttatraggagaaattaaggcatcagttac

SEQ ID NO: 8041 - DNA, 50 bp, homo sapien
gtaaatgagaataaagtttattctcycaatgacgatgataacatctttct

SEQ ID NO: 8042 - DNA, 50 bp, homo sapien
cggtctgtgtggctccttagcatgarataataggcacaagaagtggtaac

SEQ ID NO: 8043 - DNA, 50 bp, homo sapien
atcatgtctccaaatagtttaattaygtctggttatctaattagtgcatg

SEQ ID NO: 8044 - DNA, 50 bp, homo sapien
tccaattctactgcttatagatgtaygcttcttttcagaaacaatggtca

SEQ ID NO: 8045 - DNA, 50 bp, homo sapien
ctgtaagcaatggtttacagtcacayctattatccttaaaaatctatttc

SEQ ID NO: 8046 - DNA, 50 bp, homo sapien
cattggtattagactcccttcactaraatgcaaatgtcacagaaaggggc

SEQ ID NO: 8047 - DNA, 50 bp, homo sapien
ctgaaacctcttcctctttttcttcrctccttcaccatctgacacaccag

SEQ ID NO: 8048 - DNA, 50 bp, homo sapien
acaactttcaggaatgttaaaaaackgaaatcaattaatgtttgtccttt

SEQ ID NO: 8049 - DNA, 50 bp, homo sapien
ggactttcagaattttctcctttacmatttctactaacgtcatcctgttt

SEQ ID NO: 8050 - DNA, 50 bp, homo sapien
taggaatgtgtacttgatcaagtaaygtaacctcgctaagcttcagtttc

SEQ ID NO: 8051 - DNA, 50 bp, homo sapien
cggcagttcttccctatagcatacastgaaaacacaaaatatggacctgt

SEQ ID NO: 8052 - DNA, 50 bp, homo sapien
aatataaaaataggcctataagaaaytggaagactttaatcacaactgtt

SEQ ID NO: 8053 - DNA, 50 bp, homo sapien
taaatataaatacatagagataggaygaagatggcagatcggagacatgg

SEQ ID NO: 8054 - DNA, 50 bp, homo sapien
agagctgccactgaggaaaacaaacragattggtgtgaagaccattaaaa

SEQ ID NO: 8055 - DNA, 50 bp, homo sapien
tactgactgccaatagaattttagawccactacagaattaagtattttga

SEQ ID NO: 8056 - DNA, 50 bp, homo sapien
attctctctgtgcctcaaactaagaygcttcattcccatcaccacaattc

SEQ ID NO: 8057 - DNA, 50 bp, homo sapien
aaaattacctccttccctcttcggargcataactgttttgaagtctgtgt

SEQ ID NO: 8058 - DNA, 50 bp, homo sapien
ttcatacaagacattgatttgaaaawgagctattgatggaatatgcatcc

SEQ ID NO: 8059 - DNA, 50 bp, homo sapien
tatcatgcacgggtggaatggaatasaattcaaagggtgatagaacatac

SEQ ID NO: 8060 - DNA, 50 bp, homo sapien
gggacactttctaagtggcagcacamggaattaaatcccacaagacagca

SEQ ID NO: 8061 - DNA, 50 bp, homo sapien
agaaaaaagaatagctataacttgaygtttagatctaaacacaatacatt

SEQ ID NO: 8062 - DNA, 50 bp, homo sapien
gcatgcaccttatttatgtgaaatgycaatcagtagtagcatattcagat

SEQ ID NO: 8063 - DNA, 50 bp, homo sapien
gacgtttagatctaaacacaatacaktcccagataagcaacctgcctgca

SEQ ID NO: 8064 - DNA, 50 bp, homo sapien
tgatttgatcatgagtcattagaatkatgcagaagatagtaaaactcaat

SEQ ID NO: 8065 - DNA, 50 bp, homo sapien
ttgattcttaaatctctgctcttaawctttacatcagtttatgttctttt

SEQ ID NO: 8066 - DNA, 50 bp, homo sapien
cctgcttcaagtgtctgagaatacaygtgtgaagtataatgtcaagtcct

SEQ ID NO: 8067 - DNA, 50 bp, homo sapien
ccttcaagtttcacattactttccaygctttaagatgcaatccagaagct

SEQ ID NO: 8068 - DNA, 50 bp, homo sapien
aaaacatagagagatgaatctctaartaggaaaggttttgtttgggaata

SEQ ID NO: 8069 - DNA, 50 bp, homo sapien
atggtacctggttagaaataccacaygaaagagaattcccaagctaagta

SEQ ID NO: 8070 - DNA, 50 bp, homo sapien
gctgctcagatgccgggatgttcatmaacaggacaaaaggctgaaaagtg

SEQ ID NO: 8071 - DNA, 50 bp, homo sapien
agaaagggcattctaagcaaagtatragtaatgctgcaaaagcatggata

SEQ ID NO: 8072 - DNA, 50 bp, homo sapien
ctgcagatattcctaagaaactacaytgaattgtttacctcatgaataat

SEQ ID NO: 8073 - DNA, 50 bp, homo sapien
gcctagtaaccacaaattcttgggcraaatattcaagacaactggtcaaa

SEQ ID NO: 8074 - DNA, 50 bp, homo sapien
aatttgaggaataaaatatttgaaartcagtagccacaaattcttttttt

SEQ ID NO: 8075 - DNA, 50 bp, homo sapien
agggaggagacattaccaactagaakaaagttaagcaatggcttacttag

SEQ ID NO: 8076 - DNA, 50 bp, homo sapien
agaaacaaagcaagtaaacttgaacratcattcccgctaagtgctttatc

SEQ ID NO: 8077 - DNA, 50 bp, homo sapien
catatttacaatgtgttcttacttcyaaattacatgtttaatcacagaaa

SEQ ID NO: 8078 - DNA, 50 bp, homo sapien
tcaggacatcatgatgtcatgcctaraggataactaacatcccgatatgt

SEQ ID NO: 8079 - DNA, 50 bp, homo sapien
attctccagccatccaaccgtcaaawtctgtgtcttattctagaagggat

SEQ ID NO: 8080 - DNA, 50 bp, homo sapien
aactccggggcacaaggactttgcawgtgataacatgtgctgtcagcatc

SEQ ID NO: 8081 - DNA, 50 bp, homo sapien
atttaattacaaaatcagattaacawcacattcatgaatcacatttaatc

SEQ ID NO: 8082 - DNA, 50 bp, homo sapien
catgtacctcatcagaatttcttcawacttgcttcaaaaaggtggtatgt

SEQ ID NO: 8083 - DNA, 50 bp, homo sapien
aaatgaaaactaccattctgattaaratagtgtaatagagaaaattgaat

SEQ ID NO: 8084 - DNA, 50 bp, homo sapien
tttatgagcttcaggatctttaaaaytcccactgatagctatgctcttgt

SEQ ID NO: 8085 - DNA, 50 bp, homo sapien
accaaaggctcaatccacaatttacrgcaaataactctatgggcagtgac

SEQ ID NO: 8086 - DNA, 50 bp, homo sapien
aacctatcctattactaaagtatcayggaattttaggtgaataacagctc

SEQ ID NO: 8087 - DNA, 50 bp, homo sapien
tcattcaactcaagaatgttcctaawtgtgggagtatgctgaatacagaa

SEQ ID NO: 8088 - DNA, 50 bp, homo sapien
ctctgcttccaactgtgtcctataaytggttttatgtgctttgatagaag

SEQ ID NO: 8089 - DNA, 50 bp, homo sapien
ctgatcattacagctttacattatcragcaccttaagcacacattaataa

SEQ ID NO: 8090 - DNA, 50 bp, homo sapien
tagtcacagagaacaattagtcacarggaatcagaatgaagaatacaaac

SEQ ID NO: 8091 - DNA, 50 bp, homo sapien
tttgtttttgattcttggaatgatakagagtgtattctacaaaatcaagc

SEQ ID NO: 8092 - DNA, 50 bp, homo sapien
agaatgaattaattgaactttaaaamctaccaggacaaagaattattgag

SEQ ID NO: 8093 - DNA, 50 bp, homo sapien
gtgcctcttcagacattagttcttayggttcttgctctgttgatgaactc

SEQ ID NO: 8094 - DNA, 50 bp, homo sapien
aggttaagtaacttgcctgagggtcrccgattagcatcagagccggcatt

SEQ ID NO: 8095 - DNA, 50 bp, homo sapien
gtgcctggcacgttgcacacactcaratacgtaataatgaacatttattg

SEQ ID NO: 8096 - DNA, 50 bp, homo sapien
catggtttcatatattggtgttcacyatgttatagataattaaagaagat

SEQ ID NO: 8097 - DNA, 50 bp, homo sapien
ctcacagttagctaaactgtattggyaatgctgtccagaaaataagcaat

SEQ ID NO: 8098 - DNA, 50 bp, homo sapien
attaaatgtttaggtcagagtacacraattgaagaatatgagtaatttga

SEQ ID NO: 8099 - DNA, 50 bp, homo sapien
ttgcttccacatgtcagctgaaaccyaatattagctatatctgctggaat

SEQ ID NO: 8100 - DNA, 50 bp, homo sapien
cagtagattcttactgagcagaagawtaccattttgagtaagtgggcttt

SEQ ID NO: 8101 - DNA, 50 bp, homo sapien
tgcttccaaagcttggctgttgtgartagttctgcaataaacatgagagt

SEQ ID NO: 8102 - DNA, 50 bp, homo sapien
tgagggccccagaagtatgcttaacrctcctatagtctgaagaccacaag

SEQ ID NO: 8103 - DNA, 50 bp, homo sapien
taaataaggaatagaggcaaaataarcatttgaatttataactactctta

SEQ ID NO: 8104 - DNA, 50 bp, homo sapien
cccatttctctgacctactttgctargaataattgattttttcacacctg

SEQ ID NO: 8105 - DNA, 50 bp, homo sapien
ccttattagaatagccattaattgarcatgtaagatcaacatgaaacaat

SEQ ID NO: 8106 - DNA, 50 bp, homo sapien
tgtcagacaggtaaactctagggaartaacagcgttggacagatcagcct

SEQ ID NO: 8107 - DNA, 50 bp, homo sapien
agtgtgattctttgttgttttgcaayagacattgacaatctaagtttgtt

SEQ ID NO: 8108 - DNA, 50 bp, homo sapien
tttttttccacaaaattaaaacactsagacatatagaaattaaattcaac

SEQ ID NO: 8109 - DNA, 50 bp, homo sapien
agaaaccattttattttctaacctarcaagtactgtctctggcactttca

SEQ ID NO: 8110 - DNA, 50 bp, homo sapien
tgaaggaaatgggtaaataggtgacyggttagccaacactagtgtgattc

SEQ ID NO: 8111 - DNA, 50 bp, homo sapien
aagctacttgcaagttctgtctgtayatcttaactcccccggagaatgcc

SEQ ID NO: 8112 - DNA, 50 bp, homo sapien
atacgtatagcacatcatccagtagrctacactgagctttgacacatggc

SEQ ID NO: 8113 - DNA, 50 bp, homo sapien
ttctgcaagttcctcttttgggtaamtccaactcagatccacataggaca

SEQ ID NO: 8114 - DNA, 50 bp, homo sapien
cactttcaaacaccattgtttctcarattctaagtcttgtgctctgaagt

SEQ ID NO: 8115 - DNA, 50 bp, homo sapien
acagtgcaaaaggaaacagacctaartccatccagcttaccgttatttat

SEQ ID NO: 8116 - DNA, 50 bp, homo sapien
gattgggactggaactctaaggagakaatttcagcagagaagcgtgccca

SEQ ID NO: 8117 - DNA, 50 bp, homo sapien
ttcaattcttctcaaagtgtcactcragtatttctgagcattcttagggg

SEQ ID NO: 8118 - DNA, 50 bp, homo sapien
acacacatctcctaatgcttacaccratgtcggtttccatgtcttcgtcc

SEQ ID NO: 8119 - DNA, 50 bp, homo sapien
gatctcccttttagttcttctaaccrcattcaagtattcattacctctta

SEQ ID NO: 8120 - DNA, 50 bp, homo sapien
tccaactcatgcagtgtggcacgaayttcacagtatgtgtgtgatagaac

SEQ ID NO: 8121 - DNA, 50 bp, homo sapien
caggattcccaacagtttaaacgcargccctttaatagaacctctagtga

SEQ ID NO: 8122 - DNA, 50 bp, homo sapien
gctagctcttactgctttttaagaasagtgaatctttgagtcactagagg

SEQ ID NO: 8123 - DNA, 50 bp, homo sapien
agtataaaaatataaatatagtaackgtaggagccatataattgctactg

SEQ ID NO: 8124 - DNA, 50 bp, homo sapien
taccagaggggaacagggaggattaycaggatgtcttaacagagttatct

SEQ ID NO: 8125 - DNA, 50 bp, homo sapien
ttaaactttttgtacactaagattaygtatgaagagacaaaatagtgcaa

SEQ ID NO: 8126 - DNA, 50 bp, homo sapien
aacaaggtatttacctccagtgagamcaaaagccgtaaagcagtaattaa

SEQ ID NO: 8127 - DNA, 50 bp, homo sapien
gcaatgcctaactttgtcaaaataasgttgcaaaattcagaatgaaaaag

SEQ ID NO: 8128 - DNA, 50 bp, homo sapien
catgcaagcctgcagctggatcagaygcaccacaagtggcttctgctatg

SEQ ID NO: 8129 - DNA, 50 bp, homo sapien
ggaaagagaacgtgaaagggaatgcraattgacactgcttaatggcagga

SEQ ID NO: 8130 - DNA, 50 bp, homo sapien
cagccactcagtgaacatttgtgaastcaactgcctaaagtagcatagcc

SEQ ID NO: 8131 - DNA, 50 bp, homo sapien
gttttcatcacatacatgtatatgarggtattaatgtcacaggattttac

SEQ ID NO: 8132 - DNA, 50 bp, homo sapien
tattaatgtcacaggattttacttawctcaaattctcctaggtctcttaa

SEQ ID NO: 8133 - DNA, 50 bp, homo sapien
taatatataaacaaattagggaacarcttcatgctaaagacaagctttat

SEQ ID NO: 8134 - DNA, 50 bp, homo sapien
catgatggccagagatgatcaagacygaatgaataagccacgaggaagag

SEQ ID NO: 8135 - DNA, 50 bp, homo sapien
ttaatttttgaatattaaattttctwacaatgggtcatacttggataaaa

SEQ ID NO: 8136 - DNA, 50 bp, homo sapien
tctgcacaacatacagaggctctccrcacaagctagggcttccccaggta

SEQ ID NO: 8137 - DNA, 50 bp, homo sapien
ctaaattaaactgacactgattatawactttaacacacttttaggattcc

SEQ ID NO: 8138 - DNA, 50 bp, homo sapien
cccacactgattcttggtttagtcaygtaacttgctttaacctccaacag

SEQ ID NO: 8139 - DNA, 50 bp, homo sapien
agagtgagcgaaaatgtggtagcaartattgcagagctctatccatgggg

SEQ ID NO: 8140 - DNA, 50 bp, homo sapien
ttggttgcctttgctggatctatgaygggcctaaaagacacccagttgat

SEQ ID NO: 8141 - DNA, 50 bp, homo sapien
ttctgacttcagttggacttctggcragttctgaagctgtgattgacctt

SEQ ID NO: 8142 - DNA, 50 bp, homo sapien
tacttttgaatacgaaattattaacyccattatctttggtgaagaaaaat

SEQ ID NO: 8143 - DNA, 50 bp, homo sapien
tttttggttgtttgtttggcttaatsaaaatgcatgtttctaaagaaatg

SEQ ID NO: 8144 - DNA, 50 bp, homo sapien
cctagggcgactatatcaataaccaygtgtctttagttagccagcctagg

SEQ ID NO: 8145 - DNA, 50 bp, homo sapien
tgttttgtggtgatacttctgaatartatcacatttcgaacaatgtaaac

SEQ ID NO: 8146 - DNA, 50 bp, homo sapien
cagcaggcatttttataggcattcartaagtaattagaaataaaacacaa

SEQ ID NO: 8147 - DNA, 50 bp, homo sapien
ctcctttgtcttgttgctgtggtgcwgaacaacttgaaactgtaattggg

SEQ ID NO: 8148 - DNA, 50 bp, homo sapien
acacaggaaggtacagatcgtcaagkactgaagcaataacagatgcagga

SEQ ID NO: 8149 - DNA, 50 bp, homo sapien
tttagactgaaccaaccaatttaacmcaactggagtagaagcagtttttc

SEQ ID NO: 8150 - DNA, 50 bp, homo sapien
tctcttatgatgaggaaagtttgaasccagtgacaatcatgcttcagatg

SEQ ID NO: 8151 - DNA, 50 bp, homo sapien
aaaatattacacattctggaacttayatggaaatgggctaaaaatacaga

SEQ ID NO: 8152 - DNA, 50 bp, homo sapien
tgcccaaatttccccttttcataggkataccaaccatattagactacagg

SEQ ID NO: 8153 - DNA, 50 bp, homo sapien
agatgtgaggcacatggcatactaargcacttcgaaattgtgtgtgataa

SEQ ID NO: 8154 - DNA, 50 bp, homo sapien
gagaattctgattgcattatccatgragcccagaacttaaaagcccagtc

SEQ ID NO: 8155 - DNA, 50 bp, homo sapien
aaatatgttatatttgtttgcgagayggaagaggaaagtagaatgaaaag

SEQ ID NO: 8156 - DNA, 50 bp, homo sapien
tatggtattcctgtgaatatcatcaygtataacttgttacatgtcactta

SEQ ID NO: 8157 - DNA, 50 bp, homo sapien
gacaaacccaggggactatcagtagragccaagtatgaagtttctgatgg

SEQ ID NO: 8158 - DNA, 50 bp, homo sapien
cagattttattgtacatttcaattawcttcagttggtaggaaagatcttg

SEQ ID NO: 8159 - DNA, 50 bp, homo sapien
cactgtaacagaccagagacatatakaaatcactgggtcactgaaaatct

SEQ ID NO: 8160 - DNA, 50 bp, homo sapien
aggaagcttcatctataataattcarcaagcaggactggagagtggtcat

SEQ ID NO: 8161 - DNA, 50 bp, homo sapien
ccacaaaagcttctttatcgccacasagactctactcttgccacctaatc

SEQ ID NO: 8162 - DNA, 50 bp, homo sapien
tcaccccacaatctggcgcatactaycctatcttgttacgctctaaatct

SEQ ID NO: 8163 - DNA, 50 bp, homo sapien
caaatccactcttcccagttaaagawaagtcatcctgattagcttcccag

SEQ ID NO: 8164 - DNA, 50 bp, homo sapien
cttgagttccctctttcccttctcaycttcttggttgctcccttgtggat

SEQ ID NO: 8165 - DNA, 50 bp, homo sapien
cacacatctccatttccttgaatggratcacgcaaccctaggaggctgca

SEQ ID NO: 8166 - DNA, 50 bp, homo sapien
tgggttattgtttttcaacagagaamgtgtcacagcagaattgtagatta

SEQ ID NO: 8167 - DNA, 50 bp, homo sapien
gttctgtgtcttttaatggcccaaayagttcctgacttgtaacagctttt

SEQ ID NO: 8168 - DNA, 50 bp, homo sapien
aaccccaagaaatatgaattataacygtgtctcagagaatttacacgaat

SEQ ID NO: 8169 - DNA, 50 bp, homo sapien
agcacagagaatgctcaaatactgcraagaataaggtttgctacttggga

SEQ ID NO: 8170 - DNA, 50 bp, homo sapien
gtttaaagccttaccactcaatatcraatgaaagacgtggaatatcaaca

SEQ ID NO: 8171 - DNA, 50 bp, homo sapien
aatgagaaaaaatagacaaactatarggaaaattgattaaaacaaagctg

SEQ ID NO: 8172 - DNA, 50 bp, homo sapien
gccatgtgggcatttttacctctgamgccaaaggagcaattagtcctttt

SEQ ID NO: 8173 - DNA, 50 bp, homo sapien
gtatcttctaataaccagtgaagtaygtagaagataacaaattacatctt

SEQ ID NO: 8174 - DNA, 50 bp, homo sapien
acgccctgagcttgggcctgactcasagaccttcctacgaagccatgaat

SEQ ID NO: 8175 - DNA, 50 bp, homo sapien
ccaaagccaattgttaaacattcacyaagatactgctgagtgcaagagaa

SEQ ID NO: 8176 - DNA, 50 bp, homo sapien
gttttattttctcatgatgcaagtcraaataattgcctgcaaatccaaag

SEQ ID NO: 8177 - DNA, 50 bp, homo sapien
atcagtgtttcctaaaattgttacasagaactgccagaaaactagaaaat

SEQ ID NO: 8178 - DNA, 50 bp, homo sapien
ttatcaaggccaagaactttcctaasatgaagacagtatcagaatgaatt

SEQ ID NO: 8179 - DNA, 50 bp, homo sapien
tgcacacacggagaagaaagcagaamggaagtgtgtctgtggtatatttt

SEQ ID NO: 8180 - DNA, 50 bp, homo sapien
gcttctcagttcagaatttttaacarcttagatatttgagacctgaggga

SEQ ID NO: 8181 - DNA, 50 bp, homo sapien
cctgtggctttttcaaagtaaagaaygatgactactggaaaatgtatcca

SEQ ID NO: 8182 - DNA, 50 bp, homo sapien
taggttctcaaaatacgtttgctgaytaacttaggaagggaagatacagt

SEQ ID NO: 8183 - DNA, 50 bp, homo sapien
cttgtcttcttgactccaatggttascagatccagaatttccataaattt

SEQ ID NO: 8184 - DNA, 50 bp, homo sapien
gtcgaaggtgcttatcattatggtakgcaattttgtcggatgttagcgaa

SEQ ID NO: 8185 - DNA, 50 bp, homo sapien
ttccccaatgttatacattatgtaartggcacagttgcatctaaaatata

SEQ ID NO: 8186 - DNA, 50 bp, homo sapien
gaattaaaaatatgctctactaaagwcagatataaaactggagttagaat

SEQ ID NO: 8187 - DNA, 50 bp, homo sapien
gtatttttttttctgggtagttacartgactgatacatcacctaatcaat

SEQ ID NO: 8188 - DNA, 50 bp, homo sapien
atagatgacataatgttagtagcaayagtagtaacaacaactaatgttca

SEQ ID NO: 8189 - DNA, 50 bp, homo sapien
aacactgctattactgctgctagtaytacctattactatccccatcacta

SEQ ID NO: 8190 - DNA, 50 bp, homo sapien
gtagatgcattctttccatgggcatsagcaggtctggatctcctgctttc

SEQ ID NO: 8191 - DNA, 50 bp, homo sapien
agagtgtatgtggaattccttttacyactttctgttcacccaattagctc

SEQ ID NO: 8192 - DNA, 50 bp, homo sapien
cttaaacaattgtcttagaggaagcrctatgttaaatatgcagatagata

SEQ ID NO: 8193 - DNA, 50 bp, homo sapien
caaaagttaccttcaccactcttgawcttctctccatccagcttgccgtg

SEQ ID NO: 8194 - DNA, 50 bp, homo sapien
gtttatgtgaagtttgtcccatttaygttcttctgatgagcagtgggagc

SEQ ID NO: 8195 - DNA, 50 bp, homo sapien
agaaaggcaaccctagccttaagtartaagaggaacaaggtagagttgtt

SEQ ID NO: 8196 - DNA, 50 bp, homo sapien
tcttgtactcattatttttctagaaytgctgggtaaaccagaatggtttg

SEQ ID NO: 8197 - DNA, 50 bp, homo sapien
atgtggagcaaaagccagaggatggytcccactacaaagaattatcaggc

SEQ ID NO: 8198 - DNA, 50 bp, homo sapien
gaaaagtcacacattattaattgcgyattgattaatatttaaaacatgtt

SEQ ID NO: 8199 - DNA, 50 bp, homo sapien
ctttttttttttttctaaactgaagsaaactcatggttgttcctagaaaa

SEQ ID NO: 8200 - DNA, 50 bp, homo sapien
ttacttacaatttaccttacaaccamcactgacttacaggtggattaaaa

SEQ ID NO: 8201 - DNA, 50 bp, homo sapien
atctaagtgaactatattgttctacratctccatcttccatgaaataacc

SEQ ID NO: 8202 - DNA, 50 bp, homo sapien
aatgagctcccaaatatcacttcaartattctacgcaaacaaaatttcca

SEQ ID NO: 8203 - DNA, 50 bp, homo sapien
aattctgtgaatggacatttgagagrccgttgagtccgcaggtgaagaaa

SEQ ID NO: 8204 - DNA, 50 bp, homo sapien
agggatgtccagaaaatcagacttgraggacacataccagattccgtgcc

SEQ ID NO: 8205 - DNA, 50 bp, homo sapien
ttttgacggtgaaatgaaatgggcamtgaaagattggaattagcagtgct

SEQ ID NO: 8206 - DNA, 50 bp, homo sapien
ttatctagatgttatggatggttaaktagtttctttattggctctgaata

SEQ ID NO: 8207 - DNA, 50 bp, homo sapien
caccttcctctaattgtgaaatacaytaaagcccagggcactggatacct

SEQ ID NO: 8208 - DNA, 50 bp, homo sapien
attcaaattcttatgtatgcttcaaytgtagataaatttattatggaaag

SEQ ID NO: 8209 - DNA, 50 bp, homo sapien
aaacaaattgtttaccttgaacttaygacactcagttttctcatctggag

SEQ ID NO: 8210 - DNA, 50 bp, homo sapien
ggagttcaatgaggccacagacaaawaaacgagtatcccaggagaaaacc

SEQ ID NO: 8211 - DNA, 50 bp, homo sapien
tgtgaaccaagccaagtatctgtagraggtagcaggattgacttaatagt

SEQ ID NO: 8212 - DNA, 50 bp, homo sapien
aagagattactagggcctgaaaataygacacctccttccactctaagaca

SEQ ID NO: 8213 - DNA, 50 bp, homo sapien
aatttgtaagacacagatttgactasatgctaaattgtgttccaaagaga

SEQ ID NO: 8214 - DNA, 50 bp, homo sapien
caggcggggcggttgaccagctgaayggactcacttctaagaaatgcaaa

SEQ ID NO: 8215 - DNA, 50 bp, homo sapien
taaatgtcacgattctttgatttaarcatcctgaccttttaaaataaata

SEQ ID NO: 8216 - DNA, 50 bp, homo sapien
tgtggtgtttccagttcagtagatartatagaacatactccaaaagaata

SEQ ID NO: 8217 - DNA, 50 bp, homo sapien
aaggaaaaaaaataccctcaacacakgatatgattataaagaaaaagtat

SEQ ID NO: 8218 - DNA, 50 bp, homo sapien
ctggaaagatatatgtcaaacagtakagaaaaggattggaaagtggggaa

SEQ ID NO: 8219 - DNA, 50 bp, homo sapien
atacaatacaagccttcctaaatacsaaaagataacctgaaaatagtatg

SEQ ID NO: 8220 - DNA, 50 bp, homo sapien
aagcagcagcatagtggctaacaggkatataggaatcgctactgcagttt

SEQ ID NO: 8221 - DNA, 50 bp, homo sapien
aattgggtagcccaacataatcacawgggtttttattgaatgaagaagat

SEQ ID NO: 8222 - DNA, 50 bp, homo sapien
acaaataaaaagtcaaattttctgcrcctttcaaaaatgatgtgtaatga

SEQ ID NO: 8223 - DNA, 50 bp, homo sapien
aagtaaacacacttgctggaattgartatgttccttgattaactgcaatt

SEQ ID NO: 8224 - DNA, 50 bp, homo sapien
ttgtttttctcacgagcattataaamataaacaacccctgctgagttatt

SEQ ID NO: 8225 - DNA, 50 bp, homo sapien
acaaatataacttcgcctaatctacraaaaccatgtttccaaattgtgga

SEQ ID NO: 8226 - DNA, 50 bp, homo sapien
ttttctcataccattcctcacataakgtattcctcctccccatgcttacc

SEQ ID NO: 8227 - DNA, 50 bp, homo sapien
agtacactctatgatgttcccacgayggcaaaatcacccaaggacgcatt

SEQ ID NO: 8228 - DNA, 50 bp, homo sapien
tttggagtgctttcaggcttatagcraaaaaggaagaatcttcacataaa

SEQ ID NO: 8229 - DNA, 50 bp, homo sapien
tatcacataataattttacattcagyatcaatatcaattttttccctata

SEQ ID NO: 8230 - DNA, 50 bp, homo sapien
aattagtaattagagtgtttatgtcrgaagatacagtaggaaatccctgt

SEQ ID NO: 8231 - DNA, 50 bp, homo sapien
agtagactgtagagtataatataagyctgttggagcagggatggtaggaa

SEQ ID NO: 8232 - DNA, 50 bp, homo sapien
catgtgaagccacttaaatattaggyaattttgattaatgttagtaggag

SEQ ID NO: 8233 - DNA, 50 bp, homo sapien
tgattcaactgataacagctgcctcrctatgttctgttcactagtgtgaa

SEQ ID NO: 8234 - DNA, 50 bp, homo sapien
ataggtatatttggctgagatttagsatttgagtttgctgcaagacagtg

SEQ ID NO: 8235 - DNA, 50 bp, homo sapien
aatggataaaaagcatatatcccagragaaaagctagaaggaagctgtct

SEQ ID NO: 8236 - DNA, 50 bp, homo sapien
taggatttgagtttgctgcaagacartggaaggagaaatacagttatttt

SEQ ID NO: 8237 - DNA, 50 bp, homo sapien
agaaacagaaaaatatgctccaaaamatagaataagtttccagaaactga

SEQ ID NO: 8238 - DNA, 50 bp, homo sapien
ctgtcaggtatatcacatatctttgkatccttgcggtcagtttctggaaa

SEQ ID NO: 8239 - DNA, 50 bp, homo sapien
agagctgagttggaccctgatacccyagagacatgagaatgaagctttgg

SEQ ID NO: 8240 - DNA, 50 bp, homo sapien
ttcttaagaaaattgtagtagaaacrgcattaatatttcaaggagttaag

SEQ ID NO: 8241 - DNA, 50 bp, homo sapien
ctctttgtcatattgttaatggctcrctataaactaccttacaacttgag

SEQ ID NO: 8242 - DNA, 50 bp, homo sapien
tgtgccaataggtttattcaagcaasttacatatagtccatctttgaagc

SEQ ID NO: 8243 - DNA, 50 bp, homo sapien
ggagccagctctgctgggttctcagwagataccaaagagactagatcaga

SEQ ID NO: 8244 - DNA, 50 bp, homo sapien
gccaccactttaccaaagttctctastaactcttgtcactcatgggagaa

SEQ ID NO: 8245 - DNA, 50 bp, homo sapien
acagacacagaaaaggaactgaaagwattgctagaggcttataggtgttt

SEQ ID NO: 8246 - DNA, 50 bp, homo sapien
taaagatagaacattacaattttgcrgagggtaaacctatacaaattagt

SEQ ID NO: 8247 - DNA, 50 bp, homo sapien
gtctgttgctgctagttgtacctaartggtcaaagattttactatctctt

SEQ ID NO: 8248 - DNA, 50 bp, homo sapien
gacagtcattattcacataagcaagmaaactaaactattcatttattaca

SEQ ID NO: 8249 - DNA, 50 bp, homo sapien
atcttactccccagacgtaaggaaayggaaatgggcacagagagactcag

SEQ ID NO: 8250 - DNA, 50 bp, homo sapien
acactataatattatccattgcaaaratgaaaatatgtgaaactcttatt

SEQ ID NO: 8251 - DNA, 50 bp, homo sapien
ggttagaactgatacctgcctcttasaaactcaaatgtaaaatagaaggg

SEQ ID NO: 8252 - DNA, 50 bp, homo sapien
agattatttaactgtgaacccataawtgtcaaaatctaaaatgtaataac

SEQ ID NO: 8253 - DNA, 50 bp, homo sapien
tacacccacacaataactccagccasgtagatttctggaagcttctcaaa

SEQ ID NO: 8254 - DNA, 50 bp, homo sapien
accagtttctgttaaacttgctccaytgagtcattttttccaagattcca

SEQ ID NO: 8255 - DNA, 50 bp, homo sapien
attgtgaagcagtgataatgtttccraggagaaattagaagaaattataa

SEQ ID NO: 8256 - DNA, 50 bp, homo sapien
cccaagtttacaattattaagtgtargctcatgcatggcattaaaatttg

SEQ ID NO: 8257 - DNA, 50 bp, homo sapien
tgggagtttattaagtatcaactcayacaatcaaaaggtcccacaatagg

SEQ ID NO: 8258 - DNA, 50 bp, homo sapien
aaggacaacgtgtgttgttttgggamtatggtagcaatgagatgagtgct

SEQ ID NO: 8259 - DNA, 50 bp, homo sapien
cagtccccaaatatttggaaactaarttacatatgctaagcaaaccattg

SEQ ID NO: 8260 - DNA, 50 bp, homo sapien
agtaataaaaagaaatacttgaaatmaattgttgatagccatgatcattt

SEQ ID NO: 8261 - DNA, 50 bp, homo sapien
tttcttgatatatcactaaaggcaarcatagagatccttcggtggactca

SEQ ID NO: 8262 - DNA, 50 bp, homo sapien
tctcaataaatattagcattcacaaycaatatagtttcacaatgactaca

SEQ ID NO: 8263 - DNA, 50 bp, homo sapien
aatttgataagaaataatggaactartagagttataaaggaaaacaggtg

SEQ ID NO: 8264 - DNA, 50 bp, homo sapien
cttagataggactatagtttacaaakcatctccacgtgcactgtctcatc

SEQ ID NO: 8265 - DNA, 50 bp, homo sapien
tacactcaagaaagcgatggttcatsaatatacaatggtgcattgcctgc

SEQ ID NO: 8266 - DNA, 50 bp, homo sapien
ctacaaaaagactgtttccaaactamgcagtcagaagtatggttcaactc

SEQ ID NO: 8267 - DNA, 50 bp, homo sapien
gttggggtggttggaaatgacataamctgtgtgatgctttggatagttct

SEQ ID NO: 8268 - DNA, 50 bp, homo sapien
taatgtttcactaatattgaataaasagtgataaagacatgggcttcgat

SEQ ID NO: 8269 - DNA, 50 bp, homo sapien
ctgtatatctttctctttgtcaaatyaatatccaaacactctacttgttt

SEQ ID NO: 8270 - DNA, 50 bp, homo sapien
atttagtcaaaaagtaatttgtcaaktatgtggacagacacctctatttt

SEQ ID NO: 8271 - DNA, 50 bp, homo sapien
cattgagccatttgtttctggaacargccatagtcatttatacaccttcc

SEQ ID NO: 8272 - DNA, 50 bp, homo sapien
aataggagaaaaagcaaatatatcargatgaaaaaacaggaggaagctat

SEQ ID NO: 8273 - DNA, 50 bp, homo sapien
tatttgtacatgtcactcactcctaygctgcagagaaaagtgagagccac

SEQ ID NO: 8274 - DNA, 50 bp, homo sapien
aaatatttagcatttatttatgaaakctacaacaatacatacaagaatgc

SEQ ID NO: 8275 - DNA, 50 bp, homo sapien
atttcacagatttatataatgctcakcttctgtatgaagtacagaatgat

SEQ ID NO: 8276 - DNA, 50 bp, homo sapien
tgttagaatgtctttgataaaaccckgaaacttgctgttcttgccttatc

SEQ ID NO: 8277 - DNA, 50 bp, homo sapien
aaaacactgtatgttatcttcgttcwatttagggcatactcgctccctct

SEQ ID NO: 8278 - DNA, 50 bp, homo sapien
ggcttaagcaggaatgagcaatgctwacgctaacactggccatgattttt

SEQ ID NO: 8279 - DNA, 50 bp, homo sapien
taaaggtatgaagtcataaaggaaakaatttgagcaacatattaaagagt

SEQ ID NO: 8280 - DNA, 50 bp, homo sapien
gattagaactatggtagcagtctatyaaaacagagtcttccctggtgctg

SEQ ID NO: 8281 - DNA, 50 bp, homo sapien
tctttcaaaagcttacagtactaaakttcccaacccttcttgcatctctc

SEQ ID NO: 8282 - DNA, 50 bp, homo sapien
gaatgctttcatctgaagctacttargactagttaaccaaggaaaagggg

SEQ ID NO: 8283 - DNA, 50 bp, homo sapien
agaaaagtttgacatgaatctattaycaatttatggatcaacattaagac

SEQ ID NO: 8284 - DNA, 50 bp, homo sapien
gcttgcacactacaatggcagagtcraatgcttgcaacagactctatacc

SEQ ID NO: 8285 - DNA, 50 bp, homo sapien
cccctgcctcgcagcctcgcggaagycttaatgctgagtgccactagcat

SEQ ID NO: 8286 - DNA, 50 bp, homo sapien
gggctcctcctgagttcaatctaacrgtcctcagaagaaaggcgtgtccg

SEQ ID NO: 8287 - DNA, 50 bp, homo sapien
tgatttgtcccgaggctatgatggaygacaagtgatctgcaagaccagtg

SEQ ID NO: 8288 - DNA, 50 bp, homo sapien
ggtatgtaaaaagtatttcattttascagtctcatgaagtaagtcaatat

SEQ ID NO: 8289 - DNA, 50 bp, homo sapien
agaggataagtgctgtgaatgatgakattaactgtattttggaggtcaag

SEQ ID NO: 8290 - DNA, 50 bp, homo sapien
atactaggtaaatgaaactatcaackatccttttactaagaaatgtgaac

SEQ ID NO: 8291 - DNA, 50 bp, homo sapien
tagagcgctgctgtgcttccacagcrctatattggtaccagcatcatctc

SEQ ID NO: 8292 - DNA, 50 bp, homo sapien
ggaaagggacttcttacatagcggcragcaaaaggagagaatgagagcca

SEQ ID NO: 8293 - DNA, 50 bp, homo sapien
atggtacatatctgataaaaaatcamcttgaaaatggcaggtataaatga

SEQ ID NO: 8294 - DNA, 50 bp, homo sapien
cccaaaccctttcagtcaccttgaaygaggaatgtttttttcattaacat

SEQ ID NO: 8295 - DNA, 50 bp, homo sapien
cttggcctttcccttatgattgaaartgattgaagcagctctacatctca

SEQ ID NO: 8296 - DNA, 50 bp, homo sapien
cactgcataggttctgcaaagagatkaagacagtattgactggaattaca

SEQ ID NO: 8297 - DNA, 50 bp, homo sapien
tccacggtaaaacacatggctccaaytgaataaactctaaggctcctgta

SEQ ID NO: 8298 - DNA, 50 bp, homo sapien
ctgaatgaacaaaaacagcttttccraactactgaatccaaataaacatt

SEQ ID NO: 8299 - DNA, 50 bp, homo sapien
cctctacaatggtgcttaatgtcacwataatttgatctttttttttcctt

SEQ ID NO: 8300 - DNA, 50 bp, homo sapien
caaagacactatagcaataacatacraggaattgtctaggaatacctagc

SEQ ID NO: 8301 - DNA, 50 bp, homo sapien
tagttctatggagaagggtgacaaaytaggtgatgaaatgacataagaat

SEQ ID NO: 8302 - DNA, 50 bp, homo sapien
gcttctgggttaaagcaggtaaaaartgactcatcttctttaggacaatg

SEQ ID NO: 8303 - DNA, 50 bp, homo sapien
gaagtcaccttgatgacgacgactgyagtggggtgaatgccatcacagtg

SEQ ID NO: 8304 - DNA, 50 bp, homo sapien
gtcttaaatatctctagttctctgayagtaaattatgccaacatttggat

SEQ ID NO: 8305 - DNA, 50 bp, homo sapien
tccttcaggtgattgaaaaaattcgraaagtcacctgtttcctcagaatt

SEQ ID NO: 8306 - DNA, 50 bp, homo sapien
cttgctattgccctaatatcattacyatcccagatatgcattttcttgtt

SEQ ID NO: 8307 - DNA, 50 bp, homo sapien
taaactccataatggcaggcgaccayggtgtcttctttgctgcatcccta

SEQ ID NO: 8308 - DNA, 50 bp, homo sapien
ggtagggaggatcaatggcagtgatkaatagctcttgctgggctgtagta

SEQ ID NO: 8309 - DNA, 50 bp, homo sapien
tttactgatttaataatgtcacaacrcgatatcctacaacctgagaatga

SEQ ID NO: 8310 - DNA, 50 bp, homo sapien
aaagtcatgggagactgtagagaaayggtataatgactagatatccacac

SEQ ID NO: 8311 - DNA, 50 bp, homo sapien
aatgctgcccgccattctttcatgayaatagccatatgaaacatggacat

SEQ ID NO: 8312 - DNA, 50 bp, homo sapien
tgaggtgactcagaatggcttcaaaygcaggtttcagtttgcagcagcca

SEQ ID NO: 8313 - DNA, 50 bp, homo sapien
cacttctggtcaatctccagcatagraccgataacttctagtttcccttc

SEQ ID NO: 8314 - DNA, 50 bp, homo sapien
gaaaaaaagttatgtcctacagatasaagttttgattccagatctctgtg

SEQ ID NO: 8315 - DNA, 50 bp, homo sapien
atttgcatctaattcaagttcataayaatgttcctaaatcattagcacat

SEQ ID NO: 8316 - DNA, 50 bp, homo sapien
gttggaagcttctggtagtttataartgaagttctccagtccccaaattc

SEQ ID NO: 8317 - DNA, 50 bp, homo sapien
atatgcctgggattcaataatccaarcgaaacatcctttttttcagttat

SEQ ID NO: 8318 - DNA, 50 bp, homo sapien
aataatcctttgtgcatgattataaygaagtgctcactgaatcaaatgcc

SEQ ID NO: 8319 - DNA, 50 bp, homo sapien
cagctttctaatcaacattagaaaawtagtcatgctctattacataacac

SEQ ID NO: 8320 - DNA, 50 bp, homo sapien
gaagctaatacaacaatgaacatcamgtaggtcagtctttaatccatctc

SEQ ID NO: 8321 - DNA, 50 bp, homo sapien
gagtactagaaactcatatcattgaraaaatactatgattccatatcttc

SEQ ID NO: 8322 - DNA, 50 bp, homo sapien
tacattttagggagacgtgagacatsaatcaatatttgagtttctgatta

SEQ ID NO: 8323 - DNA, 50 bp, homo sapien
aactttttttttttatttcactatgyatgttggtatgtatgtttttattt

SEQ ID NO: 8324 - DNA, 50 bp, homo sapien
aaggtttaaaactgagagatgaatayacgcatgacaaagcagtttctcag

SEQ ID NO: 8325 - DNA, 50 bp, homo sapien
tgaaggccagattgggtgactttagyagtttattggccttcatttcatgc

SEQ ID NO: 8326 - DNA, 50 bp, homo sapien
tattgtagaattgaaaagttacgtgrcaaataatgtagatacacagagga

SEQ ID NO: 8327 - DNA, 50 bp, homo sapien
ggctctggtttccttgcctgatacaytgaagtcagcttccaaagaatgcc

SEQ ID NO: 8328 - DNA, 50 bp, homo sapien
taaacacattaagtcattgctctaarcatcctcaagatactatatgaaaa

SEQ ID NO: 8329 - DNA, 50 bp, homo sapien
tagaagagtatctagacctaagaggmacagggtacacattgtttaatgtt

SEQ ID NO: 8330 - DNA, 50 bp, homo sapien
atgaatagaattaggttttaaaaagwacaggaagatagaagagatgtagc

SEQ ID NO: 8331 - DNA, 50 bp, homo sapien
agtatcaagtagcatgtggtataacmattttctatattttcttagaaaag

SEQ ID NO: 8332 - DNA, 50 bp, homo sapien
cagtggcaagagagagaataacaaarcaactaaatgcagcaatcagaatt

SEQ ID NO: 8333 - DNA, 50 bp, homo sapien
aaccaagtagatctgagctcttccastgatgttttttgagtttacgaata

SEQ ID NO: 8334 - DNA, 50 bp, homo sapien
ggctgaaagaccacgtggagatagamgggcccagcatcacagctactcag

SEQ ID NO: 8335 - DNA, 50 bp, homo sapien
gttctaagtatgttggaaagacccargaggttattaagcagaataaaatt

SEQ ID NO: 8336 - DNA, 50 bp, homo sapien
cctgactgacctaatcctagtcagaygaagtagaactgagataccaggga

SEQ ID NO: 8337 - DNA, 50 bp, homo sapien
gttttcaaggactttctatggactcyagatgtaattccaaactggttttt

SEQ ID NO: 8338 - DNA, 50 bp, homo sapien
aatgagataaggccccgtcacaaatwattactatcatacaaagtaagaac

SEQ ID NO: 8339 - DNA, 50 bp, homo sapien
catgtcactgctgggcaagttccaayaaatgtctcaagaagattagatct

SEQ ID NO: 8340 - DNA, 50 bp, homo sapien
gactgttgcaggtacaatcaataaakgttaagtggctagcacgatgcgtg

SEQ ID NO: 8341 - DNA, 50 bp, homo sapien
catttatagaatgtgaccttaaaacrgaattatattgccaatgtagataa

SEQ ID NO: 8342 - DNA, 50 bp, homo sapien
ttagagcaatgatagataagcctagmaagttaaactgagctcgtattggg

SEQ ID NO: 8343 - DNA, 50 bp, homo sapien
tgtgccaactggttattttattatcycaggaaatatgcactgcaggaata

SEQ ID NO: 8344 - DNA, 50 bp, homo sapien
ctactttgctaatgccctcctctttwgtttagtgtgttgtctgcccatca

SEQ ID NO: 8345 - DNA, 50 bp, homo sapien
caagccaaaggacacctggcttctarttcacccacactgcatgtaagacc

SEQ ID NO: 8346 - DNA, 50 bp, homo sapien
attcagagtggaaaataattactgayggatttcaattgctaaaagacagc

SEQ ID NO: 8347 - DNA, 50 bp, homo sapien
ggagaaaattgattatgttaggaaasgtgagattgagattcagagtggaa

SEQ ID NO: 8348 - DNA, 50 bp, homo sapien
taggatagaaattagaaaaattgaaraagtagaaaattagcagagtttaa

SEQ ID NO: 8349 - DNA, 50 bp, homo sapien
tctagtaggtattagctcattacaastatgtgtacacaaccagtccttac

SEQ ID NO: 8350 - DNA, 50 bp, homo sapien
ttgatactgaattaataaagatttayggaaggtagcatcagcagcagtga

SEQ ID NO: 8351 - DNA, 50 bp, homo sapien
gtcatgtggtaagcctaataaaacaycttctgaaataattagcccttaaa

SEQ ID NO: 8352 - DNA, 50 bp, homo sapien
atatgtttgaaatagattactgaaaytgaagttgctactgcaaataatat

SEQ ID NO: 8353 - DNA, 50 bp, homo sapien
tctcttaatcctgagactttttataygacatctcctctcattgtattaag

SEQ ID NO: 8354 - DNA, 50 bp, homo sapien
tgctaactcagaatccggatgggaargagagatgattaattaccactctc

SEQ ID NO: 8355 - DNA, 50 bp, homo sapien
gttgtgttcttaccaactctttatawgaatgccttttcccctttccaaat

SEQ ID NO: 8356 - DNA, 50 bp, homo sapien
gctggctaaattaaaaagttgcataycactctaagtcagaagcacatttc

SEQ ID NO: 8357 - DNA, 50 bp, homo sapien
ccttcaactcctagatcctgtctttsaaaatgcagccgttatgttggcag

SEQ ID NO: 8358 - DNA, 50 bp, homo sapien
taagattcagacgaataaatgatgaygaaggaccatcacacagcctggta

SEQ ID NO: 8359 - DNA, 50 bp, homo sapien
tccaaaatataggataagagctttayacatagccgtgtgtgtgattgtgt

SEQ ID NO: 8360 - DNA, 50 bp, homo sapien
acaaactttgtttttaaagctcaccrgattgataattttcagcttttctt

SEQ ID NO: 8361 - DNA, 50 bp, homo sapien
ttctggctcacatttatactcagtaygtagttgttgagaatgcatgaaca

SEQ ID NO: 8362 - DNA, 50 bp, homo sapien
aaaatactgttcatacactaggacasattcaaataaaaacattttaaaca

SEQ ID NO: 8363 - DNA, 50 bp, homo sapien
ataatctcccctaaatattgacttcmaaggactacagtgaaggattatct

SEQ ID NO: 8364 - DNA, 50 bp, homo sapien
tgacttgtctaaggtcacatagcacygagtaatgtcatcgagatttgaag

SEQ ID NO: 8365 - DNA, 50 bp, homo sapien
taaaaatcaagaattactatcctagmaagctggtaccacaaagaaaaaaa

SEQ ID NO: 8366 - DNA, 50 bp, homo sapien
cttctgataggcagggactcaaaccmaggttcctctgcacctcggaccct

SEQ ID NO: 8367 - DNA, 50 bp, homo sapien
agcttgggctctgggaagaggtgcaygtcatttctacatgtacaacctaa

SEQ ID NO: 8368 - DNA, 50 bp, homo sapien
gagacctgtctcagagcatgggttaygatggagagagagagcacttgaga

SEQ ID NO: 8369 - DNA, 50 bp, homo sapien
ttgcctactaagtcatcatctacaamaatttcagtcacagtgcccaagac

SEQ ID NO: 8370 - DNA, 50 bp, homo sapien
agaaaaggaatgtgaagggttataaraaaatgagagttctgtatcactca

SEQ ID NO: 8371 - DNA, 50 bp, homo sapien
agcaatgagatattggtttagtttaragaggtacaaagcaggacaaggat

SEQ ID NO: 8372 - DNA, 50 bp, homo sapien
aaagaatctttggatttggccataargtgttcattggttacttcaccgaa

SEQ ID NO: 8373 - DNA, 50 bp, homo sapien
tttgattccttgccctcaaaaactgsagaatgaatacatagcatttatgc

SEQ ID NO: 8374 - DNA, 50 bp, homo sapien
caataaggccaagaggcgagacaaaragggcaaaaatcttctttagtgag

SEQ ID NO: 8375 - DNA, 50 bp, homo sapien
tatacatttccagtgtatatgacaaygaaaaggtgcaatttatttattag

SEQ ID NO: 8376 - DNA, 50 bp, homo sapien
aaagaatgaagttgttttcagctaarattattttggagttaacctgcatg

SEQ ID NO: 8377 - DNA, 50 bp, homo sapien
cccaagtaaacttcctatatcctacyggcttgagcttattgtggcctcaa

SEQ ID NO: 8378 - DNA, 50 bp, homo sapien
cctcacctgtgacaaagtttacaagkagggaatcttggaggaagttctga

SEQ ID NO: 8379 - DNA, 50 bp, homo sapien
tcctgcacatacctacacttataaawacagaaaagtctcaaaataggcat

SEQ ID NO: 8380 - DNA, 50 bp, homo sapien
ccaagatcgtcacttattaacttcasaaccaatgactgtttcctctcctg

SEQ ID NO: 8381 - DNA, 50 bp, homo sapien
gagagaggagagcagttagactcgaygatagcgggagaagtggaaggtga

SEQ ID NO: 8382 - DNA, 50 bp, homo sapien
ggaggtcacccatagaatcagaaaayctgagaaatgtgagggcttttaag

SEQ ID NO: 8383 - DNA, 50 bp, homo sapien
cggaaatttctcaaggagcattcagyaatccaaacgctgcagcccaggtc

SEQ ID NO: 8384 - DNA, 50 bp, homo sapien
tttgacctcaaatttatatcaacaamctactccaccaaacgaatgaacat

SEQ ID NO: 8385 - DNA, 50 bp, homo sapien
tgacagcaacttcatggatttgaacrcataaatgaaaaggcatgggaggc

SEQ ID NO: 8386 - DNA, 50 bp, homo sapien
tggtttgttagttgtcactttttaartctgtagctaatacaaaatcttag

SEQ ID NO: 8387 - DNA, 50 bp, homo sapien
ccatacctttagtctttgatgtagayaatgaaagatggaaaagagaagcc

SEQ ID NO: 8388 - DNA, 50 bp, homo sapien
tagaatctgccaagggatatgttcaytcacatagatgcctgaggtggaaa

SEQ ID NO: 8389 - DNA, 50 bp, homo sapien
tgacctgtgcttttggtatcagattmaaatataattgcccagaccaaaat

SEQ ID NO: 8390 - DNA, 50 bp, homo sapien
cctgaagaatggtagtctaaaactgraccctatcttcattacagatttaa

SEQ ID NO: 8391 - DNA, 50 bp, homo sapien
acatcctgagggatcttataaaagaraaattgtatcattttactctcctg

SEQ ID NO: 8392 - DNA, 50 bp, homo sapien
catattttccatctgtgctactctartagaggttctctgtgaggactcca

SEQ ID NO: 8393 - DNA, 50 bp, homo sapien
atttcctgtatgtaacataataccartctattcaatttcccgttttctga

SEQ ID NO: 8394 - DNA, 50 bp, homo sapien
aagaaacacagaacgtctataaaaaytgagcacatattaggttccaaagg

SEQ ID NO: 8395 - DNA, 50 bp, homo sapien
cattcactcaactcttcatcacttcrgaaatagaatatagttttgcgaga

SEQ ID NO: 8396 - DNA, 50 bp, homo sapien
atgccttagcaatagatttgcaccayatatcttgaggatacgatatttta

SEQ ID NO: 8397 - DNA, 50 bp, homo sapien
tctctctttgaaatgggataatggaytaaacaaggttgtagtgggtttaa

SEQ ID NO: 8398 - DNA, 50 bp, homo sapien
aaagaatgtatgaatgctgtctttaraagataacatcatatggaggttct

SEQ ID NO: 8399 - DNA, 50 bp, homo sapien
cagctttaggacagtttacaagtcaytattcatctttcacttctgcagaa

SEQ ID NO: 8400 - DNA, 50 bp, homo sapien
ccatgaggaggatggtgacataaaartgaggaaataagagactggtggtg

SEQ ID NO: 8401 - DNA, 50 bp, homo sapien
cacgtaatgaataggttcctgattartaagccagcatgcctgtgggccag

SEQ ID NO: 8402 - DNA, 50 bp, homo sapien
catgtgcctcctggcctatccgtccyagagttggaggaggaggagcccca

SEQ ID NO: 8403 - DNA, 50 bp, homo sapien
atgtctatgctttctctcagctttaygattctaaggagaaagagaatcta

SEQ ID NO: 8404 - DNA, 50 bp, homo sapien
agtggggaaaatttatggcctattcsagaagagtgagcagcctaatcaag

SEQ ID NO: 8405 - DNA, 50 bp, homo sapien
cttcacttggtgcccaggatactatyagtgcagagaggcatgtgggttga

SEQ ID NO: 8406 - DNA, 50 bp, homo sapien
aaagtcttacattttgcaaagatackactaatggcttcaaaggaatgaaa

SEQ ID NO: 8407 - DNA, 50 bp, homo sapien
aggaactgaggtagacctggaagaarggatctgacctaggatcttcctaa

SEQ ID NO: 8408 - DNA, 50 bp, homo sapien
tacagaacagctgtgtctcttttacyataaagctcgtgtgccttgtctct

SEQ ID NO: 8409 - DNA, 50 bp, homo sapien
ccaaatgcctgtgtgcaaaggcttaytaaacagggacttgagctaggtca

SEQ ID NO: 8410 - DNA, 50 bp, homo sapien
tcatttttactgcagctaatcaatcrcatcttgagttcccataccagctt

SEQ ID NO: 8411 - DNA, 50 bp, homo sapien
ggtagacattgtattcctggagaackagatctgtaaataaacagggcctt

SEQ ID NO: 8412 - DNA, 50 bp, homo sapien
cctatacatggtactggggttacacygtgagcaagacagacatatttact

SEQ ID NO: 8413 - DNA, 50 bp, homo sapien
ggcattaatggatccacgactaaagrcacaagggctgtggaagtcttggt

SEQ ID NO: 8414 - DNA, 50 bp, homo sapien
tacagtggaagcacaaaagaggagtwaatatcaatcatgacccattcatc

SEQ ID NO: 8415 - DNA, 50 bp, homo sapien
ttcgttggctttctacctgaatttcwctagtcacttctgtccatataatc

SEQ ID NO: 8416 - DNA, 50 bp, homo sapien
gtgagtgagaagcaaactttatttcyaattcagttattttggcttttctg

SEQ ID NO: 8417 - DNA, 50 bp, homo sapien
tgggaattgatagaggaagggaaatkaacatacattcaacatcaagtttt

SEQ ID NO: 8418 - DNA, 50 bp, homo sapien
aggactgatttacagaaccacaaccracagctatttcagtggtagaaaat

SEQ ID NO: 8419 - DNA, 50 bp, homo sapien
ggcagagctgatcatttcctctaagrctgaacattaccctccaccccatt

SEQ ID NO: 8420 - DNA, 50 bp, homo sapien
gtgcatgaggaaaaaggaagatccakactaaaaagaaacaggatggatat

SEQ ID NO: 8421 - DNA, 50 bp, homo sapien
taagctgtgggagttgagggtttaaytgcttggccacttggccttctctc

SEQ ID NO: 8422 - DNA, 50 bp, homo sapien
gagatcatctccagggttataaatcrgagagaatgagacgctagagccag

SEQ ID NO: 8423 - DNA, 50 bp, homo sapien
ttaacagctggctagctgctagagayataaagacaagctaaccatggcct

SEQ ID NO: 8424 - DNA, 50 bp, homo sapien
aatgattagcattattggatttgagratagaacaataaattcctagatca

SEQ ID NO: 8425 - DNA, 50 bp, homo sapien
tagagaaagaactacaaggccgtccygagaagtatacactagggggatct

SEQ ID NO: 8426 - DNA, 50 bp, homo sapien
tcctttacaactatattatcacaaayctcaaaaattccaacactttaaag

SEQ ID NO: 8427 - DNA, 50 bp, homo sapien
aagcatgaatacctttcacatagcaytaagtacctaaatatttgtcaaat

SEQ ID NO: 8428 - DNA, 50 bp, homo sapien
tcgattttctgcaatgacaacaacgyagaaaacagggtgaacttcctgga

SEQ ID NO: 8429 - DNA, 50 bp, homo sapien
accaaatacagagtccatgaactcartgacataaaagagaagactatgag

SEQ ID NO: 8430 - DNA, 50 bp, homo sapien
aggggcgatgagatcatggaagacaytggatactatgtttaggaatagag

SEQ ID NO: 8431 - DNA, 50 bp, homo sapien
cttaattaatatactgagtaaggtaraagatatttagatagaaacactgg

SEQ ID NO: 8432 - DNA, 50 bp, homo sapien
gactctaagctactgagggaatacayacttatctctgtagctgccactgt

SEQ ID NO: 8433 - DNA, 50 bp, homo sapien
aacataaaccttttccaaccactacrgaattgttagaccctaggtttgga

SEQ ID NO: 8434 - DNA, 50 bp, homo sapien
ctccttttggaaagacctggcataartcactgagagctgtgccctgtgca

SEQ ID NO: 8435 - DNA, 50 bp, homo sapien
agcatagagtgtgcttttcattaaaygttagctgtttttacttatttatt

SEQ ID NO: 8436 - DNA, 50 bp, homo sapien
gcatgccactacacctggctaattaragcaatttttgatggggtctcact

SEQ ID NO: 8437 - DNA, 50 bp, homo sapien
acaaattgttttgcccggtccttcakgcagaacaaataaacacaaaataa

SEQ ID NO: 8438 - DNA, 50 bp, homo sapien
tccctcgcttgtttgaaggcaatgcrgagaactcagaccctcaagataaa

SEQ ID NO: 8439 - DNA, 50 bp, homo sapien
aacttgtctgatcataagagtctccyaagatgcttgtgatagatagaggt

SEQ ID NO: 8440 - DNA, 50 bp, homo sapien
aatgaagcatctttggagtcaacacycattaagtagttattagtcttctc

SEQ ID NO: 8441 - DNA, 50 bp, homo sapien
ctgtccttttatctcgatacgtgaaygcttctatttgtgggaaatccccg

SEQ ID NO: 8442 - DNA, 50 bp, homo sapien
catctgcagaggctaaatgcagaccyattgtttatttttgttgtgacctt

SEQ ID NO: 8443 - DNA, 50 bp, homo sapien
gatttatacacaatagacctggtacyaatagatgcgtaacttaaaatccc

SEQ ID NO: 8444 - DNA, 50 bp, homo sapien
tagcaaataattgcatcacagagaayagagtttgcttacagagacccagg

SEQ ID NO: 8445 - DNA, 50 bp, homo sapien
agttagtaccaactagaagcacttayacctgacttccttttaccactttt

SEQ ID NO: 8446 - DNA, 50 bp, homo sapien
ataaaatatatgtgcaatagataaaygtcaaggaaagtcatagatgtctt

SEQ ID NO: 8447 - DNA, 50 bp, homo sapien
tgcatgtctgggcttctgtaagtgaygactgtttttctcactgcactgtc

SEQ ID NO: 8448 - DNA, 50 bp, homo sapien
gaccacttcacacctgcacctacgcrccgtcctgtgggagccagcctgag

SEQ ID NO: 8449 - DNA, 50 bp, homo sapien
taatgaggaagcagaggctcagaaasattaaaaaccttgtccaaggccac

SEQ ID NO: 8450 - DNA, 50 bp, homo sapien
cctcattagaaagatggaaaataacracgtctactttgaatggggttgtg

SEQ ID NO: 8451 - DNA, 50 bp, homo sapien
atccatgtctcattgtacaatagaayttcacacccacatctccttcaggg

SEQ ID NO: 8452 - DNA, 50 bp, homo sapien
atttgcacagcattgctatgggaagyctgaatctatctagctttacaaag

SEQ ID NO: 8453 - DNA, 50 bp, homo sapien
ttctgcttcaaaaaaattccaatatkagtcagatatcagacatttaaaag

SEQ ID NO: 8454 - DNA, 50 bp, homo sapien
taatttaccagtcagggagtggaaaygtgagaacttggcagttgagccta

SEQ ID NO: 8455 - DNA, 50 bp, homo sapien
ttttaccccttctcaggttattcaasgttttcaaaaacaaagatgttgta

SEQ ID NO: 8456 - DNA, 50 bp, homo sapien
aaactgaaataaagtgctgattcacwatggaccaagagaaaagcagagga

SEQ ID NO: 8457 - DNA, 50 bp, homo sapien
atatgggagaatttgaatctcatcasaaggtctaatttgaagtaataaac

SEQ ID NO: 8458 - DNA, 50 bp, homo sapien
aagtgacattataaacaatcatcccraagtctaaaaacatataacttatt

SEQ ID NO: 8459 - DNA, 50 bp, homo sapien
ggtatatacacacttgatttcaaaamgttatgcagctttgctctccaaaa

SEQ ID NO: 8460 - DNA, 50 bp, homo sapien
acagtacccagaatatgctctaatgmacaacagctggtccttctgtctag

SEQ ID NO: 8461 - DNA, 50 bp, homo sapien
ctcaaatctgagccatcctgctaagyaaaccattccagaattactgcccc

SEQ ID NO: 8462 - DNA, 50 bp, homo sapien
tttattttactgttactgaaatctcratattatgtggccaggcatggtga

SEQ ID NO: 8463 - DNA, 50 bp, homo sapien
tgcttgcattttactctaagcagcartatgaaatcaggctgtatttttag

SEQ ID NO: 8464 - DNA, 50 bp, homo sapien
caaaaagtggaaaaggataaatgcgsatggtgaacaggaagtgagaaggt

SEQ ID NO: 8465 - DNA, 50 bp, homo sapien
agcataaatatgaaaggatattaatyaaaccccagaagaaagccactttt

SEQ ID NO: 8466 - DNA, 50 bp, homo sapien
cccagagtccaggtgtgaaccacagsaagtgaggaggacaggccccaaac

SEQ ID NO: 8467 - DNA, 50 bp, homo sapien
acaactaaaaatggtgaataaaacayggcgatgaataaaacaaacccatt

SEQ ID NO: 8468 - DNA, 50 bp, homo sapien
tgtgtcactcaggtttctcaacaccrcttttaaaagagaatgccctttcc

SEQ ID NO: 8469 - DNA, 50 bp, homo sapien
ccttcctacatacggaactgttgtargaatgaaataaaactgtatgtgga

SEQ ID NO: 8470 - DNA, 50 bp, homo sapien
ggtcttttccggctcctagaggccaytgcttgacttgttgccctttcctc

SEQ ID NO: 8471 - DNA, 50 bp, homo sapien
ttctctgaattacactgtagccaatkactagcaaaacctctttaaatctg

SEQ ID NO: 8472 - DNA, 50 bp, homo sapien
agtggagatggccaccaccgacagaraataactctatgcttaggatccaa

SEQ ID NO: 8473 - DNA, 50 bp, homo sapien
ctatagtttcttagttgtatttaaarcgcatgtcccagtgcattacctat

SEQ ID NO: 8474 - DNA, 50 bp, homo sapien
cttcacaacagcaattgtcaaaaaayatgatgattggcttctatatgtat

SEQ ID NO: 8475 - DNA, 50 bp, homo sapien
cagataggcaaacaatttaaaagackgattacatgcactgttggtaaaaa

SEQ ID NO: 8476 - DNA, 50 bp, homo sapien
cccaccttgttaagtatgaattggamatttgtacccatgcagtttccttg

SEQ ID NO: 8477 - DNA, 50 bp, homo sapien
gtacaaatcaagaatgctaacctaamttaattcagcaaagaataggttaa

SEQ ID NO: 8478 - DNA, 50 bp, homo sapien
aagaagaaatatacataattccaaawgataaaataattcagtggggtgcc

SEQ ID NO: 8479 - DNA, 50 bp, homo sapien
tatttgcatttcaatatttaattgcrcatgttttactgacaactttgtcc

SEQ ID NO: 8480 - DNA, 50 bp, homo sapien
agaaaatggtgggaaccataatatcraagaaagaacacacaaaatcatcc

SEQ ID NO: 8481 - DNA, 50 bp, homo sapien
ggacatattctcccagaaccattaayaccgcaaagacaatacatctcttg

SEQ ID NO: 8482 - DNA, 50 bp, homo sapien
ggttctgggagaatatgtccaatgargattaaaatacagacctgcccagc

SEQ ID NO: 8483 - DNA, 50 bp, homo sapien
cttgtacatagcggacacccagtaawgtatgcaattttgcttgctaaaat

SEQ ID NO: 8484 - DNA, 50 bp, homo sapien
cgctgctatcacactcgtccacaccrcttgtctgccatcacctaggtggc

SEQ ID NO: 8485 - DNA, 50 bp, homo sapien
acaggcatgagccattgtgcccggcsaagtgttcaaaaattatagcctac

SEQ ID NO: 8486 - DNA, 50 bp, homo sapien
ctgggactgaacatgggcctttggcrgaatgacccagtccttgttcccag

SEQ ID NO: 8487 - DNA, 50 bp, homo sapien
caaagctggaaaacgagttataacckctgcaccttacaaacctgttcctg

SEQ ID NO: 8488 - DNA, 50 bp, homo sapien
acaaactaaaaacgttgacagaatgmatcaatcaaagaacccatgcagga

SEQ ID NO: 8489 - DNA, 50 bp, homo sapien
agagcacagagaatgtaagcatccayacgctttttatgaagtcatcatgg

SEQ ID NO: 8490 - DNA, 50 bp, homo sapien
acggaaaaacgatttgatggaaaatyaaatcagttgccatgagagttcat

SEQ ID NO: 8491 - DNA, 50 bp, homo sapien
tgaggcaaccaaaataactgacataygaaaagtgataaggttataagcaa

SEQ ID NO: 8492 - DNA, 50 bp, homo sapien
aactaggaagtttagtatagttgctraatggagatcaatacatgcaaaaa

SEQ ID NO: 8493 - DNA, 50 bp, homo sapien
atgcgaatctccaagagaggcataartagcacataagagttcccaaactt

SEQ ID NO: 8494 - DNA, 50 bp, homo sapien
gcctcctcatctctcagtgatcaacmgatataacattttatgaaattcaa

SEQ ID NO: 8495 - DNA, 50 bp, homo sapien
gaataggaaaacccaagaacaatgartatccattgagaaaaagcccatga

SEQ ID NO: 8496 - DNA, 50 bp, homo sapien
tgatatctggagaagagaaaggatawacctgaagtcacaaaaagtaacaa

SEQ ID NO: 8497 - DNA, 50 bp, homo sapien
cgcatctagcaggagaaagaaaaccsgacactttggagataaatagagag

SEQ ID NO: 8498 - DNA, 50 bp, homo sapien
ggactctgcctctccttcttacctaycgatgaatcccacagtgcccagca

SEQ ID NO: 8499 - DNA, 50 bp, homo sapien
atgccacccatctcaagacttagacracaggcttgctcgggagaacttag

SEQ ID NO: 8500 - DNA, 50 bp, homo sapien
cagagttactgagtgcccgctatgcrccaggctgtgttgtaggatctgga

SEQ ID NO: 8501 - DNA, 50 bp, homo sapien
tccttcacactctggaacattcttgyattgttgtagagggtgaaacagaa

SEQ ID NO: 8502 - DNA, 50 bp, homo sapien
cagaggggctcattgtttcttggccyggaaattacacatctccatgccac

SEQ ID NO: 8503 - DNA, 50 bp, homo sapien
aggtcctcttgagtttcaagtgggaygtaaattgaatgtaggcactcttc

SEQ ID NO: 8504 - DNA, 50 bp, homo sapien
attgtagaatgtctgtgctatatgtwaaccactataattcctactttcct

SEQ ID NO: 8505 - DNA, 50 bp, homo sapien
tcatttgtggaagagtaaggaaagcragtatctgaaaagcatagtcgaga

SEQ ID NO: 8506 - DNA, 50 bp, homo sapien
agacaaaatccatccgatgtaaatayaagtagttatcaacagacagctaa

SEQ ID NO: 8507 - DNA, 50 bp, homo sapien
aaattaatattacttgggaagttgaygataaaataagaattgaagttgcg

SEQ ID NO: 8508 - DNA, 50 bp, homo sapien
atcaacaaacagcccagaggaagacrctgaagtccaaagaggctggctga

SEQ ID NO: 8509 - DNA, 50 bp, homo sapien
aaaaggactgacatctagtatattcraaaactccaggttataaaacaaag

SEQ ID NO: 8510 - DNA, 50 bp, homo sapien
tctacatacccgagacttaaagggayggaatgaatgtccaaggagaatcc

SEQ ID NO: 8511 - DNA, 50 bp, homo sapien
acccacccagagacgttgatttaaawgttcatggccatgtcgtccattta

SEQ ID NO: 8512 - DNA, 50 bp, homo sapien
gattgtatatagttaaagaaaaaacrattcattggcccatgtcagatcta

SEQ ID NO: 8513 - DNA, 50 bp, homo sapien
atggttaaaaccatttccattgtcartatgcagataaggaaactaaatct

SEQ ID NO: 8514 - DNA, 50 bp, homo sapien
acggcacttactccttgagcataatyacctgaaagatgcctggtttggat

SEQ ID NO: 8515 - DNA, 50 bp, homo sapien
atgctggaaggaaatgagagataaayagatgaacataacagcctataggc

SEQ ID NO: 8516 - DNA, 50 bp, homo sapien
aagaaaccttgtaatggtaaaatatracttcataaacttctattacaatt

SEQ ID NO: 8517 - DNA, 50 bp, homo sapien
gacaaaagaagcccaggtactgtaakgtcagcatgagaagtttatgtctt

SEQ ID NO: 8518 - DNA, 50 bp, homo sapien
ttatttcactctctggtcaaacctcrattactgtccttgtcacatttctt

SEQ ID NO: 8519 - DNA, 50 bp, homo sapien
ctgaagaacctaagttcaatgttaaygttcctgtatgtaggcacaatgtt

SEQ ID NO: 8520 - DNA, 50 bp, homo sapien
agatgtaccttaaagtgttagcagayacagattaagacactgggagccaa

SEQ ID NO: 8521 - DNA, 50 bp, homo sapien
gagacaggaaggagagaacaagtcaytgaagacgtggggacagagaacgg

SEQ ID NO: 8522 - DNA, 50 bp, homo sapien
ctgtctccatcactttttgggcaaasgttattgtgagctatctgacagcc

SEQ ID NO: 8523 - DNA, 50 bp, homo sapien
aattgaaacaataaataaagagatcwaagccctctgtaaactctcccgtt

SEQ ID NO: 8524 - DNA, 50 bp, homo sapien
acaaaacaaaaacaaaggcaaacacraggttcttgaatgggatggtaaca

SEQ ID NO: 8525 - DNA, 50 bp, homo sapien
gataagagttagttatgaaatcccargacaaaatactgtatatctattca

SEQ ID NO: 8526 - DNA, 50 bp, homo sapien
aggtctctctaactgcacaccacatyatgacctacaattaataatccttg

SEQ ID NO: 8527 - DNA, 50 bp, homo sapien
ggctgaattttctttcttggtgttgyataaaataatggcacatcttaaca

SEQ ID NO: 8528 - DNA, 50 bp, homo sapien
ggacatttcatatgaatggagtaacrcacatatatggccttttctatctg

SEQ ID NO: 8529 - DNA, 50 bp, homo sapien
aattccaaatacaaaccaggcttaaytgaaaacaagtcccggctggacgg

SEQ ID NO: 8530 - DNA, 50 bp, homo sapien
tttcttcctttgaatggaaaacacartggccaaattgcttggttgttgtg

SEQ ID NO: 8531 - DNA, 50 bp, homo sapien
caccacaaaagcataaacgtgcaagmagagccaatacgtcttttgaaaag

SEQ ID NO: 8532 - DNA, 50 bp, homo sapien
atcagaaagtacagagtccagaaagwcagaaaagaatgcgtgacttgtct

SEQ ID NO: 8533 - DNA, 50 bp, homo sapien
taaacacataataaagttctaaagamtaaagagatgttcagtagccagtg

SEQ ID NO: 8534 - DNA, 50 bp, homo sapien
agaatatcattcctattgatcccagrcctaactggaaccttaaggtgcag

SEQ ID NO: 8535 - DNA, 50 bp, homo sapien
atctgatgaaaatatgtttccactgsatgattcaaggtgatagtacataa

SEQ ID NO: 8536 - DNA, 50 bp, homo sapien
tgtgattaggaaggacccatagacaygatattatcagaaagtggctgacc

SEQ ID NO: 8537 - DNA, 50 bp, homo sapien
aggttcaagtattttcctatctccayggaccatttgtgctacctctgtga

SEQ ID NO: 8538 - DNA, 50 bp, homo sapien
ccatgcctttcatatccccagagatkagcaccaatttgcagacactgtct

SEQ ID NO: 8539 - DNA, 50 bp, homo sapien
gcattttatggttgcatgaaagtccyagatattttattttggggaaagta

SEQ ID NO: 8540 - DNA, 50 bp, homo sapien
tactaagctctagctgctaactacasacttgagactaaaaggtgatttca

SEQ ID NO: 8541 - DNA, 50 bp, homo sapien
agaagtgataataaaaatagcaccaytctgaacagctggaaaccccggct

SEQ ID NO: 8542 - DNA, 50 bp, homo sapien
tcttgaaatgttctgggagtttctayatggaaggagacagttgccacctt

SEQ ID NO: 8543 - DNA, 50 bp, homo sapien
ttatgtatactcacaaacggcaatastatgcagcaatgaaatgaataaac

SEQ ID NO: 8544 - DNA, 50 bp, homo sapien
gggcaggcctactcctgtcatgtccragctatgagaccttgggcaagtac

SEQ ID NO: 8545 - DNA, 50 bp, homo sapien
gctgtggtgggtcaaggccacattaygataggcttgatgatgcagagaga

SEQ ID NO: 8546 - DNA, 50 bp, homo sapien
agatcccacattccccagcttattasatggcccttatcattttgatcaca

SEQ ID NO: 8547 - DNA, 50 bp, homo sapien
accagatgagaacattgcacactaaytggaaaatcattaaaagaagcact

SEQ ID NO: 8548 - DNA, 50 bp, homo sapien
cagacagatcccagcctgcagtcacrgagaagatgacgggtggggcctga

SEQ ID NO: 8549 - DNA, 50 bp, homo sapien
tctttgtctataggatgtgtaattcratcacgttctgtttagattcctct

SEQ ID NO: 8550 - DNA, 50 bp, homo sapien
gctaaaatgcgggttctggatataarcaaacatgagtttaaaacctggct

SEQ ID NO: 8551 - DNA, 50 bp, homo sapien
ctatcacctcaccactaatagaacastgttagcatctgggcacatcctca

SEQ ID NO: 8552 - DNA, 50 bp, homo sapien
atcaactagcttaggatcaaatcackcctttatcacttacaaactatgag

SEQ ID NO: 8553 - DNA, 50 bp, homo sapien
ttcctcaattgttcttctagtgacaratctcaaacgtcctctgttggaat

SEQ ID NO: 8554 - DNA, 50 bp, homo sapien
ctgcacaaagaacttcctgttgaaaycttaccagtagaccctcacattac

SEQ ID NO: 8555 - DNA, 50 bp, homo sapien
atcttaagagtgaacacactaagcasatttgaatgattgctactaaagtt

SEQ ID NO: 8556 - DNA, 50 bp, homo sapien
ggccagcctgccaaggggacttgacragagggaagatcactgctttcctc

SEQ ID NO: 8557 - DNA, 50 bp, homo sapien
aattctttagtgaccttcaaccggtyaatgaaacgctgtgctttagttgc

SEQ ID NO: 8558 - DNA, 50 bp, homo sapien
tcatatagctatagtttatccttctraatagatctacggtagttcacagt

SEQ ID NO: 8559 - DNA, 50 bp, homo sapien
tatttccacttcagaatgtttcctaraagtctggaggagcaagcgtacca

SEQ ID NO: 8560 - DNA, 50 bp, homo sapien
gaagtctggaggagcaagcgtaccasaggccaagctcctgccacctaaaa

SEQ ID NO: 8561 - DNA, 50 bp, homo sapien
ccacccagcatagagatgaatactcrctgaattttaggaagaaacttcgt

SEQ ID NO: 8562 - DNA, 50 bp, homo sapien
aataagaaagtgattcatgtcaccamacttttaatgctcctcatatacta

SEQ ID NO: 8563 - DNA, 50 bp, homo sapien
ttgctaatttaataaacaggtatctyagaggaatcaaaggtctacgtata

SEQ ID NO: 8564 - DNA, 50 bp, homo sapien
ggaatcaggcatccttatttgcccaygtgaacatacatctgagccccacc

SEQ ID NO: 8565 - DNA, 50 bp, homo sapien
ttgtacttccacagaactcccaaaakttaattctctatagtaacaaaaaa

SEQ ID NO: 8566 - DNA, 50 bp, homo sapien
cagagctcccccaaagcaaagcaaaygtaggacatgagagtcaagagaaa

SEQ ID NO: 8567 - DNA, 50 bp, homo sapien
acctgaagcttccaaagggcctatcrctggtgcctctctattctcttctt

SEQ ID NO: 8568 - DNA, 50 bp, homo sapien
aaatgcaaaactattttgagtggaaragaatgaagatgaggtaacaacag

SEQ ID NO: 8569 - DNA, 50 bp, homo sapien
acttgcatagggaacctgttttctakgtactatgagctcagttacattaa

SEQ ID NO: 8570 - DNA, 50 bp, homo sapien
gcaatattctattaatgaatagttayggaatggttgactgaggaaacaag

SEQ ID NO: 8571 - DNA, 50 bp, homo sapien
ctttttaaataatattattgtgaaarttaaagtactgacctttaatatta

SEQ ID NO: 8572 - DNA, 50 bp, homo sapien
gagggttttctctttagatgatcggkccacgttttggtgtgaccactagg

SEQ ID NO: 8573 - DNA, 50 bp, homo sapien
gaagatgttagtgtaaatatctaatkaaccaaatcagttgttacatgggt

SEQ ID NO: 8574 - DNA, 50 bp, homo sapien
cacgatatagaactgaagaaagttamaatgtatatcactgagatgagatc

SEQ ID NO: 8575 - DNA, 50 bp, homo sapien
gttgaatgggaagacacgatatagamctgaagaaagttaaaatgtatatc

SEQ ID NO: 8576 - DNA, 50 bp, homo sapien
ctaggaaaaagcttagataatcgcasaataatagtgggagacttcaaaat

SEQ ID NO: 8577 - DNA, 50 bp, homo sapien
tcaactactctaaatttctagctacygagaagttaagaatgattatgaga

SEQ ID NO: 8578 - DNA, 50 bp, homo sapien
attaggactgtagacatagtgaatasacatttagattagatttacaataa

SEQ ID NO: 8579 - DNA, 50 bp, homo sapien
tgacacgtgcaaatgagtttgtaacrgaagaaaaatacatgtatggtgca

SEQ ID NO: 8580 - DNA, 50 bp, homo sapien
taacatatcattaggattaaaattayatacttcggtacaaaaacaggcaa

SEQ ID NO: 8581 - DNA, 50 bp, homo sapien
aagtctgcagttccctggacatacartgcttttcctcactgcagaaccta

SEQ ID NO: 8582 - DNA, 50 bp, homo sapien
cattgaggtaaggactacgaaatgarataatccgggattagggtgacccc

SEQ ID NO: 8583 - DNA, 50 bp, homo sapien
gaattacttagaagtttgtcactgayctgaactattcatgaatatatggg

SEQ ID NO: 8584 - DNA, 50 bp, homo sapien
gaaggaaggtatatgttgcaaagccsagaatataagatgttcctcagaaa

SEQ ID NO: 8585 - DNA, 50 bp, homo sapien
attccatcggccacttggatgttaamctgttgtctccaggagctgcatga

SEQ ID NO: 8586 - DNA, 50 bp, homo sapien
agatagcaagatatgttatttaaacygtgtgttatagatggaaaataaat

SEQ ID NO: 8587 - DNA, 50 bp, homo sapien
acctggctccatgtcagcacgttctraagagtcagcaatgtccgtgggcc

SEQ ID NO: 8588 - DNA, 50 bp, homo sapien
gaattggtaattcacacggctaaaamtctgacagtctattaaaataccaa

SEQ ID NO: 8589 - DNA, 50 bp, homo sapien
gaccagagaggcagcaatgccaatcraggtcattcttgggtacaggagac

SEQ ID NO: 8590 - DNA, 50 bp, homo sapien
gaaacaatgatggaaaactcctaccwcatgtagcgcatctagaaaggctt

SEQ ID NO: 8591 - DNA, 50 bp, homo sapien
aagggtcagatcccacttaacgtgaygatctggagaactggagttataat

SEQ ID NO: 8592 - DNA, 50 bp, homo sapien
aacacatctatattctgacctgtcayaggaaagccacacgaagaagggca

SEQ ID NO: 8593 - DNA, 50 bp, homo sapien
tgcttgcttctgttgggctctattgyaggcagaatgaaggcatagaatga

SEQ ID NO: 8594 - DNA, 50 bp, homo sapien
ctaaaaccataaaaatgatagaagawtcttaggcaataccattcaagaca

SEQ ID NO: 8595 - DNA, 50 bp, homo sapien
atttatatacctcaatttatttaggrcaagtttctagagatttattttgt

SEQ ID NO: 8596 - DNA, 50 bp, homo sapien
tgactgggcaccaaacaaggcaaaasgatggaatgaaagaaagggaaaca

SEQ ID NO: 8597 - DNA, 50 bp, homo sapien
tgagatgtgtaggtgagagacatgcraaagagccagagataccagctgaa

SEQ ID NO: 8598 - DNA, 50 bp, homo sapien
tataaaagccacagtgtggatggcarcccccagtgttcttcaggggaaat

SEQ ID NO: 8599 - DNA, 50 bp, homo sapien
tctctgtcgtgcagtataattgatarcactattcaaaattaatagacttt

SEQ ID NO: 8600 - DNA, 50 bp, homo sapien
ggcagactcataaacgactgtgataraatgtgatcaattaataagaatca

SEQ ID NO: 8601 - DNA, 50 bp, homo sapien
catttctttgtaattgaaaaatatasactgtagtaagtttcagacagtaa

SEQ ID NO: 8602 - DNA, 50 bp, homo sapien
accagccttcctagagtttttcctaygctatttgcctttattgcctttat

SEQ ID NO: 8603 - DNA, 50 bp, homo sapien
atattttgccaaaaatgacagtcaartaattcatcctactttcctatttc

SEQ ID NO: 8604 - DNA, 50 bp, homo sapien
ccacttctcataataaatccactctsaagtatctaaatacctaatatcct

SEQ ID NO: 8605 - DNA, 50 bp, homo sapien
ccccatcagccattaatccaactacyatgtttactgctaaaaggccttgc

SEQ ID NO: 8606 - DNA, 50 bp, homo sapien
gcattatattcattcctctgattaaytgaaaactttcaggggtcagggtt

SEQ ID NO: 8607 - DNA, 50 bp, homo sapien
taacctaacatagaggaaagatttcyaaattcagatttatcactgtcatt

SEQ ID NO: 8608 - DNA, 50 bp, homo sapien
tgtcattggtacatatcaggatatawcaacacatacgtattaaatgaaga

SEQ ID NO: 8609 - DNA, 50 bp, homo sapien
agctggtcctatgcaacagtaaagcraagattttgactcaaatgacctac

SEQ ID NO: 8610 - DNA, 50 bp, homo sapien
agaagaaataacaccattcttatacwaactcttccacaaaatagagaaca

SEQ ID NO: 8611 - DNA, 50 bp, homo sapien
tttctagctggatgtgactatgaaarcaagttgtctaggagtcactggca

SEQ ID NO: 8612 - DNA, 50 bp, homo sapien
actagctattttcatcctgggtaaarcacttatcctatcacggccttagt

SEQ ID NO: 8613 - DNA, 50 bp, homo sapien
catattaagagatctaaaaagtcagraagagataactagactaccaaatg

SEQ ID NO: 8614 - DNA, 50 bp, homo sapien
cttaagaggaaaattaaaagtgatcratgacagatccaaaataactatat

SEQ ID NO: 8615 - DNA, 50 bp, homo sapien
actcaatcatttgccacctatgagamcttgaataaatcaactcttctctc

SEQ ID NO: 8616 - DNA, 50 bp, homo sapien
gaaagtagagtcattgccttaaatayatacaccagtttacaccatatata

SEQ ID NO: 8617 - DNA, 50 bp, homo sapien
atttttctctttttaaaaatactatsaatccaacctgaagatacccatgg

SEQ ID NO: 8618 - DNA, 50 bp, homo sapien
ccaggataccttgtgaaaatactcakcttactctgctatccaatttattt

SEQ ID NO: 8619 - DNA, 50 bp, homo sapien
aacacgctggtacataaagatataargttttacgcacccttagataagct

SEQ ID NO: 8620 - DNA, 50 bp, homo sapien
aaaataggcaatgtgatgattaccarctctaccatatagaaattcaaaat

SEQ ID NO: 8621 - DNA, 50 bp, homo sapien
aaaactggttttctaacaatatttgracatatatccagtgtgtttctatt

SEQ ID NO: 8622 - DNA, 50 bp, homo sapien
tgagatactagatttaaaagttttaygtaagctgaatcattttatacagt

SEQ ID NO: 8623 - DNA, 50 bp, homo sapien
atagtctgtgttaagaagctcgttayctatacaatgaacaagatttaaga

SEQ ID NO: 8624 - DNA, 50 bp, homo sapien
aacgctctttgtcaagaaaacagacraggaacactcaatcccactaggga

SEQ ID NO: 8625 - DNA, 50 bp, homo sapien
agatgagatacagaagatgaatagargtttaccagacaatgtgggaaatg

SEQ ID NO: 8626 - DNA, 50 bp, homo sapien
ttactttcacatacattgtgttagcygattctttaaggtagatgggtctg

SEQ ID NO: 8627 - DNA, 50 bp, homo sapien
tatataaaacagcttacttctgacayatgagttgttgtgtctagatagct

SEQ ID NO: 8628 - DNA, 50 bp, homo sapien
atgggtattacaaatactgcctacaraagattgttccaatatttacaaaa

SEQ ID NO: 8629 - DNA, 50 bp, homo sapien
tatggcaggtgaaggacttatggaaragacaaataacagcagaacactgg

SEQ ID NO: 8630 - DNA, 50 bp, homo sapien
acaagtccagagcagggaggttagayatttctctgtgagagcaacatgtg

SEQ ID NO: 8631 - DNA, 50 bp, homo sapien
cagcaagagaaagaacactagcaacrgaaaataaagtctgctctctgctc

SEQ ID NO: 8632 - DNA, 50 bp, homo sapien
aatggtcacttagatgaaatgttcayatcctgaaaagcacaacctactaa

SEQ ID NO: 8633 - DNA, 50 bp, homo sapien
tgaccatcatgatgaaaactctaaayaatataggaatatcagaaaacttt

SEQ ID NO: 8634 - DNA, 50 bp, homo sapien
tattatattgaattacatgataacartaactacaattggaataaacagtt

SEQ ID NO: 8635 - DNA, 50 bp, homo sapien
gaaaatggaggaagcaaatttgtcayggcagtaatgtaaagctaaaacag

SEQ ID NO: 8636 - DNA, 50 bp, homo sapien
actggggctctctatctcatctgcamatgttctgattgatacccgtggga

SEQ ID NO: 8637 - DNA, 50 bp, homo sapien
ctcttcacgaggtaacagagacaacyctacatagcgcaactgatccccag

SEQ ID NO: 8638 - DNA, 50 bp, homo sapien
ccataaagtattataagagtttgaayttaagattattaagagatgaaatc

SEQ ID NO: 8639 - DNA, 50 bp, homo sapien
tatgttgcttattagcgtacttgaayatgcctcagtttgggttgcttatc

SEQ ID NO: 8640 - DNA, 50 bp, homo sapien
tgttgataatattagagaggctagartatatctctaagagctcatatatt

SEQ ID NO: 8641 - DNA, 50 bp, homo sapien
atgtatgaaattaatagcttatatamccccaacatgatttgtatcaagag

SEQ ID NO: 8642 - DNA, 50 bp, homo sapien
ctatattcctgtgtgacaaatggtaygttctgtggagatctatgaaatgg

SEQ ID NO: 8643 - DNA, 50 bp, homo sapien
tcagtgttcttgactttgaacagaamtatattaccagaatgacctatagc

SEQ ID NO: 8644 - DNA, 50 bp, homo sapien
caatcgtgtgacttctaacctccaaygactgacaacaattgcctcatata

SEQ ID NO: 8645 - DNA, 50 bp, homo sapien
ctgacatcaccaagttcgactattaygattccaaaaattcactgctatgt

SEQ ID NO: 8646 - DNA, 50 bp, homo sapien
agaagagttcagattccaaacttgargtggccaagagaagataaatgctg

SEQ ID NO: 8647 - DNA, 50 bp, homo sapien
tgtacatgaatgatgacctggataasagagaggctgcaggggcaggtgtc

SEQ ID NO: 8648 - DNA, 50 bp, homo sapien
gagcatttctgctaatctactaaaasatgttatgcatttctgagacggga

SEQ ID NO: 8649 - DNA, 50 bp, homo sapien
aaaccaggtagtgtttttattcaccmaagaattgaaccatacaaattctc

SEQ ID NO: 8650 - DNA, 50 bp, homo sapien
ttcctcagagattttgggaggattamattagacccataaatgtaaacatg

SEQ ID NO: 8651 - DNA, 50 bp, homo sapien
tgaccagatcttctaatgtaaaatayagtccagttgtcaaccaattctaa

SEQ ID NO: 8652 - DNA, 50 bp, homo sapien
gtcaaccaattctaatcaataagaawagctcataaaaatacaatattcct

SEQ ID NO: 8653 - DNA, 50 bp, homo sapien
tttaccctcttctttttattatttgragaccgttcattttatttctgcgt

SEQ ID NO: 8654 - DNA, 50 bp, homo sapien
tggttgttatgtagacttgattatayagttgctttatagtgccaatgggg

SEQ ID NO: 8655 - DNA, 50 bp, homo sapien
ctgggactctttatcctcattgatastataatctttaaagtagtttggat

SEQ ID NO: 8656 - DNA, 50 bp, homo sapien
gatgcaaagatttaaccaaaacagasgatttaatagaaggtagaaaaaac

SEQ ID NO: 8657 - DNA, 50 bp, homo sapien
agaaggcaagatctaacatggatcarggaacctaccacagcaggtggaga

SEQ ID NO: 8658 - DNA, 50 bp, homo sapien
ttaatcatggcagaaagacccaataraagttgctctgtgcctgggctaga

SEQ ID NO: 8659 - DNA, 50 bp, homo sapien
actaagatataaaactgttaaatacwcatatgatatacacatacatcaga

SEQ ID NO: 8660 - DNA, 50 bp, homo sapien
aagtatttttataccttctaaaacaktctgacagttaaaaacccattata

SEQ ID NO: 8661 - DNA, 50 bp, homo sapien
tgttctgttctaggcttagtacatayagcagtaaacaaaaattcttactc

SEQ ID NO: 8662 - DNA, 50 bp, homo sapien
gtggagtgtcctgatacttctacaayggaaacacctgctaattccaccct

SEQ ID NO: 8663 - DNA, 50 bp, homo sapien
ttgcataaaaggcagtagggtaaacmaaattgaaacatggatttgaagga

SEQ ID NO: 8664 - DNA, 50 bp, homo sapien
aagacaggaactcttcatagctaacrggtctcccattaaataccatcaag

SEQ ID NO: 8665 - DNA, 50 bp, homo sapien
tcagtgctcccaattcaccaagagaygtggtatgagcagatttcacatgt

SEQ ID NO: 8666 - DNA, 50 bp, homo sapien
aataggccagatgggcaaatcacacygtagacaaagagctttccccctat

SEQ ID NO: 8667 - DNA, 50 bp, homo sapien
gaaaattgcaagttggtgtgctcatsactattaagcagttgacacagtga

SEQ ID NO: 8668 - DNA, 50 bp, homo sapien
aaaatcaatggccatactccacaatmagaagtagatcacagtggttatct

SEQ ID NO: 8669 - DNA, 50 bp, homo sapien
aaatatgtaaaatttcagaagataayaagtatactaaaataatcaaagca

SEQ ID NO: 8670 - DNA, 50 bp, homo sapien
gcatgccatggtttccagggatttargagaattgacctttatgaagtaat

SEQ ID NO: 8671 - DNA, 50 bp, homo sapien
atttacaactatgttaaatactatgratgagaggtttatgatgttgtgat

SEQ ID NO: 8672 - DNA, 50 bp, homo sapien
ataggcaaataaatctgtagagtcakaaaatagattagtgatttcctggg

SEQ ID NO: 8673 - DNA, 50 bp, homo sapien
agcaactaacaaaagaattaacacartgtcaggacaaactgtaagatttg

SEQ ID NO: 8674 - DNA, 50 bp, homo sapien
ctggaagagcatatacatagcacatyataggctctcaatacattttcaca

SEQ ID NO: 8675 - DNA, 50 bp, homo sapien
gtcttagtcataaattctttgcctasgtcaacatccagtagagtttttcc

SEQ ID NO: 8676 - DNA, 50 bp, homo sapien
caaagttagttgcagggtcctagagycagtgcgtgagcattaacagagga

SEQ ID NO: 8677 - DNA, 50 bp, homo sapien
ttatgagacagaaggcacacccatamatttttgaaataggcccccttcta

SEQ ID NO: 8678 - DNA, 50 bp, homo sapien
aacataggtctacaggtctactttakggaagcctgaatctctcaagacag

SEQ ID NO: 8679 - DNA, 50 bp, homo sapien
agcagaagattctcaaagtaagaaayggctttagctcaagaaacaattcc

SEQ ID NO: 8680 - DNA, 50 bp, homo sapien
tttaataaccattctcttgataaaawattaggctcgtaatagtcaaaatc

SEQ ID NO: 8681 - DNA, 50 bp, homo sapien
gtcattaattgttatgcttcatcaartgattactggttgagggaaaagga

SEQ ID NO: 8682 - DNA, 50 bp, homo sapien
tggtttaactacttatatcaattacyacctttaagtcatgaaaaattaaa

SEQ ID NO: 8683 - DNA, 50 bp, homo sapien
tgctgttatcaaaaggattaagttasctaagcagagacgaaggtttagat

SEQ ID NO: 8684 - DNA, 50 bp, homo sapien
tttgtatttccttcctcgctttttawattacgtggccttgtctcatgatg

SEQ ID NO: 8685 - DNA, 50 bp, homo sapien
ttaagaaccactatattctacttccraagagttaactagcaaacaactga

SEQ ID NO: 8686 - DNA, 50 bp, homo sapien
tgccaggccttacccagttctcaccrctgtaaacttttatccttctggct

SEQ ID NO: 8687 - DNA, 50 bp, homo sapien
tttgtggtaagggtagattttgagargtagcaataacgagattgatttta

SEQ ID NO: 8688 - DNA, 50 bp, homo sapien
aatgaagagatggtaacaagtttgarctaattatgagatataattatcaa

SEQ ID NO: 8689 - DNA, 50 bp, homo sapien
cacatgcattttagataagcagctayggtggccaatactgcttaaagaac

SEQ ID NO: 8690 - DNA, 50 bp, homo sapien
gttttttttctttttccttttaaggrcctcaacaagtttatcatgctcag

SEQ ID NO: 8691 - DNA, 50 bp, homo sapien
ttgcattgggttcaggagatttaaasattagttaagacagggatcttgtt

SEQ ID NO: 8692 - DNA, 50 bp, homo sapien
ctaaaatgcatgtgtttatcagataytaacttatataataattggaccta

SEQ ID NO: 8693 - DNA, 50 bp, homo sapien
ttattcgtaaactcaatgaagaaaaygtaaaataggttgggtgcggtggc

SEQ ID NO: 8694 - DNA, 50 bp, homo sapien
agactggaaacttggaacgtcttcakaactggccattaattagtactatg

SEQ ID NO: 8695 - DNA, 50 bp, homo sapien
atacttatttgttaggtttattagaktcgttttctcccttttctgtcttt

SEQ ID NO: 8696 - DNA, 50 bp, homo sapien
aaaactattaatactggttatctcaygcaagtatcaaaagttctgcttgg

SEQ ID NO: 8697 - DNA, 50 bp, homo sapien
tttcaggcaactagcataggacctascataatgtatatgcccaaaaatgt

SEQ ID NO: 8698 - DNA, 50 bp, homo sapien
agtagacaattaaaacaatgtgtgargccctaggactgagactcaggcag

SEQ ID NO: 8699 - DNA, 50 bp, homo sapien
aacttttgggccttacctggtcttayaattattgatcctatcatctttta

SEQ ID NO: 8700 - DNA, 50 bp, homo sapien
aactctcagataaattttacatttasattgccgtgccgtcagcagtaatt

SEQ ID NO: 8701 - DNA, 50 bp, homo sapien
atttcctcaatgactttcaaacttasagtaaccaattcatccaagtaaca

SEQ ID NO: 8702 - DNA, 50 bp, homo sapien
cgtatgtaactatcctaggagatccrgaatttgaaagcctataaggaaac

SEQ ID NO: 8703 - DNA, 50 bp, homo sapien
tcatcacctctcttcctatctgccaygttataccttcagttatgctctcc

SEQ ID NO: 8704 - DNA, 50 bp, homo sapien
ccaattttgagggatacaattagttkaaattcttcaaatcaaggatagac

SEQ ID NO: 8705 - DNA, 50 bp, homo sapien
tcagttagaaccttatgattgagacrgatggaaaggggccatgtaaaaac

SEQ ID NO: 8706 - DNA, 50 bp, homo sapien
catttaaacttgagcaaattttccastctatgggggtcagaactgtcatg

SEQ ID NO: 8707 - DNA, 50 bp, homo sapien
tattgagttattctcaatagatacaygaaataatattctacttggaaatt

SEQ ID NO: 8708 - DNA, 50 bp, homo sapien
ttagggtagtgaaagtactccatacratactataataatggatacatgtc

SEQ ID NO: 8709 - DNA, 50 bp, homo sapien
atctttttaaaggtctacctgtctawcaatcacgaattttctaatgacct

SEQ ID NO: 8710 - DNA, 50 bp, homo sapien
ctttcttgatggttataaacactaamtatgttggaagtaaacctcttagc

SEQ ID NO: 8711 - DNA, 50 bp, homo sapien
gactttttttttctatacagggcagratatttaaaattgagagtattcct

SEQ ID NO: 8712 - DNA, 50 bp, homo sapien
attaagtatgtttgatatgatccatyagtttatgtaattttactagctag

SEQ ID NO: 8713 - DNA, 50 bp, homo sapien
tttctttcatacttacttagctcaayttagaggtatttctgaaaaaaaaa

SEQ ID NO: 8714 - DNA, 50 bp, homo sapien
gagtttcccaggactttcggtagagsaataaaatctcagaagtaataaag

SEQ ID NO: 8715 - DNA, 50 bp, homo sapien
tacctaggaagagcttagattttgasagtttcccaggactttcggtagag

SEQ ID NO: 8716 - DNA, 50 bp, homo sapien
gaatgaaatttgtaacagaactctaygctgtttgcaaatgctgtcagctc

SEQ ID NO: 8717 - DNA, 50 bp, homo sapien
caggaaaatgtgtgcaattatagcaratgaaacagtaaagtgaacatttt

SEQ ID NO: 8718 - DNA, 50 bp, homo sapien
tttttctttctctctagtaagataawatgatgctggttgtctttgctctg

SEQ ID NO: 8719 - DNA, 50 bp, homo sapien
gttagtcatggctaaagctgttgttmaaatattgggaccacagccactta

SEQ ID NO: 8720 - DNA, 50 bp, homo sapien
gttcccttcctttgatttagtggaargattattagaaatatattagaatt

SEQ ID NO: 8721 - DNA, 50 bp, homo sapien
aaaaatgaagccccacattaaagcakaaaacttcaaggtaaaagaaacct

SEQ ID NO: 8722 - DNA, 50 bp, homo sapien
aaagttatgtgaaatgataaaggaaytatattagctaaaacaattttgaa

SEQ ID NO: 8723 - DNA, 50 bp, homo sapien
gtctgcattcttccattgtgctacaytgcctgattcagtctggacatgtg

SEQ ID NO: 8724 - DNA, 50 bp, homo sapien
gtagattgactatttcatttgtttaractctgctgtatccaacttagcat

SEQ ID NO: 8725 - DNA, 50 bp, homo sapien
tcaggaaggcaaaggaacattaagartcaaagtcaattgagggatataaa

SEQ ID NO: 8726 - DNA, 50 bp, homo sapien
aatgtaaactccacattttgtttcayggaaatggaacgcgataaaaaaag

SEQ ID NO: 8727 - DNA, 50 bp, homo sapien
tgattttgaggaacaaagtgctaagrctctttatgtatctgcctgatcaa

SEQ ID NO: 8728 - DNA, 50 bp, homo sapien
actcaagccaatagagataattagaktccatatttgccctactaatgtca

SEQ ID NO: 8729 - DNA, 50 bp, homo sapien
gataatacaaggaaaatgcctaatamccttcttgtgcacatgtaagggtt

SEQ ID NO: 8730 - DNA, 50 bp, homo sapien
cgaatactagacaatatgaagagacmatttacattagagacacctatgtt

SEQ ID NO: 8731 - DNA, 50 bp, homo sapien
atttctttcaagactggttattgacmataggaccgattaaaatgttcaaa

SEQ ID NO: 8732 - DNA, 50 bp, homo sapien
aatttccattgtgctttactactaayaagattcctcatataaattgatat

SEQ ID NO: 8733 - DNA, 50 bp, homo sapien
agggaacccatcctttcaagttaackggtttgtgatgatactgctattgt

SEQ ID NO: 8734 - DNA, 50 bp, homo sapien
aagagacacctagtaagagctcaacrctgtggtaaaattatgatagttat

SEQ ID NO: 8735 - DNA, 50 bp, homo sapien
ttctcaggaaagggagaactactaaygtatggccacctatgtgtaagaaa

SEQ ID NO: 8736 - DNA, 50 bp, homo sapien
attatttttcttcctatcagtaatcragtcctgtcaaccacactcctcta

SEQ ID NO: 8737 - DNA, 50 bp, homo sapien
tataatgcacaacaggcctatgaagraattatggttattcaaaaaaaaaa

SEQ ID NO: 8738 - DNA, 50 bp, homo sapien
tatttttctacctcactgaataatargtgataagccaaataatatgcttc

SEQ ID NO: 8739 - DNA, 50 bp, homo sapien
attgtcatgtatgcaccattttatargttaaacatgctttcttgtgtcag

SEQ ID NO: 8740 - DNA, 50 bp, homo sapien
agaaagcattattttatttgaataargtgaggatagctacttctgtattt

SEQ ID NO: 8741 - DNA, 50 bp, homo sapien
tctattttagctcaaaaaatttcaawatctcctgcaagtccactgtatga

SEQ ID NO: 8742 - DNA, 50 bp, homo sapien
tagccataaccagtaatagtagtaayagtaatgatattccttcacatttg

SEQ ID NO: 8743 - DNA, 50 bp, homo sapien
acagaaaaatggaaacagtacagatyaagtatcagaataaaaatcttaat

SEQ ID NO: 8744 - DNA, 50 bp, homo sapien
tcttgcctaatcattcactgagaaawtaaatcccaccaggcaagtgcatt

SEQ ID NO: 8745 - DNA, 50 bp, homo sapien
atataaatgtgtgtattatgtacacrgtgatgaatatatgtaaataggca

SEQ ID NO: 8746 - DNA, 50 bp, homo sapien
ataggtagaactaacaggaaaattasatgacagcaatttctttctctgac

SEQ ID NO: 8747 - DNA, 50 bp, homo sapien
atcactctccaagtaactcgcaatasctgttgacaatgaagaagtgaaat

SEQ ID NO: 8748 - DNA, 50 bp, homo sapien
tatggttcctttcctccccgattaayaggattatgagagaatgacataag

SEQ ID NO: 8749 - DNA, 50 bp, homo sapien
ctaatgacacacaaatctatatgtcyaccttgatggcatatatgtactcc

SEQ ID NO: 8750 - DNA, 50 bp, homo sapien
aataatatctaagcaaaaaacagcaraatagttcaaatcgtgtatgtatt

SEQ ID NO: 8751 - DNA, 50 bp, homo sapien
gacagggaggagttgacatgctgatwaatatactgaattatggaagtgct

SEQ ID NO: 8752 - DNA, 50 bp, homo sapien
ctgactctgaggcagctgcagtatgwagttcattagtggtcatggctccc

SEQ ID NO: 8753 - DNA, 50 bp, homo sapien
cataggttgaatttcagtttgaccayaacacacttcttagacttgatttt

SEQ ID NO: 8754 - DNA, 50 bp, homo sapien
gaacatgaggtgtctctgaaagttgmagatgaaaatgtccagttgattat

SEQ ID NO: 8755 - DNA, 50 bp, homo sapien
tgaagctcatgatttcacttacacaraaaatttcgcagtgagttttagga

SEQ ID NO: 8756 - DNA, 50 bp, homo sapien
aatgctgccaggtcacctgctaaaawcatcttaactgtttggaaggactc

SEQ ID NO: 8757 - DNA, 50 bp, homo sapien
ccacagctgaccagcattaacgttayaatagaagactgacaaagctgact

SEQ ID NO: 8758 - DNA, 50 bp, homo sapien
gttttcaatacctgctttaatgatasagtactctgtattcttcgatttat

SEQ ID NO: 8759 - DNA, 50 bp, homo sapien
tatacaagatatataaaagtttgtakgctaactaataatgtgtcttgccc

SEQ ID NO: 8760 - DNA, 50 bp, homo sapien
atttaaaaaacaaatataagaccaargaatggctacacagaagttcctat

SEQ ID NO: 8761 - DNA, 50 bp, homo sapien
atagtggagaggactatattgaatargccagtcaaaataatcatatttga

SEQ ID NO: 8762 - DNA, 50 bp, homo sapien
ccttaacaagtttaacaatcactcaractatgaaattgtcactttgtcat

SEQ ID NO: 8763 - DNA, 50 bp, homo sapien
aatgtacgtgtatagatattagttaygtataagacccacacactgttagt

SEQ ID NO: 8764 - DNA, 50 bp, homo sapien
tcaagcctctgctgcatgctatacastaagtagtatgagataaaaagaag

SEQ ID NO: 8765 - DNA, 50 bp, homo sapien
tgatttccattagctttaatttcgayctaatttggtagttgcagcccaaa

SEQ ID NO: 8766 - DNA, 50 bp, homo sapien
ctcttcagtcctggccatgacctcastccctctcttcatgagtgtttatg

SEQ ID NO: 8767 - DNA, 50 bp, homo sapien
tttaaaatgagataatgtctgtgaartgcttttaggacactgcctggcat

SEQ ID NO: 8768 - DNA, 50 bp, homo sapien
gttagcaggtgttacataaaaaaggrataccatgagcaaaagtatttgaa

SEQ ID NO: 8769 - DNA, 50 bp, homo sapien
ttaaatcaaaaagaacaatatcaaaraaactatggtatgtttaaatggtt

SEQ ID NO: 8770 - DNA, 50 bp, homo sapien
acatgcacatctgttaaatgctacamgaagaaagttagccagtgagtttt

SEQ ID NO: 8771 - DNA, 50 bp, homo sapien
tctcttacattaatcatgtacttatracattctaggcaatcagcacatat

SEQ ID NO: 8772 - DNA, 50 bp, homo sapien
gggacttgaattaaaggactaacagkagtaatatgaagaggatagagaaa

SEQ ID NO: 8773 - DNA, 50 bp, homo sapien
tgctctaaaatttatgtaacatttawgaatacattgtgagttatgctgat

SEQ ID NO: 8774 - DNA, 50 bp, homo sapien
ctggaaggttattggaacaaatactmaacatgtagcttggcctcatacag

SEQ ID NO: 8775 - DNA, 50 bp, homo sapien
aaatcaataactgttacctttgaaaratctgcagttaattatgtggtttt

SEQ ID NO: 8776 - DNA, 50 bp, homo sapien
catttattgagtactgtgattgtaarattttttttctgtatcctctacca

SEQ ID NO: 8777 - DNA, 50 bp, homo sapien
aagtgaaatgcaataaaacaaggtawgcctgtggtacagagacgagggtg

SEQ ID NO: 8778 - DNA, 50 bp, homo sapien
tattgtattttcaaaatcagtaaaasagtagattctaagtgttcttgcta

SEQ ID NO: 8779 - DNA, 50 bp, homo sapien
ttttacaatactgaatcttccaatcracaaataaagtttattttttccag

SEQ ID NO: 8780 - DNA, 50 bp, homo sapien
aaggaaatgtgcttgcctataaatayggtcccataaagtctgcctgtact

SEQ ID NO: 8781 - DNA, 50 bp, homo sapien
aggttcagagaccatgagccaaaccyattgcaagtcttttagaatcactt

SEQ ID NO: 8782 - DNA, 50 bp, homo sapien
aaaatcaacagcttcagagtaggatraattaggaaagatccaggcaaaaa

SEQ ID NO: 8783 - DNA, 50 bp, homo sapien
ataaatatcacaaattcaattgtttmaagagcaaaaatttattttctcac

SEQ ID NO: 8784 - DNA, 50 bp, homo sapien
tttccttcttatggttattgaggaaygaaatgagagtacatagtatgaat

SEQ ID NO: 8785 - DNA, 50 bp, homo sapien
atgggggaggactaggatgggaggaycaaccgagtcacagatgagcccag

SEQ ID NO: 8786 - DNA, 50 bp, homo sapien
ttcaaggcagtagctttccttctgayccagggtgtatctagaaatgttgt

SEQ ID NO: 8787 - DNA, 50 bp, homo sapien
attttttggcaatcttagaagtcaaytgatgaaagtggtagtgacaaaaa

SEQ ID NO: 8788 - DNA, 50 bp, homo sapien
aaggtttaatagtaaatgtcacgtgsatgaatgtcctttatcctgtattt

SEQ ID NO: 8789 - DNA, 50 bp, homo sapien
ggaaatatgacactaaagtattttaracgaagaaatgacatgcttgtata

SEQ ID NO: 8790 - DNA, 50 bp, homo sapien
aatggcatgtattcaagaaagtacargccttatacaaaattggaaatatt

SEQ ID NO: 8791 - DNA, 50 bp, homo sapien
ggttcagctggagcaacactgtctcrcttgttcatcttcctcctctcatg

SEQ ID NO: 8792 - DNA, 50 bp, homo sapien
ctgctgtcctcctgctctctgttacyctgtatcttccaagttcaaaaacg

SEQ ID NO: 8793 - DNA, 50 bp, homo sapien
tttggctgccaataatagaagtgcckcatttcatctgtatatatcttctg

SEQ ID NO: 8794 - DNA, 50 bp, homo sapien
atgaataaatgaataatttattgccyaagactaccatgaatataatttaa

SEQ ID NO: 8795 - DNA, 50 bp, homo sapien
ttgccccagaaagtataagtgtaagyattgataatctgcttctgaggaag

SEQ ID NO: 8796 - DNA, 50 bp, homo sapien
tccaaggaccatacttcagggaaaayacattacataatcaatcctgtaaa

SEQ ID NO: 8797 - DNA, 50 bp, homo sapien
tttccttatggagtacggtggacaartaaacagaaggtaacaggagtaga

SEQ ID NO: 8798 - DNA, 50 bp, homo sapien
cagaatgaaatactgagtctcagcawtcaggatgttgattctaaaagtgt

SEQ ID NO: 8799 - DNA, 50 bp, homo sapien
ttgccaactcctacagccatttctarggcctacaacaacaacaaaatgat

SEQ ID NO: 8800 - DNA, 50 bp, homo sapien
tacaagtagacttcagaaaataagcratgctcaagctgaatcttgaaaag

SEQ ID NO: 8801 - DNA, 50 bp, homo sapien
gataagaatttgcatctacaatggastacctacttaacaagcccctaaat

SEQ ID NO: 8802 - DNA, 50 bp, homo sapien
cctattgcatcttcctcctaagctaycaccatacaatatattacagactc

SEQ ID NO: 8803 - DNA, 50 bp, homo sapien
aaattattaaatctaaacttctttarcaaagctctacaaaatcaaaccct

SEQ ID NO: 8804 - DNA, 50 bp, homo sapien
aaagggactcagagttggctttaccyaatctccaagaaaatagacccaca

SEQ ID NO: 8805 - DNA, 50 bp, homo sapien
gtaagcagcaagctatggttctaaayagggttctggccgccctatgaatc

SEQ ID NO: 8806 - DNA, 50 bp, homo sapien
ctaacttaaccctttatttattgcckaaggaaacagagtccagtgtctca

SEQ ID NO: 8807 - DNA, 50 bp, homo sapien
attagatcttacttgaaaagtaatargtacaataagtggttggtgattga

SEQ ID NO: 8808 - DNA, 50 bp, homo sapien
aaaaaaaaaaaaaagatcacgtaacraggagtaacacagaataatggact

SEQ ID NO: 8809 - DNA, 50 bp, homo sapien
ggaagttagtgttttacatgactaawtatgccaagttgacgatagatcaa

SEQ ID NO: 8810 - DNA, 50 bp, homo sapien
tttcagtcataatctgtttatctccratgcttaagtctaaggaatgtgtt

SEQ ID NO: 8811 - DNA, 50 bp, homo sapien
gatgcatgtagtcctagcaaacatcracctgaaatgatttgaatttatcc

SEQ ID NO: 8812 - DNA, 50 bp, homo sapien
tgtggaaaaatgagctgtgtttttgraaacagttttgaagccttaactcg

SEQ ID NO: 8813 - DNA, 50 bp, homo sapien
attttttactttgaaatgaacaagaytcacaaagtaagtatactgtgagt

SEQ ID NO: 8814 - DNA, 50 bp, homo sapien
aagtccccactagcctattatgcaaygactgctgaatatctacttaaagc

SEQ ID NO: 8815 - DNA, 50 bp, homo sapien
gcaaaggtgaccttgtcataaataawggtttgctgcacagaatgtctagc

SEQ ID NO: 8816 - DNA, 50 bp, homo sapien
caatggactatgatttttttttagayggatgattatgtactttaagtctc

SEQ ID NO: 8817 - DNA, 50 bp, homo sapien
tgtttgagatgtatcagtaaataacractctaaggactatggcattaagt

SEQ ID NO: 8818 - DNA, 50 bp, homo sapien
attgatggaaatgatcttaaaaggastaatcacaaacaggagaaactgac

SEQ ID NO: 8819 - DNA, 50 bp, homo sapien
cctttcaaggtgtatattcaaataaycaactactttcattgggaaagcac

SEQ ID NO: 8820 - DNA, 50 bp, homo sapien
ctccgagtacatgggggatctgttcyagtatctttgttcttttgtggttc

SEQ ID NO: 8821 - DNA, 50 bp, homo sapien
agggtgtcaaggaaaacttctgcaaygaagtgatgtaaatgaatggttgt

SEQ ID NO: 8822 - DNA, 50 bp, homo sapien
cagagtgtgggaaagcctaatggacraatagtttagttttttcccccaat

SEQ ID NO: 8823 - DNA, 50 bp, homo sapien
tgtacaattaaaaacttgtacaggartatatctggagtatgttaaaataa

SEQ ID NO: 8824 - DNA, 50 bp, homo sapien
tagacagcaaaggacaatcctgaaaktacgacaattatttagcatagaca

SEQ ID NO: 8825 - DNA, 50 bp, homo sapien
ctagctctaaggagtagttccctaaygcagctgtagcttttggagtttga

SEQ ID NO: 8826 - DNA, 50 bp, homo sapien
tgctctctcttttatagaggaaattraaaaatgactcccttctgatttgg

SEQ ID NO: 8827 - DNA, 50 bp, homo sapien
cactagcgacatgcagttactgaacwcttgaaatgtagctagctagggtg

SEQ ID NO: 8828 - DNA, 50 bp, homo sapien
gtgaagagccctgctggtcatttgasatttattgtgaacattgtaatcct

SEQ ID NO: 8829 - DNA, 50 bp, homo sapien
agaatatatagaatgctcaaaagtakctaaagattagccttgcaaaatga

SEQ ID NO: 8830 - DNA, 50 bp, homo sapien
cactattgtcaatttcaagctaccarcataatgtattgtaatggcaaaaa

SEQ ID NO: 8831 - DNA, 50 bp, homo sapien
ttccctaaacactctaaacaaacgcygcagattctgacttcttgggccag

SEQ ID NO: 8832 - DNA, 50 bp, homo sapien
aggcatttaatgctataaaaatccckcttagcacttcttttgctgtgtcc

SEQ ID NO: 8833 - DNA, 50 bp, homo sapien
atacctgtttcaaaaatagatggtamtaatatggccacaaagtgaaacac

SEQ ID NO: 8834 - DNA, 50 bp, homo sapien
tgttgtacctgttatatgtgtttgaratcaggtgcgccgttcatcccatc

SEQ ID NO: 8835 - DNA, 50 bp, homo sapien
gtgaaatatcaacttcctctaaaaakactttcttctctcattccattaac

SEQ ID NO: 8836 - DNA, 50 bp, homo sapien
catcagaaattctagataaaggaaayagactggttgttgataacttcatt

SEQ ID NO: 8837 - DNA, 50 bp, homo sapien
gtaacgacactgaaagactaagaacmacaaatacactttccaggagatga

SEQ ID NO: 8838 - DNA, 50 bp, homo sapien
attaacatatactttctaattggaayttaaacagaaggcaaattcacaaa

SEQ ID NO: 8839 - DNA, 50 bp, homo sapien
agcccttgaaaaaagatattagcaaygctgtttaacaggcaaagacactg

SEQ ID NO: 8840 - DNA, 50 bp, homo sapien
acaatagtatctttaaatcatatcartctctaagaatagtgagtagaatg

SEQ ID NO: 8841 - DNA, 50 bp, homo sapien
gacaccaagctttctctaatccacaraaagtgttatttaaatgaaaatat

SEQ ID NO: 8842 - DNA, 50 bp, homo sapien
aggtggttgcattaactcttacacawaataaaagtaggaacattgtaaca

SEQ ID NO: 8843 - DNA, 50 bp, homo sapien
ttttcctaattacttattaattgtcragcagaactttttcctttttctct

SEQ ID NO: 8844 - DNA, 50 bp, homo sapien
agaataaaatttggaaacttcttcartaactctcagtagatgaataggta

SEQ ID NO: 8845 - DNA, 50 bp, homo sapien
tgaaagagggctctggggaagtaaayggaactgcagcaagtaaattaata

SEQ ID NO: 8846 - DNA, 50 bp, homo sapien
gtcttattcttgtcttctctgcaaascctagttatcttgcttatgttggg

SEQ ID NO: 8847 - DNA, 50 bp, homo sapien
agccagatcctagagttgagaggaasttataaggagaaatgaggtacctt

SEQ ID NO: 8848 - DNA, 50 bp, homo sapien
agttgccagtaaagtatgttagttamacacaggtcttgcgtttcatcttc

SEQ ID NO: 8849 - DNA, 50 bp, homo sapien
aaggcaaaaaatgtactgaaggatayggaaggataaatattaaattgaga

SEQ ID NO: 8850 - DNA, 50 bp, homo sapien
accagtggtgcagttctgaggaccaragggccaatgatgtgagtcctagt

SEQ ID NO: 8851 - DNA, 50 bp, homo sapien
agctggtgacatttgagttacatgawgttaagtaaaaaagttaaacagcc

SEQ ID NO: 8852 - DNA, 50 bp, homo sapien
tttcagtaaaattctatcactgcttytggttgaatcatgacaaaaatcgt

SEQ ID NO: 8853 - DNA, 50 bp, homo sapien
aagtagacaaaagtcttcattctacrcctagattatttttggaagtggac

SEQ ID NO: 8854 - DNA, 50 bp, homo sapien
atgctaccatgattttttgacattaygtatgtttgaaatgttcttcccct

SEQ ID NO: 8855 - DNA, 50 bp, homo sapien
aaaagcatatttacctaaattatcartatcatgcttatttctcactcacc

SEQ ID NO: 8856 - DNA, 50 bp, homo sapien
atgctaatttaacaaaaataacaaargcaagattataagctgggatgctt

SEQ ID NO: 8857 - DNA, 50 bp, homo sapien
acaaatttaggcaaattatacttaaragttttattgagcaaagaatgaat

SEQ ID NO: 8858 - DNA, 50 bp, homo sapien
gctgattatagggagatttctctgaygtcaatgctaaggcagccagaatt

SEQ ID NO: 8859 - DNA, 50 bp, homo sapien
tttcctttggaaagtatctttatttsaaacctaaatcatgggttccagaa

SEQ ID NO: 8860 - DNA, 50 bp, homo sapien
tgaagtcaaggcagagacggtgatayaccattgccttcagcaaaaggcaa

SEQ ID NO: 8861 - DNA, 50 bp, homo sapien
gattagaaaagcacttggaagaaggwcctgtgaattcatctagtgtacaa

SEQ ID NO: 8862 - DNA, 50 bp, homo sapien
tcataattctcaattggttcatatcycacacaagaaacagagataaatta

SEQ ID NO: 8863 - DNA, 50 bp, homo sapien
tggaggagacctcattggcactcgayggacaagctgcacctcagatgcgt

SEQ ID NO: 8864 - DNA, 50 bp, homo sapien
ctgcttaggggaaaggaattaacaargagcatgaaggtatctggagagtt

SEQ ID NO: 8865 - DNA, 50 bp, homo sapien
tattgctgtaagaatgaaataaaatraacagatgtggagaaaccactaaa

SEQ ID NO: 8866 - DNA, 50 bp, homo sapien
gatgaattcggttaccagctgaagayagtttctttgaaataaatatcttg

SEQ ID NO: 8867 - DNA, 50 bp, homo sapien
acctagctattacttctatggactawaagaggctatactaagttttttat

SEQ ID NO: 8868 - DNA, 50 bp, homo sapien
ttctggcagtctggacggaattaaayaactgtctacacaaatcaaagctt

SEQ ID NO: 8869 - DNA, 50 bp, homo sapien
attagaaacaactatttaactagagwacccttatcatgcttttgaaagaa

SEQ ID NO: 8870 - DNA, 50 bp, homo sapien
cttctctacttctttgctgactctayagtaatttcattaaattatgcagc

SEQ ID NO: 8871 - DNA, 50 bp, homo sapien
attcctggctagataaaatggtgaargtctattaccaccaaagaacatct

SEQ ID NO: 8872 - DNA, 50 bp, homo sapien
aaaggtctacaataatttaagcatcrctcagcacaccatttctctgacta

SEQ ID NO: 8873 - DNA, 50 bp, homo sapien
caaaatgccaatcttggcttttagaracaactgcccttctctttgtgcct

SEQ ID NO: 8874 - DNA, 50 bp, homo sapien
ctttctccagtcatgtcctcttttayagaattacgctgccttaaaacatt

SEQ ID NO: 8875 - DNA, 50 bp, homo sapien
aaatcaattcaactcaaaacttcaargtaatttcaaacttcagttgtgtc

SEQ ID NO: 8876 - DNA, 50 bp, homo sapien
ataaaacaatgaagttacccatttcracaatgcttggcaattttttacca

SEQ ID NO: 8877 - DNA, 50 bp, homo sapien
cagaggacttaactgaagactgacamcaggaatttgaggatggattctag

SEQ ID NO: 8878 - DNA, 50 bp, homo sapien
aatagtttgatacaattcacttttgraaaattacattaacattcatggct

SEQ ID NO: 8879 - DNA, 50 bp, homo sapien
aatgaagtgtgctgatattgctgaawgagtgctaagaattatacaaataa

SEQ ID NO: 8880 - DNA, 50 bp, homo sapien
agatttagcttattgtttgtaaatgragataaaatacctgcaaaggggtt

SEQ ID NO: 8881 - DNA, 50 bp, homo sapien
taagttaagggaatgggaattatgcyaatgaacaatactagtcagttgcc

SEQ ID NO: 8882 - DNA, 50 bp, homo sapien
accctcagcacctggcaggtaaacaratcatttcgagagtaatgttgttc

SEQ ID NO: 8883 - DNA, 50 bp, homo sapien
acttggacatgattatagtttagaamaaattgagtcacgaatatgctggt

SEQ ID NO: 8884 - DNA, 50 bp, homo sapien
agctcccactttgtccactcatcaarcaattcacactgaactcctaggga

SEQ ID NO: 8885 - DNA, 50 bp, homo sapien
cagctatgtgacttgatcaagataaytaaattccctaagatttaggttgc

SEQ ID NO: 8886 - DNA, 50 bp, homo sapien
ttttgttcaagagggagtaatgagtyaacttgaagtcagtttgatgcatt

SEQ ID NO: 8887 - DNA, 50 bp, homo sapien
ttttatttagagaccccttagctaaygcagcacctgacttttaatacgtg

SEQ ID NO: 8888 - DNA, 50 bp, homo sapien
atttagtttgtcatttgttccagaartacttatttaacacccattataaa

SEQ ID NO: 8889 - DNA, 50 bp, homo sapien
cagtttggcttcatgtgaattcagartaataacttgccttgccaccatct

SEQ ID NO: 8890 - DNA, 50 bp, homo sapien
atcagggcagaattccagaaggaagmcatgctttaacagacctcttcacc

SEQ ID NO: 8891 - DNA, 50 bp, homo sapien
tttaatttgattaactttaatttgaygtgtaaacattgtttctaagatag

SEQ ID NO: 8892 - DNA, 50 bp, homo sapien
ggtcacttttggatatatattttaaracactataagtattctatcacacc

SEQ ID NO: 8893 - DNA, 50 bp, homo sapien
atagaaaataaaactgaatgatcctraagatttggtactttatctccccc

SEQ ID NO: 8894 - DNA, 50 bp, homo sapien
ttcaattagtagttttcacatgtacrggaaaaataaattgattcagcacc

SEQ ID NO: 8895 - DNA, 50 bp, homo sapien
gtactggccaaagtcaatgtaccacraaagggaggtttgctcagattggc

SEQ ID NO: 8896 - DNA, 50 bp, homo sapien
tcacagcaatgctataaaataggtaygcttgttatcttcattttactgag

SEQ ID NO: 8897 - DNA, 50 bp, homo sapien
ctttggcaacttattacagctctgarccagttttgtcaaagcgaacatta

SEQ ID NO: 8898 - DNA, 50 bp, homo sapien
aatggactaatacataataatattcrgaaaagaggccctatgtttcattt

SEQ ID NO: 8899 - DNA, 50 bp, homo sapien
aatgaatccagtgaagtgctaggacratggaatgaaatagtgtcttgaaa

SEQ ID NO: 8900 - DNA, 50 bp, homo sapien
taactcacttcttaccatagaccaayattaattctggtgcattaaagaaa

SEQ ID NO: 8901 - DNA, 50 bp, homo sapien
ttctgaatacttaattaatgtgctasatgcaaaatatatgccagaaatga

SEQ ID NO: 8902 - DNA, 50 bp, homo sapien
ttgcaaaaatgactaacacattgaaycaagggacaaagtcagtaaaaagc

SEQ ID NO: 8903 - DNA, 50 bp, homo sapien
gccattccccagacaacatagaaaargataatcaaagtgtaaaggtgact

SEQ ID NO: 8904 - DNA, 50 bp, homo sapien
tttctcgagatttggactttctgaasataaaagctatgggagaaatcaca

SEQ ID NO: 8905 - DNA, 50 bp, homo sapien
acttcatttttaaaaactttatcaakcattgttctcttcacaaatgccac

SEQ ID NO: 8906 - DNA, 50 bp, homo sapien
gtaaacaaatcccattattttgacawctcttttagttattgacagcctat

SEQ ID NO: 8907 - DNA, 50 bp, homo sapien
cctaagccagtacatgtttttaatgsaaagacagttcaaatcaacatatt

SEQ ID NO: 8908 - DNA, 50 bp, homo sapien
ggcaagaacaaggagtgctgaggaartatgggcaatgttctaacaccatc

SEQ ID NO: 8909 - DNA, 50 bp, homo sapien
tgtaagcactgaatgataatttcacraaagtttagcaatgaaaatggtca

SEQ ID NO: 8910 - DNA, 50 bp, homo sapien
agttttcttatctgtaaaacattgayaacagagtgctgtgaagattaagt

SEQ ID NO: 8911 - DNA, 50 bp, homo sapien
gtaaagcacatatttttaaatagcastcactctaatttagtaattcattt

SEQ ID NO: 8912 - DNA, 50 bp, homo sapien
gaaaacgtttaaatccattcgcaaakaagagtcatctataaaatagtata

SEQ ID NO: 8913 - DNA, 50 bp, homo sapien
tatttgaaatacaaagaacttacaamatgataaaatcttactcataattt

SEQ ID NO: 8914 - DNA, 50 bp, homo sapien
cgaatcccattgtaaagctggggaaygccctccagaactcagatggccaa

SEQ ID NO: 8915 - DNA, 50 bp, homo sapien
acattcttggtctttctgcggcaggyaatgacataataggaaggggagaa

SEQ ID NO: 8916 - DNA, 50 bp, homo sapien
aagatatattcaaaaaatgtacttaygtagaccccatctttctcttttta

SEQ ID NO: 8917 - DNA, 50 bp, homo sapien
tgcctttccatcaaatcctgttttasctgtcttcattattcattgcctac

SEQ ID NO: 8918 - DNA, 50 bp, homo sapien
tactatgctaacactttaatgtgaayggatgatgagtggtgccaaatgct

SEQ ID NO: 8919 - DNA, 50 bp, homo sapien
acagacaagaaaatgttctgagacayggtgatttcttatagcttttccag

SEQ ID NO: 8920 - DNA, 50 bp, homo sapien
gcaaaacacatggaaaagagtctcaygcgactggactgggacttacttaa

SEQ ID NO: 8921 - DNA, 50 bp, homo sapien
atagagtagacatatatttttaagaygcgattctggttttttaggagaga

SEQ ID NO: 8922 - DNA, 50 bp, homo sapien
atgtggccaagctaaccaaggctgaygttcttctagggtttggaatcttg

SEQ ID NO: 8923 - DNA, 50 bp, homo sapien
tatataacatatacagtgtgattgarcctattataaaatagagtagacat

SEQ ID NO: 8924 - DNA, 50 bp, homo sapien
gacaacaagccactagcaagcggtcrcagtaagccaggtgagagatgaag

SEQ ID NO: 8925 - DNA, 50 bp, homo sapien
gtgacaagatacagagtctgagttgwaatgtctctgaaggttgatctcta

SEQ ID NO: 8926 - DNA, 50 bp, homo sapien
accacacccagaattaggtcagaccrcctaagattttatctcttcaaata

SEQ ID NO: 8927 - DNA, 50 bp, homo sapien
cattgtattcattaataatgacatcrctttttaacccattagtatattca

SEQ ID NO: 8928 - DNA, 50 bp, homo sapien
agctctctgatgtcctagatattcamaaagcataccacaacctcttctgc

SEQ ID NO: 8929 - DNA, 50 bp, homo sapien
tcataaacagatttttcctaatagcwctttcaactaggttggccttgctg

SEQ ID NO: 8930 - DNA, 50 bp, homo sapien
aggttgatcagaaataatttattcckcatacttgcatgaattttggaatt

SEQ ID NO: 8931 - DNA, 50 bp, homo sapien
taagtagtggtcttgataggttagargacaggatggtcagggagataaat

SEQ ID NO: 8932 - DNA, 50 bp, homo sapien
gacttataatttaagttttccataaytgtgccatttaagtaaaacatact

SEQ ID NO: 8933 - DNA, 50 bp, homo sapien
taataacaaactctccgagctaaaasagcacattcaaacctactgcaagg

SEQ ID NO: 8934 - DNA, 50 bp, homo sapien
gattggaaggattaatatcatcaaartgtccatactaccgaaagaaatct

SEQ ID NO: 8935 - DNA, 50 bp, homo sapien
tcattgtcatgagataaacagtctaycttaccaaaatcagaaatcagcaa

SEQ ID NO: 8936 - DNA, 50 bp, homo sapien
caacataacagaaagaacaaacctaraatgataagcaggtaactgatacc

SEQ ID NO: 8937 - DNA, 50 bp, homo sapien
gcagagacccaaatgttttctggaamgcctccaaatattagcatctgtag

SEQ ID NO: 8938 - DNA, 50 bp, homo sapien
aaacaaattgtttgaaaatcctatamaacatgattcagtggacttactga

SEQ ID NO: 8939 - DNA, 50 bp, homo sapien
taaaacccagacttcaccattatacratttatccatgtaatcaaaaacta

SEQ ID NO: 8940 - DNA, 50 bp, homo sapien
attaaaattccctgcacctagtaggmagaacattgtgacactcaaaagat

SEQ ID NO: 8941 - DNA, 50 bp, homo sapien
gaagtcattatggatctttaggttaragggaaacagtgaagccaaattta

SEQ ID NO: 8942 - DNA, 50 bp, homo sapien
gccagtgacctttatatgtcagttayggatttcatcatctgatctacagt

SEQ ID NO: 8943 - DNA, 50 bp, homo sapien
agtgggatttcacatttgctacgaamcagtgtcccgtttgaaatgagatt

SEQ ID NO: 8944 - DNA, 50 bp, homo sapien
ggtatatctgactcaaagatgaccaygatacaaatccagtgataacagtt

SEQ ID NO: 8945 - DNA, 50 bp, homo sapien
atcattgtgttacagttgcctatagyagtgagtacagtaacatgctgtac

SEQ ID NO: 8946 - DNA, 50 bp, homo sapien
tgtggacagttgccttgttcagcaayctttgtatcatttcaatattttct

SEQ ID NO: 8947 - DNA, 50 bp, homo sapien
atcacagtgtttcatgtcattccacmcaagaggaaattattatgaagtaa

SEQ ID NO: 8948 - DNA, 50 bp, homo sapien
gttttcttttttgatgctaatcactyaatgacattttctccttctgggct

SEQ ID NO: 8949 - DNA, 50 bp, homo sapien
tcttaagattcttctaactgtaagamaaaaatatggtacaatgaatacat

SEQ ID NO: 8950 - DNA, 50 bp, homo sapien
cacacacgtatgtatatatctagacygaattatttcacagtggcaaaagg

SEQ ID NO: 8951 - DNA, 50 bp, homo sapien
aaagtcaccgttacatgatttttacrccttccatttcattttacccttca

SEQ ID NO: 8952 - DNA, 50 bp, homo sapien
ttaataatcccttgaattttgggcastagtttcatgatttctccaaagtt

SEQ ID NO: 8953 - DNA, 50 bp, homo sapien
aatgtaggaatgaacaatgagtgaaygctgtcttctaaatttgcatgact

SEQ ID NO: 8954 - DNA, 50 bp, homo sapien
gctgagcataaaactcctttctccaytccttcatttattaactcccccct

SEQ ID NO: 8955 - DNA, 50 bp, homo sapien
atattaattcatgtttacagatgaasagacctaattttaaagaaaccatt

SEQ ID NO: 8956 - DNA, 50 bp, homo sapien
tgtttaggggaaaggtgttcatgacyatactttaaacaccatatttctat

SEQ ID NO: 8957 - DNA, 50 bp, homo sapien
tgggtatgagaagttgtacttgctayctaaaaggccagaagatgatcatc

SEQ ID NO: 8958 - DNA, 50 bp, homo sapien
atgacattgctttctctattttaggractgaatgaatacatgtctaagaa

SEQ ID NO: 8959 - DNA, 50 bp, homo sapien
cacatccagtttcgtatttctacacrattgaggttttgacatttgaatga

SEQ ID NO: 8960 - DNA, 50 bp, homo sapien
acatgctctgcatcttcgacatccaycaatttggtaccacagtaagcatg

SEQ ID NO: 8961 - DNA, 50 bp, homo sapien
gatgagtaattagtttatcctgagaraaaccagtcttttaaaacaacagt

SEQ ID NO: 8962 - DNA, 50 bp, homo sapien
gcaaagaatgactaggatgttgaagraatttgaaattacatcatgaagaa

SEQ ID NO: 8963 - DNA, 50 bp, homo sapien
tgaggtaactgatgctcagagtaggraacttgtcaaagacacacattcag

SEQ ID NO: 8964 - DNA, 50 bp, homo sapien
tttgaaagaactttataaaaactaasaggttgaatttgaatgcatgttta

SEQ ID NO: 8965 - DNA, 50 bp, homo sapien
ctgcaggctccatctgcaaaacatayctaaaatctgaccatttctcacca

SEQ ID NO: 8966 - DNA, 50 bp, homo sapien
tacccaacacactcacctatattcckgactacactcattcagctccacat

SEQ ID NO: 8967 - DNA, 50 bp, homo sapien
cattagtgtccattccatattgagtyactaaaatttacacataagacata

SEQ ID NO: 8968 - DNA, 50 bp, homo sapien
atcaggagagaatttagcgtgcatamaggtatcaaatagcagtcagggat

SEQ ID NO: 8969 - DNA, 50 bp, homo sapien
attcctgagactaccccgaaacacayggaagtatgacaaaagtataagac

SEQ ID NO: 8970 - DNA, 50 bp, homo sapien
tgctgcctggtaagccttgtacttayatttggcatacttgctgccacatt

SEQ ID NO: 8971 - DNA, 50 bp, homo sapien
tgtaatatgtaccttgttgtataaaygattaccctatggtgactactctg

SEQ ID NO: 8972 - DNA, 50 bp, homo sapien
tttatcatttgcctatactcttaaarttgcttaaacttgtgtttgtttcc

SEQ ID NO: 8973 - DNA, 50 bp, homo sapien
tttgtaacaagaaagcagattgctaraacaataaatttggcaggatgcaa

SEQ ID NO: 8974 - DNA, 50 bp, homo sapien
tgctagtatgaagttaactggagaaytgtgataagagtaaaaactattat

SEQ ID NO: 8975 - DNA, 50 bp, homo sapien
ttgagtgcatatcaatctgttaccaytacataatctttgaagtttattta

SEQ ID NO: 8976 - DNA, 50 bp, homo sapien
atggactaatacacacagcatatatmaactttgaaatgtatttaattaac

SEQ ID NO: 8977 - DNA, 50 bp, homo sapien
ctgcttagtcaaatgaattcagtcarcatagttaatcaatagggctactg

SEQ ID NO: 8978 - DNA, 50 bp, homo sapien
tacattgaacaaaattctgttctcaraaaagacaagtgaatgttaggaat

SEQ ID NO: 8979 - DNA, 50 bp, homo sapien
gtgaaaaaggtgacactttgaatatyaactggtaaccaatattttgatga

SEQ ID NO: 8980 - DNA, 50 bp, homo sapien
ctggaagtttcaaggaaatagataaygaaactttggtctggtggcagtaa

SEQ ID NO: 8981 - DNA, 50 bp, homo sapien
actggcatctagagtatcatctgacrcataggaataattaacaaatattt

SEQ ID NO: 8982 - DNA, 50 bp, homo sapien
ggcataaactctattcctgactttayaagaactttattttttatttcagg

SEQ ID NO: 8983 - DNA, 50 bp, homo sapien
cctgatcccaaataatgaaagtgcaraaaaatcaataatggtaaaagaat

SEQ ID NO: 8984 - DNA, 50 bp, homo sapien
cctggatctattccaaaataaattgmattggcagggtcagtgggaatcac

SEQ ID NO: 8985 - DNA, 50 bp, homo sapien
ttgcattcccagccttatttgttacratctatgacactgagtaggacatg

SEQ ID NO: 8986 - DNA, 50 bp, homo sapien
agggaagacagctttttgagtaccasattggtgttgaagttgggcttctc

SEQ ID NO: 8987 - DNA, 50 bp, homo sapien
atctttcagatagtaactgcaggaaragctgggtccatcagacctaaaat

SEQ ID NO: 8988 - DNA, 50 bp, homo sapien
tcacttcattctgcactcatttatgyattctgaatcacatagccaatata

SEQ ID NO: 8989 - DNA, 50 bp, homo sapien
catgtgattattcaaatcctctatawacttgctcctttcatctgctcgat

SEQ ID NO: 8990 - DNA, 50 bp, homo sapien
tgaaagcaaccttttttgtgagccaygtattaccaaagctgtgctgacct

SEQ ID NO: 8991 - DNA, 50 bp, homo sapien
cagaagtattttaagaaggctgaacrcaattttgaagtggcaatcattcc

SEQ ID NO: 8992 - DNA, 50 bp, homo sapien
accatttagtattctttctaaggcascaaataaaaatatgaactatcttg

SEQ ID NO: 8993 - DNA, 50 bp, homo sapien
gatacacttaattatatgccaagacrgtattgcaaaagctcatttgtgat

SEQ ID NO: 8994 - DNA, 50 bp, homo sapien
cttaaaatacttctgttcttcaaacraaatacctcacatcagttctaaat

SEQ ID NO: 8995 - DNA, 50 bp, homo sapien
ttctgtcatcatattttgcattacaytatttccatcaatggttcaaaata

SEQ ID NO: 8996 - DNA, 50 bp, homo sapien
ggccaaaggattgtgtggaataagamgtaaaaaccatgcagctacccagg

SEQ ID NO: 8997 - DNA, 50 bp, homo sapien
aagcagtagttacagccttactattmaataaagttgggagcaaaaagcat

SEQ ID NO: 8998 - DNA, 50 bp, homo sapien
tttttctactacctaggaaattgacrcattctttcacctactgatgtcca

SEQ ID NO: 8999 - DNA, 50 bp, homo sapien
gtcatgcatgacttctgatgtgtgaygcttcagctagacagttgatatat

SEQ ID NO: 9000 - DNA, 50 bp, homo sapien
cttccaaactttaacattctgtcacyatagaataaactatatataaacta

SEQ ID NO: 9001 - DNA, 50 bp, homo sapien
ggaaattcttttgtcccatttcagcmacatccaagcattttccttagaag

SEQ ID NO: 9002 - DNA, 50 bp, homo sapien
tctgagtctttttttaggttaagcasaacttgatttatgaatctgggcat

SEQ ID NO: 9003 - DNA, 50 bp, homo sapien
ggcatgaaaaatagatctagcagaawaatttagttacatatgcccttttt

SEQ ID NO: 9004 - DNA, 50 bp, homo sapien
catgcaaagaaaagcaaaacttagtsaaagatagtatcttgaccatataa

SEQ ID NO: 9005 - DNA, 50 bp, homo sapien
gaatctggataaaagaccctagtgaracagatgctaacagaacattatgc

SEQ ID NO: 9006 - DNA, 50 bp, homo sapien
gggtcccagtaatgttggagggttaygtttggagagccattaaaattttt

SEQ ID NO: 9007 - DNA, 50 bp, homo sapien
tataacacctgttcccaaatttaagmatacaatgaaatttagattaccat

SEQ ID NO: 9008 - DNA, 50 bp, homo sapien
aatgaagctattagaatgacggaaaraaggaagcatattatacctttgta

SEQ ID NO: 9009 - DNA, 50 bp, homo sapien
ttaccaaattctgtttcctcttctaygaaaacatcacaatacttaaaact

SEQ ID NO: 9010 - DNA, 50 bp, homo sapien
agtaatccaggtcaaagtcggcttaycctgcaatcgtttatgcagtatat

SEQ ID NO: 9011 - DNA, 50 bp, homo sapien
acttaaaactttctattgtcggccayctttgggttccccctgacttacat

SEQ ID NO: 9012 - DNA, 50 bp, homo sapien
attctgcattttgaattttccaaacygatctatatccatgaatatactat

SEQ ID NO: 9013 - DNA, 50 bp, homo sapien
ttgggatttttagaaataattgatgycagaaagtcaaacatataatgaat

SEQ ID NO: 9014 - DNA, 50 bp, homo sapien
aatacaagcaaaaccaaaaaagccartgcaactgatatcaacaagaaatt

SEQ ID NO: 9015 - DNA, 50 bp, homo sapien
gcagaggagggtgccaacaacaaggyaatcatttggctttgcccaaccca

SEQ ID NO: 9016 - DNA, 50 bp, homo sapien
tcaagatttcttttcatacctaaaayggcttctattacatgatacaattc

SEQ ID NO: 9017 - DNA, 50 bp, homo sapien
caattacatggaggtaacttcatgaraagaataagatcagtcatactcaa

SEQ ID NO: 9018 - DNA, 50 bp, homo sapien
tgcaatataacttcctttttctttaygtgatgatatctgagtaagtacca

SEQ ID NO: 9019 - DNA, 50 bp, homo sapien
aatgatttttcatcagctgtttcgaratcaagacaaattccccaaacttc

SEQ ID NO: 9020 - DNA, 50 bp, homo sapien
ctaataccgaataaatcttttcctasagttttggcacaatcatgtttttc

SEQ ID NO: 9021 - DNA, 50 bp, homo sapien
aatagtcacgagatacgggttcatarctaggtcactcagcaatcatccca

SEQ ID NO: 9022 - DNA, 50 bp, homo sapien
atttacatttctataatgtcagttgragttttaagaggtcagtttttaaa

SEQ ID NO: 9023 - DNA, 50 bp, homo sapien
tccaccataaaaagggacaaatcaarttcttggtgtagggcaaccttcct

SEQ ID NO: 9024 - DNA, 50 bp, homo sapien
atgattagcaagaaaaatgatcagcrcttagtttttgagataagttttct

SEQ ID NO: 9025 - DNA, 50 bp, homo sapien
gaatcataacaattttataagatgakatagcaggttttaatagcacataa

SEQ ID NO: 9026 - DNA, 50 bp, homo sapien
ggccaaaggattcaaaactttataartagacaataataatcgcaataaat

SEQ ID NO: 9027 - DNA, 50 bp, homo sapien
ggacttaatatgaaaatattctaaasctctcaaacatgtctcttttaaac

SEQ ID NO: 9028 - DNA, 50 bp, homo sapien
aattgagcttacacaatggtctaaaygcaaagaaacagaccaagactacc

SEQ ID NO: 9029 - DNA, 50 bp, homo sapien
cttaagttttaaagaatgctggcaartgtttaagcgatcagcactgctgg

SEQ ID NO: 9030 - DNA, 50 bp, homo sapien
tttaaataactgtcgtgtttaggaaygtccacctattactgttcttctcc

SEQ ID NO: 9031 - DNA, 50 bp, homo sapien
aaacccacttctacatatcatatcartaaaggaagttttgtctgcagcga

SEQ ID NO: 9032 - DNA, 50 bp, homo sapien
tattttcatccatatctttcttccaytagttctgttgctttggatacatt

SEQ ID NO: 9033 - DNA, 50 bp, homo sapien
tttctagtaattagtaactttcaacratttatatggttaaaaaataaatt

SEQ ID NO: 9034 - DNA, 50 bp, homo sapien
agcacctgaagtatgttggatctcakgttagacaccggaaatttataaat

SEQ ID NO: 9035 - DNA, 50 bp, homo sapien
ggaagaggatggccgtgctacaatasagcgtcaaaagatctcttataaac

SEQ ID NO: 9036 - DNA, 50 bp, homo sapien
ataaatcaggagagtatgccttcttraacccaaagtctagcatgagaaaa

SEQ ID NO: 9037 - DNA, 50 bp, homo sapien
cacactgagcatttaatcaatgtaaktaatatggcaccattatctaggtt

SEQ ID NO: 9038 - DNA, 50 bp, homo sapien
ggtagaaaagtgtcatggttgaatayggatgctatagttaggatttatat

SEQ ID NO: 9039 - DNA, 50 bp, homo sapien
taatgatacccagatcaagccatgayataactagtgcagtgtgcaagatt

SEQ ID NO: 9040 - DNA, 50 bp, homo sapien
tccggtttaagtatgacctttaaaaktctctaccactacacaaacatcgt

SEQ ID NO: 9041 - DNA, 50 bp, homo sapien
tcataacttctaataaaaagtatggraaaggcgatcataaaataaattat

SEQ ID NO: 9042 - DNA, 50 bp, homo sapien
tcttcctaaacctttcaggctcaaakagggaatctgaaacaagtggaccc

SEQ ID NO: 9043 - DNA, 50 bp, homo sapien
tttgggaaaccaaattacagtcacaygattgcttagtgagcacagaatcc

SEQ ID NO: 9044 - DNA, 50 bp, homo sapien
tatgttaaaatcagaaagggtcttaygagccattgaatccaatcttcctt

SEQ ID NO: 9045 - DNA, 50 bp, homo sapien
aaatgggcagcactggtgagcaaagraatattatagaggtttttttttca

SEQ ID NO: 9046 - DNA, 50 bp, homo sapien
aaaaagctacagtaaagtactaattyaacctaccattccttaaaaaaaaa

SEQ ID NO: 9047 - DNA, 50 bp, homo sapien
ctcatattgattgaatgctgattacygactgagcatagaaactatttcag

SEQ ID NO: 9048 - DNA, 50 bp, homo sapien
catgaactgttcgttgcataactgtyaagcatcatgttagagctcatatt

SEQ ID NO: 9049 - DNA, 50 bp, homo sapien
ttattatacagatggatagtgaaaayggaattaattgttagccaaaaaag

SEQ ID NO: 9050 - DNA, 50 bp, homo sapien
agactggattgaagtgggttaatcaktcagcagatttcaggatgggttga

SEQ ID NO: 9051 - DNA, 50 bp, homo sapien
acattcaaaataaagcacgaatattyaaactttgtgaggctatttctgtc

SEQ ID NO: 9052 - DNA, 50 bp, homo sapien
ctcacatcttcattccagtgtctacratcccatttaactttgtgctaaag

SEQ ID NO: 9053 - DNA, 50 bp, homo sapien
attactcaaaactaggcaggtcttayactcttggttaaaggtactcattt

SEQ ID NO: 9054 - DNA, 50 bp, homo sapien
tgtcaccatggtctttcttctagatraagtttagctggaaggaagaagtg

SEQ ID NO: 9055 - DNA, 50 bp, homo sapien
gaaggctgtctctacaaggtattcgycacaggcatatcaggcttaatata

SEQ ID NO: 9056 - DNA, 50 bp, homo sapien
tttctcatattcaaagtagccttctraatatcactcactcaacactgctt

SEQ ID NO: 9057 - DNA, 50 bp, homo sapien
atcctataaaatggaaaacattgaartgagaagccaatttgagcaaaaag

SEQ ID NO: 9058 - DNA, 50 bp, homo sapien
tttgacctatggttcctacccattckccagtgatgttctgagttgatctt

SEQ ID NO: 9059 - DNA, 50 bp, homo sapien
aagatttctaaaattataactgttcyatggccaggtaacaatgattttgg

SEQ ID NO: 9060 - DNA, 50 bp, homo sapien
cttctctgggcatagtaatcgcaccyataaaataaacaattgtatgatag

SEQ ID NO: 9061 - DNA, 50 bp, homo sapien
ccatgtcagaaaccttcccatattcratgcaaagctcaaatgtcatcttc

SEQ ID NO: 9062 - DNA, 50 bp, homo sapien
tcttctgagtctgacagtacccaacsatctaaatctaaaaggattttgtt

SEQ ID NO: 9063 - DNA, 50 bp, homo sapien
ttctaggagagcattaaaggcagtcrcataaatgacactcatccctaggc

SEQ ID NO: 9064 - DNA, 50 bp, homo sapien
tccatctttagacattttaaaaggtmacaattaggctacatgagaactct

SEQ ID NO: 9065 - DNA, 50 bp, homo sapien
attccagcctcctgtctacttctcaygggacaagaatgccatcattatct

SEQ ID NO: 9066 - DNA, 50 bp, homo sapien
accatctctgagtaccgtgctgagtracaacgggccaaatttagcagcta

SEQ ID NO: 9067 - DNA, 50 bp, homo sapien
tttataaaatcatcaagagttattgyagcgtcaacagtgtttgttactcc

SEQ ID NO: 9068 - DNA, 50 bp, homo sapien
ttttagaataaatgattgttgactayatattttcattttataaaatcatc

SEQ ID NO: 9069 - DNA, 50 bp, homo sapien
ttattctaaaatctttccagtactaygagagatcttttgtttattaactc

SEQ ID NO: 9070 - DNA, 50 bp, homo sapien
gttaagtccatcatatgtttctaacygccaatatattcttccattctcaa

SEQ ID NO: 9071 - DNA, 50 bp, homo sapien
gtgagtggagggtttctcttgtagcsaagattgtagaagcccgttttgga

SEQ ID NO: 9072 - DNA, 50 bp, homo sapien
cctcccaggaacatgaacatgaaacrcttgagtcccagtgggctgctccg

SEQ ID NO: 9073 - DNA, 50 bp, homo sapien
cctgctttcatattttacgagtaaartatagatgccagaatattacaatg

SEQ ID NO: 9074 - DNA, 50 bp, homo sapien
cttggctaataaagatcactagatayaggctaaaattaggcagggtgggg

SEQ ID NO: 9075 - DNA, 50 bp, homo sapien
aagaggcaagtttatgagccttgaartaaacaaatagcagtcaaggaaac

SEQ ID NO: 9076 - DNA, 50 bp, homo sapien
gttctctgtttattgtttgtcttcayctgtaagaatacagtcttcacaag

SEQ ID NO: 9077 - DNA, 50 bp, homo sapien
ccccgttgttctcagcataaaggggwccaagtacttaaataaaaaattca

SEQ ID NO: 9078 - DNA, 50 bp, homo sapien
tattaggacacaaagttgagtaagasagagtcccctggaagactttcagt

SEQ ID NO: 9079 - DNA, 50 bp, homo sapien
ccctcaataacatcacagttttacarcttcacagcaagaatgtcaccctg

SEQ ID NO: 9080 - DNA, 50 bp, homo sapien
gtatgcatgaggcaatgtgtatttayctgtattactagcgcatatggttt

SEQ ID NO: 9081 - DNA, 50 bp, homo sapien
actagcgcatatggtttggctctaamacacaagtcaagaacccagaagtg

SEQ ID NO: 9082 - DNA, 50 bp, homo sapien
gatctgttttctttacctcttatgamtatgaatgcttttgtttgtgtctt

SEQ ID NO: 9083 - DNA, 50 bp, homo sapien
tatgtgggctataataagtcattaayagtttggagttgaaaaagggcatg

SEQ ID NO: 9084 - DNA, 50 bp, homo sapien
gtggcccattcattaaattatgtgaygtgtaaatatacagccttaggctt

SEQ ID NO: 9085 - DNA, 50 bp, homo sapien
gctgttttaaatttctaaatttgacrctatcagttttactcttctagctc

SEQ ID NO: 9086 - DNA, 50 bp, homo sapien
tgctataaaccactgatttgggagasagcatgttgtaagcattatcatgc

SEQ ID NO: 9087 - DNA, 50 bp, homo sapien
tccaaagtcaggactttttctactayaataaactgtctttctttaccttt

SEQ ID NO: 9088 - DNA, 50 bp, homo sapien
ctaatttttataggaattataagtaycttgagagcaggaccatgtctttt

SEQ ID NO: 9089 - DNA, 50 bp, homo sapien
gcaactactttttatttcccagggaygtaggaacaccgaggaggtagaac

SEQ ID NO: 9090 - DNA, 50 bp, homo sapien
ctgtttcagtggttgaaccctagctracataaggatactttgtaagtatc

SEQ ID NO: 9091 - DNA, 50 bp, homo sapien
agcttttcctctaagatatggaacamgacaagaatgtccactttcaacac

SEQ ID NO: 9092 - DNA, 50 bp, homo sapien
attagcaggctggtcctaaaattaayatgaaaatacaaggaacccagaat

SEQ ID NO: 9093 - DNA, 50 bp, homo sapien
caagaaagatgactgatctagacatkaattcaccattggtctgcttccct

SEQ ID NO: 9094 - DNA, 50 bp, homo sapien
tacctcctaagtataaacctctacayatacatagtcaacgaatttggatg

SEQ ID NO: 9095 - DNA, 50 bp, homo sapien
cctagacacataatggaatcttaatraatgttggtagaatgggtgaaata

SEQ ID NO: 9096 - DNA, 50 bp, homo sapien
aaactgctgttaatgtagctctaaawtatcttggctctctggttagtatt

SEQ ID NO: 9097 - DNA, 50 bp, homo sapien
tcaatagcatttagattttttaagaygataaccaaggtgctatcaacaat

SEQ ID NO: 9098 - DNA, 50 bp, homo sapien
cttctaagtcacctgccatgtagaayttatcacaaccagtaaacaagcaa

SEQ ID NO: 9099 - DNA, 50 bp, homo sapien
aaaagcttacttaggtgtcaccatawacagaaaatcaagcagaaaagatg

SEQ ID NO: 9100 - DNA, 50 bp, homo sapien
atttttatttcccaatgcctttaaarttactccgtgtttctggaaactct

SEQ ID NO: 9101 - DNA, 50 bp, homo sapien
aaaaaaagcatattcagaaaaaaaamtgatgagagaccactacacaccta

SEQ ID NO: 9102 - DNA, 50 bp, homo sapien
aaatgactacttaattatattgtaargttgtatataggaaacatgtcact

SEQ ID NO: 9103 - DNA, 50 bp, homo sapien
agtggctatactggtaccacaaacakagattttaagtcaagaagtgtcat

SEQ ID NO: 9104 - DNA, 50 bp, homo sapien
tggaaaattgacgacactgaaagagrattgttgtagttaagcttccctga

SEQ ID NO: 9105 - DNA, 50 bp, homo sapien
aatcttaggtgctttcttcttttgtkaaagtgttgaattaattacatcca

SEQ ID NO: 9106 - DNA, 50 bp, homo sapien
tattacagaagatgaactaagatttsaaacttaatatgggaatgtgggag

SEQ ID NO: 9107 - DNA, 50 bp, homo sapien
gtctccagagaaggaagttctttggrcaaaatttttgagtttaagaatta

SEQ ID NO: 9108 - DNA, 50 bp, homo sapien
gaaaaacaagatatttcagtgttaayggtagcacataataagaattttca

SEQ ID NO: 9109 - DNA, 50 bp, homo sapien
tggcagcatcttctttgtagtgtcartataaaataggatgggttgtccat

SEQ ID NO: 9110 - DNA, 50 bp, homo sapien
tccccaaaatgatgtatcaactgcakgtcataatttagataaatattaat

SEQ ID NO: 9111 - DNA, 50 bp, homo sapien
ttttttcagaaataaagtatcgatawgccaattctaatattataacagta

SEQ ID NO: 9112 - DNA, 50 bp, homo sapien
atcctcatatttctgcaagacctaaycagctaatgatgcccagagcatgt

SEQ ID NO: 9113 - DNA, 50 bp, homo sapien
aggtccttgcccataagcaaaataaytggagagttctctaatggaataga

SEQ ID NO: 9114 - DNA, 50 bp, homo sapien
gatagcacacctaaagtgtttttatyactatcatttcttcatgtatatat

SEQ ID NO: 9115 - DNA, 50 bp, homo sapien
ttagaaattaaaaataccctgacaasattgaatattcagagtagatggag

SEQ ID NO: 9116 - DNA, 50 bp, homo sapien
catccgaggaaatatgtttgaagacyactggtgaagcacgcgagtggata

SEQ ID NO: 9117 - DNA, 50 bp, homo sapien
caacctacgttggataaaatcctgarataagtcagaagtttgtttgaagt

SEQ ID NO: 9118 - DNA, 50 bp, homo sapien
gctgaactttctttgcatcataaacrcgaaaaaaatgctcaaattaagtc

SEQ ID NO: 9119 - DNA, 50 bp, homo sapien
ggatttagatgcaggcaagaatagayatgtttaatgtaaacttcccaaac

SEQ ID NO: 9120 - DNA, 50 bp, homo sapien
caagataaaatgtaggcatagaagakagttaagtaagatggatatgctcc

SEQ ID NO: 9121 - DNA, 50 bp, homo sapien
ttttatttgcatgttggtgttgaaargtcagtaaattataaaaatgagga

SEQ ID NO: 9122 - DNA, 50 bp, homo sapien
tcataagtggaaataaaaaatggaayatggaagttgtaaaaggaagtagt

SEQ ID NO: 9123 - DNA, 50 bp, homo sapien
atatgcccctttcatatctaatgagkacaataataatatgttacatttac

SEQ ID NO: 9124 - DNA, 50 bp, homo sapien
atcttttgtgcatttctagcaaaaayttaacattcacaccaagttgacgg

SEQ ID NO: 9125 - DNA, 50 bp, homo sapien
ctggaaggtggttgaattattttaakccatgacaaattcctttacaagag

SEQ ID NO: 9126 - DNA, 50 bp, homo sapien
gattttaagcagcaagaagaagcaaytaactcaggatgccagcagtttgg

SEQ ID NO: 9127 - DNA, 50 bp, homo sapien
atagatcagaattttccagtctctaycatgaagcaaggactctgatccgt

SEQ ID NO: 9128 - DNA, 50 bp, homo sapien
cccagtcacctagcaaagtcaggtarcgattttaagcagcaagaagaagc

SEQ ID NO: 9129 - DNA, 50 bp, homo sapien
cctaatttggcttatcgaagattcaytagatcatgtcaagggccaaagag

SEQ ID NO: 9130 - DNA, 50 bp, homo sapien
tatctttggctctaacccacagatcracatttccctgtgctcacacctgc

SEQ ID NO: 9131 - DNA, 50 bp, homo sapien
attcttaatcattatgtaaacatacrctatggaccttgaccaagctgtcc

SEQ ID NO: 9132 - DNA, 50 bp, homo sapien
cacgaaaagatgagaatgttcttcaragtaaaagtgaagtcttttaaaag

SEQ ID NO: 9133 - DNA, 50 bp, homo sapien
ttactattttgtattttcgttgggaygttgaatacacatttcatacaatt

SEQ ID NO: 9134 - DNA, 50 bp, homo sapien
ttcacagcatacgtttgaatcttacwcactttatatttgtttaggatgtt

SEQ ID NO: 9135 - DNA, 50 bp, homo sapien
actactaatgcatgatctcatattasaacgctaccaaagatcttaaatgt

SEQ ID NO: 9136 - DNA, 50 bp, homo sapien
aacttgcttgcatgtttgagaattarctgtaatctttatatgcacacaca

SEQ ID NO: 9137 - DNA, 50 bp, homo sapien
ctggaaagcctggttttctacttaaygcaatttatgccaaacctgcaaac

SEQ ID NO: 9138 - DNA, 50 bp, homo sapien
ctttggcatcagagatctgaatttargtccttgttctgtcttctatgaga

SEQ ID NO: 9139 - DNA, 50 bp, homo sapien
aggactcttttcatagttacaatggyatgtttagagtcttgacaaatgca

SEQ ID NO: 9140 - DNA, 50 bp, homo sapien
ctttatcctctagctagcaatctaaygagtggatacaagatattaatcat

SEQ ID NO: 9141 - DNA, 50 bp, homo sapien
tcttaggagactggttatatctgaawgtcactgaaccatgtacaactgtt

SEQ ID NO: 9142 - DNA, 50 bp, homo sapien
gacagttgtagatcacgttagaagcrgaggtaatagaaccatcggcattt

SEQ ID NO: 9143 - DNA, 50 bp, homo sapien
caatttggtgtcaatgatctggtgamaataggattacattggagccaatt

SEQ ID NO: 9144 - DNA, 50 bp, homo sapien
tttgctaacaatgagactttgcttamaaggattcctctactccatcaata

SEQ ID NO: 9145 - DNA, 50 bp, homo sapien
tgttttattttctgtatgacttttgratatttgtacttttgagaaaatta

SEQ ID NO: 9146 - DNA, 50 bp, homo sapien
ccatgtttattaatgtcggtggttaygataatctccttaagtgccacata

SEQ ID NO: 9147 - DNA, 50 bp, homo sapien
tagaccccctactgaaggtcttgacrcataagatcagaactaaataggct

SEQ ID NO: 9148 - DNA, 50 bp, homo sapien
ctcctaaaacataaatagataagaawgctagagagatatatcctaccaga

SEQ ID NO: 9149 - DNA, 50 bp, homo sapien
ttaacagcagttcaacagagaatccraagtgacctgcaaaactaacaaga

SEQ ID NO: 9150 - DNA, 50 bp, homo sapien
taggaaaaaatggaaatagggtttasagtatccagtcacatgttatactg

SEQ ID NO: 9151 - DNA, 50 bp, homo sapien
ttccataaaagctatctcaggtagcrcttttacccattggaactctttgt

SEQ ID NO: 9152 - DNA, 50 bp, homo sapien
cacttgtgtatctggctttatctccragtactttatagttatatagtggg

SEQ ID NO: 9153 - DNA, 50 bp, homo sapien
agagtagatgctcattaaaagttaarccgactgtgaattctcccaagctt

SEQ ID NO: 9154 - DNA, 50 bp, homo sapien
gccatggaagtattaatgagacaaakaattagctttaaatatctgctaaa

SEQ ID NO: 9155 - DNA, 50 bp, homo sapien
gcacagattcaaatcggttcaattayggagttgattaactgacttgtctc

SEQ ID NO: 9156 - DNA, 50 bp, homo sapien
tcagttgcagagagcaaactcccacwatataactataaagtacttggaga

SEQ ID NO: 9157 - DNA, 50 bp, homo sapien
ctcacttttaggaaatgattgttcawgaccatctttaaatctaaattaga

SEQ ID NO: 9158 - DNA, 50 bp, homo sapien
atcttattacctgtttgatatggaaktaagactagagatcctacaagtat

SEQ ID NO: 9159 - DNA, 50 bp, homo sapien
ggggatctccaagccatgcccggtakctttaaccatctatttgaaatgat

SEQ ID NO: 9160 - DNA, 50 bp, homo sapien
caattatttttcctttttcaagtgayacattcagcataacctgaaagatt

SEQ ID NO: 9161 - DNA, 50 bp, homo sapien
actttctattagtttacatacattarcgtgttttatgcaattatactgat

SEQ ID NO: 9162 - DNA, 50 bp, homo sapien
tggtgatcttcttgtgtagttacccrcggatctagctgaaaccaagatcc

SEQ ID NO: 9163 - DNA, 50 bp, homo sapien
tttgggtgagatgacattagaactayaaactggtaagattttctgagaac

SEQ ID NO: 9164 - DNA, 50 bp, homo sapien
cctaccagaaacaaaagcaaaatgcraggaaaagactgattactgatgct

SEQ ID NO: 9165 - DNA, 50 bp, homo sapien
gtcaaatagtattaacactttattcyatgcaatgcttacgacaactttta

SEQ ID NO: 9166 - DNA, 50 bp, homo sapien
cctttctcatcttgctttgttcataygtagcacagttgaaatacacttat

SEQ ID NO: 9167 - DNA, 50 bp, homo sapien
gtttaaagtcctcatgaaagctctgyaacataatattgcttgatttgatg

SEQ ID NO: 9168 - DNA, 50 bp, homo sapien
ggaataaattcatctttcatttcagwatcaacttatatgctagctttttc

SEQ ID NO: 9169 - DNA, 50 bp, homo sapien
aaaaactattattgtaggttacatcragaataaaaaggagaaaataaacc

SEQ ID NO: 9170 - DNA, 50 bp, homo sapien
ttatcagtggaagaaatcattgaacrcggtagaaatttcatttgaagaga

SEQ ID NO: 9171 - DNA, 50 bp, homo sapien
ggtcacatttttttttccagcataakaattgaaatagaagagaagatcag

SEQ ID NO: 9172 - DNA, 50 bp, homo sapien
aaaagaatcaccatggcaatgaaaayggatatcttaagtgctgctgctgc

SEQ ID NO: 9173 - DNA, 50 bp, homo sapien
atacgtgtatatataggatcagttcrctataggtaccgtaattcttaact

SEQ ID NO: 9174 - DNA, 50 bp, homo sapien
tagaacactataatataagccttgcratgttctgcgaatttctaagctta

SEQ ID NO: 9175 - DNA, 50 bp, homo sapien
aattatatttcaaggagactgtcaaytatatatgatcattcagaagagat

SEQ ID NO: 9176 - DNA, 50 bp, homo sapien
acatctttcaattttttgagtgggckgataaaattgcttcccactcttct

SEQ ID NO: 9177 - DNA, 50 bp, homo sapien
ttgtaattcaatacccatcgcaatasagtagaatcaggaaaatatgaaag

SEQ ID NO: 9178 - DNA, 50 bp, homo sapien
ccttgatataagccattcatgtggartagtcctagtggtctcagaatttg

SEQ ID NO: 9179 - DNA, 50 bp, homo sapien
gattaaaaagttctttcaggtcttamataaaatgtgaaatactaagaaac

SEQ ID NO: 9180 - DNA, 50 bp, homo sapien
catcatcttgtaatcagctaatcackaacttaactcttaaatgtaaagcc

SEQ ID NO: 9181 - DNA, 50 bp, homo sapien
catgtatgtgtctgtttatatttcaragccagaataacttggggattaag

SEQ ID NO: 9182 - DNA, 50 bp, homo sapien
ggttccatagtttctcttggtagaakattttcaactctttctgtggcatt

SEQ ID NO: 9183 - DNA, 50 bp, homo sapien
atctcagccacaagactaccatctartaaactaaaacttggcagtgattt

SEQ ID NO: 9184 - DNA, 50 bp, homo sapien
atgcacagtgaaaacaattaaagacwcaatgtgaaaaacatctgaaggga

SEQ ID NO: 9185 - DNA, 50 bp, homo sapien
ggatcagaatttatatctagataagmatacggagccaaggacaaagaagc

SEQ ID NO: 9186 - DNA, 50 bp, homo sapien
aagttctcagaatatacttgtgtgaytaaacgtaatgtctcttgaattaa

SEQ ID NO: 9187 - DNA, 50 bp, homo sapien
tagaagaagcagcttcatggagggartaaaattgacctgaggtttcaaag

SEQ ID NO: 9188 - DNA, 50 bp, homo sapien
atttcacagtaaaccataatggtcarccagctggagtacagtgtttacaa

SEQ ID NO: 9189 - DNA, 50 bp, homo sapien
ggccacgtaatcatagatatagacayaattaaaagaatgacaagaaatac

SEQ ID NO: 9190 - DNA, 50 bp, homo sapien
ccaacgcatctttggacagttattamgatgaggatacagagtggaagcag

SEQ ID NO: 9191 - DNA, 50 bp, homo sapien
tgtgggtgattttgtactgggcgatwacataaatagtgatcttttctgga

SEQ ID NO: 9192 - DNA, 50 bp, homo sapien
aaactgagactcataattgttcaacrgaatgttcaaaatcagaaagctac

SEQ ID NO: 9193 - DNA, 50 bp, homo sapien
ttgtttcagaagataagattaaaaakacgaagagagagattctaaaaatt

SEQ ID NO: 9194 - DNA, 50 bp, homo sapien
gaacataggccttttctttaaggcartatataatctgattatagcagaat

SEQ ID NO: 9195 - DNA, 50 bp, homo sapien
attctcaaaagtgtctcagcttagawggtaaatgataggatataattaat

SEQ ID NO: 9196 - DNA, 50 bp, homo sapien
aatgttttcttcaggtgtaatgaaayctaagggacgtgccagtatcttcc

SEQ ID NO: 9197 - DNA, 50 bp, homo sapien
cttcgtggcagagccactgagtagcragtcagcttttttattagtgagtg

SEQ ID NO: 9198 - DNA, 50 bp, homo sapien
tacttattcaacgtcatattactccyatatcaaatgcagatcctatataa

SEQ ID NO: 9199 - DNA, 50 bp, homo sapien
ggtgatcagccgatcagttagcatgyattaaaggaaatgatctggtgtag

SEQ ID NO: 9200 - DNA, 50 bp, homo sapien
ttgtattatttcttttcggatattayggcagggctctggagtcaggctgc

SEQ ID NO: 9201 - DNA, 50 bp, homo sapien
ggaagaaactaagagtgttcaaggamgaacgacaaagagaatggttaggg

SEQ ID NO: 9202 - DNA, 50 bp, homo sapien
taacatcctgagactgggcccggaamaaagatagctcttgacctttatac

SEQ ID NO: 9203 - DNA, 50 bp, homo sapien
tgaaagattaccaaaaccctatggasagctagagcagatggggttgtttt

SEQ ID NO: 9204 - DNA, 50 bp, homo sapien
ctggtgtaaataacaagaaaggtaamgatatatgaacaatacatacaaag

SEQ ID NO: 9205 - DNA, 50 bp, homo sapien
gtatcttcttattctctctccatgtraatgaaaatgtcttaacagaaacc

SEQ ID NO: 9206 - DNA, 50 bp, homo sapien
tctcattttggcactttacaagaaaygaaactatcactcattgacaagta

SEQ ID NO: 9207 - DNA, 50 bp, homo sapien
cagatatagcctgtctagctcctgayggtcatgattttgaattatcagaa

SEQ ID NO: 9208 - DNA, 50 bp, homo sapien
taatggagtcagggctgatacctcayaaggacgttgtaaagatagagaaa

SEQ ID NO: 9209 - DNA, 50 bp, homo sapien
tacttataactaataacactatacarcttatggaacactattagatatag

SEQ ID NO: 9210 - DNA, 50 bp, homo sapien
cagaacttgattagggattgtttaargcatatatggtcaagcatatgaat

SEQ ID NO: 9211 - DNA, 50 bp, homo sapien
gctgtcttcctcatcatggctttgamgttttccactgcagccccctccct

SEQ ID NO: 9212 - DNA, 50 bp, homo sapien
atttattcagtcatgtaacatggtayacctaatatgcaccagacaccaat

SEQ ID NO: 9213 - DNA, 50 bp, homo sapien
tatttctaaaacatggtaaattaacycaaatcctggcatgttatacaaaa

SEQ ID NO: 9214 - DNA, 50 bp, homo sapien
gaaaactgaagtggagtgtgtgtacyatagcagagagcgaaggtccctct

SEQ ID NO: 9215 - DNA, 50 bp, homo sapien
ctagacatgctgtaaaacaattaaawaaggcattacagatacgattgtat

SEQ ID NO: 9216 - DNA, 50 bp, homo sapien
actgaatgctctagctactgtcctayaaacattctaaagaaacaaagtat

SEQ ID NO: 9217 - DNA, 50 bp, homo sapien
acccccaaaattcatgtgttgaaacygaattaccaaaaaaagagaaaaag

SEQ ID NO: 9218 - DNA, 50 bp, homo sapien
ttgactctcttgcctgtctagtctcyaaggattaagtcatagacacaata

SEQ ID NO: 9219 - DNA, 50 bp, homo sapien
tacaaaaagagtcataaccataagaytatagtttgcagaaatttaggtca

SEQ ID NO: 9220 - DNA, 50 bp, homo sapien
ccaacaccaaaaagcagcttgtgccraaatacatttatctgtgaaaacta

SEQ ID NO: 9221 - DNA, 50 bp, homo sapien
attccgatgatttaaaaagcatttaygtaacatggtgaaaccctgtctct

SEQ ID NO: 9222 - DNA, 50 bp, homo sapien
tttagaaactagctcaggaatgaacraccaagaagaccatggatgtataa

SEQ ID NO: 9223 - DNA, 50 bp, homo sapien
gtcctatgtgctactttggaaagtaytaagtatacagcgtgcctgtcact

SEQ ID NO: 9224 - DNA, 50 bp, homo sapien
gggttgctggacagaagctagaaaamtacgtctgggtcattgggaggaaa

SEQ ID NO: 9225 - DNA, 50 bp, homo sapien
tttattgatttcatgccattattaargttaataccctcagaatctccata

SEQ ID NO: 9226 - DNA, 50 bp, homo sapien
ggtgttacttgaagttcataaatcartctaaatcaattagatattgtgac

SEQ ID NO: 9227 - DNA, 50 bp, homo sapien
atgaatatgcaaacattctctaggasctttagaggtagatgaaagataaa

SEQ ID NO: 9228 - DNA, 50 bp, homo sapien
ccttggtctcagaataaatatcaaaragactaaagatacgtgctttgttc

SEQ ID NO: 9229 - DNA, 50 bp, homo sapien
caacagaagagctgtattaaagctaygtatcaaccttgaaaatcagaaaa

SEQ ID NO: 9230 - DNA, 50 bp, homo sapien
agtcattgagttccttccacagagcsctggagataaaacagctgcaatgc

SEQ ID NO: 9231 - DNA, 50 bp, homo sapien
tggtattgaagaattttaagaagagraggtatctgatcaaatttctacct

SEQ ID NO: 9232 - DNA, 50 bp, homo sapien
agatagaccattgtctctgtttcaaygaaagtcaaaggaatagcatgata

SEQ ID NO: 9233 - DNA, 50 bp, homo sapien
cagtgtggagcctctctgttgggcasacttttcgtgatcatgttccagag

SEQ ID NO: 9234 - DNA, 50 bp, homo sapien
agctcccttaaagtgaaatttcctaytacctgcttttctgcttgtaagga

SEQ ID NO: 9235 - DNA, 50 bp, homo sapien
ttgaaatgagtaaactaaggcctacracttcaaattaatattctgagttt

SEQ ID NO: 9236 - DNA, 50 bp, homo sapien
atgatttatctgcatcaatcttaagyaactctttgtaattattgctaaat

SEQ ID NO: 9237 - DNA, 50 bp, homo sapien
acacgttggctctgatctactgaacsaacattccttgtgctgtgctcatt

SEQ ID NO: 9238 - DNA, 50 bp, homo sapien
agactctccttgtgctaggataccaygttcttgtcatttcttctttcttt

SEQ ID NO: 9239 - DNA, 50 bp, homo sapien
gttatggtgagtgcgctgcattttgyaatgttttggtcttctccctccta

SEQ ID NO: 9240 - DNA, 50 bp, homo sapien
cattcctggaaatgtgtagctttacygcctgaataaatggataaatatct

SEQ ID NO: 9241 - DNA, 50 bp, homo sapien
atacctacgtagtttatattcttcamagcaaatctaaactgtagatacta

SEQ ID NO: 9242 - DNA, 50 bp, homo sapien
aggaaacagtaaaaaatacaatatawctgaaacatgcgccaatagattgc

SEQ ID NO: 9243 - DNA, 50 bp, homo sapien
gtcttcaaatgactacgagaaaccamgcacatggatttgggggatacaca

SEQ ID NO: 9244 - DNA, 50 bp, homo sapien
agtagtgaagaattacaaataaaaamctctgtcaagaaagagctacaggt

SEQ ID NO: 9245 - DNA, 50 bp, homo sapien
tgggactagttgttttgcatgtctcragtaataagttagtgactggttgt

SEQ ID NO: 9246 - DNA, 50 bp, homo sapien
tgtcctggaatgaaacttgagtgtgwactgttctatgcctcagaacagta

SEQ ID NO: 9247 - DNA, 50 bp, homo sapien
atcaattcacacctctcgaatctaayctgcaacagctgcacaacaatgtt

SEQ ID NO: 9248 - DNA, 50 bp, homo sapien
acactctgagcaagtcccagatataytacaactcaatgcaatctttaaca

SEQ ID NO: 9249 - DNA, 50 bp, homo sapien
ttaaatattgtcttatacttctttaygtccgcattagagtcttgagaaga

SEQ ID NO: 9250 - DNA, 50 bp, homo sapien
cctttacctgttattgttaagagtamagaaaacatctttctgtatgtttc

SEQ ID NO: 9251 - DNA, 50 bp, homo sapien
ctatgttgaggaccagacgtttatawcaccaatgtcaagaaatgacaagc

SEQ ID NO: 9252 - DNA, 50 bp, homo sapien
aatacaatgctattaataatcctaamcttgtgtggggctaggctaatgtg

SEQ ID NO: 9253 - DNA, 50 bp, homo sapien
tagatgagtaaacaagagagggaccragataaacagagaaattcaagtac

SEQ ID NO: 9254 - DNA, 50 bp, homo sapien
aaccacagacacttttaacatgcacrgaaatcttgaaatactatctccag

SEQ ID NO: 9255 - DNA, 50 bp, homo sapien
aaacttattatgtgagggaattacayctttagttagacaattgtagaaaa

SEQ ID NO: 9256 - DNA, 50 bp, homo sapien
aagtgagagagcctggagacatgaargctaactaatgggcatcagcagca

SEQ ID NO: 9257 - DNA, 50 bp, homo sapien
tggctaacatgtttgataatcttaaytctgttatgcaacattgttactat

SEQ ID NO: 9258 - DNA, 50 bp, homo sapien
ggccaccataacaaaatactgtcaartgggtgacttaaaacaatagaaat

SEQ ID NO: 9259 - DNA, 50 bp, homo sapien
atatagaaatgagaaattatagataygtgatttcgcagaaacatgtctta

SEQ ID NO: 9260 - DNA, 50 bp, homo sapien
aaaaaaaaaatgagatcaaagaaatsactctcaagatttgatccactcaa

SEQ ID NO: 9261 - DNA, 50 bp, homo sapien
atatctcattatgttcttacagagaytaaattagaggagaaaatatgtgt

SEQ ID NO: 9262 - DNA, 50 bp, homo sapien
ttaataactacatgcaataaatgcartagtatacaaggggtagttcagca

SEQ ID NO: 9263 - DNA, 50 bp, homo sapien
caaggatgaaacaccttgaacaacarcgcttggcaacagcatcatgctca

SEQ ID NO: 9264 - DNA, 50 bp, homo sapien
cttttttgcccaaatgctagggctawatttcagtcctcctactcatcttt

SEQ ID NO: 9265 - DNA, 50 bp, homo sapien
cttaaattagtatttgtctttgtatyataaatgccctaagagacttagaa

SEQ ID NO: 9266 - DNA, 50 bp, homo sapien
ttgaggattaacaaatatgtctgtayataaaactgtgtcgaacacagagt

SEQ ID NO: 9267 - DNA, 50 bp, homo sapien
gggtcccaaatgaaaggactgtgccyacagaaaggatagcaaatagctca

SEQ ID NO: 9268 - DNA, 50 bp, homo sapien
agctgctatttaatatctgctatccragtagaaagagcatgagcactttc

SEQ ID NO: 9269 - DNA, 50 bp, homo sapien
gagtgattttgaaaagttggaccgtyacattaatttaattaggaggagaa

SEQ ID NO: 9270 - DNA, 50 bp, homo sapien
gttaattggcagcatcaaactataasatgaatggtgactatgaaatcaat

SEQ ID NO: 9271 - DNA, 50 bp, homo sapien
atgctgatataataattcagtgttgsagaacataatatactgaataacac

SEQ ID NO: 9272 - DNA, 50 bp, homo sapien
atcaatacttgcgtattacttaccaygttgtgcatatattactgtttaag

SEQ ID NO: 9273 - DNA, 50 bp, homo sapien
tattagttgggcttctgggaaaagayggctagacatgataaataatatgc

SEQ ID NO: 9274 - DNA, 50 bp, homo sapien
cttacaaaatcgttatgaaaagtccyattctctgtcataaaatagattaa

SEQ ID NO: 9275 - DNA, 50 bp, homo sapien
gttgggatcagttgcaagtcttaccmaggttattgaatgttgcagattaa

SEQ ID NO: 9276 - DNA, 50 bp, homo sapien
aattcttttctaagcataaaggaaaygtagaaagacctgaatgcataaaa

SEQ ID NO: 9277 - DNA, 50 bp, homo sapien
cagtataactctaaagacatttgaaytagatatcacaaaatatataaatt

SEQ ID NO: 9278 - DNA, 50 bp, homo sapien
gtgtgtgattacagtaagctgtgtcraaagtcatcctctgagtaaggtta

SEQ ID NO: 9279 - DNA, 50 bp, homo sapien
gtgaggatataaaagttaatcggcaytattctatagaaaaggtaaaaaga

SEQ ID NO: 9280 - DNA, 50 bp, homo sapien
ttgaatgcacttgacctctctgaaaygatcagatatatagcatattggaa

SEQ ID NO: 9281 - DNA, 50 bp, homo sapien
agaaagaggtgttgaaagtctagatkagcagttcaaaggaaactctccaa

SEQ ID NO: 9282 - DNA, 50 bp, homo sapien
aacatgtaaaaagaaactcgttccarcattttcaccagctttccatgcct

SEQ ID NO: 9283 - DNA, 50 bp, homo sapien
gaaaaaatgatgaatctacgttttakcatgggttgaatgagtattggtat

SEQ ID NO: 9284 - DNA, 50 bp, homo sapien
cactcctatttaaaatggaatggacrgcaacactgatggatgatcaaggc

SEQ ID NO: 9285 - DNA, 50 bp, homo sapien
ccaggccaaatatatggaaagcaaayggcttatgtttcatagaattaatg

SEQ ID NO: 9286 - DNA, 50 bp, homo sapien
ggagatttctttgttttgttttacgmatgtatcgcccaaacataaaactt

SEQ ID NO: 9287 - DNA, 50 bp, homo sapien
aaatttgaaatttgtatgtcataaawtaataacgtgatattttgcctttt

SEQ ID NO: 9288 - DNA, 50 bp, homo sapien
tgaatatgtcaagtcattcaaaatcyacaaggaggccaggcgtggtggct

SEQ ID NO: 9289 - DNA, 50 bp, homo sapien
ttctttaagtagcataaactttctawaatgctggttcacatatgttagca

SEQ ID NO: 9290 - DNA, 50 bp, homo sapien
ctctttattctcatgtcaatccagargtttacctttgatttccagaggga

SEQ ID NO: 9291 - DNA, 50 bp, homo sapien
ctaagaggtttttactggttgtagaygacactatactggtcaggcatatg

SEQ ID NO: 9292 - DNA, 50 bp, homo sapien
tcccagcccttctttctgctgttaawtctctagtcaaacccactttggga

SEQ ID NO: 9293 - DNA, 50 bp, homo sapien
cctataactggaatgttaaactcccrcgtcatagaaataatgcagaagcc

SEQ ID NO: 9294 - DNA, 50 bp, homo sapien
gaaaattcatggaattgtgcacttakgatgtatacatttctgtatgaatt

SEQ ID NO: 9295 - DNA, 50 bp, homo sapien
taaagctttctggcaagcctataacrgtcacctttgggtcaggggtactg

SEQ ID NO: 9296 - DNA, 50 bp, homo sapien
gttattttctaaaaaggaaaggatasagagagtcttacaaattgtgtttt

SEQ ID NO: 9297 - DNA, 50 bp, homo sapien
tcaaatggaattacaatagtctgtakctaaggtttactctttccctccat

SEQ ID NO: 9298 - DNA, 50 bp, homo sapien
gaggatggtgagaactctcccaaaakctaagttcccaggtgctggttatg

SEQ ID NO: 9299 - DNA, 50 bp, homo sapien
ctacagaatttaacctcttcaaaaaytaaccttcctttgtccaaaagcta

SEQ ID NO: 9300 - DNA, 50 bp, homo sapien
gaaaatgatgtttagtttgtaggaaygtaaagtctgacattgtccatctt

SEQ ID NO: 9301 - DNA, 50 bp, homo sapien
taagatattaattttatccatttacrctcatcaaaaaagaaatatatggt

SEQ ID NO: 9302 - DNA, 50 bp, homo sapien
ctttaaaaagaaaattagcctaccaycttgcagtcaattgagtctgctac

SEQ ID NO: 9303 - DNA, 50 bp, homo sapien
gacaactgggcaaaaaggtgaaaacragggcaagactatgtaatgctgtg

SEQ ID NO: 9304 - DNA, 50 bp, homo sapien
gtcaatggacctctcataatggcacmgacaggagatatttgtgttttgtg

SEQ ID NO: 9305 - DNA, 50 bp, homo sapien
atccactgtagaagctcttaagaatratgtggataaaatggcatgctcta

SEQ ID NO: 9306 - DNA, 50 bp, homo sapien
tacaatgtgtcaaacattatgtttaycagaacttttaatagatactctca

SEQ ID NO: 9307 - DNA, 50 bp, homo sapien
tattcatccaatattaacttgaatamgtgcaaaaaaggacagatatcctt

SEQ ID NO: 9308 - DNA, 50 bp, homo sapien
caaaatgatttatgcttagaccccargaggaatgttggtgaacagcattt

SEQ ID NO: 9309 - DNA, 50 bp, homo sapien
tacagtctgccagtcagtatgctaastactttacaagaattatttttatg

SEQ ID NO: 9310 - DNA, 50 bp, homo sapien
ttagcatgagcaacatatccttctayctttaaactccagggaacgcatgt

SEQ ID NO: 9311 - DNA, 50 bp, homo sapien
caacagttaccgagtctgagtcaacrgagtgtggtctgaggaagaatgtg

SEQ ID NO: 9312 - DNA, 50 bp, homo sapien
cagtaatgcgatcaagggagatatamaacaactattaagaaatgaagtac

SEQ ID NO: 9313 - DNA, 50 bp, homo sapien
ggatgcccagaactcctttatatcasgtgctagtgtccaactgtctgtgt

SEQ ID NO: 9314 - DNA, 50 bp, homo sapien
gataggtttatggcaaaataaatcaraattgaaatcttttggctatactt

SEQ ID NO: 9315 - DNA, 50 bp, homo sapien
tgtagcagaggccctattgcatgtcscttgactcttttttgtgttccttc

SEQ ID NO: 9316 - DNA, 50 bp, homo sapien
agtccttagtttttggggccaattargtatggagcaaagtatactaataa

SEQ ID NO: 9317 - DNA, 50 bp, homo sapien
taaatcaaaattgaaatcttttggcyatacttattactattttctggaaa

SEQ ID NO: 9318 - DNA, 50 bp, homo sapien
gtaggaggtagaatttgaattagtayctaagacttaatatagcctttcaa

SEQ ID NO: 9319 - DNA, 50 bp, homo sapien
tgtaagagtagagtatacaataggargtgaattccagcttccagtcatac

SEQ ID NO: 9320 - DNA, 50 bp, homo sapien
acccagtatatgctagatggcattcyaagtggtgagagttaatactgaaa

SEQ ID NO: 9321 - DNA, 50 bp, homo sapien
gtgctctttgaatgtttgtcatgtgyatattgatccatcagtaagtaaat

SEQ ID NO: 9322 - DNA, 50 bp, homo sapien
tatagtccaaaaagcacaggctctaygccaaaaagatgttgttttgaatt

SEQ ID NO: 9323 - DNA, 50 bp, homo sapien
aagcttaattaaaacaaaaatatggycaaagagtcataggatgttagagt

SEQ ID NO: 9324 - DNA, 50 bp, homo sapien
actgtgagcttggatgagtcacagaktctcttgagtctcaagttctctat

SEQ ID NO: 9325 - DNA, 50 bp, homo sapien
ccagatggaggagtccagatgttgaygacttgattgttctagagaagggg

SEQ ID NO: 9326 - DNA, 50 bp, homo sapien
tgcaactgtatgtattccttaattamaatttactacatatagactaatct

SEQ ID NO: 9327 - DNA, 50 bp, homo sapien
tatagtttttaaaaaagacagcttaygttccctatcatattttctggggg

SEQ ID NO: 9328 - DNA, 50 bp, homo sapien
acttgaggctttggactggaactacyacatttattttctacttacaatag

SEQ ID NO: 9329 - DNA, 50 bp, homo sapien
tctgacctctctttcctgtctcaccratgggcctagtgcgtcaacaagct

SEQ ID NO: 9330 - DNA, 50 bp, homo sapien
atttttattaagtggctaaaaaaatyatcataccttcatctagctggcct

SEQ ID NO: 9331 - DNA, 50 bp, homo sapien
tctggcaatcaagaaaagatgtgccracgttaagcaaccattggtaaact

SEQ ID NO: 9332 - DNA, 50 bp, homo sapien
caaatatttagctattcaaatttaaygcactgactattgcataattttat

SEQ ID NO: 9333 - DNA, 50 bp, homo sapien
gtgttgttcatgtgtcaactgtataygttatctctacataaggactacaa

SEQ ID NO: 9334 - DNA, 50 bp, homo sapien
ttatttctttgccataattcttagaraagttttggactatactacgtaca

SEQ ID NO: 9335 - DNA, 50 bp, homo sapien
aggaggcctcaatgtcaataaaataygaggttcttcccagctttatggtt

SEQ ID NO: 9336 - DNA, 50 bp, homo sapien
tattaatataagagatttactaaggraacacctgtgaaggaaaatgggct

SEQ ID NO: 9337 - DNA, 50 bp, homo sapien
ttttgataagatttctagggaattayctaactccacccccttttaccaca

SEQ ID NO: 9338 - DNA, 50 bp, homo sapien
aaatttgttttatatagagtaaaaartgttaatattcataatggattgtt

SEQ ID NO: 9339 - DNA, 50 bp, homo sapien
tggcttatcaattcttctaactatartacgtgacttttattttttaaaaa

SEQ ID NO: 9340 - DNA, 50 bp, homo sapien
ttaacccaccttggtcttagaatccygcttcagctactactcttcctttg

SEQ ID NO: 9341 - DNA, 50 bp, homo sapien
tgtctcatactctaatgactcttcarggatcacgttttgaacacacaaac

SEQ ID NO: 9342 - DNA, 50 bp, homo sapien
caggcatagtaactaatgcaatcccragataataactacaagaagcagct

SEQ ID NO: 9343 - DNA, 50 bp, homo sapien
tagatatgtgtatgtgttctaaaaaraatgaatgtatccatgtgactttt

SEQ ID NO: 9344 - DNA, 50 bp, homo sapien
tttgtagtagtaatatctatcatcartattaaacagatgccattcaatta

SEQ ID NO: 9345 - DNA, 50 bp, homo sapien
ggctgaagtagactagaaagaaaaawattgagtcaatgttgtatagaggc

SEQ ID NO: 9346 - DNA, 50 bp, homo sapien
tcattcccaaagtcttacaatttcayggatattgcagcatattttacaac

SEQ ID NO: 9347 - DNA, 50 bp, homo sapien
cacagcatagttttattcttcattcyatggcatttgttctctgtaaattc

SEQ ID NO: 9348 - DNA, 50 bp, homo sapien
ctcaagtcttctagttgatcatttawgagtctgcttcatcttcagtacca

SEQ ID NO: 9349 - DNA, 50 bp, homo sapien
agattgggaatccagtgttaagtgargctaatatttctaatggcctcccc

SEQ ID NO: 9350 - DNA, 50 bp, homo sapien
atatcttgagtctgttgtatgactcragtgaggacaaaatttgaacattc

SEQ ID NO: 9351 - DNA, 50 bp, homo sapien
gctggaacacagagttatttaagtaygcaatgatgagaggctaagattgc

SEQ ID NO: 9352 - DNA, 50 bp, homo sapien
gatccctgctgcatttgagccaatakgacaaaaggatgagtagaatctgg

SEQ ID NO: 9353 - DNA, 50 bp, homo sapien
gacgtgtttgactagcaattgacaawttatgtaaaatatcaactttcata

SEQ ID NO: 9354 - DNA, 50 bp, homo sapien
ataaaagcaatgcttaatttagagaracactatcatgcattatacattcc

SEQ ID NO: 9355 - DNA, 50 bp, homo sapien
gtttaaagtttgccaagtacttagcraagggttacactaacttcaaacgg

SEQ ID NO: 9356 - DNA, 50 bp, homo sapien
aaatacagaaaattgagttatccacrgtacataattagatcaatgcctaa

SEQ ID NO: 9357 - DNA, 50 bp, homo sapien
cacatatatccatgctagctttataycatttatcatcatttatgtcacat

SEQ ID NO: 9358 - DNA, 50 bp, homo sapien
cctggagtatttaaacattcaattaygtccaaccatcagactgagcctca

SEQ ID NO: 9359 - DNA, 50 bp, homo sapien
ttctaagaagacattataggtaccamcacatggtctgtatatccaccaat

SEQ ID NO: 9360 - DNA, 50 bp, homo sapien
ttttgggaaagacatatcaaagtaaygcgcacttcacacagcaaatgaac

SEQ ID NO: 9361 - DNA, 50 bp, homo sapien
agacacactgtcaaatgttacaatasagaacaaaatatatgttgcataac

SEQ ID NO: 9362 - DNA, 50 bp, homo sapien
caaattacaaagtcttatgaagctcraaggaaaagtggcaatgtcaccaa

SEQ ID NO: 9363 - DNA, 50 bp, homo sapien
atcaggaaactctgtctttgtctcartcttgcagtttgtctctgtgtttc

SEQ ID NO: 9364 - DNA, 50 bp, homo sapien
taaaaggcgcctaagatcattttaaracagcatttcaaagagttttcaaa

SEQ ID NO: 9365 - DNA, 50 bp, homo sapien
attaaatttgtcttctttctcagaastgttcccagtagcgtatattcttc

SEQ ID NO: 9366 - DNA, 50 bp, homo sapien
tgagaaaaccagagcctgtcattaayaacttgatccaaagtcatgagttt

SEQ ID NO: 9367 - DNA, 50 bp, homo sapien
aattgaatatagataaaatgcagagrctagctggactaaaatcttgactg

SEQ ID NO: 9368 - DNA, 50 bp, homo sapien
tgaggggcaaaagaccaagacaaacycatcttcacagagaaaaagccata

SEQ ID NO: 9369 - DNA, 50 bp, homo sapien
gaacttgccacctgattcatacacartgacaacgggagagtgaggggcaa

SEQ ID NO: 9370 - DNA, 50 bp, homo sapien
agaattggatttttttgtgtcaaaasggttatctctctgtgagctctgtg

SEQ ID NO: 9371 - DNA, 50 bp, homo sapien
cagggagtcttcaccaccataagtckgaacaggcaaggaaggtgaagatg

SEQ ID NO: 9372 - DNA, 50 bp, homo sapien
tgtagaaaactcagcatgattgtagragaataagtactaaatatagaagt

SEQ ID NO: 9373 - DNA, 50 bp, homo sapien
tccacctcagagcatccttcttaaakcatctaacctgtaacactttggaa

SEQ ID NO: 9374 - DNA, 50 bp, homo sapien
agtatttaaaatcaaggctttataaytatgagggtgtgtgtgtgtgcacg

SEQ ID NO: 9375 - DNA, 50 bp, homo sapien
aatatttagaaataaacctctttaakcagaaggtctcaacagtggcttaa

SEQ ID NO: 9376 - DNA, 50 bp, homo sapien
aggtcttggtcttgaaggtgagagayggttacagaccacagccgccacta

SEQ ID NO: 9377 - DNA, 50 bp, homo sapien
gaccactgtcaagtcacagagtcacraattgtctagaatcaatattatgt

SEQ ID NO: 9378 - DNA, 50 bp, homo sapien
ctcagattgtgacctaattaattcamaagttcaatcatttgccatattca

SEQ ID NO: 9379 - DNA, 50 bp, homo sapien
tgggtatacatttacaataataaacrattcttaagctattaaaacattac

SEQ ID NO: 9380 - DNA, 50 bp, homo sapien
attgtgccattttgatcttttgacartccgtctctgcctttgtccctctc

SEQ ID NO: 9381 - DNA, 50 bp, homo sapien
ttaggcaggttaaggtccttccatascaggagagatctttatagaattaa

SEQ ID NO: 9382 - DNA, 50 bp, homo sapien
ccatacagtagtctcaaatttctgamccattattctgttaattctataaa

SEQ ID NO: 9383 - DNA, 50 bp, homo sapien
ccagaggaaacactgtcatgttggcyaatatcacaaaaactgattacaaa

SEQ ID NO: 9384 - DNA, 50 bp, homo sapien
ataaccaacactggcctgaaattcgraagactcagtagtttgggtcattg

SEQ ID NO: 9385 - DNA, 50 bp, homo sapien
aagaaaaaagctttgctttttttcaktataggaaactggagaatgcccag

SEQ ID NO: 9386 - DNA, 50 bp, homo sapien
ctaacccactcaggaggcccaggatmaggaaacaactttaggaaggagtc

SEQ ID NO: 9387 - DNA, 50 bp, homo sapien
gagtggcagtatagggtaatggttamgagcatggactttgaagtcaaaca

SEQ ID NO: 9388 - DNA, 50 bp, homo sapien
tgtagtctcttaaaatggttacatamagtatcaaaacaaaagcccaaaac

SEQ ID NO: 9389 - DNA, 50 bp, homo sapien
cccaaaaaggtgcaccgtatggccaygtcttttattgatttgtccacctc

SEQ ID NO: 9390 - DNA, 50 bp, homo sapien
ttaaaatgtctatgaataaccttaasaagaaattttgagtgcacatcttt

SEQ ID NO: 9391 - DNA, 50 bp, homo sapien
aaacatagagcttggtttctccacarattgcatatggcttcttttttaaa

SEQ ID NO: 9392 - DNA, 50 bp, homo sapien
aatgaatatctgctgatgatagaaaytggtatgtacatttgtaatgtttt

SEQ ID NO: 9393 - DNA, 50 bp, homo sapien
aagggaaaattccccttacatactasaaaactattactccataatatatc

SEQ ID NO: 9394 - DNA, 50 bp, homo sapien
gtgtctacttttctgatggcatctascctattacgttctatactttgata

SEQ ID NO: 9395 - DNA, 50 bp, homo sapien
gaacaaaacacagagtaatatcaaartatagaacgtaataggctagatgc

SEQ ID NO: 9396 - DNA, 50 bp, homo sapien
gtgtttcacacacagcaagtactcartaaaattattcatagaagacttat

SEQ ID NO: 9397 - DNA, 50 bp, homo sapien
ggctgcattcacaatgacttcaatcraggtagtggtagtacggatagtaa

SEQ ID NO: 9398 - DNA, 50 bp, homo sapien
ttgtattttgggctagacaaagtccygagtggtgttcatcatcccaccag

SEQ ID NO: 9399 - DNA, 50 bp, homo sapien
atattcagtaagaaattgcacaaagyaagttttggagtgctctttatttg

SEQ ID NO: 9400 - DNA, 50 bp, homo sapien
aatttcaggggcctgttatttcccaractactctgcccttggtcaccaag

SEQ ID NO: 9401 - DNA, 50 bp, homo sapien
ggattgagattccatcccgctgacartaaacatcaatggtggagcagaaa

SEQ ID NO: 9402 - DNA, 50 bp, homo sapien
tcctcgcatcagggcttagaattccrgaactacattgggcatcttagcac

SEQ ID NO: 9403 - DNA, 50 bp, homo sapien
gcatccccagcacttgacgcgtagargtgaagtcttgatggaataaatga

SEQ ID NO: 9404 - DNA, 50 bp, homo sapien
gcgagataaacgatcgggcgcaaagrcacaacctaatataatatttgcag

SEQ ID NO: 9405 - DNA, 50 bp, homo sapien
cttctctttcaggagctgtctactamcttatttcttttacgtagtgactt

SEQ ID NO: 9406 - DNA, 50 bp, homo sapien
tatgaggccatataaatgacataccracattaaataacacgaaataatcc

SEQ ID NO: 9407 - DNA, 50 bp, homo sapien
aggacacaatatttacctataaatarccattggaaagacagtaattcaag

SEQ ID NO: 9408 - DNA, 50 bp, homo sapien
ccggttgttatcattcggaaatgtgratctggccttgttaaagctttcac

SEQ ID NO: 9409 - DNA, 50 bp, homo sapien
gaacaggaaccaaactgaggacagcrgaaagactgagaataagagagaag

SEQ ID NO: 9410 - DNA, 50 bp, homo sapien
tgtgtttttcatggtaaccacatacragggaatgcttaaactgtaagccc

SEQ ID NO: 9411 - DNA, 50 bp, homo sapien
attcctcttgtctagtcatgtgatasctgagcttttccaattttttgatt

SEQ ID NO: 9412 - DNA, 50 bp, homo sapien
tccattgcatctttgactcctactcratcatgaatatctgagatgtccga

SEQ ID NO: 9413 - DNA, 50 bp, homo sapien
ctaagtattttctgagccaaattaaytaaatatccatagttcctctgtaa

SEQ ID NO: 9414 - DNA, 50 bp, homo sapien
aggaactgtggatgttaaatctcatraattgtctggcttgaggggtttag

SEQ ID NO: 9415 - DNA, 50 bp, homo sapien
tgctttgtctgaaagtcatagtcaamcctaacttttatctttctcaatgc

SEQ ID NO: 9416 - DNA, 50 bp, homo sapien
taaaaagtattttaccttcgtaacgracatttatgaaagtaaaaaatagt

SEQ ID NO: 9417 - DNA, 50 bp, homo sapien
aagctcctagggggcactttaattayagtatgtatcgaggtaggatgcaa

SEQ ID NO: 9418 - DNA, 50 bp, homo sapien
ggaacttaacacaacaaggttctccratctgttacctattttacagagtt

SEQ ID NO: 9419 - DNA, 50 bp, homo sapien
caggtttcctcctaccatattactargatagaagcacagtttagaactag

SEQ ID NO: 9420 - DNA, 50 bp, homo sapien
agtggaagatactgacaagagcaccratcataaaatactggtccgcacag

SEQ ID NO: 9421 - DNA, 50 bp, homo sapien
ttatcaggtgttaacattagagtgayacctggtaaaaattgctgtaattg

SEQ ID NO: 9422 - DNA, 50 bp, homo sapien
cacttaaattttctgaattaaaatcracagagaaggtaggaggcagcaaa

SEQ ID NO: 9423 - DNA, 50 bp, homo sapien
gactttgagaataatagattctataygccaatggtacaagcataaggaaa

SEQ ID NO: 9424 - DNA, 50 bp, homo sapien
gaagagttgtcagttaatgattgaayggattttcaaaccgactgaaacct

SEQ ID NO: 9425 - DNA, 50 bp, homo sapien
aatgactgttgtagcaggctttcccractgaaatatttaagcttttaaat

SEQ ID NO: 9426 - DNA, 50 bp, homo sapien
aatttttggcattaagagaaaaagamgctgttgtatttgattttaaatgg

SEQ ID NO: 9427 - DNA, 50 bp, homo sapien
cataaaaatacactcagtaatgaaaygtcaattctatgttctgacttttc

SEQ ID NO: 9428 - DNA, 50 bp, homo sapien
tggtatctcacgggatggcagaaaamgccaagactgaaaactcctgtccc

SEQ ID NO: 9429 - DNA, 50 bp, homo sapien
aagggattgaaatttcaaccaattayatagggagtttaagctctaactgc

SEQ ID NO: 9430 - DNA, 50 bp, homo sapien
aatgtaatgattcattaaagctaggraagtatcttgggagacatgttctt

SEQ ID NO: 9431 - DNA, 50 bp, homo sapien
tgtgaggtttttttgcaaattagatratcagtaagtccctagcgccatag

SEQ ID NO: 9432 - DNA, 50 bp, homo sapien
aattgatgcattcacttattaatgaragcacactattctcactaaggccc

SEQ ID NO: 9433 - DNA, 50 bp, homo sapien
tggaagattgagaaagggaagagtasaggctgacgtaagaggaggctaga

SEQ ID NO: 9434 - DNA, 50 bp, homo sapien
gaaaatggaaaggggtcactaaagastccaaaataatgattaaaacaaac

SEQ ID NO: 9435 - DNA, 50 bp, homo sapien
gaaaacaaatgctttgtttaaatatsacacacaaatgctgtgtatgatat

SEQ ID NO: 9436 - DNA, 50 bp, homo sapien
catagggtcccctttagacagttaaracggcagctgcaaaaatgaacagc

SEQ ID NO: 9437 - DNA, 50 bp, homo sapien
ctaaatatttggttacaatataacaygaatcacaacctttgtagcctctg

SEQ ID NO: 9438 - DNA, 50 bp, homo sapien
ggcaattaaccctctgaaatttttckctgatcaaaggaacaggaattgct

SEQ ID NO: 9439 - DNA, 50 bp, homo sapien
aatttattatgaggttttcacatacrctatatcctttgctcttcaaaata

SEQ ID NO: 9440 - DNA, 50 bp, homo sapien
tttggaaaaaaaatggcaacgagtawggtttgataaagggttgctctggg

SEQ ID NO: 9441 - DNA, 50 bp, homo sapien
aaacatggcaattacccttctatatraaacttctgattgaagaaaacgat

SEQ ID NO: 9442 - DNA, 50 bp, homo sapien
aagtattgtaactggaatgaagtgasaagtatctagactgggatgtctcc

SEQ ID NO: 9443 - DNA, 50 bp, homo sapien
gtaaagcttccgtttcctcgtctatraaaggagacataagaggacataat

SEQ ID NO: 9444 - DNA, 50 bp, homo sapien
ttcacaataactgagcccttccttgraattatacctcactcaataaatgt

SEQ ID NO: 9445 - DNA, 50 bp, homo sapien
tagttgacactttgcatatagtagtwaagaaaacagacaaggatctctgc

SEQ ID NO: 9446 - DNA, 50 bp, homo sapien
ttactctcccatgcacctatcttaamgtgttcagggcactttgatggaaa

SEQ ID NO: 9447 - DNA, 50 bp, homo sapien
aactatctgccctcaaaagttttagyaaggctgaaatcagatcttgcaca

SEQ ID NO: 9448 - DNA, 50 bp, homo sapien
ttagaccttgaccaaggtctagtaarcggtttgcacatcagcaaaccgtt

SEQ ID NO: 9449 - DNA, 50 bp, homo sapien
agagagaaggtaaagacttggataaygctattctctctatttctcacctc

SEQ ID NO: 9450 - DNA, 50 bp, homo sapien
gtaaaaaaggttgggaagcatcaaarttagggaatgctgaccacaaagat

SEQ ID NO: 9451 - DNA, 50 bp, homo sapien
aggccacagcagggatggcacagagrcgtaaccttaccataggggtcagt

SEQ ID NO: 9452 - DNA, 50 bp, homo sapien
ccctttctacatattctttgtcacaygatctaacttgtgctggcacttag

SEQ ID NO: 9453 - DNA, 50 bp, homo sapien
ctgattctgtgtttaccttggacaarctatatcacctctctgtttcctca

SEQ ID NO: 9454 - DNA, 50 bp, homo sapien
tatgtgttctgcatatctgaactcartctttcttcaactttggaagacag

SEQ ID NO: 9455 - DNA, 50 bp, homo sapien
ttttcacctgtaaccttttgctaatraactgtagctgtgagtctaacagt

SEQ ID NO: 9456 - DNA, 50 bp, homo sapien
ataaccaccattcaggttactaagcraggtagtataggggacacaaataa

SEQ ID NO: 9457 - DNA, 50 bp, homo sapien
tctagaacttgatgctcttgattaarcaacactgaagctatctctcttat

SEQ ID NO: 9458 - DNA, 50 bp, homo sapien
ggattgggggttcatatgcagggaawaactaatggttctatgtgaaacat

SEQ ID NO: 9459 - DNA, 50 bp, homo sapien
tatcacaattactgtgtaaaataggmcatttatatattatccccaaaaag

SEQ ID NO: 9460 - DNA, 50 bp, homo sapien
ctcagatggtggtggtgtgtttctaycttttggattcagccatgaaaatg

SEQ ID NO: 9461 - DNA, 50 bp, homo sapien
ttaattagtaagttggagaaggtaargaaaatccataaaaagcgtctatt

SEQ ID NO: 9462 - DNA, 50 bp, homo sapien
tttttattacctggcaagactgcccrattgtctctgatgttcagatggaa

SEQ ID NO: 9463 - DNA, 50 bp, homo sapien
gtaggcatggtaggtgggaaagagartatagtgtgatgaaaaggccatta

SEQ ID NO: 9464 - DNA, 50 bp, homo sapien
atagattaactcagcagggagtaccrgacaaaggcaagcgggtgctggct

SEQ ID NO: 9465 - DNA, 50 bp, homo sapien
cctgttgcatcttctctgcacttaaygacttaattttaaaaagataaaac

SEQ ID NO: 9466 - DNA, 50 bp, homo sapien
ataaaatttagaaaaccaggcattckgaagcccctacagcagttgtccca

SEQ ID NO: 9467 - DNA, 50 bp, homo sapien
tttctgtcatagaaacttaggaagaygtaccttcatgctctaaatcagat

SEQ ID NO: 9468 - DNA, 50 bp, homo sapien
tgcaatacatataacaaatgtctaamaataattaatgcctatcatgccta

SEQ ID NO: 9469 - DNA, 50 bp, homo sapien
taataatggacaattacagaataacrcaatgcagaactgcaaatgacctt

SEQ ID NO: 9470 - DNA, 50 bp, homo sapien
tggaaaagtaaaagtcatcagtgtcmaatgagattactaagcagaaataa

SEQ ID NO: 9471 - DNA, 50 bp, homo sapien
ttagaagggacagagtagactggatwataccaagccatttttaaaataca

SEQ ID NO: 9472 - DNA, 50 bp, homo sapien
ccatgaggctagactatgtaggttaygaacaatatccaaaaaagggtagg

SEQ ID NO: 9473 - DNA, 50 bp, homo sapien
atcttaacaaccccctacttctacaytattttcattaaccatgtaaaatt

SEQ ID NO: 9474 - DNA, 50 bp, homo sapien
cagtactaagggtggttaaaagtatraagtaggtgagaattaagtagaaa

SEQ ID NO: 9475 - DNA, 50 bp, homo sapien
aactctgagtttcagtttctaatcarcttacatagataagaattaacacc

SEQ ID NO: 9476 - DNA, 50 bp, homo sapien
cagaatgatatcttgcctataattcrgaaggtaatagtgaacaaatgaag

SEQ ID NO: 9477 - DNA, 50 bp, homo sapien
ctgttgtcaaaactgcctgttggacraaggtgggtattaaggcaataaat

SEQ ID NO: 9478 - DNA, 50 bp, homo sapien
aagtaccctttagttaattgcacaayggattgcctagagttaaaagttct

SEQ ID NO: 9479 - DNA, 50 bp, homo sapien
atgcaggaacaatgggacctctgcckatacaagctgaccattcaacccct

SEQ ID NO: 9480 - DNA, 50 bp, homo sapien
cagttaaagagactaggaagactcaragatggtagtaatctatattttta

SEQ ID NO: 9481 - DNA, 50 bp, homo sapien
aggggaaagtgccaagtaggaggaakgataactctagaccacatggcttt

SEQ ID NO: 9482 - DNA, 50 bp, homo sapien
ttcaaaagggatgctatttgtgactyactgaattggttttatgatctacc

SEQ ID NO: 9483 - DNA, 50 bp, homo sapien
ataaatgctttaacatctaatccaaygtcttaggctaaaattctataaat

SEQ ID NO: 9484 - DNA, 50 bp, homo sapien
ctttagctaatctctctgggctacawctaggccatctgttaaggtgggat

SEQ ID NO: 9485 - DNA, 50 bp, homo sapien
gagtaggctgatttgaaatctgatcygaggtactttagtgatcttattgg

SEQ ID NO: 9486 - DNA, 50 bp, homo sapien
ctccaaggactctttgtgctagagaraacatctaacgtcacagataggct

SEQ ID NO: 9487 - DNA, 50 bp, homo sapien
tatttaatacatgatagggaatgatsacaaactttattattgagattgag

SEQ ID NO: 9488 - DNA, 50 bp, homo sapien
tttaagggtgttgggaaaccaactcraatccaacattctggactttgctt

SEQ ID NO: 9489 - DNA, 50 bp, homo sapien
tgtgtttcctattcttgaagttccaygaaatataaagatacacctacata

SEQ ID NO: 9490 - DNA, 50 bp, homo sapien
gggctcaagtcagctgtgattagaartgagctactgtggactaccgcata

SEQ ID NO: 9491 - DNA, 50 bp, homo sapien
gctggaaggcatcagcttatgagaayccacttttttctgcatgactagct

SEQ ID NO: 9492 - DNA, 50 bp, homo sapien
acagtctcttcctttatgacttataygttgtacatcttgttttagacatc

SEQ ID NO: 9493 - DNA, 50 bp, homo sapien
ttgttctttttctgcaaatgtggcastcggttttatttttaaatgctgac

SEQ ID NO: 9494 - DNA, 50 bp, homo sapien
cacaattcagcatgtcacataagtaycatctccattttatatgtgagcaa

SEQ ID NO: 9495 - DNA, 50 bp, homo sapien
atagatcccttctgtgtctaagcaaraaggtgacaagatgacattacttt

SEQ ID NO: 9496 - DNA, 50 bp, homo sapien
catgatgataatcgttgagtaagaayagttatttccagattatttccagg

SEQ ID NO: 9497 - DNA, 50 bp, homo sapien
ggcaaagatatgcccttattgtgaartatcatgaacttaatataactgca

SEQ ID NO: 9498 - DNA, 50 bp, homo sapien
tgtttattgtagaaaacctggaatcmgattactttggcaagcttgaatct

SEQ ID NO: 9499 - DNA, 50 bp, homo sapien
tagtgacaacacaacagttaacaaargaacaaaagtgcaccaggttaacc

SEQ ID NO: 9500 - DNA, 50 bp, homo sapien
tgtttccggtttctggctattaccamtaaagctactatgagcatttgcac

SEQ ID NO: 9501 - DNA, 50 bp, homo sapien
ggagagtagtcttatccaaatcatartatcagtagtaatatcaaataatt

SEQ ID NO: 9502 - DNA, 50 bp, homo sapien
tttattcagctttattgatgcacaaytgacatacaataaatacacataca

SEQ ID NO: 9503 - DNA, 50 bp, homo sapien
ttgtgcatcaataaagctgaataaamaagtaaaatcattactggaatctt

SEQ ID NO: 9504 - DNA, 50 bp, homo sapien
ctttcaccaaggttgcccttgataayaaacggatgtaatcctgcataaga

SEQ ID NO: 9505 - DNA, 50 bp, homo sapien
tataaaatgctcatttaagtagcaamacagaaatgctgtctcttggtaag

SEQ ID NO: 9506 - DNA, 50 bp, homo sapien
agcaatgagtgagttgtttggctcasatggttactttggttatcaagaca

SEQ ID NO: 9507 - DNA, 50 bp, homo sapien
gagaagataaacataattagtagaamtagaggtaaactggaagtgttgac

SEQ ID NO: 9508 - DNA, 50 bp, homo sapien
atggaggcccaccttcataatctcayctaaatctaattacctcccaaaga

SEQ ID NO: 9509 - DNA, 50 bp, homo sapien
ttaagcttggtgttcaaaaagacaargtgatccagacttttgtagtgcca

SEQ ID NO: 9510 - DNA, 50 bp, homo sapien
gagacatgtttctttctctcttccgyattgacaccttctcttgcctttgg

SEQ ID NO: 9511 - DNA, 50 bp, homo sapien
accagggacagagaggggagtgtacygagatactaatcaattactgagga

SEQ ID NO: 9512 - DNA, 50 bp, homo sapien
atttttgactgactttgcgggtaaaygaaacaatacaaatggtttaaaat

SEQ ID NO: 9513 - DNA, 50 bp, homo sapien
ctgtgaggctaatattatagctcaaytccagaacatcttgtagtggttat

SEQ ID NO: 9514 - DNA, 50 bp, homo sapien
tccttgccagcagtgtatagagttcragttgcatcccatcgtgtcagcac

SEQ ID NO: 9515 - DNA, 50 bp, homo sapien
tgaaactagcataatgcaaacttagkccaatcctgtaacatttcagaata

SEQ ID NO: 9516 - DNA, 50 bp, homo sapien
aaaaaagcatataaatgctacagaawatgctactgaaaaaaatcaatgga

SEQ ID NO: 9517 - DNA, 50 bp, homo sapien
tgaaatagggaagatcagggttgaaytgaatagggatacagtttatcaca

SEQ ID NO: 9518 - DNA, 50 bp, homo sapien
cctctaaaggataaaatgaaatgacracggtaaagtctggtgcagagggc

SEQ ID NO: 9519 - DNA, 50 bp, homo sapien
ccctgaaaaaaaaagtattggagaaytgtaagcctcatgttagccaattg

SEQ ID NO: 9520 - DNA, 50 bp, homo sapien
tcaggagaaggcaaatcacagttcaygttctagctttttctaagcaaaca

SEQ ID NO: 9521 - DNA, 50 bp, homo sapien
aatctattatgtatttcctactgtgmatcttgaaattttattcaacattg

SEQ ID NO: 9522 - DNA, 50 bp, homo sapien
cacagccctagagggccattatagcygaatattctttgtaattggctgta

SEQ ID NO: 9523 - DNA, 50 bp, homo sapien
gcttggaaaatgagctaaatgaggaygttgatgcaccatgcagtgacttg

SEQ ID NO: 9524 - DNA, 50 bp, homo sapien
gccatctaagaaatacaaaattggawtcacagcaggttgaggaattgggg

SEQ ID NO: 9525 - DNA, 50 bp, homo sapien
ctaggtggctaggtggtaaaaactaraatgagtatgaatgtatgttttct

SEQ ID NO: 9526 - DNA, 50 bp, homo sapien
aaaggagaacaaaaccaaatgataawgactcacatgtaaaagaaagggaa

SEQ ID NO: 9527 - DNA, 50 bp, homo sapien
caaaaactgtttaactttgtctcacycagaattttccaaacacatttgag

SEQ ID NO: 9528 - DNA, 50 bp, homo sapien
gttttagttttacttgtgacattcaygttattagaagaatgacacaattt

SEQ ID NO: 9529 - DNA, 50 bp, homo sapien
atttgagtaactttaaaatgtaagcratcaataataaaagattactatat

SEQ ID NO: 9530 - DNA, 50 bp, homo sapien
ctaataacatgaatgtcacaagtaaractaaaactagcaagagaatgtga

SEQ ID NO: 9531 - DNA, 50 bp, homo sapien
ctgcttatcagaaggccaacgctgasagttaagggaactcatttaataag

SEQ ID NO: 9532 - DNA, 50 bp, homo sapien
acaagtaaaactaaaactagcaagasaatgtgaataaaaggcccagcttg

SEQ ID NO: 9533 - DNA, 50 bp, homo sapien
ttttttccattcctctttgttctccygatctgaaagcccacggactggag

SEQ ID NO: 9534 - DNA, 50 bp, homo sapien
aggccagtactagtttctctgttggwcaggtaaggaaatgcaaggttaca

SEQ ID NO: 9535 - DNA, 50 bp, homo sapien
gttgaatttgaatctaagagatccartactgacctcaccaagccccatag

SEQ ID NO: 9536 - DNA, 50 bp, homo sapien
agaggtagtaagacataggaacttayagaccagatattcctctttctctt

SEQ ID NO: 9537 - DNA, 50 bp, homo sapien
aaggctactaatggatttttctcackaataggcccactctcctttgatca

SEQ ID NO: 9538 - DNA, 50 bp, homo sapien
tcaggaggtaataaagtcttgaaatyattcttgaagttagaattaagaag

SEQ ID NO: 9539 - DNA, 50 bp, homo sapien
ctgactccaaggtaaagcaactgaasgagcaatgcctttaccacagcaaa

SEQ ID NO: 9540 - DNA, 50 bp, homo sapien
taataagtttccctgacagcagaagkaagtctttccagtcaattctttgt

SEQ ID NO: 9541 - DNA, 50 bp, homo sapien
gagcagtgaagggcagttactatgasaactaaagtggggaagtcatcaga

SEQ ID NO: 9542 - DNA, 50 bp, homo sapien
gaaaacattagggtgttcttggaatratcctcttgagaaaattgcctact

SEQ ID NO: 9543 - DNA, 50 bp, homo sapien
gcaccacctttgcctcacactcctgrataccaaaggcagaccacagtgtt

SEQ ID NO: 9544 - DNA, 50 bp, homo sapien
gaccatccatttcattgatgctggayggatttaaatcatttctgtgctat

SEQ ID NO: 9545 - DNA, 50 bp, homo sapien
tataaccaaatgtagactttataaaygaggcctaggaataaacgttaggc

SEQ ID NO: 9546 - DNA, 50 bp, homo sapien
tgtatttcccagaaagcagagtgaarattaattaagccagacacacaaga

SEQ ID NO: 9547 - DNA, 50 bp, homo sapien
tgagcatcccaggtccggaaatccasagtgctccaatgagcctttcccct

SEQ ID NO: 9548 - DNA, 50 bp, homo sapien
gaatcttgagttgataacctctacasactatcttatttctgtgtttcaaa

SEQ ID NO: 9549 - DNA, 50 bp, homo sapien
gttaaaaccccagggatttgtacaayagattctgtattagataatgcaaa

SEQ ID NO: 9550 - DNA, 50 bp, homo sapien
aacagaactccattaagagattactractaagaagcactaagatttgtgg

SEQ ID NO: 9551 - DNA, 50 bp, homo sapien
acattctctcccacctccctgagctyacgcgaattatgtttcattttgct

SEQ ID NO: 9552 - DNA, 50 bp, homo sapien
aggacttagaaggtggaaccttcccracttagctcccaagtcttcctaat

SEQ ID NO: 9553 - DNA, 50 bp, homo sapien
tatctctctcttgagctctagaacartatatccaagtgtcccctggacgt

SEQ ID NO: 9554 - DNA, 50 bp, homo sapien
ggagatgaatccggggtatcgtgacraaaatgtctgtttgagggtaggtc

SEQ ID NO: 9555 - DNA, 50 bp, homo sapien
tgccatcttcaaattaggaaaataaygtcttccatgaaaatctctctgag

SEQ ID NO: 9556 - DNA, 50 bp, homo sapien
ggatgtctgtgtctacacttagagarcctctggagttaattcagatcttt

SEQ ID NO: 9557 - DNA, 50 bp, homo sapien
gacaatcgcattcctacacaaaacartaaccaatcagaaacataattaga

SEQ ID NO: 9558 - DNA, 50 bp, homo sapien
tcaaagtgcttcttaaatgctgcagwatgattaatttcacaatttccaaa

SEQ ID NO: 9559 - DNA, 50 bp, homo sapien
cagagaagagataaacagaattcagsaacagctaactccaagtcagataa

SEQ ID NO: 9560 - DNA, 50 bp, homo sapien
aaaatgataaagtcacaggatttaaragtattttctagagtctttgagtt

SEQ ID NO: 9561 - DNA, 50 bp, homo sapien
gccgctctgatatttgcataaacagyatagtatctagcagttgtgccagg

SEQ ID NO: 9562 - DNA, 50 bp, homo sapien
gcaaatgtctcaagatcagttctaaygggcccaaccaagatccaggaaga

SEQ ID NO: 9563 - DNA, 50 bp, homo sapien
gcagtgatggcagcagttgtgatgaragcaatgtcctggccagactgtct

SEQ ID NO: 9564 - DNA, 50 bp, homo sapien
tatctggcacacaatagagattcaawtaacgctaatttctttacttccat

SEQ ID NO: 9565 - DNA, 50 bp, homo sapien
cccaacagatcccaaatagaatgaamccaaagaaatacacaatgagatac

SEQ ID NO: 9566 - DNA, 50 bp, homo sapien
gacagctcctctacaaatacgtaacrcagccagataggacatatcattta

SEQ ID NO: 9567 - DNA, 50 bp, homo sapien
agggctgaatcctgcttggtaatatyagtgtgtgtgcttggggatggacc

SEQ ID NO: 9568 - DNA, 50 bp, homo sapien
atgttatgaaacctatttgatagtamgaaggccaagattcagataaattt

SEQ ID NO: 9569 - DNA, 50 bp, homo sapien
gcatggaaaaaatccacaggaattaycaaagctgattgtctctgagattt

SEQ ID NO: 9570 - DNA, 50 bp, homo sapien
tgcctggactcagaggtcttgtcacrcaatctttcctttccttgtgcggg

SEQ ID NO: 9571 - DNA, 50 bp, homo sapien
actctcctttttgaaagtctgggcargaaataatgataaggatggacatg

SEQ ID NO: 9572 - DNA, 50 bp, homo sapien
agtattaacacatctaaaatagtatsaaatcatgtaatgcagaacgaaat

SEQ ID NO: 9573 - DNA, 50 bp, homo sapien
caagtgattggggtagaggctccacygaattatttttaaatctaataata

SEQ ID NO: 9574 - DNA, 50 bp, homo sapien
ttggaaggaaggaggcgatattctgsattataaaaatgaattgggaacat

SEQ ID NO: 9575 - DNA, 50 bp, homo sapien
caagagagtgcctgctagagtggtayagtcctgcagtgtccaacccacag

SEQ ID NO: 9576 - DNA, 50 bp, homo sapien
ggacagaataggttaatttttaataygacacagtataaaaaagaattttc

SEQ ID NO: 9577 - DNA, 50 bp, homo sapien
acactatgcaagatttttcagcgtaycatttgagagggtgcagaagcaac

SEQ ID NO: 9578 - DNA, 50 bp, homo sapien
tcctagttgtttcaaccttttgaaayattgcttgaaaagtcctttttggc

SEQ ID NO: 9579 - DNA, 50 bp, homo sapien
cagggagagtaagccaaaaagacaayggtgctggtaatctaaagaaggct

SEQ ID NO: 9580 - DNA, 50 bp, homo sapien
ctaaggaattctaaaataatagaagycggtgggaactggaatagtcatag

SEQ ID NO: 9581 - DNA, 50 bp, homo sapien
tccttggagccctttgctattatcayaattctcactatccttgcaaacca

SEQ ID NO: 9582 - DNA, 50 bp, homo sapien
gctctggctacagaggtgatttgcayaagaaacctcccatctcaagtaca

SEQ ID NO: 9583 - DNA, 50 bp, homo sapien
ttgagtattgcaaataaatacccatsataaggcctttgggagaagtttcc

SEQ ID NO: 9584 - DNA, 50 bp, homo sapien
tttccccattgatgagggaaggccasactaacccacaatccacatctgca

SEQ ID NO: 9585 - DNA, 50 bp, homo sapien
tgatccatgaggctgtccaattccakcataaaacaggctagcaaggagac

SEQ ID NO: 9586 - DNA, 50 bp, homo sapien
atctatggtttctgatttcaagaaawttgtgtttagctttagaacatgtc

SEQ ID NO: 9587 - DNA, 50 bp, homo sapien
gaaagatagcaacaaattctagatakagtcatgtagttatacagtaataa

SEQ ID NO: 9588 - DNA, 50 bp, homo sapien
aatttgttgctatctttctctattamacatcctatattccctttgtcttc

SEQ ID NO: 9589 - DNA, 50 bp, homo sapien
gttttaaaaaatatgtcatctaaaamaatattaaacaatattcagatatg

SEQ ID NO: 9590 - DNA, 50 bp, homo sapien
atatttaaagcattgttctacaatgmagcaatttgtcagttttatcagta

SEQ ID NO: 9591 - DNA, 50 bp, homo sapien
caaacaattgtattactagcattggragaatatgattaagaactcttcca

SEQ ID NO: 9592 - DNA, 50 bp, homo sapien
aatgatttttttttccaagcccataratagttttctcaagattgtgacca

SEQ ID NO: 9593 - DNA, 50 bp, homo sapien
tgcctgttgaaatctctgattgttayattatctcctatgctgtagatttt

SEQ ID NO: 9594 - DNA, 50 bp, homo sapien
gagggcaatatataacactctataayagtgaggtcaaatatgataaatct

SEQ ID NO: 9595 - DNA, 50 bp, homo sapien
ctcaaaggccatgattttgtgtcaawagatcagcaaataaatgcacattt

SEQ ID NO: 9596 - DNA, 50 bp, homo sapien
gaattattgaagagtttgaagaacarctacttagaaatgataataaacac

SEQ ID NO: 9597 - DNA, 50 bp, homo sapien
ctggtgctgatcacatagaaccaaakggcttttagtatagtatggtactg

SEQ ID NO: 9598 - DNA, 50 bp, homo sapien
gatgacttagattaggtaagaggatragaaacagatccttatatttccaa

SEQ ID NO: 9599 - DNA, 50 bp, homo sapien
tttgctaggccaatcttcctcaataycttggtctcttcattattaaaaat

SEQ ID NO: 9600 - DNA, 50 bp, homo sapien
cagaaaacagtcttttggattcacastatgagcgataataggtgggctct

SEQ ID NO: 9601 - DNA, 50 bp, homo sapien
tttacataattctcatatttagaaartgctcctttttccagagttgactg

SEQ ID NO: 9602 - DNA, 50 bp, homo sapien
gggcttcagacagcacatagtagacratctcttgctggccttgggcattg

SEQ ID NO: 9603 - DNA, 50 bp, homo sapien
tttggatcatttagcttcaggtacakgattaatactttttgagaaaaaat

SEQ ID NO: 9604 - DNA, 50 bp, homo sapien
gaactgagctaggaataaatgtacaratgaatcaatgacacttattgagc

SEQ ID NO: 9605 - DNA, 50 bp, homo sapien
tttaatgccttctgatatctgttgaygaaatagaatagtagaacaatatt

SEQ ID NO: 9606 - DNA, 50 bp, homo sapien
cttgccatactataagtattgtgtgyactgtaattctgcacattaaatag

SEQ ID NO: 9607 - DNA, 50 bp, homo sapien
caaggattggacaatccaatccaaargacaagtgaactcgaagctgatgt

SEQ ID NO: 9608 - DNA, 50 bp, homo sapien
aagggctcttgggtacgttacttcaygaaaccctcagggaagctccagtt

SEQ ID NO: 9609 - DNA, 50 bp, homo sapien
gactaatgaaaattaaatctctgagkataccgagagcccagatttttaaa

SEQ ID NO: 9610 - DNA, 50 bp, homo sapien
agtatcttaaaagtttgagaaccgaygtccagtgaagtagacttggaatc

SEQ ID NO: 9611 - DNA, 50 bp, homo sapien
accgtgtaaattttcagatatataaytgatgttcaatattgccatgctgc

SEQ ID NO: 9612 - DNA, 50 bp, homo sapien
tatggccaaggagggtctctgatagraaggaccaaggcccttcctcccat

SEQ ID NO: 9613 - DNA, 50 bp, homo sapien
tgtcaccttcacgtacccactatgaycagaacgagctctcttggcaaacg

SEQ ID NO: 9614 - DNA, 50 bp, homo sapien
tgattaaggcacctactacactatarcacaatgatttgcactgatattta

SEQ ID NO: 9615 - DNA, 50 bp, homo sapien
cagagcactctagtttttcttcatartacctaccacatgtataattagat

SEQ ID NO: 9616 - DNA, 50 bp, homo sapien
cacatttcctagagtcctgcagtaayaacgatgactaaaatttattggta

SEQ ID NO: 9617 - DNA, 50 bp, homo sapien
aggtgctaaagttgttgcccattacygataaggaaaagctgggctggagg

SEQ ID NO: 9618 - DNA, 50 bp, homo sapien
ttatcaaagctttatgctaataaaakatagttacagtaatttacagaaca

SEQ ID NO: 9619 - DNA, 50 bp, homo sapien
tctagtgagttcactgtctaaaaaaytggaattataatccaggctttcta

SEQ ID NO: 9620 - DNA, 50 bp, homo sapien
atagaattggggaaatacccttccaygctataagacaaggaggatatgta

SEQ ID NO: 9621 - DNA, 50 bp, homo sapien
gctgggctcgtgggagaaacagattraataggaatcaccctcctctatgg

SEQ ID NO: 9622 - DNA, 50 bp, homo sapien
accagtttttttccaggacacattcrgaatgatgcaggtggggatctgaa

SEQ ID NO: 9623 - DNA, 50 bp, homo sapien
ctgaaaacattttgattcctaagcasctttgagtaccagtttttttccag

SEQ ID NO: 9624 - DNA, 50 bp, homo sapien
gtacctccatgctacgattttaactraaggaatatcatgagcgcctgctt

SEQ ID NO: 9625 - DNA, 50 bp, homo sapien
atgtgattttattcatgagattttayattttctaatgagaagtttctatt

SEQ ID NO: 9626 - DNA, 50 bp, homo sapien
agaaagcagaacagaaattcaacaaraggtccctgaagagctcagattcc

SEQ ID NO: 9627 - DNA, 50 bp, homo sapien
tagtaataggcatgtccgtagttgawagaatgtagattttggaaggagca

SEQ ID NO: 9628 - DNA, 50 bp, homo sapien
caccatagtatttgtaaggccttccmatttagagaaaaaggagtcatagg

SEQ ID NO: 9629 - DNA, 50 bp, homo sapien
ctccaaacttaccagataagactgaygtagggagaatatgaaatctgaac

SEQ ID NO: 9630 - DNA, 50 bp, homo sapien
ccaagatggaagccatagtcctttayaaccaaatctcagaaatgacatca

SEQ ID NO: 9631 - DNA, 50 bp, homo sapien
attctgccaaacaattttctgatcamgcatacatatatgataaatgcaca

SEQ ID NO: 9632 - DNA, 50 bp, homo sapien
tctcagcaaagtgctctgcttacccractgtgtaaaccagaaacctgggt

SEQ ID NO: 9633 - DNA, 50 bp, homo sapien
ttatgcaaatcagctttggtatttcwaggaaaaattattgtgagttttaa

SEQ ID NO: 9634 - DNA, 50 bp, homo sapien
tgcccatcatcccttgtaactgtccrataaaaactctgactattttgcag

SEQ ID NO: 9635 - DNA, 50 bp, homo sapien
agcagacacattttgtttgagataaygtaagcagggagaagtatagaatc

SEQ ID NO: 9636 - DNA, 50 bp, homo sapien
gggagaaaagccgataagaagtcaaygataactatagccatggccataat

SEQ ID NO: 9637 - DNA, 50 bp, homo sapien
cttcctttttcacctatgtgaggackgtagcattgattgggacttccaaa

SEQ ID NO: 9638 - DNA, 50 bp, homo sapien
tatacttacttattacttatcatcawccattatattttccaatttttcat

SEQ ID NO: 9639 - DNA, 50 bp, homo sapien
gcttcccaccagcacgttccaggccratacgccagggccaacaggtaact

SEQ ID NO: 9640 - DNA, 50 bp, homo sapien
tcaatgttatcatcgttgaaacaaamactcaggtcatgtggctggagagt

SEQ ID NO: 9641 - DNA, 50 bp, homo sapien
ttatttgccttgtggtatggcactarcattattttttagtaaatatattt

SEQ ID NO: 9642 - DNA, 50 bp, homo sapien
agtgtatagtagattttaaagtaccrgacaactagggacactccctgtgc

SEQ ID NO: 9643 - DNA, 50 bp, homo sapien
gacctgaggattgattgccttaaatsatgggcttcttagattatttgacg

SEQ ID NO: 9644 - DNA, 50 bp, homo sapien
ttatggtggaaatagttattattacragtcatgttctgaatgctcatttt

SEQ ID NO: 9645 - DNA, 50 bp, homo sapien
cctatcatcaccttcttggatcttarcatcttgagaccatgtacccagaa

SEQ ID NO: 9646 - DNA, 50 bp, homo sapien
cgtgagccaccgcacccggcttgcakatagtaattcttaatcttttggta

SEQ ID NO: 9647 - DNA, 50 bp, homo sapien
acaggtgacttttgatgcctttggcyaactaggcactcacattccctctc

SEQ ID NO: 9648 - DNA, 50 bp, homo sapien
gagtttagaagccctaccctttcaaraagtgttgatggaattgaagacaa

SEQ ID NO: 9649 - DNA, 50 bp, homo sapien
caaaatacatttgttttcagatgccyagacaagactcagcttccctagtc

SEQ ID NO: 9650 - DNA, 50 bp, homo sapien
tatggcaaaaaataaagagttataawacacaagaacacatcatcacagca

SEQ ID NO: 9651 - DNA, 50 bp, homo sapien
atgtttgtcatctagatcctgcatasaaagagctcactctgaaagatcac

SEQ ID NO: 9652 - DNA, 50 bp, homo sapien
tagaaaaaaaaaatctttgcttataygtagaggttaaataagttattgca

SEQ ID NO: 9653 - DNA, 50 bp, homo sapien
gatatctggagtgggttgtacatgcrgaagttcagtaggatgagctgagc

SEQ ID NO: 9654 - DNA, 50 bp, homo sapien
gtcttaacatcaacaagtatgtcaaygataagtcactagaaacaaatccc

SEQ ID NO: 9655 - DNA, 50 bp, homo sapien
atataattctattttgttctaattcraaggcttctgaaaaacgaatgagt

SEQ ID NO: 9656 - DNA, 50 bp, homo sapien
ttaggtttagattttagtttagttakgtttctctcctcaggtcttttgcg

SEQ ID NO: 9657 - DNA, 50 bp, homo sapien
gtcccctccacccaagaaaagttacygagaatcaagacttgtaggaagag

SEQ ID NO: 9658 - DNA, 50 bp, homo sapien
cactcaatactacaattatggacacrcagcaggtggctcaggagtcccac

SEQ ID NO: 9659 - DNA, 50 bp, homo sapien
tgggctccagactatccctcttaacygtgacacgagctttcaaagaggtg

SEQ ID NO: 9660 - DNA, 50 bp, homo sapien
catccccaaacgtgagagagttggaygacgatgtatttaagattgaataa

SEQ ID NO: 9661 - DNA, 50 bp, homo sapien
tctctttgttatttccgatcattcaytaaagtatctgaaaactagaccat

SEQ ID NO: 9662 - DNA, 50 bp, homo sapien
aactataagcaagccgtgatatctaygaaaggttatcttatttacacacc

SEQ ID NO: 9663 - DNA, 50 bp, homo sapien
tcctgcattgtattcttttactatgrcagctatgacaaatttggtggctt

SEQ ID NO: 9664 - DNA, 50 bp, homo sapien
agaatgtagtcataagagtatttacygcaatgttgtttagaagagggaga

SEQ ID NO: 9665 - DNA, 50 bp, homo sapien
tacttcagaagatgtatgaaaaatayagtttcacaaacacaagggaacca

SEQ ID NO: 9666 - DNA, 50 bp, homo sapien
cagctcctctaggctttcttgagcaygattgctatttaacagctctgatt

SEQ ID NO: 9667 - DNA, 50 bp, homo sapien
actcagcatgaacgtgttcctttctyacttcacagaggctttgagcttgg

SEQ ID NO: 9668 - DNA, 50 bp, homo sapien
taatttcatgggtctatcagtttcaygggtaatcctctgcctctgtaagc

SEQ ID NO: 9669 - DNA, 50 bp, homo sapien
ctagtaataatactacaatacctgaygtgattggagcaaaatactaataa

SEQ ID NO: 9670 - DNA, 50 bp, homo sapien
aagtcaaaatctgaaggctggaccgractttcaaaagctctggcaaagaa

SEQ ID NO: 9671 - DNA, 50 bp, homo sapien
ataggcaataaacgagacataaggartcaccaatctctactactccctca

SEQ ID NO: 9672 - DNA, 50 bp, homo sapien
gtacatacacttccggtttcttccaytaaagcattcacctcccagatggc

SEQ ID NO: 9673 - DNA, 50 bp, homo sapien
tgcacgtattttacacacaggttcastacgctaacagctccaccgagatt

SEQ ID NO: 9674 - DNA, 50 bp, homo sapien
ttttaaaaaatcctggcctgctgaaygaatagtttcttctgcaacatttg

SEQ ID NO: 9675 - DNA, 50 bp, homo sapien
tttctgtattgttaagtctatacatyacaaacacttataatgatatataa

SEQ ID NO: 9676 - DNA, 50 bp, homo sapien
ttattaataaaatcttacatgtgaayggcaccttgtaatgtacagaatgc

SEQ ID NO: 9677 - DNA, 50 bp, homo sapien
tatttaactatcctactactaataartggaatacaattctcatttggaga

SEQ ID NO: 9678 - DNA, 50 bp, homo sapien
tgaaaactggaaaaataaaattataygctactaaaactggattcatttca

SEQ ID NO: 9679 - DNA, 50 bp, homo sapien
ccggttccagactctgctacccattyaagtgactgtgggcaaggcacctc

SEQ ID NO: 9680 - DNA, 50 bp, homo sapien
aaggccttagtcaaattattagtcarattcctcatttattaaaatgaaag

SEQ ID NO: 9681 - DNA, 50 bp, homo sapien
gatggcacaccaaggcactataggayatcacgggcggtcctttcacctgg

SEQ ID NO: 9682 - DNA, 50 bp, homo sapien
tacaggcagcctctgaaggtgaccasataactgtcttcactgtgaccagt

SEQ ID NO: 9683 - DNA, 50 bp, homo sapien
tctaatttattctcttttttttaatsagtaaaatgcacataacataaaat

SEQ ID NO: 9684 - DNA, 50 bp, homo sapien
ctctcaggaaacttttatttagagcygcacttctcaaactttaatatgca

SEQ ID NO: 9685 - DNA, 50 bp, homo sapien
ggataaggattcgaatgtttactaartgtttaactgtatagtcccaaccc

SEQ ID NO: 9686 - DNA, 50 bp, homo sapien
gagtctcaaaatggtcttttgtctcrcaagaggttacggttaagaaccgc

SEQ ID NO: 9687 - DNA, 50 bp, homo sapien
acacgcaaagagaactagcagcaagragtaatgcattttcactgccagat

SEQ ID NO: 9688 - DNA, 50 bp, homo sapien
gattgtaaaagaaagacgctggaaayagtagctactttgatgcaggcagc

SEQ ID NO: 9689 - DNA, 50 bp, homo sapien
catgatctctacagtgtaatattgaycaactttcaaacatttgaaaagct

SEQ ID NO: 9690 - DNA, 50 bp, homo sapien
cctgctaaggaagaatggtcgctcaracatccaaggaaggaactggccaa

SEQ ID NO: 9691 - DNA, 50 bp, homo sapien
ttagagtgatgactagatgtaaatargtgaacacagatattttctagatt

SEQ ID NO: 9692 - DNA, 50 bp, homo sapien
ttgagatacttgtaccaatgggacckatatgatgctgatgacagtcgcta

SEQ ID NO: 9693 - DNA, 50 bp, homo sapien
tggaccattcatcattgtgaccctayactgaaatccagctcaagcttggt

SEQ ID NO: 9694 - DNA, 50 bp, homo sapien
ttctgtggaatgtgcaatttaactcsaaggacactacaaactcaccaccc

SEQ ID NO: 9695 - DNA, 50 bp, homo sapien
catacatagatttaaaaagccaaccmattgacatatagcttcagaattac

SEQ ID NO: 9696 - DNA, 50 bp, homo sapien
ttaaagcttcttgtcttaatgagagrccctgtataccactctgcactgaa

SEQ ID NO: 9697 - DNA, 50 bp, homo sapien
agcaggattaacatagaaacaaaaaragtcacagatgttcacccacccac

SEQ ID NO: 9698 - DNA, 50 bp, homo sapien
acaattgctttgagtctttaaataayctcccaggccagctggtgggagaa

SEQ ID NO: 9699 - DNA, 50 bp, homo sapien
ctctctgccaagtcctgagtcaccckgaggatagcagatgcgcagactca

SEQ ID NO: 9700 - DNA, 50 bp, homo sapien
aaagttctcggctgccaacacattgyaatttgagaagcatcccgaagccc

SEQ ID NO: 9701 - DNA, 50 bp, homo sapien
atgcaatatgccaagggccatgacgsagacgtgcagggtgtcaagagagc

SEQ ID NO: 9702 - DNA, 50 bp, homo sapien
atgccactgtgctctccctctagaakaagtcacctgggatagaagccgtc

SEQ ID NO: 9703 - DNA, 50 bp, homo sapien
gctgcgctggctcccttgcagtaaayggtagtaggaaaatgcagctgttt

SEQ ID NO: 9704 - DNA, 50 bp, homo sapien
ttaaaaaattctctcttgcaatggcyatacaatagattataattgctcca

SEQ ID NO: 9705 - DNA, 50 bp, homo sapien
aatggcaaatccataacactgctgcsaggcacaatgtcataaaactcact

SEQ ID NO: 9706 - DNA, 50 bp, homo sapien
aaagctaataaagaatgaggtttagkagaacaaagaaagtctgttatctt

SEQ ID NO: 9707 - DNA, 50 bp, homo sapien
ttaatctaagagctatgtctttgtgractatttcatgcccaatattgtta

SEQ ID NO: 9708 - DNA, 50 bp, homo sapien
gaggtgaccccttgacttgtggagamgaagcccaaattcagcagactgaa

SEQ ID NO: 9709 - DNA, 50 bp, homo sapien
aattagatgcaagagccaggattagmatttatcatgaatcatccctgcca

SEQ ID NO: 9710 - DNA, 50 bp, homo sapien
ctccaggaaaggatgtcattttacasataacagagaaatcctgcctgccc

SEQ ID NO: 9711 - DNA, 50 bp, homo sapien
atgtaccagtcactatgagccatgartaagaaaaaaactagtcactgcca

SEQ ID NO: 9712 - DNA, 50 bp, homo sapien
ctcctgccctggtactgatttatctracgaattattatttaaaaataaaa

SEQ ID NO: 9713 - DNA, 50 bp, homo sapien
tagaactgagatagtataaaggacarcctaaagaaaaaactattctccaa

SEQ ID NO: 9714 - DNA, 50 bp, homo sapien
tttttggggaaattttttgcccttaycttagcactctcagaacaggaagt

SEQ ID NO: 9715 - DNA, 50 bp, homo sapien
tgttcaattactttaaatagatccamaaatcaacacaacatttcaaagcc

SEQ ID NO: 9716 - DNA, 50 bp, homo sapien
ccagctctggatacatctaaagaagsctattatgttccaggggtcaagct

SEQ ID NO: 9717 - DNA, 50 bp, homo sapien
aagaatatacttttgcttttccaggratacaagcattagctttattgtgg

SEQ ID NO: 9718 - DNA, 50 bp, homo sapien
gacagaacaggcagctatatggtgargaaatgtacagacacaaatatcca

SEQ ID NO: 9719 - DNA, 50 bp, homo sapien
ggaaaccttttcgtcattttcttaaygtggacagataattgtctccaaac

SEQ ID NO: 9720 - DNA, 50 bp, homo sapien
ggaagataaaatgaacctgagatgarcacaataagaacaataagattctt

SEQ ID NO: 9721 - DNA, 50 bp, homo sapien
ggtaaaatagcaaaactaagttccawagttatactggctccttaacatac

SEQ ID NO: 9722 - DNA, 50 bp, homo sapien
gaagactccgttcctgatgaaataaygcaggaagggcacatcctttggag

SEQ ID NO: 9723 - DNA, 50 bp, homo sapien
ccatgggctttttattctgtctgtaygagatgatttttttcttcccctta

SEQ ID NO: 9724 - DNA, 50 bp, homo sapien
taaatatgtgaatgaccatattctargtgtctactatgagtcaactgttc

SEQ ID NO: 9725 - DNA, 50 bp, homo sapien
atagatttccccatttccactcggaygtaaaacagcccaggatcagttag

SEQ ID NO: 9726 - DNA, 50 bp, homo sapien
gcatgataaaattaccttaactcccrgcatctgtttatgccacatagtga

SEQ ID NO: 9727 - DNA, 50 bp, homo sapien
aaataagccatcttgccattagacartcagaaacctgtgtagcctcccga

SEQ ID NO: 9728 - DNA, 50 bp, homo sapien
tacagggaatgataccttatatgcasgctcgtttctgtgagtctatagtg

SEQ ID NO: 9729 - DNA, 50 bp, homo sapien
ccttttaaatgggcaatactaataaragttgtcatattcaattctatgtg

SEQ ID NO: 9730 - DNA, 50 bp, homo sapien
aatgtacaattccatcagtatattarcaattctaagagatctaataataa

SEQ ID NO: 9731 - DNA, 50 bp, homo sapien
ggccacaggctcttttgcaatatgakgtacccagaatgagaaattcagag

SEQ ID NO: 9732 - DNA, 50 bp, homo sapien
aaccaatgccttgcctttattattayggctctttctatgaggctggattt

SEQ ID NO: 9733 - DNA, 50 bp, homo sapien
cacacagaggtgctggctctaatacraatttactacgtggatccttccta

SEQ ID NO: 9734 - DNA, 50 bp, homo sapien
aggctttatcaatttctatggcataygttctctcatcagggctaatttca

SEQ ID NO: 9735 - DNA, 50 bp, homo sapien
tgggcactaggtatcacattcttgaragctgtaggaaggatccacgtagt

SEQ ID NO: 9736 - DNA, 50 bp, homo sapien
tgtgaactttaaatcttgacacataygccaattgccttccatagaggtta

SEQ ID NO: 9737 - DNA, 50 bp, homo sapien
ctgggtcctcatgataatgaaattcyagctgtgcagagggaaactgaagc

SEQ ID NO: 9738 - DNA, 50 bp, homo sapien
attctgtagtggtatgttagttgggwaataatttgagtttgttttcagac

SEQ ID NO: 9739 - DNA, 50 bp, homo sapien
ggaaaagattcttttttctcatgtayagaggagactcagggcaggatgtt

SEQ ID NO: 9740 - DNA, 50 bp, homo sapien
gagggcaagggctctttaggctcaartagtgcgtcgtatgggagtttgga

SEQ ID NO: 9741 - DNA, 32 bp, homo sapien
caaattcaaaaggtacraaggatccagagtga

SEQ ID NO: 9742 - DNA, 50 bp, homo sapien
aatgtgggtaatctgatcttggatamctgagctgattgtgacaaagaagg

SEQ ID NO: 9743 - DNA, 50 bp, homo sapien
ctatatacatcatctcacttcatccwctcagcaaaatagaattatcttca

SEQ ID NO: 9744 - DNA, 50 bp, homo sapien
aaaatgatcattttggaattgtaacraagtctctgaaatggaggcccttg

SEQ ID NO: 9745 - DNA, 50 bp, homo sapien
gtgaacttaagaaagccatatctgtwaaaaataagttcaatcaaaattta

SEQ ID NO: 9746 - DNA, 50 bp, homo sapien
gagaaaatacaaagaagatacaatamaagcaataaaaaatatttaatgcc

SEQ ID NO: 9747 - DNA, 50 bp, homo sapien
tagctgagactcctccttataccacwcttaatcccctttgcagaaccata

SEQ ID NO: 9748 - DNA, 50 bp, homo sapien
gaaaattcactgcaactcattgtgcrattaaacagggcctgcctgtccat

SEQ ID NO: 9749 - DNA, 50 bp, homo sapien
atgtgcacctatcattgccaagtgawgttctatgtgcttggattatcagc

SEQ ID NO: 9750 - DNA, 50 bp, homo sapien
agaatacaaaaatagaatagagcacrctatgtagacaaggagaaaagctt

SEQ ID NO: 9751 - DNA, 50 bp, homo sapien
gtaacctctatagcttgtattttcayatatccagtgcagacttctatcac

SEQ ID NO: 9752 - DNA, 50 bp, homo sapien
cctggaagtacgtgcatggcctgtgmaccatataaatacattccaccaat

SEQ ID NO: 9753 - DNA, 50 bp, homo sapien
cggaaactcagagacggagatattgraactctgcagagggcctcagcctc

SEQ ID NO: 9754 - DNA, 50 bp, homo sapien
tactattcttgaaaatgtgtcatggycaatttctaggaaacaagcaagta

SEQ ID NO: 9755 - DNA, 50 bp, homo sapien
agtcactgggagctgagccctctccrattcaggttaatcatggatattta

SEQ ID NO: 9756 - DNA, 50 bp, homo sapien
ctggaataacacagaacagactaackccttcttcagacaacagctctgcg

SEQ ID NO: 9757 - DNA, 50 bp, homo sapien
tctggactgagatggtaacacatcckaatctacagaatcagaattagaaa

SEQ ID NO: 9758 - DNA, 50 bp, homo sapien
ttacacggccactggtgagcaccacrctagacgaccagagatccctgggt

SEQ ID NO: 9759 - DNA, 50 bp, homo sapien
acgatttactccattgtcagccttcygaaaggacttgagattggtgggac

SEQ ID NO: 9760 - DNA, 50 bp, homo sapien
ataaatgctctcattttagagcctasgaatttgaaattaattcatacact

SEQ ID NO: 9761 - DNA, 50 bp, homo sapien
atttatttaaggagaccaagatcaartgtgtcagttgagaacatgcaaat

SEQ ID NO: 9762 - DNA, 50 bp, homo sapien
ccatttactgctatatattaaataartaggcaactgtgaaatgcatcttt

SEQ ID NO: 9763 - DNA, 50 bp, homo sapien
atgattcaagggtacaatgtggtcaygaaaatggaagacagtgtcaccaa

SEQ ID NO: 9764 - DNA, 50 bp, homo sapien
ggagtgcctgaatgtgtgtaaagggrattgatctatgtgataatgtctga

SEQ ID NO: 9765 - DNA, 50 bp, homo sapien
atttttaaaggcacacatacaatcaytattttaaatcctatggcttggaa

SEQ ID NO: 9766 - DNA, 50 bp, homo sapien
agtgcagaacaaattatttatgacaygtgggattagatctaaaatgactt

SEQ ID NO: 9767 - DNA, 50 bp, homo sapien
tccctctctgagaatctatgaaatgmagtccatcagaaacacagcattcg

SEQ ID NO: 9768 - DNA, 50 bp, homo sapien
tgagctggagtccatgacaccaattsaaaagatagagggctggctttcat

SEQ ID NO: 9769 - DNA, 50 bp, homo sapien
ccttcaggcctagactggagtcctcrcactgctactaactgagaagcttt

SEQ ID NO: 9770 - DNA, 50 bp, homo sapien
tgaaagagttaataacctcataatgraacaggcaagtccaccaggctaat

SEQ ID NO: 9771 - DNA, 50 bp, homo sapien
gggcaaaagtgctctatttgtataargggaggaaaagaagaggtgactga

SEQ ID NO: 9772 - DNA, 50 bp, homo sapien
atggaaggcctgctaaatatatcccyggagtgctttgctttctaagggca

SEQ ID NO: 9773 - DNA, 50 bp, homo sapien
atgtttgaggtcaatatggtaaacayaggaaaagtgcaaagcaagaagag

SEQ ID NO: 9774 - DNA, 50 bp, homo sapien
cacctactgagacttattcacacaartctaatccaatatggtaatcagca

SEQ ID NO: 9775 - DNA, 50 bp, homo sapien
tttcctaaatcatacaatacactcawctataaaacagaggaaaatctact

SEQ ID NO: 9776 - DNA, 50 bp, homo sapien
cactgttggagacagtgttttatctkaatagcttttttatgtaacactgt

SEQ ID NO: 9777 - DNA, 50 bp, homo sapien
atctttgcaaataaactctcctccartgatcctattttgaatatgccatc

SEQ ID NO: 9778 - DNA, 50 bp, homo sapien
tggttttgtttgtttccaaacttatwaaattagatgtcttttcttctttc

SEQ ID NO: 9779 - DNA, 50 bp, homo sapien
ggtgtctatgattagatcctcagatraaatataggttctcttcagcagac

SEQ ID NO: 9780 - DNA, 50 bp, homo sapien
ccagtgtgaccttagcctcagttcawccttcctgaaatccaccataccaa

SEQ ID NO: 9781 - DNA, 50 bp, homo sapien
gtgaatacaagaaaaatcaattatckaagatgcaggtaaaataatttccc

SEQ ID NO: 9782 - DNA, 50 bp, homo sapien
acttgatctcagaagagaaatgagaygtgtttaaatgttaaagtaatgca

SEQ ID NO: 9783 - DNA, 50 bp, homo sapien
cattccaaggtacatcttcagggtayaaagccaggactctgagcagctat

SEQ ID NO: 9784 - DNA, 50 bp, homo sapien
aatttcgttatctcaatagtggagtraaaaggtgtggacgttgaaagatg

SEQ ID NO: 9785 - DNA, 50 bp, homo sapien
aaactgtacctaggaagttatcactraaaactgttaagacttagctataa

SEQ ID NO: 9786 - DNA, 50 bp, homo sapien
aagcttaattcacaaggagttgtcaygtgctctgggtgaactaggagcat

SEQ ID NO: 9787 - DNA, 50 bp, homo sapien
gtgcagtatcctactcaataaatgakgtttactttagtctcttagttctt

SEQ ID NO: 9788 - DNA, 50 bp, homo sapien
ttgaaaggaaaactatttattcagargccataactgaccatgagtctaga

SEQ ID NO: 9789 - DNA, 50 bp, homo sapien
gaacctaagagctatgcccgaacacraaagctgattcttaaatgatggga

SEQ ID NO: 9790 - DNA, 50 bp, homo sapien
ctctgcctgcgaacttctatattcarctgcctacataacatccccatttg

SEQ ID NO: 9791 - DNA, 50 bp, homo sapien
ccttttccttttcctccttcactacmaatatcactaccatgagatctgtg

SEQ ID NO: 9792 - DNA, 50 bp, homo sapien
tgtttgaagcttgaagtgaatgcgargaatatccaattttaaagcacatt

SEQ ID NO: 9793 - DNA, 50 bp, homo sapien
tgacttttcaatcccatacatctgcragtcgaaggcggcccatccaagct

SEQ ID NO: 9794 - DNA, 50 bp, homo sapien
aagtgctccggaaaggctaagacagkctgcttcagtgtgcagatgagagc

SEQ ID NO: 9795 - DNA, 50 bp, homo sapien
acattagaaggtggtagaaaacatartaacagccgtgcacggtggctcgt

SEQ ID NO: 9796 - DNA, 50 bp, homo sapien
ctgacaggaatagcagcccgttgaakttatgtcctccatcctcaaagttc

SEQ ID NO: 9797 - DNA, 50 bp, homo sapien
tagttaatgcagtgtacaggataagmaatggtgccctgtgcagagttagc

SEQ ID NO: 9798 - DNA, 50 bp, homo sapien
ggacccagcagaagatgggttgagayacataaatgcacctgatccaaaga

SEQ ID NO: 9799 - DNA, 50 bp, homo sapien
tctttgatgttctattaagtgaaaartgtcattaagttacatgttaaaat

SEQ ID NO: 9800 - DNA, 50 bp, homo sapien
cgctgctggtagagggtaatgaacaygcaagtaaacaccactcctttctc

SEQ ID NO: 9801 - DNA, 50 bp, homo sapien
aaaaaatgacttgagcttcttgacaratatgtgagactcaaaatggcatt

SEQ ID NO: 9802 - DNA, 50 bp, homo sapien
tctaaggaatatacagctcatcaacratgtatttctttgtatttcctttc

SEQ ID NO: 9803 - DNA, 50 bp, homo sapien
ctagcagcataatcataacattagcratcagataagagccgcctacttca

SEQ ID NO: 9804 - DNA, 50 bp, homo sapien
aattctcaagattcctattaaaacaytattggtgaatactgatcattttg

SEQ ID NO: 9805 - DNA, 50 bp, homo sapien
tttcaacatttcaaaaagcctaacaraagtgatacatatacctgcactga

SEQ ID NO: 9806 - DNA, 50 bp, homo sapien
gcacacagataaatacagtagagaayggaacaggccctttgaggtcatat

SEQ ID NO: 9807 - DNA, 50 bp, homo sapien
attggactcataataccttccgagtraacaatcctgatgccaatcccaat

SEQ ID NO: 9808 - DNA, 50 bp, homo sapien
ctcaggaagaatcaaaaggaaatgcracaaggagtcataaaaaaaaaaac

SEQ ID NO: 9809 - DNA, 50 bp, homo sapien
gaagacacacatagaaggaagaagayggtaaaagaacagagggggaaaac

SEQ ID NO: 9810 - DNA, 50 bp, homo sapien
tcggttcagagcccgctcactataamaacagactaagagtcaaaatgaga

SEQ ID NO: 9811 - DNA, 50 bp, homo sapien
agcagcaaaggctcaatattacttamcgatttgacgaaaggcctcacctt

SEQ ID NO: 9812 - DNA, 50 bp, homo sapien
ggacaaaattctatatacacatctaygaacttgagcttgttaatgttatt

SEQ ID NO: 9813 - DNA, 50 bp, homo sapien
ggcaatgtaggtcccttggtacaagwctgactcgtaggcattgtaattgt

SEQ ID NO: 9814 - DNA, 50 bp, homo sapien
tacctctcccccagtaatctgccaartcgagttgatttttccttcttggc

SEQ ID NO: 9815 - DNA, 50 bp, homo sapien
cctatatatgcacagtgatgcatacyagttaaacactcgtaaatttgttt

SEQ ID NO: 9816 - DNA, 50 bp, homo sapien
gtgggcctctgggttgggccaagaawttcagactgggcgccatgaccaag

SEQ ID NO: 9817 - DNA, 50 bp, homo sapien
tggctgccacaaatgaaagaccttgragtccaaatactcctctctcaaag

SEQ ID NO: 9818 - DNA, 50 bp, homo sapien
cccgcacaggctgccttacgtaccastggatggtttcttggctgatggcg

SEQ ID NO: 9819 - DNA, 50 bp, homo sapien
tggcagccagattaaaatcggagaasaatttctgccaggcttctaggaac

SEQ ID NO: 9820 - DNA, 50 bp, homo sapien
actttaactttggagctttggaagamaatcaagtttatacttcataagat

SEQ ID NO: 9821 - DNA, 50 bp, homo sapien
tctagcgtattaagagccatacttaygcttgtattttcttaagcttatca

SEQ ID NO: 9822 - DNA, 50 bp, homo sapien
gcaggagggcttccatttccatacaycggattaaatgcttttccttctca

SEQ ID NO: 9823 - DNA, 50 bp, homo sapien
cattcttacttgattacttgtagaargacacattccaaagatactaacac

SEQ ID NO: 9824 - DNA, 50 bp, homo sapien
tagttgaaaagagtggtaatatataygtgagaagataaattggaaaacta

SEQ ID NO: 9825 - DNA, 50 bp, homo sapien
ttcttcaactatgtctatcctgctaktaaagccatatattaacatctaaa

SEQ ID NO: 9826 - DNA, 50 bp, homo sapien
taagctactgttttattgggtctccragttagtaccttagcctttgctct

SEQ ID NO: 9827 - DNA, 50 bp, homo sapien
gaggagtcagtaactgtgtcacgatwagatttttatttacctctgtttct

SEQ ID NO: 9828 - DNA, 50 bp, homo sapien
cttgctctaggtaacacagagcataratagtgtcatgggatccaaaccca

SEQ ID NO: 9829 - DNA, 50 bp, homo sapien
gctccaggtcaaaagttaagccacartccttactggagacatggtatgga

SEQ ID NO: 9830 - DNA, 50 bp, homo sapien
tcaaaaacctgcaggtgaccattaayctttgagacagacaatagagggaa

SEQ ID NO: 9831 - DNA, 50 bp, homo sapien
ctactcggtagatggacaatgataaraatgatggcaacggagcaaaccct

SEQ ID NO: 9832 - DNA, 50 bp, homo sapien
aaatgtttcaggaaataatttctatragttgattctgaaaataaatcagt

SEQ ID NO: 9833 - DNA, 50 bp, homo sapien
aaaaaaggaaagatgtcctgaggcastatgtgtacctgcatgaaaactgg

SEQ ID NO: 9834 - DNA, 50 bp, homo sapien
agtggtcagggatcctctgtcttcayagaatctcgagtgagcagccaaca

SEQ ID NO: 9835 - DNA, 50 bp, homo sapien
ataagagaataaaagaagagctataytaaagatgagatataacgcttaac

SEQ ID NO: 9836 - DNA, 50 bp, homo sapien
cagcgggagtggagtagtgctccacrgtctgacatcacagaaacaggagg

SEQ ID NO: 9837 - DNA, 50 bp, homo sapien
ctattatcagtttgttttctatccaygaggttggattattttgattcttt

SEQ ID NO: 9838 - DNA, 50 bp, homo sapien
ttttggttgggagttctgaattacaycacacattcccctgcctgcttaac

SEQ ID NO: 9839 - DNA, 50 bp, homo sapien
ggcacagtgctgcctgctgatgatayaacaatgaaaaaaaatggtatttc

SEQ ID NO: 9840 - DNA, 50 bp, homo sapien
agaaaagcaaaataaaaacacatcasgaatgcagataaaccaatatatgt

SEQ ID NO: 9841 - DNA, 50 bp, homo sapien
tgaagggagaaatatttgtgctgaaycttaaactcaagtaggcgtttatc

SEQ ID NO: 9842 - DNA, 50 bp, homo sapien
aagcttggcttttggggggtgtctcmgactcaactggtaaacagtttcct

SEQ ID NO: 9843 - DNA, 50 bp, homo sapien
tgcaaaaagatgaatatgacctatcrcacagttcgtgctgcatttagttt

SEQ ID NO: 9844 - DNA, 50 bp, homo sapien
ggcacacagcccaggctcaaatgaayggcatatgtatgtaaactgcttat

SEQ ID NO: 9845 - DNA, 50 bp, homo sapien
atgcaggatgagtgcagatataacamaaaaggttttagaaacctcctagt

SEQ ID NO: 9846 - DNA, 50 bp, homo sapien
taactctgattctaggtaatcaccakgttaatgttaacttattgggattt

SEQ ID NO: 9847 - DNA, 50 bp, homo sapien
tgtttcttcttgccctacatacttcraaagcccttggagaaatcctacag

SEQ ID NO: 9848 - DNA, 50 bp, homo sapien
ctccagataacattaggtagacagaytaaagatctcccaaagttgttaca

SEQ ID NO: 9849 - DNA, 50 bp, homo sapien
tgattttgcataagcctttaaattcraattacaaatcttgaaattctgtc

SEQ ID NO: 9850 - DNA, 50 bp, homo sapien
ttcctccttttgatatctacattggraaaaatataatatacttagtgagt

SEQ ID NO: 9851 - DNA, 50 bp, homo sapien
tttttacacagcagtagataataccyatccttggatccaattgcttgcag

SEQ ID NO: 9852 - DNA, 50 bp, homo sapien
agctgtcagccaggtgaaggaactgyaagcaattggatccaaggataggt

SEQ ID NO: 9853 - DNA, 50 bp, homo sapien
aacaaggtcatacagcagataccagwataaatacctaacttcagtggcca

SEQ ID NO: 9854 - DNA, 50 bp, homo sapien
agggatccattcaaggcaggaaaaaygagtctgttagagagggaagaaga

SEQ ID NO: 9855 - DNA, 50 bp, homo sapien
atgctcaataaatattaggtaactamagtttgcttgcagattgtgggtaa

SEQ ID NO: 9856 - DNA, 50 bp, homo sapien
tttgtcttttgtaaaatagaggaaakgttctatgccttacacttatccta

SEQ ID NO: 9857 - DNA, 50 bp, homo sapien
acatcctagtgagggtcatctggtcratctgagtgctaagctccagctcc

SEQ ID NO: 9858 - DNA, 50 bp, homo sapien
gcttcacagagttcacagacgaatcygaataacagccttaggatgaagtc

SEQ ID NO: 9859 - DNA, 50 bp, homo sapien
cctctcaggctaagccttcctgacaygtggtgtatgaccttcctttgctc

SEQ ID NO: 9860 - DNA, 50 bp, homo sapien
agaagtagagtttcttcctctttaayactaggattttactgactcttttc

SEQ ID NO: 9861 - DNA, 50 bp, homo sapien
tatcagtatgtgcatgatactgaacrgtaaataccaagggaatgagtata

SEQ ID NO: 9862 - DNA, 50 bp, homo sapien
tggaaatgaagcctccctgaactgtraaggagtaggagggaagaattaga

SEQ ID NO: 9863 - DNA, 50 bp, homo sapien
aataacttgaggccacttccaactaygcaggaacaatactacttttcaga

SEQ ID NO: 9864 - DNA, 50 bp, homo sapien
cctgggactgagcgaccgggaagccrctgtgttctgcgaggctcagcaca

SEQ ID NO: 9865 - DNA, 50 bp, homo sapien
ccactccaagtccttaactacctggrcataagctaatgattcacaagctt

SEQ ID NO: 9866 - DNA, 50 bp, homo sapien
tttaactagtgaatacaatttataarcatgattctcaagcgtctcaactg

SEQ ID NO: 9867 - DNA, 50 bp, homo sapien
agagctggctcccaggatggtgataygaggagccaggtgcccttggccag

SEQ ID NO: 9868 - DNA, 50 bp, homo sapien
gaagcttgcattccagttgaagagakaagatgaatggatagaaatctgaa

SEQ ID NO: 9869 - DNA, 50 bp, homo sapien
ttaaatatctaccgtgtgcccagtcratcaccttgtagtgtgcagaacag

SEQ ID NO: 9870 - DNA, 50 bp, homo sapien
acccagatttcctctcctcctatcayggatcactcattctggcacttttt

SEQ ID NO: 9871 - DNA, 50 bp, homo sapien
ggaactttaaagtattttgagcctckaagggaatgtgaattgtgagacct

SEQ ID NO: 9872 - DNA, 50 bp, homo sapien
tctttaaagctttattgaggtcaaaytgatatacaaaatattgcacatac

SEQ ID NO: 9873 - DNA, 50 bp, homo sapien
tccccctaagagattttgactctgcratccaacctcaaccacacgggaga

SEQ ID NO: 9874 - DNA, 50 bp, homo sapien
tagtcaaattataacataaacacaawcagctgggcctgatggctcacgcc

SEQ ID NO: 9875 - DNA, 50 bp, homo sapien
ctacaagaaaagcacgtgagagatgsactgagaggtggcaccgtcagaac

SEQ ID NO: 9876 - DNA, 50 bp, homo sapien
gaagcagaaaggaatagccctttaaygccatgttctgtcttctaatagtt

SEQ ID NO: 9877 - DNA, 50 bp, homo sapien
gttatttaaatcacacagttttgagwatttcagtattaatatgaatttat

SEQ ID NO: 9878 - DNA, 50 bp, homo sapien
tcctggattagcatcttgcaaaagastaaaatcagagtccatccttaaat

SEQ ID NO: 9879 - DNA, 50 bp, homo sapien
agacgtggaatggattctccctcagrctcttgaaaggaaccaaccctgct

SEQ ID NO: 9880 - DNA, 50 bp, homo sapien
tttccatatgccttttctgactccgmaaggtgctccctccctttcaccta

SEQ ID NO: 9881 - DNA, 50 bp, homo sapien
ttatttgataagtgcaatgacataawtaatgttccaaattaagaaaaaaa

SEQ ID NO: 9882 - DNA, 50 bp, homo sapien
attgcatagacctcacttaataatasaccagaacttataaatttagtctt

SEQ ID NO: 9883 - DNA, 50 bp, homo sapien
ggaaagaagccgtctccataatataraagtgtaaagtaaagcagcaagtg

SEQ ID NO: 9884 - DNA, 50 bp, homo sapien
tggctaagctacctgccaacaaggaygatttctccaggtataaagcttta

SEQ ID NO: 9885 - DNA, 50 bp, homo sapien
ttctgacagcaagagtgaatcaacasaaaatgaatcacacaaagacacca

SEQ ID NO: 9886 - DNA, 50 bp, homo sapien
tcatgtagcagaaataacaaacacaktgggatcagacagactgtcaagtt

SEQ ID NO: 9887 - DNA, 50 bp, homo sapien
gtacacaatttcagaatggcaattasgctgtaacgactatcttttcctcc

SEQ ID NO: 9888 - DNA, 50 bp, homo sapien
atttactgtcaagtgtttcgccataraattaatataaggatactggaatt

SEQ ID NO: 9889 - DNA, 50 bp, homo sapien
gtcctggaagcactgtcctgatttasagatggagaaaaatgaagcttaag

SEQ ID NO: 9890 - DNA, 50 bp, homo sapien
aaaaaagacattttaatgctgactaktagaggatattaagaagtttttgc

SEQ ID NO: 9891 - DNA, 50 bp, homo sapien
cagagatttttttttagatacatccratacttcagggcacaaaatcagat

SEQ ID NO: 9892 - DNA, 50 bp, homo sapien
aaaatcccgtcatcttgctgtctaayataacctaatcatgcaagtgatat

SEQ ID NO: 9893 - DNA, 50 bp, homo sapien
tgcactcagaatttctataggtgtgyacttgattgacaggagaactaaag

SEQ ID NO: 9894 - DNA, 50 bp, homo sapien
ttatgaaaaactgacaaaaattaaaygttgagaaattatgttgaaagtaa

SEQ ID NO: 9895 - DNA, 50 bp, homo sapien
accaatacaagtaattcttaaatccmaactggccaaaatacaaaccacag

SEQ ID NO: 9896 - DNA, 50 bp, homo sapien
atgctttctggatgactgtcgatcaygagggagctaaggtgcaggagttt

SEQ ID NO: 9897 - DNA, 50 bp, homo sapien
ctgacttcctcacgtgtaagtaaacmacttgcaggcaaatcacttagcag

SEQ ID NO: 9898 - DNA, 50 bp, homo sapien
caacagctcacactgactctttctcraaacctcaattatttcatcactac

SEQ ID NO: 9899 - DNA, 50 bp, homo sapien
aaaaggtatcaatccttggtttttamactgtggtccatctccagactcta

SEQ ID NO: 9900 - DNA, 50 bp, homo sapien
ctagactgaagcacaggtaactacaygagtcaataaagagtaagtaggct

SEQ ID NO: 9901 - DNA, 50 bp, homo sapien
ttctttttgcttcaggtcaaatattraataaacctagagcatataattaa

SEQ ID NO: 9902 - DNA, 50 bp, homo sapien
cctggcgagttacatgttttttaaakgataggtatatgaaaggttcagat

SEQ ID NO: 9903 - DNA, 50 bp, homo sapien
ggggcagggagaggcctcacaagatyaggaagctgaaagcctgctctccc

SEQ ID NO: 9904 - DNA, 50 bp, homo sapien
tcagtgacgaatgtctcccagtgacragaataaggatgaggaagagacgg

SEQ ID NO: 9905 - DNA, 50 bp, homo sapien
gagtatggctctaagtgcttcactaygtgtgcaatgacctcatcttctca

SEQ ID NO: 9906 - DNA, 32 bp, homo sapien
ccggtgtcccatcacarcctctgtaacagcca

SEQ ID NO: 9907 - DNA, 50 bp, homo sapien
atttgatcaccagggagcaactgaaytgtatgtagtatttttcctatggc

SEQ ID NO: 9908 - DNA, 50 bp, homo sapien
gacacagacgggtgtcataatcctaygtgctttccatcatcatcaaaggt

SEQ ID NO: 9909 - DNA, 50 bp, homo sapien
tgctttccatcatcatcaaaggttayatctcaccatgttctataaacatg

SEQ ID NO: 9910 - DNA, 50 bp, homo sapien
agaatcacaactaagccagcatattraaaatggtttaaggatctccagtg

SEQ ID NO: 9911 - DNA, 50 bp, homo sapien
ggacctgtgtataccaaggactgacratatacataatagatgctcagaaa

SEQ ID NO: 9912 - DNA, 50 bp, homo sapien
aagtgacaaagtgagataaactgaawatttactagaatcacctctggaaa

SEQ ID NO: 9913 - DNA, 50 bp, homo sapien
gtgagggtctgtcttgggtaacctayagatattccttaccagcaaagacc

SEQ ID NO: 9914 - DNA, 50 bp, homo sapien
gagaagggtttaggtttgagttagawcttggagaacatcgaatgaatggt

SEQ ID NO: 9915 - DNA, 50 bp, homo sapien
atgtcatggtgcttgtaaaaacccaygtctctgtgtgtcctcagccttcc

SEQ ID NO: 9916 - DNA, 50 bp, homo sapien
aactggtttctaccactttcggcctsaagtgacagtgttttttaacgttg

SEQ ID NO: 9917 - DNA, 50 bp, homo sapien
atccctaagcttgtgcagtgattaaygattttcatgtcttttctatttgc

SEQ ID NO: 9918 - DNA, 50 bp, homo sapien
agcacttcaggaacatattagttctyaacgtgttcattttcttcagtccc

SEQ ID NO: 9919 - DNA, 50 bp, homo sapien
ctctttcttgatctggatggatttargagtgtttcctttatgataattca

SEQ ID NO: 9920 - DNA, 50 bp, homo sapien
caaaaagatggacagtccaagatcaytcaacaaatatcaaccgctggatt

SEQ ID NO: 9921 - DNA, 50 bp, homo sapien
aaatttatgcaaagtgttaggacagyatatggcacaaagtaatatattat

SEQ ID NO: 9922 - DNA, 50 bp, homo sapien
tatgctaggtgctgtcaatcatttawccctcatgaccttggggtggtaat

SEQ ID NO: 9923 - DNA, 50 bp, homo sapien
gccacccaactttgcgccctgctcgraagtctgctcaggcgtgcaggtgt

SEQ ID NO: 9924 - DNA, 50 bp, homo sapien
gagagccatggaaggtttttaatgcrgaagataggagattgattcattca

SEQ ID NO: 9925 - DNA, 50 bp, homo sapien
aaaagaatataatcccacttcaatawgtatcatatcctttaggagtctta

SEQ ID NO: 9926 - DNA, 50 bp, homo sapien
catacacactttagccagtttggcaytctagtccctaagaggtggataat

SEQ ID NO: 9927 - DNA, 50 bp, homo sapien
ctttgcccagatccacaatcattccygaacttactgaaagtactgtcgca

SEQ ID NO: 9928 - DNA, 50 bp, homo sapien
aaagctttccatgagatcacgtgctkactgagaaggtccatttcaaggat

SEQ ID NO: 9929 - DNA, 50 bp, homo sapien
aatttaaaaaatcattttataagtgragactaaactagaagatacacaag

SEQ ID NO: 9930 - DNA, 50 bp, homo sapien
cctaataagtacttagatgttttaaraggcaaatagtctcacacaaacca

SEQ ID NO: 9931 - DNA, 50 bp, homo sapien
ccattgacatgaggaccagtttaaayagatgattacaaaaataagaaatt

SEQ ID NO: 9932 - DNA, 50 bp, homo sapien
gaacttcaccctaagaataggactascattccagattggaagggcaccat

SEQ ID NO: 9933 - DNA, 50 bp, homo sapien
tttctgtcttctctttctacaaactmaacggataacctggcttttccatt

SEQ ID NO: 9934 - DNA, 50 bp, homo sapien
agacataagtttaatagacacagggmaccataaaacgtggacagcaggga

SEQ ID NO: 9935 - DNA, 50 bp, homo sapien
aagctcacagaattcttgagagatcyaatgagataatatgtaaaataagc

SEQ ID NO: 9936 - DNA, 50 bp, homo sapien
gctcaggactgaaatgacctcttcaygcatagttcccggagttgtttaag

SEQ ID NO: 9937 - DNA, 50 bp, homo sapien
tgggctctcttcctttgcatcctaayaggttatgagtctctgaatcccat

SEQ ID NO: 9938 - DNA, 50 bp, homo sapien
tgtgaagttttggcaatttgacttamgatacaataatggtttagcccatt

SEQ ID NO: 9939 - DNA, 50 bp, homo sapien
cacccaccttcagccaggctctttamctacctctccagggagaaaacagc

SEQ ID NO: 9940 - DNA, 50 bp, homo sapien
aacagatttaagtaacagaaacaatmaggtagagtgcatgtttgaagaat

SEQ ID NO: 9941 - DNA, 50 bp, homo sapien
gtggagacaaactatagtgtacaaaygattaaaatactgttaatgatgat

SEQ ID NO: 9942 - DNA, 50 bp, homo sapien
ggtacatatttagaactctaagcccraacatttgagaatacacacggcac

SEQ ID NO: 9943 - DNA, 50 bp, homo sapien
gaccacagaactggcttggatccgamccgacgaatgagatctgaaagcgg

SEQ ID NO: 9944 - DNA, 50 bp, homo sapien
gcttttatcagttatatttgtggcakgaattaaatttatgacagatttac

SEQ ID NO: 9945 - DNA, 50 bp, homo sapien
cacagcatttttgctgttgctgtaaytgccaggagagcagggaagtaatc

SEQ ID NO: 9946 - DNA, 50 bp, homo sapien
acacagtatctcatattaattctacrgcagtctgtcagcaaagtattctt

SEQ ID NO: 9947 - DNA, 50 bp, homo sapien
tggaacgttttccagaacttgactcraatttaacatgagttgcgtgattt

SEQ ID NO: 9948 - DNA, 50 bp, homo sapien
tgaatattttaactgagataagaaayacagcaacaaaaatggtgttggga

SEQ ID NO: 9949 - DNA, 50 bp, homo sapien
gtgaagaataagcataacacgtatamaagacattccctgattttggaaag

SEQ ID NO: 9950 - DNA, 50 bp, homo sapien
aaattgccaaaacttcacaggctacyaaaagttaacccttattgaatgaa

SEQ ID NO: 9951 - DNA, 50 bp, homo sapien
aaaacaaacacaataacacctcttayagacagcagtatacatgattagaa

SEQ ID NO: 9952 - DNA, 50 bp, homo sapien
gctgatgacaataaccctgcactaawgacagttctgcaatgggtcccttc

SEQ ID NO: 9953 - DNA, 50 bp, homo sapien
ataaggcttattctaaaatcgaagcracgcccacctaacattttcctttc

SEQ ID NO: 9954 - DNA, 50 bp, homo sapien
agaagagctaaaggacatgaattgayagtacactttgcgtggtggtacaa

SEQ ID NO: 9955 - DNA, 50 bp, homo sapien
tgcccaggagggtctcgcactggaartaaaatgtttagcccacccacagg

SEQ ID NO: 9956 - DNA, 50 bp, homo sapien
tgggacactgtgtgtaactaggacarattgtgttttttagaaatagttaa

SEQ ID NO: 9957 - DNA, 50 bp, homo sapien
tctgtgcctagcaaatcctagtaaayaactgataaatgcatgaataaaac

SEQ ID NO: 9958 - DNA, 50 bp, homo sapien
gccctgcctctttatagagcaaacartggatgctgattcctgtgccattc

SEQ ID NO: 9959 - DNA, 50 bp, homo sapien
cttgggagactgtattggtgatccargtgttatgagtaataatggcatga

SEQ ID NO: 9960 - DNA, 50 bp, homo sapien
ttccagttcccaaaattgtaactccrgatcatgccattattactcataac

SEQ ID NO: 9961 - DNA, 50 bp, homo sapien
aaacagcctttgcaaaattatgacartaggagaaacctgacatagttgac

SEQ ID NO: 9962 - DNA, 50 bp, homo sapien
cctgaaagtggccattaaaaatgcartgaagacctggaaatccccgatct

SEQ ID NO: 9963 - DNA, 50 bp, homo sapien
tgaatggtggaatgttttcttagaartgggacagcaataatgaaacataa

SEQ ID NO: 9964 - DNA, 50 bp, homo sapien
ttaggtaagcaaagactattcaaaamttagtacactttctgttctatggc

SEQ ID NO: 9965 - DNA, 50 bp, homo sapien
gaggaaatggcgtgtctggcgaaaayagtaagatgctgttgcaaacaata

SEQ ID NO: 9966 - DNA, 50 bp, homo sapien
aatagtactgtataaagaccacatayctaaattggaaactcaaagtttaa

SEQ ID NO: 9967 - DNA, 50 bp, homo sapien
aaatatcactcatgcctttgacgtasagcttataaatggatataaaagga

SEQ ID NO: 9968 - DNA, 50 bp, homo sapien
tgccataaaactatgtaagagttacyctatggcaaaatagacaacatcct

SEQ ID NO: 9969 - DNA, 50 bp, homo sapien
acaactactttcagtgcaagctaaawtaatgtaaaagcccatttcataaa

SEQ ID NO: 9970 - DNA, 50 bp, homo sapien
gactcagccctgcttcaagagcttayaaactagtggagaggatggcagtg

SEQ ID NO: 9971 - DNA, 50 bp, homo sapien
cttagccctagcttagtctaaattayattgctcaaatgagagatttctgc

SEQ ID NO: 9972 - DNA, 50 bp, homo sapien
aaataaaaaccctttatgagagttcycttgtgcaatgcttccagtgttta

SEQ ID NO: 9973 - DNA, 50 bp, homo sapien
aaataaagggacattccatcatgtgyatcctttctaagaacaaaagttca

SEQ ID NO: 9974 - DNA, 50 bp, homo sapien
gggtttttattttaaacatgatcacrcctttggtcaaatccatgccacgt

SEQ ID NO: 9975 - DNA, 50 bp, homo sapien
aaatctaggaagtcaatgtcagatcyaatttaacagggaaagcatgagcc

SEQ ID NO: 9976 - DNA, 50 bp, homo sapien
tgtgaccttcctaatgaggaaccaaraggataatgatgttcttggtgatt

SEQ ID NO: 9977 - DNA, 50 bp, homo sapien
ctaaggtggttaaaattgtttagtamgaggactcaagggcctccatttcc

SEQ ID NO: 9978 - DNA, 50 bp, homo sapien
agtcactgctctgcaaacagtatcaygctgtaaactccttggtagccccc

SEQ ID NO: 9979 - DNA, 50 bp, homo sapien
atttatgtcagcagaaaaacagaaakttaatctgcctaatcaactagaaa

SEQ ID NO: 9980 - DNA, 50 bp, homo sapien
ttgtcttttggtttctcagccctaaycattctctgttctaggtgactttc

SEQ ID NO: 9981 - DNA, 50 bp, homo sapien
ataaaaaagcaggtaatttaaataawatgggaatcgttcaagaaacggta

SEQ ID NO: 9982 - DNA, 50 bp, homo sapien
tgctgattcctgtgccattcccttamctgctccgtctcctattgccttgg

SEQ ID NO: 9983 - DNA, 50 bp, homo sapien
cataaggcacattggataagaaagarcgtggaggtaggaagactgatttg

SEQ ID NO: 9984 - DNA, 50 bp, homo sapien
tttagaactgaggaagagggagtctyaaatgactttggtgtttctagtat

SEQ ID NO: 9985 - DNA, 50 bp, homo sapien
tttggtttttatttgcttcttcttakgataagacccagttttattggaaa

SEQ ID NO: 9986 - DNA, 50 bp, homo sapien
taatgactggaaaatgccaggtaaaractggttatattgtatggtgagcc

SEQ ID NO: 9987 - DNA, 50 bp, homo sapien
gcagcagttctgaaaagtaactatayggcactgacagctgcgatagtttt

SEQ ID NO: 9988 - DNA, 50 bp, homo sapien
tgctgagcagcacctatagacaaggmacattacagtacagaacaatagca

SEQ ID NO: 9989 - DNA, 50 bp, homo sapien
ccaaaaccactgggtatgccaagaaygttaggcatccctaggcatgattc

SEQ ID NO: 9990 - DNA, 50 bp, homo sapien
cagtgctcctaaaacattcctcccarctacttctaaaggcagggggtgat

SEQ ID NO: 9991 - DNA, 50 bp, homo sapien
caacaaaacaaatatcagctacttayaataccgtatcaggaagttatttt

SEQ ID NO: 9992 - DNA, 50 bp, homo sapien
agacattaatcagtccattagtgagraaaaggccagaatttttaatcaaa

SEQ ID NO: 9993 - DNA, 50 bp, homo sapien
atcatttccctaggtaaagtaaatcmagtcaaccctagacaacaaaacaa

SEQ ID NO: 9994 - DNA, 50 bp, homo sapien
atattttttatttaaggaatacaaarctgccatgtgaagctcactgagat

SEQ ID NO: 9995 - DNA, 50 bp, homo sapien
atacacacaagacccaaccacagtaycttgaccgtgaatataataaataa

SEQ ID NO: 9996 - DNA, 50 bp, homo sapien
atgcaaatttgagaagaggaaatgarcttaaattgtgcttatgttaacaa

SEQ ID NO: 9997 - DNA, 50 bp, homo sapien
ccatgcatgtcccaccacaattaatragcaccttgccgtgtatcaaagat

SEQ ID NO: 9998 - DNA, 50 bp, homo sapien
agcctggtagaaatgccaagcctaarctgtatccataaataataatgact

SEQ ID NO: 9999 - DNA, 50 bp, homo sapien
aggtaagaatttatgaatgtgagtartaatgtctgcacagttgttctaat

SEQ ID NO: 10000 - DNA, 50 bp, homo sapien
aaagatcaagagcttaggtataagaygagcgcagtggctcatgcctgtca

SEQ ID NO: 10001 - DNA, 50 bp, homo sapien
ccagtatgttgtaagaaagccctcaracaaaggaggtaagaaacctagga

SEQ ID NO: 10002 - DNA, 50 bp, homo sapien
cggaatggcgtattttctttctaggrattgtaggctcccggccgccccct

SEQ ID NO: 10003 - DNA, 50 bp, homo sapien
cttattagaaaagtttctctacttamaattcataaaaatttgacccaatt

SEQ ID NO: 10004 - DNA, 50 bp, homo sapien
ctccctggaaacttatcggtcaaaaytttcactaaaggcagttttttgtc

SEQ ID NO: 10005 - DNA, 50 bp, homo sapien
aaatttctttgcaagttaattctcaycgtcaaagggaaaagacaaaaaat

SEQ ID NO: 10006 - DNA, 50 bp, homo sapien
ggaagtcaaggaatgcatgcaggacracaactagtacttgcaaggcactt

SEQ ID NO: 10007 - DNA, 50 bp, homo sapien
gttgactgagttccgcaacaaaaaastaagacgatctcaacagaactcat

SEQ ID NO: 10008 - DNA, 50 bp, homo sapien
atgttgtttgtttctatcagtcccaygtttgcacctgctgtttgttaaaa

SEQ ID NO: 10009 - DNA, 50 bp, homo sapien
tctcctagatggctcatggagtcaaraacaagcaagtctgaaagttaaga

SEQ ID NO: 10010 - DNA, 50 bp, homo sapien
acctctaacccatcatagtaagagayagactttaagtaattcaatcagtt

SEQ ID NO: 10011 - DNA, 50 bp, homo sapien
gatctgtgcattcttaccctgagtascgttgtttcctcatctatcatagg

SEQ ID NO: 10012 - DNA, 50 bp, homo sapien
gttttgcatacttcgattgttcttamccttgagagatactataaccactt

SEQ ID NO: 10013 - DNA, 50 bp, homo sapien
aaaacttgtacacatagacaatagartaggttggagaattgtgtcatttt

SEQ ID NO: 10014 - DNA, 50 bp, homo sapien
ccatattcattatgacagaccatgaratgatttgccaagtcagcctcttg

SEQ ID NO: 10015 - DNA, 50 bp, homo sapien
agagagaactgaattgaagtcatatraagctctaaattttatttgagtgt

SEQ ID NO: 10016 - DNA, 50 bp, homo sapien
cttaaattttctacctatttcttttmaaaaatctggctgtttattatcct

SEQ ID NO: 10017 - DNA, 50 bp, homo sapien
cagttctctcttagaaccttacaacygctcaagtagagatcacttcaaat

SEQ ID NO: 10018 - DNA, 50 bp, homo sapien
tttaaagtttgtctgtaattagaaayggaaactctcgtgtttttgttttg

SEQ ID NO: 10019 - DNA, 50 bp, homo sapien
aaaatgtaggttcgtcagaattaaaygtagacagaaacagctccatatac

SEQ ID NO: 10020 - DNA, 50 bp, homo sapien
cagtattttaatatactctctttcartacacttagtgatcccttattaca

SEQ ID NO: 10021 - DNA, 50 bp, homo sapien
ctcttagaagataattttctgaatgyatctgaattggcagtggagaccga

SEQ ID NO: 10022 - DNA, 50 bp, homo sapien
aattaacaagtattgacttagcatcsactgtaggaaaagcctagggctag

SEQ ID NO: 10023 - DNA, 50 bp, homo sapien
ttcagcactgggactccatgacttayactagcagtcacccaggttctcag

SEQ ID NO: 10024 - DNA, 50 bp, homo sapien
ttttgtgctccactctgccacacaartaccaatgcagagcagccaggcac

SEQ ID NO: 10025 - DNA, 50 bp, homo sapien
tgcaaaatatcagtcttattctatcrccattatatcattcaatattactc

SEQ ID NO: 10026 - DNA, 50 bp, homo sapien
ttccatgcagtggctgttcattcacygggctaagatggtgccacagagat

SEQ ID NO: 10027 - DNA, 50 bp, homo sapien
ttgggtcttcctttattatcttctaygtatcactttctctctaatatctt

SEQ ID NO: 10028 - DNA, 50 bp, homo sapien
agatgtatcatttggaggtagacackattttcagagcacaaaacagataa

SEQ ID NO: 10029 - DNA, 50 bp, homo sapien
aggttcccagaaaatcattcaagtayctcacagtcttatatcgtcctaaa

SEQ ID NO: 10030 - DNA, 50 bp, homo sapien
gagacaaattgaattaaagtggttamgtaaatactcttaggtgaaatttg

SEQ ID NO: 10031 - DNA, 50 bp, homo sapien
taacaaatatggtctgatgatctaayggaaaagggaaatagtacatatgt

SEQ ID NO: 10032 - DNA, 50 bp, homo sapien
agatattctacttgagatattctaaytgaccactaagcactatgtgccta

SEQ ID NO: 10033 - DNA, 50 bp, homo sapien
tgggctgatatcacctgattctcaaygtgtctcttatattcttagccttt

SEQ ID NO: 10034 - DNA, 50 bp, homo sapien
ctattcatactttagttttgacccayggttgcaattgtctttatgtgctt

SEQ ID NO: 10035 - DNA, 50 bp, homo sapien
ttgcaggaatccagcaagggcttcasagtacaatttagtttggagaactc

SEQ ID NO: 10036 - DNA, 50 bp, homo sapien
gagaagggattaaactgaataaagargaaataaggagaaatatccacgga

SEQ ID NO: 10037 - DNA, 50 bp, homo sapien
cacagcaaagagtaattgtttcataratgatatgatgcttatttttgtta

SEQ ID NO: 10038 - DNA, 50 bp, homo sapien
tataataggaaactttttggaattaygagctgttatttggtgatattgtt

SEQ ID NO: 10039 - DNA, 50 bp, homo sapien
tttctcttacctcaacatatttttcyctttataccaagaggatgtctgat

SEQ ID NO: 10040 - DNA, 50 bp, homo sapien
tttttctaattctaacaaaactttayatcagagaaaagagtgacattttc

SEQ ID NO: 10041 - DNA, 50 bp, homo sapien
ggtgaaacactctctacatcattcamaagggaacaagaatgggaggaaag

SEQ ID NO: 10042 - DNA, 50 bp, homo sapien
ccaattccacatggattggagaaggyaatgcaaagggccaatgaggctct

SEQ ID NO: 10043 - DNA, 50 bp, homo sapien
atgatgctgaaaaagggctttctaaytggtgatgttaagtcagtataaca

SEQ ID NO: 10044 - DNA, 50 bp, homo sapien
aaatatatccagtacctaaacataayagcaaaaactgtaaaactcttaga

SEQ ID NO: 10045 - DNA, 50 bp, homo sapien
tactgaacattccaagaatttactgmacattagttgacacaagggtctag

SEQ ID NO: 10046 - DNA, 50 bp, homo sapien
ttaaacattcctttaatatttaataygtgtatcttctggatatattatat

SEQ ID NO: 10047 - DNA, 50 bp, homo sapien
aaataatacctactaatgagacatcrgaatgaagataaaattagtgacac

SEQ ID NO: 10048 - DNA, 50 bp, homo sapien
ttatatgccatacagagaaatgagamctctagtgaaggcaacaaaatcaa

SEQ ID NO: 10049 - DNA, 50 bp, homo sapien
gatcacttgtgtgcaacctcaagagsaccttactagatgtctttaccaat

SEQ ID NO: 10050 - DNA, 50 bp, homo sapien
tatcatttaagatatgttgataataygatattggttttcaggtctgcatt

SEQ ID NO: 10051 - DNA, 50 bp, homo sapien
tggtccatgcatagccaattccgatsagaacatagtccaatcaagcagaa

SEQ ID NO: 10052 - DNA, 50 bp, homo sapien
caaagtataaagtgtctattcatgckacaagtatagatcaattgagaaag

SEQ ID NO: 10053 - DNA, 50 bp, homo sapien
gggaagaagaggatgccagactgacraattcaaattttgagcaaagagta

SEQ ID NO: 10054 - DNA, 50 bp, homo sapien
ttctttccactaaagatatgtaaccyaatttgtttttccagtaattctgg

SEQ ID NO: 10055 - DNA, 50 bp, homo sapien
ctgtatgaacagaacatgaatggtarctccccaaaatacctttacagagg

SEQ ID NO: 10056 - DNA, 50 bp, homo sapien
gtgcatcacagattgcctaacaccayggcatgactctagttttaaccatg

SEQ ID NO: 10057 - DNA, 50 bp, homo sapien
tctgtgtgtggcacaggataatagarcaataatgctgacagtcaccttgg

SEQ ID NO: 10058 - DNA, 50 bp, homo sapien
ttgggggcagggcacgggaaaggaargtactgaaatgagggtcagtggac

SEQ ID NO: 10059 - DNA, 50 bp, homo sapien
tttctcagatccctggccaaaatcartcttttcctgtggcttccttattt

SEQ ID NO: 10060 - DNA, 50 bp, homo sapien
taagtgcctgtaccataagcaaatgratatgattaaaagaatatgctggg

SEQ ID NO: 10061 - DNA, 50 bp, homo sapien
taccagttttacatatatacataacygacctgtaactttaagtatttgga

SEQ ID NO: 10062 - DNA, 50 bp, homo sapien
ctaataactttccaagggttatgcgracagtatgggcagagtcaaggttt

SEQ ID NO: 10063 - DNA, 50 bp, homo sapien
ctctctggctgtgtgctccactaagrctgtctacagtagaatagatgcta

SEQ ID NO: 10064 - DNA, 50 bp, homo sapien
caatgaaaccattcatgtaaagcaarcaaaggaaaatacagtggtgggtt

SEQ ID NO: 10065 - DNA, 50 bp, homo sapien
cttaaaatatcacttttcacttagargaacagagcttttggagaaatagt

SEQ ID NO: 10066 - DNA, 50 bp, homo sapien
agatagtggaaacacagctaggtacycattaaatcttaaagctccaaaat

SEQ ID NO: 10067 - DNA, 50 bp, homo sapien
tacaaaagtgaaatatcaataaccaygttggtagaaaaatgaagttcaat

SEQ ID NO: 10068 - DNA, 50 bp, homo sapien
cttcatcctgctgggaaaagctgaasaggcttcacttgataatatgtcca

SEQ ID NO: 10069 - DNA, 50 bp, homo sapien
aaacaacactttattttttcagttcrccactgaagacagacaagacacac

SEQ ID NO: 10070 - DNA, 50 bp, homo sapien
gcctctctgactgcaattctggatgyatgctacggaaggtgaatcagcca

SEQ ID NO: 10071 - DNA, 50 bp, homo sapien
tgattgctttgggaaaataaaaactsaccatgatgaggagatgtaggttt

SEQ ID NO: 10072 - DNA, 50 bp, homo sapien
tcagcagggggaaattaggatactargatactacagtcagtggaatgtgt

SEQ ID NO: 10073 - DNA, 50 bp, homo sapien
tactttgtggggtaaggaatattgawcattacaaagctcagtgtattttg

SEQ ID NO: 10074 - DNA, 50 bp, homo sapien
tgtctttcaggcacagttgactgcartgaaataaggcagaagtgaacaag

SEQ ID NO: 10075 - DNA, 50 bp, homo sapien
aaacatcttaagttcacgaatataarctacagcaacttacaacaaatgtt

SEQ ID NO: 10076 - DNA, 50 bp, homo sapien
atcaaagtactaaaaatagaaggcamtgaaatataagctaattctcaata

SEQ ID NO: 10077 - DNA, 50 bp, homo sapien
ctgcctcttagtagatatttgacaayggattaacattttgagtctcagtt

SEQ ID NO: 10078 - DNA, 50 bp, homo sapien
cacttttctccatctgacctagaaaygctggctgacagtttgtagtctaa

SEQ ID NO: 10079 - DNA, 50 bp, homo sapien
aagagttagtaatataaactgtgaayagatatcagtaaattacctattgg

SEQ ID NO: 10080 - DNA, 50 bp, homo sapien
tctcttacagggaaccaaacagaacmattcattgcttttcatctagtctt

SEQ ID NO: 10081 - DNA, 50 bp, homo sapien
ctgtgggacccattcatccttgaacrgcctaattatacttggttatatct

SEQ ID NO: 10082 - DNA, 50 bp, homo sapien
ttaccgttgactcaattttcttcacyaatcaaggctcattccttgaggca

SEQ ID NO: 10083 - DNA, 50 bp, homo sapien
attggagaaaacacatgaaaaattayaggactatactggtcaagaataga

SEQ ID NO: 10084 - DNA, 50 bp, homo sapien
agactcagtttcctcatttgcttcaygacaaatttggataatgctctctg

SEQ ID NO: 10085 - DNA, 50 bp, homo sapien
gtgttcatatcgcctgcggtactcaygtgaaatttttattgaatgcttac

SEQ ID NO: 10086 - DNA, 50 bp, homo sapien
tgtgtggtccttttggaggcatttcycttttaccattcaccgccttcgtg

SEQ ID NO: 10087 - DNA, 50 bp, homo sapien
gaatttgttgacctctgtacatgacmgtaaggtactttagcaatgttcaa

SEQ ID NO: 10088 - DNA, 50 bp, homo sapien
cctggcactacatacatcatacttakctgtgattgtctatccaaagctta

SEQ ID NO: 10089 - DNA, 50 bp, homo sapien
tataatgggaagcatacatgtttcasaaaggtctacctaccattccactg

SEQ ID NO: 10090 - DNA, 50 bp, homo sapien
ccaggtaccatgaaacactttttaaytgcaaatctgtacatccaacccag

SEQ ID NO: 10091 - DNA, 50 bp, homo sapien
caacctttgaaatagtatagaaatamgatatgcatgactggaacttgcat

SEQ ID NO: 10092 - DNA, 50 bp, homo sapien
catgaatactatataaacattgaaargtagttagtaatatacttgggtct

SEQ ID NO: 10093 - DNA, 50 bp, homo sapien
caaacttgcaagttataagctacacrgtattagcaaagcacaataaagtg

SEQ ID NO: 10094 - DNA, 50 bp, homo sapien
cacaatgatcaaatcagtgtttatayaatagaggtcaatcactacctcta

SEQ ID NO: 10095 - DNA, 50 bp, homo sapien
catgcactaatagcttgccacctacyagtgacatatattttgatgctatt

SEQ ID NO: 10096 - DNA, 50 bp, homo sapien
aggaaaagcaatagctgtggaaagckcatttataatgatttgttatgaaa

SEQ ID NO: 10097 - DNA, 50 bp, homo sapien
tgtgatgtaaaagtgctctgaaaaargacaaacactatacaaatatgtga

SEQ ID NO: 10098 - DNA, 50 bp, homo sapien
cagataaccctaggaggtaaatatgwagtagaatgtgtggcatagagtga

SEQ ID NO: 10099 - DNA, 50 bp, homo sapien
cttagattcggtccagttgttctaayaggctgactctaaaatttataaga

SEQ ID NO: 10100 - DNA, 50 bp, homo sapien
caggtggctcctcaactcacaagaarttcccgtgtggccgtgaatataat

SEQ ID NO: 10101 - DNA, 50 bp, homo sapien
aggaggagcacagttacattctaacrgagcccatgaataatgagcaacca

SEQ ID NO: 10102 - DNA, 50 bp, homo sapien
gagagaacacagagaggcctttctaygatgcctaccctaaagcttgtact

SEQ ID NO: 10103 - DNA, 50 bp, homo sapien
ggtgagcagagagcaaagaataaaartagaaggaggagaaaagagacaga

SEQ ID NO: 10104 - DNA, 50 bp, homo sapien
ggcgtttttaaccaacgtgcctacaygcgacctcgacacggagcaggggc

SEQ ID NO: 10105 - DNA, 50 bp, homo sapien
agaatgtcgtctcccagtgcacaagrccaatttctatagttacttagacc

SEQ ID NO: 10106 - DNA, 50 bp, homo sapien
agactttttgcatgtcctctatgaartgttaccgaagcaatgcctatact

SEQ ID NO: 10107 - DNA, 50 bp, homo sapien
tttgttatagcagcacaaacgatacsatggcatttgtgtatgttggttga

SEQ ID NO: 10108 - DNA, 50 bp, homo sapien
taaataaatggtagaccaatgataaragaggtctaagactgtgtcagagg

SEQ ID NO: 10109 - DNA, 50 bp, homo sapien
agcagtttcctgtaaagctgtcagawggtattgttaaatatcacatgtta

SEQ ID NO: 10110 - DNA, 50 bp, homo sapien
atatttacatacataatttgggtaaygtctatgtaatttccaagagatat

SEQ ID NO: 10111 - DNA, 50 bp, homo sapien
aacagaagcaagtattactgctaacrgattaatgaaggaggagagaagct

SEQ ID NO: 10112 - DNA, 50 bp, homo sapien
ttaaaattttatggctactacctttkaaacagaagcaagtattactgcta

SEQ ID NO: 10113 - DNA, 50 bp, homo sapien
caagctatcaaaagggtgttaaaacygaaatatataaagtagagaaagtt

SEQ ID NO: 10114 - DNA, 50 bp, homo sapien
aagattataggagtgaaccaccatcragctataaatattctagtgattca

SEQ ID NO: 10115 - DNA, 50 bp, homo sapien
aattaggtcgtagtgcagatgaaagsctccgtataaattaggaaggaaaa

SEQ ID NO: 10116 - DNA, 50 bp, homo sapien
aacaactacaaatttccttgaagatsaatattatctgtatgagtctatta

SEQ ID NO: 10117 - DNA, 50 bp, homo sapien
ctcttcactgttttccatacttgacraagattgaccatgtcagcttccag

SEQ ID NO: 10118 - DNA, 50 bp, homo sapien
tcaactaacaactgttccagccataragatgaaatcctcttcattcttac

SEQ ID NO: 10119 - DNA, 50 bp, homo sapien
tctatcttccccacattgtggacacrgaaaatggtctctatatcacttct

SEQ ID NO: 10120 - DNA, 50 bp, homo sapien
tcttatcactgaacaaatgatattayagcccaaaattagaaagggagaaa

SEQ ID NO: 10121 - DNA, 50 bp, homo sapien
tgtatctactttaaatgtgttaataytatagagttgcagaaatttgaagt

SEQ ID NO: 10122 - DNA, 50 bp, homo sapien
attgctggcctttcaggagcagagasgtatgatagaaaataatgccttca

SEQ ID NO: 10123 - DNA, 50 bp, homo sapien
cttttggggaagtatagggtgtttaygacaatgaatagggtaaaggtcaa

SEQ ID NO: 10124 - DNA, 50 bp, homo sapien
ccacaaaaattaaaagttaaaaaaaygcaatctaccatcttgtgtagaaa

SEQ ID NO: 10125 - DNA, 50 bp, homo sapien
tctaccatcttgtgtagaaataccamagaaggaaaatcagcacctgcaat

SEQ ID NO: 10126 - DNA, 50 bp, homo sapien
ctctaggtagtccataaaatatttargtgctctaattctagaaactcaag

SEQ ID NO: 10127 - DNA, 50 bp, homo sapien
catatttttttatttataaattcgcwacttgagtttctagaattagagca

SEQ ID NO: 10128 - DNA, 50 bp, homo sapien
cctctctgcatcacagtttcttcacyggcctggtcaccactaaaaattcc

SEQ ID NO: 10129 - DNA, 50 bp, homo sapien
cttgatctacatttcatcctctctcrctttctgttttttcttgaccctgt

SEQ ID NO: 10130 - DNA, 50 bp, homo sapien
agcaaacatgtcactagtttaaaatraggcaccctcatggcccagcaatg

SEQ ID NO: 10131 - DNA, 50 bp, homo sapien
ccttggtctattttcacagcacaggrataaggttgcacaagttagatatt

SEQ ID NO: 10132 - DNA, 50 bp, homo sapien
atagctgaggagctgtatccttaaarttatcagccttttatttattgaat

SEQ ID NO: 10133 - DNA, 50 bp, homo sapien
accatgtcatttaagttgaccataaytgcatcatgtggtttcactgatat

SEQ ID NO: 10134 - DNA, 50 bp, homo sapien
agatatttattttattgttattccartccaacattatgactctgtataac

SEQ ID NO: 10135 - DNA, 50 bp, homo sapien
gtattgccatcttaataatattacaycttccaatacatgatcatgggaga

SEQ ID NO: 10136 - DNA, 50 bp, homo sapien
gcctggcctcatcgaatagtttgtaraaatcttgtctctgtaaacccagc

SEQ ID NO: 10137 - DNA, 50 bp, homo sapien
gcaagacatggagcagaactgagaartagtgacaaggctgggtcagttgt

SEQ ID NO: 10138 - DNA, 50 bp, homo sapien
tgggttcccagaatcttgactctatraattagttaggttctacctagtcc

SEQ ID NO: 10139 - DNA, 50 bp, homo sapien
agatacatatattcaaatggaaggastaaaattaccaccacatgcagatc

SEQ ID NO: 10140 - DNA, 50 bp, homo sapien
accagtgaccctgggccaatttgcaycaggtacagttggagcgtcaagcc

SEQ ID NO: 10141 - DNA, 50 bp, homo sapien
gcaacaccctgaaaaattatctaatraaaaggcacaaagaaaaagcttgt

SEQ ID NO: 10142 - DNA, 50 bp, homo sapien
acttcattatccaaaacaaataatgracattccttaacattcctggaatc

SEQ ID NO: 10143 - DNA, 50 bp, homo sapien
aaactgaacacagtttttacagatayacaatatggagtgacttatataca

SEQ ID NO: 10144 - DNA, 50 bp, homo sapien
agcactctttgtaagtactgtgcaakgataaaggattttgaggccagttc

SEQ ID NO: 10145 - DNA, 50 bp, homo sapien
agcagaatggattgtggttattgtarcagttatccatttagctactaata

SEQ ID NO: 10146 - DNA, 50 bp, homo sapien
tccaaatgaagggtgaatcacagtarggttgaataataatcccctgctct

SEQ ID NO: 10147 - DNA, 50 bp, homo sapien
ggtgctcatcgtgatgagtacagaaraggattagcatgctcaactttcct

SEQ ID NO: 10148 - DNA, 50 bp, homo sapien
ggctttgggagtgggaactgaaaacyggaatatcatttcactggcatatc

SEQ ID NO: 10149 - DNA, 50 bp, homo sapien
tcagtttattagcaaccataataccmccttggatataacatagcatactc

SEQ ID NO: 10150 - DNA, 50 bp, homo sapien
tcttatttgataagggtgattaaaamaactatttcttcaaaattatcaag

SEQ ID NO: 10151 - DNA, 50 bp, homo sapien
agtaaaatatgttggataaatgctayagtgaaattaagcaacttttttta

SEQ ID NO: 10152 - DNA, 50 bp, homo sapien
gacacaatatattatacttaggaaargagacttgataattttgaagaaat

SEQ ID NO: 10153 - DNA, 50 bp, homo sapien
aggaaccaattgtaagctgttctcascaccagttgacctcttgctaaaag

SEQ ID NO: 10154 - DNA, 50 bp, homo sapien
gctctttgaggaaagagcacagctaygtttcgcatggaattccagtctat

SEQ ID NO: 10155 - DNA, 50 bp, homo sapien
gagctcagcttcctcatttggagggratattactgatcttgccaggggtt

SEQ ID NO: 10156 - DNA, 50 bp, homo sapien
aggtctggggattaataattgcatamgcatctatataatttacatatatt

SEQ ID NO: 10157 - DNA, 50 bp, homo sapien
aatggtaatcatgaagtagtggaagmacatagcactgggaatagaaagcc

SEQ ID NO: 10158 - DNA, 50 bp, homo sapien
aggcaacagaagcaaaagagtctcaygcgttgattatacaaatacagccc

SEQ ID NO: 10159 - DNA, 50 bp, homo sapien
agggtaaagaaggatattctttggayggaaaaagaaggctgtcaggttcc

SEQ ID NO: 10160 - DNA, 50 bp, homo sapien
aaactctgcagcttacgtttggataktagacatctaatgacttggctgac

SEQ ID NO: 10161 - DNA, 50 bp, homo sapien
cggccttcaagaatttacaagctgaraaaagagttacgtcatgtatttgc

SEQ ID NO: 10162 - DNA, 50 bp, homo sapien
ctataaaccaatagtctatgtagaaytaggatagaatgaacaaaatctat

SEQ ID NO: 10163 - DNA, 50 bp, homo sapien
aagagaacttagcttatcagcaaagrcgcaagtggtgctgagtggagaat

SEQ ID NO: 10164 - DNA, 50 bp, homo sapien
cacacgctgtggctattttgttttayacattgaacagcaatgttcattct

SEQ ID NO: 10165 - DNA, 50 bp, homo sapien
atagaacatgaggagaatccagtcaragacaaactatacaatagagaggg

SEQ ID NO: 10166 - DNA, 50 bp, homo sapien
cagatgacttgcacattctcaaatcrccagtgtactagaggagacctgac

SEQ ID NO: 10167 - DNA, 50 bp, homo sapien
ttttaaaagtaaatcattatggcagsagatagttatggagagagataatt

SEQ ID NO: 10168 - DNA, 50 bp, homo sapien
taaatgaacaaaaaacaatgacaacraaagggtggctagagcttaactag

SEQ ID NO: 10169 - DNA, 50 bp, homo sapien
caagaataaatcttcatttagaaaaytgatcagatggttggcttgataaa

SEQ ID NO: 10170 - DNA, 50 bp, homo sapien
gcataattaaaattactgtgtgttamgcactttactgggaattttgcaca

SEQ ID NO: 10171 - DNA, 50 bp, homo sapien
ctgttttttatttgatgtcactatayaaaattatgcttttgaatctatct

SEQ ID NO: 10172 - DNA, 50 bp, homo sapien
atggtagcatttttctacactctacmcaaaggaaattcactccacagagc

SEQ ID NO: 10173 - DNA, 50 bp, homo sapien
gaaatcttagcatgcaataggtgctyaacgcagatttttaaaattcagct

SEQ ID NO: 10174 - DNA, 50 bp, homo sapien
agggtcatggactttctagaatattsaaggtagaggtctccagctgtcat

SEQ ID NO: 10175 - DNA, 50 bp, homo sapien
cttataaattacagtgtgggtagaasagctccaaataaaacacggacacc

SEQ ID NO: 10176 - DNA, 50 bp, homo sapien
ctaaattcttgtttttgatttcacasggtgagtatattagcaaagtattt

SEQ ID NO: 10177 - DNA, 50 bp, homo sapien
aaagcaaggctcaatttacagtatarctcatagaaaagcagatgttcctg

SEQ ID NO: 10178 - DNA, 50 bp, homo sapien
gcttcatattaacaaccgtgttcaasgtctaagccctggtatgaaggtca

SEQ ID NO: 10179 - DNA, 50 bp, homo sapien
atttgacatataagcataaaatacarattagaactcggccattgggagat

SEQ ID NO: 10180 - DNA, 50 bp, homo sapien
tctgctgctgctactgctaaaatccrcttgccttcggacacagtttctca

SEQ ID NO: 10181 - DNA, 50 bp, homo sapien
gataacacatgctttcagagaaatayagcagttgagtttttaattttgtg

SEQ ID NO: 10182 - DNA, 50 bp, homo sapien
cctacttacatgaatttttagcaacyctattattttcaaataataccttg

SEQ ID NO: 10183 - DNA, 50 bp, homo sapien
gcttcccaagagattagctatctacsacaaaagaaacaagtatgtaagtt

SEQ ID NO: 10184 - DNA, 50 bp, homo sapien
gcaaaaatgtgttataatttaaggamcaaaatgagcacacaacaaaacta

SEQ ID NO: 10185 - DNA, 50 bp, homo sapien
atccagttgcctcttactcattcatyatctaacaaaggtgattcattagt

SEQ ID NO: 10186 - DNA, 50 bp, homo sapien
atttttgatttaatacaaaggctagmagctaagtagatttgaggctgtta

SEQ ID NO: 10187 - DNA, 50 bp, homo sapien
ggctagaagcaccaacattctaagartcatgtacaattattatgtctgtt

SEQ ID NO: 10188 - DNA, 50 bp, homo sapien
tgctggctgcagtttctctaggatgsaaaggaggtgataagtctttccca

SEQ ID NO: 10189 - DNA, 50 bp, homo sapien
agactgtgtctgaaagcctgcatcawagggaaagaagagaaccatggaag

SEQ ID NO: 10190 - DNA, 50 bp, homo sapien
tctgttccagtctacatactttttayggaactacaaatataaataagctc

SEQ ID NO: 10191 - DNA, 50 bp, homo sapien
tgatcattaatgaggaaaagactaakgcataaagagttagaggggagagt

SEQ ID NO: 10192 - DNA, 50 bp, homo sapien
tgctatccatgcccacagtagacaasacaggagcaaacaaattaaattac

SEQ ID NO: 10193 - DNA, 50 bp, homo sapien
taataccttcagcttcttattcattsaaatcttgcttacaatccagtccg

SEQ ID NO: 10194 - DNA, 50 bp, homo sapien
aaagtgccatagattaatgaaactcrgagtaacttttttcttacctatta

SEQ ID NO: 10195 - DNA, 50 bp, homo sapien
gaactgcagttaagaccctcgaaaasatctaagaaagtgtgcatcctaaa

SEQ ID NO: 10196 - DNA, 50 bp, homo sapien
gaaactgagctttctagaggtttagycatttacccaaggtcacagctaaa

SEQ ID NO: 10197 - DNA, 50 bp, homo sapien
ttcatttgaaagaacagatgtattayacaagattatcagaggtcaagtag

SEQ ID NO: 10198 - DNA, 50 bp, homo sapien
aagaatttatgagctgagattagcaytccaaagaaagaaaagtgaaaata

SEQ ID NO: 10199 - DNA, 50 bp, homo sapien
ggatgtttaatgtctttctgcctcayggtatcacaaggtagtctaaataa

SEQ ID NO: 10200 - DNA, 50 bp, homo sapien
cagcaaaccagatgtgaggttatgcragagtaatgccagtgccagagtaa

SEQ ID NO: 10201 - DNA, 50 bp, homo sapien
acccttgtgactgtggtttacgtacragcatcctattaaaagagctttta

SEQ ID NO: 10202 - DNA, 50 bp, homo sapien
gtataataaatgtgtgcatgtatccraggagccagggctttgttcaccaa

SEQ ID NO: 10203 - DNA, 50 bp, homo sapien
aatatttgttagtagaaagaaaatcraagcctaaaactaaaggaagacta

SEQ ID NO: 10204 - DNA, 50 bp, homo sapien
atttttaaagtttcatttctatctcygagagcttgtgttaccttaggcaa

SEQ ID NO: 10205 - DNA, 50 bp, homo sapien
tgtttctataactgagtccttttgayagaagactgagacacagccaagct

SEQ ID NO: 10206 - DNA, 50 bp, homo sapien
gaagttactctgattattttttgacwcatatattccacacctttacctta

SEQ ID NO: 10207 - DNA, 50 bp, homo sapien
tgtgttcgtaagtgcagattcaaaaygctaaacagaattctgatgtaggg

SEQ ID NO: 10208 - DNA, 50 bp, homo sapien
ctggctatcaaaaatgtgtttccacygaaagtgaagtttgactgaaaagc

SEQ ID NO: 10209 - DNA, 50 bp, homo sapien
agaagagaaaggaaaagaagaatccraggataaaggaatttatgccctcc

SEQ ID NO: 10210 - DNA, 50 bp, homo sapien
tggcccaattctaagaatttgtggamatcaaaagaggatttgggtttgga

SEQ ID NO: 10211 - DNA, 50 bp, homo sapien
atcaaattgcctttttataaaatgayggagttgtaatctttcataaacta

SEQ ID NO: 10212 - DNA, 50 bp, homo sapien
agaggtgatttctctgaacaagatamcctatatgcatataaaaagtgact

SEQ ID NO: 10213 - DNA, 50 bp, homo sapien
tttctgagactgatgtacaacaatamtagatattaattaacaatgaattt

SEQ ID NO: 10214 - DNA, 50 bp, homo sapien
tactaagtcatcatgctttccattayggagtaactaaggcatccatcatg

SEQ ID NO: 10215 - DNA, 50 bp, homo sapien
tggtttaatcagtcagcttcattcaragacaagttcattcagggaaagaa

SEQ ID NO: 10216 - DNA, 50 bp, homo sapien
caagtacacagtggatggttgaagastccaagaacacagtccatttgctc

SEQ ID NO: 10217 - DNA, 50 bp, homo sapien
agaacaagactctcttggccctacaygatgctgaagaagtcacacagaat

SEQ ID NO: 10218 - DNA, 50 bp, homo sapien
aaaaataatttatagattttgtgacwgtaatgatttacatatgcccaata

SEQ ID NO: 10219 - DNA, 50 bp, homo sapien
tttacttcagttatttgcaaagtaayataatggcaagatcaatttgataa

SEQ ID NO: 10220 - DNA, 50 bp, homo sapien
taagcaggcagaatacagaatcatcraattttaagataggccaattgaaa

SEQ ID NO: 10221 - DNA, 50 bp, homo sapien
ggccccggacacctctattttctaayaattaatctacccccctttttcat

SEQ ID NO: 10222 - DNA, 50 bp, homo sapien
tattgtctctattgatacatagtgckaagtttattctttcatgtattgga

SEQ ID NO: 10223 - DNA, 50 bp, homo sapien
attagaaatactctgatctttttaayctcttcttgtaatttgataaaccc

SEQ ID NO: 10224 - DNA, 50 bp, homo sapien
ttaacctcttcttgtaatttgataamcccttgaaaatctgctgaaataga

SEQ ID NO: 10225 - DNA, 50 bp, homo sapien
ttccatctatatatgtgtattacaaygctctttatcatgattaacctcag

SEQ ID NO: 10226 - DNA, 50 bp, homo sapien
aattttaaaaatccgcatgattggcraaatccgataaaataatccattta

SEQ ID NO: 10227 - DNA, 50 bp, homo sapien
gattcctttgtcaatatgatttcaarcattcaatatttggtttatttgtt

SEQ ID NO: 10228 - DNA, 50 bp, homo sapien
cctctgtctttttaacatactcccawcctttttcatttttaactattctt

SEQ ID NO: 10229 - DNA, 50 bp, homo sapien
ttcaacaaaacaatagaaatactcargttgtggaaagaaaacttaaattt

SEQ ID NO: 10230 - DNA, 50 bp, homo sapien
acacatacatgcacacgtgtttacayaaatatctgcacatacaataacac

SEQ ID NO: 10231 - DNA, 50 bp, homo sapien
gattataggaatatatatttcgcacrgctagaaaagtcttaattgggatg

SEQ ID NO: 10232 - DNA, 50 bp, homo sapien
aatttttaaaaaacaggtctatgtayaggatcttgaactcaagtacatgg

SEQ ID NO: 10233 - DNA, 50 bp, homo sapien
acaaaacaatataagatatgattaaygaaccagaaactaggtgatacagg

SEQ ID NO: 10234 - DNA, 50 bp, homo sapien
tgttgtgcaatgctcttggccctgarattcaattagattgctttgaacga

SEQ ID NO: 10235 - DNA, 50 bp, homo sapien
gtgtgttatcaatccttttagctaaytaagccacctggttttaaccagca

SEQ ID NO: 10236 - DNA, 50 bp, homo sapien
agaactcacgtctttgaagattacaygtagttttctaataaactatactt

SEQ ID NO: 10237 - DNA, 50 bp, homo sapien
agaacctaatattttacattaagaaygactatctcagtgattgtgtgtgc

SEQ ID NO: 10238 - DNA, 50 bp, homo sapien
atgttgaggttatataattgatgtayacctgaagtcgcctatgtggaata

SEQ ID NO: 10239 - DNA, 50 bp, homo sapien
acttaccttttcttctaccatggcakgaaccttgcaccattgttggtgct

SEQ ID NO: 10240 - DNA, 50 bp, homo sapien
tatagcagctatatgagtttggcaaygggcattaagctacatgagtttgc

SEQ ID NO: 10241 - DNA, 50 bp, homo sapien
gattgtaggaaaattcatacaaaaaratgctacataggaatataaactga

SEQ ID NO: 10242 - DNA, 50 bp, homo sapien
tgacaaacaaatccaacaaaagaggyacttagagcagtgttcattgaatc

SEQ ID NO: 10243 - DNA, 50 bp, homo sapien
ggcaaaaggagaaagggaccaaggayaagttttgctgacacaagcaggga

SEQ ID NO: 10244 - DNA, 50 bp, homo sapien
aatcctgatcttggctaaggatgtcrgacaaaccatggtgcaggtgtgta

SEQ ID NO: 10245 - DNA, 50 bp, homo sapien
ccagaggaaaaaagaaactcattacrgacaatatgtccctttcggtttgt

SEQ ID NO: 10246 - DNA, 50 bp, homo sapien
catcaaaatagtacagaaggtttaaytgaatgtatccatgtggtcaaata

SEQ ID NO: 10247 - DNA, 50 bp, homo sapien
tctatggaggataagctatccaacarcactgaatttttctgatagtagat

SEQ ID NO: 10248 - DNA, 50 bp, homo sapien
tgaaggtttttgagacacattgatarcaacttgaaggctttttttctctg

SEQ ID NO: 10249 - DNA, 50 bp, homo sapien
tgtgagttaagcagtatagatattaygatcctcatcttatcagtgaagaa

SEQ ID NO: 10250 - DNA, 50 bp, homo sapien
ttaccaaagtctcataggtttaagakattgctctcaattcaatttccggt

SEQ ID NO: 10251 - DNA, 50 bp, homo sapien
tctactatgtatgggcaaagaattayggaatctttacctcttcgttgtat

SEQ ID NO: 10252 - DNA, 50 bp, homo sapien
agaatgccatgtcctcttttgtccartggaaaactcccacttatctgtta

SEQ ID NO: 10253 - DNA, 50 bp, homo sapien
attttcctttgcataaatccatgaawgtaaaagcaacatcaattataaag

SEQ ID NO: 10254 - DNA, 50 bp, homo sapien
taagtatggcatgtagcgtcttcaamagttcatggtggagggtaggagta

SEQ ID NO: 10255 - DNA, 50 bp, homo sapien
ttgaacaatctcctcctttaaagtayatgccacgctactgttccattatc

SEQ ID NO: 10256 - DNA, 50 bp, homo sapien
aagcactagaaagataaataaatcasagttaagaaaatagaaaaaaatga

SEQ ID NO: 10257 - DNA, 50 bp, homo sapien
aagaaactataatgccagctgctagratgaacataatcatatgtaactgg

SEQ ID NO: 10258 - DNA, 50 bp, homo sapien
ttccaaatttgaatcagtactgaaawaacctgcctatcaataaaagccct

SEQ ID NO: 10259 - DNA, 50 bp, homo sapien
ttaaccgaatttatttttcttcaaamggctaattacactttaatatgttg

SEQ ID NO: 10260 - DNA, 50 bp, homo sapien
actggagataattaatatctaaatakgcacaactataataatgatgcaat

SEQ ID NO: 10261 - DNA, 50 bp, homo sapien
tttggttactgaatttgttgattagyaccaattcattttctcatcaccct

SEQ ID NO: 10262 - DNA, 50 bp, homo sapien
accatgcatcaactgaaagtggaagsctcaaattcagagactgtctctct

SEQ ID NO: 10263 - DNA, 50 bp, homo sapien
ttgagaagagaatacaaggttatctyagagttatcaaatacagaaagtat

SEQ ID NO: 10264 - DNA, 50 bp, homo sapien
ccccagtgactgaattagacaataayggatattctacctataagttagag

SEQ ID NO: 10265 - DNA, 50 bp, homo sapien
cgggacagtttcaaacaaagaacaawggcaaacgagggtccttctgaaaa

SEQ ID NO: 10266 - DNA, 50 bp, homo sapien
ttggttactatagctttgcaatataygttgacatctggtagtgtgatgtc

SEQ ID NO: 10267 - DNA, 50 bp, homo sapien
cttaatagagacaatagcaaaacacygtcattgaagaaggctgagcagag

SEQ ID NO: 10268 - DNA, 50 bp, homo sapien
gcatgtagatgtaactgtggttatarattttcatgttgtccacaaatgtc

SEQ ID NO: 10269 - DNA, 50 bp, homo sapien
caatatttttagtaaatttgagcaaygttagagacaggctagcccccttt

SEQ ID NO: 10270 - DNA, 50 bp, homo sapien
cttctaagaagcaaataaaatgtcawcaagacttgtgatgtaaacaatct

SEQ ID NO: 10271 - DNA, 50 bp, homo sapien
gtgtatttctcattctctttaaatastactggtttggaagctgtggagat

SEQ ID NO: 10272 - DNA, 50 bp, homo sapien
ttaaaagctaatttaaaaaatctcaygtagaattaatggacagatagaaa

SEQ ID NO: 10273 - DNA, 50 bp, homo sapien
tttattatttttccttgtcacataamtatccatctttctatctgtccatt

SEQ ID NO: 10274 - DNA, 50 bp, homo sapien
atagatcaatcagcagcttttatcartctataatggttctctctctttgg

SEQ ID NO: 10275 - DNA, 50 bp, homo sapien
tgcacttaggcactataagccaaacygagatgatcacatctcctcaactt

SEQ ID NO: 10276 - DNA, 50 bp, homo sapien
ggccacctgtcactttatgctgcagrcattttaagtaagttgtggtttct

SEQ ID NO: 10277 - DNA, 50 bp, homo sapien
attctgacatttttgttcttaaaaaycttcgagcccttcattggtttcta

SEQ ID NO: 10278 - DNA, 50 bp, homo sapien
tccaaacacgtttgacacatctaaakaaccttctaaaggatgactaaact

SEQ ID NO: 10279 - DNA, 50 bp, homo sapien
agggtgaggagaggaagtgtatagcragcataggttgtcttgttatgcag

SEQ ID NO: 10280 - DNA, 50 bp, homo sapien
tcaaatatttttaaagcatacaacawattgataataaagtgttttattta

SEQ ID NO: 10281 - DNA, 50 bp, homo sapien
gtgtgctagggacagatctaaggacrgagtatcttggatgcaaattatag

SEQ ID NO: 10282 - DNA, 50 bp, homo sapien
agaatatgaatattgatactcccaayggaaaagtataaaattaatattga

SEQ ID NO: 10283 - DNA, 50 bp, homo sapien
ttttcttatccaactgctccttgaaygaagaaagtgaacaaggagaaacg

SEQ ID NO: 10284 - DNA, 50 bp, homo sapien
aacataaagaaaagatgagcaaagayggtaaaaagaagaaaaagaagtca

SEQ ID NO: 10285 - DNA, 50 bp, homo sapien
atcaatcagtttatttatggtactaytactgatgagtctctccttgtcta

SEQ ID NO: 10286 - DNA, 50 bp, homo sapien
aaacctttatcatctcaggtccttawaattttatagttgcttacacctct

SEQ ID NO: 10287 - DNA, 50 bp, homo sapien
atgctaaagctgtttcttaaaatgargcagataaaaaatagagaaaatct

SEQ ID NO: 10288 - DNA, 50 bp, homo sapien
cacatgtcagcaccagcatcaccackatagacagatgctgatgccacaca

SEQ ID NO: 10289 - DNA, 50 bp, homo sapien
tttttgtatactgatattcttgaacrccaactggataccctatcctacta

SEQ ID NO: 10290 - DNA, 50 bp, homo sapien
atcatattgcaaaggcactctgccaraaaggactctaccacattttcctg

SEQ ID NO: 10291 - DNA, 50 bp, homo sapien
cacaggagaagagtgtagaatttcamtcttaatgagataatgagaaaatc

SEQ ID NO: 10292 - DNA, 50 bp, homo sapien
gactcacaactatatcacatatacartctttagggacattattaataaat

SEQ ID NO: 10293 - DNA, 50 bp, homo sapien
tgcagaaagaccacacagccttacasattgatattcaacctcagctgctc

SEQ ID NO: 10294 - DNA, 50 bp, homo sapien
gtctggagcggcataaaaagggtcartcgaataggtcatacatcatatgg

SEQ ID NO: 10295 - DNA, 50 bp, homo sapien
tgctaagccagcagtttaaatgtcasctttggcactaacctgttatagga

SEQ ID NO: 10296 - DNA, 50 bp, homo sapien
caggagcctactccaaaactgcacargtgggaggtaagtcctgtcatttg

SEQ ID NO: 10297 - DNA, 50 bp, homo sapien
ccagtgggaatcactgtttgattgasagaattaagtttctgccaccttag

SEQ ID NO: 10298 - DNA, 50 bp, homo sapien
aaactaaattgccaatatggaacaarattatgcagccgttggaaattata

SEQ ID NO: 10299 - DNA, 50 bp, homo sapien
aaactataaaaatccaaaaggacagratagtgttactctgtttatcattt

SEQ ID NO: 10300 - DNA, 50 bp, homo sapien
gcaaaggacttgaaaactatatcacratcaacttccacttgcaaataact

SEQ ID NO: 10301 - DNA, 50 bp, homo sapien
ctgtttatcattttattcctagcacrgtatgtaacttgtgtttcaatgcc

SEQ ID NO: 10302 - DNA, 50 bp, homo sapien
gctaaaaatcatccctcccactcaaygactaccttgagtttaaggtcatt

SEQ ID NO: 10303 - DNA, 50 bp, homo sapien
ccaccgcaactggcccactgtgttasgatttgaaataaaaaggaactaag

SEQ ID NO: 10304 - DNA, 50 bp, homo sapien
tattaaatatgtgttcatgactagcrcatctattaaacccaaattctttt

SEQ ID NO: 10305 - DNA, 50 bp, homo sapien
tttcatctaactataaattctggagkatcagtttattctgcattatggtg

SEQ ID NO: 10306 - DNA, 50 bp, homo sapien
taggatatagaattcatgaaggagaytacagagttataggactagtgagg

SEQ ID NO: 10307 - DNA, 50 bp, homo sapien
taattactttttaaaaaggtgaaacyaggatatttcatatcttgaccaag

SEQ ID NO: 10308 - DNA, 50 bp, homo sapien
agaaggataatgtatgtaaagtaacygtaaatagcaggttctcagtaaat

SEQ ID NO: 10309 - DNA, 50 bp, homo sapien
atagcatgaatgagagctaatattamaagaccaaaattagttctttaaaa

SEQ ID NO: 10310 - DNA, 50 bp, homo sapien
aaattttcagtctgtacttgccaatraacaaattgactttcaatcagtat

SEQ ID NO: 10311 - DNA, 50 bp, homo sapien
ctatagctttttaacagtaaaacccraactatagccagatgtaattattt

SEQ ID NO: 10312 - DNA, 50 bp, homo sapien
ctgtgtccactcctctattctaaccrcatgcatattcacatggagatgat

SEQ ID NO: 10313 - DNA, 50 bp, homo sapien
tgttttccgagccacagcagaataaygtagcaaatcggaaagatgaaggg

SEQ ID NO: 10314 - DNA, 50 bp, homo sapien
gtctattacgcctgcagtatttgcawgagatttttgttttgtttgttttg

SEQ ID NO: 10315 - DNA, 50 bp, homo sapien
cactgggaagagtctgtaataggacrctagcttgtacgtatgtgttcttt

SEQ ID NO: 10316 - DNA, 50 bp, homo sapien
aaatttttttgcttcatgatgattgsaacaggatagagagcagagagggg

SEQ ID NO: 10317 - DNA, 50 bp, homo sapien
cagcatggtgctgggaagtgctaagyccagaaatcgagtttttcaagtga

SEQ ID NO: 10318 - DNA, 50 bp, homo sapien
atgagatttgctttgggaccctaaaygaacagctgaccaattcatctctt

SEQ ID NO: 10319 - DNA, 50 bp, homo sapien
tttatacatttagtgatttagagtcmgaaaatctagatttaaatcctagc

SEQ ID NO: 10320 - DNA, 50 bp, homo sapien
taaattgttaaatttgaatagtgaarccttaagtgattgaagtagaaagc

SEQ ID NO: 10321 - DNA, 50 bp, homo sapien
agcaaatctcatcacactggtcaaaygtattttctggacctttcttttct

SEQ ID NO: 10322 - DNA, 50 bp, homo sapien
aaagttcaaataaaatgagactgagwagaatcgcatgggtgttgggcacg

SEQ ID NO: 10323 - DNA, 50 bp, homo sapien
tatacagaggaaagaaagatggagaragtaatgatattgtcaaatataga

SEQ ID NO: 10324 - DNA, 50 bp, homo sapien
gtcactctacgcaacgccaataaaamtatagtcagtgctgcctaccaggt

SEQ ID NO: 10325 - DNA, 50 bp, homo sapien
catgctggggactcacagcctgctgraagagacaatattacaatattgta

SEQ ID NO: 10326 - DNA, 50 bp, homo sapien
atatatgatgcaggcaccgtattaasggctgagtgttcaactatgaacag

SEQ ID NO: 10327 - DNA, 50 bp, homo sapien
tcttgccagattttgactgtttatargagagaaaagtttatagaagccta

SEQ ID NO: 10328 - DNA, 50 bp, homo sapien
tcaaaaatggtatagcatatgaagamaattttttgatgcagacaggtact

SEQ ID NO: 10329 - DNA, 50 bp, homo sapien
catccaacccttggatctctttgagyctactgataatctccactggaaag

SEQ ID NO: 10330 - DNA, 50 bp, homo sapien
agtgactgtatatgatcattacaaaygtctttgaggtttcttaaaatgtg

SEQ ID NO: 10331 - DNA, 50 bp, homo sapien
acctctaagaggcaggacactagccyaaactaaaatgtcccttatgtctg

SEQ ID NO: 10332 - DNA, 50 bp, homo sapien
gacatatttccactttgaaaggttasgttgctcatacattattactggat

SEQ ID NO: 10333 - DNA, 50 bp, homo sapien
gaaatggggcagctgtgttcccacaygttcctcgtatttctgtggtttct

SEQ ID NO: 10334 - DNA, 50 bp, homo sapien
cataagcttccttctctcaaggcccraaacaaaaatatagttccttacct

SEQ ID NO: 10335 - DNA, 50 bp, homo sapien
tgtagatctgctaaaatgccaatgawctgttattaatggtgaaagtgttt

SEQ ID NO: 10336 - DNA, 50 bp, homo sapien
atgctttctggtgtggattatgcaaraaacttacagtcatttggcttcct

SEQ ID NO: 10337 - DNA, 50 bp, homo sapien
tgctttggatatccagagattcaaamgaaatccattggttggaaagcttt

SEQ ID NO: 10338 - DNA, 50 bp, homo sapien
ttcttactgaattttgaatagtctasgtctagggcacacactctgaccat

SEQ ID NO: 10339 - DNA, 50 bp, homo sapien
aaattaaaatgacaagttctaaacartagctcttcattaaggtgttaaat

SEQ ID NO: 10340 - DNA, 50 bp, homo sapien
tttcactattttaatacatagatcarctcaataaaatttcaacttaaatc

SEQ ID NO: 10341 - DNA, 50 bp, homo sapien
cacattcagttcttcaatattccaaygaacatggcaaatttgtcaatatg

SEQ ID NO: 10342 - DNA, 50 bp, homo sapien
aaagaaggaaaataatcagactgtawcaaaactcatctgttattggccat

SEQ ID NO: 10343 - DNA, 50 bp, homo sapien
tccctgtctcctgtccatatcagaastgcttccaaatataggctgcagac

SEQ ID NO: 10344 - DNA, 50 bp, homo sapien
gttacacaaagcaaaacaggattgaragattttgcaaagcaacaaatccc

SEQ ID NO: 10345 - DNA, 50 bp, homo sapien
acaaaccctctaggtatggtatcacrgatgcaagtgcaggtactgataga

SEQ ID NO: 10346 - DNA, 50 bp, homo sapien
gtgatttaaaaccacaaacaaaagcwattgcatattatgggagataaaaa

SEQ ID NO: 10347 - DNA, 50 bp, homo sapien
catttctagtatagatacaaatcackaatctttccagtatagactcaaag

SEQ ID NO: 10348 - DNA, 50 bp, homo sapien
gattctcacctctaatagttttaaasagttagtgatttctttcttcaaat

SEQ ID NO: 10349 - DNA, 50 bp, homo sapien
tacatatatacccatggacacaccawtaaggttcaaaggtatttcttttt

SEQ ID NO: 10350 - DNA, 50 bp, homo sapien
atctctgagtttcttttttgctgcawtataatctatgttgagatggactt

SEQ ID NO: 10351 - DNA, 50 bp, homo sapien
cagctttagatctccttgtgggctcraactgaattttataatacttctct

SEQ ID NO: 10352 - DNA, 50 bp, homo sapien
gtcttgttcattgctacaaccctaartcttggcacaaagcacagggcagc

SEQ ID NO: 10353 - DNA, 50 bp, homo sapien
gatttggaagcattatattgggagaytcgttatattgggagaatatcttg

SEQ ID NO: 10354 - DNA, 50 bp, homo sapien
tgatatccttcctgtcacagaattcrctttcttgaggcaggaattgataa

SEQ ID NO: 10355 - DNA, 50 bp, homo sapien
attactggttaattttggtaaataayctcttcagactgcagtttcttttg

SEQ ID NO: 10356 - DNA, 50 bp, homo sapien
aataattaaagcctacagaaactccraaaattgattccatttgactttgc

SEQ ID NO: 10357 - DNA, 50 bp, homo sapien
ggcattatacacgtaaaatgcctacractttcaaattaatcacaacctct

SEQ ID NO: 10358 - DNA, 50 bp, homo sapien
aaagcaaacatttttatttctcaacrcttttcctgtgaatgtatttttct

SEQ ID NO: 10359 - DNA, 50 bp, homo sapien
tcagacatctgtgctgccttgaatgkaggtgaatactaagagtttcagtg

SEQ ID NO: 10360 - DNA, 50 bp, homo sapien
tttagttttctacttatttctcttawctctgcttttaccttcattctctg

SEQ ID NO: 10361 - DNA, 50 bp, homo sapien
gtccttgacagtaataaagaaataaygcagggaattcagaagaaaactat

SEQ ID NO: 10362 - DNA, 50 bp, homo sapien
tctggtgacttaaatgttctagatamaaagctggtcgctcatggtagttg

SEQ ID NO: 10363 - DNA, 50 bp, homo sapien
aaaagttaatggtagtctctaattcwaattatatccattgtatttctagg

SEQ ID NO: 10364 - DNA, 50 bp, homo sapien
aagacagcgatgaacagtagaacagkacccttacaaccacatgaactggc

SEQ ID NO: 10365 - DNA, 50 bp, homo sapien
atgtgtcactctgctattttaggaaytgttccaataagagatgtttatag

SEQ ID NO: 10366 - DNA, 50 bp, homo sapien
aaagtacacaacatgcaaaatcagayagataatgtcaatacagacagaaa

SEQ ID NO: 10367 - DNA, 50 bp, homo sapien
ccactctttcttcccagttctcagayggttcttggagcactggcgaagtc

SEQ ID NO: 10368 - DNA, 50 bp, homo sapien
attcagatttgccttattgtcttggkatttcttagaataactgcaagggg

SEQ ID NO: 10369 - DNA, 50 bp, homo sapien
tggacaattttgttgtctaaattaaygtagagcaaggttttaaaactatg

SEQ ID NO: 10370 - DNA, 50 bp, homo sapien
attttcatgcttagtgtataatagaygctcaaaaaatatctgatgattac

SEQ ID NO: 10371 - DNA, 50 bp, homo sapien
atgaacaatgtattattcttacacaktattttcatgcttagtgtataata

SEQ ID NO: 10372 - DNA, 50 bp, homo sapien
aggaacaaggagatgagtccagaaargtagattgtgagctttgtattctg

SEQ ID NO: 10373 - DNA, 50 bp, homo sapien
aagtgagaataccaaaagaggatacrattgtcacaaaacaataagcaagt

SEQ ID NO: 10374 - DNA, 50 bp, homo sapien
cattgtatagattgatattggcttawcactgaatttttaggggaaaaaaa

SEQ ID NO: 10375 - DNA, 50 bp, homo sapien
actttctgcaaatgactccaaaataygtgtttccagtcctgacttctctc

SEQ ID NO: 10376 - DNA, 50 bp, homo sapien
acatagtgagggtggtgacccatgaygactgcatccctgaggtaagcctg

SEQ ID NO: 10377 - DNA, 50 bp, homo sapien
agttatatccactagcattaccttartaaatagaacaataaggtgacaaa

SEQ ID NO: 10378 - DNA, 50 bp, homo sapien
tcactaaagcttaaaaactgctcaamtgaactgaaaatttacctagaagg

SEQ ID NO: 10379 - DNA, 50 bp, homo sapien
ctgctcagcatcctaaatgagctccmagattagatttactttcatgtact

SEQ ID NO: 10380 - DNA, 50 bp, homo sapien
attctgaggctcaagagcttaatgcmagtatgttttctgagttaaaataa

SEQ ID NO: 10381 - DNA, 50 bp, homo sapien
ctattaaatcctacctattctaacayccaatagtgggcaagaaacatcct

SEQ ID NO: 10382 - DNA, 50 bp, homo sapien
accttggtcttggacttccagtttcyagaagtatgagaaaataaatttct

SEQ ID NO: 10383 - DNA, 50 bp, homo sapien
gagagaacttaagtatatttgctacygaaataatgtctttgtataattct

SEQ ID NO: 10384 - DNA, 50 bp, homo sapien
agtcctttccatcatcaaataaatcsatctgtatccaaactattattaac

SEQ ID NO: 10385 - DNA, 50 bp, homo sapien
agtgtggtttattcagagaaaagacrgtatctcattaaataggtatttca

SEQ ID NO: 10386 - DNA, 50 bp, homo sapien
tgcatgtgttacttaaaaataagtcrcagaatagggccttaattatggta

SEQ ID NO: 10387 - DNA, 50 bp, homo sapien
actctaatcttgaactcagtacatgkatgactactctgcaagatgtctgg

SEQ ID NO: 10388 - DNA, 50 bp, homo sapien
cagcattttggcaaaaccagcaggasaagtttagaagaacatatcagtca

SEQ ID NO: 10389 - DNA, 50 bp, homo sapien
attactgagctaatcattgtattackcaatcatttttgttgtaattgttc

SEQ ID NO: 10390 - DNA, 50 bp, homo sapien
actaaaaaaagcatctagtccaaacyattctcgagtactctgtccattgc

SEQ ID NO: 10391 - DNA, 50 bp, homo sapien
atatatatttcacttaagctgtaagyatgtttaaaatgtttgaaacagca

SEQ ID NO: 10392 - DNA, 50 bp, homo sapien
aaaactgcctttcctggacttcttcrcaactagtgttctggatgcaaatc

SEQ ID NO: 10393 - DNA, 50 bp, homo sapien
tggatctcttccttccttttcagccraatatgcacttctcaggcaattct

SEQ ID NO: 10394 - DNA, 50 bp, homo sapien
gcaagcaaacaaacctacagctagcraagaaactatggaaaatgacagat

SEQ ID NO: 10395 - DNA, 50 bp, homo sapien
acttgacttgcaaacacagattagarcaggagggcaaagaacatcttttt

SEQ ID NO: 10396 - DNA, 50 bp, homo sapien
ctaataagagttctagatttctataygtcttcattgataattctatttct

SEQ ID NO: 10397 - DNA, 50 bp, homo sapien
attaaaaattttctgaaaaaaggtargaccaatatgcatataaatttaga

SEQ ID NO: 10398 - DNA, 50 bp, homo sapien
gctttcccttcggtcacataaatgarcaatttgcaagcagattattacct

SEQ ID NO: 10399 - DNA, 50 bp, homo sapien
gcaaaattaaatttttttagattaastcaaatgcttcttgttaaaacaaa

SEQ ID NO: 10400 - DNA, 50 bp, homo sapien
gctcactatgctgtcttgaagttgcraaatcgttgtagaatgatggtttc

SEQ ID NO: 10401 - DNA, 50 bp, homo sapien
ccccacctccttgacattgcttatayctaattcccttggcatagaatgac

SEQ ID NO: 10402 - DNA, 50 bp, homo sapien
cagagctctgtacacccatagtccarggtttctagtatagtcaattctac

SEQ ID NO: 10403 - DNA, 50 bp, homo sapien
tcaacaatgtcatctaatcaaagacrataaggcatgtgaagaggcaagaa

SEQ ID NO: 10404 - DNA, 50 bp, homo sapien
gtttcagaagtgcctaaacatcatargagtaagacctgaaaacagcaaac

SEQ ID NO: 10405 - DNA, 50 bp, homo sapien
aaaaaagtgtttaaaagtgagataamaaaatgtgtgttaaaactggctgg

SEQ ID NO: 10406 - DNA, 50 bp, homo sapien
agtaacgaagagccacagaatctcawgtgttttaatacaaaaaagtttca

SEQ ID NO: 10407 - DNA, 50 bp, homo sapien
ctctactatgaggctacaaagtccasagtgttacaatgaccctcagcacc

SEQ ID NO: 10408 - DNA, 50 bp, homo sapien
aaaaagaattttcttatttctgccargataactgaaaaaagttagcaatg

SEQ ID NO: 10409 - DNA, 50 bp, homo sapien
ttccttctggatagtgccttttaacsaactgaatgatgctttttccaaga

SEQ ID NO: 10410 - DNA, 50 bp, homo sapien
ttcttcaatgttcctaatttaaatgrcagcgctaatagtttatcgttctg

SEQ ID NO: 10411 - DNA, 50 bp, homo sapien
caaagatgtcttgcttctttacccaytaccaagtctggtatacagcttcc

SEQ ID NO: 10412 - DNA, 50 bp, homo sapien
gttcataaagggctctgaattgtctyagaagcagagaagaatgaaaacgg

SEQ ID NO: 10413 - DNA, 50 bp, homo sapien
cccaaaaaagctcagaaaagcaaagraatagctaagattcaatatgtacg

SEQ ID NO: 10414 - DNA, 50 bp, homo sapien
atatttctttctcacaacatgatatyactgcttaaactggaagcagcaca

SEQ ID NO: 10415 - DNA, 50 bp, homo sapien
aaagaaatattgggagagtaagggayagtcagcacacgaacagaacagtg

SEQ ID NO: 10416 - DNA, 50 bp, homo sapien
gtacatagaaatatcactataggtayaaacacatcagagataaagatagc

SEQ ID NO: 10417 - DNA, 50 bp, homo sapien
aaaattgcactgaaatggagacagawtcactgattgaatgcttcctattg

SEQ ID NO: 10418 - DNA, 50 bp, homo sapien
tagtaacaaagagcataagcctcagmagtttttatggaactcaaagaaga

SEQ ID NO: 10419 - DNA, 50 bp, homo sapien
gatcaaagataaaatgagcgtgcaayggttaggcagaaggaaaatgcaat

SEQ ID NO: 10420 - DNA, 50 bp, homo sapien
tttacttaagccacaaaattagaacyatatcgatactgagagtgagtgaa

SEQ ID NO: 10421 - DNA, 50 bp, homo sapien
aacaaaagataaaagatctgatttaygtatctagttatcagaattcagtt

SEQ ID NO: 10422 - DNA, 50 bp, homo sapien
ttgtagtttaagcacatttcatcatmataaaaatggcatgaatgagaaat

SEQ ID NO: 10423 - DNA, 50 bp, homo sapien
cactccttttatatttatgactcacwcatcagtagagaggttattgaaaa

SEQ ID NO: 10424 - DNA, 50 bp, homo sapien
tgacttatagtcacatgaaaggtgayctctagacatgtctgtagaaaatg

SEQ ID NO: 10425 - DNA, 50 bp, homo sapien
attttatgactcaatctcaatgtacrctgctggatatacagcttatcctg

SEQ ID NO: 10426 - DNA, 50 bp, homo sapien
atattgtaaagaactcaaattactcyaaagtactatataaatgttacata

SEQ ID NO: 10427 - DNA, 50 bp, homo sapien
tacttaaagagcaagataatctaagsaaacaagagttacatcagttaggg

SEQ ID NO: 10428 - DNA, 50 bp, homo sapien
aatgatgaggagtttagacgttatayaatagaccagagtttttgagtcct

SEQ ID NO: 10429 - DNA, 50 bp, homo sapien
tgtgcaaaaaaagtgatatatacaartactataaaatatatgcatgtacg

SEQ ID NO: 10430 - DNA, 50 bp, homo sapien
ccctggctgaactatggatgaaaaartgtaccctgacacaggtattttgc

SEQ ID NO: 10431 - DNA, 50 bp, homo sapien
attgacagatctgaacagatacgcaygggcctgtccaacttctattaatc

SEQ ID NO: 10432 - DNA, 50 bp, homo sapien
tggaattaacaagatgagaacaccakattttcctaagtgtggaacaccac

SEQ ID NO: 10433 - DNA, 50 bp, homo sapien
aaaaagtaagtttgctgacaacatayggtttaatcactcacttacatata

SEQ ID NO: 10434 - DNA, 50 bp, homo sapien
ggttgggtataagatcctaagactayaagaaatgaaattttatatgggag

SEQ ID NO: 10435 - DNA, 50 bp, homo sapien
cttaagatttttccaatagtaggaayatagctcaaggtatcaattgatgg

SEQ ID NO: 10436 - DNA, 50 bp, homo sapien
attaaatttagtttaaaatccttaaktacttcaacaggaaaaaaagtgat

SEQ ID NO: 10437 - DNA, 50 bp, homo sapien
ttttcctaactttgtcataaaacaartgtctatatataaaagtgtgtgta

SEQ ID NO: 10438 - DNA, 50 bp, homo sapien
aaaataagccttatccaattacacascaagagacatatacaaacaaatca

SEQ ID NO: 10439 - DNA, 50 bp, homo sapien
tagctttcactaacaatatttgatayctgccttagtccatttatattgct

SEQ ID NO: 10440 - DNA, 50 bp, homo sapien
tccgttaatattgccatgtaaaaaayagacatcttaaggataaggagaac

SEQ ID NO: 10441 - DNA, 50 bp, homo sapien
ccatgaatagaagtcattagacagamagtaatttgttattgcaccattcc

SEQ ID NO: 10442 - DNA, 50 bp, homo sapien
caagtagagtctggataataccaaamagcaagacaacagttagtacttgt

SEQ ID NO: 10443 - DNA, 50 bp, homo sapien
ttaaaattgctttgacaaatcaaaargtctttcttcctggctaagcccac

SEQ ID NO: 10444 - DNA, 50 bp, homo sapien
cctttgaaaataaagtatacaaacartgagtggcaggaaggcgaaaagaa

SEQ ID NO: 10445 - DNA, 50 bp, homo sapien
actttttcagctggagatcttgataygagaaattaatggatattgattca

SEQ ID NO: 10446 - DNA, 50 bp, homo sapien
agcaatgcaaaacagcctaacatacsacgtaatatgtacagccaccattc

SEQ ID NO: 10447 - DNA, 50 bp, homo sapien
tagcctctgggcctcataaatccagrcatgtatcagttcatctccaaaca

SEQ ID NO: 10448 - DNA, 50 bp, homo sapien
tcgtttcagcacatcttcatatccarcgagctcttttttcaatgctggct

SEQ ID NO: 10449 - DNA, 50 bp, homo sapien
ttttggtataacacatcaagaacacyggaaattatcagacatgttctttg

SEQ ID NO: 10450 - DNA, 50 bp, homo sapien
aaagatttttccctccctacatcaaygtcccttaccagggtggtacattt

SEQ ID NO: 10451 - DNA, 50 bp, homo sapien
gacagacctctatccatacctctgaraatctctgtaataattcagatctg

SEQ ID NO: 10452 - DNA, 50 bp, homo sapien
gttgctgtgactgggtatgttactayaagtttatgcattttactgtgtcc

SEQ ID NO: 10453 - DNA, 50 bp, homo sapien
ctcattttctgtatctgtactacaayggtatctaacaatatcaggcacag

SEQ ID NO: 10454 - DNA, 50 bp, homo sapien
tagatttcaagtttcttgtaagcagratttataggtactttatcttgtta

SEQ ID NO: 10455 - DNA, 50 bp, homo sapien
accatgttctacttattattagaccmagagtgctagagagaaagtgtgac

SEQ ID NO: 10456 - DNA, 50 bp, homo sapien
tgttgaaagtggatttgaaaatgcayggtagctgcctaatcatgcttgaa

SEQ ID NO: 10457 - DNA, 50 bp, homo sapien
tgaaagtggtaaaacttatttgctasgtgttaatggcaatttcaaacaat

SEQ ID NO: 10458 - DNA, 50 bp, homo sapien
ctatttccaagctatgatttcattayataagtaacagtaaatccgacaaa

SEQ ID NO: 10459 - DNA, 50 bp, homo sapien
actgatcatgatcctttcattgtcayaagatacaaaataagtataaattg

SEQ ID NO: 10460 - DNA, 50 bp, homo sapien
tttggcaaacactggaagatcagaarggcaatattattaaatccatataa

SEQ ID NO: 10461 - DNA, 32 bp, homo sapien
agaaactgctgtgagcrcaaatagataggaaa

SEQ ID NO: 10462 - DNA, 50 bp, homo sapien
tgccaaagtctgtcacagaaatctgsaatataaaatgaataggagcctga

SEQ ID NO: 10463 - DNA, 50 bp, homo sapien
tcaatgtgtttacctaaagctgaacyatacgcccttttggaatgctgcat

SEQ ID NO: 10464 - DNA, 50 bp, homo sapien
aacttttaaatcaaggttcattagamaaagattattaaccagtttcaatg

SEQ ID NO: 10465 - DNA, 50 bp, homo sapien
tccccactcagtctgccagcattaartcatacactttttgtcaaatcata

SEQ ID NO: 10466 - DNA, 50 bp, homo sapien
agcttaaaataatcgtgaatatagtwacccaaatgaagtctttgatatat

SEQ ID NO: 10467 - DNA, 50 bp, homo sapien
ttaggtgataagccatgcagttctamagagtaagtatgattcattttgta

SEQ ID NO: 10468 - DNA, 50 bp, homo sapien
atttaagaaacagaatccaacaccayagatcagagttcatgctaggatta

SEQ ID NO: 10469 - DNA, 50 bp, homo sapien
cctttctgatgaaagacagctaagayaaaagatttcatcaacaatcaact

SEQ ID NO: 10470 - DNA, 50 bp, homo sapien
catcagcagtatttcaaacaacaccrcaatttttcttctgcccaaatgaa

SEQ ID NO: 10471 - DNA, 50 bp, homo sapien
gttacttcaattatcatatattaaayggtgaaaatgacgacaaagaagcc

SEQ ID NO: 10472 - DNA, 50 bp, homo sapien
caggcatttcttggcctgtgtcaacyggaacatggcaaaaaaattttata

SEQ ID NO: 10473 - DNA, 50 bp, homo sapien
aagactgggttcaatttcttcaataygattgtcacgtttgttgaaagctt

SEQ ID NO: 10474 - DNA, 50 bp, homo sapien
agataattcaaagacatccaatagargtggcataaataccaaaaatttga

SEQ ID NO: 10475 - DNA, 50 bp, homo sapien
gcttcaagagctcagagaagactaamgtggctgagggaaaaggtttattg

SEQ ID NO: 10476 - DNA, 50 bp, homo sapien
aatttaagttctatatggtcgtatgmatctgttttaagttaggttgaacc

SEQ ID NO: 10477 - DNA, 50 bp, homo sapien
gtattagtttcccttttatgaaaaastaaagtgtaacaataaaaagaaaa

SEQ ID NO: 10478 - DNA, 50 bp, homo sapien
agactatgaatatattggatttctayggtatttatttgcaaaattgtgaa

SEQ ID NO: 10479 - DNA, 50 bp, homo sapien
aataattaccatagtctgtttgataytaaatgctgcttaaaagttactat

SEQ ID NO: 10480 - DNA, 50 bp, homo sapien
gaattaagactggcacaaggatgtasaagagagaaggaattgagaaattg

SEQ ID NO: 10481 - DNA, 50 bp, homo sapien
accaattatttgctacttttaactcyatactacacttcatgaaagttgat

SEQ ID NO: 10482 - DNA, 50 bp, homo sapien
aatccatggtgtaactaataggtatsaaactcagggtctataggaccccc

SEQ ID NO: 10483 - DNA, 50 bp, homo sapien
taaacaatgttttgggttagatgagkaagagtatataacatggaataatg

SEQ ID NO: 10484 - DNA, 50 bp, homo sapien
caagcacagataaacatattattackctccaattctggtcatttttacct

SEQ ID NO: 10485 - DNA, 50 bp, homo sapien
cttagtcatttctttaaaggaaaaawgtctactacatgatggaaacattg

SEQ ID NO: 10486 - DNA, 50 bp, homo sapien
tgccattactccaggactttattaaytccattgaaatcagggtagcctcc

SEQ ID NO: 10487 - DNA, 50 bp, homo sapien
tataaaaaatgtaatattttagaaawtgcctaaatgtcaagaatacaaca

SEQ ID NO: 10488 - DNA, 50 bp, homo sapien
gctataatttcattgctctgaagatracgaacaatccagatgcaatattc

SEQ ID NO: 10489 - DNA, 50 bp, homo sapien
tagtttaatttatgcaagatgaataygtttagagatcttctgtaaaactt

SEQ ID NO: 10490 - DNA, 50 bp, homo sapien
tttaggctgtaaccaatagtcatcartatgttttccagtgagactcagtg

SEQ ID NO: 10491 - DNA, 50 bp, homo sapien
tacattttcttctaggagttattcastagttttaggtctcacactttaat

SEQ ID NO: 10492 - DNA, 50 bp, homo sapien
tcactttgggtatgaacattttaacracattaagccttccaattcatgta

SEQ ID NO: 10493 - DNA, 50 bp, homo sapien
gattacctccttccgttatttaaaaygctgatgtaaatattcgcctcctc

SEQ ID NO: 10494 - DNA, 50 bp, homo sapien
ccatgattggcctcctagttacgaaytggaccatggatatttaccactaa

SEQ ID NO: 10495 - DNA, 50 bp, homo sapien
ttgaaacataaaaatatgatttaaayggcaacactgatcaaccaattttc

SEQ ID NO: 10496 - DNA, 50 bp, homo sapien
caacaacaacaacaacaacaacaaaragaacaatatattggttatgtata

SEQ ID NO: 10497 - DNA, 50 bp, homo sapien
attattatgactagaaaatggtagastcaaaatataattcaaattagtct

SEQ ID NO: 10498 - DNA, 50 bp, homo sapien
gtgacatatgataaggccttgagccrggataatagtattgagaatcagaa

SEQ ID NO: 10499 - DNA, 50 bp, homo sapien
aagctttcactactaagagtagcaartatttcaacattcagggattatta

SEQ ID NO: 10500 - DNA, 50 bp, homo sapien
agttgaacagtaacaaaatcctcacrcaatcttcttcccaacttgtaaaa

SEQ ID NO: 10501 - DNA, 50 bp, homo sapien
atgaatccaagccttcaccctcagaygcaacgtgaatgttttgtaggttc

SEQ ID NO: 10502 - DNA, 50 bp, homo sapien
tcagcttggactagaaaaggtatgargaagatgagataggagttggaaat

SEQ ID NO: 10503 - DNA, 50 bp, homo sapien
taacatgatttttatacgatactgaygattggctttcctctatttctacc

SEQ ID NO: 10504 - DNA, 50 bp, homo sapien
tgggtatcctgaagggaatgttttcyattaatatctccaagaacctaact

SEQ ID NO: 10505 - DNA, 50 bp, homo sapien
tgcataggggtaaataatggtaatayggtaataatggtaaataatggtgg

SEQ ID NO: 10506 - DNA, 50 bp, homo sapien
cttttaagctcaaagtagttaaacartgtcacttgacctgaggtagccca

SEQ ID NO: 10507 - DNA, 50 bp, homo sapien
tgttttcttctcagtgcaaggatgcraggcctatctatcatacagcattg

SEQ ID NO: 10508 - DNA, 50 bp, homo sapien
acacatatacttgtgttacaggaaakgtgttcgatccataccccaagaga

SEQ ID NO: 10509 - DNA, 50 bp, homo sapien
ctggaaacacaggcaaagatgtgaaytgagatgattaaataatgttttca

SEQ ID NO: 10510 - DNA, 50 bp, homo sapien
acatacagtatgtgctgagtacttakgaacttttggttatcctctattat

SEQ ID NO: 10511 - DNA, 50 bp, homo sapien
ttgagaacctcattagttcctaccartatatcttctctctctccaatcca

SEQ ID NO: 10512 - DNA, 50 bp, homo sapien
tgatcaggtctagctatctagcaaayggcagtaacccaaataatgcatca

SEQ ID NO: 10513 - DNA, 50 bp, homo sapien
ttcctcttcattcctttgactatcasctaatggaccagtcacagtataaa

SEQ ID NO: 10514 - DNA, 50 bp, homo sapien
gatttaaatccaaccaggtcaaccawatctatattatgttaaatataagt

SEQ ID NO: 10515 - DNA, 50 bp, homo sapien
tctatgactgtatgtgtgtatcatgracaacagaatgaggatccttaggg

SEQ ID NO: 10516 - DNA, 50 bp, homo sapien
tcttgcgattcatcactggggtcctmaaagcatcttccaaggggataata

SEQ ID NO: 10517 - DNA, 50 bp, homo sapien
cagtgaatatataagaaataaagaayaggagataaactaacacaataaca

SEQ ID NO: 10518 - DNA, 50 bp, homo sapien
catagtggtgtttattttcgctttargacatagggaagaatcagactcaa

SEQ ID NO: 10519 - DNA, 50 bp, homo sapien
tggatgtcaggcaggagccaatacartgctgaggatgaggtgtgaggggt

SEQ ID NO: 10520 - DNA, 50 bp, homo sapien
aacaagcaggtcttttattttattayacttctctttgacattcactccag

SEQ ID NO: 10521 - DNA, 50 bp, homo sapien
taagtccatacagaaatggttccaasaatctacatcaacctgcatagacc

SEQ ID NO: 10522 - DNA, 50 bp, homo sapien
atagctaataggcttctaaatggagscaacctgtggataaacaagttccc

SEQ ID NO: 10523 - DNA, 50 bp, homo sapien
actgtgaaaagctcaaagttctgtakgttaggtcttagatggtctctcag

SEQ ID NO: 10524 - DNA, 50 bp, homo sapien
atgttgctaggtctggtgacgagaakctcctatcctaatttagcttaggg

SEQ ID NO: 10525 - DNA, 50 bp, homo sapien
aatgttttactgtatgatactgacawgataatttctgttattgctaaagt

SEQ ID NO: 10526 - DNA, 50 bp, homo sapien
cctgacaaactcagtgacattcacamagggcatcgtgggaacaaataaaa

SEQ ID NO: 10527 - DNA, 50 bp, homo sapien
ctaggacataaaatacatctcaataracctaaaagaattgaagtcataca

SEQ ID NO: 10528 - DNA, 50 bp, homo sapien
gctttggtgggcaatcaagagatccratcataataataaagacacttttg

SEQ ID NO: 10529 - DNA, 50 bp, homo sapien
caagaagattgatgatatgattaaasactgtgaagaaaggttaaaattaa

SEQ ID NO: 10530 - DNA, 50 bp, homo sapien
ggaagggataggcctgggttgaaccrcagaatcttacgaccactaggaag

SEQ ID NO: 10531 - DNA, 50 bp, homo sapien
ctaaaaatacaaaagttagggtagcrgacgcctataatcccagctactca

SEQ ID NO: 10532 - DNA, 50 bp, homo sapien
tttgaggtggaattttggaaatgagraccatgatgaatgaatgatggaaa

SEQ ID NO: 10533 - DNA, 50 bp, homo sapien
tgtctgactgtgatacaaaaagaaartaatgcaatatatctcagcatttg

SEQ ID NO: 10534 - DNA, 50 bp, homo sapien
aatacaggaaatgaaataccaaaaarttataagccatatagaaaacaaat

SEQ ID NO: 10535 - DNA, 50 bp, homo sapien
agactgacaatatgattggagctagkaataatttatgacagtagactttc

SEQ ID NO: 10536 - DNA, 50 bp, homo sapien
acatctacaaagatgccttgtagtayggctaagaggtcacagcatgttaa

SEQ ID NO: 10537 - DNA, 50 bp, homo sapien
taaataatgaacagatggtgattctmaagtgagtggtagcaggtgatttt

SEQ ID NO: 10538 - DNA, 50 bp, homo sapien
ctaggaaaacaattcagtccatgtayctgttaaaaacagcttttgaggaa

SEQ ID NO: 10539 - DNA, 50 bp, homo sapien
tgtataaatacaggcaagttacctayccagctatgcctctgtttcttcat

SEQ ID NO: 10540 - DNA, 50 bp, homo sapien
aaatatggctgttgctagctcttcaytcatggccttacatcatataatac

SEQ ID NO: 10541 - DNA, 50 bp, homo sapien
tggtgtggaagaagctggacacataytagagtcatgcaagtgaaagaaca

SEQ ID NO: 10542 - DNA, 50 bp, homo sapien
actcaaggtccattctctccctacaygcagaacaaatgttaagtcatatt

SEQ ID NO: 10543 - DNA, 50 bp, homo sapien
ggggacctcactcaaatttgatcaaytggagtccttcttgaatgctttga

SEQ ID NO: 10544 - DNA, 50 bp, homo sapien
aaacaaccttatgaagactacaatamtatatgttttaaggatacatttga

SEQ ID NO: 10545 - DNA, 50 bp, homo sapien
ttacagtgatggctaaattccatcastctatttgattcaggctggtgtta

SEQ ID NO: 10546 - DNA, 50 bp, homo sapien
cccattaagattacccatttgattasatgggctggcttcccctgtagatt

SEQ ID NO: 10547 - DNA, 50 bp, homo sapien
aattggacctccaaggatgatttaawtaagatttgatttagtgagaaaaa

SEQ ID NO: 10548 - DNA, 50 bp, homo sapien
ttgaggaatataaccgtattgactaygtaaaggacagttagaacataata

SEQ ID NO: 10549 - DNA, 50 bp, homo sapien
attaagtctttattatttgcttttcracctaattatttgtttattaaagt

SEQ ID NO: 10550 - DNA, 50 bp, homo sapien
cttctggttaagacattctgctctaratacctcttcccttctagaagcta

SEQ ID NO: 10551 - DNA, 50 bp, homo sapien
gatctcatactttaataaaattggtsaagacttacactaaagttgccaac

SEQ ID NO: 10552 - DNA, 50 bp, homo sapien
aaatgtgatttgagcttggtatacawaatcattcataagaattagatgtc

SEQ ID NO: 10553 - DNA, 50 bp, homo sapien
acttcataatttaaaacattaggaayattgagagttaaccttttatttct

SEQ ID NO: 10554 - DNA, 50 bp, homo sapien
tgtgaagaatgaatctctcactaggmagttgcattagaggatcaggaata

SEQ ID NO: 10555 - DNA, 50 bp, homo sapien
ttgttttgcatggtttcagtttgcaygaccattttttactgtcccagact

SEQ ID NO: 10556 - DNA, 50 bp, homo sapien
cgcataagaatggcattttaaggcasaaatagaacactttgaattactgt

SEQ ID NO: 10557 - DNA, 50 bp, homo sapien
atactagtaaccctagtgattgtgtraataaaaaaacgtagctcttataa

SEQ ID NO: 10558 - DNA, 50 bp, homo sapien
tattacagatgaatattttaaaggasaaatagcctaccagttctgctaat

SEQ ID NO: 10559 - DNA, 50 bp, homo sapien
tggtcagagcactgtggagttgtagwaaaacaaatttgcagactatgttc

SEQ ID NO: 10560 - DNA, 50 bp, homo sapien
gtagaggcagtcaatatttttgtcarggtaatgatgcaaagagatatgta

SEQ ID NO: 10561 - DNA, 50 bp, homo sapien
gatactgattaggcaagaaatgtaasaccaagtgaagaaatggagtccaa

SEQ ID NO: 10562 - DNA, 50 bp, homo sapien
tttctgtactccttatagaaagtgaraaattgttcctgtcagtggactga

SEQ ID NO: 10563 - DNA, 50 bp, homo sapien
ttaggactaaatatttctactgatcracactgctcacaagccttcatgat

SEQ ID NO: 10564 - DNA, 50 bp, homo sapien
cctccttctctgctttccaaagtagragtagccattgaagcagtagagag

SEQ ID NO: 10565 - DNA, 50 bp, homo sapien
caaaaagccctttctccaaaacaaaygagaactctataatagggcattct

SEQ ID NO: 10566 - DNA, 50 bp, homo sapien
gcaaatttaagcattctgaacctacratttcatggtttaggacttgcctg

SEQ ID NO: 10567 - DNA, 50 bp, homo sapien
tataagattttatgattattcttgamgtttttgatgcaaaaggaaaatat

SEQ ID NO: 10568 - DNA, 50 bp, homo sapien
gtagaactgagctgttcatattttcmcattggcataaacgcaaaactaaa

SEQ ID NO: 10569 - DNA, 50 bp, homo sapien
cacctatcttacaagattcttctcargatcaggaataatgtgtatataac

SEQ ID NO: 10570 - DNA, 50 bp, homo sapien
atgcaataatgttatcagaattgccrcaacccattaattataaacataag

SEQ ID NO: 10571 - DNA, 50 bp, homo sapien
ttccaaaacgcccttcaaaaggaaargcctctggatcaaataaatattgg

SEQ ID NO: 10572 - DNA, 50 bp, homo sapien
agttttgaaataaaggtctccctgcyataaataatttgaatgtcacatat

SEQ ID NO: 10573 - DNA, 50 bp, homo sapien
attggagcagatgatcactagagaamcttccaatgttaagacttaaagtt

SEQ ID NO: 10574 - DNA, 50 bp, homo sapien
atctcaggagcaggcacatacctaayaggtcctcaataacgatcgtccta

SEQ ID NO: 10575 - DNA, 50 bp, homo sapien
atataaacaagtaggcaggtaattarcatcagtgtaaagagagtctctag

SEQ ID NO: 10576 - DNA, 50 bp, homo sapien
ctggaccgagacaatgccgtatctarccgaaaagcaacttagccaggcat

SEQ ID NO: 10577 - DNA, 50 bp, homo sapien
gcaggtatggtatgtgacaatcaaartacaattcttggtcaggcgtagtg

SEQ ID NO: 10578 - DNA, 50 bp, homo sapien
aggtatttccagtacccagtacaaamttctattgttggtcttaactcact

SEQ ID NO: 10579 - DNA, 50 bp, homo sapien
attgaatggtaaatttagacctagartacaatgactggttgtttaagaaa

SEQ ID NO: 10580 - DNA, 50 bp, homo sapien
tgagtatggagagttagaatattaamaatgcagtggaggaaaactgctaa

SEQ ID NO: 10581 - DNA, 50 bp, homo sapien
ctttcctgtcacacacaaactttgayacaaccaatggtgctggagagtgt

SEQ ID NO: 10582 - DNA, 50 bp, homo sapien
ggtgagtgtcctttgtgggccctgayaacaagatctgctcctctaaattt

SEQ ID NO: 10583 - DNA, 50 bp, homo sapien
aattaatttattcttaattattcccrcatttacagtagactttcccaatg

SEQ ID NO: 10584 - DNA, 50 bp, homo sapien
gtgtgtcatacacaaaataaatatawgccaaatggatggctgagggaaga

SEQ ID NO: 10585 - DNA, 50 bp, homo sapien
gatgctccctctacaaggttccttayattggaaaagccaatgacctgtca

SEQ ID NO: 10586 - DNA, 50 bp, homo sapien
tccattttgtacactaggatcttccrccaaatattaaagtcattaaatgc

SEQ ID NO: 10587 - DNA, 50 bp, homo sapien
gttttgactgcaattgcttttgaaaygattcttccaggaggctccctgaa

SEQ ID NO: 10588 - DNA, 50 bp, homo sapien
atgttttagttatgaaatcacagtgraagtcatgaggattccttttcagg

SEQ ID NO: 10589 - DNA, 50 bp, homo sapien
aacagtggcttctctttgttataackccaagtctagatctccaacaaccg

SEQ ID NO: 10590 - DNA, 50 bp, homo sapien
atccaggcactggcatgtacaacaaraggaagtattaacaatgactctga

SEQ ID NO: 10591 - DNA, 50 bp, homo sapien
ttctaagtgaatttatgaaaataagsctcctgggaaagtttttgagtctg

SEQ ID NO: 10592 - DNA, 50 bp, homo sapien
atactttttctaatgggggaactccracaatcttagctctgagaatttgc

SEQ ID NO: 10593 - DNA, 50 bp, homo sapien
gaaatgactcacctagagattggaaraagttagttgtagaaagaggtgta

SEQ ID NO: 10594 - DNA, 50 bp, homo sapien
ttcatgaagataaaatctctttatamctattggctgcaatcttgtcaggt

SEQ ID NO: 10595 - DNA, 50 bp, homo sapien
taatacgtaataatacataaataaartaataggacatgcatgccagactg

SEQ ID NO: 10596 - DNA, 50 bp, homo sapien
accctattttctcctctactaccaayatcaaaacctatactagcaacaca

SEQ ID NO: 10597 - DNA, 50 bp, homo sapien
gaacattaatacatgattaaataccygaatgaatgggtggtggaaatagt

SEQ ID NO: 10598 - DNA, 50 bp, homo sapien
gcctcatccctctgtctctgattaarttaaaatgaagaaaggacatgcta

SEQ ID NO: 10599 - DNA, 50 bp, homo sapien
aaaaaaaaaacctcaaaatcttgaamtaggtcttactgatatgtctaagt

SEQ ID NO: 10600 - DNA, 50 bp, homo sapien
ctttttcctgaaaagagcaactttgyagatccttttttcagtaggaattg

SEQ ID NO: 10601 - DNA, 50 bp, homo sapien
cacctattttggtaggtattcccaaygatagagctacttatatattttct

SEQ ID NO: 10602 - DNA, 50 bp, homo sapien
gggcaagcctacccatggagtttgasacatacagtttaagtgccatagta

SEQ ID NO: 10603 - DNA, 50 bp, homo sapien
agcctcctccctaggtttgagacacrcttttccactggagctcttcttgt

SEQ ID NO: 10604 - DNA, 50 bp, homo sapien
agcagaacccttaattatttgaaaascaatttttatatttctgtattctg

SEQ ID NO: 10605 - DNA, 50 bp, homo sapien
ttttctaggcctgcaactcagctacygacgtgagatctccctgggctctt

SEQ ID NO: 10606 - DNA, 50 bp, homo sapien
ttcattccagtttgttgttgttttcrataaagacattcctgctggtcttc

SEQ ID NO: 10607 - DNA, 50 bp, homo sapien
cattttctctcttctctattacacarataaatcaagtcctcttggcctct

SEQ ID NO: 10608 - DNA, 50 bp, homo sapien
tctcaaggatataatgataagtaaayagacaggctgacatgctatctata

SEQ ID NO: 10609 - DNA, 50 bp, homo sapien
ctggtgccctagagtgtctgaactayaatataaaaccatcatgtataact

SEQ ID NO: 10610 - DNA, 50 bp, homo sapien
cattagaaaatcagccaagctcaatraatggagaatctgtcagcacatgt

SEQ ID NO: 10611 - DNA, 50 bp, homo sapien
gcaaatatttcacttagaacttcaayttttgaatctgtaaaacagggaaa

SEQ ID NO: 10612 - DNA, 50 bp, homo sapien
aaaatgagatttttttctaaactggraaattctctagccataatgacctg

SEQ ID NO: 10613 - DNA, 50 bp, homo sapien
cctaaagcagctgcctgttggaataragcgtcctttctccatctcaatct

SEQ ID NO: 10614 - DNA, 50 bp, homo sapien
acacgtgagccaagtgcataataatrataaaacgtaataagatcgctact

SEQ ID NO: 10615 - DNA, 50 bp, homo sapien
tccctgcagatgagagtttaataaakgtattccagtggtctgcagatttt

SEQ ID NO: 10616 - DNA, 50 bp, homo sapien
ttaatagttcatgaccagaaacgtayctaccacagtgtataataaaactg

SEQ ID NO: 10617 - DNA, 50 bp, homo sapien
tcctcttgatgattatgcagacacartgggatgcatcttaagcaggggac

SEQ ID NO: 10618 - DNA, 50 bp, homo sapien
attagtgtattcagtatttgtgataygatagaaggatgaaaatagttcag

SEQ ID NO: 10619 - DNA, 50 bp, homo sapien
cagccacaggaagcataatcacaaayttgaacagaactgactaacttaga

SEQ ID NO: 10620 - DNA, 50 bp, homo sapien
tacttgtatgaatcaaaagcacctcrcactccatatattcaaatctcatc

SEQ ID NO: 10621 - DNA, 50 bp, homo sapien
aggtaaaaccagatactacaactcaytcttgattcttccttttctgtcaa

SEQ ID NO: 10622 - DNA, 50 bp, homo sapien
tttcaatgtttctaaactcaaattcracacttttaaagagtgtcaaaggc

SEQ ID NO: 10623 - DNA, 50 bp, homo sapien
ggtggacgtgattttattcaccttarggcaacataaaatcttctataatt

SEQ ID NO: 10624 - DNA, 50 bp, homo sapien
aaatgagaggcagtaagacaaactgscagtgaagacaaaaatttcagagc

SEQ ID NO: 10625 - DNA, 50 bp, homo sapien
acattcgattagcattctacttagarctttcaccatatatgtcctgttct

SEQ ID NO: 10626 - DNA, 50 bp, homo sapien
tacatttttaaaatctgttctataakatatgtggatttccaagtggagtt

SEQ ID NO: 10627 - DNA, 50 bp, homo sapien
acccttttctagatgtatttatgcaraggcaagctcctgctatttgacct

SEQ ID NO: 10628 - DNA, 50 bp, homo sapien
gaaatgtttgaactataagaaataaraccagaaatatggatttgttgcaa

SEQ ID NO: 10629 - DNA, 50 bp, homo sapien
catgtgtggagggttttcctcatacrctaaccaagcaattctgcagtgga

SEQ ID NO: 10630 - DNA, 50 bp, homo sapien
tgttttttaatatggtgattctatargacattcatgtaaaggatgggaat

SEQ ID NO: 10631 - DNA, 50 bp, homo sapien
cccagtgatgccaaaagggaatgagsatacaaagtgctggcccaggtgtt

SEQ ID NO: 10632 - DNA, 50 bp, homo sapien
agtttgttggtaataaaattttgaamgtctgtctttggcctttttctctc

SEQ ID NO: 10633 - DNA, 50 bp, homo sapien
tacatatgcatataaattcatagagwaagttctggaaagatatatttcaa

SEQ ID NO: 10634 - DNA, 50 bp, homo sapien
acagaggtgaatataaatttcagtayctaatgggagagacagatataaaa

SEQ ID NO: 10635 - DNA, 50 bp, homo sapien
agagtctggggactgactgaaaccartgatgagaaaatgctacaaaagct

SEQ ID NO: 10636 - DNA, 50 bp, homo sapien
ctctggaggacattggccaacatccrctaaaataaataaacattccaatt

SEQ ID NO: 10637 - DNA, 50 bp, homo sapien
aagaaagactcatgagttcattcatragaggcggaagattgctttgggtt

SEQ ID NO: 10638 - DNA, 50 bp, homo sapien
atcttgtacttcaatagtcaaaaaaygctacacatcccatactcttgaaa

SEQ ID NO: 10639 - DNA, 50 bp, homo sapien
aggaaacgaattacatttccgatatyaaagtcctgatatatatttaagag

SEQ ID NO: 10640 - DNA, 50 bp, homo sapien
atcaaaaataatacaaagttctaaargtacagtgtaacaactatgtacac

SEQ ID NO: 10641 - DNA, 50 bp, homo sapien
aatcaagagcatagaaaatgataaasatgtagaaaataaattttaaagtc

SEQ ID NO: 10642 - DNA, 50 bp, homo sapien
attaatctgggaaagaacctaaaagmcttggctcccttgcaggaaatatt

SEQ ID NO: 10643 - DNA, 50 bp, homo sapien
gcagagggctccattctctttgtgtraatccatgtttgctggcatcccgg

SEQ ID NO: 10644 - DNA, 50 bp, homo sapien
ctttttactctttttgatagttttasaatgttgttccatatgaacacatt

SEQ ID NO: 10645 - DNA, 50 bp, homo sapien
cacttgagtttcttcacctacactaygacacttttcagtatttttccact

SEQ ID NO: 10646 - DNA, 50 bp, homo sapien
taatcttttcacaattccatgaaacygacattaggacacatcgtatagca

SEQ ID NO: 10647 - DNA, 50 bp, homo sapien
atttccagattataaaattaacaacygatgtgattttaatgaatcatctc

SEQ ID NO: 10648 - DNA, 50 bp, homo sapien
catgctgagtagacagaagtctgtgkaactatgcaggagcaagcttcaac

SEQ ID NO: 10649 - DNA, 50 bp, homo sapien
gataaaatgaggcagaagatttagayagatgatattaatagataattagg

SEQ ID NO: 10650 - DNA, 50 bp, homo sapien
aagacaaaaacacagatggtttccargtcaaatatagatgatataaaagt

SEQ ID NO: 10651 - DNA, 50 bp, homo sapien
agaaagtaattctagaacaacctacyacttactttagagcttcactttta

SEQ ID NO: 10652 - DNA, 50 bp, homo sapien
gaggaaacaaaatttctaatgtttargaagttctacgaaaatgaacagtt

SEQ ID NO: 10653 - DNA, 50 bp, homo sapien
gaagcaaagtctgtaagaaataatayggatagaggtgcagctggagacat

SEQ ID NO: 10654 - DNA, 50 bp, homo sapien
ataaaagggttttttgtatgttcgtraagttcacataggattaagggaaa

SEQ ID NO: 10655 - DNA, 50 bp, homo sapien
tgatcattacaaattagctagtctayggtattctgtttatagcaaacaca

SEQ ID NO: 10656 - DNA, 50 bp, homo sapien
atattgatacgtcaattcggtaagargtcaagattcaggaaccgtgaagg

SEQ ID NO: 10657 - DNA, 50 bp, homo sapien
aagtactaagcagcctgtgagaagartaggcagaaaagaaaagattaggc

SEQ ID NO: 10658 - DNA, 50 bp, homo sapien
attacatgccaagcaccggtgaagamaattatgcacaaaaatcaacactg

SEQ ID NO: 10659 - DNA, 50 bp, homo sapien
tgaaaatgaaaggccatgagtctgawccaaggtgaactcagctggctgct

SEQ ID NO: 10660 - DNA, 50 bp, homo sapien
atcagccttgatcttcctacatccamatgttctctgtgggcttggctttc

SEQ ID NO: 10661 - DNA, 50 bp, homo sapien
tagcaacttcagacccaaactcttawctgtgacactgcagccatctttct

SEQ ID NO: 10662 - DNA, 50 bp, homo sapien
tgttgaagccttgtctgcttaattgracagtggatctctcgggtccctgt

SEQ ID NO: 10663 - DNA, 50 bp, homo sapien
tcaatccagtttagctaaattgacaytctatgaaaccaccacacatatct

SEQ ID NO: 10664 - DNA, 50 bp, homo sapien
gctaagaaaagttttgagcaactaartattgtaaccaccaagattatgaa

SEQ ID NO: 10665 - DNA, 50 bp, homo sapien
aaagattatggcaagtgccacaaagrctattaatttataaacagtagaag

SEQ ID NO: 10666 - DNA, 50 bp, homo sapien
acaggcctcaaggtgctcctaaaaawtccctgcaaagattcgacaaaaac

SEQ ID NO: 10667 - DNA, 50 bp, homo sapien
ttagctgacccacacatctggtttckctgacatttgtagtctcaccttaa

SEQ ID NO: 10668 - DNA, 50 bp, homo sapien
gcatagaaacatacaattgcatcacrggaacaatttgtatttgtagtttc

SEQ ID NO: 10669 - DNA, 50 bp, homo sapien
tgcccttgattacatttacatttacyactaattccctgagctcttgaaca

SEQ ID NO: 10670 - DNA, 50 bp, homo sapien
aaaagtcagaaacgtaatagctttaraaattgaataaatgactgcatctt

SEQ ID NO: 10671 - DNA, 50 bp, homo sapien
ggtgtgtcatttaatctctataagtsaaggattgttcatctgtaaaacgg

SEQ ID NO: 10672 - DNA, 50 bp, homo sapien
aaggataaaatgggacaatgcataaygggtttcatatagggaatgaactc

SEQ ID NO: 10673 - DNA, 50 bp, homo sapien
ataacttgaaccctgtctatgactcratttctgacatagtaaacgtacct

SEQ ID NO: 10674 - DNA, 50 bp, homo sapien
aggtgacaagattgccagcaaacagyaagattccatatttctagagaaac

SEQ ID NO: 10675 - DNA, 50 bp, homo sapien
atgtaagagagtaagtttacaaaaawgtccttgatgtttgttgaatagta

SEQ ID NO: 10676 - DNA, 50 bp, homo sapien
gaactatctcaaacacaagtaaagcrgaacttcttttaaaggaaaattat

SEQ ID NO: 10677 - DNA, 50 bp, homo sapien
cttattatttcaaaagctattttgcyagtctattaaaagctattagaact

SEQ ID NO: 10678 - DNA, 50 bp, homo sapien
aatcaacatattaattgtatacgtakagtaattttgatatacttcaagac

SEQ ID NO: 10679 - DNA, 50 bp, homo sapien
ttgagaactgtcaaggaattgcaagsataaacagatttttattttagaaa

SEQ ID NO: 10680 - DNA, 50 bp, homo sapien
tccttcaatattgacacaataaagamagacagttggtatagctatctttc

SEQ ID NO: 10681 - DNA, 50 bp, homo sapien
agagaagtgtaacgctatttaagcaygttcctgtctgaccacttgggcac

SEQ ID NO: 10682 - DNA, 50 bp, homo sapien
tgaagattaaaaaaaatgccaaccaraacagattctatttgtaagtatgt

SEQ ID NO: 10683 - DNA, 50 bp, homo sapien
ccaagagctttatagatggtccaagyatcttgcataaactatatccgtgt

SEQ ID NO: 10684 - DNA, 50 bp, homo sapien
atagaatgtcacatactaataatgawgaggccatgcctataaagttatac

SEQ ID NO: 10685 - DNA, 50 bp, homo sapien
tttccaagtatgtttcagcacaggarataaaatcatgctcctttggagtc

SEQ ID NO: 10686 - DNA, 50 bp, homo sapien
cagatctcatttcaatgtctggaaayctgtaatctataagaagcaaatgt

SEQ ID NO: 10687 - DNA, 50 bp, homo sapien
gaataaagtatcatttccaattaaayatgattgtgctgcctgatttattt

SEQ ID NO: 10688 - DNA, 50 bp, homo sapien
tatggtagggtatcagccctagaaamgtatccaagaaatagataagaatt

SEQ ID NO: 10689 - DNA, 50 bp, homo sapien
tcagggggagatagcaacaggatgasacggcaacattttcttttatgctc

SEQ ID NO: 10690 - DNA, 50 bp, homo sapien
ctccctgcaataggcagctacccagmaatgttatctatacttatgacatc

SEQ ID NO: 10691 - DNA, 50 bp, homo sapien
attaaagaagaaagaggctacctacmgcttcatatttcccacagaatatc

SEQ ID NO: 10692 - DNA, 50 bp, homo sapien
tgtaatatttatactctggagattaygatggatcttgagcccttcattta

SEQ ID NO: 10693 - DNA, 50 bp, homo sapien
ggtaactctcagtttagcgacattaracatgccttccttcttctgtggct

SEQ ID NO: 10694 - DNA, 50 bp, homo sapien
atcatgtgtggtattgagtcaaacayactgaagcatttctgggaggtgaa

SEQ ID NO: 10695 - DNA, 50 bp, homo sapien
tatcctggaagcagcatacagaccartagaaaatgaaatgatccccaagt

SEQ ID NO: 10696 - DNA, 50 bp, homo sapien
tgccaattcaaaaaacaagggctcaytaaaattctatcatcttttccccc

SEQ ID NO: 10697 - DNA, 50 bp, homo sapien
aacgaatggatggaataatgttatarggctgtgataaaaataagtactag

SEQ ID NO: 10698 - DNA, 50 bp, homo sapien
tctggctgtggtttctgaagtcatawtaaattacattaaaagtacttctc

SEQ ID NO: 10699 - DNA, 50 bp, homo sapien
aaaactcttgtgaaatgttcagatamactgcaattttaaataaattttat

SEQ ID NO: 10700 - DNA, 50 bp, homo sapien
aaattctgttcatttcttaccagacrgattatataaaatcgctaattctc

SEQ ID NO: 10701 - DNA, 50 bp, homo sapien
ttatttaaattctgaccatgctttcyaattatgaaaatatttcagtcacc

SEQ ID NO: 10702 - DNA, 50 bp, homo sapien
cttgcttttgttgtatgcaagataargttgcctttcatttatgtcacatc

SEQ ID NO: 10703 - DNA, 50 bp, homo sapien
aataatggaagtgaaagatgcttcayggaatgtaaaagattattttgact

SEQ ID NO: 10704 - DNA, 50 bp, homo sapien
ctggccgttcacgtatgtaatagccygcaatatttgagcaaactgatata

SEQ ID NO: 10705 - DNA, 50 bp, homo sapien
tattgcaggctattacatacgtgaayggccaggaagtggcagtttccagg

SEQ ID NO: 10706 - DNA, 50 bp, homo sapien
cataattattatgtagggtctgataycaatttctcttcattagagattga

SEQ ID NO: 10707 - DNA, 50 bp, homo sapien
aagaagaaggatgaataacttccaaytcatttaaacttaattagaaagag

SEQ ID NO: 10708 - DNA, 50 bp, homo sapien
attaaaacagtccaaggagatacgaygaaaccttctcaagagtgctggaa

SEQ ID NO: 10709 - DNA, 50 bp, homo sapien
ctagtcatgtgtgtcctgagatactsaccctttcagctcttgggtaaact

SEQ ID NO: 10710 - DNA, 50 bp, homo sapien
tcgtagatggatgattgtgtcctaayaggtgaagaggacagggacaggga

SEQ ID NO: 10711 - DNA, 50 bp, homo sapien
aaaagaacaatcagctagcaattatraaagttcaatagctagaaagttat

SEQ ID NO: 10712 - DNA, 50 bp, homo sapien
atagtattgatttgtcagaaaacgamagtagatgacacagtattttttct

SEQ ID NO: 10713 - DNA, 50 bp, homo sapien
ttataccttcctctgctgactttaartagttcatcctaccttgcttggga

SEQ ID NO: 10714 - DNA, 50 bp, homo sapien
ttgatgtgaaaatttaaggcaaatcracttcctatgagatacagattttg

SEQ ID NO: 10715 - DNA, 50 bp, homo sapien
aggtgtcccaaatgtccactgtcaamctctaaaagtggactttcttcctg

SEQ ID NO: 10716 - DNA, 50 bp, homo sapien
tgataataaacgtctactttctaaakcaacttctttcgtcattctataag

SEQ ID NO: 10717 - DNA, 50 bp, homo sapien
aactttcctcagctgctgtagtagamacactcataaccctgtctcaagaa

SEQ ID NO: 10718 - DNA, 50 bp, homo sapien
ccttgggcatctgctagcttcatgayggtcagaccttgaatctttaaact

SEQ ID NO: 10719 - DNA, 50 bp, homo sapien
aataaaaacactacctcagaagaaayttatgtctcaagaagaaatcaaat

SEQ ID NO: 10720 - DNA, 50 bp, homo sapien
caatgcaaaaactaatccaaagaaarttgatgttagcttattaaagaaaa

SEQ ID NO: 10721 - DNA, 50 bp, homo sapien
cattagtctatttgtctttatactastaacataacattttgattactgta

SEQ ID NO: 10722 - DNA, 50 bp, homo sapien
aagtgaaacttgaaaacaatggccaragtactaagaactaatgtttcttc

SEQ ID NO: 10723 - DNA, 50 bp, homo sapien
tgggttgaagttatttaccaggtgawcttatttcaatgtaataatgactc

SEQ ID NO: 10724 - DNA, 50 bp, homo sapien
ccttgtattattatattaactggaargatgataaagtgaacttacaactt

SEQ ID NO: 10725 - DNA, 50 bp, homo sapien
ctttcacagagtagcctaatgatccygcaagtttagcatatatctatctt

SEQ ID NO: 10726 - DNA, 50 bp, homo sapien
taaattaattgttagtactgccacartcatcaagtagagcccagactcct

SEQ ID NO: 10727 - DNA, 50 bp, homo sapien
ccttttctgcaaatgattacaaacartatccttccattgtcagaataaaa

SEQ ID NO: 10728 - DNA, 50 bp, homo sapien
tatggcaaataattttattatgatcwaaaaaggactcttgaagctagtta

SEQ ID NO: 10729 - DNA, 50 bp, homo sapien
ggaatacacaactgaagtttagaaayggacgtcttgctactgaatgtcag

SEQ ID NO: 10730 - DNA, 50 bp, homo sapien
gtggtcacacgcaggtgcagataaayctaaaggaaagaacgagaaagtta

SEQ ID NO: 10731 - DNA, 50 bp, homo sapien
atgttcaaccacactaataaaatcargtttgaacatccatttgttccaga

SEQ ID NO: 10732 - DNA, 50 bp, homo sapien
attgagtgactctctatgcagaaccyaaccttaactgcagctgtgaacat

SEQ ID NO: 10733 - DNA, 50 bp, homo sapien
gtccagcagtggcaccagcacgggckcttcaaatacaccaggtgagatta

SEQ ID NO: 10734 - DNA, 50 bp, homo sapien
acatttgagccaggacatgtgatacyagaagatataaagctatttagccc

SEQ ID NO: 10735 - DNA, 50 bp, homo sapien
catgttgttaagcgagtaaatcactwaacctctgtaacctctgtttttgt

SEQ ID NO: 10736 - DNA, 50 bp, homo sapien
accccacttttggacttgggtctaayggcaaaggcaagattgaacattgg

SEQ ID NO: 10737 - DNA, 50 bp, homo sapien
taaagggtgtatatatagcctatacmaattcacatattgggttcaaatag

SEQ ID NO: 10738 - DNA, 50 bp, homo sapien
tataaagcaatcaactttttttagcrcctcagagtatgccactgttacct

SEQ ID NO: 10739 - DNA, 50 bp, homo sapien
gaagaaataattcagccaagagatgyatagcaaggattaagtagcagagt

SEQ ID NO: 10740 - DNA, 50 bp, homo sapien
ggaaataggattaagtaagtccagakaagtagacagaagaatatttatga

SEQ ID NO: 10741 - DNA, 50 bp, homo sapien
gcttttagtgctcctgaagctagacraccaaagtataaaataacatatgt

SEQ ID NO: 10742 - DNA, 50 bp, homo sapien
agcaatttttaaccatttggagttcwctaaatacatcatactgctttatt

SEQ ID NO: 10743 - DNA, 50 bp, homo sapien
tgatattatccatgtttcatagatasgtaggctagaagtatattttgaga

SEQ ID NO: 10744 - DNA, 50 bp, homo sapien
caaaatatgaatgctgtgtttatgayataaatgaataaagagcagatgat

SEQ ID NO: 10745 - DNA, 50 bp, homo sapien
ctcatagacatactctagatttcccracaatttcatagtgaagcaggtca

SEQ ID NO: 10746 - DNA, 50 bp, homo sapien
aacttccacatagttaaaactggaakggataatagccggttcgtaaagct

SEQ ID NO: 10747 - DNA, 50 bp, homo sapien
caacaagcctaaataaagtttgaagscatcacatgaaatctgatagatga

SEQ ID NO: 10748 - DNA, 50 bp, homo sapien
atttgagtaaattagtgtaactaaaygcttttcacctaaatgctatataa

SEQ ID NO: 10749 - DNA, 50 bp, homo sapien
cagatgttttatacttccattttatragaaaaaactaggaaatacatttc

SEQ ID NO: 10750 - DNA, 50 bp, homo sapien
tttattttcatgttttatttttccartgatgcaagttagttttgtgaatt

SEQ ID NO: 10751 - DNA, 50 bp, homo sapien
ataggaaaaacacctcagtggatgcracatttaagggtggtggagtggtg

SEQ ID NO: 10752 - DNA, 50 bp, homo sapien
gcgattaagggaaagtctctcgttawctcttgtttttcatctctgaggac

SEQ ID NO: 10753 - DNA, 50 bp, homo sapien
tcaaaggactctgtttcatcattcamtatatcagtgttagaaaatacttt

SEQ ID NO: 10754 - DNA, 50 bp, homo sapien
tttctacctagatgtacattcactayggtctgagtctaatgtaacggcag

SEQ ID NO: 10755 - DNA, 50 bp, homo sapien
ttttcttgttttaggtatcactggartaggctctgagacatctattgaaa

SEQ ID NO: 10756 - DNA, 50 bp, homo sapien
agaagaacagtagtagactgtcaaayatgccttggatttaattgggtacc

SEQ ID NO: 10757 - DNA, 50 bp, homo sapien
aaacagcatagtagtactcatgttgraatcgcaaccagactagagatgtc

SEQ ID NO: 10758 - DNA, 50 bp, homo sapien
ctcaatttttaatgctaatcttttakggcaatcctattttagaagctaat

SEQ ID NO: 10759 - DNA, 50 bp, homo sapien
acatgtgcagtggtagtaacactaaratttctcatttggcaaccagcaca

SEQ ID NO: 10760 - DNA, 50 bp, homo sapien
tttaaaatgtatatacctttaagcakgaaacataaagtttggttggtaat

SEQ ID NO: 10761 - DNA, 50 bp, homo sapien
cttttaaaggacacatttatataacyactgaagagcaactgagaaaagaa

SEQ ID NO: 10762 - DNA, 50 bp, homo sapien
tataataagatgatgatccactaaamaactgaacatgcaagcatgaattg

SEQ ID NO: 10763 - DNA, 50 bp, homo sapien
agtgaaaaatgccactgtacacttaygagagaatgagcttttacacacaa

SEQ ID NO: 10764 - DNA, 50 bp, homo sapien
tgtggcatgaacaagatgtcggcccwagttctctctctaaacacttacta

SEQ ID NO: 10765 - DNA, 50 bp, homo sapien
acacactgccatttagcaagtaaaayagtttaatccacttatatttatta

SEQ ID NO: 10766 - DNA, 50 bp, homo sapien
tgaactggataagaaaaaaaattcartattcaaagagcatgatattccct

SEQ ID NO: 10767 - DNA, 50 bp, homo sapien
taccaggcacattcatgggacatccratacaatctataatttttgtaaat

SEQ ID NO: 10768 - DNA, 50 bp, homo sapien
aagttttaagttggcggaggttagckcattaaatttaaggaaacaagttg

SEQ ID NO: 10769 - DNA, 50 bp, homo sapien
ataaggcaattctagtaagaagagamaagataattcaatgctgaactact

SEQ ID NO: 10770 - DNA, 50 bp, homo sapien
acatctattgagcaactatttgcacyggatattataaatatcaacttaat

SEQ ID NO: 10771 - DNA, 50 bp, homo sapien
actcaggagcccagcaattgatacaygcctaaaatacaaagtgattaact

SEQ ID NO: 10772 - DNA, 50 bp, homo sapien
ggagatttccagccacatcttgcacygcacttttcatttcacataaccat

SEQ ID NO: 10773 - DNA, 50 bp, homo sapien
gtaatcagaaagtgaagtatgcaacragggaaacatgccaagctcaagga

SEQ ID NO: 10774 - DNA, 50 bp, homo sapien
gtaacaagatccattgttgatgaatmagaaaagtcttcagttaggtctag

SEQ ID NO: 10775 - DNA, 50 bp, homo sapien
aactgcaagaaattagactggtaaaytgataactgacacagggcccacat

SEQ ID NO: 10776 - DNA, 50 bp, homo sapien
tgagggcaagatttaaatacctagarataataaaaatcttaagctttgat

SEQ ID NO: 10777 - DNA, 50 bp, homo sapien
cgtaatgatgcaggtacttgaaaaayggagggctgcagggaggtaacaaa

SEQ ID NO: 10778 - DNA, 50 bp, homo sapien
caaataatcactataagagaaatgcrcttaaatacaataatgaactcatg

SEQ ID NO: 10779 - DNA, 50 bp, homo sapien
caatctgtttgtttttagacgttagratcttctccttttctgcttcccct

SEQ ID NO: 10780 - DNA, 50 bp, homo sapien
agagccagaagaacttggaggaccawtgattttaaaggtttctttgtttt

SEQ ID NO: 10781 - DNA, 50 bp, homo sapien
gtataagagatttccaccgtggaaawttggactccgagctctttgagagt

SEQ ID NO: 10782 - DNA, 50 bp, homo sapien
ggcaggagttaatcaaacaaataaamgatgcatgctggagcataaggcaa

SEQ ID NO: 10783 - DNA, 50 bp, homo sapien
gtgtggtttcatctcacagaattaarcctctcttttgatggagcagggtt

SEQ ID NO: 10784 - DNA, 50 bp, homo sapien
gaaagaacacttggagagagaatgamcacgtactatggctataaattgtg

SEQ ID NO: 10785 - DNA, 50 bp, homo sapien
ggggctaaaacgatggaattacacakatttacccgtagtagactacaaac

SEQ ID NO: 10786 - DNA, 50 bp, homo sapien
ctatactaaattgcatcatactctamattatgaaaaatatttatttcctt

SEQ ID NO: 10787 - DNA, 50 bp, homo sapien
cacctctgagttgctgattataaaakaagtgatacattctttttaagaac

SEQ ID NO: 10788 - DNA, 50 bp, homo sapien
aaagcctttatatgactagtaccaascacattatatagcaacaaagagtc

SEQ ID NO: 10789 - DNA, 50 bp, homo sapien
tttgatccattgtggctagattttcragatcttacaacttaagaaacaat

SEQ ID NO: 10790 - DNA, 50 bp, homo sapien
tggtgaaacaagggctctacacttgsagtctgctaacaaggctgatccat

SEQ ID NO: 10791 - DNA, 50 bp, homo sapien
ggggaggcttggcttgtcaaagaccygaccgagagtcctaggatagtaag

SEQ ID NO: 10792 - DNA, 50 bp, homo sapien
ttctttttcttttcattgttagaaayatgcttgaaatattgatattctac

SEQ ID NO: 10793 - DNA, 50 bp, homo sapien
tgagaaagatcttgtctgccagcgtsaatatttttttcctatcatcctgc

SEQ ID NO: 10794 - DNA, 50 bp, homo sapien
tattagagctgggctagtctagtaaycttgaatttggttaacaatacttc

SEQ ID NO: 10795 - DNA, 50 bp, homo sapien
gttctgatttcaggttacatgagtaraatatttaaaaatcagggagagta

SEQ ID NO: 10796 - DNA, 50 bp, homo sapien
ttaagagagaatagtgtcaagtctargcctgtaggtaacaaagaatgaag

SEQ ID NO: 10797 - DNA, 50 bp, homo sapien
tatctctgcagatgagaagtaataargtcaaagataagaggtacatgacc

SEQ ID NO: 10798 - DNA, 50 bp, homo sapien
cagagaaaaagtgctgtctataaaayaggaagttagccctcacaagacag

SEQ ID NO: 10799 - DNA, 50 bp, homo sapien
atttaggtaaaaatctttattatcargagttgagctaagagttattaaat

SEQ ID NO: 10800 - DNA, 50 bp, homo sapien
caccaaaatattgaaggtaaataagmctgtgacatggttggagctcaaca

SEQ ID NO: 10801 - DNA, 50 bp, homo sapien
cacactgaatgacaggtagaaaaaarggaccattatttagaccccagagg

SEQ ID NO: 10802 - DNA, 50 bp, homo sapien
agggggtaggcctgttctttatttcscagtgcacttccataatatgaatg

SEQ ID NO: 10803 - DNA, 50 bp, homo sapien
acacaactcctggaaactcagagacrggaagatggatttgatttgggcct

SEQ ID NO: 10804 - DNA, 50 bp, homo sapien
cctcttccccatcttcaccctcatckgaattgtaccattacttggtcact

SEQ ID NO: 10805 - DNA, 50 bp, homo sapien
aaggaaaaacaaacccaaaaggaagyccctatgatttgaagaaacttgca

SEQ ID NO: 10806 - DNA, 50 bp, homo sapien
aatgtcacatttgttttcagttttayggttaaatattttactttccccca

SEQ ID NO: 10807 - DNA, 50 bp, homo sapien
atatgccagcatcttcagaccttacrgctaggacactactgcttccttgt

SEQ ID NO: 10808 - DNA, 50 bp, homo sapien
catgtaccctgccctcaagagttcaytatttggatgcaaatagcaggatt

SEQ ID NO: 10809 - DNA, 50 bp, homo sapien
actgcttaggtagtggaagactagargacaatgtgtatgcatgttttggt

SEQ ID NO: 10810 - DNA, 50 bp, homo sapien
aaattctccatatgtttacaagcagsatctaaggagcaatgatctcaaaa

SEQ ID NO: 10811 - DNA, 50 bp, homo sapien
tacagttacaggtgctactggaatcraaatcagcacaaggactttagatt

SEQ ID NO: 10812 - DNA, 50 bp, homo sapien
gaataagcaaataattacaaagctargatccaagaaagccaaaatcgaca

SEQ ID NO: 10813 - DNA, 50 bp, homo sapien
tttacctactcaacacattttaaccratttccaagagttctatttacctt

SEQ ID NO: 10814 - DNA, 50 bp, homo sapien
agcccttaagtgtagctttaaggaakgttatagaatttggaagaccagag

SEQ ID NO: 10815 - DNA, 50 bp, homo sapien
cccaaggagatcacaatctagtcaakaagtcaagcatattaatctaacaa

SEQ ID NO: 10816 - DNA, 50 bp, homo sapien
gtgctgccagaagctactgttttaartcatcattgcaaagggtagtgtgt

SEQ ID NO: 10817 - DNA, 50 bp, homo sapien
gaaaagttatggttatctctcataaytgttgaaaagaataaaccagataa

SEQ ID NO: 10818 - DNA, 50 bp, homo sapien
gtggtcccatttctgtgtcagactcrctaagccatgaaggtgtgagctag

SEQ ID NO: 10819 - DNA, 50 bp, homo sapien
aagcaaccatgcaattgccgcactcrctccacatttgccgaaaaggatat

SEQ ID NO: 10820 - DNA, 50 bp, homo sapien
ctgcttgtaaaatatttacatgcaaytggtacttggtagttgttttcaat

SEQ ID NO: 10821 - DNA, 50 bp, homo sapien
atttctttttaaggatacttgcatayggcttacacgggagatagacagat

SEQ ID NO: 10822 - DNA, 50 bp, homo sapien
gctcccagtctggtagagcatatccraattcatgagaaaggccagaagtc

SEQ ID NO: 10823 - DNA, 50 bp, homo sapien
cctccagggagcagaatgaaccgaasggagcactgaacaagaactttcta

SEQ ID NO: 10824 - DNA, 50 bp, homo sapien
ttttttttaacaggtaactgttataragtgggataggaaaaaccctgttc

SEQ ID NO: 10825 - DNA, 50 bp, homo sapien
tgttatagagtgggataggaaaaacyctgttcctgtagaattccttacta

SEQ ID NO: 10826 - DNA, 50 bp, homo sapien
ggtcagtttgagcttccaatccccaygtcaggtatcattagcacccagtc

SEQ ID NO: 10827 - DNA, 50 bp, homo sapien
gacaaaaaataacaaaagctgacaargaggcagagaaaagaaaactcttt

SEQ ID NO: 10828 - DNA, 50 bp, homo sapien
tttagtttgaagtattgcgaattcarcatttagcagagacactcatattc

SEQ ID NO: 10829 - DNA, 50 bp, homo sapien
attttttaaatgctcctagagtgaaycaatgaaaatatctatctcaatgc

SEQ ID NO: 10830 - DNA, 50 bp, homo sapien
tgcagtgggtaacaaatagctacaargcgatcgtaagccatagctgctag

SEQ ID NO: 10831 - DNA, 50 bp, homo sapien
gtgtatacacaagaaaataaaaacaytgaactcagtcttggatagagaga

SEQ ID NO: 10832 - DNA, 50 bp, homo sapien
attaaagctttatgaagttgtcgtaygttttccaaattcaaataagctcc

SEQ ID NO: 10833 - DNA, 50 bp, homo sapien
gtttgagttgcagagcctgagagcawtataaggatgaattcttctgttct

SEQ ID NO: 10834 - DNA, 50 bp, homo sapien
aaagggaagaaatgtttaaaactcaycattttctaattttattatacttt

SEQ ID NO: 10835 - DNA, 50 bp, homo sapien
agaataaaaatgactcaatttcaagwaaaatctctgtcctctttgttttt

SEQ ID NO: 10836 - DNA, 50 bp, homo sapien
gtcggtgacaaatctgagtttcaccsaggtccatctgactctaaaattga

SEQ ID NO: 10837 - DNA, 50 bp, homo sapien
tgcccttcatctcctatctctctaartctttcatttgccacatttaccat

SEQ ID NO: 10838 - DNA, 50 bp, homo sapien
gtcctgatacagctattcaatgaackcagcgatgctgtcagagacctatc

SEQ ID NO: 10839 - DNA, 50 bp, homo sapien
acaggatcaacaacatcacaagtaartatgaattaagttgttagaaaagt

SEQ ID NO: 10840 - DNA, 50 bp, homo sapien
ccacacctgtgaactttctgtgtccygaattctgtctgaatgatacttga

SEQ ID NO: 10841 - DNA, 50 bp, homo sapien
ccaccccagcactgcaactcttaaayctcattctagctgggcagaggcca

SEQ ID NO: 10842 - DNA, 50 bp, homo sapien
accaaagaggctgtcagcaagaaggkaagcaacctgaggctggtccgagg

SEQ ID NO: 10843 - DNA, 50 bp, homo sapien
ttctcctaagattaaatcactgtaayagatttgaaaaccctttctcctca

SEQ ID NO: 10844 - DNA, 50 bp, homo sapien
ggaaacactccagaacattgatttasgcaaatattttatggctgcgacct

SEQ ID NO: 10845 - DNA, 50 bp, homo sapien
attcctgtcttgcaatctgagtaaarttcacaccactagaaaatgacaga

SEQ ID NO: 10846 - DNA, 50 bp, homo sapien
atatacacataatgaaatatttatgyagcttaaaaaggcaagaaatcctg

SEQ ID NO: 10847 - DNA, 50 bp, homo sapien
gtgtgaactttactcagattgcaagwcaggaataaagcaatgcccactct

SEQ ID NO: 10848 - DNA, 50 bp, homo sapien
tggtatttagcctttcacgttaacartcacttgtcccctaatgataggca

SEQ ID NO: 10849 - DNA, 50 bp, homo sapien
ccctggctggcatagaggggtcattsaataaatgctcaagggatgactgg

SEQ ID NO: 10850 - DNA, 50 bp, homo sapien
agggagtttacattctataattagaktaggaggaaaatgagaacccactg

SEQ ID NO: 10851 - DNA, 50 bp, homo sapien
ctccttcctagacaccaggagttaarcaacaatgccttttattttcttcc

SEQ ID NO: 10852 - DNA, 50 bp, homo sapien
ggcatcaggggtggaagaagaggagraatgatgtatgtatagctgattct

SEQ ID NO: 10853 - DNA, 50 bp, homo sapien
caggctcaaacaaacacagagtaatsaatttctgctaattattaggcact

SEQ ID NO: 10854 - DNA, 50 bp, homo sapien
ccaatgctgtagaactatcacctgaraaatgatgcaagtttttactgcca

SEQ ID NO: 10855 - DNA, 50 bp, homo sapien
atcagcttaaaaaattaaatttctaragccacatctgagataacagcact

SEQ ID NO: 10856 - DNA, 50 bp, homo sapien
agagttggtttaggactagtggatgscatcatgtcaagttgtggataatg

SEQ ID NO: 10857 - DNA, 50 bp, homo sapien
tagccaagtgtcactttaggaatcarctgccttgtctgaaaaatagaaat

SEQ ID NO: 10858 - DNA, 50 bp, homo sapien
ctacttgggaggaattttcccttacyatttcaaagtatctaatgacataa

SEQ ID NO: 10859 - DNA, 50 bp, homo sapien
ggaaaatacttgtgcaaatagcaagractgttcctgagggctgtgtaatg

SEQ ID NO: 10860 - DNA, 50 bp, homo sapien
ggcccagtgctgactcttttcaccayggaacaccaaagagactctccaca

SEQ ID NO: 10861 - DNA, 50 bp, homo sapien
gtccagagacagtggacagcgcactsaagaaggtaagactagatcaactc

SEQ ID NO: 10862 - DNA, 50 bp, homo sapien
gtttataatgggctgtatggtgtaaygaatgatgtttttattttgaaata

SEQ ID NO: 10863 - DNA, 50 bp, homo sapien
gggcaagaagctttagtccattagakatgttaaaccaaactccattctct

SEQ ID NO: 10864 - DNA, 50 bp, homo sapien
aatgtgagcaacagtcctgagtgacrcaggttgcagaatgtacatcctag

SEQ ID NO: 10865 - DNA, 50 bp, homo sapien
ttttcatgtttaaaatagcaatgtawccttcttagagatctaaagggata

SEQ ID NO: 10866 - DNA, 50 bp, homo sapien
ctctgggacaacacctaaaaatgcaygagatgtccctactgaagaattcg

SEQ ID NO: 10867 - DNA, 50 bp, homo sapien
cttcttagagatctaaagggataccragtaaggtggttggcagaggaatt

SEQ ID NO: 10868 - DNA, 50 bp, homo sapien
agtcctttataactggtttgtccaarttaggatccagttgaggaccctat

SEQ ID NO: 10869 - DNA, 50 bp, homo sapien
gagaggctgttttatccacttgttayattgacaactcccagtgcaatcgt

SEQ ID NO: 10870 - DNA, 50 bp, homo sapien
agatgggtttctgcaagtctctttamgcccgcaacatgggatactcttta

SEQ ID NO: 10871 - DNA, 50 bp, homo sapien
ggtaagttcaagtgtttggtggatayaggaatactggatgcgggaacaag

SEQ ID NO: 10872 - DNA, 50 bp, homo sapien
aaaggaatccatttgaagtaacatawaagacaccacatgattaacagctt

SEQ ID NO: 10873 - DNA, 50 bp, homo sapien
tagagctgttttaggttcacagtaamattgtccagaggtacaaaaactta

SEQ ID NO: 10874 - DNA, 50 bp, homo sapien
ctaacaggaaggcctgggtctacaaygaatatgacaagcggagaacaagc

SEQ ID NO: 10875 - DNA, 50 bp, homo sapien
agactcccatctcaaaaaaataataraagtccttgtcatagttcagatat

SEQ ID NO: 10876 - DNA, 50 bp, homo sapien
gagctaactttacaaagcacctaaaytggttcagaagttatactctttaa

SEQ ID NO: 10877 - DNA, 50 bp, homo sapien
aaatattgagatgttctttctccacmactcacttctaatttcccttattg

SEQ ID NO: 10878 - DNA, 50 bp, homo sapien
acagtgggacaagtatgatgaaggcragtatttcccaagcatccaataag

SEQ ID NO: 10879 - DNA, 50 bp, homo sapien
caacaaaccaggtcaaaatcttaccyggaaaatacacgactcagtgatca

SEQ ID NO: 10880 - DNA, 50 bp, homo sapien
gtaaataatatcaacttcaacttaakagtgctttgctaggaggcagtaga

SEQ ID NO: 10881 - DNA, 50 bp, homo sapien
aacttgcctaattgataccttggcckatggtgtcattaacaatgcttgaa

SEQ ID NO: 10882 - DNA, 50 bp, homo sapien
cttgctgccgtttgggttacctacaycaaaacagatttgtgttctgctct

SEQ ID NO: 10883 - DNA, 50 bp, homo sapien
ggagatgatgggtcacagaaagaatratcatgggcttttgtaccgtagaa

SEQ ID NO: 10884 - DNA, 50 bp, homo sapien
tttatggccaggcgtagtgacttacrcatgtaatcctcgcactttttttt

SEQ ID NO: 10885 - DNA, 50 bp, homo sapien
aaacacgtggcaatgcactaatttayaatataggcctgaatccccataaa

SEQ ID NO: 10886 - DNA, 50 bp, homo sapien
tattttgtatgtaccattggttgaayatctttattaatttttcaggaaaa

SEQ ID NO: 10887 - DNA, 50 bp, homo sapien
aaacatatttacttttttcccacctraatctcagttcattctgtattttc

SEQ ID NO: 10888 - DNA, 50 bp, homo sapien
tcttcttatcctagaaatggagaaaratcacccaattaattttttgacat

SEQ ID NO: 10889 - DNA, 50 bp, homo sapien
aaccatttccacatttcagatctaayggtgttctcatgacattgcaaagt

SEQ ID NO: 10890 - DNA, 50 bp, homo sapien
aggtaaaatagagaaaaagcaatagraagtaaaccaaaaggaagaagtaa

SEQ ID NO: 10891 - DNA, 50 bp, homo sapien
atgaggaaacactttcttgcattaartggtcgacatctgggatccacgtg

SEQ ID NO: 10892 - DNA, 50 bp, homo sapien
acataacaaaattttactcttttaayctatgtatgtatgtgtgtaagtag

SEQ ID NO: 10893 - DNA, 50 bp, homo sapien
aaggtttatgagtgggagaagaaacratcctatccctcccatgtctcatt

SEQ ID NO: 10894 - DNA, 50 bp, homo sapien
tggagctgaaatggagttgagagatkatctacaatttcctagtttttaac

SEQ ID NO: 10895 - DNA, 50 bp, homo sapien
ataatgcagtattctgtatttagtascaatgagatctttcagacctttct

SEQ ID NO: 10896 - DNA, 50 bp, homo sapien
tgacaatttaacatacaccatcccaktatttagtttgtacgtggcatata

SEQ ID NO: 10897 - DNA, 50 bp, homo sapien
atattcacaccccaaattaaatacaycagagttgctaaaacccaactagt

SEQ ID NO: 10898 - DNA, 50 bp, homo sapien
aaagagtaaatttgacaatgtagatmacatcggtaatgtacaaagtaagc

SEQ ID NO: 10899 - DNA, 50 bp, homo sapien
gtatagataataaaggtatagaaacyggtatagaaagcaaactgcaagaa

SEQ ID NO: 10900 - DNA, 50 bp, homo sapien
tttagtcaaagaaattgctgaagacmcagtggatattttggcaagtgaag

SEQ ID NO: 10901 - DNA, 50 bp, homo sapien
atactgtttaccgtaaacatcctaasacataaggacataaaaaagttaaa

SEQ ID NO: 10902 - DNA, 50 bp, homo sapien
gtaagcatttagaaaatttgggttaygcctgcatttgaatctgactctcc

SEQ ID NO: 10903 - DNA, 50 bp, homo sapien
gtgtttgtgaggatgggttgaagcasagtgggttgagaattggtggtgga

SEQ ID NO: 10904 - DNA, 50 bp, homo sapien
aaatatatatcaacagaagactatcrattctaaatctcattaaatacccc

SEQ ID NO: 10905 - DNA, 50 bp, homo sapien
aggggtctcgggccactctgtctctsaataggaaccactgccctatttca

SEQ ID NO: 10906 - DNA, 50 bp, homo sapien
gatgtctactgcccaagcagttgtcraggttacatttttaggtctacaag

SEQ ID NO: 10907 - DNA, 50 bp, homo sapien
aaaagaaaagaaaaaggagtaacagrattagattttggaaaaaatgactc

SEQ ID NO: 10908 - DNA, 50 bp, homo sapien
acttctcagattttcagctagaatasattgcttccaaattcacatgctga

SEQ ID NO: 10909 - DNA, 50 bp, homo sapien
attaccagagagagttctcaatgcaytatttcattgtatgtgcccgatct

SEQ ID NO: 10910 - DNA, 50 bp, homo sapien
tttattctcatgtttgtgttatttgraaaagtgaatggtcaataaatggc

SEQ ID NO: 10911 - DNA, 50 bp, homo sapien
cctaaatagtcactttcacactgaascatgaaagggtataatttcagttc

SEQ ID NO: 10912 - DNA, 50 bp, homo sapien
aatgtttcttttgctaataaataccragttctccagggttagggcctttt

SEQ ID NO: 10913 - DNA, 50 bp, homo sapien
attttggcactttggctagtgtgcawaatggtcagagcctcatgggattc

SEQ ID NO: 10914 - DNA, 50 bp, homo sapien
agctgccattttcaggtttattttcraggtggattgttacaatgagaaga

SEQ ID NO: 10915 - DNA, 50 bp, homo sapien
gtggcactggaagaaatagttcacartacatgctgaagatttagaaatgg

SEQ ID NO: 10916 - DNA, 50 bp, homo sapien
tactccaaccagacatgtcttatcartcccaatgactttgaacattaccc

SEQ ID NO: 10917 - DNA, 50 bp, homo sapien
cctgcacaactatgggcctgtaatamccttgattggtttggtagatttat

SEQ ID NO: 10918 - DNA, 50 bp, homo sapien
tgtaggcaggacctcctgtaagaaasagggacatttcgatttcttgcttt

SEQ ID NO: 10919 - DNA, 50 bp, homo sapien
aaagctttgatggtgtgaggctatargaggtgattttctgagagtttgga

SEQ ID NO: 10920 - DNA, 50 bp, homo sapien
tatggtgcctaatcaattagatgtawctttaaacatggtagacatggtta

SEQ ID NO: 10921 - DNA, 50 bp, homo sapien
atcacaaaatgcatgactgaaaaaaytattatctaggaaatagtatgtta

SEQ ID NO: 10922 - DNA, 50 bp, homo sapien
ggtaagaaaggctattaggttaacargaacatcaaatggatagaataatc

SEQ ID NO: 10923 - DNA, 50 bp, homo sapien
taaactgctgggcagctgactctaaytgatttattattgctcacagttat

SEQ ID NO: 10924 - DNA, 50 bp, homo sapien
taagcagccccaatctttataggcaygtttcagagcaaagctcactcatt

SEQ ID NO: 10925 - DNA, 50 bp, homo sapien
cttgtccaaagaaacatatataaacmaatcaaaacccttccttggtgacc

SEQ ID NO: 10926 - DNA, 50 bp, homo sapien
cccggaagccatttcagtgcacttayatccaaggaatgaatttctttcaa

SEQ ID NO: 10927 - DNA, 50 bp, homo sapien
cacagactcattttaattgactggawaggctaagagagaggttcagcttc

SEQ ID NO: 10928 - DNA, 50 bp, homo sapien
gtggctttggctacattttgtagaartcaataaatactaaatttagccct

SEQ ID NO: 10929 - DNA, 50 bp, homo sapien
gtcagcatcataaaagacgaagaaargctgtggaagtgttctagataaaa

SEQ ID NO: 10930 - DNA, 50 bp, homo sapien
gatttcttgtgagactttggctaaaycatgtttgtatcttcattgcctct

SEQ ID NO: 10931 - DNA, 50 bp, homo sapien
gggatgatgaattgacttgtcccaawtcacagacctagagttgcaaagat

SEQ ID NO: 10932 - DNA, 50 bp, homo sapien
tcggcacaagcttctaattacaagckgaatactcatgaaggatggataac

SEQ ID NO: 10933 - DNA, 50 bp, homo sapien
agaaagcataataaagaagccatgcratactatcaagcaaatgaatttac

SEQ ID NO: 10934 - DNA, 50 bp, homo sapien
tctgtcctcatataaaaagtgactayagtatcccaagagaaaacattgag

SEQ ID NO: 10935 - DNA, 50 bp, homo sapien
ccaatgactaatgctttacccacgartcattaaacccattctgcactttt

SEQ ID NO: 10936 - DNA, 50 bp, homo sapien
ttggggtccagaaaactccagaagtraaacatccgtcagctgttcaaggc

SEQ ID NO: 10937 - DNA, 50 bp, homo sapien
gtcaaggtaatagagtccaacatctragaaacatcatagcactgacaatg

SEQ ID NO: 10938 - DNA, 50 bp, homo sapien
gacaccagtgtatctccttttgctaratttatatgacattctcttatata

SEQ ID NO: 10939 - DNA, 50 bp, homo sapien
gtctcctaaactctttagaaaatgakgacaaggaccttcacaatgtcaga

SEQ ID NO: 10940 - DNA, 50 bp, homo sapien
aatgtggagttgtggatatatttgcrgatagaaacaataagattggcagc

SEQ ID NO: 10941 - DNA, 50 bp, homo sapien
agggttataggggctactcactgtcrcaggagatgtcacagatgttcctt

SEQ ID NO: 10942 - DNA, 50 bp, homo sapien
gttaagaactgctttactaaaccaasttgcttgtggatcatctttggcag

SEQ ID NO: 10943 - DNA, 50 bp, homo sapien
tacccatctcagtatgtggcatatgrcaagtgagcaataaatgtttgtgg

SEQ ID NO: 10944 - DNA, 50 bp, homo sapien
ttaattattcaaggactggtgatacraatagataactaactatgatatat

SEQ ID NO: 10945 - DNA, 50 bp, homo sapien
caatcccctcccaatgacttggggaygtcttattcattctgtaaagctgg

SEQ ID NO: 10946 - DNA, 50 bp, homo sapien
actaggcactaaagaaaatctcgatwaacaactaagtttgaaaatgtaca

SEQ ID NO: 10947 - DNA, 50 bp, homo sapien
ctgagaaagacagtgtgctttgcaayggttaagtccacagctcctgagat

SEQ ID NO: 10948 - DNA, 50 bp, homo sapien
tatttcctaagtacttacataatcaytaaacatatgggtaattaaaatcc

SEQ ID NO: 10949 - DNA, 50 bp, homo sapien
tttctcatttgagagataagagaaakaaatttttgttggagtactcttct

SEQ ID NO: 10950 - DNA, 50 bp, homo sapien
tatttgttgagtgtggtgtaataaayaaaaggcaactaaatcctgcatca

SEQ ID NO: 10951 - DNA, 50 bp, homo sapien
tcacatatcaaaatgagtgagatacrgagaaagaaaagtttaggcttaaa

SEQ ID NO: 10952 - DNA, 50 bp, homo sapien
agaaagattgtgaagtttatattgayaggaactccacaatatacttttga

SEQ ID NO: 10953 - DNA, 50 bp, homo sapien
tttgcaggggctttttggtaatatcygaactcaaagaaatgcagctctaa

SEQ ID NO: 10954 - DNA, 50 bp, homo sapien
tgggtggtgggcaacatggaaataaygagacctttaatgaaaaaatataa

SEQ ID NO: 10955 - DNA, 50 bp, homo sapien
gttggtccccttctgttgctaagaaragattggcaattatttcttctctg

SEQ ID NO: 10956 - DNA, 50 bp, homo sapien
tgcaggagaggagggaccctcaacawctctggtgctcctggaagctttgc

SEQ ID NO: 10957 - DNA, 50 bp, homo sapien
tgcggaataagtatcccaactgaacygtgtccatatgaagtatctcaatt

SEQ ID NO: 10958 - DNA, 50 bp, homo sapien
cccattcctcagcctgatgacttcarataaaccatcctgggtgagatgga

SEQ ID NO: 10959 - DNA, 50 bp, homo sapien
ctgtgggatgactgaacaaagtgacmaaatagagagcatggattattacc

SEQ ID NO: 10960 - DNA, 50 bp, homo sapien
aaagtagaaattagtcatgaaggaayccaacaaatggcattctaggcaga

SEQ ID NO: 10961 - DNA, 50 bp, homo sapien
gctgggctttggggcaggaccttgasatagcatcaaaaaacagagacttt

SEQ ID NO: 10962 - DNA, 50 bp, homo sapien
tgaagtgatctctgtctacgggatgraatagatgtacttttcctagttct

SEQ ID NO: 10963 - DNA, 50 bp, homo sapien
catcccgtagacagagatcacttcawtcgtttttgaactttatttttaat

SEQ ID NO: 10964 - DNA, 50 bp, homo sapien
aattagtatttgaagagaaaccaaamtcatttagcttaaagaccaaggag

SEQ ID NO: 10965 - DNA, 50 bp, homo sapien
gcaagaatcagactatggcagaatgyaaaaagttaatgagacaatataaa

SEQ ID NO: 10966 - DNA, 50 bp, homo sapien
agtaaaaatgaaacgtaccttttaayagagattcagttacttacaagtag

SEQ ID NO: 10967 - DNA, 50 bp, homo sapien
caccatccatgttgcttaattaacastagtccagtctcttaccagccagc

SEQ ID NO: 10968 - DNA, 50 bp, homo sapien
tattcaactgcatacagaatatagamtcaaaaaaacaatttattatgtat

SEQ ID NO: 10969 - DNA, 50 bp, homo sapien
cagcaatggccgtttgcaagctggarcactgtaaggacaggaggaagcca

SEQ ID NO: 10970 - DNA, 50 bp, homo sapien
attcatgccctcttttatcttcccaragacaacaggcttgctatgtaacc

SEQ ID NO: 10971 - DNA, 50 bp, homo sapien
tgctccatggtttccacaatattcaygccctcttttatcttcccaaagac

SEQ ID NO: 10972 - DNA, 50 bp, homo sapien
agaatatcaccattgccaattgtggraaatgctagtaaatttgacttgtt

SEQ ID NO: 10973 - DNA, 50 bp, homo sapien
gagcacaaagattataggatattgcragtaaatggggtggaagggtgctt

SEQ ID NO: 10974 - DNA, 50 bp, homo sapien
ttttaatctattccttctgcaaatakgtattaaatgctagccatggatat

SEQ ID NO: 10975 - DNA, 50 bp, homo sapien
aagaaaatgctgctctataggactamggagttccctttctctgtcccttt

SEQ ID NO: 10976 - DNA, 50 bp, homo sapien
aggaaaaaaaagatgatgttagtagraagaagaagatctctgtcgcagta

SEQ ID NO: 10977 - DNA, 50 bp, homo sapien
atacaacctgaaatctagtgaggatyaaggtggatatttccaagtaaata

SEQ ID NO: 10978 - DNA, 50 bp, homo sapien
tagtagaaagaagaagatctctgtcrcagtacaatgtaaattaaaaaata

SEQ ID NO: 10979 - DNA, 50 bp, homo sapien
agcagagccatcctgcccgatttagraaacactcggaacctgccctcttt

SEQ ID NO: 10980 - DNA, 50 bp, homo sapien
ggaatcattatttcccacagttgccragaagtgattaaaaatttggccct

SEQ ID NO: 10981 - DNA, 50 bp, homo sapien
gtttttcagtcaccaaagtggattaycaactttataacaaaaccagtata

SEQ ID NO: 10982 - DNA, 50 bp, homo sapien
ccttgtcttttatagacagagagtaratttgtatttctaaggatatgcag

SEQ ID NO: 10983 - DNA, 50 bp, homo sapien
agaatgctacaactattaaaaaaaawtcacctgataggatctctgttctt

SEQ ID NO: 10984 - DNA, 50 bp, homo sapien
tacagacatttcttttcttggccagkaattctagtattttacagcatggc

SEQ ID NO: 10985 - DNA, 50 bp, homo sapien
gaaaaggcttatagaaaatggaaaastggatagcagtagatggcatggac

SEQ ID NO: 10986 - DNA, 50 bp, homo sapien
tatcttctcttgtgtattaggaatamtatggcacctaacctatggagttg

SEQ ID NO: 10987 - DNA, 50 bp, homo sapien
aagctcagatacatgaaaagcaccamataagtattagctatgattatagc

SEQ ID NO: 10988 - DNA, 50 bp, homo sapien
aatgaacttattgtctatctgttcartatcatattatgtggctgttaaaa

SEQ ID NO: 10989 - DNA, 50 bp, homo sapien
tggataatgtaacagctgcaatgagyatttggcagaatggaaaatgttct

SEQ ID NO: 10990 - DNA, 50 bp, homo sapien
tagttggggacaaaaccctacagcarggactcattaagtaaggcacccca

SEQ ID NO: 10991 - DNA, 50 bp, homo sapien
cagaagtgctaatgctaatgtggtaygacactgtagaaaacacaagaaac

SEQ ID NO: 10992 - DNA, 50 bp, homo sapien
agatgacctgcccaagagtggacaaygaagatttggcctcctacctctca

SEQ ID NO: 10993 - DNA, 50 bp, homo sapien
gactcagccagattggatataagccraacaagccaaggacagagcattag

SEQ ID NO: 10994 - DNA, 50 bp, homo sapien
agtaatgggcttcggtatttctctargcagtaatctactttttctcaaaa

SEQ ID NO: 10995 - DNA, 50 bp, homo sapien
atttaggtcaagcaatcaagcacaaygattcaaaattgaaaccaactttt

SEQ ID NO: 10996 - DNA, 50 bp, homo sapien
aaaactttagaacttgtttgcaaaarctaaatggtataaaacacatttta

SEQ ID NO: 10997 - DNA, 50 bp, homo sapien
tgaagtgttacttggatttgtaccartcattcgcatcatggttacgtaat

SEQ ID NO: 10998 - DNA, 50 bp, homo sapien
gatgagatactgtaatcatatgggaratcttgaattaaagagttatctaa

SEQ ID NO: 10999 - DNA, 50 bp, homo sapien
agaaatcttggacctgaggaatccartgaatgaaataaaaaatacagttg

SEQ ID NO: 11000 - DNA, 50 bp, homo sapien
cagtccagctccatacaatggatacrcagatgtaagagcatcattccctt

SEQ ID NO: 11001 - DNA, 50 bp, homo sapien
ctttatcacctaaatgcgtgtccaartactatgttccacattccccaaaa

SEQ ID NO: 11002 - DNA, 50 bp, homo sapien
gctttcctccatcccaattctaccaygtcaatattatctagaaatttaat

SEQ ID NO: 11003 - DNA, 50 bp, homo sapien
aggagagttgcttaacattattggaygtcactgtttcttacattttccgt

SEQ ID NO: 11004 - DNA, 50 bp, homo sapien
aatgaatgcataccatgtataagaakagactctggagaatttggcagcaa

SEQ ID NO: 11005 - DNA, 50 bp, homo sapien
tcttcttctttaaatgaaggttggakgtattaaaatatgtaaagcaatca

SEQ ID NO: 11006 - DNA, 50 bp, homo sapien
aggctctgctgactattttacccaaygtcacatgctttaagtttttcact

SEQ ID NO: 11007 - DNA, 50 bp, homo sapien
gagcaaaaaataaaaagcaaaatcayggaaactcagctatagctgtagaa

SEQ ID NO: 11008 - DNA, 50 bp, homo sapien
cctccaacatatattcttatatgtcractgcctaatattccattgaaggg

SEQ ID NO: 11009 - DNA, 50 bp, homo sapien
aaatttaggtaaaaactcaattctayggcctaaaagatttaaactccttc

SEQ ID NO: 11010 - DNA, 50 bp, homo sapien
aaaaagacattcaagtaaagggagtmaatttggacaacccagtaaatgca

SEQ ID NO: 11011 - DNA, 50 bp, homo sapien
aaatgtccagctacattcaaggacamcagtgcagttttctgagaagaaag

SEQ ID NO: 11012 - DNA, 50 bp, homo sapien
catgggagagagactagaataatgamggtgttctaagcctgcctatatat

SEQ ID NO: 11013 - DNA, 50 bp, homo sapien
gtacattaacttaactctcatgtcamcctatacctatgtaatacctataa

SEQ ID NO: 11014 - DNA, 50 bp, homo sapien
taatgagttggaattaaattccttayacaatgtagtgatagatatgtaca

SEQ ID NO: 11015 - DNA, 50 bp, homo sapien
attatggcaaaacaggggaaattaaygctatgcctcaggcataccgtgtt

SEQ ID NO: 11016 - DNA, 50 bp, homo sapien
tagcatggaggaatgttagaaaaatsaagtacaggtgaatttggacactg

SEQ ID NO: 11017 - DNA, 50 bp, homo sapien
agtgactggaacataaaaattaccawtgggaaatctcactgtcttagaga

SEQ ID NO: 11018 - DNA, 50 bp, homo sapien
tgaaacaggtttttagcctagtaaartgttcacagaaggctggtacccaa

SEQ ID NO: 11019 - DNA, 50 bp, homo sapien
gcaatatcttttcaacctaatcgtayacttaaattactgacaagaagcaa

SEQ ID NO: 11020 - DNA, 50 bp, homo sapien
agccatacaactcagattttacacasaattgcttaagaggagaacgtata

SEQ ID NO: 11021 - DNA, 50 bp, homo sapien
gcaaaacagctaggaagcagtactaycttttatcatttaggaataaaatt

SEQ ID NO: 11022 - DNA, 50 bp, homo sapien
aaataaacaggctctctctgtttaarctaatggtaatgctacatcattgt

SEQ ID NO: 11023 - DNA, 50 bp, homo sapien
tagaatttcatggaggttaagatacygcactgagttgtagtgttatcaat

SEQ ID NO: 11024 - DNA, 50 bp, homo sapien
atcccaggttacacatacagggatgraagcctcttgtaagaatcacccac

SEQ ID NO: 11025 - DNA, 50 bp, homo sapien
gaagaaaaagaagagctttcataagsagaaatgagtgtgagaggggaggt

SEQ ID NO: 11026 - DNA, 50 bp, homo sapien
gacataacatcaactgcttccagatraaaatcactgccattgtctaagat

SEQ ID NO: 11027 - DNA, 50 bp, homo sapien
acagaaaaggccatcaataaactcartatctttcgtgttaaaaagtctcc

SEQ ID NO: 11028 - DNA, 50 bp, homo sapien
aaccactgcacattgtatatgctccrattaaggcatttaatacattacct

SEQ ID NO: 11029 - DNA, 50 bp, homo sapien
gattactgccctgacctgcaaactaygtcaacctacccattatacacttt

SEQ ID NO: 11030 - DNA, 50 bp, homo sapien
gaaccaacttttgcatctatgcaccraaggatttaagcagatgtttagcc

SEQ ID NO: 11031 - DNA, 50 bp, homo sapien
actcaataaattttagctattaacayatataatgtactgtgccttttgtt

SEQ ID NO: 11032 - DNA, 50 bp, homo sapien
ctttcctcaatagtaagtgtcaaggmataactgtcaacaaggagattcta

SEQ ID NO: 11033 - DNA, 50 bp, homo sapien
aagttgggctaaggtggtgatcatgragatggaaagaaaggatgaaattg

SEQ ID NO: 11034 - DNA, 50 bp, homo sapien
caactgaccactaatctaacatatawctaggcatttatcttgtttttgtt

SEQ ID NO: 11035 - DNA, 50 bp, homo sapien
tcttttctccactcaaaaatttccayggattctcccttgtgtcttccaaa

SEQ ID NO: 11036 - DNA, 50 bp, homo sapien
gctgagaatcactcccatacctgtaraactccaaactggctacaggcgtg

SEQ ID NO: 11037 - DNA, 50 bp, homo sapien
ggaaccttacccaacaagaacagatyactaattgagcctgccttattgaa

SEQ ID NO: 11038 - DNA, 50 bp, homo sapien
tgatccaaaagaaattctgagggaarataagatgaatggtgaaatcggaa

SEQ ID NO: 11039 - DNA, 50 bp, homo sapien
tacgacctaggctgtgtctacattargtaaagagtatctgtgcctcagat

SEQ ID NO: 11040 - DNA, 50 bp, homo sapien
tgggatttagattctagctactgtayattttcataaagttggttaacctg

SEQ ID NO: 11041 - DNA, 50 bp, homo sapien
tgttaagattaaaattatgaaaataycctgaaattcatgagcataagttt

SEQ ID NO: 11042 - DNA, 50 bp, homo sapien
ggggatcagatcttgggactaaaaamctatgaaacaaggaccatgggaaa

SEQ ID NO: 11043 - DNA, 50 bp, homo sapien
tatctcgtaaagtttttcacataaakaatatatcagttaaagaacatact

SEQ ID NO: 11044 - DNA, 50 bp, homo sapien
aacagagtggatggtgaagagagaascaatctcaaaggaagttatcttgg

SEQ ID NO: 11045 - DNA, 50 bp, homo sapien
gctaattttgaccatttaaaaaataygcaaagtcactagtaatagcagca

SEQ ID NO: 11046 - DNA, 50 bp, homo sapien
ctctaaaagtgctcatcatggacgasgttctctacaaaatttaaaaaaaa

SEQ ID NO: 11047 - DNA, 50 bp, homo sapien
ctcttagcttttcaggttcagaaacygatttaatcaagatacagaaaaga

SEQ ID NO: 11048 - DNA, 50 bp, homo sapien
agtatacaacaaaggaagaaatgtaygtaactatgtggaatattggaaag

SEQ ID NO: 11049 - DNA, 50 bp, homo sapien
tctaaggtttcttccaaatctaaaakttcatgattctgtatcatccagtt

SEQ ID NO: 11050 - DNA, 50 bp, homo sapien
gaaactgaagaagacacacaaaaaaygagaagacatcccatggtcacgga

SEQ ID NO: 11051 - DNA, 50 bp, homo sapien
tctattattgaaattagtcacaggcmagaccagattccagggggaaagaa

SEQ ID NO: 11052 - DNA, 50 bp, homo sapien
tacaacccagctcatacataactgtsaagttttcaaggtacccagcacct

SEQ ID NO: 11053 - DNA, 50 bp, homo sapien
tcaatgaatgtttactgaaagtggtyaaatgactgatagtatctgataaa

SEQ ID NO: 11054 - DNA, 32 bp, homo sapien
aagaactcaactatctsaacaggaaaaaaatt

SEQ ID NO: 11055 - DNA, 50 bp, homo sapien
actcattaattttcaaactgaataawcttctaagtaatagatgccatttt

SEQ ID NO: 11056 - DNA, 50 bp, homo sapien
tataccatagtagttattttagaaayatgtgctagtttaattcataaaca

SEQ ID NO: 11057 - DNA, 50 bp, homo sapien
atcaattaatttgtagagaaaattcragttcttcaatttagcagccaatt

SEQ ID NO: 11058 - DNA, 50 bp, homo sapien
tcatataatagttagctataaaaacrcattacaaaagtatagaccatagt

SEQ ID NO: 11059 - DNA, 50 bp, homo sapien
gttcttgtggacattccacacaacamtaacgaatccatttatcatcctgc

SEQ ID NO: 11060 - DNA, 50 bp, homo sapien
actaattatagtaatgaggctgttamaacataattagaattatcacaata

SEQ ID NO: 11061 - DNA, 50 bp, homo sapien
taggctttagataaggagttcttaamctggggtccttgaattaaacttag

SEQ ID NO: 11062 - DNA, 50 bp, homo sapien
catcttgcagttcaaaacagtggtgragaatataacaaaatacactccag

SEQ ID NO: 11063 - DNA, 50 bp, homo sapien
tgtattttcagaaatgcatacatagycaataaacatttgttgagttaatg

SEQ ID NO: 11064 - DNA, 50 bp, homo sapien
tagctgagttttggccaaaggaacaygagtggatgtgatgtgatttatag

SEQ ID NO: 11065 - DNA, 50 bp, homo sapien
ctgtggagaaacagcattgctctatragagattacattaaaaaactgggg

SEQ ID NO: 11066 - DNA, 50 bp, homo sapien
tcatgaaagatacttctccatcctcsatcaaaattgcctctccttaaatg

SEQ ID NO: 11067 - DNA, 50 bp, homo sapien
tctccaagtgtcccagaagcactaamttactgaaaatagaatctcatcaa

SEQ ID NO: 11068 - DNA, 50 bp, homo sapien
cacttgagagtctcaaggaactttargataaaacagcgaaacatgaggac

SEQ ID NO: 11069 - DNA, 50 bp, homo sapien
ctaagaaccactgcagtgccagttayctgcttccagagaaaacagggatc

SEQ ID NO: 11070 - DNA, 50 bp, homo sapien
tgtcagacaaacagattttctctatkaggtaccaacctgcctatataggg

SEQ ID NO: 11071 - DNA, 50 bp, homo sapien
caccagactcagtggacatattttcraggttaaagaattctcaagtttga

SEQ ID NO: 11072 - DNA, 50 bp, homo sapien
acaaaacttttcagaatataatttcycctaaggttttgggaaatcactgc

SEQ ID NO: 11073 - DNA, 50 bp, homo sapien
gcaaattctactggacattaagaaaycgtgtagacaaaagagatatttaa

SEQ ID NO: 11074 - DNA, 50 bp, homo sapien
gcacctccaaagaaaggggatatacraatatgcagtgtcaaatacaaaaa

SEQ ID NO: 11075 - DNA, 50 bp, homo sapien
ggcataaatctgaaagcccttgctargcaggtaggaggttatcttatcca

SEQ ID NO: 11076 - DNA, 50 bp, homo sapien
tgatattctcattgaggccaaaacgraaatttgagggacataattgcctt

SEQ ID NO: 11077 - DNA, 50 bp, homo sapien
accactagagtataccaattgtcttyaaccttatattatctatgaaaata

SEQ ID NO: 11078 - DNA, 50 bp, homo sapien
tgtgagaaggacatttcttactgcarataattcttggcagctgttgttgg

SEQ ID NO: 11079 - DNA, 50 bp, homo sapien
cacctatttaacacaatttccaagayatcactgatcatgtaactatttta

SEQ ID NO: 11080 - DNA, 50 bp, homo sapien
tggttaccctggtggcatggtgtaaygctttaatgcagttctaatgctaa

SEQ ID NO: 11081 - DNA, 50 bp, homo sapien
gtgcccagaggaatcctaacttcccrcagaagcatgaatgtccatggatt

SEQ ID NO: 11082 - DNA, 50 bp, homo sapien
atcattgtggcttactttagccaacrgagtataatgtaggtaatgtgttt

SEQ ID NO: 11083 - DNA, 50 bp, homo sapien
cagggcatgactcatcacaaggtacrgaaatgattgtcctgtccggtttt

SEQ ID NO: 11084 - DNA, 50 bp, homo sapien
ttggacgtgcaagtgttgttatagcygaggtttaaaatggctctgctaaa

SEQ ID NO: 11085 - DNA, 50 bp, homo sapien
agcaaagcatggcttttctagaagasagtatcagtccgggagaggcaaga

SEQ ID NO: 11086 - DNA, 50 bp, homo sapien
ctagtatttactatctaatccaacamacatttttatgatactttgtcata

SEQ ID NO: 11087 - DNA, 50 bp, homo sapien
ctataaaaaataatgtggcatctagraaaatattatcttcccccagaatg

SEQ ID NO: 11088 - DNA, 50 bp, homo sapien
taacagctatagtagtttaagcaacwcatgttcagcattatgacatgtcc

SEQ ID NO: 11089 - DNA, 50 bp, homo sapien
tttaaacaaggagttgacataatcaraatataaacagcactggccttcga

SEQ ID NO: 11090 - DNA, 50 bp, homo sapien
gctgttctctgggaatcaccacatayagtacagctttgagatattgatgc

SEQ ID NO: 11091 - DNA, 50 bp, homo sapien
tggtctcagaatagcaacatcactascacatatggataccaataaagttt

SEQ ID NO: 11092 - DNA, 50 bp, homo sapien
atttatattcccactagtaatattcragagtaaacatctccccatactct

SEQ ID NO: 11093 - DNA, 50 bp, homo sapien
tatctcctctttccactggaattaargttctcagtacactacgctgtttg

SEQ ID NO: 11094 - DNA, 50 bp, homo sapien
caccatgactgagagaattagctgaygaaggaagggcttagcagttgctt

SEQ ID NO: 11095 - DNA, 50 bp, homo sapien
ttgagatatatttaacttctacctcraagacatagtttttatattggaag

SEQ ID NO: 11096 - DNA, 50 bp, homo sapien
aaaattctttattcacttaacattcyatggtattatttagacttttttta

SEQ ID NO: 11097 - DNA, 50 bp, homo sapien
ccacaacagttataaccactcaaaayattgtggtcctatagatttctttg

SEQ ID NO: 11098 - DNA, 50 bp, homo sapien
gagtagcatcaccatcctataactcyatattgcctaatttgttaatttct

SEQ ID NO: 11099 - DNA, 50 bp, homo sapien
aagaaaaccttatggcaatgaacaartcttctagtaattaacaatatagg

SEQ ID NO: 11100 - DNA, 50 bp, homo sapien
aacttgttagaaatagatgaaaggcycttgagctcaggcaagacagagtc

SEQ ID NO: 11101 - DNA, 50 bp, homo sapien
agggtgggtggcagcaaaacaatgaraggtgcccagagccgtgctccctg

SEQ ID NO: 11102 - DNA, 50 bp, homo sapien
catcagatactacttaaaatgaagcmattagcctgccaactatctcattg

SEQ ID NO: 11103 - DNA, 50 bp, homo sapien
ttatcaccacattttactcagccaayttagatagatttgaaactgaaaca

SEQ ID NO: 11104 - DNA, 50 bp, homo sapien
ccatgtggaccgtccaatcaacaacygagtgtcttcaacctccatgtccc

SEQ ID NO: 11105 - DNA, 50 bp, homo sapien
tctaatagaaaggctttgtcaccacyggagtaatggacgctagtccttag

SEQ ID NO: 11106 - DNA, 50 bp, homo sapien
tgatttgttcaaatcagaatctaaasaaagccagtaactgattttgggaa

SEQ ID NO: 11107 - DNA, 50 bp, homo sapien
acttattgaagattataatatctaargtcttaactactagagaccaaatg

SEQ ID NO: 11108 - DNA, 50 bp, homo sapien
aataatttcttgtgttatgacatacraagaaataaatacgaagcttagaa

SEQ ID NO: 11109 - DNA, 50 bp, homo sapien
agattgatggagaaggctgaagaccwaactaaaatataaagtccaacatt

SEQ ID NO: 11110 - DNA, 50 bp, homo sapien
taatacgtggttttgtggtcattgaytattttaataagccagtatatcaa

SEQ ID NO: 11111 - DNA, 50 bp, homo sapien
aaagatgatatgtgctagtattgagraataggctagaagcaactttctat

SEQ ID NO: 11112 - DNA, 50 bp, homo sapien
agaatttttacatatgcctcattaayagtgcagcccttactgtcgttgtc

SEQ ID NO: 11113 - DNA, 50 bp, homo sapien
gcttttctggaatccactgtgctatsaattcctattttcttttttggcct

SEQ ID NO: 11114 - DNA, 50 bp, homo sapien
tgatagaaaaaaaaaatcactaatcmaagtcctaaaacagtgatctttct

SEQ ID NO: 11115 - DNA, 50 bp, homo sapien
tctccaagaatatgggattctgtacratggccaaaactaaaaatagctgc

SEQ ID NO: 11116 - DNA, 50 bp, homo sapien
aaacttcccctggccttgctagatayccaaatatgagaagctcaaaaaca

SEQ ID NO: 11117 - DNA, 50 bp, homo sapien
acctaggggatgtggcggttaattasgaccttcagatgattgcattggag

SEQ ID NO: 11118 - DNA, 50 bp, homo sapien
cggaggccaaatattagaattttacygcttgttaggtgtatatttttgta

SEQ ID NO: 11119 - DNA, 50 bp, homo sapien
agtctgtggaaaacagcatgatatcrcttgaatacagtaaagaaaggtga

SEQ ID NO: 11120 - DNA, 50 bp, homo sapien
aatctgaattggattctaagtctaaytcctacactaagtggtcctataga

SEQ ID NO: 11121 - DNA, 50 bp, homo sapien
gttgaactgttgaaacaaaatccaartcatcacatctttgcaggttctct

SEQ ID NO: 11122 - DNA, 50 bp, homo sapien
agctgaaggattttcagatcttatargagtatttgtgcatatttacactg

SEQ ID NO: 11123 - DNA, 50 bp, homo sapien
ataccaaacacaaatatctgatccaygtaggaatcattttttaaacgaac

SEQ ID NO: 11124 - DNA, 50 bp, homo sapien
agtgaaacttggagggctcttccctwaaatggtatctatcccagtggatg

SEQ ID NO: 11125 - DNA, 50 bp, homo sapien
aatatagatttggctggcctaaaagkattctttctgtatctctctctgtc

SEQ ID NO: 11126 - DNA, 50 bp, homo sapien
aaggaaatggtgtactgaagctatayatttcacattctatgcagcctatt

SEQ ID NO: 11127 - DNA, 50 bp, homo sapien
atcattgtcattattgccaccatcawtaggctatccatcaataattactg

SEQ ID NO: 11128 - DNA, 50 bp, homo sapien
gctaagtgaggtattggaaatttcartcactgtaaaattggaggaaaatg

SEQ ID NO: 11129 - DNA, 50 bp, homo sapien
ggaaataataagggattcagaaaaamaagtacatggagatatgctgaaag

SEQ ID NO: 11130 - DNA, 50 bp, homo sapien
cggggcatatagttctgagtttgcaycacatctaaggaaagctagattag

SEQ ID NO: 11131 - DNA, 50 bp, homo sapien
ctgacaattaaaattcactggcatgraatagcataaggatgaattttatg

SEQ ID NO: 11132 - DNA, 50 bp, homo sapien
ttaaaacaaggagagattcaaaacaytctattcatcctatgtaaaacata

SEQ ID NO: 11133 - DNA, 50 bp, homo sapien
attttctcctttctcctacccactgkatctgattaagtcctacttatcct

SEQ ID NO: 11134 - DNA, 50 bp, homo sapien
ttcttagaaaaaacaggaagacatakaagtgctttaattggggaaggatg

SEQ ID NO: 11135 - DNA, 50 bp, homo sapien
tgttcctaaaactttacagaagaaaygattacagaagctgatttgtagca

SEQ ID NO: 11136 - DNA, 50 bp, homo sapien
tggccaaatggaaaggccgtttgcgwaataagattagggtggggcaacca

SEQ ID NO: 11137 - DNA, 50 bp, homo sapien
cctgacaaagagtaaaacaaacatasaaagtaaatatctgacaaaagcag

SEQ ID NO: 11138 - DNA, 50 bp, homo sapien
cctttatttcaaacaagagaaatacrcaatactcaatataaacactagaa

SEQ ID NO: 11139 - DNA, 50 bp, homo sapien
ctcggggttcttggcattaaaaacaygactggccactagagttttataag

SEQ ID NO: 11140 - DNA, 50 bp, homo sapien
gtgtaataggcacaaatgatcaaaaktactgccctaggagctctctacta

SEQ ID NO: 11141 - DNA, 50 bp, homo sapien
gctattaaaatcaatagttgtaatayaaaattctcttaaaaaagttttat

SEQ ID NO: 11142 - DNA, 50 bp, homo sapien
tgggcacattcagaaattttgtctaygatctttctgctctgcagaggcag

SEQ ID NO: 11143 - DNA, 50 bp, homo sapien
gaggaaacagcaataaacagcacaaytaaactcactgtaaatggaagaaa

SEQ ID NO: 11144 - DNA, 50 bp, homo sapien
agcataaaaggaattattcaacaccmgataaattattaaagtcattaatt

SEQ ID NO: 11145 - DNA, 50 bp, homo sapien
ccaaaagttaagggaaagagatagaragaaggttatgcagatttcctgtg

SEQ ID NO: 11146 - DNA, 50 bp, homo sapien
ttgactgaattctggcttttaaacaytgaacctcttgatcagaacacaat

SEQ ID NO: 11147 - DNA, 50 bp, homo sapien
actttgtaggtgctagcctgaagtaraaattctgtagtttggagctacag

SEQ ID NO: 11148 - DNA, 50 bp, homo sapien
tctttgctgttgttggtcgcagctamataagactggacatttaacttttc

SEQ ID NO: 11149 - DNA, 50 bp, homo sapien
tcacacacctaggtatttttgtatcwattgcttcagttcttttccgtgtg

SEQ ID NO: 11150 - DNA, 50 bp, homo sapien
ttgtcctcaagtgctaaatcagagcrgagtagtatattttagttagttgc

SEQ ID NO: 11151 - DNA, 50 bp, homo sapien
agccagcaccctagctacctggttgwaacgtaaatgaagagcggggctct

SEQ ID NO: 11152 - DNA, 50 bp, homo sapien
gtatcatgaaaggacccggtatgtcmacgacttgagaaacattcagtgag

SEQ ID NO: 11153 - DNA, 50 bp, homo sapien
accctgttttgttttaatcccaccargatgtttgagctctgtgtatttgt

SEQ ID NO: 11154 - DNA, 50 bp, homo sapien
atgtcaaattgtgtgtatctagttcwagtcctgatccgatttcatataat

SEQ ID NO: 11155 - DNA, 50 bp, homo sapien
aaaagtctgggttatagaaaggttgraaacgtctctactaagattatact

SEQ ID NO: 11156 - DNA, 50 bp, homo sapien
ctgtaaaattaaatcagacaaattasgtagaatgatagacacttggcttc

SEQ ID NO: 11157 - DNA, 50 bp, homo sapien
gtgtagtagacatgaaataaacacckcaattattaccttcataggacaca

SEQ ID NO: 11158 - DNA, 50 bp, homo sapien
tggtttcaaatttagtgttgacctastaaccttgatccaaaaacattcaa

SEQ ID NO: 11159 - DNA, 50 bp, homo sapien
ttagctgcaatatgtctgggagttcyctaaaggactgaaaaacaggattg

SEQ ID NO: 11160 - DNA, 50 bp, homo sapien
tatggcaatctcaaatgtagaaatcyaaagtccatgaattatataaagga

SEQ ID NO: 11161 - DNA, 50 bp, homo sapien
tttagcatacattttctgaaatttcraagtccctggtatagtacagaagc

SEQ ID NO: 11162 - DNA, 50 bp, homo sapien
aaagcttacctctctttagtgacagrataaaatcactaaggtacacaaat

SEQ ID NO: 11163 - DNA, 50 bp, homo sapien
ccaagtactgaagttaatactgttgracaaagatagcttaaacatggaga

SEQ ID NO: 11164 - DNA, 50 bp, homo sapien
ttagatagcacccttactcgaaggarcttaaaatggtagcattacattct

SEQ ID NO: 11165 - DNA, 50 bp, homo sapien
agtctttccaggctctttcaattctraagtctatgattgtacaatatggc

SEQ ID NO: 11166 - DNA, 50 bp, homo sapien
tggatttcaggactaaacttttcaargattaacaaatgaacttcaatggt

SEQ ID NO: 11167 - DNA, 50 bp, homo sapien
caattctgatctttcatgctggacaygtattacgactcttggacacagtg

SEQ ID NO: 11168 - DNA, 50 bp, homo sapien
aagtaaactttcaaggttattaaccracacagtagaataaattatgtcct

SEQ ID NO: 11169 - DNA, 50 bp, homo sapien
caagttgccctaaaaatgatgtcacraagggcacactcgtataaaaatgg

SEQ ID NO: 11170 - DNA, 50 bp, homo sapien
ttgatttacatagcatagtaataagycaaggatttcccagtcattaaagt

SEQ ID NO: 11171 - DNA, 50 bp, homo sapien
ctgtatgactgtcttaagtccttcargtgtggtggtagccaagaagaaag

SEQ ID NO: 11172 - DNA, 50 bp, homo sapien
actaacactcatataaatgatccacmaaataaggttctacaagaatataa

SEQ ID NO: 11173 - DNA, 50 bp, homo sapien
agggtatttctgctggtgattttcayatttcgggtcagtagcaacaagag

SEQ ID NO: 11174 - DNA, 50 bp, homo sapien
aataaccaaaatctttcataaagtcrattgttcgatgcgtttgtttgatc

SEQ ID NO: 11175 - DNA, 50 bp, homo sapien
aaatcagataggtagatccaattcartcttctctgaggtaagatcaaaag

SEQ ID NO: 11176 - DNA, 50 bp, homo sapien
aagcgtccgtatttacatcttggcamcatgcaggcctcctgaggtcctaa

SEQ ID NO: 11177 - DNA, 50 bp, homo sapien
gggagtgccttctctatttggctcaragtaatatggagacagctaaccat

SEQ ID NO: 11178 - DNA, 50 bp, homo sapien
ctaaccaggtctgtggccttagaaayacatttaacctctgtttttttgct

SEQ ID NO: 11179 - DNA, 50 bp, homo sapien
gagacttaacatcacagagaacatayggatttgaaagggaaatggggaaa

SEQ ID NO: 11180 - DNA, 50 bp, homo sapien
ttcaaatacacacaaagagaaaacartatttagcaatgaaatgttgtatt

SEQ ID NO: 11181 - DNA, 50 bp, homo sapien
ctcctaaaatcacaatgaattttacmaatggcatagatggaatatgatgg

SEQ ID NO: 11182 - DNA, 50 bp, homo sapien
gtcatataactgcagtgcttctgtasagcggacaaggcattcatctctgc

SEQ ID NO: 11183 - DNA, 50 bp, homo sapien
ttcccagctcagggctctcttctaaygcacaagggcccgtgatttctctt

SEQ ID NO: 11184 - DNA, 50 bp, homo sapien
aagcacggtctactttcaagtaatcyagaccaaacacactgtagtctagg

SEQ ID NO: 11185 - DNA, 50 bp, homo sapien
atggaatgatgcttttaatgatttargacttagatttagtccttttttaa

SEQ ID NO: 11186 - DNA, 50 bp, homo sapien
tctatgtcagagagctagatagtaayagaaaaggttatacctgatgtgtt

SEQ ID NO: 11187 - DNA, 50 bp, homo sapien
ctgggaaggtacttcattaggaaaarcagtatatgtgcacaataataacc

SEQ ID NO: 11188 - DNA, 50 bp, homo sapien
tcatcttctgcctctatttagccaayggcagtaagttgtttcaagtcttc

SEQ ID NO: 11189 - DNA, 50 bp, homo sapien
ggttaccaaaaaaaggtcaatcacaragatttttttcagtttaatttcta

SEQ ID NO: 11190 - DNA, 50 bp, homo sapien
acatggaaatcagcactcacaacacyggtaggaatcaaaattgctgctac

SEQ ID NO: 11191 - DNA, 50 bp, homo sapien
taaataggctaagatgcgtggctcaygaacaattatcagccatgtgagaa

SEQ ID NO: 11192 - DNA, 50 bp, homo sapien
agtaggaagtttgccttttgcgcctsaatgatcgttttggcagtcatttc

SEQ ID NO: 11193 - DNA, 50 bp, homo sapien
ttcttaaggtaccattgtattggacraatgtgctctaaaaagtaagcgtg

SEQ ID NO: 11194 - DNA, 50 bp, homo sapien
ggttttttcacaaaacaggttttaayaagaacaacagagcacaaaaaccg

SEQ ID NO: 11195 - DNA, 50 bp, homo sapien
ctgtgacagaaagaaagccagcatarcaatgttcagagccctgcaagata

SEQ ID NO: 11196 - DNA, 50 bp, homo sapien
gcttttcacaccacactcagggatamagtttaaaatgcatatacttcagg

SEQ ID NO: 11197 - DNA, 50 bp, homo sapien
tgcctacattaaaatgtgaaagccayggatcaacacctagtaaaaaatgt

SEQ ID NO: 11198 - DNA, 50 bp, homo sapien
tgttgtgctaagaactttgcacacartatctggtttaatcttcacaataa

SEQ ID NO: 11199 - DNA, 50 bp, homo sapien
ttccaaatatcaaatacactaagtaygacactgatttttagttcttgatc

SEQ ID NO: 11200 - DNA, 50 bp, homo sapien
aaatacctggcccagataagatagcracagggaacaagtccagagtttta

SEQ ID NO: 11201 - DNA, 50 bp, homo sapien
tttagtccaccatttaggcaatacawgtaattatagcacatcaaaaaagc

SEQ ID NO: 11202 - DNA, 50 bp, homo sapien
gatgcaagccgtattaaacaagtaasggaactctacaggatgcagaatta

SEQ ID NO: 11203 - DNA, 50 bp, homo sapien
caaaaataccaactccaggaaataaygtgaactctaaatttgacttaaat

SEQ ID NO: 11204 - DNA, 50 bp, homo sapien
catgataggagatgtggtaggaataygacagggtaaagcagttaaggact

SEQ ID NO: 11205 - DNA, 50 bp, homo sapien
atttagcaagaactatttctacacaktggaattgcaagtaatttcttcat

SEQ ID NO: 11206 - DNA, 50 bp, homo sapien
tctttatcataatagatgtaataagkatggtaagaatgtacggaagcact

SEQ ID NO: 11207 - DNA, 50 bp, homo sapien
atagcatggaaacagactggtataartagtacagtagtcaccagtgtgcc

SEQ ID NO: 11208 - DNA, 50 bp, homo sapien
cttttctgccaaatatttgatttgarcacttactaatttcgaaccaatta

SEQ ID NO: 11209 - DNA, 50 bp, homo sapien
gtataaaatgaaatgagtgtacctamatatcaactacctctcaagtctgt

SEQ ID NO: 11210 - DNA, 50 bp, homo sapien
gagtatcttataagtgaagtacaccmaatttagcctataactttttgtta

SEQ ID NO: 11211 - DNA, 50 bp, homo sapien
tgtgaataacactcaaatccacttaygtattgataattgtccaattaagg

SEQ ID NO: 11212 - DNA, 50 bp, homo sapien
ttaattgcagaagaaaactagaatcyaataccaagtatgatacagttttt

SEQ ID NO: 11213 - DNA, 50 bp, homo sapien
tatgtaaccagtatttagaaaaagcragtgtgatttaataaaaatatagc

SEQ ID NO: 11214 - DNA, 50 bp, homo sapien
ccaaattctccacaaattttattagractatagaagggattcaatataaa

SEQ ID NO: 11215 - DNA, 50 bp, homo sapien
tccaggtaaactagagatagaaacckgagttgtttttgtttttgttttta

SEQ ID NO: 11216 - DNA, 50 bp, homo sapien
gaatatagctcccacactcagaatayagcttaaattttattctctttgag

SEQ ID NO: 11217 - DNA, 50 bp, homo sapien
caaattcctgagacagtgtggaatayagtatttcagatttagcattaaag

SEQ ID NO: 11218 - DNA, 50 bp, homo sapien
ctttcaaaagtcatcccaagtatcartcatctgacacctgccctgacttc

SEQ ID NO: 11219 - DNA, 50 bp, homo sapien
ctgaactaataggcatattatgatascattgaacctgcacagatagattc

SEQ ID NO: 11220 - DNA, 50 bp, homo sapien
aggtatttgaaataccagtaatcaayagataaacagtagtcaagattttg

SEQ ID NO: 11221 - DNA, 50 bp, homo sapien
gtgtcccttttccactaccctatcaycatcagctatggtaaagttatcca

SEQ ID NO: 11222 - DNA, 50 bp, homo sapien
ttgttggggtgtgtctaatatagaargacaaaaatagccctgattgcttg

SEQ ID NO: 11223 - DNA, 50 bp, homo sapien
gaatccttctgatttcaaaatgtgayctcttaacctctatgcccacgtag

SEQ ID NO: 11224 - DNA, 32 bp, homo sapien
tttgaaatgttgattaygacacttcacacaat

SEQ ID NO: 11225 - DNA, 50 bp, homo sapien
tcattagtatctgccttctgatcatwacggtcccagaaaattcaaaacat

SEQ ID NO: 11226 - DNA, 50 bp, homo sapien
agtgtctaagaggtgtcatgactccrcagatgatatttgtctaggtgtca

SEQ ID NO: 11227 - DNA, 50 bp, homo sapien
tgaaatatttccaggatgagtgtaartagctatcaccttatgctccccat

SEQ ID NO: 11228 - DNA, 50 bp, homo sapien
aacataatatagtgaagtttgatagsaatgtagtaaagtattgtgagaat

SEQ ID NO: 11229 - DNA, 50 bp, homo sapien
aaaccttcctcatacggttgttatargagctaaatttgataatccatgtg

SEQ ID NO: 11230 - DNA, 50 bp, homo sapien
ttaagccactttatattcctggtacrcaaacacagcaatgtcataaatgt

SEQ ID NO: 11231 - DNA, 50 bp, homo sapien
catctctttttggcaaattaaattayctcttaactagtgtttttttaatc

SEQ ID NO: 11232 - DNA, 50 bp, homo sapien
atggtaggtgttcacataccaaaaaktatctttgataagcaaatctggag

SEQ ID NO: 11233 - DNA, 50 bp, homo sapien
ctaattagatcgtatggggatatgasactagaatgaaagaagaggtttta

SEQ ID NO: 11234 - DNA, 50 bp, homo sapien
ttgacacagtgaagttgactttaaaygtatacacatacgcacagacatac

SEQ ID NO: 11235 - DNA, 50 bp, homo sapien
ttcattaactctcccagaagaacaaygaagtcactgagaagatgtttcat

SEQ ID NO: 11236 - DNA, 50 bp, homo sapien
tcaaggctattctttgtaacagatcraggtcaaattatcagacacaaaac

SEQ ID NO: 11237 - DNA, 50 bp, homo sapien
agttgtctttctctcttaccaatgcrctattcgaaatttgattttgtttt

SEQ ID NO: 11238 - DNA, 50 bp, homo sapien
cagtgattgaaaatggttgatgaaasttcctttgcttttgaacatgaaag

SEQ ID NO: 11239 - DNA, 50 bp, homo sapien
caaacttaaattcagcaatttcttaragcactttcaatatgccacatata

SEQ ID NO: 11240 - DNA, 50 bp, homo sapien
caaatctctgagaatcaagtagctamaatatcatcattattatcattatt

SEQ ID NO: 11241 - DNA, 50 bp, homo sapien
ttataaaccacttccaggtgatgtcratactgctcgtttagctaccacat

SEQ ID NO: 11242 - DNA, 50 bp, homo sapien
aactgtttggatagcttactgcatgsaatttcataaccaacactactttt

SEQ ID NO: 11243 - DNA, 50 bp, homo sapien
agttcaaagtcacaatatctaggacygacatctggaaatgtatgtaagaa

SEQ ID NO: 11244 - DNA, 50 bp, homo sapien
aagagaattacctgaaaaacaagaargtagtcagatataagattttaaaa

SEQ ID NO: 11245 - DNA, 50 bp, homo sapien
taggtctcctaatcaccagcagtaaycaattagaaaatgtaatggaaaaa

SEQ ID NO: 11246 - DNA, 50 bp, homo sapien
tgcagggttcctgctaacgagctaaygtttattccactataaccctaatc

SEQ ID NO: 11247 - DNA, 50 bp, homo sapien
tgttcttttttctatctttcaatagyattttagaatgttttttaaataca

SEQ ID NO: 11248 - DNA, 50 bp, homo sapien
ttccaatcttggtcttaaaaacttaygatgaagataaggtaatgtactta

SEQ ID NO: 11249 - DNA, 50 bp, homo sapien
aaggaattaatgcagaagtctctaamtgtgagaaattaatgcagaagcct

SEQ ID NO: 11250 - DNA, 50 bp, homo sapien
agtagaaagatggtagctaggttaawgaagaaacaaagagtgagggtcca

SEQ ID NO: 11251 - DNA, 50 bp, homo sapien
ggtgggggagacgttgattcctacayggtgtcggcattcaggcacagtca

SEQ ID NO: 11252 - DNA, 50 bp, homo sapien
aacaagaataaaaataaggcatataraacttctacttttttttcttcttc

SEQ ID NO: 11253 - DNA, 50 bp, homo sapien
cacctctaacctttctaaccatcaakaacatacaatagatagtagatctc

SEQ ID NO: 11254 - DNA, 50 bp, homo sapien
cccagtgaaatgtgaagaggctaacygggaagtctccgtaagtgcatata

SEQ ID NO: 11255 - DNA, 50 bp, homo sapien
aaaacaaaaaatcactgccgttaaartatggcaggttgtagagtgtgagg

SEQ ID NO: 11256 - DNA, 50 bp, homo sapien
taaagtcaatttcaggctattttccyaaggtgatctgggctgtgcagggc

SEQ ID NO: 11257 - DNA, 50 bp, homo sapien
agacatgtaaagaaaagtacctgtayaccaaacttattgctgtataaaga

SEQ ID NO: 11258 - DNA, 50 bp, homo sapien
aagacgcattagggtggaatagttaraaaggagcctagaaaaagtgaaat

SEQ ID NO: 11259 - DNA, 50 bp, homo sapien
ggtgctcagttaatttgtattaaacrgacagataccagtttctgctgcca

SEQ ID NO: 11260 - DNA, 50 bp, homo sapien
cacatttaagatgtttcataaaatawgcactgatacttcctcactaatag

SEQ ID NO: 11261 - DNA, 50 bp, homo sapien
acagggtcaatgcatctgggtcatamaacatcccacatatgcaccttcac

SEQ ID NO: 11262 - DNA, 50 bp, homo sapien
aaatatgatattttgttaataaaaayggacactaaatgtaatcaatgtat

SEQ ID NO: 11263 - DNA, 50 bp, homo sapien
ttcaaatgaataaaatacacaaatamcaatcaaataaactgaattgtgga

SEQ ID NO: 11264 - DNA, 50 bp, homo sapien
tttttgatcttagccaatgtgacaastaaaaatatgaaacatcactgaag

SEQ ID NO: 11265 - DNA, 50 bp, homo sapien
aagaggaaaatgccaagttgggtaaygaaaactgaaccgccctgtgctct

SEQ ID NO: 11266 - DNA, 50 bp, homo sapien
tcagataaagtactttgttctactasgtctaccagagtcgttcatactgc

SEQ ID NO: 11267 - DNA, 50 bp, homo sapien
tttcgtaatatcaaatgtcatagcgyaatattctgaatgtactctgttag

SEQ ID NO: 11268 - DNA, 50 bp, homo sapien
tgtttttgttagttttctctaaaaartcatttataatcagtgttcccaat

SEQ ID NO: 11269 - DNA, 50 bp, homo sapien
agggcaatacaagatcagttaagcaygtacttttaaaaaatggacacagc

SEQ ID NO: 11270 - DNA, 50 bp, homo sapien
ctctgcaaaagatgacagaacgaaargaaattccagtaagctttgctgtg

SEQ ID NO: 11271 - DNA, 50 bp, homo sapien
attcacaataaacagaattcagtaayagtaaagagtccaaatggaaggtt

SEQ ID NO: 11272 - DNA, 50 bp, homo sapien
tttgaaatcaagtctgttttgtgcaragcatgtaatttcagaggtcatgt

SEQ ID NO: 11273 - DNA, 50 bp, homo sapien
tgctgcctcactctgcctgatatgcyactcaaatctctctgtggcctgac

SEQ ID NO: 11274 - DNA, 50 bp, homo sapien
ttaaagggagaaatatccttccgaaraaccatctatattgatattaatgt

SEQ ID NO: 11275 - DNA, 50 bp, homo sapien
ttggagtaaagagcattggtaaggaygaaatttagtggttagttttgtgt

SEQ ID NO: 11276 - DNA, 50 bp, homo sapien
ttctagtgagtgaactctttcttgartaacatccttttgttctgcttctt

SEQ ID NO: 11277 - DNA, 50 bp, homo sapien
tgaagtgctcttgaaatttaagtgawctataactccttgcttactcacag

SEQ ID NO: 11278 - DNA, 50 bp, homo sapien
agttttcaactaaaaatcctgcatasacatgttaccacataacaccacat

SEQ ID NO: 11279 - DNA, 50 bp, homo sapien
tgcagagagagctggaagtattcacrgaacataggaggaaactgaggcat

SEQ ID NO: 11280 - DNA, 50 bp, homo sapien
ggcaagtacttattcattacgtgacrctcaacttaagaatcaccttcttt

SEQ ID NO: 11281 - DNA, 50 bp, homo sapien
ggagaattgcaattgatatttatgayattttgctacagattataaagtta

SEQ ID NO: 11282 - DNA, 50 bp, homo sapien
ccttgtttgcagagtttaggtcccaragaatataaagacactcaaagtat

SEQ ID NO: 11283 - DNA, 50 bp, homo sapien
tccttctgcagcaatgtggaagacargctacagacaggatggccagtgca

SEQ ID NO: 11284 - DNA, 50 bp, homo sapien
tcaatctggatctccatagccagaaygtcataccacccaacctagtctaa

SEQ ID NO: 11285 - DNA, 50 bp, homo sapien
actaagttaatgtgtaggctctctcyaggtgttaaggaaataatcctgat

SEQ ID NO: 11286 - DNA, 50 bp, homo sapien
ggtctacattttgaaagctctgaagsacaagactgagattggacttattt

SEQ ID NO: 11287 - DNA, 50 bp, homo sapien
gaaattacaggaagaaatgaaacgcratagaaaaggtaaatataaagtta

SEQ ID NO: 11288 - DNA, 50 bp, homo sapien
ctcctatttttacagaaaaggaaacygagacttggagaagttcttgctaa

SEQ ID NO: 11289 - DNA, 50 bp, homo sapien
cctgatgttataacacaaattactaygttaccatgctaagtaaaaaaaat

SEQ ID NO: 11290 - DNA, 50 bp, homo sapien
acatctgaaaagtaaaggaattataractagctgctgcttcacaccaaca

SEQ ID NO: 11291 - DNA, 50 bp, homo sapien
tattcgaggaaaaatataaagtgagratgtaagtaacacggatataggtt

SEQ ID NO: 11292 - DNA, 50 bp, homo sapien
acattaggaaaaaacaagtgaatggratgaaatgagatatacaagcaata

SEQ ID NO: 11293 - DNA, 50 bp, homo sapien
aaatttcacataataccatctttcarcaaattatacgaaggcaaatgtgg

SEQ ID NO: 11294 - DNA, 50 bp, homo sapien
gcagttgtttgtatattctgaggtamatcatgtgaattatactggctata

SEQ ID NO: 11295 - DNA, 50 bp, homo sapien
agaaaatgaaactatatcctcagctwaacttcaaaaataactaaccaaat

SEQ ID NO: 11296 - DNA, 50 bp, homo sapien
gggaaggagggctcacaagaactaaygatggccctagagttctggtcttt

SEQ ID NO: 11297 - DNA, 50 bp, homo sapien
gggtttgactatcccccaaaatcaamgtttttcactggtttgagtctact

SEQ ID NO: 11298 - DNA, 50 bp, homo sapien
tagtcagtgagtctagtccagaagcratgatcagattaatgttggccctt

SEQ ID NO: 11299 - DNA, 50 bp, homo sapien
tctctgcatgtagcctgaaatctacyggacaaagaatctagtaatttaga

SEQ ID NO: 11300 - DNA, 50 bp, homo sapien
ataatctcttatatcttatcgacctmaatcaaaggcagagcttcaagttt

SEQ ID NO: 11301 - DNA, 50 bp, homo sapien
atgtatgagaagacattgcttgataratgttatttgccagactttatttt

SEQ ID NO: 11302 - DNA, 50 bp, homo sapien
tatgattgtctaaaagtaggttacayaaagggagtattgtttaaaatgga

SEQ ID NO: 11303 - DNA, 50 bp, homo sapien
ggtgcaaagaaaaattgacattaaarccctttataggcatggtttacact

SEQ ID NO: 11304 - DNA, 50 bp, homo sapien
atgcccactgcagtagaacttagaaraacatccagcaaatttttttacaa

SEQ ID NO: 11305 - DNA, 50 bp, homo sapien
ttttggtggggagaatcaaaatctaytactttcccaaaacctcctgtgac

SEQ ID NO: 11306 - DNA, 50 bp, homo sapien
attcagaaatatagtatttgactcayaaaacttggagccactcaccacac

SEQ ID NO: 11307 - DNA, 50 bp, homo sapien
tagagggctatgcaagccaagataasgatgtctgactttaccctaaggga

SEQ ID NO: 11308 - DNA, 50 bp, homo sapien
ggaagggctaatggaagaaatttgckacccaagggacagtgctgacggaa

SEQ ID NO: 11309 - DNA, 50 bp, homo sapien
agttccattgtttaggaacagcaaasatgaggaaggatacaaaaggagac

SEQ ID NO: 11310 - DNA, 50 bp, homo sapien
aaagagtagaaaaggatagaggaagrcctgtgaagctcgtattctgccga

SEQ ID NO: 11311 - DNA, 50 bp, homo sapien
aatacaacaatcaggtggaggtccaygaaatatcttactcttgatagtaa

SEQ ID NO: 11312 - DNA, 50 bp, homo sapien
aaagcaaggaaaaattgacaacaacyctgttatgactaagcagaggagac

SEQ ID NO: 11313 - DNA, 50 bp, homo sapien
gtcagaattttccatggatccatcaragaaatagtttctgcaccatttgt

SEQ ID NO: 11314 - DNA, 50 bp, homo sapien
tagatctgagtatgaatgagtctgarctataaaactaacgagatagatgg

SEQ ID NO: 11315 - DNA, 50 bp, homo sapien
aatcaggaaagatttctttaataaaytgacatggagcagagaaaggaatc

SEQ ID NO: 11316 - DNA, 50 bp, homo sapien
gtgataattttcacctaggcaaatamtattagacctgacaaggtttagga

SEQ ID NO: 11317 - DNA, 50 bp, homo sapien
tgaagaataggtcctgggagttccartatttagaggttgagaaaagtaat

SEQ ID NO: 11318 - DNA, 50 bp, homo sapien
ctcttccttcttgccatctctaaacyctacgtatgaatcttgggttctgg

SEQ ID NO: 11319 - DNA, 50 bp, homo sapien
gacccccaaatagccacctggtggaygtttcttgtttgtctaaattgtag

SEQ ID NO: 11320 - DNA, 50 bp, homo sapien
ccaggaggatcctgggagtgtggaaygaaagataaagaaccttaagctga

SEQ ID NO: 11321 - DNA, 50 bp, homo sapien
gtaattgttcaaatttttattttaaygcacagtatgagaaatgaactttt

SEQ ID NO: 11322 - DNA, 50 bp, homo sapien
agggtttgtgttcacttatcagctcyactacttcccaacttataacattt

SEQ ID NO: 11323 - DNA, 50 bp, homo sapien
tgtattttgtgcggatagatttaaasaccaattgattatgtaacagagtt

SEQ ID NO: 11324 - DNA, 50 bp, homo sapien
tgctacatagtgaaagctccaaaacygttggttaatgaatgttgaaatca

SEQ ID NO: 11325 - DNA, 50 bp, homo sapien
cagttaaagacactaatcagtcaacrgattcttcatattttaattttata

SEQ ID NO: 11326 - DNA, 50 bp, homo sapien
acttcaccgatttggtgtgtgtcaayttccatctgctagtatctgcatct

SEQ ID NO: 11327 - DNA, 50 bp, homo sapien
acagctttagcaaatgtgtggcctgmaactccaattggtggttctgatac

SEQ ID NO: 11328 - DNA, 50 bp, homo sapien
taaacccatattctatccagtttaaktctctatgtgactagaattcccaa

SEQ ID NO: 11329 - DNA, 50 bp, homo sapien
tccttcttagaaattacctaagaacygcttcatatgtttttccctctctc

SEQ ID NO: 11330 - DNA, 50 bp, homo sapien
cgcagcagtagctaactaatacaccracaaaattgattttcttatgatct

SEQ ID NO: 11331 - DNA, 50 bp, homo sapien
tgagcaaagtttcaacatgctgggartcagaatcatgctcagatcagagc

SEQ ID NO: 11332 - DNA, 50 bp, homo sapien
cttatgagcaaattttattaaacaasaatccaggatgctatgataaaccc

SEQ ID NO: 11333 - DNA, 50 bp, homo sapien
taaaattggacctttttagttatcayagaagtctattcagaaagagggta

SEQ ID NO: 11334 - DNA, 50 bp, homo sapien
aaagtacagattctgcaatctcaaaraacgatgtgaaattctcctaataa

SEQ ID NO: 11335 - DNA, 50 bp, homo sapien
gagcagcaaccagaattctaatctcyactgttgcaagctcaggctccatg

SEQ ID NO: 11336 - DNA, 50 bp, homo sapien
ccatggtgtattttcaggcctatacrccagggttgctgtcactgcctatt

SEQ ID NO: 11337 - DNA, 50 bp, homo sapien
tcatccagagaaaaaattaccaaaayggaagaatgtaaatgacattcaaa

SEQ ID NO: 11338 - DNA, 50 bp, homo sapien
gagtcaggagttgaccaaagagcagraagttttttataaaatggtgcaac

SEQ ID NO: 11339 - DNA, 50 bp, homo sapien
agatttatggctgacatccctataaygaaagatggattaacaagagaaaa

SEQ ID NO: 11340 - DNA, 50 bp, homo sapien
attaagtgtcaggctctgtcctaaaygttaaacaggtgaacataccattc

SEQ ID NO: 11341 - DNA, 50 bp, homo sapien
ccctggctgatttatatctaagccartgaattaccaaaggccagtctctg

SEQ ID NO: 11342 - DNA, 50 bp, homo sapien
actaaattttaaaatgcttggcataycttaaagtcagtaattcagtatct

SEQ ID NO: 11343 - DNA, 50 bp, homo sapien
tctgtgttattaagctgtggtataayggactatctctggccaggatagaa

SEQ ID NO: 11344 - DNA, 50 bp, homo sapien
tcataagtggttttaatggttcttayagaaatcttatattgcttttgcac

SEQ ID NO: 11345 - DNA, 50 bp, homo sapien
acctgtaaataagcatgggcttaacygtgcagagcctcgtaaaccatggt

SEQ ID NO: 11346 - DNA, 50 bp, homo sapien
gtgtttgacatttctttggctcaaaygtagtcattccacttctcttggta

SEQ ID NO: 11347 - DNA, 50 bp, homo sapien
ttcatatcaaaacttgttacacttayatgtggttacttatagagatccat

SEQ ID NO: 11348 - DNA, 50 bp, homo sapien
acacaaatgagcaggaagatcatgcratttcaagtattttgttatttttt

SEQ ID NO: 11349 - DNA, 50 bp, homo sapien
acattactgttaatgagacaacatayggtatacagatttcaccatttttc

SEQ ID NO: 11350 - DNA, 50 bp, homo sapien
tacaatctcataaagcagggtaaaayatattgcataaacactgcggctct

SEQ ID NO: 11351 - DNA, 50 bp, homo sapien
ttccatatccttcttcagttgaaagraccacaaaaacactagctaaaact

SEQ ID NO: 11352 - DNA, 50 bp, homo sapien
ttgcataaacactgcggctctagtcmatgagtcatagtaaaacactgtcc

SEQ ID NO: 11353 - DNA, 50 bp, homo sapien
gcagggtcattttgttaatccacaamcataataatactcgacaaaaggtt

SEQ ID NO: 11354 - DNA, 50 bp, homo sapien
ccacaaaggacgatgagatttacaargagttttcccagaggcatgacgtt

SEQ ID NO: 11355 - DNA, 50 bp, homo sapien
tactacttaggatcaactttttataygtacaagctggttattggcgcttt

SEQ ID NO: 11356 - DNA, 50 bp, homo sapien
aaaaaaaatggaatatgttaagggarataaggtaaaagcaaaatccccat

SEQ ID NO: 11357 - DNA, 50 bp, homo sapien
caggctgtagcttttctcctggtgaygaacaaggatgttctccttaagga

SEQ ID NO: 11358 - DNA, 50 bp, homo sapien
tgattgtgataagctatttgatccawcatacatgtatcaaatgcctgcta

SEQ ID NO: 11359 - DNA, 50 bp, homo sapien
cttaggtctagaaatgtcttctttayggaatgtaattatataatcaggac

SEQ ID NO: 11360 - DNA, 50 bp, homo sapien
ctctctataactccatgggataatayaaaaatgactgctttctctaaaca

SEQ ID NO: 11361 - DNA, 50 bp, homo sapien
gagctaatttgtttcttactgtattsaaggaactgcagagagagcaaggg

SEQ ID NO: 11362 - DNA, 50 bp, homo sapien
aaaagggggagatggcagacttgaamagagcccaagagtttggttgtggg

SEQ ID NO: 11363 - DNA, 50 bp, homo sapien
aatgctataatgtatgtataatgtawaatgtataatgctatatgtaacag

SEQ ID NO: 11364 - DNA, 50 bp, homo sapien
cattctgccccactgggttccataaygtaggatatcacctgccacactca

SEQ ID NO: 11365 - DNA, 50 bp, homo sapien
aagcttataattttaattgtaaatcractgtggaatctaaactttcccct

SEQ ID NO: 11366 - DNA, 50 bp, homo sapien
ctgactacaaccacctagaataatcmgagagagtttcaggtgcaacccct

SEQ ID NO: 11367 - DNA, 50 bp, homo sapien
ggttagtaataatggtgctagctaarctattaatatgataaactcttgtg

SEQ ID NO: 11368 - DNA, 50 bp, homo sapien
tttttcaacttagaaatttatgggartaggacaatttgtttctaatattg

SEQ ID NO: 11369 - DNA, 50 bp, homo sapien
tttgttacttacagctgaattaagaygtttataaattatggctaaaaatt

SEQ ID NO: 11370 - DNA, 50 bp, homo sapien
tcccagttcacgcgataataagaccractcgatactcactaggatttgta

SEQ ID NO: 11371 - DNA, 50 bp, homo sapien
ttatttggcctttgttgaacagcaaracttaatttggatgtcatctaaga

SEQ ID NO: 11372 - DNA, 50 bp, homo sapien
gaaatattgcctataaagggatttcyataaaatgagtgccattttctcat

SEQ ID NO: 11373 - DNA, 50 bp, homo sapien
aagcctggccaagttaaagctggatmatacgaagtgtggagggggattta

SEQ ID NO: 11374 - DNA, 50 bp, homo sapien
tttatggatgaggaaacagactccartgcttctgatattaaccactaggc

SEQ ID NO: 11375 - DNA, 50 bp, homo sapien
tgattggcacataagtgctatggaartatatgctactcttactgcagtta

SEQ ID NO: 11376 - DNA, 50 bp, homo sapien
ggtgtgctatgttcgttttcttgcawcctatcaggtaggatacccttttc

SEQ ID NO: 11377 - DNA, 50 bp, homo sapien
agatagactgaataaaggaagtgagmatccattaaaaactctagtaaata

SEQ ID NO: 11378 - DNA, 50 bp, homo sapien
aaataagcagttggatggacaataascacaacttccttgttaggtgatct

SEQ ID NO: 11379 - DNA, 50 bp, homo sapien
tgcatttgattcagttacaagtccartagttctaagccgggagtggaccc

SEQ ID NO: 11380 - DNA, 50 bp, homo sapien
tacaattgtgtcattccttttactcrgaagacttcagtttttacattgcc

SEQ ID NO: 11381 - DNA, 50 bp, homo sapien
tacgaaatggatcctcttttattcaytatttagggatatcagcacatttg

SEQ ID NO: 11382 - DNA, 50 bp, homo sapien
cagctcacatctcattactacaaaargaaacccaatctcagatagctatc

SEQ ID NO: 11383 - DNA, 50 bp, homo sapien
ctgctacagttatgcctgtagttaaycaaatttgtcaactgcagagatat

SEQ ID NO: 11384 - DNA, 50 bp, homo sapien
tgcacagtgactgggaatattatgawgccatagaaagaaatggaatttgt

SEQ ID NO: 11385 - DNA, 50 bp, homo sapien
ttaaccatttgtgagtgtgtgtgtamgtgtctcctcctggacatatttac

SEQ ID NO: 11386 - DNA, 50 bp, homo sapien
atcatcataattcaatgattatcaaygtacttcttgtttagagaattaac

SEQ ID NO: 11387 - DNA, 50 bp, homo sapien
tctagatcagtggatcatcagaaaakcacctaaaacttaaaaaagcttta

SEQ ID NO: 11388 - DNA, 50 bp, homo sapien
ccctggcttcccagaggatatagaayaccaagaacactctagactaaaac

SEQ ID NO: 11389 - DNA, 50 bp, homo sapien
aagctttgtcattaaatatttacacyggcttagccctggaggtatttcct

SEQ ID NO: 11390 - DNA, 50 bp, homo sapien
gaactaaaatcaggtaaggtggggamgtaaaacatatccctaaatgatta

SEQ ID NO: 11391 - DNA, 50 bp, homo sapien
ttttggtttgccggtttgttcatgawattttataattcaagtcctgagaa

SEQ ID NO: 11392 - DNA, 50 bp, homo sapien
atgccgataattaggctgccatggartaactgtatgttggccatattttc

SEQ ID NO: 11393 - DNA, 50 bp, homo sapien
actattagttagttagtagatagctsaatgtatggtattctggtgaccta

SEQ ID NO: 11394 - DNA, 50 bp, homo sapien
cttctcatcctgaattgccatttcartagtgttatctctagtctgctgga

SEQ ID NO: 11395 - DNA, 50 bp, homo sapien
agtgacattgcaaagccttagttgartacaggtcaagatggaaattattt

SEQ ID NO: 11396 - DNA, 50 bp, homo sapien
gtcattctagcataaatatccataaygaggtactcaagttgatactggaa

SEQ ID NO: 11397 - DNA, 50 bp, homo sapien
actttattatggatgcaaatgtatgyaagaacagtaataaaaatcttcag

SEQ ID NO: 11398 - DNA, 50 bp, homo sapien
gtcctattataaaattactttcacayatataggatgcaatggttctaatg

SEQ ID NO: 11399 - DNA, 50 bp, homo sapien
gtgttgttaaagattttcttgtgaaytataatgaacgcagtgaacaagga

SEQ ID NO: 11400 - DNA, 50 bp, homo sapien
tgtgaggtgtgtgatagccacaatgyatagttgaggaaacttaagtggca

SEQ ID NO: 11401 - DNA, 50 bp, homo sapien
gatcatttacattataagaaacacaygaaaatctagaaaacattttacat

SEQ ID NO: 11402 - DNA, 50 bp, homo sapien
gggataaaagaagtaatagatgaccraagaactagccacttgaatggatt

SEQ ID NO: 11403 - DNA, 50 bp, homo sapien
gaaattagggtttctgacaatgcccyatctgctagcttgtcttctcattt

SEQ ID NO: 11404 - DNA, 50 bp, homo sapien
atctacaagaattatactaaaagccrcttaaaagacgtaacacatatgta

SEQ ID NO: 11405 - DNA, 50 bp, homo sapien
aaaacgagtgcatgacaaaacctgaytacttctgacatgtccagcataca

SEQ ID NO: 11406 - DNA, 50 bp, homo sapien
cttagaagaattcctattacacaaasgtccctttcaaaaatacacatttc

SEQ ID NO: 11407 - DNA, 50 bp, homo sapien
tacgggatatgatcatctttgatcasggttccaaacaaaagttatgtcac

SEQ ID NO: 11408 - DNA, 50 bp, homo sapien
aattgtccttctgttactgttactgyatgtatccacttttgaaaataatt

SEQ ID NO: 11409 - DNA, 50 bp, homo sapien
ctctcctgagaagttcctcgttttargtggacattgtgtgcattctttaa

SEQ ID NO: 11410 - DNA, 50 bp, homo sapien
acttgatggcctatagttgtaacgaygtatttggggaacaagcacatttt

SEQ ID NO: 11411 - DNA, 50 bp, homo sapien
atcaatgtgtaatgaatttttattcyaattggctcccttgagggattatc

SEQ ID NO: 11412 - DNA, 50 bp, homo sapien
agaactggcaggcttttattaggtaygaagatgagtgtcacatcagttca

SEQ ID NO: 11413 - DNA, 50 bp, homo sapien
actgtgctgaattctttacatactaycttatttcgttcctgccatagccc

SEQ ID NO: 11414 - DNA, 50 bp, homo sapien
taaagagaaaggtgaatcaacattamggctgggtaccagggttcatgcct

SEQ ID NO: 11415 - DNA, 50 bp, homo sapien
gtcagtgttttattgcagactaacckattaatgacctctttaaaagtaaa

SEQ ID NO: 11416 - DNA, 50 bp, homo sapien
ttaaatatcaatacaaatgagtctaygaagtaatctattttctacaaccc

SEQ ID NO: 11417 - DNA, 50 bp, homo sapien
cagtttactttcctcagctgcattaraagaataactatatacagcagtta

SEQ ID NO: 11418 - DNA, 50 bp, homo sapien
gaaataaatcatgaccatatgtctcraatagaaaagtgcatgctttacct

SEQ ID NO: 11419 - DNA, 50 bp, homo sapien
atccatgcaccaaataaatcaggagkagaatttccaagtgtccattctct

SEQ ID NO: 11420 - DNA, 50 bp, homo sapien
aaaagcaatcttcacctggacagaamaggaatgaactaaaatgttctgta

SEQ ID NO: 11421 - DNA, 50 bp, homo sapien
ggcttttaggagataattaaggttamgtgagataatagagatgggttcct

SEQ ID NO: 11422 - DNA, 50 bp, homo sapien
gaatttcatacattaaaaagaaaaasttggtctatattttttttaccact

SEQ ID NO: 11423 - DNA, 50 bp, homo sapien
taatttcaaaatgtaatgaactgcaygaactacagaacctcataaaactg

SEQ ID NO: 11424 - DNA, 50 bp, homo sapien
cgctgcctgccatcactgttataagycaactatggtattatgacttcttt

SEQ ID NO: 11425 - DNA, 50 bp, homo sapien
gttctattagccaagctcttatacartattaatcctccaaatggttatct

SEQ ID NO: 11426 - DNA, 50 bp, homo sapien
gggaaggaatttatatgaatcttagsaatattgtgtgagaatatgtgaag

SEQ ID NO: 11427 - DNA, 50 bp, homo sapien
ctcggtatcatgtcaattcttgccarattaatgttaaattcactgtgatc

SEQ ID NO: 11428 - DNA, 50 bp, homo sapien
aagtgctaatgttagagaacaaccaygtgaacaaatgtgaatgatgtgaa

SEQ ID NO: 11429 - DNA, 50 bp, homo sapien
tgatcctctggagttctttattctaygcctgaactcaaaaaataaacctg

SEQ ID NO: 11430 - DNA, 50 bp, homo sapien
agaaataaatgtggctttaccaagargcaaagttcaacttatttcattat

SEQ ID NO: 11431 - DNA, 50 bp, homo sapien
gtagataattatgacacaatgtagaracaactaaagtatgatatattatt

SEQ ID NO: 11432 - DNA, 50 bp, homo sapien
gtgtggttgaatttctgaacaaataygatccttgcaagagtaattaaaat

SEQ ID NO: 11433 - DNA, 50 bp, homo sapien
cattttataaatgcattgactagcakgatattagaagtcctggctcactt

SEQ ID NO: 11434 - DNA, 50 bp, homo sapien
gggatatattatgatcaaagaccaaytaggaggcgataaatgcaaggttt

SEQ ID NO: 11435 - DNA, 50 bp, homo sapien
ctatatgcaattaaaatcgttagcartgaaacaaaatggtttagaacata

SEQ ID NO: 11436 - DNA, 50 bp, homo sapien
taaccataaatacttctgtaatgagraaccaattgtagcttatagaataa

SEQ ID NO: 11437 - DNA, 50 bp, homo sapien
gtgaataatcttctactagatcttcrcatactgggttttcttagtattca

SEQ ID NO: 11438 - DNA, 50 bp, homo sapien
tccaaaagggaaagggacattgcttsaaagtgaaagagacacgattggcc

SEQ ID NO: 11439 - DNA, 50 bp, homo sapien
ttatttcatatcttcacagccctgaratatagttattatctccattttgt

SEQ ID NO: 11440 - DNA, 50 bp, homo sapien
atatagggagtatatctaaaagtaamcatctcttagaaagattgtcatgc

SEQ ID NO: 11441 - DNA, 50 bp, homo sapien
tgacttcatctcagagactatctgamactactgttccaataccaatccta

SEQ ID NO: 11442 - DNA, 50 bp, homo sapien
tttactgacagatagataattatgakgtatccaggctccatttttttgga

SEQ ID NO: 11443 - DNA, 50 bp, homo sapien
agtcagtgtggaatgcaaggacttayatgaatctacttcttcaatttgaa

SEQ ID NO: 11444 - DNA, 50 bp, homo sapien
ggcatatctgatgaatgctactctaygatcgtgtaagacatgctttccag

SEQ ID NO: 11445 - DNA, 50 bp, homo sapien
ctccctccctccacataacccctgartatggtcatctcatattgctcata

SEQ ID NO: 11446 - DNA, 50 bp, homo sapien
aacattacagcattatacttctctaygtaactattgtgttttcacatcaa

SEQ ID NO: 11447 - DNA, 50 bp, homo sapien
cataggaatagtaataatgaaatcawgttgttactattaaaggattctta

SEQ ID NO: 11448 - DNA, 50 bp, homo sapien
ctagtcctattcatcactcaattacragtcagacatacaggaggtgccaa

SEQ ID NO: 11449 - DNA, 50 bp, homo sapien
tgggagaaaatcctatttcagcctasagattttattctgtaattacatca

SEQ ID NO: 11450 - DNA, 50 bp, homo sapien
aagatgctttagtaaggatatatgaytcacaaaataggaaaataattcaa

SEQ ID NO: 11451 - DNA, 50 bp, homo sapien
atgcatgaatgcaatgtaactaaaamcttaacagtagctatgcaattttc

SEQ ID NO: 11452 - DNA, 50 bp, homo sapien
ttacattcactattattttttctgcygaatacagaggagtgtgctgtgag

SEQ ID NO: 11453 - DNA, 50 bp, homo sapien
caccagtcatattacattatgttctyactggtataaattggaactatgta

SEQ ID NO: 11454 - DNA, 50 bp, homo sapien
gagaggtcatcagaaaatatagataragcagatctacagagtttacaatg

SEQ ID NO: 11455 - DNA, 50 bp, homo sapien
acgaaggagaattaaaaactttaaaratcataaacattggtaaggatgaa

SEQ ID NO: 11456 - DNA, 32 bp, homo sapien
tctgtgaagagaaataktaggatgttttttcg

SEQ ID NO: 11457 - DNA, 50 bp, homo sapien
acaaaaaaaggaaaacaataagtggycatctcatctaaagacagcaaaat

SEQ ID NO: 11458 - DNA, 50 bp, homo sapien
ttagatcctacatgacccaatcatamaactattctactgtaaatgcacta

SEQ ID NO: 11459 - DNA, 50 bp, homo sapien
tgtaatactgaagcctaacaagatasagactgaaatgcatgaattttgga

SEQ ID NO: 11460 - DNA, 50 bp, homo sapien
tttaagaaatgttaatgcataagtayaagaatacctgtagtcgtacacaa

SEQ ID NO: 11461 - DNA, 50 bp, homo sapien
ctggaccactttgccaatttgctgascttcgtagtgtcctcgtacaacct

SEQ ID NO: 11462 - DNA, 50 bp, homo sapien
ctctgccaaaagaagatgtttactcrccaaaccaaattccttgttggacc

SEQ ID NO: 11463 - DNA, 50 bp, homo sapien
gagggaaaaccagtgccttccaaaakgatattataatctagatggtgaaa

SEQ ID NO: 11464 - DNA, 50 bp, homo sapien
ctctgatgaaccctcaaataatgaasaaggaaatgttactgcctaagaga

SEQ ID NO: 11465 - DNA, 50 bp, homo sapien
attccacgaattatttatctaaaaaygtcagatccaccaaggcagagttc

SEQ ID NO: 11466 - DNA, 50 bp, homo sapien
ccctacttgtaaggttttatgtacarataattgaatgaggtctgatgtaa

SEQ ID NO: 11467 - DNA, 50 bp, homo sapien
aaaaatgctgatcaaacccataaaartaatttctctacttattaatgcat

SEQ ID NO: 11468 - DNA, 50 bp, homo sapien
gttccatggccccagtgatgaagtcraactcaaattgcagccagatacat

SEQ ID NO: 11469 - DNA, 50 bp, homo sapien
tgtttccacatattgctcactttagmattgatggctcagtgggcgaatct

SEQ ID NO: 11470 - DNA, 50 bp, homo sapien
attatttttagacattcattgctacsctgttatgctatttttctcaactt

SEQ ID NO: 11471 - DNA, 50 bp, homo sapien
aaaaaaaaatttttgtttgtgaaaartgaactccattattgtataaggtt

SEQ ID NO: 11472 - DNA, 50 bp, homo sapien
ggcaaactgtaaaagtagtaggaacractgaattttgaaataagaatctg

SEQ ID NO: 11473 - DNA, 50 bp, homo sapien
tgagtaagtagtcacaatggtgattwaacatgtggtgagcatattgaaag

SEQ ID NO: 11474 - DNA, 50 bp, homo sapien
tactacttttacagtttgcccataaytatctagagtaaaatgctttcaag

SEQ ID NO: 11475 - DNA, 50 bp, homo sapien
tactaagggactgaacaaggaacaaygtgatgtttttgatgtagtacaga

SEQ ID NO: 11476 - DNA, 50 bp, homo sapien
atgagtggctaagtccttgccctcamtaaattacacaaaatatccaaatt

SEQ ID NO: 11477 - DNA, 50 bp, homo sapien
caactaacttagctgtaaagagtcaygcagaacttaaaagaagatcagac

SEQ ID NO: 11478 - DNA, 50 bp, homo sapien
catctcatgagctttagaattctgasaggttcattcttttatagggttat

SEQ ID NO: 11479 - DNA, 50 bp, homo sapien
cccaagattgcatgctatatacttaracctggttcatatggcactgattc

SEQ ID NO: 11480 - DNA, 50 bp, homo sapien
atgattctaaggatgtttgaagataygctatactcgctgaactgagagct

SEQ ID NO: 11481 - DNA, 50 bp, homo sapien
cagaagattctgaccttaagtattaygaactctgcttacaactatcagtg

SEQ ID NO: 11482 - DNA, 50 bp, homo sapien
gagttcaaagtgggacagattccaayaccaacttgaggaaagaggaggtg

SEQ ID NO: 11483 - DNA, 50 bp, homo sapien
gcaattttcgcttttaactattgcawctctgtcagtaaacactctgacat

SEQ ID NO: 11484 - DNA, 50 bp, homo sapien
attgaatgttgctattctgacttcartagtactaactcatttaaaatact

SEQ ID NO: 11485 - DNA, 50 bp, homo sapien
gggagaaaaacgttaaggtgaaaaayttgtcctatttcttttttgttttt

SEQ ID NO: 11486 - DNA, 50 bp, homo sapien
cacaaccccaaataaaagagttatcyagaggccctattttgtccttatgg

SEQ ID NO: 11487 - DNA, 50 bp, homo sapien
ccggcagactaagatttcaccatacratatggctcttacagaatcatttc

SEQ ID NO: 11488 - DNA, 50 bp, homo sapien
taaatgatatcaagtattttgcttaycacgtagtctgagttctagagatt

SEQ ID NO: 11489 - DNA, 50 bp, homo sapien
ggctgtatttgtgtccatcaaaaagkagagactcagcaaatatttactga

SEQ ID NO: 11490 - DNA, 50 bp, homo sapien
aaacaatgagacatccagtaaaaccraatgcgataacaggaagagatcct

SEQ ID NO: 11491 - DNA, 50 bp, homo sapien
tttccaggaagtttgtattttaacaytgattttgtgcagacaatacttta

SEQ ID NO: 11492 - DNA, 50 bp, homo sapien
aacagaacctggccttgttgtgcttraaatcgaattgtcacctcagaacc

SEQ ID NO: 11493 - DNA, 50 bp, homo sapien
cctacaacgtatcataataaacaaaygctagcggtggctcacgcctgtaa

SEQ ID NO: 11494 - DNA, 50 bp, homo sapien
acaacccctgatctagataccacaaytaaaagcaaaaccaaggtaaattt

SEQ ID NO: 11495 - DNA, 50 bp, homo sapien
acaactttcctagattaaaccaggaraatatagaatctctgaacagacta

SEQ ID NO: 11496 - DNA, 50 bp, homo sapien
ttctggatatactcactatagcaggrccatcaagattctagggcttgtga

SEQ ID NO: 11497 - DNA, 50 bp, homo sapien
ttttctctctttttggttaatctcaytaattgactatcaattttatttgt

SEQ ID NO: 11498 - DNA, 50 bp, homo sapien
agtggcagaactaggaatgaaatccrcaactttatcatttcagaggctgc

SEQ ID NO: 11499 - DNA, 50 bp, homo sapien
ggggtgctatgagttcaggcatatakcccaatgatctataataaagcaaa

SEQ ID NO: 11500 - DNA, 50 bp, homo sapien
tcttgttcaagaattggtgtctgaaycttaagtcaataagaaggaaataa

SEQ ID NO: 11501 - DNA, 50 bp, homo sapien
gcagccatagacaatatgttaatgayggatatggctgtgtttcaataaaa

SEQ ID NO: 11502 - DNA, 50 bp, homo sapien
gtgtgtgtgtttccttctcttctgakcatagaaactccatttaagaacta

SEQ ID NO: 11503 - DNA, 50 bp, homo sapien
cagctctgtaaatggtatccttgagwataacctctttaaggaagtcttag

SEQ ID NO: 11504 - DNA, 50 bp, homo sapien
ccattgatgaaaaaacaattatgtcwatctttattattacactaagtttt

SEQ ID NO: 11505 - DNA, 50 bp, homo sapien
catcttcccaacttagcctcagtacwccatgtctataatgctacttgtca

SEQ ID NO: 11506 - DNA, 50 bp, homo sapien
gcaaaaacctgagtctcctggattcycgcatattttcacttcaccatcac

SEQ ID NO: 11507 - DNA, 50 bp, homo sapien
attccttgtttatttatgttaaagartcaggatacatctatataaactgt

SEQ ID NO: 11508 - DNA, 50 bp, homo sapien
attctgtggctctgtgaattttcaaygtatgtctaaaaagcctatgaagc

SEQ ID NO: 11509 - DNA, 50 bp, homo sapien
cgaaagaggtccaatagtactcaccrcgtgacaatctacatgcctttcct

SEQ ID NO: 11510 - DNA, 50 bp, homo sapien
aaaagatgaagcttacatgaccttcyaaaattgaatatgacagtatcctc

SEQ ID NO: 11511 - DNA, 50 bp, homo sapien
tgattacacctactaattacactcayggtttgggatttggaagctaatta

SEQ ID NO: 11512 - DNA, 50 bp, homo sapien
ttctttattggtgttggactagtgcygaaaggttggctataataggaagt

SEQ ID NO: 11513 - DNA, 50 bp, homo sapien
aaggatttagcaacattttaattcamcattatacaggtatcagagttaat

SEQ ID NO: 11514 - DNA, 50 bp, homo sapien
tgaacttctaattctgtgggtacaayatacttactatgcactggttcatt

SEQ ID NO: 11515 - DNA, 50 bp, homo sapien
ccgctgtatcaagaagaaaagatacrcaaggcaggatttgtatgggacat

SEQ ID NO: 11516 - DNA, 50 bp, homo sapien
gcgtatcttttcttcttgatacagcrgagtatttttatactttactattc

SEQ ID NO: 11517 - DNA, 50 bp, homo sapien
ttaaaaaatgtactctctctttaaayaatagtcattcataaagttatcag

SEQ ID NO: 11518 - DNA, 50 bp, homo sapien
attatctttatcatttgttctcttckattaaggatgttatctgcaaacct

SEQ ID NO: 11519 - DNA, 50 bp, homo sapien
atataatatctacttgttttcttgarcattgccatcaccaaactagtact

SEQ ID NO: 11520 - DNA, 50 bp, homo sapien
attataattatttaaggatacataakggcctgttaactatagttgcttct

SEQ ID NO: 11521 - DNA, 50 bp, homo sapien
atataaaattttgttcctgagtaaakttatagactctattcttatatcct

SEQ ID NO: 11522 - DNA, 50 bp, homo sapien
agtggtgaagggatgatgccgtacargtagataatgataatgagaacact

SEQ ID NO: 11523 - DNA, 50 bp, homo sapien
tgaaagtatgatgttgataacagtcraagtcttagtgatgtagtatgaat

SEQ ID NO: 11524 - DNA, 50 bp, homo sapien
ttgcacctgtcagtttggtgtttaartattagctcacacacttcttggta

SEQ ID NO: 11525 - DNA, 50 bp, homo sapien
tcacatatattatcagggaatgggckaactttatccaactggaagagatg

SEQ ID NO: 11526 - DNA, 50 bp, homo sapien
gtttgaactgccttaatctagtctayaaaatgcttgctttgagctgtact

SEQ ID NO: 11527 - DNA, 50 bp, homo sapien
actattaaaatctttctttgtgcatraaaagccataagatacatcagaaa

SEQ ID NO: 11528 - DNA, 50 bp, homo sapien
atttcacagtcaatgctaaataagcsgatgttttattgttctgtttttct

SEQ ID NO: 11529 - DNA, 50 bp, homo sapien
cacatgatcttttattttttaactaytactcgtgttacccaaggtttgat

SEQ ID NO: 11530 - DNA, 50 bp, homo sapien
tgctcatatagaaactcacaagaagrcgtatttgttagcccagcacacca

SEQ ID NO: 11531 - DNA, 50 bp, homo sapien
tcaattttcttgttagcttacaaaaragaaagagaaggagtgtgaccaaa

SEQ ID NO: 11532 - DNA, 50 bp, homo sapien
tcactgcttcttagggcaatttcagrcataaaaaaaaaaatccattttca

SEQ ID NO: 11533 - DNA, 50 bp, homo sapien
gtactatctttgtgttcttcctgaartctattatcaagtaaacaaaatgg

SEQ ID NO: 11534 - DNA, 50 bp, homo sapien
cccttaactacatcaattttatatcrctcccttcacttctaatttatttt

SEQ ID NO: 11535 - DNA, 50 bp, homo sapien
ggtgctgagaaactcatgttctaccrcctgtaatttatttgaaatacttc

SEQ ID NO: 11536 - DNA, 50 bp, homo sapien
accaaataataggtatgatcaaggasaggttatatggttggcgccatttt

SEQ ID NO: 11537 - DNA, 50 bp, homo sapien
tcataataagctgttaaggctacaasaagggataaagaaaagggtggggg

SEQ ID NO: 11538 - DNA, 50 bp, homo sapien
taaaggttgtcattcataatgaagcratataaagcatagaaaatgcttag

SEQ ID NO: 11539 - DNA, 50 bp, homo sapien
tcaattcaaccttctaaccaactacrggaatgaatatctccattctgcaa

SEQ ID NO: 11540 - DNA, 50 bp, homo sapien
aatggagttctccaaatgtgtctgarctaaatgttttaatgtgtcacttt

SEQ ID NO: 11541 - DNA, 50 bp, homo sapien
gagggtgaaactatttgagcaaaaartacatattatagattagtgggcat

SEQ ID NO: 11542 - DNA, 50 bp, homo sapien
taagcttgattttgctagcagattawattttggtaaacagaaaaggtaag

SEQ ID NO: 11543 - DNA, 50 bp, homo sapien
tagtaaaaaaattaccctggataaamgtttgagaaactgtatgttgaaaa

SEQ ID NO: 11544 - DNA, 50 bp, homo sapien
aaacttcattctgtttttccatccartcagatcaataatcaatctagtta

SEQ ID NO: 11545 - DNA, 50 bp, homo sapien
caggcctcacaccaaattgataatayactatgcttgcagcaaaaaaatgg

SEQ ID NO: 11546 - DNA, 50 bp, homo sapien
ccatctataatcatgaaactaaaaaytcattaatgtgcttattgtttgat

SEQ ID NO: 11547 - DNA, 50 bp, homo sapien
tgaagtcattagaatgaattgtactwaatgatactcagatcaccttttaa

SEQ ID NO: 11548 - DNA, 50 bp, homo sapien
tgacaggtcattgacagatatgaaasaagaagaagaagtttgttgggatt

SEQ ID NO: 11549 - DNA, 50 bp, homo sapien
accatcagagagcaagaaatccaaasagttggttaattttcctaaactcc

SEQ ID NO: 11550 - DNA, 50 bp, homo sapien
ttttaaagatgaatgaaaatcaatargctgatattaataaaggttttcat

SEQ ID NO: 11551 - DNA, 50 bp, homo sapien
ggggaattttactcaaatgttattckaagttacagaactaccagttaggt

SEQ ID NO: 11552 - DNA, 50 bp, homo sapien
cctatgaacccttctcaatcaaatarcacctctgtgacataaagataaac

SEQ ID NO: 11553 - DNA, 50 bp, homo sapien
tgcatgaatgtgacacagttaattaratgtcctaatagaaacttcattaa

SEQ ID NO: 11554 - DNA, 50 bp, homo sapien
tatggttgttggaccgcattagaaaytagtctggttcaagcacttattta

SEQ ID NO: 11555 - DNA, 50 bp, homo sapien
tagtattttttattacaaaatattasagacagttaaacgaggtggaaagc

SEQ ID NO: 11556 - DNA, 50 bp, homo sapien
ttttgtaaattgggtgttggaatcaygaaataatgagtaatttttggagg

SEQ ID NO: 11557 - DNA, 50 bp, homo sapien
ccccatatgctttaaaaacctaccargaaagagcaagaagtttgcattag

SEQ ID NO: 11558 - DNA, 50 bp, homo sapien
tgagccaaaagcagtggcaaactgartatcttttgatttgtagtagaatt

SEQ ID NO: 11559 - DNA, 50 bp, homo sapien
aggcaaataaaggcattgaccttagractgagaagaataaaaactagact

SEQ ID NO: 11560 - DNA, 50 bp, homo sapien
tgtactatttgcattttattgtctgrataccaaacttatgcctggcttta

SEQ ID NO: 11561 - DNA, 50 bp, homo sapien
caacctcctttttctcttcttgtcarcagctaagaactgacctttttctc

SEQ ID NO: 11562 - DNA, 50 bp, homo sapien
ttcatcgtattgacattgagcatatyacttaaaatttctgttcctgtttc

SEQ ID NO: 11563 - DNA, 50 bp, homo sapien
tgtgttttattataattatatgtgcyaaatatgtttgagttattatagat

SEQ ID NO: 11564 - DNA, 50 bp, homo sapien
aggagagagataccattgatgtagaraaaactataagcaaatttatataa

SEQ ID NO: 11565 - DNA, 50 bp, homo sapien
ataatcatttactcttgctctagatraccataattcctttccattgccga

SEQ ID NO: 11566 - DNA, 50 bp, homo sapien
gggatattgttcaaggagtgccttaracataggtacatttattgtacata

SEQ ID NO: 11567 - DNA, 50 bp, homo sapien
ctttttaacaagtgagttagacccartagaaatgaagaaaacaaaaagga

SEQ ID NO: 11568 - DNA, 50 bp, homo sapien
atttcagcagtgcgattcaatcttamaagaattctggttgggcaagcagg

SEQ ID NO: 11569 - DNA, 50 bp, homo sapien
ttagaataaattcagcgtaaagtatmagagacattcttttcactgggaac

SEQ ID NO: 11570 - DNA, 50 bp, homo sapien
aatactttgttagacttaatctttcmcgcaggtctaaaataacactaata

SEQ ID NO: 11571 - DNA, 50 bp, homo sapien
tcaataataaccaaatcatagagaasagtttggtaatatataaagcaacc

SEQ ID NO: 11572 - DNA, 50 bp, homo sapien
tcttgttatcatcctttaccacctaygtgacttctggctatgtgtactgg

SEQ ID NO: 11573 - DNA, 50 bp, homo sapien
gctgaagagattctaatattaccccyggatcacactaagatctcccaaaa

SEQ ID NO: 11574 - DNA, 50 bp, homo sapien
ttacatagtggttttattttattccyacagctgtacttctagtgtactta

SEQ ID NO: 11575 - DNA, 50 bp, homo sapien
ccaccgccatgggaaggtgaattacyaaaaaagcatggctttcctcagga

SEQ ID NO: 11576 - DNA, 50 bp, homo sapien
ccaacacatagatgaggacatgtaaygattgaaagaagtgatcatagagg

SEQ ID NO: 11577 - DNA, 50 bp, homo sapien
cggtggggtggtggtgaccttattcrcattttttgtttgtttgttttgtt

SEQ ID NO: 11578 - DNA, 50 bp, homo sapien
tcacatttgtcatggccctttcaaaygggagtccacaataaatcaatgaa

SEQ ID NO: 11579 - DNA, 50 bp, homo sapien
atccagtctcagtagtaaaattacawcaggtgaggcctgaagtttcctga

SEQ ID NO: 11580 - DNA, 50 bp, homo sapien
acttcttgctaccaccttttccctaytacactctattttcaacacagcag

SEQ ID NO: 11581 - DNA, 50 bp, homo sapien
atataattcaaagaaacataagaatwagtatggccctgttgccattgtaa

SEQ ID NO: 11582 - DNA, 50 bp, homo sapien
agtatagcagctttttaattattaaygaagcctgtcagatctttgaagaa

SEQ ID NO: 11583 - DNA, 50 bp, homo sapien
cacaatgattttataagaatattgartataagatgcttagcaaactgcta

SEQ ID NO: 11584 - DNA, 50 bp, homo sapien
gaagaatagctctctttgtattctcrgaccataattatcttaggagcagg

SEQ ID NO: 11585 - DNA, 50 bp, homo sapien
ctatttcagccatctatcaatgcaasaggacagagaaattatagtggtct

SEQ ID NO: 11586 - DNA, 50 bp, homo sapien
ccaatttattctgagccctggcgtastaagcaatgtcccgaggtgctgcc

SEQ ID NO: 11587 - DNA, 50 bp, homo sapien
tatactattcttaattgctccaaaasgtgattgttaaaaataataatagt

SEQ ID NO: 11588 - DNA, 50 bp, homo sapien
tccaggcaatgcattagaaaactaawagagatgctacacctaagcaaatt

SEQ ID NO: 11589 - DNA, 50 bp, homo sapien
gatgaaaatatagctcatcctgtgamaaagatatggatttaaggttgttt

SEQ ID NO: 11590 - DNA, 50 bp, homo sapien
agattcttccactcataagctactaraagtacataaagaaggtctggttg

SEQ ID NO: 11591 - DNA, 50 bp, homo sapien
ttatagggtttctgcagagaaatacrctgttaggctgatgggcttgcttt

SEQ ID NO: 11592 - DNA, 50 bp, homo sapien
agtggaaacacctatttctaattccrcaaaggagcctttacctagtagta

SEQ ID NO: 11593 - DNA, 50 bp, homo sapien
cctccagtgagctattcaagataatsatgcccccaacaccagctgagctt

SEQ ID NO: 11594 - DNA, 50 bp, homo sapien
acagaagtcttgatagtaactcagarattcttagcctgtcagtcatttct

SEQ ID NO: 11595 - DNA, 50 bp, homo sapien
ttttcatttggtattttgtaactaastagctgtagcacataagggtaaaa

SEQ ID NO: 11596 - DNA, 32 bp, homo sapien
gacctaacatctacaargaagtccatccatga

SEQ ID NO: 11597 - DNA, 50 bp, homo sapien
caagatgctgttgtagtacttctaakagcttgaaataggaacactggaga

SEQ ID NO: 11598 - DNA, 50 bp, homo sapien
aataactgaattttgccaataaccayatgcgttctgaagcagatttctcc

SEQ ID NO: 11599 - DNA, 50 bp, homo sapien
tctgacacatagtggtccctttatayatgtttgtgactaaatgaatgagt

SEQ ID NO: 11600 - DNA, 50 bp, homo sapien
gggagccggggtgccatgacgctaayaggctgcagaagagttgccccctc

SEQ ID NO: 11601 - DNA, 50 bp, homo sapien
tctggcctctcatgttctatcgacargtaataagtgtcctaattcaaggc

SEQ ID NO: 11602 - DNA, 50 bp, homo sapien
gcttatgggctccaacttgagtcgtwacagcagatagaaaaggcaagtgt

SEQ ID NO: 11603 - DNA, 50 bp, homo sapien
acaaactgaaaatactgccctctaawtatgctaagactgatttacctaat

SEQ ID NO: 11604 - DNA, 50 bp, homo sapien
tgagtaataactaaaacttattgaaygtgtattatttgccaggcagtatt

SEQ ID NO: 11605 - DNA, 50 bp, homo sapien
aactaagtttatagacagtgtcagaygtgtattaattaaatctaaacaag

SEQ ID NO: 11606 - DNA, 50 bp, homo sapien
gatgtgaggaaagacaaagacaggargactttcagaggacaacacagacg

SEQ ID NO: 11607 - DNA, 50 bp, homo sapien
aaccaacactctggttatgggactcratgaatcgtctgtgttgtcctctg

SEQ ID NO: 11608 - DNA, 50 bp, homo sapien
ctttgtaactttcctcatgctcttasacttctaatctttttaacctcgaa

SEQ ID NO: 11609 - DNA, 50 bp, homo sapien
taaaagtggggtgaccatattgggayaattctgatttccaccattgcttc

SEQ ID NO: 11610 - DNA, 50 bp, homo sapien
ttgtctctgtcttgatgggcttaacrgtaattcttcagggaagagcacct

SEQ ID NO: 11611 - DNA, 50 bp, homo sapien
ataagtagaccagatttcaggagaargtttatacgtaagatagagcccag

SEQ ID NO: 11612 - DNA, 50 bp, homo sapien
aaacaccatccacctaatagtctcaraggcatgattaacaaaaagactat

SEQ ID NO: 11613 - DNA, 50 bp, homo sapien
ttatgcaaatttgcaccagttcccayagtgaatgccaaaaaaaggtgaca

SEQ ID NO: 11614 - DNA, 50 bp, homo sapien
tcctttatactctaacatttcatcargccaggagattaaatataatcaaa

SEQ ID NO: 11615 - DNA, 50 bp, homo sapien
gaagatagaaattcaaaatttatcarcatgcattatatttagagccacag

SEQ ID NO: 11616 - DNA, 50 bp, homo sapien
gagtgaaactatgatatccatcaaayttctcagacaatactatccacaaa

SEQ ID NO: 11617 - DNA, 50 bp, homo sapien
cccctgatgagtttttcaatcacaawcttaggaatccatgactttttact

SEQ ID NO: 11618 - DNA, 50 bp, homo sapien
gcccttttgccacaacctgttgtccraagattctcactcaaattatggtc

SEQ ID NO: 11619 - DNA, 50 bp, homo sapien
atttactcaaaatcccattctcaatmaagcaaataataataaaatagaac

SEQ ID NO: 11620 - DNA, 50 bp, homo sapien
caaatcctagttctagtgcatgatayaagtttgaattctaggttcaaagt

SEQ ID NO: 11621 - DNA, 50 bp, homo sapien
tatcctaagccggatatgtaatatgkatttaacaattgtctttcagttca

SEQ ID NO: 11622 - DNA, 50 bp, homo sapien
gataacttaaggcatccagaaagtarcacatttatggaaaatggcaacat

SEQ ID NO: 11623 - DNA, 50 bp, homo sapien
atcagaatctaacaaccacaaaacayatactttcacaggtagggtccaga

SEQ ID NO: 11624 - DNA, 50 bp, homo sapien
atataacgagattctagccttatgayataacgagataactaacatctagc

SEQ ID NO: 11625 - DNA, 50 bp, homo sapien
agaatctcaatacctgtgggagcaaktaagtataagctaaatacaataga

SEQ ID NO: 11626 - DNA, 50 bp, homo sapien
tttggtgcctttatgcttacagtaaygttcggttggtaaactttttctgt

SEQ ID NO: 11627 - DNA, 50 bp, homo sapien
attttttttttaaagaatctcttatyactcttctctctatgtgtgtgtgt

SEQ ID NO: 11628 - DNA, 50 bp, homo sapien
tttacagttggccttttatttcccaygtcacaaggtctgaaacaaagaga

SEQ ID NO: 11629 - DNA, 50 bp, homo sapien
taaggttgtatagagtcagctattgraagtcaatcctagaaacagacact

SEQ ID NO: 11630 - DNA, 50 bp, homo sapien
gttgatacttcatttggctcttttamccgaaagatttatatgaggacaag

SEQ ID NO: 11631 - DNA, 50 bp, homo sapien
tgacaactttatatgtttattgccamacttcggcctcctttgtttctaga

SEQ ID NO: 11632 - DNA, 50 bp, homo sapien
ttcaatatgacattcaagctctccamaatctaatgcttaaaaacatattt

SEQ ID NO: 11633 - DNA, 50 bp, homo sapien
catgcctctgtatcagtttcagggckatcataaatcaacagtctgtggac

SEQ ID NO: 11634 - DNA, 50 bp, homo sapien
atgctctcaaagactcagataaatcrctaagtccctactgttcattctgt

SEQ ID NO: 11635 - DNA, 50 bp, homo sapien
ttgccttctccctctgtcttatgtargtgactgggccctttgtatggaca

SEQ ID NO: 11636 - DNA, 50 bp, homo sapien
gtgaggatacaaaacaagaaatacasactagaatgttcttgggttttata

SEQ ID NO: 11637 - DNA, 50 bp, homo sapien
taatgctactctattcagtaactcckcgttaaatcacaagtcttgtcaaa

SEQ ID NO: 11638 - DNA, 50 bp, homo sapien
tgcaaattctttgtatattgctttcyagtgatgattttgtcagatgacca

SEQ ID NO: 11639 - DNA, 50 bp, homo sapien
ctagaaagaatgttctcaccttcaaygtgtttattttgcatctaggaaag

SEQ ID NO: 11640 - DNA, 50 bp, homo sapien
atcagtcttttacttatctccattakgtatcagtatttaagaatgataca

SEQ ID NO: 11641 - DNA, 50 bp, homo sapien
tttccccagttaatcgtttttaacaytgtatcattcttaaatactgatac

SEQ ID NO: 11642 - DNA, 50 bp, homo sapien
gagttagaatatagtttattctttamatgtaggagtgtgtgacttaacct

SEQ ID NO: 11643 - DNA, 50 bp, homo sapien
tgagtattaatactcatcatttctayatgctgaaaacatttcaaatcctc

SEQ ID NO: 11644 - DNA, 50 bp, homo sapien
taatattacaataatagaagaacaayaccaataatttaccaagcacataa

SEQ ID NO: 11645 - DNA, 50 bp, homo sapien
taagtctgatattaggactgaattaygatgaatcaggttttaatcaggat

SEQ ID NO: 11646 - DNA, 50 bp, homo sapien
atactatactagtaaatatgctggakgattttattaaaaatgtggctgaa

SEQ ID NO: 11647 - DNA, 50 bp, homo sapien
gcagaaattaggtgataagaaaaccrgataactatagcattcaaaagtaa

SEQ ID NO: 11648 - DNA, 50 bp, homo sapien
tcaagtttgctcacaaagaagacgaygtttgagaaaacatggataaatga

SEQ ID NO: 11649 - DNA, 50 bp, homo sapien
aatcagatagtgtacagtcaacccamataatctgtctatgaaggctgttt

SEQ ID NO: 11650 - DNA, 50 bp, homo sapien
ttctaggaagcagatttatagaaatyatattagcagtttgcaatgtcttt

SEQ ID NO: 11651 - DNA, 50 bp, homo sapien
aaccagaaaaggtaatccatttactragaacaattttacataaattcaga

SEQ ID NO: 11652 - DNA, 50 bp, homo sapien
gttgtacattttgttctctaattaayggagggactagttacaaagcctaa

SEQ ID NO: 11653 - DNA, 50 bp, homo sapien
ttgatacaatttttcaatgagcttargtcctatgacactataagtatatt

SEQ ID NO: 11654 - DNA, 50 bp, homo sapien
ttgtcctgggcataataccatggaaycattcctcccttgtgaggtctctt

SEQ ID NO: 11655 - DNA, 50 bp, homo sapien
tactgattgacatacctaattagaasagtgaaaacatttaaatatggttg

SEQ ID NO: 11656 - DNA, 50 bp, homo sapien
tatccttctgtatgcaaaatgagtcygaatacattttttaatagtctgta

SEQ ID NO: 11657 - DNA, 50 bp, homo sapien
atgagggccaaattcatggtttacaratggctgtactctccttgtatact

SEQ ID NO: 11658 - DNA, 50 bp, homo sapien
catctcattaggcctgactcaataawaactcacactgtttgtctactttt

SEQ ID NO: 11659 - DNA, 50 bp, homo sapien
gtgtgttgaaaaaagaacacgggaasaaaattctgtttaaatttatatga

SEQ ID NO: 11660 - DNA, 50 bp, homo sapien
ttaagagtctatagtctaaagaaacrctgacattttggatacagtaattt

SEQ ID NO: 11661 - DNA, 50 bp, homo sapien
aatctttttcagtgtaaattcaaccyaatcacttcatgtggaaaatattt

SEQ ID NO: 11662 - DNA, 50 bp, homo sapien
aatactgaaaacaagctaatttcccrgatgataatatcttatttttgccc

SEQ ID NO: 11663 - DNA, 50 bp, homo sapien
gactagggaagagctacttctcttamaatttgaggtgcaggaaattgagc

SEQ ID NO: 11664 - DNA, 50 bp, homo sapien
cttctggccatgtgttttgctctgayagtcttggaatgggaatctcagca

SEQ ID NO: 11665 - DNA, 50 bp, homo sapien
aaccctcatcactcactttggaggakaccatgctaccatgtcacagtgta

SEQ ID NO: 11666 - DNA, 50 bp, homo sapien
tagttttttactgctatttaataaaytaccacacgttaaatggcataaaa

SEQ ID NO: 11667 - DNA, 50 bp, homo sapien
accgggctttctgaaccaataagaawacagtgataatattatatactcct

SEQ ID NO: 11668 - DNA, 50 bp, homo sapien
aatactcaattatttccatgtttgamtatattgcttgaaaataatatata

SEQ ID NO: 11669 - DNA, 50 bp, homo sapien
aaatttttcaagaacaattacaaaaygctatcttacattcaaaatagtta

SEQ ID NO: 11670 - DNA, 50 bp, homo sapien
ataaaaaaacccttgacatagtccayattaatgtatacactgcccactga

SEQ ID NO: 11671 - DNA, 50 bp, homo sapien
tcactggatgtataaatgcacacaasgtatcacacaacagatgttctact

SEQ ID NO: 11672 - DNA, 50 bp, homo sapien
tgttttctactcctaatcttaaccaygtgtgatattgaccactttattgc

SEQ ID NO: 11673 - DNA, 50 bp, homo sapien
agtagaaaacatgaactgaaagctckatttattccctagctagtcatcat

SEQ ID NO: 11674 - DNA, 50 bp, homo sapien
gacattgtaattttgtaggggaacayggcctaagaactacaatgcaaaaa

SEQ ID NO: 11675 - DNA, 50 bp, homo sapien
aaatgttttgaatagaattgaatcayaatagtttttaatttagctattaa

SEQ ID NO: 11676 - DNA, 50 bp, homo sapien
agtcatacagcatttcataaatgcamgggactcattaaaaggtctcacat

SEQ ID NO: 11677 - DNA, 50 bp, homo sapien
tcagtgtataaactccaatctcttcrcaaagtgtcatcctgctccacaaa

SEQ ID NO: 11678 - DNA, 50 bp, homo sapien
tacatctttccaaatatgcttcaacmaccaatgctcatttgcaaagccac

SEQ ID NO: 11679 - DNA, 50 bp, homo sapien
gtgtcaattatggcaactaagatgawtatatatgttgaaatataaataaa

SEQ ID NO: 11680 - DNA, 50 bp, homo sapien
gctctttctctgactagtagcaaaastgaaatgagagattaaaagcatga

SEQ ID NO: 11681 - DNA, 50 bp, homo sapien
ctgtgttcgccattcaatcccttgcrcatctatgattccatttttcatat

SEQ ID NO: 11682 - DNA, 50 bp, homo sapien
tctaggactgttgtagcccgtccaaygagaatccctttctgagatttttc

SEQ ID NO: 11683 - DNA, 50 bp, homo sapien
gaatagaatagattctgttgagttaygggtaaagaaattggatcagaggt

SEQ ID NO: 11684 - DNA, 50 bp, homo sapien
ataacaaagaagctctcataatcaawggaaattctataggaaagtagcca

SEQ ID NO: 11685 - DNA, 50 bp, homo sapien
gggtagactggattctaagccaaaaktagtaactcgtaggtttttaacat

SEQ ID NO: 11686 - DNA, 50 bp, homo sapien
tctatgtaaaacttatttttctagascaacactttcttgcttgtcttcca

SEQ ID NO: 11687 - DNA, 50 bp, homo sapien
tgtatgagaacacgtatccactaaaygagggcttcagtaaaaacgatttg

SEQ ID NO: 11688 - DNA, 50 bp, homo sapien
ctgaatgtttctgttttctattgaayggtctgaaaaccagtaaacccttt

SEQ ID NO: 11689 - DNA, 50 bp, homo sapien
tttggtgtcctctcagtctttcaaawcttaatctactggatcttgtgatt

SEQ ID NO: 11690 - DNA, 50 bp, homo sapien
atgtttttgactcatatgtatgaaaygtataaatccctttcaaataatcc

SEQ ID NO: 11691 - DNA, 50 bp, homo sapien
aggggagggacactgcctttcctcamtaacagtccattataaaaatttca

SEQ ID NO: 11692 - DNA, 50 bp, homo sapien
ataaaagtgcataggaagccacatarctgacgagtagagggtaatagaag

SEQ ID NO: 11693 - DNA, 50 bp, homo sapien
tagttttattcctcctatttctgcarctagaaaaatcacttagccctctt

SEQ ID NO: 11694 - DNA, 50 bp, homo sapien
tgtttattggtactagtatctatcakagaggtgggattactttgatgcct

SEQ ID NO: 11695 - DNA, 50 bp, homo sapien
gaatggactatgagtaatgatcagaytaggataaaatgacattaatatat

SEQ ID NO: 11696 - DNA, 50 bp, homo sapien
gccaaaagctcacaattttatctgayggaggacaaattattttttgtaaa

SEQ ID NO: 11697 - DNA, 50 bp, homo sapien
tttcttggagggtttctgtgctttargatgtctgttagagtatgtgtttc

SEQ ID NO: 11698 - DNA, 50 bp, homo sapien
tgcctagcaaattcccatggtctccrgctctgaaaggatatctttgttaa

SEQ ID NO: 11699 - DNA, 50 bp, homo sapien
atatataagagcccaagtaatccaartaacagtaagtctggtaccagcct

SEQ ID NO: 11700 - DNA, 50 bp, homo sapien
ttgggaatggtccagtccggcgataygcttgtcgcttgtatttatacata

SEQ ID NO: 11701 - DNA, 50 bp, homo sapien
ttaatttcctggtatacagatcaggkaataatataatctcagtgttgaaa

SEQ ID NO: 11702 - DNA, 50 bp, homo sapien
atattccaaccaatcaaaacggatgycagtcatgaaaaattcaattgggt

SEQ ID NO: 11703 - DNA, 50 bp, homo sapien
cctgttcagtaagtgttggcaactaygaattaatctttgacaaattcact

SEQ ID NO: 11704 - DNA, 50 bp, homo sapien
ggcaaggtcatcttactgtttgcaaygatacatggttctgtacactaggc

SEQ ID NO: 11705 - DNA, 50 bp, homo sapien
gaaaaaagtgtcctttagagatttasagatattgataagcaattagaaga

SEQ ID NO: 11706 - DNA, 50 bp, homo sapien
atttttgtactctatcatctgatcaygctttacatacgttcataagtctc

SEQ ID NO: 11707 - DNA, 50 bp, homo sapien
ataaaactaatttaaaaaccaattawaatatctgaggaaacagattacta

SEQ ID NO: 11708 - DNA, 50 bp, homo sapien
tctcaaaataaattggcttagcatartatcatcttcaatgaaaattattt

SEQ ID NO: 11709 - DNA, 50 bp, homo sapien
tgcatctaaacaagttgtctaaaatkatacatcttctctttatttacgca

SEQ ID NO: 11710 - DNA, 50 bp, homo sapien
tgactgataagataggatcacgtggwacaaatggaggattcattctctct

SEQ ID NO: 11711 - DNA, 50 bp, homo sapien
cactttgtgttttcctagatctagayactatgttcagtaaaaatacaaat

SEQ ID NO: 11712 - DNA, 50 bp, homo sapien
gaactaaatccaaattacataaatcrcaataaacaatcaaataagcctat

SEQ ID NO: 11713 - DNA, 50 bp, homo sapien
aatttccccaaactcaaagagataamagtaaacagtgaagaagcaggtca

SEQ ID NO: 11714 - DNA, 50 bp, homo sapien
aacagaccctttcttcaggaaatcartacaatttagcagtactcagccaa

SEQ ID NO: 11715 - DNA, 50 bp, homo sapien
ctattgattaatggattactgttcasaggcaatttaataatataaagcaa

SEQ ID NO: 11716 - DNA, 50 bp, homo sapien
taattaatgagaataaaatttctacragggcagatctttctgcagcacaa

SEQ ID NO: 11717 - DNA, 50 bp, homo sapien
taaaaattatagtatattcataaaaygcaatgcaataatacattcagtaa

SEQ ID NO: 11718 - DNA, 50 bp, homo sapien
tgtactgtgcattcatgtgtcaaaaytcatcttaatatacacttaagagc

SEQ ID NO: 11719 - DNA, 50 bp, homo sapien
tattaaatcatgttcattttatagcygaggaacgtgagcttttagtaggt

SEQ ID NO: 11720 - DNA, 50 bp, homo sapien
ataaacacattaagaatttgagcaasgaattaaaatctatttttaaacag

SEQ ID NO: 11721 - DNA, 50 bp, homo sapien
cgtgatacttacatatgcaactgaayctcatcatagctaatataacagcc

SEQ ID NO: 11722 - DNA, 50 bp, homo sapien
aagtacagcttcttccctgtaagtasgtgctaggtgtggaaagagtttca

SEQ ID NO: 11723 - DNA, 50 bp, homo sapien
aaagtggtaacttgactagtccctcyatcaaagcctaaaagctttgattt

SEQ ID NO: 11724 - DNA, 50 bp, homo sapien
agatttatagttcatcttatgtgccrattttaactgatttgttattagaa

SEQ ID NO: 11725 - DNA, 50 bp, homo sapien
acaaccaaagatccctaactaataamagctcataaaaatgattaaatatt

SEQ ID NO: 11726 - DNA, 50 bp, homo sapien
aggaaagcttgaaatggcctcctaaytgttttccttctttctcttgttgc

SEQ ID NO: 11727 - DNA, 50 bp, homo sapien
tcagctggaatctgcttaagcctacygagctcacgtggggagtgtcaacc

SEQ ID NO: 11728 - DNA, 50 bp, homo sapien
tccatcagagacagctggagatagcrgaaatgttcaaaagtgactactta

SEQ ID NO: 11729 - DNA, 50 bp, homo sapien
aggccacaggggcatgggctcacaawtgggatttgatctgtggtttgcac

SEQ ID NO: 11730 - DNA, 50 bp, homo sapien
cctgataaaaacactgaaatctacaytctaccactggtggtagggcagtg

SEQ ID NO: 11731 - DNA, 50 bp, homo sapien
ccagtggaattctcggaaagaggcawatattgttagtcacaaatttaata

SEQ ID NO: 11732 - DNA, 50 bp, homo sapien
aaaccctctaagccttttgccttgargtcatgtaaaagtattttattagc

SEQ ID NO: 11733 - DNA, 50 bp, homo sapien
aagtttttattagaattgcatacaayttataagctaattaggaagtaata

SEQ ID NO: 11734 - DNA, 50 bp, homo sapien
attaaaatgagttggcttgtaataaraaggcaagattcatacaatcaaat

SEQ ID NO: 11735 - DNA, 50 bp, homo sapien
tatgtttctttgctttacatgatatkacacactctgtatttctgaccctg

SEQ ID NO: 11736 - DNA, 50 bp, homo sapien
gattagctgaactctagctattgtaraaaacgtagatttactcaattcat

SEQ ID NO: 11737 - DNA, 50 bp, homo sapien
aaatttaaaattagtctcttttgtartaatttaatgcatgtctttcacgc

SEQ ID NO: 11738 - DNA, 50 bp, homo sapien
gcttggctaacatttctgtagtcaaratactgtgggtttctcaacatgca

SEQ ID NO: 11739 - DNA, 50 bp, homo sapien
ccaccaaactgtgaggagaagcaatyacgtataaacccctaaagcaccta

SEQ ID NO: 11740 - DNA, 50 bp, homo sapien
ccttcaaaaaacaaatccaaattacrggtaggtgctttaggggtttatac

SEQ ID NO: 11741 - DNA, 50 bp, homo sapien
ttccataatctaccaaaacttattawacatctactttgtgtaggttttga

SEQ ID NO: 11742 - DNA, 50 bp, homo sapien
attgtgtctgtaactattcccatcaytgagaaaatagtggagaacaaaac

SEQ ID NO: 11743 - DNA, 50 bp, homo sapien
agtattagttaattaaaggtactaargcattttttcatatacagaaacaa

SEQ ID NO: 11744 - DNA, 50 bp, homo sapien
cccttgcagaaaagctcaaagttggycagagttagtgagcagaagggctg

SEQ ID NO: 11745 - DNA, 50 bp, homo sapien
cagctaaaatggttatttgaaataayggcaacctaaaaaaataaggatat

SEQ ID NO: 11746 - DNA, 50 bp, homo sapien
caagaaaagcagagtagctgtataamcctctataaactgtgctttgaaaa

SEQ ID NO: 11747 - DNA, 50 bp, homo sapien
caaaatctacattagtcaataaatayaaaacagggactgtactgcatatg

SEQ ID NO: 11748 - DNA, 50 bp, homo sapien
actaagaatctaattgggaaccacaragttatatcaatattattcaaaaa

SEQ ID NO: 11749 - DNA, 50 bp, homo sapien
gtaaattagagttaattttcaaatayggaaagaggtataaaaaaataaac

SEQ ID NO: 11750 - DNA, 50 bp, homo sapien
aaagaacacaaactgaataataatamaaaatcctattaaaaagtaggcca

SEQ ID NO: 11751 - DNA, 50 bp, homo sapien
aaagacacacacccacaggctgtagrccactttttcacagaagaattttg

SEQ ID NO: 11752 - DNA, 50 bp, homo sapien
cacagaaatattttaaatacgcttakgaatagaattcttgtattccttgg

SEQ ID NO: 11753 - DNA, 50 bp, homo sapien
atatctgtgacaacactggcaattcsatcagcaacaatcttgggctacag

SEQ ID NO: 11754 - DNA, 50 bp, homo sapien
cctaaataatgatgttctcagaaaaytaacctggccttggtactcatcct

SEQ ID NO: 11755 - DNA, 50 bp, homo sapien
atggcttggtcaaaggaattttgcasgtatttacatctctctaatcagat

SEQ ID NO: 11756 - DNA, 50 bp, homo sapien
tctttctcatctgaaatcttgtactsaatcatccaagtccctctaaagcc

SEQ ID NO: 11757 - DNA, 50 bp, homo sapien
gttctttttttattgtttggccacartgccttttaaatataaacagaaaa

SEQ ID NO: 11758 - DNA, 50 bp, homo sapien
acaaatccatttttaaatttgcatgwaagattcaattggctattaatatc

SEQ ID NO: 11759 - DNA, 50 bp, homo sapien
gttttcaatgctagcactctttttamaacttacatacagtctgtatttca

SEQ ID NO: 11760 - DNA, 50 bp, homo sapien
atgttacaacaatctgctcttgataktaatgttcctgatagattaaaaga

SEQ ID NO: 11761 - DNA, 50 bp, homo sapien
tgctttactttgcattgatttaaagwcttaatgatttgagtatctattaa

SEQ ID NO: 11762 - DNA, 50 bp, homo sapien
gttatcagcctggacatcacagggakactattataatggtctttacaatt

SEQ ID NO: 11763 - DNA, 50 bp, homo sapien
tgcaactggcaaggaatagtcagaaygaaggatgtggttgatggttgagt

SEQ ID NO: 11764 - DNA, 50 bp, homo sapien
tgctttctcatggccaagaagactayggatatcaatttctcatcctaatt

SEQ ID NO: 11765 - DNA, 50 bp, homo sapien
aggtagtaaattatatagttcactaraaggtaatacatgcaatgttttaa

SEQ ID NO: 11766 - DNA, 50 bp, homo sapien
aatacttgcccgcatagagaaatcartcaactctgtggtattcctcagct

SEQ ID NO: 11767 - DNA, 50 bp, homo sapien
ctatgagatagcagacttcatggtastaattaaaatataaactcattgac

SEQ ID NO: 11768 - DNA, 50 bp, homo sapien
ggtaatcctaaggaacacgtttgagragataggagaaatttgacatatag

SEQ ID NO: 11769 - DNA, 50 bp, homo sapien
gagattcctaataacttggagaggarcatattttattacaagtgacaagt

SEQ ID NO: 11770 - DNA, 50 bp, homo sapien
ttgttttgcttaagcacttggctgtyaatatctcccttctccagatccca

SEQ ID NO: 11771 - DNA, 50 bp, homo sapien
ctgtctctgtgtttaaacatacatcrataaaaagttttttttaaaataaa

SEQ ID NO: 11772 - DNA, 50 bp, homo sapien
taaaaagcattaacaaatactgtcartaagagatgcattttaaatataaa

SEQ ID NO: 11773 - DNA, 50 bp, homo sapien
ataccattggctatgaacttaacaartactaaaatatgatcacattggtc

SEQ ID NO: 11774 - DNA, 50 bp, homo sapien
tatgtgaaaacaacatactgtgactraaaaacatagtaaaacaaatttgc

SEQ ID NO: 11775 - DNA, 50 bp, homo sapien
gaacttaccacttttctagtagatgsaagctggctgtttaactgtcctca

SEQ ID NO: 11776 - DNA, 50 bp, homo sapien
attcattcaaatcaaattattagtayctatttagcctctcagccataagg

SEQ ID NO: 11777 - DNA, 50 bp, homo sapien
aagctgttttatctacctaattttaygttgatcagacagatcatttctgc

SEQ ID NO: 11778 - DNA, 50 bp, homo sapien
taaatactggaggattctacctaaamtctagatctggcttcttttgaaaa

SEQ ID NO: 11779 - DNA, 50 bp, homo sapien
gtcatgtcatatttctagttccaagkataacaatttgatcatccacatat

SEQ ID NO: 11780 - DNA, 50 bp, homo sapien
ttcgtagtactcctggcctaggcackccatcttaattaaaaacatgagaa

SEQ ID NO: 11781 - DNA, 50 bp, homo sapien
aagttttgaaaatgcagttttcgtcyctgaatccaaacacccactcatcc

SEQ ID NO: 11782 - DNA, 50 bp, homo sapien
aaaatgttgagactgagagattgcayggtacttacctcaaagtctcaata

SEQ ID NO: 11783 - DNA, 50 bp, homo sapien
ttggaagccatatctgtcttatttcrattcttactctctttttacaatga

SEQ ID NO: 11784 - DNA, 50 bp, homo sapien
gtgtgtcatgggggtttgtcacaagkattatttcatcaccagctattaag

SEQ ID NO: 11785 - DNA, 50 bp, homo sapien
actcgttaaatgatagtaagtaggargagaatgcagagtaataagaaaac

SEQ ID NO: 11786 - DNA, 50 bp, homo sapien
gacatacatatattgttttgaaataygtctttgaaactgtttctccccat

SEQ ID NO: 11787 - DNA, 50 bp, homo sapien
tttgtattaaataaaaaccttagaaraattagatagctctgatattctcc

SEQ ID NO: 11788 - DNA, 50 bp, homo sapien
tctggccaatttctcccatatggaamgacagtatttacccaatacctgta

SEQ ID NO: 11789 - DNA, 50 bp, homo sapien
ccagagcaggtattgcttggttaaayactattcctcttccaagctcagcc

SEQ ID NO: 11790 - DNA, 50 bp, homo sapien
gtggactccacttttatcttttatgkcaataactccaataacagtttttt

SEQ ID NO: 11791 - DNA, 50 bp, homo sapien
tccctagtggaaatctatttcagtckccttacagctccttaaacatacct

SEQ ID NO: 11792 - DNA, 50 bp, homo sapien
acaaatatttttggagaatttcttaygtgttaggtgcagtgcaaggctct

SEQ ID NO: 11793 - DNA, 50 bp, homo sapien
agtttctgaatttaccttggatgtayaaaatcatgtaaggtattgcaaaa

SEQ ID NO: 11794 - DNA, 50 bp, homo sapien
agtaacccctgtgtcatctttagtgycaaatgcaaaagaaagagccatga

SEQ ID NO: 11795 - DNA, 50 bp, homo sapien
tttacagccacttcatgatgtcatayaccctgaacattctagctgcaata

SEQ ID NO: 11796 - DNA, 50 bp, homo sapien
atgtcatccttaaatgtcctcattgkatgtaaaggtaccaagagattcct

SEQ ID NO: 11797 - DNA, 50 bp, homo sapien
tatttgcactagaatatgggcaaatsaatcttctattctcgcagattgtc

SEQ ID NO: 11798 - DNA, 50 bp, homo sapien
gtgtataatatttgcacattacacartccaagagagatatcagagcagta

SEQ ID NO: 11799 - DNA, 50 bp, homo sapien
tcctagcgaaaaatctgtactggaaragtggttattgacaagatcagttt

SEQ ID NO: 11800 - DNA, 50 bp, homo sapien
atctctacggttacattttctcaaamgtaagttccgcttttacagtccaa

SEQ ID NO: 11801 - DNA, 50 bp, homo sapien
ggggcactacttgagagttttgaaayatgtaatttgtcacagcaaggaca

SEQ ID NO: 11802 - DNA, 50 bp, homo sapien
gttcaataccagtccagtcttgaagscttaaaattcttttgatatgaatc

SEQ ID NO: 11803 - DNA, 50 bp, homo sapien
ctatcctttgaaaccaacttcggacyaattattttaatagtgttgataag

SEQ ID NO: 11804 - DNA, 50 bp, homo sapien
attggcctacagagggtgctagttcwcttcaaaaaagtaaaagaagtgca

SEQ ID NO: 11805 - DNA, 50 bp, homo sapien
acagtgattaatttgtaatagtgagsccctagctaggtacggaagttgta

SEQ ID NO: 11806 - DNA, 50 bp, homo sapien
atctgattgtgcctgcagaatggaargtagcttcttaagaaatgctgttc

SEQ ID NO: 11807 - DNA, 50 bp, homo sapien
tctcaagcagcctgaggctgggtcaycagaacacaaatgtacagttacaa

SEQ ID NO: 11808 - DNA, 50 bp, homo sapien
ctagaggcttcagcttagccaaaacrggtgtcagaaaggccacgtgctaa

SEQ ID NO: 11809 - DNA, 50 bp, homo sapien
ttgcatttagtctcttagcggcctcragagcttcattcgcagtgtctgct

SEQ ID NO: 11810 - DNA, 50 bp, homo sapien
gttaaggagaatagttaggtacaagrataccacacaccatcctcaaacgg

SEQ ID NO: 11811 - DNA, 50 bp, homo sapien
taaaagatacaaatctgaacctaccraagacagacagacacatggggtga

SEQ ID NO: 11812 - DNA, 50 bp, homo sapien
aaaaccaaaatttgcttcattgtgayatttaccctctgggcctatgtttg

SEQ ID NO: 11813 - DNA, 50 bp, homo sapien
cttgtgtcagaggctgacctctaaaygaatctgtatccaggtgggaaaca

SEQ ID NO: 11814 - DNA, 50 bp, homo sapien
cagctgctgggaaagaccatttaaarcatttaatatcctccctacctctc

SEQ ID NO: 11815 - DNA, 50 bp, homo sapien
tgagctaggacattgaaagatgagayggatttaaatagtagaaaggaaac

SEQ ID NO: 11816 - DNA, 50 bp, homo sapien
aagtcagtaaatactaaaagtgatayaataacagctcatatttaggatta

SEQ ID NO: 11817 - DNA, 50 bp, homo sapien
atgtgtgtgtgtcctatgtacatcawtatgaagattccaagagaatttat

SEQ ID NO: 11818 - DNA, 50 bp, homo sapien
tggttttctgagttatgcacctgccrcttactttaggcttttattgcttc

SEQ ID NO: 11819 - DNA, 50 bp, homo sapien
cctggcgtagcattactcatcagaaygtttgagtctcaatgacaaaagat

SEQ ID NO: 11820 - DNA, 50 bp, homo sapien
ttgagaacatccaagaaattcagaamgtatttgttgaataaatacattaa

SEQ ID NO: 11821 - DNA, 50 bp, homo sapien
aacgaatccaaatatagacattagartcagaggcctgggttcactggtga

SEQ ID NO: 11822 - DNA, 50 bp, homo sapien
aagaaaatgctaccacttctgaagasctgatatgtaaaatagtcaattaa

SEQ ID NO: 11823 - DNA, 50 bp, homo sapien
ccagggttcttctgccttattctggyattaatgtgaatattttactcaac

SEQ ID NO: 11824 - DNA, 50 bp, homo sapien
tcagcagggactagtaaaagaatagyaaatggatcatgagtagtagtagt

SEQ ID NO: 11825 - DNA, 50 bp, homo sapien
tctttctatccatgcctatcaacacrgctaactatggagctgtttctact

SEQ ID NO: 11826 - DNA, 50 bp, homo sapien
tcagttgtctcctccttctacgtaargtatcccatgcttctactagatcg

SEQ ID NO: 11827 - DNA, 50 bp, homo sapien
tgcctaagaatcaaaacccttctaayaccttgtcctgtccctgcctctcc

SEQ ID NO: 11828 - DNA, 50 bp, homo sapien
ttgcatatcagtttttgtcaaatgcrcaacaggacgttattacagaccat

SEQ ID NO: 11829 - DNA, 50 bp, homo sapien
gaacaaaagctggatacactgaaaastaaactgagaacagaagctgcttc

SEQ ID NO: 11830 - DNA, 50 bp, homo sapien
aattgttatatctgtttggcatgatkaagaggttcgtcttggtgagatga

SEQ ID NO: 11831 - DNA, 50 bp, homo sapien
agccccaagttatcactgaaaagaastgtgatgtaatagaaagaactcga

SEQ ID NO: 11832 - DNA, 50 bp, homo sapien
tgagttgtagaatcagggcataaccmaggcaaagtgccattatggcgtag

SEQ ID NO: 11833 - DNA, 50 bp, homo sapien
gctcagatggcctcattaaaaaggcrgaatttgagaaatggagtgctctc

SEQ ID NO: 11834 - DNA, 50 bp, homo sapien
cacttccatttgcatagatctcaaayatcagagctggaaggatcatggtg

SEQ ID NO: 11835 - DNA, 50 bp, homo sapien
aaaattgttacctaaaagagaattcratggaaatgaaataaaataaaata

SEQ ID NO: 11836 - DNA, 50 bp, homo sapien
aaaggacctagagaaggaataacaaygagacttgacttgactttgaaaat

SEQ ID NO: 11837 - DNA, 50 bp, homo sapien
taggtaatcgtaaatacatattgaaygaaggaatgaaacaaaaatgaaaa

SEQ ID NO: 11838 - DNA, 50 bp, homo sapien
atcattctgcatgtaacatgaacatragcgtggaggtgcagcatccattt

SEQ ID NO: 11839 - DNA, 50 bp, homo sapien
gcaataaattagagctcaattccaaytcataaaaagctgtactccaaaat

SEQ ID NO: 11840 - DNA, 50 bp, homo sapien
ctaaaagagggtctagtggtatttcrctccaatcataaagctaagtgaat

SEQ ID NO: 11841 - DNA, 50 bp, homo sapien
caaatccctggtttatatggataatraggcaaaacaaaatcaacttggag

SEQ ID NO: 11842 - DNA, 50 bp, homo sapien
agctgctgcttgatttgtacagaaaygtgttactcttagaatattctgca

SEQ ID NO: 11843 - DNA, 50 bp, homo sapien
aaaaaatccaccatagttaatcctcraaagtgaaatttttgcatcctata

SEQ ID NO: 11844 - DNA, 50 bp, homo sapien
tggaaataatcatataactgactgtyaagtgcccaagccaagaggcaaaa

SEQ ID NO: 11845 - DNA, 50 bp, homo sapien
acaaatcagttatgactccaaattaygtatgggaagagacttctcacagt

SEQ ID NO: 11846 - DNA, 50 bp, homo sapien
cagtaaggctcccagatggtctctcyacttctgtccttactgccaccaac

SEQ ID NO: 11847 - DNA, 50 bp, homo sapien
ctggcaaagagaaggtacacagtgaragacttacttttttgagatttttt

SEQ ID NO: 11848 - DNA, 50 bp, homo sapien
ctgaacgctgtaggcgatgttgtaayataatagtcagtatttatgtatct

SEQ ID NO: 11849 - DNA, 50 bp, homo sapien
aagatatgggatagtggaatatataratcactgatgtctcaattctgcca

SEQ ID NO: 11850 - DNA, 50 bp, homo sapien
aatgcatgaatgaggaaaaatttcaycttatggtagaggtaacaactcct

SEQ ID NO: 11851 - DNA, 50 bp, homo sapien
attaccttatggactcaaatatgtcrctcttgaagcagatggctctcacc

SEQ ID NO: 11852 - DNA, 50 bp, homo sapien
ggcccaaagatgatttggacaaggaytcatagtgtgatgctactgatctg

SEQ ID NO: 11853 - DNA, 50 bp, homo sapien
aaatgcttggctgcattcacagaccragagagtatagtggagataacatc

SEQ ID NO: 11854 - DNA, 50 bp, homo sapien
tactcttatgtacttttctatcgtakaaattatgttattgaattaatatg

SEQ ID NO: 11855 - DNA, 50 bp, homo sapien
aaataaaagatgaaacatagttcatyagcagttaatcatttgggaaaact

SEQ ID NO: 11856 - DNA, 50 bp, homo sapien
tgttagaggcactgaaatcataaaartaaagctaccacttgtagagaaat

SEQ ID NO: 11857 - DNA, 50 bp, homo sapien
gatgtatgaatgcaatgaactcaaaytgatggaacattggttgttaaaat

SEQ ID NO: 11858 - DNA, 50 bp, homo sapien
ccagccaaagttttacattttttcargttatcatgttaaattcatagact

SEQ ID NO: 11859 - DNA, 50 bp, homo sapien
gggccagagtctgaagagaaagacartgggttgcaaaggtggtgaatgaa

SEQ ID NO: 11860 - DNA, 50 bp, homo sapien
tgggctattgcactattgagtggaayggccgacaatttgagacagaagag

SEQ ID NO: 11861 - DNA, 50 bp, homo sapien
agctcagagaaacagccagatcgaartgtctaattggcttaaagtataag

SEQ ID NO: 11862 - DNA, 50 bp, homo sapien
agtccatacactgtaataaggaatayatgcagtttacaatttggactatt

SEQ ID NO: 11863 - DNA, 50 bp, homo sapien
cttacacataaacaaaagatattcartagcccggcttttaggtcacagtt

SEQ ID NO: 11864 - DNA, 50 bp, homo sapien
agaagtataataagtattgtgttacrgagtgtggaggggagcacatcaga

SEQ ID NO: 11865 - DNA, 50 bp, homo sapien
acttggatggtacttaatgcaccaartaggaaaattatgaaaataaccaa

SEQ ID NO: 11866 - DNA, 50 bp, homo sapien
ccagtttctagccacttaaaccgtgyaaatggacgtgtgatcattttccc

SEQ ID NO: 11867 - DNA, 50 bp, homo sapien
cttccctttgatgcaataatctgacyctaagaactagttccttgaatgta

SEQ ID NO: 11868 - DNA, 50 bp, homo sapien
ccacattagtattagattttaataayggacaacatggcaggaagaaagtt

SEQ ID NO: 11869 - DNA, 50 bp, homo sapien
agccaccacacccagcatcattaaargaccttaaacagacaagtgacatg

SEQ ID NO: 11870 - DNA, 50 bp, homo sapien
tgcctatctgtagttgtcctgaaaarcagatgggaaggtgggcatttgaa

SEQ ID NO: 11871 - DNA, 50 bp, homo sapien
cagatgccacgttgtggggaaacccragcagctatgtggagaggccttca

SEQ ID NO: 11872 - DNA, 50 bp, homo sapien
tttttcttcaaatgttcttatggtgrattgaaaatggctgtgtattcttt

SEQ ID NO: 11873 - DNA, 50 bp, homo sapien
aactggatgtgctgataaatgttggratctactgcaggctcagaaaaaga

SEQ ID NO: 11874 - DNA, 50 bp, homo sapien
aaaaagaatgcaatgaattggcctcwctcctgaagtttgtcagggccagc

SEQ ID NO: 11875 - DNA, 50 bp, homo sapien
agagggtaaaatttcaacaaaaataygtaacaaaactgattcttaacaga

SEQ ID NO: 11876 - DNA, 50 bp, homo sapien
gtttgaggaagtattggtgaaaatargacagaccattgtaaaggccagtt

SEQ ID NO: 11877 - DNA, 50 bp, homo sapien
taagtaacacaaataagagttaaacragagtatgaaatgagttattgtgt

SEQ ID NO: 11878 - DNA, 50 bp, homo sapien
tctaaagcataagccaatgtagaacrgaggtttaaggaagaggaaaagct

SEQ ID NO: 11879 - DNA, 50 bp, homo sapien
ttctctttttttcctcagaaagcacragattcctagatgtttatctgttt

SEQ ID NO: 11880 - DNA, 50 bp, homo sapien
acagatgatgacattttctaggcccrattcagatgatgcagagcttcctt

SEQ ID NO: 11881 - DNA, 50 bp, homo sapien
gaaacagaagcttattctgcaattayagaggaagtaaaaagcaaaagaaa

SEQ ID NO: 11882 - DNA, 50 bp, homo sapien
agacttatctccatttatgatgccaytatcattcgtctgatcactccatt

SEQ ID NO: 11883 - DNA, 50 bp, homo sapien
ttaaaccctgcaatttggaataaggwcctgaaaagggtgaagggagtgct

SEQ ID NO: 11884 - DNA, 50 bp, homo sapien
ttgcgactatcacatctttgctccayactgtgaacagagagatttttcta

SEQ ID NO: 11885 - DNA, 50 bp, homo sapien
tttttaaaatactgttcttttatcayagtcacctgagaactgctttagac

SEQ ID NO: 11886 - DNA, 50 bp, homo sapien
aaaaataatgcattaaagagcttacsgaagtgcaggtcatacaatcagca

SEQ ID NO: 11887 - DNA, 50 bp, homo sapien
ggtatgaagagccatcgggagactcraatcctatagtgctagagaagtat

SEQ ID NO: 11888 - DNA, 50 bp, homo sapien
catatactatctcgtagggattagaytccatgtttatcacacactctaca

SEQ ID NO: 11889 - DNA, 50 bp, homo sapien
gctttccagcttacagaatgctttcycattattatttcattgaattcttc

SEQ ID NO: 11890 - DNA, 50 bp, homo sapien
ctacagatgtgaaaactatgtcccaragagctgaagtaaaacacatgaag

SEQ ID NO: 11891 - DNA, 50 bp, homo sapien
caagaagaaattaagcgaaactcagraagttcttaaatatgtcgaaggag

SEQ ID NO: 11892 - DNA, 50 bp, homo sapien
ggaaggtcacaacacagaggatacaraataaggatttgaagccatgtccg

SEQ ID NO: 11893 - DNA, 50 bp, homo sapien
gggttgaaaagtgtgcatacatagckaacatccaagacagaaagtggtaa

SEQ ID NO: 11894 - DNA, 50 bp, homo sapien
ctcaatcttaagggagatcttatgayataatatgcatgacagcatgcatg

SEQ ID NO: 11895 - DNA, 50 bp, homo sapien
cagatctcaatgccagggccgctaaygagtggagggtaaggaaggtcaca

SEQ ID NO: 11896 - DNA, 50 bp, homo sapien
tgccgacggcaatatctgataaaagsctgtcattaaaagtgtatctgtgc

SEQ ID NO: 11897 - DNA, 50 bp, homo sapien
gcatctgaactaggcctttgagagcrgatagtatttgaatatcaggggta

SEQ ID NO: 11898 - DNA, 50 bp, homo sapien
actttgctacacgtctgagaacacgragtttattttgtatccatagaaaa

SEQ ID NO: 11899 - DNA, 50 bp, homo sapien
tagactgttgactggcctacagcaartactcaaaaaatgtaggagaatga

SEQ ID NO: 11900 - DNA, 50 bp, homo sapien
atggttccaggcaaagacacagccastaatttacacaatatagtactttc

SEQ ID NO: 11901 - DNA, 50 bp, homo sapien
ttgacaccctcaaaatttgcctctakcgatcttttggaatgcatttccct

SEQ ID NO: 11902 - DNA, 50 bp, homo sapien
gataggggaagattctgagatacacmgaggtctagtaattttccatacag

SEQ ID NO: 11903 - DNA, 50 bp, homo sapien
aaaaagaaaactttcatgtgggtaaygatactcctgacatcttgggcata

SEQ ID NO: 11904 - DNA, 50 bp, homo sapien
taaccaggcagtttcaattttcacayctactgaatacagatcagttgtga

SEQ ID NO: 11905 - DNA, 50 bp, homo sapien
caataatatttattttgtatgcccaygcgctaaaaccccttcctattttt

SEQ ID NO: 11906 - DNA, 50 bp, homo sapien
ttgtctactttggatatctgtgacaytcattgacagtatttttagttgct

SEQ ID NO: 11907 - DNA, 50 bp, homo sapien
ctttgtccatgaaaaattgttgataygttcaagctcacagtgttctgttt

SEQ ID NO: 11908 - DNA, 50 bp, homo sapien
aattggagttcattcaccaggttggrcaatgaaacaccagctcttgctct

SEQ ID NO: 11909 - DNA, 50 bp, homo sapien
ggtggtattcaggaatttgctgaaarttatctctggagacttggagacac

SEQ ID NO: 11910 - DNA, 50 bp, homo sapien
aaatatttgcttcactattatgctgyattgaatattaggtctatgaatat

SEQ ID NO: 11911 - DNA, 50 bp, homo sapien
ggagtccaggtcttccctaacattcsatgaccaacagaggtgttctagaa

SEQ ID NO: 11912 - DNA, 50 bp, homo sapien
cttgtttaaaatgattctgattctasatggtccttctatcttgggagaac

SEQ ID NO: 11913 - DNA, 50 bp, homo sapien
cactcctattgtttactgttttgctwaattggctatatttcaataatatt

SEQ ID NO: 11914 - DNA, 50 bp, homo sapien
ctgacaatgttatgcttttgagatartacacgtgcatttaaaaaataaag

SEQ ID NO: 11915 - DNA, 50 bp, homo sapien
ttagccttgattaggtgagtattacmctgtatttccttatcagaaggcct

SEQ ID NO: 11916 - DNA, 50 bp, homo sapien
aggaactgatgtgtttattcctacayggtctgtttatgaactaaatgaga

SEQ ID NO: 11917 - DNA, 50 bp, homo sapien
ctggaaggcactctcttcaggattcyatagtgtctaccatgttgctaagc

SEQ ID NO: 11918 - DNA, 50 bp, homo sapien
agagtaaggacaatttaaggctcctraaagaggattcaaccagtcactcc

SEQ ID NO: 11919 - DNA, 50 bp, homo sapien
tacttgggaggctgaggcatgggatyactttaaacctagaggtggaggct

SEQ ID NO: 11920 - DNA, 50 bp, homo sapien
attcttttgtgtgagatactcaaccsacgtcaaaacagcttcaggctgta

SEQ ID NO: 11921 - DNA, 50 bp, homo sapien
aaaaggaagagtcaattcagtgagtsacataaaatattgcatataggtgt

SEQ ID NO: 11922 - DNA, 50 bp, homo sapien
aactagggaggatgtggttagtgaayggaatgaaagtggtccaatccgtc

SEQ ID NO: 11923 - DNA, 50 bp, homo sapien
tttttgacttgctgtatagttctccratttgtgaaatcatcaaattaagt

SEQ ID NO: 11924 - DNA, 50 bp, homo sapien
ttattttcaaccttagaaaacttcartacatctttcaaaatccagctaaa

SEQ ID NO: 11925 - DNA, 50 bp, homo sapien
ttttttaaccaatttttcttcactayagatacacacatttatctcaacta

SEQ ID NO: 11926 - DNA, 50 bp, homo sapien
gtcccgctcacacacactggacttgyactaaatgctcaacgattccattc

SEQ ID NO: 11927 - DNA, 50 bp, homo sapien
tgatacattttaaaaggtggtgatamcatactagtaatcaatattcataa

SEQ ID NO: 11928 - DNA, 50 bp, homo sapien
tcaactagactctaggcgctgaaaartcagatatagtgtcactgcatctc

SEQ ID NO: 11929 - DNA, 50 bp, homo sapien
ataacaccagcaaattgggtcaatargttattcctttaaaataggactat

SEQ ID NO: 11930 - DNA, 50 bp, homo sapien
cactctgacttggagattaggggctmagacagccgtggatgagagtccag

SEQ ID NO: 11931 - DNA, 50 bp, homo sapien
gtagctatttgacaaagagtgggaargacaattattccaggaagaaagat

SEQ ID NO: 11932 - DNA, 50 bp, homo sapien
tcgtcttttccttgtcttcagagcayagtttctctaacagtgaataacat

SEQ ID NO: 11933 - DNA, 50 bp, homo sapien
ttatctctattccagactaaatgtasagcagatatctgatataatcctgg

SEQ ID NO: 11934 - DNA, 50 bp, homo sapien
tgtgactaagaaagcgtgatatccayagtaaggtaaagaacattgttaag

SEQ ID NO: 11935 - DNA, 50 bp, homo sapien
taatactttattctctcagaaaaatkagatttgtagcaaaaaagacaaag

SEQ ID NO: 11936 - DNA, 50 bp, homo sapien
catcacttcttaatctaatagttagrccttattttacccaagctttcttt

SEQ ID NO: 11937 - DNA, 50 bp, homo sapien
actgcctcagagaaaggatgttacartggaaaacagaaccgggaaaagac

SEQ ID NO: 11938 - DNA, 50 bp, homo sapien
attacaaattcttaatacatttgaamatcagtgacagtttaaaaccaaaa

SEQ ID NO: 11939 - DNA, 50 bp, homo sapien
atatggaacatactgtaaacattatragctgcaaatcttaaattgttagt

SEQ ID NO: 11940 - DNA, 50 bp, homo sapien
catgagtatattaggtgtgagtccawtatgtagacaggccagagtaaagc

SEQ ID NO: 11941 - DNA, 50 bp, homo sapien
acctaatctctctttaataaagatcrataagctggtcaaaatgaatgaga

SEQ ID NO: 11942 - DNA, 50 bp, homo sapien
aaacatctatgtgaatatagcgatgmaacagttgtgatatgagaccatgt

SEQ ID NO: 11943 - DNA, 50 bp, homo sapien
tgttgcctaagtgtacaatgtttatraattctacagtacagtagtataca

SEQ ID NO: 11944 - DNA, 50 bp, homo sapien
cagtgagagcaggttatgccacccaygtgatatgtggagatgggacaaag

SEQ ID NO: 11945 - DNA, 50 bp, homo sapien
cattttctcttcttttcctcatacaytcccacaagtgtcaattcctctag

SEQ ID NO: 11946 - DNA, 50 bp, homo sapien
tcaacatacaaaaataaatataccarattaaccaaaaggaaggataaaag

SEQ ID NO: 11947 - DNA, 50 bp, homo sapien
tctaacaagcttccctggcagataamatttcacacatgttgttacaaatc

SEQ ID NO: 11948 - DNA, 50 bp, homo sapien
gatttgttccttttccctgtaaccartctttgccatgaacatgattataa

SEQ ID NO: 11949 - DNA, 50 bp, homo sapien
tgacctcccactcacctttagaatarcatccagagtccttagcacaactt

SEQ ID NO: 11950 - DNA, 50 bp, homo sapien
tagtaaaagtccattcagaatcaaakccactatcctcttaagaaaataaa

SEQ ID NO: 11951 - DNA, 50 bp, homo sapien
agtgttttgaagatccgttcatgtcyctggcattgctcctctccctttct

SEQ ID NO: 11952 - DNA, 50 bp, homo sapien
aacaatggcctcactctcattcacaytgtatatcattcttcaagttcttg

SEQ ID NO: 11953 - DNA, 50 bp, homo sapien
tatgatgacacacttgtccataaaaytaaatagcagagagatctgaagga

SEQ ID NO: 11954 - DNA, 50 bp, homo sapien
tgatggttttttgccagtatgtaaawtcctatcttaggttctaaggtgca

SEQ ID NO: 11955 - DNA, 50 bp, homo sapien
ttaagtgagaaaacaaaggagtgaaytaatgaacaaagaaaacatgatag

SEQ ID NO: 11956 - DNA, 50 bp, homo sapien
aaaaacaaagattataacaaaaggartatagtgacatatgactaaaatca

SEQ ID NO: 11957 - DNA, 50 bp, homo sapien
atcatatacacacctattaaatatayacggacagagagaaagaaagcata

SEQ ID NO: 11958 - DNA, 50 bp, homo sapien
tggggaaggagaagtagactaagaaygcaaaagaaaaaggaatagtagat

SEQ ID NO: 11959 - DNA, 50 bp, homo sapien
tgcctaccaaaataaatgtacacackattatatatgcatacaaactagga

SEQ ID NO: 11960 - DNA, 50 bp, homo sapien
cctccatcagaatgcctttcactgayggtcggatacaggggccctcaatc

SEQ ID NO: 11961 - DNA, 50 bp, homo sapien
agaaagaaggagaacttcatagaaamggaagaagttatggccaatataat

SEQ ID NO: 11962 - DNA, 50 bp, homo sapien
ccttgttctttaagagtaaaagccaragaaagtccttagagtggtctcta

SEQ ID NO: 11963 - DNA, 50 bp, homo sapien
tagaaagggtccctgagccaaggaayataggagcctgttgaaactaaaat

SEQ ID NO: 11964 - DNA, 50 bp, homo sapien
agtcccctagtcttcaaccaaatccratgaataaccaagccctgtggatt

SEQ ID NO: 11965 - DNA, 50 bp, homo sapien
tgggagcaagttgaaaatcagaagcsgagcagaaaaacacaaacacatgc

SEQ ID NO: 11966 - DNA, 50 bp, homo sapien
caaagcttatttttaatgaaaagcasacctaaacacagctaacaacgcaa

SEQ ID NO: 11967 - DNA, 50 bp, homo sapien
acagaccctaaacaacagggtagacyaagttttcaagatctcttcatctg

SEQ ID NO: 11968 - DNA, 50 bp, homo sapien
aaatgaatttctggaaatagcactaratctgataaaattcagtgtctctt

SEQ ID NO: 11969 - DNA, 50 bp, homo sapien
gagttatattttatcttgtgtgcaayagagagccacttaagattcagaga

SEQ ID NO: 11970 - DNA, 50 bp, homo sapien
actgaagtatgcagatgaggcctaawtcccttttccactaattattagtg

SEQ ID NO: 11971 - DNA, 50 bp, homo sapien
ctattatcacttaaaggttattacastcagcttcaaaatgatattgaaat

SEQ ID NO: 11972 - DNA, 50 bp, homo sapien
agtataaaattcaaaatataggataygtggatttcaatatcattttgaag

SEQ ID NO: 11973 - DNA, 50 bp, homo sapien
gcacaagtggtgtgagaccgtacagraagcatgaatcttgatggaactga

SEQ ID NO: 11974 - DNA, 50 bp, homo sapien
taggctctgataaagtctgcactaaygtaaaaggacttaaagttaagata

SEQ ID NO: 11975 - DNA, 50 bp, homo sapien
taaggaggcaagagaatttgacaaaygtggtagagatggtcagtaagaag

SEQ ID NO: 11976 - DNA, 50 bp, homo sapien
ggcatggaagatagatcttgtttatyacccttagcctataaaattttttc

SEQ ID NO: 11977 - DNA, 50 bp, homo sapien
tacttgttagcttcgagctcagtccrattatttagcttctctgaacacca

SEQ ID NO: 11978 - DNA, 50 bp, homo sapien
agtgataaatatacacaggaataatmatgatagtatatgaaattattaag

SEQ ID NO: 11979 - DNA, 50 bp, homo sapien
tggttacactagtaaagaggcaataytattctaggagtttaaatgtttta

SEQ ID NO: 11980 - DNA, 50 bp, homo sapien
gcactgatgaacatagaaacgacacragtaagaatggatttgagagatgg

SEQ ID NO: 11981 - DNA, 50 bp, homo sapien
gtatttcttcgtagcagtttgtcgayctgagaaatggcctcttcccagca

SEQ ID NO: 11982 - DNA, 50 bp, homo sapien
ctgagtattgcttcagttgtatcacraaagttttgaaatgtagtttgtct

SEQ ID NO: 11983 - DNA, 50 bp, homo sapien
tattgcttgccttctaaatgaatcargcaacttctcatctcgttctgtgc

SEQ ID NO: 11984 - DNA, 32 bp, homo sapien
catacaaaaatcagtamcagatggatgacaga

SEQ ID NO: 11985 - DNA, 50 bp, homo sapien
ttgcttaaacttcaccttgcaccaakattctgggttaggtgcagtgtaca

SEQ ID NO: 11986 - DNA, 50 bp, homo sapien
acatgtgtgcacccacagtatcctaygttcacctctgtcatagcacttac

SEQ ID NO: 11987 - DNA, 50 bp, homo sapien
atagtggaagagttggtttacttgascaatagctattgaatatgtcaggc

SEQ ID NO: 11988 - DNA, 50 bp, homo sapien
agcatacagtccaagcatgaataacycagcattatgcacagttttaatca

SEQ ID NO: 11989 - DNA, 50 bp, homo sapien
ctatttctgcgctttcttcctgggartaaaatgtttgcaggaagtgaaca

SEQ ID NO: 11990 - DNA, 50 bp, homo sapien
agcattcttctccttttgtgaaagayattccttctaatggaagaaaatca

SEQ ID NO: 11991 - DNA, 50 bp, homo sapien
tgtactcagaataaacaggcaagagwctccttatttattggctctttagt

SEQ ID NO: 11992 - DNA, 50 bp, homo sapien
aagatcaatccggagcaggcacaccrcatagcaagagtggtaacaagaaa

SEQ ID NO: 11993 - DNA, 50 bp, homo sapien
ctataatcaaggcagaaaattatgayggcctggactaggcagctgcttta

SEQ ID NO: 11994 - DNA, 50 bp, homo sapien
tttaatttagaatgagtgatttaacyatgttagacaacacaaagaaactt

SEQ ID NO: 11995 - DNA, 50 bp, homo sapien
aacatttaggggtatgttaggttgaycttagtgtgtagctcttccaggaa

SEQ ID NO: 11996 - DNA, 50 bp, homo sapien
ggtcatagggatcagtgcttattttwaaaaagaaatccatctacttcttt

SEQ ID NO: 11997 - DNA, 50 bp, homo sapien
accctataagaaatgtttagaaatayacctgtggaaacataagttatatg

SEQ ID NO: 11998 - DNA, 50 bp, homo sapien
gtaaaaatggaatgaatctaggatasgcttaacctaaggaatcattggca

SEQ ID NO: 11999 - DNA, 50 bp, homo sapien
ataggcaggattcttctgaaaaatcsaaagaaatccatcagggctcaaag

SEQ ID NO: 12000 - DNA, 50 bp, homo sapien
cagactttgtttaaattctgattgaycacttgctaactgtgtgccctagg

SEQ ID NO: 12001 - DNA, 50 bp, homo sapien
cacacacacatacacaatacagtacsgcacaatctagactctactaaaaa

SEQ ID NO: 12002 - DNA, 50 bp, homo sapien
tggagtatactttgtaagactctgayggatgttttataataaactttggg

SEQ ID NO: 12003 - DNA, 50 bp, homo sapien
gttttcatcttcctgccagcattacraaatttaacttataacaaaaaatg

SEQ ID NO: 12004 - DNA, 50 bp, homo sapien
caggggggttctcagtttttccttcrccgttctggctaaaaaaacaaata

SEQ ID NO: 12005 - DNA, 50 bp, homo sapien
gaattacctaggtagatagaactcartccgagaggctttttggcgggaga

SEQ ID NO: 12006 - DNA, 50 bp, homo sapien
aactttgctctgataaacatagttargcatacaagaatttaagcaacttg

SEQ ID NO: 12007 - DNA, 50 bp, homo sapien
tattattacatgaaacgctacagcasattagcagacaaatgccaaactgg

SEQ ID NO: 12008 - DNA, 50 bp, homo sapien
tccctcaatcagcgggccaagaaccragaataaagtttcatttgccgact

SEQ ID NO: 12009 - DNA, 50 bp, homo sapien
gtccaaagtcacacagctatagtaaratcaaaagtagattacaaattggt

SEQ ID NO: 12010 - DNA, 50 bp, homo sapien
cttactgaataactgctatggactaygcatgtgttagatgctggggtaga

SEQ ID NO: 12011 - DNA, 50 bp, homo sapien
ctgaatggtgactgggactgcctacrctatttccacagtgttgacctgtt

SEQ ID NO: 12012 - DNA, 50 bp, homo sapien
cgtccaaggttagaaacttaaaaacmcaacgattgatacctaaaagaaag

SEQ ID NO: 12013 - DNA, 50 bp, homo sapien
tccagtaggcacttataaatacacaygtaaaacttgtcagagaaatcaga

SEQ ID NO: 12014 - DNA, 50 bp, homo sapien
taggcatccagatatgttgtcttaamgatactgggatactagactagtat

SEQ ID NO: 12015 - DNA, 50 bp, homo sapien
aacccaggtctgtacaacttcaaagsctttccgctatagcaaggcagcat

SEQ ID NO: 12016 - DNA, 50 bp, homo sapien
gtttacaatatacatttagtatttasgtttacagaatactatatacatta

SEQ ID NO: 12017 - DNA, 50 bp, homo sapien
aagatactgtatttttacattgcaakatcatagggatcattacacccaag

SEQ ID NO: 12018 - DNA, 50 bp, homo sapien
tttcaaaaaaaatgtgaaggtgtccygacaattaaaggaggttaattcaa

SEQ ID NO: 12019 - DNA, 50 bp, homo sapien
ttcttttctgataaaatacctactawcatacagattttgacagaatatta

SEQ ID NO: 12020 - DNA, 50 bp, homo sapien
ccctgttctgtgatatttaaatagaractgcttgaactctcatttcacag

SEQ ID NO: 12021 - DNA, 50 bp, homo sapien
cactcgtttcttgcagaaggctctayagaaggctgttccactagctggca

SEQ ID NO: 12022 - DNA, 50 bp, homo sapien
ggtgggctgctagctcctgtcttaaycattgggagaattattctccgtaa

SEQ ID NO: 12023 - DNA, 50 bp, homo sapien
tatctaatcctttgagagaaagccayggtacattctgtttacagagcatt

SEQ ID NO: 12024 - DNA, 50 bp, homo sapien
aagagcccttctactgctatcacacyattctgagatttaggaaaccccat

SEQ ID NO: 12025 - DNA, 50 bp, homo sapien
aacatttcaaattcttttttagggcraatgagaagtttggtgagtttaaa

SEQ ID NO: 12026 - DNA, 50 bp, homo sapien
ttgtctccagctatagaatagtccaratttttaagtttaaaggacgcttc

SEQ ID NO: 12027 - DNA, 50 bp, homo sapien
ggttccctggagagcataccttgtascaaagcatggcagtgagatgcaga

SEQ ID NO: 12028 - DNA, 50 bp, homo sapien
caccgtagcaccaacactgggtatcragaaggctcagaggagcaaaacgt

SEQ ID NO: 12029 - DNA, 50 bp, homo sapien
caatggggaaatacactcttgttaawacgtagaaaatgttcaagtcaccc

SEQ ID NO: 12030 - DNA, 50 bp, homo sapien
gagtccaagttctaccacttacttaygttgtctgaccttgaagagatcct

SEQ ID NO: 12031 - DNA, 50 bp, homo sapien
tttcagctttagtgttaatcatgtaractgtaccaaaattgttctcttcg

SEQ ID NO: 12032 - DNA, 50 bp, homo sapien
ttctgcctatctctaattcctgtgcmcttagtctttgcgctagaagtttc

SEQ ID NO: 12033 - DNA, 50 bp, homo sapien
tttatagatgaagaagagctcagaaraataagtagcttgttgacttctca

SEQ ID NO: 12034 - DNA, 50 bp, homo sapien
atgtcaaaagaatataacttccaaartccacctgatgacctaatctttat

SEQ ID NO: 12035 - DNA, 50 bp, homo sapien
tactgctgccctgcggccctgtcaaygtttccacaaccacgccatggaac

SEQ ID NO: 12036 - DNA, 50 bp, homo sapien
gttttcagctctaatagcccaagcaygtatgaaagatagtcagggactct

SEQ ID NO: 12037 - DNA, 50 bp, homo sapien
gtttgaggaggctgtagttctattamaaattcagagggcttcagaggcaa

SEQ ID NO: 12038 - DNA, 50 bp, homo sapien
gaaagtaaatacagtatagggtcaamttctgtagccagctgggggaaaaa

SEQ ID NO: 12039 - DNA, 50 bp, homo sapien
tcctaaacaacctcaggctgtcatcrctgcttaatagtcccattttataa

SEQ ID NO: 12040 - DNA, 50 bp, homo sapien
cgatttcaatagtttccaaatgcacygtagactttttcatacctctggct

SEQ ID NO: 12041 - DNA, 50 bp, homo sapien
ctgtaccatttttaaaccattgataygtcataagcaaatattagaccaca

SEQ ID NO: 12042 - DNA, 50 bp, homo sapien
ctcatgaatgacaccattatacccayggagtcctggtctctagtcctagt

SEQ ID NO: 12043 - DNA, 50 bp, homo sapien
aaggtagaggtatagcagcaaaggakgaacttagcttatatctggagatg

SEQ ID NO: 12044 - DNA, 50 bp, homo sapien
aaactataagttgttcgacaataaargcaatgtggtcaggtgttcctagc

SEQ ID NO: 12045 - DNA, 50 bp, homo sapien
agcttcaatagcttgatctggaaaaygagatttaagagtaacaattgttg

SEQ ID NO: 12046 - DNA, 50 bp, homo sapien
ggcatgaaagtggaatgaattcttayggtcaccattacaaagatgagagg

SEQ ID NO: 12047 - DNA, 50 bp, homo sapien
atatatggccaattgaatacactcartagatggtagatattattttcttt

SEQ ID NO: 12048 - DNA, 50 bp, homo sapien
agacaaagtgagcattgtccttatcmgaatcatctttatcagaactggtc

SEQ ID NO: 12049 - DNA, 50 bp, homo sapien
attggaaaaagtttgaaaacaatccyggataataaatcacacttactcag

SEQ ID NO: 12050 - DNA, 50 bp, homo sapien
ttaggaacaaaatttagtctctatamcaatttggcttctcccaaaggtac

SEQ ID NO: 12051 - DNA, 50 bp, homo sapien
caaaaatggccttataattagtaaaygaatggtcagttttccatctttat

SEQ ID NO: 12052 - DNA, 50 bp, homo sapien
gcattaataaagtgctaacaccaaasttgagtacttgttggatgaaatta

SEQ ID NO: 12053 - DNA, 50 bp, homo sapien
ttctagtatgaaaattcagttatgawatcctggaaggcatgatgttgtat

SEQ ID NO: 12054 - DNA, 50 bp, homo sapien
acttcctgtactgttggttttttccyactcagttaagtgacagcaaagct

SEQ ID NO: 12055 - DNA, 50 bp, homo sapien
tcgtccctaaacttccatggagaacygtcacaaaggaatcctaattctca

SEQ ID NO: 12056 - DNA, 50 bp, homo sapien
ttgtgcagatctaataggataactarcattccacacacattacacattta

SEQ ID NO: 12057 - DNA, 50 bp, homo sapien
ttggaaattggatccagtctggaaaktcactcgatcacagtggggatctg

SEQ ID NO: 12058 - DNA, 50 bp, homo sapien
tgaatgaacactatattgaatgaagraacaagactgagctgcattatttg

SEQ ID NO: 12059 - DNA, 50 bp, homo sapien
ttgtactgttttcagctatgtctacwatgactttattgttttaccatcca

SEQ ID NO: 12060 - DNA, 50 bp, homo sapien
tggccttcaatagtattttagaaccraagagttggaagagattgtagtct

SEQ ID NO: 12061 - DNA, 50 bp, homo sapien
tcaatctgggaccagcagctcatacratatattcttcccttgctgatggc

SEQ ID NO: 12062 - DNA, 50 bp, homo sapien
agcagcaactacttggaaggtgagargaatcaggaaatacatgttgcaca

SEQ ID NO: 12063 - DNA, 50 bp, homo sapien
ggtatgatccaccttttttgctccaytgaaggacatcctaattctgttca

SEQ ID NO: 12064 - DNA, 50 bp, homo sapien
aagactgatttaatatcacccatgartacgcatacttgggaagttttcat

SEQ ID NO: 12065 - DNA, 50 bp, homo sapien
atattgacctaaatatctttgaacaraattactcaatctttatttctgag

SEQ ID NO: 12066 - DNA, 50 bp, homo sapien
tagcccatgtgcccagccacagataygtcaaatttgctagcctaagtatt

SEQ ID NO: 12067 - DNA, 50 bp, homo sapien
catctgatagtatgcttcgagaatarcaatctgatgatagctttcaacat

SEQ ID NO: 12068 - DNA, 50 bp, homo sapien
gaatatagagttaggccagaaatagkatttggtgatcaaggatagagaac

SEQ ID NO: 12069 - DNA, 50 bp, homo sapien
acactacttaccataatggtgaagamacctgaaattatgaatcaatgtat

SEQ ID NO: 12070 - DNA, 50 bp, homo sapien
gcagggaatatcataaacaaagttakgatggcaaaaaaggactacaaata

SEQ ID NO: 12071 - DNA, 50 bp, homo sapien
gcacatttccatatttcaatttctckcaaataaggatgcatcctacaacc

SEQ ID NO: 12072 - DNA, 50 bp, homo sapien
gtattgtaataatatgttaatgcatsaaaaaatatttgccatgttcttat

SEQ ID NO: 12073 - DNA, 50 bp, homo sapien
ccatagtcttcttagactggatgaartaaggatagaatgatgatgctgac

SEQ ID NO: 12074 - DNA, 50 bp, homo sapien
tgggtgaattaaagttcaaagtttcyaaaagatagagagataccattgtc

SEQ ID NO: 12075 - DNA, 50 bp, homo sapien
aaagactgttagatacaataataaamgcaatacaagacgtggattccaaa

SEQ ID NO: 12076 - DNA, 50 bp, homo sapien
tcttggcggggtgggtgtgggtaaaytcaagccctagatgtgcctttaat

SEQ ID NO: 12077 - DNA, 50 bp, homo sapien
tttgatctccctgcaaaacagaacckgctgtgaggagtgtagttagctga

SEQ ID NO: 12078 - DNA, 50 bp, homo sapien
cactgaaataaacatgttttcacatyggtcactttaaaaaaacatgtttt

SEQ ID NO: 12079 - DNA, 50 bp, homo sapien
acctcatatgtagtaactgttttaaycctctcaataaagtaggaactatt

SEQ ID NO: 12080 - DNA, 50 bp, homo sapien
gaaactgacaaatcagctatgccaastgtattaaataaatgctactcaaa

SEQ ID NO: 12081 - DNA, 50 bp, homo sapien
catatatgtaaaatattttggtatgraataaactagaacttaaggtgtgg

SEQ ID NO: 12082 - DNA, 50 bp, homo sapien
ctccactctcaaagggaggtatagaygtgctcctcattctttatgtagag

SEQ ID NO: 12083 - DNA, 50 bp, homo sapien
aaattttcctataaagacacaagtarcctagaacaccatattaatgaaat

SEQ ID NO: 12084 - DNA, 50 bp, homo sapien
taggaaaatttacaatcttgtgttayggttcaatgagaaagtctaaaaag

SEQ ID NO: 12085 - DNA, 50 bp, homo sapien
tagcctcctaaaattaatttcctgastcactaatgatcatgtcagtttga

SEQ ID NO: 12086 - DNA, 50 bp, homo sapien
aggcatgagccaccacgcccagtatwaaccattttcaagtgtacagttca

SEQ ID NO: 12087 - DNA, 32 bp, homo sapien
tgtcctcttttccattwaatcaaagtcccagg

SEQ ID NO: 12088 - DNA, 50 bp, homo sapien
gcaaagattaactcatctcagtaaakagcgttaagaactgcggtaggctg

SEQ ID NO: 12089 - DNA, 50 bp, homo sapien
tttaggagtttctttgccttagcaayggcttatcaaagtcaagcactgtg

SEQ ID NO: 12090 - DNA, 50 bp, homo sapien
aagatttcaggcttgagctggagtaygaaaggaaattgaaactaaagatt

SEQ ID NO: 12091 - DNA, 50 bp, homo sapien
atcctaaaaccacactgtgtttccayggatcaagtttttagttttatgct

SEQ ID NO: 12092 - DNA, 50 bp, homo sapien
ttcgtactccagctcaagcctgaaaycttccttcttgtaaacaaaaacca

SEQ ID NO: 12093 - DNA, 50 bp, homo sapien
acagaagctgtggtgagaattaatcyatgatgtgttagactctccagcta

SEQ ID NO: 12094 - DNA, 50 bp, homo sapien
agaaatgttactaataaattcacaasttgtatttacaattcaagcacagt

SEQ ID NO: 12095 - DNA, 50 bp, homo sapien
cagtgtggttttaggatggagatcgratttcactcacctcaaaataactc

SEQ ID NO: 12096 - DNA, 50 bp, homo sapien
tgatgaccaaagctggtggagagtayggtaattaacccagatgattcaga

SEQ ID NO: 12097 - DNA, 50 bp, homo sapien
tgcttatgcatttactaatgttatargaatgattttgtcagacaacattg

SEQ ID NO: 12098 - DNA, 50 bp, homo sapien
ctggaaattataataaatttattcarctgttccagaaataagaagctttc

SEQ ID NO: 12099 - DNA, 50 bp, homo sapien
cttttgggaggtctgggatcagataygaaatgaggtgctttatacaaaac

SEQ ID NO: 12100 - DNA, 50 bp, homo sapien
tggtgggggtccagctcatttagaamcttgttggttgttgtgagaactcc

SEQ ID NO: 12101 - DNA, 50 bp, homo sapien
tacagatgttacttgttggcagaacygacaataaccaaaacaaagcttgg

SEQ ID NO: 12102 - DNA, 50 bp, homo sapien
gtgtggaagaactctgaccataaaarttgacaagagtgggcaaaaaggac

SEQ ID NO: 12103 - DNA, 50 bp, homo sapien
ggaaatgggattccaactgattgaamgacaattttccaaaaacagttgat

SEQ ID NO: 12104 - DNA, 50 bp, homo sapien
caggataatcatactcatcgaactcrcaagtttgttgtgagaattatatg

SEQ ID NO: 12105 - DNA, 50 bp, homo sapien
aactgtctatagcaaaatgcaaacgratttgggacttttttctcagtcta

SEQ ID NO: 12106 - DNA, 50 bp, homo sapien
caaggaggctcatgctaaatcaaagragttactaataaggtgtcactcac

SEQ ID NO: 12107 - DNA, 50 bp, homo sapien
gaaactccatgatgctttatctcackcagctataacaatttgtgaatcct

SEQ ID NO: 12108 - DNA, 50 bp, homo sapien
agttactaataaggtgtcactcacartatctggtaggagagctaagttta

SEQ ID NO: 12109 - DNA, 50 bp, homo sapien
gctcattgtaactcctggtggtcaakatgaaaattttcatcctttctctt

SEQ ID NO: 12110 - DNA, 50 bp, homo sapien
ttggtgggttcaagatactgcttaamatttaagagatgtaaacatctgta

SEQ ID NO: 12111 - DNA, 50 bp, homo sapien
aggtttctctttttattattcaacaytgagaagcagaaaagtgttcaact

SEQ ID NO: 12112 - DNA, 50 bp, homo sapien
agtgtgtaaagctggagaatatcacmaataaagaacaagatgaaaaggaa

SEQ ID NO: 12113 - DNA, 50 bp, homo sapien
ttgattgcttattttagtatgcagamatttttagtttgatacattcttat

SEQ ID NO: 12114 - DNA, 50 bp, homo sapien
attttcctaatcacaagcatttggamtaatgaaacctgcaaaggggaaaa

SEQ ID NO: 12115 - DNA, 50 bp, homo sapien
cctttgtagaacactatgcaatttayaacacctttccacatacctcctgc

SEQ ID NO: 12116 - DNA, 50 bp, homo sapien
tcactttccactttccatatgtttaygctttctgcagtgtttactgatat

SEQ ID NO: 12117 - DNA, 50 bp, homo sapien
atgtcatagggttattgtaaggatcmacctgaaatatcacatgagaatgt

SEQ ID NO: 12118 - DNA, 50 bp, homo sapien
caccgctgaagcttgtgttcatttayctttactaggtgagtttttcactg

SEQ ID NO: 12119 - DNA, 50 bp, homo sapien
ttcccaaaactttgcatgtatcaaartcattaaaagagtgcagatttctg

SEQ ID NO: 12120 - DNA, 50 bp, homo sapien
ctcaactaaagaaaactaacagcaaytatcattctaaacaacaaaacact

SEQ ID NO: 12121 - DNA, 50 bp, homo sapien
tgtaacaatgagattcagatgctgcraagtgaaaaagaatgatgtgtcct

SEQ ID NO: 12122 - DNA, 50 bp, homo sapien
agtacaagatagatgcttctctttaygatttgagatacaattaagtaatg

SEQ ID NO: 12123 - DNA, 50 bp, homo sapien
aaaataaattcttgcttataagaaaytaagagagcctgtgagtatacaag

SEQ ID NO: 12124 - DNA, 50 bp, homo sapien
tgtgccttattttcagttgcattaartgtaggaatttcacataattaaga

SEQ ID NO: 12125 - DNA, 50 bp, homo sapien
gcttttttggtcaataaacatacaartgaacttcctgcaccatggattta

SEQ ID NO: 12126 - DNA, 50 bp, homo sapien
tacatcaggtgttagaatgggggtaytaaactaagaagtaattattcttt

SEQ ID NO: 12127 - DNA, 50 bp, homo sapien
atggaagttctagtgttcacaaatamgttgcgaaaataagctacagagca

SEQ ID NO: 12128 - DNA, 50 bp, homo sapien
gggagaggaaaagcattgctaaccasgactgtcttaattttgggtaaaca

SEQ ID NO: 12129 - DNA, 50 bp, homo sapien
atttttctgttgctttaatattatasaattgcaggaaatattataagctt

SEQ ID NO: 12130 - DNA, 50 bp, homo sapien
tagagagctgttcttcatattcaaasgttgctcagccaatgtggaaacca

SEQ ID NO: 12131 - DNA, 50 bp, homo sapien
caaaaagggcattaacttgcaggaaygggcagtttgtcaaaatgtattgg

SEQ ID NO: 12132 - DNA, 50 bp, homo sapien
caattttattcctttcagcagccgaygtgacttatcaaagtgcttccttg

SEQ ID NO: 12133 - DNA, 50 bp, homo sapien
atccaaagtataaaaaaactgttacraatcatgttgatacttcctgtgta

SEQ ID NO: 12134 - DNA, 50 bp, homo sapien
ggagatcattaccatcttagatttasagtccgattatcttattattttta

SEQ ID NO: 12135 - DNA, 50 bp, homo sapien
gtacaaagtcccaacctggccttcarggcattcatcaattatttatgcaa

SEQ ID NO: 12136 - DNA, 50 bp, homo sapien
aacaccttatgatgtaagcgaacaayaagtttttatataaccagcatgtt

SEQ ID NO: 12137 - DNA, 50 bp, homo sapien
cttgatcactgattgctcccttgaartcaacaaatatttataagatgcag

SEQ ID NO: 12138 - DNA, 50 bp, homo sapien
ccttgatgattgtagctgtattgtasgttttagtatcaatcaggtagagt

SEQ ID NO: 12139 - DNA, 50 bp, homo sapien
tacactaatgagctactgatagttayagaaaagcagtgactgtgcatact

SEQ ID NO: 12140 - DNA, 50 bp, homo sapien
cccctgtaggatcgaccttgcaaatyaaccttggatctggtagctaagcc

SEQ ID NO: 12141 - DNA, 50 bp, homo sapien
aaagttatttgtatctcaagtggacycggttaaatgatattcatttgctg

SEQ ID NO: 12142 - DNA, 50 bp, homo sapien
ctgcctctatgctaattgatcccttmaacttaggttcagaaagagtacat

SEQ ID NO: 12143 - DNA, 50 bp, homo sapien
aggagatacctgagaaactatttaargacatcagatagatacccagcaac

SEQ ID NO: 12144 - DNA, 50 bp, homo sapien
tcagctcccaggtactcaggacatgmactagaaggaggaggaagtgagct

SEQ ID NO: 12145 - DNA, 50 bp, homo sapien
tcttggtaaatgctgtcctggttcaygctgtatgtctagatctcagggga

SEQ ID NO: 12146 - DNA, 50 bp, homo sapien
gttcatcatgtgtgctaagttcaaaragaaggaatgtgctttgcttaaga

SEQ ID NO: 12147 - DNA, 50 bp, homo sapien
gtaattaaaagcagagtgagatactracactaggagataataaagctgtt

SEQ ID NO: 12148 - DNA, 50 bp, homo sapien
taacatcttggatgtgtaggaccaasttatgataagcaactaacttcatc

SEQ ID NO: 12149 - DNA, 50 bp, homo sapien
tgttggttggctggcaaatgatggtkaatactactcagttatgtgtaatt

SEQ ID NO: 12150 - DNA, 50 bp, homo sapien
gggtctgctgcaaaacaaatttttcraaagaacactgattaggtgatctg

SEQ ID NO: 12151 - DNA, 50 bp, homo sapien
gtccctgctagatacattggaatacsatgaagggctacaaaggcctgaca

SEQ ID NO: 12152 - DNA, 50 bp, homo sapien
ggaaagaaatgaactagaagcagtaygcaagccaaaggagaagagaattt

SEQ ID NO: 12153 - DNA, 50 bp, homo sapien
agctatacagatgttagtcattacargatggtcactctgctctgacaggc

SEQ ID NO: 12154 - DNA, 50 bp, homo sapien
agtacaatgtagtatactttgcccamaatgggtttcctgaactgttaagg

SEQ ID NO: 12155 - DNA, 50 bp, homo sapien
ggtgctaggagaagggtggattccargtaggtacagttgtcccttggtct

SEQ ID NO: 12156 - DNA, 50 bp, homo sapien
agaaacttcccatacttaacctaaasagccaacagaggtcaatttcattt

SEQ ID NO: 12157 - DNA, 50 bp, homo sapien
gtttcaatttatagttctgttgttcyctaaaaatttatttcactgtttcc

SEQ ID NO: 12158 - DNA, 50 bp, homo sapien
tccttttcagttggaaatgagggaayagtttcattaatacagcggaaact

SEQ ID NO: 12159 - DNA, 50 bp, homo sapien
aaaccctatctgtggagaataataayaatgcattcacatcttttgttttt

SEQ ID NO: 12160 - DNA, 50 bp, homo sapien
attttctactcattttctccaatacwcctacttgctatattgattttaag

SEQ ID NO: 12161 - DNA, 50 bp, homo sapien
acctgtaaccttctcaatggcaccaraaacaacggcactgaccctggaca

SEQ ID NO: 12162 - DNA, 50 bp, homo sapien
aaatcacatttatttttactattgakcttcttctatattctggttattaa

SEQ ID NO: 12163 - DNA, 50 bp, homo sapien
tttgtctgtaactaagagtttgatargatataaaaggtgaggtcctttgg

SEQ ID NO: 12164 - DNA, 50 bp, homo sapien
gacccatcacacccttaatggtgaayagaaatgtcgtaattgagatggaa

SEQ ID NO: 12165 - DNA, 50 bp, homo sapien
cctctctcggttctcaggaaacatargtagattagcttgtggctgcagaa

SEQ ID NO: 12166 - DNA, 50 bp, homo sapien
ctttccacctgctttgcccattttcrcctggtggagtagaagctgtcagt

SEQ ID NO: 12167 - DNA, 50 bp, homo sapien
ctggctcggctggagattatcctcawctttatggttgtaacagctaacat

SEQ ID NO: 12168 - DNA, 50 bp, homo sapien
ttttcaactaagatcaatacagataygaacaaatacgattttttaatact

SEQ ID NO: 12169 - DNA, 50 bp, homo sapien
tgaaaagggtgtttgatattcaagayggtatttgtcatttgggggaaagg

SEQ ID NO: 12170 - DNA, 50 bp, homo sapien
atatacatcataattgtgactctcckagacttcctactaaaatatttaaa

SEQ ID NO: 12171 - DNA, 50 bp, homo sapien
tgtggctcttcaatcatggagttacraagatggaccaagataatgttgta

SEQ ID NO: 12172 - DNA, 50 bp, homo sapien
aaagtactaaatactgaattaaatcyatggcaagtaatattatgggaaaa

SEQ ID NO: 12173 - DNA, 50 bp, homo sapien
agtgtctaaaggataaggtcaaaatraaattgataaacaggagaaagaat

SEQ ID NO: 12174 - DNA, 50 bp, homo sapien
tattaacttctattgctgttatgaarattaatcagacctggtttttccct

SEQ ID NO: 12175 - DNA, 50 bp, homo sapien
ttatttaattgccataacaaggctaygtaggattgccagacataatacat

SEQ ID NO: 12176 - DNA, 50 bp, homo sapien
aattaatacctaccttatagtattarggctgccaaattaaatacaatgtt

SEQ ID NO: 12177 - DNA, 50 bp, homo sapien
tattattaagtgtttgaaatggctawgaaatacttgtaggatcttatatt

SEQ ID NO: 12178 - DNA, 50 bp, homo sapien
ggatcacaattcatcaatgcccttgraacacttggtgataagggctcaaa

SEQ ID NO: 12179 - DNA, 50 bp, homo sapien
cagtaagagtcataaatacagcatcsgacttcttacaaattctgaattca

SEQ ID NO: 12180 - DNA, 50 bp, homo sapien
aatggcaaggtctaggacagcaccaragaaagacaggatgtctgcagccc

SEQ ID NO: 12181 - DNA, 50 bp, homo sapien
gttgactacactgttaagttaaaaargttacagaacaacatgtgctcaca

SEQ ID NO: 12182 - DNA, 50 bp, homo sapien
ggaatgaagccaggatttaccaaaarcaaggagatagtcccaggaatttt

SEQ ID NO: 12183 - DNA, 50 bp, homo sapien
gttttagcaatgacggaatcatttcyacctaatttgaacaaatttctatg

SEQ ID NO: 12184 - DNA, 50 bp, homo sapien
cgtatgtctctgtatcgtaactctaygctccattctctcaaagctggact

SEQ ID NO: 12185 - DNA, 50 bp, homo sapien
aagctaaatgacactcaatctttccraactgacattgattcaacttaatc

SEQ ID NO: 12186 - DNA, 50 bp, homo sapien
taacctggttccttaacaacgatgcrcttagcatagtgtattctgtagtg

SEQ ID NO: 12187 - DNA, 50 bp, homo sapien
gaaaggccctcaggaaatcccaataycgtgcaaattgagctttgtaataa

SEQ ID NO: 12188 - DNA, 50 bp, homo sapien
ctgcataggagttagttatgatgccratgatgacggtgatgatgctgcca

SEQ ID NO: 12189 - DNA, 50 bp, homo sapien
atttcatcatcatctttactatttgwagctccacttcctgtagtgtcttc

SEQ ID NO: 12190 - DNA, 50 bp, homo sapien
cacttaagaaacataggttacaaaaygactggttaccacatattaacaag

SEQ ID NO: 12191 - DNA, 50 bp, homo sapien
ttgcagccagcaaaggaactgtgtakgtggagacaacctcagaagcatga

SEQ ID NO: 12192 - DNA, 50 bp, homo sapien
cacaactatgcttgacaagaaaattsaaggccaaaagcccatgtccctcc

SEQ ID NO: 12193 - DNA, 50 bp, homo sapien
acaaccactggtctaagccgtaaccygaatttacaaatgagagaactttg

SEQ ID NO: 12194 - DNA, 50 bp, homo sapien
aatgccctatatagtattcaggatasctaccaagtgtttttatagtaaac

SEQ ID NO: 12195 - DNA, 50 bp, homo sapien
taatttgagttattagtggcaatcayatataaatgcaatggcataccagg

SEQ ID NO: 12196 - DNA, 50 bp, homo sapien
tttagaaagagggcctagattaaaamcttgattaacttaagcttgtttca

SEQ ID NO: 12197 - DNA, 50 bp, homo sapien
taaaggaaacaagacatataataccmagtagaaagaaacatgaaattcta

SEQ ID NO: 12198 - DNA, 50 bp, homo sapien
acttagcaactttcttactcttttawagactaccacctgactctatttca

SEQ ID NO: 12199 - DNA, 50 bp, homo sapien
gaaacccataagggagactgaagacragcaaccagtgaggcaggagacaa

SEQ ID NO: 12200 - DNA, 50 bp, homo sapien
gtggttatattgacatcttttgcacygacttttataagagttgttttgct

SEQ ID NO: 12201 - DNA, 50 bp, homo sapien
acttaaaatatggcctgaattatacracaactatatctaacaaaacacag

SEQ ID NO: 12202 - DNA, 50 bp, homo sapien
tgtttattttaaatctacactgagtwaaattcaattgttttggtagatag

SEQ ID NO: 12203 - DNA, 50 bp, homo sapien
cacggtaagtggattctgtagttgamagctaataggaataaaaagaaaaa

SEQ ID NO: 12204 - DNA, 50 bp, homo sapien
gtggtgggacaaaggatctttagacygcacctgaagggagagaagctatt

SEQ ID NO: 12205 - DNA, 50 bp, homo sapien
gccatctgtcccagacataagtggayatacctccttagctgcaacacaga

SEQ ID NO: 12206 - DNA, 50 bp, homo sapien
gcaatgtgcatgaaagtcctagagasgtgtgtaccttacagtcctgcaac

SEQ ID NO: 12207 - DNA, 50 bp, homo sapien
tcttactccattagctaggatttagkcccatggccacatttagctgcaag

SEQ ID NO: 12208 - DNA, 50 bp, homo sapien
gatgcctgcttatcatttcaataagkccataccttacaggtggggtttct

SEQ ID NO: 12209 - DNA, 50 bp, homo sapien
agtggtttctctgcctgtaaataaaycatctacctcccgtgggatggctg

SEQ ID NO: 12210 - DNA, 50 bp, homo sapien
ttttgctaaaaaagcactaaactaaratatttgacttcatttattcattc

SEQ ID NO: 12211 - DNA, 50 bp, homo sapien
atgagaagtggcttgtgcccttcaaycttaataccagagacacaggaggg

SEQ ID NO: 12212 - DNA, 50 bp, homo sapien
aagagtcaggatccagagttggccarataagaaggtggatggaggaagtg

SEQ ID NO: 12213 - DNA, 50 bp, homo sapien
ttaagagcaggtgcacagaaaggaaycactgcaatgtatggcttaatcta

SEQ ID NO: 12214 - DNA, 50 bp, homo sapien
acctagtgttgccaatttctcttacmccctttaggaaggactgccgtgtc

SEQ ID NO: 12215 - DNA, 50 bp, homo sapien
tcttttggcataggtgttgctgtcamagtcagattataatctaatttcct

SEQ ID NO: 12216 - DNA, 50 bp, homo sapien
ggaaagcctcagctgtttacagaaamaactttaggagtacacccttcttg

SEQ ID NO: 12217 - DNA, 50 bp, homo sapien
aatacatatgcagtgttcaatgtcartatacaattcttccatgtgggctt

SEQ ID NO: 12218 - DNA, 50 bp, homo sapien
gctctcagttatgaattcttaagagkcctatattcggtaagttagcccaa

SEQ ID NO: 12219 - DNA, 50 bp, homo sapien
ctgtcatgaggccttctgccttgtaygtgtctctgtgtcttttcttcttg

SEQ ID NO: 12220 - DNA, 50 bp, homo sapien
aatgtgttctactgaatgatcagcayggattagagccagtaggaaagcag

SEQ ID NO: 12221 - DNA, 50 bp, homo sapien
tgccaagaaagatttatggaaatgckacctacttaaatatttcagcagaa

SEQ ID NO: 12222 - DNA, 50 bp, homo sapien
aaactgcactttccacgggatgggcygattatggtcatgaacctggagga

SEQ ID NO: 12223 - DNA, 50 bp, homo sapien
cgggaatcctttgaagtttcaagccrgcaaccgatatgattagctcataa

SEQ ID NO: 12224 - DNA, 50 bp, homo sapien
tgcttaccaccaagacaccttggacrcatggatttcttagaagcccagtg

SEQ ID NO: 12225 - DNA, 50 bp, homo sapien
gagcttcagtctgtgcttcttcaacrcggaggtgactgttcaaattgcag

SEQ ID NO: 12226 - DNA, 50 bp, homo sapien
tccctgtaccacagttgccccattgraacgagaataagactactgatctc

SEQ ID NO: 12227 - DNA, 50 bp, homo sapien
tgtgcaattatttgttaaggatcaartggtgaagatgtaggcccctagcg

SEQ ID NO: 12228 - DNA, 50 bp, homo sapien
gagaaggagagcttatccagaagacsgataattggagtttacccacatgc

SEQ ID NO: 12229 - DNA, 50 bp, homo sapien
aacatgctcctgaaagtattaataarctaactcatatgtaaaaccaataa

SEQ ID NO: 12230 - DNA, 50 bp, homo sapien
ttagtgtgaaagcacattcaatacaygtggccaataattgtctcttgact

SEQ ID NO: 12231 - DNA, 50 bp, homo sapien
tgttccaagcacagctacaaatgagrcagttaagtccgtggaagcgctgt

SEQ ID NO: 12232 - DNA, 50 bp, homo sapien
cagtccccgtacttgcgcactagcartatcacctcttccctctgtccctc

SEQ ID NO: 12233 - DNA, 50 bp, homo sapien
cataatgtatcaaagggtttaaactracttctgctagtatgagtctgtgg

SEQ ID NO: 12234 - DNA, 50 bp, homo sapien
actttctccatttccttctcactaastgtctctatccttatgcttttcct

SEQ ID NO: 12235 - DNA, 50 bp, homo sapien
aggcggcctgggtgaggtgagcctaraactgagactcaggagacagggat

SEQ ID NO: 12236 - DNA, 50 bp, homo sapien
tcagtccctgatgttggagttgaacygtaggactgtctgtaaaatgaaag

SEQ ID NO: 12237 - DNA, 50 bp, homo sapien
tgggaatgtgcatcactatcatctayggcaaactgtgatgagttttctga

SEQ ID NO: 12238 - DNA, 50 bp, homo sapien
ttcatcagcctaaaatataatttaarctcacattaacaaactttaaaagc

SEQ ID NO: 12239 - DNA, 50 bp, homo sapien
tgtttgatttgagctgatcctgtgaygagatagaaaaaaaaaatccatgc

SEQ ID NO: 12240 - DNA, 50 bp, homo sapien
caaacccactgatcgctcagattcamgatcccagacttttaaccgcttta

SEQ ID NO: 12241 - DNA, 50 bp, homo sapien
aaacaaagaccatggctaaatattgraattgggaaaagggcttttcttct

SEQ ID NO: 12242 - DNA, 50 bp, homo sapien
ttcatgtcacttacatgttctcctamcctaggcttctgtttcagttgatg

SEQ ID NO: 12243 - DNA, 50 bp, homo sapien
acagtgcccttttccatccacctacrgtaataaactcgtctggagggagc

SEQ ID NO: 12244 - DNA, 50 bp, homo sapien
actgctcttattgactttgctagaarccgtgtgaggttgcccagatcaag

SEQ ID NO: 12245 - DNA, 50 bp, homo sapien
ctgtggttatttgtttaactgtctaycttccctactaagtgttacagctt

SEQ ID NO: 12246 - DNA, 50 bp, homo sapien
tgccgagccaaggaacacatgttacraaccaactggaaggtgggcagtgg

SEQ ID NO: 12247 - DNA, 50 bp, homo sapien
aatgtctgtggggtcaggtttaatayatttgcactgagctcgtaccaggc

SEQ ID NO: 12248 - DNA, 50 bp, homo sapien
attcatgttttactgttgctgtgggwaaaaataattttaacttaaccaat

SEQ ID NO: 12249 - DNA, 50 bp, homo sapien
aatcagctcttctgtacctctgtccyaataatcttgctgaccaacagatg

SEQ ID NO: 12250 - DNA, 50 bp, homo sapien
agtgccaaaccaccacttctgacgcratcatgaggctggtctccttgtct

SEQ ID NO: 12251 - DNA, 50 bp, homo sapien
aaacagctgggcttttcttctttgcygaatcaatctactcctgattttac

SEQ ID NO: 12252 - DNA, 50 bp, homo sapien
tttatttttgtttcccattagtctgyagaatgtattcagagtgtgtatgt

SEQ ID NO: 12253 - DNA, 50 bp, homo sapien
ttagtgtgctgccattatgtcatgaraaagtgataaaatgacgtgaccac

SEQ ID NO: 12254 - DNA, 50 bp, homo sapien
tcctgatctcattactgggtcaccaycttgatcattggtccccatcttcc

SEQ ID NO: 12255 - DNA, 50 bp, homo sapien
atattggcaaactcactatttttaayctgaagagctgaccttgcaatgtg

SEQ ID NO: 12256 - DNA, 50 bp, homo sapien
ctggcactcagtagggctcatggaawatatctattgatcagttcatgata

SEQ ID NO: 12257 - DNA, 50 bp, homo sapien
ttgctgtagcgtgggctttagttgakgtgaataacttcacagtagctcct

SEQ ID NO: 12258 - DNA, 50 bp, homo sapien
ccagatgaagacacatgctgtaaatwagggttggcagataaaatagaggg

SEQ ID NO: 12259 - DNA, 50 bp, homo sapien
aagcaaacccggatatttcaggattyaaaaaaccccacagaggttgaagc

SEQ ID NO: 12260 - DNA, 50 bp, homo sapien
tggggagcagtcttctgatttttcamgattagctggaaatccaaatcttt

SEQ ID NO: 12261 - DNA, 50 bp, homo sapien
atctaggattagtgatcaaacaatgscagagatcttgactaagtggctca

SEQ ID NO: 12262 - DNA, 50 bp, homo sapien
aaatacttagtaaatgctaaacacartactttttggcatttctttcagca

SEQ ID NO: 12263 - DNA, 50 bp, homo sapien
atttccaaatgctgacagtagatcayatgaggcatcctaagggcaagcat

SEQ ID NO: 12264 - DNA, 50 bp, homo sapien
atcttatttagaaagagggcatgtcrgaatgagaatggatgagggtgtcc

SEQ ID NO: 12265 - DNA, 50 bp, homo sapien
catcacagcgccaaaggtaaccaacmacacgcgactcaaccctttggctc

SEQ ID NO: 12266 - DNA, 50 bp, homo sapien
ggctgcaaggaacacccagctgagayattatacgtcaggaaacaaaccca

SEQ ID NO: 12267 - DNA, 50 bp, homo sapien
caaatggactaagacatctaccttcracataatgcatgcaagctttgaga

SEQ ID NO: 12268 - DNA, 50 bp, homo sapien
atgaaaagcttataagccatccagtyaaaagtcattggttattgtgtatc

SEQ ID NO: 12269 - DNA, 50 bp, homo sapien
tattgttaaattcactcttaaccacyaagataacactttcctggccttga

SEQ ID NO: 12270 - DNA, 50 bp, homo sapien
ctgaaccaactggtcactctaattayggatacacaataaccaatgacttt

SEQ ID NO: 12271 - DNA, 50 bp, homo sapien
taaaccctgagcaaataagccagagragaaggcattttccctttgactga

SEQ ID NO: 12272 - DNA, 50 bp, homo sapien
gaacaaggagccttaactgatggagwcgtaccatacgaacagccccttta

SEQ ID NO: 12273 - DNA, 50 bp, homo sapien
tgcttatttttcaggaagacttgaaygacatctttctgtttctcacagaa

SEQ ID NO: 12274 - DNA, 50 bp, homo sapien
aatttagaatcaacaaaaccgatgaygaattatatcaaatctgtatattt

SEQ ID NO: 12275 - DNA, 50 bp, homo sapien
cagtgtatgtagtagtcccattacamgaactttctcgaattcaaagatgg

SEQ ID NO: 12276 - DNA, 50 bp, homo sapien
ttactgcctccaaatgctttcagtaygttgtttcattttattctgttaac

SEQ ID NO: 12277 - DNA, 50 bp, homo sapien
cctggaactagcagtgctgtgggacracctcatgaagggacccagtggag

SEQ ID NO: 12278 - DNA, 50 bp, homo sapien
ttttgttgagattatggtagggaaayctatgaaaaccgtcatacttaaat

SEQ ID NO: 12279 - DNA, 50 bp, homo sapien
gtatttgtgaagtcccatgagaacaraagacgatttggataggatcaggt

SEQ ID NO: 12280 - DNA, 50 bp, homo sapien
aaggaaacactgaacacactatacaygctgcaaggttcttaggccctttg

SEQ ID NO: 12281 - DNA, 50 bp, homo sapien
tcaactggtaagatctgaagtcccamctagaaaggaacacataattggat

SEQ ID NO: 12282 - DNA, 50 bp, homo sapien
cagtgggaaagcaaatatcctgacaraccagtatggaaaattctcctttc

SEQ ID NO: 12283 - DNA, 50 bp, homo sapien
agatatggaatcaaataagtgtccarctgataactaaataaaataaatgt

SEQ ID NO: 12284 - DNA, 50 bp, homo sapien
aatgaattttctcaaagtaacgttargtattggtaagatttcatttatcc

SEQ ID NO: 12285 - DNA, 50 bp, homo sapien
atagagggataactcactcattaccrcaaaaaaagggatcaaactcttca

SEQ ID NO: 12286 - DNA, 50 bp, homo sapien
ctacaaagaatttactattaatggasagaaatgagtcagtaagtaatggc

SEQ ID NO: 12287 - DNA, 50 bp, homo sapien
tgggagtcagctccacctgacggcayaggctgaatatggtgtggtgcttc

SEQ ID NO: 12288 - DNA, 50 bp, homo sapien
acagccaagataaaatgacttagaaktaatgtccaccggcaaggagggcc

SEQ ID NO: 12289 - DNA, 50 bp, homo sapien
agtcctttcacaaagggcaaaatcartccggctgtctagtttgagctttg

SEQ ID NO: 12290 - DNA, 50 bp, homo sapien
ttgaaaaacgatagacaattgcaaamacgagttgacctttttgtgttcct

SEQ ID NO: 12291 - DNA, 50 bp, homo sapien
catcctgaagtggaaaggacaagtcragcccagacctgcattagtccacc

SEQ ID NO: 12292 - DNA, 50 bp, homo sapien
gtgtcatggaagtattaaccaaagtsaaggctgtaaaatcatttcaagga

SEQ ID NO: 12293 - DNA, 50 bp, homo sapien
ttctggaatgacagccactttaagcygcaatgtaaatgttcttctttaga

SEQ ID NO: 12294 - DNA, 50 bp, homo sapien
aaatattagctgttgtggaaactcayggtgggccttaaacctcccttatt

SEQ ID NO: 12295 - DNA, 50 bp, homo sapien
atcaaattctgcaataactgaaccartagaagtagtaagaagtagtaagg

SEQ ID NO: 12296 - DNA, 50 bp, homo sapien
aaggacatacacaagagaggagctcraagagaaatttcgggtgtaaaggg

SEQ ID NO: 12297 - DNA, 50 bp, homo sapien
gaattttacttgtggcactttcctcratttatctcaaactctgaaattta

SEQ ID NO: 12298 - DNA, 50 bp, homo sapien
agtccaccctgatgacctcatctcarcttgatcacatctgcaaagatcct

SEQ ID NO: 12299 - DNA, 50 bp, homo sapien
ttcatcttgggtagaaggaagtatamacctattatgttctaggctttgac

SEQ ID NO: 12300 - DNA, 50 bp, homo sapien
gatcccaaaaccctagcctagaagakagcgaagaatctcttggctggggt

SEQ ID NO: 12301 - DNA, 50 bp, homo sapien
ctcaaaacaaaaactaaaacaaatcsagagctgtcactgcttaggcccca

SEQ ID NO: 12302 - DNA, 50 bp, homo sapien
aagcccaagctacaagaagagcccayatgtaggtttcagttgagcctagc

SEQ ID NO: 12303 - DNA, 50 bp, homo sapien
caagggcagaaagatggagtaagacyctttcttttggcttccttagcaag

SEQ ID NO: 12304 - DNA, 50 bp, homo sapien
acaacacagggattgtcccatttaaygttataaacgatcatccttcttac

SEQ ID NO: 12305 - DNA, 50 bp, homo sapien
ggaggcataatctatcgctacatctraatttataaagcagagaccattat

SEQ ID NO: 12306 - DNA, 50 bp, homo sapien
gaaaattgttgaagaattgtctgacycaaattaacacaagtttccagctt

SEQ ID NO: 12307 - DNA, 50 bp, homo sapien
tccttcaataaaattgcaaattataraatgaacatacaactatcagttcc

SEQ ID NO: 12308 - DNA, 50 bp, homo sapien
catgctgaaatcaatggtaaaggtcyatataataagcattcaaaagttca

SEQ ID NO: 12309 - DNA, 50 bp, homo sapien
tttgatttatggacctaattatcttraacatgatcaggcagggggcaagg

SEQ ID NO: 12310 - DNA, 50 bp, homo sapien
agcatcaaaaaagaatgaaatacacmggaataaatttagccaaagtggtg

SEQ ID NO: 12311 - DNA, 50 bp, homo sapien
tagggatgtgtaccttgcctgcataygaccttgggcaaatgacctaaact

SEQ ID NO: 12312 - DNA, 50 bp, homo sapien
tgacagaaatcattgcttagcttagratttgactgaagagacgcatagcc

SEQ ID NO: 12313 - DNA, 50 bp, homo sapien
agggacgctcctccacatcctataayggtcagatgccccctacaacaaag

SEQ ID NO: 12314 - DNA, 50 bp, homo sapien
ccccatacctatctttcagggagacygtatgagatagaggtgaaaagatc

SEQ ID NO: 12315 - DNA, 50 bp, homo sapien
cgaacactctgaggacttatggtgayagaaatcattgcttagcttaggat

SEQ ID NO: 12316 - DNA, 50 bp, homo sapien
gataatagggctaagaaatgtaaacmggataaagagtccttgatctcctt

SEQ ID NO: 12317 - DNA, 50 bp, homo sapien
tatcagcgttaaaatagcgatgtcaygatccgcatttcaaggcactgttt

SEQ ID NO: 12318 - DNA, 50 bp, homo sapien
gtcagcctgaatttcttgaaagctaygatagatttaatagaagattgcac

SEQ ID NO: 12319 - DNA, 50 bp, homo sapien
gataggagttcaactatgttatcaasctctgtttcatcaatagtggggct

SEQ ID NO: 12320 - DNA, 50 bp, homo sapien
gacattaacactcttcccatcccaargtgaggtctacatttcatttctct

SEQ ID NO: 12321 - DNA, 50 bp, homo sapien
gcagcagagctgggatctgaatccayatctatctgacttgggaatccaca

SEQ ID NO: 12322 - DNA, 50 bp, homo sapien
ccaagtcatcctgttctgggttcacrcaccctctggatccctcttcctgc

SEQ ID NO: 12323 - DNA, 50 bp, homo sapien
gaacagtaggatgaagaccaagggayggtagagcaagaagaaaaggagtt

SEQ ID NO: 12324 - DNA, 50 bp, homo sapien
ctattttaatattttgcctgaataaytgagttttaccttaagagagaaat

SEQ ID NO: 12325 - DNA, 50 bp, homo sapien
ttacagttaaataaattatgttaaaracaaaggtaatacatactctaaat

SEQ ID NO: 12326 - DNA, 50 bp, homo sapien
gtctgaagctagtttcagaaaaatgycagttggtgcttagctcgttggat

SEQ ID NO: 12327 - DNA, 50 bp, homo sapien
gggaagtaaactcataaaagggagcratgttgttgaactctgcctgcagg

SEQ ID NO: 12328 - DNA, 50 bp, homo sapien
catttacatgtcttaattttggtccratcatatgtcactctggaaagcca

SEQ ID NO: 12329 - DNA, 50 bp, homo sapien
accagaaacccaagcacgctggaaasagccaaccattaacgatgaccttt

SEQ ID NO: 12330 - DNA, 50 bp, homo sapien
agtgatgtagtacaggttttcatcamggtctcttgactccgaagtcatat

SEQ ID NO: 12331 - DNA, 50 bp, homo sapien
aaaaaaaagtgctctgtttaaacaayctccagtggctttataatgctact

SEQ ID NO: 12332 - DNA, 50 bp, homo sapien
caattaatgcaattaacagcaattaratagcaagtcttggcaggcagagg

SEQ ID NO: 12333 - DNA, 50 bp, homo sapien
tgccacagtggcaattcagtgaaaarttacctaatagcactgcacatata

SEQ ID NO: 12334 - DNA, 50 bp, homo sapien
cacaaaattatttgttctcgtcttgmaattatctgatttatcaactttct

SEQ ID NO: 12335 - DNA, 50 bp, homo sapien
catgctggaattagaagacataaaaragatgattgtgccccaagagagag

SEQ ID NO: 12336 - DNA, 50 bp, homo sapien
acttgctgttcataactggactgaaratttaacgtaaggctctgttgccg

SEQ ID NO: 12337 - DNA, 50 bp, homo sapien
gcctaagcgccacggctactactaaragcctcctctctttctgtctttat

SEQ ID NO: 12338 - DNA, 50 bp, homo sapien
acagggagtatataaccagcacagartatcttcttttaaagacacagcat

SEQ ID NO: 12339 - DNA, 50 bp, homo sapien
ggtttagtgtgtctccttagtggagyaatggcattgtcagtcattgacac

SEQ ID NO: 12340 - DNA, 50 bp, homo sapien
atttctgcttcacatcagactctgamaatagtgagcccattttttgtaca

SEQ ID NO: 12341 - DNA, 50 bp, homo sapien
tagctccacacaaactaattacacasagcagatctactgtgaacacaatt

SEQ ID NO: 12342 - DNA, 50 bp, homo sapien
gtatgatagggacacttgaaaattgyatagataattgccaacttgaaggc

SEQ ID NO: 12343 - DNA, 50 bp, homo sapien
cccatcctaagtagaaaatatcctargttgaagatatatttatgacatat

SEQ ID NO: 12344 - DNA, 50 bp, homo sapien
aactcctgatgcacttaagactcagratattcactagttgtaatgtagcc

SEQ ID NO: 12345 - DNA, 50 bp, homo sapien
agcacatcccagaaaacacgtggaasaaatgaatccagagatacccagaa

SEQ ID NO: 12346 - DNA, 50 bp, homo sapien
ctcttgctcttctgttgaaaatgtaygtgttcaccgggcatagcggctca

SEQ ID NO: 12347 - DNA, 50 bp, homo sapien
atgatatgatcctatgtgtgaaataygcttctaatgatcctagtctaagc

SEQ ID NO: 12348 - DNA, 50 bp, homo sapien
tttttgcccaggtttctctccttaaktccttcagttccaaaatagatgag

SEQ ID NO: 12349 - DNA, 50 bp, homo sapien
acttttatcaggcagtaaaaccaagwcaaatggaattccggtcagtgcag

SEQ ID NO: 12350 - DNA, 50 bp, homo sapien
taaataataaaggaaatgttcatgaraagtcaagattccagtgaagcttg

SEQ ID NO: 12351 - DNA, 50 bp, homo sapien
gtctgggctgtctaagaaatgtgaamggaaaatatcctgggccctttcaa

SEQ ID NO: 12352 - DNA, 50 bp, homo sapien
aagccgagaacaaagaacattattcrcaatttagagccattagtgtaagc

SEQ ID NO: 12353 - DNA, 50 bp, homo sapien
gttgtaacaattaaacttagtgaacrcagaatgcctggcatgtagcaagc

SEQ ID NO: 12354 - DNA, 50 bp, homo sapien
ttaggaagtttgggctttatctgccyggaaataggaatccatggaaggat

SEQ ID NO: 12355 - DNA, 50 bp, homo sapien
acttggaaaacgttgcccaagggacygctaatttgcatctcagctccagg

SEQ ID NO: 12356 - DNA, 50 bp, homo sapien
tcagatcacaaatgccttttggacakataagagttgctctcctaaattct

SEQ ID NO: 12357 - DNA, 50 bp, homo sapien
gttactatttttcccccataacataycggaaggatcgcttcagcctcctg

SEQ ID NO: 12358 - DNA, 50 bp, homo sapien
accatcctgtgactgagaaaacaaamaatgggataagctcacagtagcat

SEQ ID NO: 12359 - DNA, 50 bp, homo sapien
acttaatgccatgtgtctgggatacrataaatgctcaataaaatgatact

SEQ ID NO: 12360 - DNA, 50 bp, homo sapien
ttctcacttttgtaatcactggctaygttgacaataacccatgctctctc

SEQ ID NO: 12361 - DNA, 50 bp, homo sapien
tccatcctggggtcccggctgaagargcatgctctattcctggcagacta

SEQ ID NO: 12362 - DNA, 50 bp, homo sapien
tgctctctctcatatcttaaagccasgcaagtcaaatccaaattctttat

SEQ ID NO: 12363 - DNA, 50 bp, homo sapien
tcccactttctgtgagcagaagataycaatctatttcaatttgttgatat

SEQ ID NO: 12364 - DNA, 50 bp, homo sapien
agattttatatatacagttaccaaasaggagtgacagcacagtcgagtag

SEQ ID NO: 12365 - DNA, 50 bp, homo sapien
gcaacgagcagagtcaaaataattaraaaatgatgcacggcctaccacaa

SEQ ID NO: 12366 - DNA, 50 bp, homo sapien
gtttcttgagagtagaaatgaaataygtctttgtggaagccaacgcagct

SEQ ID NO: 12367 - DNA, 50 bp, homo sapien
tccttaacgggccaccctccctataygatacaccagacaaactcaaagct

SEQ ID NO: 12368 - DNA, 50 bp, homo sapien
aatccattttttcccagtggcattayggatagagaaattcctaggaaaat

SEQ ID NO: 12369 - DNA, 50 bp, homo sapien
ctgatcatgtttcccattaactcttsaaaaatatgacctccatttaaatc

SEQ ID NO: 12370 - DNA, 50 bp, homo sapien
atcttctggagcctatggtattctgyaggaactcagtcatataacacccc

SEQ ID NO: 12371 - DNA, 50 bp, homo sapien
cagtgtgaaaactgactaatacacckgacataccaaagttaaaaagaaag

SEQ ID NO: 12372 - DNA, 50 bp, homo sapien
agagaccactcttttgggtcatcaamgatagccatatccactttagtgag

SEQ ID NO: 12373 - DNA, 50 bp, homo sapien
acaggatagcaatttatagcctcgaygcagaaagaaaagggtgacacctt

SEQ ID NO: 12374 - DNA, 50 bp, homo sapien
aagaaaacatgattttgtaagaaaakagacacattggtttttagcattag

SEQ ID NO: 12375 - DNA, 50 bp, homo sapien
ctggatttggtgcatgctctatagamagcaaggctactaataaaaggtct

SEQ ID NO: 12376 - DNA, 50 bp, homo sapien
taagaaatgctgtccttctatgagayggttggtaactcccaaggaagttg

SEQ ID NO: 12377 - DNA, 50 bp, homo sapien
agctgggagtcattgaccaggctatsactattctaggctgattgttgcag

SEQ ID NO: 12378 - DNA, 50 bp, homo sapien
ctaattaccctgactggatcattacrcactgtacgcctatatcaaaatat

SEQ ID NO: 12379 - DNA, 50 bp, homo sapien
tgcatttttcctttcctaggtcccarctgttactgctgtatcactccagg

SEQ ID NO: 12380 - DNA, 50 bp, homo sapien
tcctccccgttgcaatctgggaataytaacaaatgcttatgagtccatcc

SEQ ID NO: 12381 - DNA, 50 bp, homo sapien
ttggttgggactgacctgggaagaastctatgtacttggcaggtgggcag

SEQ ID NO: 12382 - DNA, 50 bp, homo sapien
cagaaacagctgccatcctttcaaayagacataaggtgctgtattagggt

SEQ ID NO: 12383 - DNA, 50 bp, homo sapien
acgatggagaattttatatcatgtayattttcacacacacacacacacac

SEQ ID NO: 12384 - DNA, 50 bp, homo sapien
cacgaatgtgttctggagctagctckcgatgatctggaagtccccaagca

SEQ ID NO: 12385 - DNA, 50 bp, homo sapien
tgtagtggtggaagctggcctctcgratgcagaacaggaagtagcgagca

SEQ ID NO: 12386 - DNA, 50 bp, homo sapien
aatatcccatctagtaatattttgarctgcgtataggccttcgttttcaa

SEQ ID NO: 12387 - DNA, 50 bp, homo sapien
tatttgctaaataatataccatgccracattaacagtgattcttcaaact

SEQ ID NO: 12388 - DNA, 50 bp, homo sapien
aagccatttgaagcatcagacaacawtaactgcatcttgaagcatgaatc

SEQ ID NO: 12389 - DNA, 50 bp, homo sapien
taaatgacagcctgtccatgagctaygtagggctaaagccagcaggggaa

SEQ ID NO: 12390 - DNA, 50 bp, homo sapien
gcaatattggacagaaattaaattaygaccattttgaaggaaacatgagg

SEQ ID NO: 12391 - DNA, 50 bp, homo sapien
gaggacaccgtgctcagtagaacgakccaggaacacgaagttaaacgcct

SEQ ID NO: 12392 - DNA, 50 bp, homo sapien
tcatgacaatgttgccatctatagayctaatccactcataaatcattttg

SEQ ID NO: 12393 - DNA, 50 bp, homo sapien
aaatatgagtttattaatatctattkaacaggtattgggcatagattatt

SEQ ID NO: 12394 - DNA, 50 bp, homo sapien
acccttatggaaaaaagctatagaayccttccaaacagccttcctacatc

SEQ ID NO: 12395 - DNA, 50 bp, homo sapien
ttctctgccactgagggtgaattcaygcagaggaagcaaaaagattacca

SEQ ID NO: 12396 - DNA, 50 bp, homo sapien
tcacagcaggttcagagaggcatgasagcaccctcagtcacagccagagc

SEQ ID NO: 12397 - DNA, 50 bp, homo sapien
gtctggcaaggagtaaatatccaacraatgttcgcaatcggggcgatgtt

SEQ ID NO: 12398 - DNA, 50 bp, homo sapien
gtaggacccattcacagagagggaargagttaaagcataatgtcacagcc

SEQ ID NO: 12399 - DNA, 50 bp, homo sapien
tctgaaagtagatttctaagcaaaaygctctctatctctgcccaaaggcc

SEQ ID NO: 12400 - DNA, 50 bp, homo sapien
gtaatttgttatagcagctggagccractaacacactcatcataagaaaa

SEQ ID NO: 12401 - DNA, 50 bp, homo sapien
ataatgctgtgactttgtattagccrggagtcctgaattatcaaaagatt

SEQ ID NO: 12402 - DNA, 50 bp, homo sapien
aacagacaaaaatcatgtcttcgtcraaatgtattggaggagctgaagaa

SEQ ID NO: 12403 - DNA, 50 bp, homo sapien
atgacagttttaggataaaggggaaratagtatcaatgcggtatatattc

SEQ ID NO: 12404 - DNA, 50 bp, homo sapien
atacctggttccatgggaactacaawgatgttattttccaagcaacttta

SEQ ID NO: 12405 - DNA, 50 bp, homo sapien
tttcattcaaaatttttcctgtttcwattaatcaccttctaccctttacc

SEQ ID NO: 12406 - DNA, 50 bp, homo sapien
gacctctgtgactcttaacgagagakgaatagatacaaaaagtcttataa

SEQ ID NO: 12407 - DNA, 50 bp, homo sapien
attgtgtgtgttttccttgacatgartaaccaagagtcggctccttcagg

SEQ ID NO: 12408 - DNA, 50 bp, homo sapien
ttagaccttagacatccttaatagcyagacttagtacataatgtggtatt

SEQ ID NO: 12409 - DNA, 50 bp, homo sapien
tttctgatgactgcttttgagatgasaatgtttgtgtgtatgtgaaagcc

SEQ ID NO: 12410 - DNA, 50 bp, homo sapien
tcactttaaactgcacattgcatacyggagacctacacacaagagaaata

SEQ ID NO: 12411 - DNA, 50 bp, homo sapien
actcaccttccaggatctcaggcgargtccccagttgaaacaggaaaaat

SEQ ID NO: 12412 - DNA, 50 bp, homo sapien
ttcaaaaatacagaaacaaggctaartattccatatataaagatctccta

SEQ ID NO: 12413 - DNA, 50 bp, homo sapien
cattgagcttatgtcaggcactgtaratgcaaaaatagctaagacctcat

SEQ ID NO: 12414 - DNA, 50 bp, homo sapien
aaacaaaaacctgtcacacgaaatckaatttgatcattcagtggaagttc

SEQ ID NO: 12415 - DNA, 50 bp, homo sapien
accatataatgtaaagtgtaaagacygtatgatggtatactttcattttc

SEQ ID NO: 12416 - DNA, 50 bp, homo sapien
ggaatgtgcagcaagtaaatacccayattctgccaagggagaagaaaagc

SEQ ID NO: 12417 - DNA, 50 bp, homo sapien
ttttgtgtcaggatatttatcatgckctcatgtcatcatttcagagttta

SEQ ID NO: 12418 - DNA, 50 bp, homo sapien
tgaaaaatgtgtagtaaccttcctasaaagtagccattgagatcatggac

SEQ ID NO: 12419 - DNA, 50 bp, homo sapien
caaacagatcgtatcaaagaatgaasagaagagacgttatatacctgtct

SEQ ID NO: 12420 - DNA, 50 bp, homo sapien
aacttgtagtactaattcaaaattaygatctgtttgaatatttgttttgt

SEQ ID NO: 12421 - DNA, 50 bp, homo sapien
atgtggctaagagttagagtcatagraagatcctcttgacaaaatgctaa

SEQ ID NO: 12422 - DNA, 50 bp, homo sapien
tctacctaaatctgcagcttccagaragaagagatgttataactatcagg

SEQ ID NO: 12423 - DNA, 50 bp, homo sapien
taggaagagttgtacagctgttgccrctgattccaggacctttttagcac

SEQ ID NO: 12424 - DNA, 50 bp, homo sapien
agaaaagagactctcttgttatactwactggagaacaagtgttataggtt

SEQ ID NO: 12425 - DNA, 50 bp, homo sapien
tatgactaaattcatgggaagtggaygatacaactttttaagctttatta

SEQ ID NO: 12426 - DNA, 50 bp, homo sapien
agctcagtagtcgacaccattgtacraaattctttctcttgaattagtgc

SEQ ID NO: 12427 - DNA, 50 bp, homo sapien
agaaaccaactagctggagaggtagratgcatgctctgagtacttaacaa

SEQ ID NO: 12428 - DNA, 50 bp, homo sapien
ctactgctgccttcaacagtggaaamggtggggagaaggaggcagcaccc

SEQ ID NO: 12429 - DNA, 50 bp, homo sapien
tatggaaatataaaatcataactttsaaacaatgggttgatagtttaggt

SEQ ID NO: 12430 - DNA, 50 bp, homo sapien
tttggttggatttgggatccaaccartgagacactctggcagaagacgga

SEQ ID NO: 12431 - DNA, 50 bp, homo sapien
aaactcttttgaggagcggaatgtaygtgtatatgcatgcacacgtgcct

SEQ ID NO: 12432 - DNA, 50 bp, homo sapien
tggaagctctgaggactatagagacrcaaaaaggcagaaactggaaaaga

SEQ ID NO: 12433 - DNA, 50 bp, homo sapien
agtatagtgtgcatacagatgcataytaagtgttaaacaatatcaagaag

SEQ ID NO: 12434 - DNA, 50 bp, homo sapien
gttttccctatattctgactaacaaytgaatgcatgatagaaaagcaatt

SEQ ID NO: 12435 - DNA, 50 bp, homo sapien
aactgtcttcttcatagaaacttacrgaagtcctcagagtgtttctattg

SEQ ID NO: 12436 - DNA, 50 bp, homo sapien
gggccataacagaaaacatactgacraggaaagatgttcacagtatacag

SEQ ID NO: 12437 - DNA, 50 bp, homo sapien
caaaaaatagcatgaacattcaaaayagtaggcaaaacacactggggagt

SEQ ID NO: 12438 - DNA, 50 bp, homo sapien
atacactagcttacaaaacagtttayaacaattaggagcatgcttattaa

SEQ ID NO: 12439 - DNA, 50 bp, homo sapien
cagcatgaccttctttactccaaccmattgggatcagattatgtgaccag

SEQ ID NO: 12440 - DNA, 50 bp, homo sapien
aacagggacagctgaggagtgacaartcgaaatgaggcttgtagaaaaat

SEQ ID NO: 12441 - DNA, 50 bp, homo sapien
gataatcttgcgagtgtcagggaaaytttaacgaggtgatctcctgcttc

SEQ ID NO: 12442 - DNA, 50 bp, homo sapien
gctttattacgttgagtccagagtaktacgttctgtagtgctagtttagc

SEQ ID NO: 12443 - DNA, 50 bp, homo sapien
gaatacatatcacaggaatatatacratacatagcagaagattatatata

SEQ ID NO: 12444 - DNA, 50 bp, homo sapien
aatatccatctctaataactaaaacrgtctgtgtgcaaagatgctttgtg

SEQ ID NO: 12445 - DNA, 50 bp, homo sapien
gggccttactatgtcatctatgaatyacctgtgcataaaaaataattgct

SEQ ID NO: 12446 - DNA, 50 bp, homo sapien
ggaaagatatttgcaagtagttattmaacagtgacaaaatgacaaacctg

SEQ ID NO: 12447 - DNA, 32 bp, homo sapien
gtgatcagtgtcaaaayacgttgaattcagtg

SEQ ID NO: 12448 - DNA, 50 bp, homo sapien
gccgaggcatcctacagatgaatgawctaattgaacctgatggcccagta

SEQ ID NO: 12449 - DNA, 50 bp, homo sapien
actttcaatgaatggcttatatgtamcgaaaatgtcctaattacttcagt

SEQ ID NO: 12450 - DNA, 50 bp, homo sapien
aaattctaaatcgaaatgtatcacaygtcttagaacggatctccaaccca

SEQ ID NO: 12451 - DNA, 50 bp, homo sapien
acaactcataaacttcacaaggtaartacaaaccagctgcagagaaatac

SEQ ID NO: 12452 - DNA, 50 bp, homo sapien
aagtcatcagatccaaccttgtactsactttcagaatctcctgatccatc

SEQ ID NO: 12453 - DNA, 50 bp, homo sapien
ccttttttttccaatttgtggcaacrgcattatcttatagcctagactgc

SEQ ID NO: 12454 - DNA, 50 bp, homo sapien
tatctctcttaatttttctgaaccayacatattagtgagatttgcaatgc

SEQ ID NO: 12455 - DNA, 50 bp, homo sapien
gaggatgactgagacttagtccgtamcctgaaataaagagattgaaagat

SEQ ID NO: 12456 - DNA, 50 bp, homo sapien
tttaggtctcagttgatgggccacartataaggtctttattcttgatgat

SEQ ID NO: 12457 - DNA, 50 bp, homo sapien
accacacaggcttaaaagaatcccasataactttggctgatagaacttgt

SEQ ID NO: 12458 - DNA, 50 bp, homo sapien
gaatcaaagaaaatgcattgcttcaraaaagtaggacagaggaaagacac

SEQ ID NO: 12459 - DNA, 50 bp, homo sapien
tagctcatcaaaaatgatcacattcmatcatatttctgccaagtcaccag

SEQ ID NO: 12460 - DNA, 50 bp, homo sapien
taagtaaaagcagaggtgcatactaraataaaatggcagaaaaaaaggct

SEQ ID NO: 12461 - DNA, 50 bp, homo sapien
attaaaaaaatactaagaacttatasctaggcaattttagaaacctactt

SEQ ID NO: 12462 - DNA, 50 bp, homo sapien
atcatcttcagaggatgtcccaataygttgaactgagatgccttcctgtt

SEQ ID NO: 12463 - DNA, 50 bp, homo sapien
aaaaaccacccacacacccgatcccratgtttaaataacaagccactggt

SEQ ID NO: 12464 - DNA, 50 bp, homo sapien
aatcatatcatttcccatatttttaraagacattcctgcacagcatttgc

SEQ ID NO: 12465 - DNA, 50 bp, homo sapien
agatggatccatgctgttgcacatayctgtaattcattctttttagtttt

SEQ ID NO: 12466 - DNA, 50 bp, homo sapien
agccagcccagccagaggtactgccsaaggacttgttctccaaagcttcc

SEQ ID NO: 12467 - DNA, 50 bp, homo sapien
gttcaatccattttccaaagacagargtatgattccaacccaggccatgt

SEQ ID NO: 12468 - DNA, 50 bp, homo sapien
ggatgatgcataactcgagatgtcasaaaataaggaacgaaaaggcaaat

SEQ ID NO: 12469 - DNA, 50 bp, homo sapien
ttaattgtagagtttgcacatctcamatatctgaatagcattatcaagtt

SEQ ID NO: 12470 - DNA, 50 bp, homo sapien
tctactatcatttgggatcacaggawcatgggtatacaaatggcaccaag

SEQ ID NO: 12471 - DNA, 50 bp, homo sapien
tggttttacagagggaagtgataaargatgatgtctatcctcaagaaaat

SEQ ID NO: 12472 - DNA, 50 bp, homo sapien
atggtattgagctgtctggtctatayggaagaataggtgtctatattctt

SEQ ID NO: 12473 - DNA, 50 bp, homo sapien
atcagggcttctgaggatatctgctyacatatattcctcattcacataac

SEQ ID NO: 12474 - DNA, 50 bp, homo sapien
aaggattacttatctttagaaaatcmatacacaggctatggaagcattta

SEQ ID NO: 12475 - DNA, 50 bp, homo sapien
gttagagagaacatgtagctaatcayctatgtctccactgtgtgataccc

SEQ ID NO: 12476 - DNA, 50 bp, homo sapien
agcagactcatattgaacttctccargaggaatttactaccacacttaag

SEQ ID NO: 12477 - DNA, 50 bp, homo sapien
aaaaaaagtagaagagatttgaacaygtctatataaaaaggaaaaaagaa

SEQ ID NO: 12478 - DNA, 50 bp, homo sapien
ggtgaaaaccgttcttttgtaagcakgtatttaaaactgttctggcatta

SEQ ID NO: 12479 - DNA, 50 bp, homo sapien
attgaaagcttattatgtgtcactaycttgtacctcttaaaattactgaa

SEQ ID NO: 12480 - DNA, 50 bp, homo sapien
ttttccatttaatattttcagaccaygggtgactctgggtaactgagacc

SEQ ID NO: 12481 - DNA, 50 bp, homo sapien
cttgtagtaaatatacagaacaaaaygtaccatcttaaccatgtttaagt

SEQ ID NO: 12482 - DNA, 50 bp, homo sapien
gaatttacactgcaaagaaaaactaygaatgtatggaattttttaaaaag

SEQ ID NO: 12483 - DNA, 50 bp, homo sapien
ttaatacatagggtggctttctaackgaagatcatttaaatgtaaacaca

SEQ ID NO: 12484 - DNA, 50 bp, homo sapien
tatctgggaaaatattcctcagttayatgattgttaaaatgaaactttac

SEQ ID NO: 12485 - DNA, 50 bp, homo sapien
agcatctcgaagggcatatattcaawacgttaaatagacgttctgcgggg

SEQ ID NO: 12486 - DNA, 50 bp, homo sapien
tgatggatttgatatcgtatattacygctgtgcactttcattttccatgt

SEQ ID NO: 12487 - DNA, 50 bp, homo sapien
tgaatttcaatccgaagaagcctcastaccagtcaaggttggaggagggc

SEQ ID NO: 12488 - DNA, 50 bp, homo sapien
gagaagagactatttaaagattaagyctcatagcatcatcactaaaggtt

SEQ ID NO: 12489 - DNA, 50 bp, homo sapien
tatgggtaacgaagatacagcagaartaaaacagactgaagtccctgacc

SEQ ID NO: 12490 - DNA, 50 bp, homo sapien
aaagtgcttttgaggtaaaatgaaaytgacgggtctcgactctcagggcc

SEQ ID NO: 12491 - DNA, 50 bp, homo sapien
tatgaaaaagcatgagccattaaatractaaaacagatttatctaaacac

SEQ ID NO: 12492 - DNA, 50 bp, homo sapien
aacttcatgagaataacaaatgaagsagtcgagcaactggaagctaaagt

SEQ ID NO: 12493 - DNA, 50 bp, homo sapien
tgtgtagaagaccataccatacagcratttgtttaattacaaaatactgg

SEQ ID NO: 12494 - DNA, 50 bp, homo sapien
ttctgtaatgcaagggagaatcaaaytttaacagtatacatcctgttcag

SEQ ID NO: 12495 - DNA, 50 bp, homo sapien
ggtgtgaagcacaggctttacatccrgcacaatgccaatttattttagtc

SEQ ID NO: 12496 - DNA, 50 bp, homo sapien
aagaagtgcacatgtccaatcaagartattaaggaagagtgaattggaga

SEQ ID NO: 12497 - DNA, 50 bp, homo sapien
tatgaggatcaagcattgggtgtcawctctaaatatgaggccaccaccat

SEQ ID NO: 12498 - DNA, 50 bp, homo sapien
gatggcctctgtgcaaatctgtcgayaacttctcttctactcttttgtca

SEQ ID NO: 12499 - DNA, 50 bp, homo sapien
ggtaactgcttcatctttaaccacawcctttctagaagttaccaggctat

SEQ ID NO: 12500 - DNA, 50 bp, homo sapien
ttaattgtaatatttggtctactcaygattaatccaattgctgatatatt

SEQ ID NO: 12501 - DNA, 50 bp, homo sapien
caaaaaacagccgggaacagcacaakttgtatctgccatggtgaacagag

SEQ ID NO: 12502 - DNA, 50 bp, homo sapien
ggagagattgcggtggaattaggtaygagggatggagaatctctttcctc

SEQ ID NO: 12503 - DNA, 50 bp, homo sapien
gagattgtgaaaggttaagctgtcargtaaatgggaatgcactgagatgg

SEQ ID NO: 12504 - DNA, 50 bp, homo sapien
ttactgccatctctatttcacatccrctggagaatacagctttcccaaaa

SEQ ID NO: 12505 - DNA, 50 bp, homo sapien
cacaggtactatactaagtgttatcyaggcttatgttatgtaattttccc

SEQ ID NO: 12506 - DNA, 50 bp, homo sapien
attccagatattttattgtactatamaaattctattacaagcatagaaga

SEQ ID NO: 12507 - DNA, 50 bp, homo sapien
cttcagttcttcaatgtaattttcawagtattcacttgcatcttcagagg

SEQ ID NO: 12508 - DNA, 50 bp, homo sapien
tctggaattttattccgacctatgaygttaagacttcaaatctatggttg

SEQ ID NO: 12509 - DNA, 50 bp, homo sapien
agttttttaaaccatgatggactacrgtaacaataaattgcattttttag

SEQ ID NO: 12510 - DNA, 50 bp, homo sapien
cttttaagattgcagttttatttcamgagctctgtaacccatattttctc

SEQ ID NO: 12511 - DNA, 50 bp, homo sapien
gaaggagggcacctcagaagccctcrataaaaacagggaggaagagaaca

SEQ ID NO: 12512 - DNA, 50 bp, homo sapien
aaggttagaacaaagttggtgatgamagtcagggcaaatgttcagaaatg

SEQ ID NO: 12513 - DNA, 50 bp, homo sapien
ttaaagatcccccaaaatgtgactasataaaattgatcatgcacaatcca

SEQ ID NO: 12514 - DNA, 50 bp, homo sapien
catggtactttttataatggaaatcrgatcagattattgtggtttagaaa

SEQ ID NO: 12515 - DNA, 50 bp, homo sapien
gttcagaaatggactgaatcccagaragaaagtttgaatggtgctaaaag

SEQ ID NO: 12516 - DNA, 50 bp, homo sapien
aatctattattctaaagcacagttcyatttgcttaagaatatgtaaatat

SEQ ID NO: 12517 - DNA, 50 bp, homo sapien
gggaacttgcacttttagcaaaagamcactgtgagtttgcaggaaacaga

SEQ ID NO: 12518 - DNA, 50 bp, homo sapien
cctagaaagttcattgagccattackgctgatgcattatttacttagcag

SEQ ID NO: 12519 - DNA, 50 bp, homo sapien
taagagaacaaccaaaccctctgagraagctgcatgatcttacagtggca

SEQ ID NO: 12520 - DNA, 50 bp, homo sapien
tgagatggacgcctccagggacttaygagagcaggaacataggtacacag

SEQ ID NO: 12521 - DNA, 50 bp, homo sapien
gatatgctttctggaaggataaaacraatacatatgggaaaaagtacttg

SEQ ID NO: 12522 - DNA, 50 bp, homo sapien
aaagctgtaaattacttgtgaaaaaytagtatagattattcatttgtaag

SEQ ID NO: 12523 - DNA, 50 bp, homo sapien
gatattaaattcctaaaaactggcakgaaatatctgttgaaggtgagagg

SEQ ID NO: 12524 - DNA, 50 bp, homo sapien
atgcaagggaactaagagggaactcraatccagtgtaaggcatatcaaat

SEQ ID NO: 12525 - DNA, 50 bp, homo sapien
cacgcgattcacaaatcaggatgcamgttagttatactttctgcaaccct

SEQ ID NO: 12526 - DNA, 50 bp, homo sapien
agaactggtttcatcaaggtagttastaaattcagcgacatgaaggaaag

SEQ ID NO: 12527 - DNA, 50 bp, homo sapien
ttgctttactgtgagtgaattggggmagtttgcttatctagaagcagctt

SEQ ID NO: 12528 - DNA, 50 bp, homo sapien
atttcagtcctgtgaattattcttcscaaacagtgtttaagagcctttca

SEQ ID NO: 12529 - DNA, 50 bp, homo sapien
gtatttagcattgcagccagcaagartcagtgcacagtgaaatttttaat

SEQ ID NO: 12530 - DNA, 50 bp, homo sapien
cactgagtgaaatcaattgctttaarctataatgtgatgcaactatgtga

SEQ ID NO: 12531 - DNA, 50 bp, homo sapien
ttgcagacctcaggacggcccatgaygcacgggtaccacagaggaccctg

SEQ ID NO: 12532 - DNA, 50 bp, homo sapien
atttttgtgcatggtgtgagctagamctccaagtttatttaaaatgttca

SEQ ID NO: 12533 - DNA, 50 bp, homo sapien
ttggacaagtgacttaaatatctaawtacaaatcaaatagcattttccta

SEQ ID NO: 12534 - DNA, 50 bp, homo sapien
tgccttgctgaaagtctttggcccartctctcgacagtcacaccctgcag

SEQ ID NO: 12535 - DNA, 50 bp, homo sapien
gttaaactttaaaaataaattctcaractacgagatagatatatatattt

SEQ ID NO: 12536 - DNA, 50 bp, homo sapien
acctccaaacaccaaagataattaaygtcaccaaatctaaagatgaactc

SEQ ID NO: 12537 - DNA, 50 bp, homo sapien
taaaagagatttggggtttgagcccragtagcttaaggtaggtccttcaa

SEQ ID NO: 12538 - DNA, 50 bp, homo sapien
atttctagcttttgcctacataaacragagagtaatacaagcaaaatggt

SEQ ID NO: 12539 - DNA, 50 bp, homo sapien
cttctctggcaggccgcagggagtcracatactttctggtgagtttaaag

SEQ ID NO: 12540 - DNA, 50 bp, homo sapien
ctgggtctgggtctgggcctggccaytaaggaagccacaccttttgtgct

SEQ ID NO: 12541 - DNA, 50 bp, homo sapien
ttttttcttttacttatatgcaaaamctataatttgagaattggtggttt

SEQ ID NO: 12542 - DNA, 50 bp, homo sapien
cgtttctttcctgaggatctaagtgracccatcatcccagctggccatct

SEQ ID NO: 12543 - DNA, 50 bp, homo sapien
caggcccattgaggcttatttaatcraacttctcactgaagactctgcag

SEQ ID NO: 12544 - DNA, 50 bp, homo sapien
tgaaatccttaggcttaacctccacyaaaggtctcatattacctgcaact

SEQ ID NO: 12545 - DNA, 50 bp, homo sapien
agttagagactcctcagatctcttaygctttgggaccactttcttggttc

SEQ ID NO: 12546 - DNA, 50 bp, homo sapien
tgcataatggaaagaataacttagcraacagtatctgttacataccaggc

SEQ ID NO: 12547 - DNA, 50 bp, homo sapien
ttcctcttctacttgactgaaaatawgagagggcataaagttctaggata

SEQ ID NO: 12548 - DNA, 50 bp, homo sapien
ttgaactcactgactcggcacgcacygtagcaaaggtttgcacagaaact

SEQ ID NO: 12549 - DNA, 50 bp, homo sapien
ctagaagtgataaaccagcctcgtgyatggatgttacagtactcattacc

SEQ ID NO: 12550 - DNA, 50 bp, homo sapien
ctaaacgtttttagactttaaaaaaytagttactagagtgaactttctgc

SEQ ID NO: 12551 - DNA, 50 bp, homo sapien
agttgtcatgtattaatttagaaaaygcaaagaaagaactcataacttca

SEQ ID NO: 12552 - DNA, 50 bp, homo sapien
tcataacttgttttgaactcatcaaycaagcgaactgaattccaaagagg

SEQ ID NO: 12553 - DNA, 50 bp, homo sapien
caacaattctgaggcctagtcactaraacaacttataatgcagacacttc

SEQ ID NO: 12554 - DNA, 50 bp, homo sapien
catacatattttgagcagtattttayattttccagatttagggaaagaaa

SEQ ID NO: 12555 - DNA, 50 bp, homo sapien
tagatacatttttttctgataactaygcagagatcctctcaacatcccca

SEQ ID NO: 12556 - DNA, 50 bp, homo sapien
aatctgtaaaacaaggtcattagatkaaatatgttataaagtgaaacaat

SEQ ID NO: 12557 - DNA, 50 bp, homo sapien
ttcatcctttgctctcattctgtaartcatagaaaagtttgaaacattct

SEQ ID NO: 12558 - DNA, 50 bp, homo sapien
gggaaattgcccctctatttctctarggttcttcttgttactccctcccc

SEQ ID NO: 12559 - DNA, 50 bp, homo sapien
aggttgatgaatgtttgcagcatacracttcaagattgcagcaaaggtta

SEQ ID NO: 12560 - DNA, 50 bp, homo sapien
ctgctatgaacctgttgcccctttcsatcgtgtatttatgtaggtttatc

SEQ ID NO: 12561 - DNA, 50 bp, homo sapien
attaggggcaataattcttatccagwcatgggagccagtgaatttaattt

SEQ ID NO: 12562 - DNA, 50 bp, homo sapien
cactgtaatcaccaaccacgttctcycagggcactacagagtaggtatta

SEQ ID NO: 12563 - DNA, 50 bp, homo sapien
ttttaacaaaaatgtcaagtctttayagttgtaatatcaccatgtttccc

SEQ ID NO: 12564 - DNA, 50 bp, homo sapien
caagataaagcaaaatggagttatayattgtttaggcatatgtgtttatg

SEQ ID NO: 12565 - DNA, 50 bp, homo sapien
agctttgtttaatttcccttttaaaytacaatcacgtctttataggtgta

SEQ ID NO: 12566 - DNA, 50 bp, homo sapien
tactttctaatttctagttaccttgwatagcatcatttgaataatgaatt

SEQ ID NO: 12567 - DNA, 50 bp, homo sapien
ctcctagaaaaaatatagaaaaaacrctttatgatattggtgttggcaat

SEQ ID NO: 12568 - DNA, 50 bp, homo sapien
atatgaaacagcaagttataaaatartatgatcaagtttcatgtaaagca

SEQ ID NO: 12569 - DNA, 50 bp, homo sapien
gtgaaacataacttctgtaataagcrcatgttaaagcaaatatgcctcac

SEQ ID NO: 12570 - DNA, 50 bp, homo sapien
actctttgggccgcgctatcactagsaaatctggagaagatccctgactg

SEQ ID NO: 12571 - DNA, 50 bp, homo sapien
gttaattcaattaagaatttttcacwctggacaacggtaaagacttgata

SEQ ID NO: 12572 - DNA, 50 bp, homo sapien
agctgccacagaagtaacttgacacrgagaaatagatttcctaaattcta

SEQ ID NO: 12573 - DNA, 50 bp, homo sapien
gcattgtgatattaactttcctttayagactccacataatgcatcatgag

SEQ ID NO: 12574 - DNA, 50 bp, homo sapien
tgtcctgaccttacacatttgacccrcagctttagggatttcatggacaa

SEQ ID NO: 12575 - DNA, 50 bp, homo sapien
gcttttagagtatgtgttcttttaaytgataagatggtactattctcatg

SEQ ID NO: 12576 - DNA, 50 bp, homo sapien
taaagaactgcctaacattgatggtraaattacttctccctcaaagttta

SEQ ID NO: 12577 - DNA, 50 bp, homo sapien
gccgtgtgtgtgcacggagggcaaaygctgtcttccaggttactgtggaa

SEQ ID NO: 12578 - DNA, 50 bp, homo sapien
atactcctgttcctcagttggttcamgataaaaacactgaagatttacat

SEQ ID NO: 12579 - DNA, 50 bp, homo sapien
aatggagcttttgtccaccaaagacrcagtactagctgtgagcccacggg

SEQ ID NO: 12580 - DNA, 50 bp, homo sapien
ctgttccatttattacatctgtataraaattactccaagatgaagtggct

SEQ ID NO: 12581 - DNA, 50 bp, homo sapien
tcagtgtcccctctgtggcttcctcratataaatgggtacataaatgcac

SEQ ID NO: 12582 - DNA, 50 bp, homo sapien
taatttcaagttattaattgaaaaaygaactagcaattttgtacctgctg

SEQ ID NO: 12583 - DNA, 50 bp, homo sapien
tcctccatgaacccgtctcaaacaayagtgctcccttctctcctgacaga

SEQ ID NO: 12584 - DNA, 50 bp, homo sapien
tgtcagagcgctgtgagtaacaacayggcacgactataaaatagcgagaa

SEQ ID NO: 12585 - DNA, 50 bp, homo sapien
acctataatcattgcatctttcacaraacaaatgacatgtcaacactaaa

SEQ ID NO: 12586 - DNA, 50 bp, homo sapien
attatgttaatttgataaagaccccmatagagaaatacataagctgtaat

SEQ ID NO: 12587 - DNA, 50 bp, homo sapien
aacatgagatccaagtgggaacgcaragccaaaccatgtcagtgtgaatc

SEQ ID NO: 12588 - DNA, 50 bp, homo sapien
aaaccaattagtgtgtctaaagacaktcaaaatgaggactgaaacttgtt

SEQ ID NO: 12589 - DNA, 50 bp, homo sapien
taaagttactgcctatttttgtgtartaatgtttgttttgctttgttttc

SEQ ID NO: 12590 - DNA, 50 bp, homo sapien
aaatcaagagagtgatttaaaggtgkaatcaccatgagaaagcactcagc

SEQ ID NO: 12591 - DNA, 50 bp, homo sapien
agccaataatctcacttcaaatagaytaccttagagagaatgctggaatt

SEQ ID NO: 12592 - DNA, 50 bp, homo sapien
atcgcggctaacttggagggtttaaratggcacctctttgctttgtctgg

SEQ ID NO: 12593 - DNA, 50 bp, homo sapien
tacattaaatacataacatacacaawattttcctgggggttttaccttta

SEQ ID NO: 12594 - DNA, 50 bp, homo sapien
gccatcttaaaccctccaagttagcygcgatctgtaaaaaaggatgatgc

SEQ ID NO: 12595 - DNA, 50 bp, homo sapien
actctaatacaagtgaggttctaaamttcacacaccctctgtccatccat

SEQ ID NO: 12596 - DNA, 50 bp, homo sapien
attttagagtcatagagacctaaaayctccatcttctgtatttgacccga

SEQ ID NO: 12597 - DNA, 50 bp, homo sapien
actggggcaaatatagagaagttaargaatgttcccaagaatgatggctg

SEQ ID NO: 12598 - DNA, 50 bp, homo sapien
gggaaccagcgtgtggttagccaaayaacagttagttcttcttcctgttg

SEQ ID NO: 12599 - DNA, 50 bp, homo sapien
gtcgacagatacctcatacagtagcratctggctggcatcaggccagtga

SEQ ID NO: 12600 - DNA, 50 bp, homo sapien
gtggtccctctccctaagaaacacartgatgcagtcctgcttggggtgtg

SEQ ID NO: 12601 - DNA, 50 bp, homo sapien
aaaggattgaaaccaaggtaagtgcmattttctcagcagtggtgattcca

SEQ ID NO: 12602 - DNA, 50 bp, homo sapien
caaataaaaacggtatgaaggcataytaaattttggctgatacttccctt

SEQ ID NO: 12603 - DNA, 50 bp, homo sapien
tccaagaattaattgaaatgatttayaggttaaactacatgaaactgttg

SEQ ID NO: 12604 - DNA, 50 bp, homo sapien
tatgctgtatgggaactaaataatgratacaactcccacccctaatttag

SEQ ID NO: 12605 - DNA, 50 bp, homo sapien
gtgaatgatgtttaagactcttgaayaaaagcacgtagagaatatttcct

SEQ ID NO: 12606 - DNA, 50 bp, homo sapien
ttttattggtacgtagctttggacaygtggctcactacagataaataaag

SEQ ID NO: 12607 - DNA, 50 bp, homo sapien
ggtaacgtttaaatgtctgctgctayggaagcaagaaaattcactccctg

SEQ ID NO: 12608 - DNA, 50 bp, homo sapien
aagctcttctagttcattaatcatartaatccaaatggttcaaacttact

SEQ ID NO: 12609 - DNA, 50 bp, homo sapien
ataaggctttcttgctgcattaagasagaaaaaggcataagagatttcag

SEQ ID NO: 12610 - DNA, 50 bp, homo sapien
acctccagtgccaccgagagccctayggtttacaggcaggtgttccctgg

SEQ ID NO: 12611 - DNA, 50 bp, homo sapien
caaaacaaactaaattaggcaatacraagtggtccctcttcatccgtgtt

SEQ ID NO: 12612 - DNA, 50 bp, homo sapien
ggaaaagccaactcagtcatttttgmaactaggtatttctgtaatcttag

SEQ ID NO: 12613 - DNA, 50 bp, homo sapien
tgtgcatgtttaaacttcataagaayggtacctaataatgcttattctgc

SEQ ID NO: 12614 - DNA, 50 bp, homo sapien
aaatagaaacattcagttttagctckaagtcttgcactagcttttgctta

SEQ ID NO: 12615 - DNA, 50 bp, homo sapien
acaattaggtctcttcataagtcaascattgcatcgagtttcagggttag

SEQ ID NO: 12616 - DNA, 50 bp, homo sapien
cttataaattcttgtgttaatatccrgcagttaacagtacatcctcctga

SEQ ID NO: 12617 - DNA, 50 bp, homo sapien
aggaatctgggattctgatgttgcartagctaaccctgaaactcgatgca

SEQ ID NO: 12618 - DNA, 50 bp, homo sapien
gcagggtcttgtttcattcctgatayaagtaacctgtgtatttccctttt

SEQ ID NO: 12619 - DNA, 50 bp, homo sapien
tgatccacctgcttaatatggtcaartaaagtctagaacagggcctttct

SEQ ID NO: 12620 - DNA, 50 bp, homo sapien
aagcgagttctccaatacacagaatwaatgttgcttctctagtattgaaa

SEQ ID NO: 12621 - DNA, 50 bp, homo sapien
gaatcctaggtaacagacatacaatraaacctcattagaacatcagaaaa

SEQ ID NO: 12622 - DNA, 50 bp, homo sapien
atatctttattcttattcaacacaakgttaacggtggaggcacctataat

SEQ ID NO: 12623 - DNA, 50 bp, homo sapien
tttgtctctctgtaggataggaagamgctgaggcccatgagactatagta

SEQ ID NO: 12624 - DNA, 50 bp, homo sapien
aataaagatgtgtccaataaacagastactaactagccttatggatgacc

SEQ ID NO: 12625 - DNA, 50 bp, homo sapien
gtggcccagtgcatggaaagctgcckactgggcgtcccaagacaggataa

SEQ ID NO: 12626 - DNA, 50 bp, homo sapien
agatccccttgacacagtaagatacrccttggcccttgataggcttatga

SEQ ID NO: 12627 - DNA, 50 bp, homo sapien
cctggctttgctcatttattaagacwatctgggttgcactgtgattttgg

SEQ ID NO: 12628 - DNA, 50 bp, homo sapien
aacagagagaagtaaaacattattasaatcactttatcccttcaagaact

SEQ ID NO: 12629 - DNA, 50 bp, homo sapien
ctgttttgtctactgtatatatcaaraatattagaatttatatctatcta

SEQ ID NO: 12630 - DNA, 50 bp, homo sapien
cttgcgggatctccagggtcatcagractaaatgactcaagctgaaatga

SEQ ID NO: 12631 - DNA, 50 bp, homo sapien
aaatgcccatctcacatatgcagaaygtctaggcggcagaggcaaacaag

SEQ ID NO: 12632 - DNA, 50 bp, homo sapien
acatcacaaatgtttgggaaacagakgaatcagcaatgtttctgttacac

SEQ ID NO: 12633 - DNA, 50 bp, homo sapien
tgtaaaatggccacggccattcccargttacctacacaggtcttaaatgt

SEQ ID NO: 12634 - DNA, 50 bp, homo sapien
taattaggttccagttacatactgaraatgaacaatatctaaagcttagc

SEQ ID NO: 12635 - DNA, 50 bp, homo sapien
gaaaaaacagcataccttggaatcaratcctttcaattccacttcatggt

SEQ ID NO: 12636 - DNA, 50 bp, homo sapien
tgatttcattgaacttagagcaaccragaacaagaactgggtttcgtggc

SEQ ID NO: 12637 - DNA, 50 bp, homo sapien
tcactgtggtatagtgagtagtacayagtgctttctcttctgtttgttgg

SEQ ID NO: 12638 - DNA, 50 bp, homo sapien
caggctagggactttttgacaatacrctttccttaaaactgtaactagtt

SEQ ID NO: 12639 - DNA, 50 bp, homo sapien
gctctgggagttctgcattaacaaasgagatggaaattagtggttctgag

SEQ ID NO: 12640 - DNA, 50 bp, homo sapien
tgccaattttttttctttggaagaaygcaagtctttaagttgtctaaaat

SEQ ID NO: 12641 - DNA, 50 bp, homo sapien
tttaccaaacagacgtaggacttaakagacccagaaaatgttcagatttc

SEQ ID NO: 12642 - DNA, 50 bp, homo sapien
gaagcattatgttataatgttaagcraagaaatacaaaatgtaagaatgt

SEQ ID NO: 12643 - DNA, 50 bp, homo sapien
cccattgtccttaggcttaagaatasctgggtctgacctttcttcatttg

SEQ ID NO: 12644 - DNA, 50 bp, homo sapien
agaggccttctcctctaaacgtgaayactgtgtaatatagaagcattatg

SEQ ID NO: 12645 - DNA, 50 bp, homo sapien
aagcttaggctagagtcaaattttayagtacagataggccaaggctacca

SEQ ID NO: 12646 - DNA, 50 bp, homo sapien
agcatgtattaattttaaaaatatamactgcgattttaaaaaagaaaatc

SEQ ID NO: 12647 - DNA, 50 bp, homo sapien
gttcttgtgctatttcagcgcaaaakatttaggaaatagagagacacaca

SEQ ID NO: 12648 - DNA, 50 bp, homo sapien
tcataattgttttctttcttcttgckgaaaaggactttaaagatcatttt

SEQ ID NO: 12649 - DNA, 50 bp, homo sapien
tatatgccttctcctcatttttgctsaaagcacgaagaacacacattaaa

SEQ ID NO: 12650 - DNA, 50 bp, homo sapien
aaccagtctggctcagggacaatgaygattcagctaacctagaagagcag

SEQ ID NO: 12651 - DNA, 50 bp, homo sapien
ttatttttctcactttctgtattccrgccctgataaccacctctcaattc

SEQ ID NO: 12652 - DNA, 50 bp, homo sapien
acacccaactgatacactgaagattraaattctaactgtagaacctagaa

SEQ ID NO: 12653 - DNA, 50 bp, homo sapien
gcaaatctcagatcaaattctgctayatgtttgctttttaaaagccaaac

SEQ ID NO: 12654 - DNA, 50 bp, homo sapien
aacccgtctgccttcccagctatggrcacaacaacacttttatacttata

SEQ ID NO: 12655 - DNA, 50 bp, homo sapien
tctagattcaacccagaactttgcartattgtgtagaattcccagcagca

SEQ ID NO: 12656 - DNA, 50 bp, homo sapien
ttctctttccctacattctggaacasaggatgtttgaaattcagaattca

SEQ ID NO: 12657 - DNA, 50 bp, homo sapien
aaatgggaaaggtgttccaagtcccratgggaagcagagcatcaggaaat

SEQ ID NO: 12658 - DNA, 50 bp, homo sapien
tcatgagctttatcttacattttcawtcccatctgatcaaatggttttct

SEQ ID NO: 12659 - DNA, 50 bp, homo sapien
tagggatttgcgttccatagttgtawgcatttagcaaaagcttaattaat

SEQ ID NO: 12660 - DNA, 50 bp, homo sapien
cctctcaggtggaacatgcctctaarctactgaaatgaaggtgactgaca

SEQ ID NO: 12661 - DNA, 50 bp, homo sapien
tgaattagagaaacttcacattagaratgattaaatgcttagcatatttt

SEQ ID NO: 12662 - DNA, 50 bp, homo sapien
gctccaaatactctagctgcagataygtgcggaagccaccctggaggata

SEQ ID NO: 12663 - DNA, 50 bp, homo sapien
ccttcctctcaattctcaagataacygtgggagataggttctattgttca

SEQ ID NO: 12664 - DNA, 50 bp, homo sapien
caagcatcatctaagacataaaaagraccataactcctagtaagagcata

SEQ ID NO: 12665 - DNA, 50 bp, homo sapien
actctataaattagatgtgttttgastatgctgataaggtttataagact

SEQ ID NO: 12666 - DNA, 50 bp, homo sapien
attttcagtaaatatctgtgagtagwaaaccctttcaatattttaacatt

SEQ ID NO: 12667 - DNA, 50 bp, homo sapien
gccagtgtgtcccatagatattgaaragggctgtgtattataatttgtcc

SEQ ID NO: 12668 - DNA, 50 bp, homo sapien
taaaaaatgataaaggaaacattaarcacttccaaaccatttaccaaata

SEQ ID NO: 12669 - DNA, 50 bp, homo sapien
gcaggtagaaaggcacaccctatcaraagtatcaaccaggcccaatggca

SEQ ID NO: 12670 - DNA, 50 bp, homo sapien
tgcatacttttgtgctaggacgccamaagaggatggatgtcgtcactgaa

SEQ ID NO: 12671 - DNA, 50 bp, homo sapien
tcaaatgtcccaagctcaggatgaaragtgcaaaatgaaaacattgaacc

SEQ ID NO: 12672 - DNA, 50 bp, homo sapien
ttcttcaccagctgagtagctgtacscaagttactttatctccctgagtc

SEQ ID NO: 12673 - DNA, 50 bp, homo sapien
gcaaaatgctatgatactgaatataytaatgtttgagggcttgtgaaaag

SEQ ID NO: 12674 - DNA, 50 bp, homo sapien
aggcaaatgcgactgtatcctgacartaggtcaactaaatcaaatcaatg

SEQ ID NO: 12675 - DNA, 50 bp, homo sapien
acatgtctctattccagcaaaacaayctcagggaaggtatctcattggcc

SEQ ID NO: 12676 - DNA, 50 bp, homo sapien
gtttctgagccttgtaaagccttcakgactattttagctaaactcaacat

SEQ ID NO: 12677 - DNA, 50 bp, homo sapien
tacaggttgtcctcaaactagacagraaacaaccaaaagttaacaatgtt

SEQ ID NO: 12678 - DNA, 50 bp, homo sapien
ttcagaatgtcgagtgtattcataayggatggttcttcattacttacaaa

SEQ ID NO: 12679 - DNA, 50 bp, homo sapien
aataggggaaaaagggctccgagagyaaggaataatgagttgcccaaatt

SEQ ID NO: 12680 - DNA, 50 bp, homo sapien
tcaagggcagttcacttatgttcctracagttcagagttaaatctgaatc

SEQ ID NO: 12681 - DNA, 50 bp, homo sapien
agttcaagttcaaatctgcctgtcayggttagtgggaaaactatactggg

SEQ ID NO: 12682 - DNA, 50 bp, homo sapien
agtgccggagggaacaaaagcgctcratggaagcatcaccctgtagacct

SEQ ID NO: 12683 - DNA, 50 bp, homo sapien
gaacagtaatacccaagcaataaatraagacaataactgaatttggagca

SEQ ID NO: 12684 - DNA, 50 bp, homo sapien
ttcctgctccatgtgaaccaagctayaagcaatctcctgggcagtgctgt

SEQ ID NO: 12685 - DNA, 50 bp, homo sapien
aaaagtagcctgctttttctgatgaracactaatatgctctttgtaatag

SEQ ID NO: 12686 - DNA, 50 bp, homo sapien
ctcaaaactaaattccctttcctatraagaagtgtgtcattcatcaagca

SEQ ID NO: 12687 - DNA, 50 bp, homo sapien
gcatagctgctaatgacttcggcatyacccggagccaagccacgggggac

SEQ ID NO: 12688 - DNA, 50 bp, homo sapien
cgctgcatggaaattaattagagtcrgaccatgtcccccgtggcttggct

SEQ ID NO: 12689 - DNA, 50 bp, homo sapien
ggctgtgcagtgtcatgccagaagtracaaaagatgagacgttgcctgca

SEQ ID NO: 12690 - DNA, 50 bp, homo sapien
gggcaaagcaatattatgtaataaayatataatgccctgatgatgctatt

SEQ ID NO: 12691 - DNA, 50 bp, homo sapien
cgttcttcttaaaaacaaatttgaayctaatctgttaaacagaaccagct

SEQ ID NO: 12692 - DNA, 50 bp, homo sapien
aggtgatttggattcatgaactctamgaaccatagtttgtgaaatgttga

SEQ ID NO: 12693 - DNA, 50 bp, homo sapien
cccagatacttaatgcttctcagtckcaatattcccacttctgaatgcac

SEQ ID NO: 12694 - DNA, 50 bp, homo sapien
aggaaattggcttttcttccaatagratcatctcctgaaatctctgtgta

SEQ ID NO: 12695 - DNA, 50 bp, homo sapien
agaccttggttcttgtgttttgggayactggaagaccccctactcagtcc

SEQ ID NO: 12696 - DNA, 50 bp, homo sapien
gaaccaaggtctgatgcctttaatcyatgtaaaaatcagtataatgattt

SEQ ID NO: 12697 - DNA, 50 bp, homo sapien
cctccaagttaaagtgtgaatttaaragtgcaatcatgcctcagcctatc

SEQ ID NO: 12698 - DNA, 50 bp, homo sapien
ggcccagctgccacagaactgagacygaatggaaatcacctatcaagacg

SEQ ID NO: 12699 - DNA, 50 bp, homo sapien
gctcagattgtggaaaccttagctaygtggaactaactaatctaattcta

SEQ ID NO: 12700 - DNA, 50 bp, homo sapien
atacagattcctgagtagtcccccaratagtaaatctatacttccaagtt

SEQ ID NO: 12701 - DNA, 50 bp, homo sapien
accatgtgactggtaactacaggcamctctagaatctgatggtggcttcc

SEQ ID NO: 12702 - DNA, 50 bp, homo sapien
gtgactgcagccctgacttgacagcraccttgtgagagcccctgagtcag

SEQ ID NO: 12703 - DNA, 50 bp, homo sapien
aagataactcccattttggttgcacrgtgatggattagatgggaaaaatc

SEQ ID NO: 12704 - DNA, 50 bp, homo sapien
tatagttcgaaccactgtagatagaygggggttcattctttaatagcctc

SEQ ID NO: 12705 - DNA, 50 bp, homo sapien
tgtatatgaaatgcattgtatagcayggtgtatgttctttgaatgtgaag

SEQ ID NO: 12706 - DNA, 50 bp, homo sapien
gaatggccagaacaagagctaccgarattccaactagaagactacttgtg

SEQ ID NO: 12707 - DNA, 50 bp, homo sapien
agtacacaaaggctatcagtgtcgaygttattcagactgtgagtaacagt

SEQ ID NO: 12708 - DNA, 50 bp, homo sapien
tgtctagcatgatttatcaacagaaycaaatgggactatatgtgaaaata

SEQ ID NO: 12709 - DNA, 50 bp, homo sapien
attttaagagtaacttgaatgggccrgaactcctgtttttaaactgtaaa

SEQ ID NO: 12710 - DNA, 50 bp, homo sapien
agcaattctacttctaggtacaggawgaattatatgaaaccactaataac

SEQ ID NO: 12711 - DNA, 50 bp, homo sapien
cttgaaaactgctaagcatgtggaargtgcctgccaagggctgtgtgtcc

SEQ ID NO: 12712 - DNA, 50 bp, homo sapien
aatctaaattctgattattatgcaaytccctctttttaggctgtcatcat

SEQ ID NO: 12713 - DNA, 50 bp, homo sapien
ttgccttagcataagctatgagttamaaccaatggaatcgctacaataac

SEQ ID NO: 12714 - DNA, 50 bp, homo sapien
tctctctacgatgtcacgtgttatayctctttacagtcacttcccccagt

SEQ ID NO: 12715 - DNA, 50 bp, homo sapien
accgtacacataagtcaatgaaacasaataggaatcccagaaataagctt

SEQ ID NO: 12716 - DNA, 50 bp, homo sapien
ctttgcttaccgcatactgcatttcygaaagccaaaataccaagtcacta

SEQ ID NO: 12717 - DNA, 50 bp, homo sapien
ggagtttcatggttattttcatttarcgttcataatctaaatggcacttt

SEQ ID NO: 12718 - DNA, 50 bp, homo sapien
gagattggtgcgcaagtgatttactragaaagtgctcccaggggaaactg

SEQ ID NO: 12719 - DNA, 50 bp, homo sapien
tccttctacaactaaggattactgaytatcaaactaaaatggtccctaag

SEQ ID NO: 12720 - DNA, 50 bp, homo sapien
gcacatagaataggtcttcatgctaygtaaccaacgcatatggaccactt

SEQ ID NO: 12721 - DNA, 50 bp, homo sapien
tctttatgagaagcaggcaaataacygtgattcaaattgatagcagggaa

SEQ ID NO: 12722 - DNA, 50 bp, homo sapien
cacagctgcagtggaaatgtaacacyatccttcctctttgctaagggttt

SEQ ID NO: 12723 - DNA, 50 bp, homo sapien
gtatctagtgctcagttcatagttayagactcagatgtagatacagattg

SEQ ID NO: 12724 - DNA, 50 bp, homo sapien
atctgtctagcaatacgataacggarctatcacctcacctttttaaagac

SEQ ID NO: 12725 - DNA, 50 bp, homo sapien
agtgttacatgtaagtgttggaaacygtatccatttggctgactcatacg

SEQ ID NO: 12726 - DNA, 50 bp, homo sapien
acctgttaaaatcagaagaaatgaawctttaagagtccagagtatatttc

SEQ ID NO: 12727 - DNA, 50 bp, homo sapien
gaaattcttgtttggcaaactcacaygtttctctgtctggtagttccctt

SEQ ID NO: 12728 - DNA, 50 bp, homo sapien
aatagatataaacattcttaacaaayataaatggtaaccttccccaccaa

SEQ ID NO: 12729 - DNA, 50 bp, homo sapien
cttcccaagtgttttatttttgtccrgcatttaccattaaagcattgtaa

SEQ ID NO: 12730 - DNA, 50 bp, homo sapien
aacaactgatgctaccaaacgtggaytcaatatacttgttaaaacgtgta

SEQ ID NO: 12731 - DNA, 50 bp, homo sapien
atagtgcatactatacaccaaacacygtcctaaatgttttgcacatatgc

SEQ ID NO: 12732 - DNA, 50 bp, homo sapien
aacctgcttttctcttcaaattgcasgctttctaattaaaaacacttttt

SEQ ID NO: 12733 - DNA, 50 bp, homo sapien
caaggacaaaccttagcagcgtgaasacagagtattaccgtaaaacctgt

SEQ ID NO: 12734 - DNA, 50 bp, homo sapien
gaatggttttatctgacaggtttaawagtggcaatgagaataagtctggc

SEQ ID NO: 12735 - DNA, 50 bp, homo sapien
tggctgatgttattgttataaacccrcacttggcaaatcactgatgaaca

SEQ ID NO: 12736 - DNA, 50 bp, homo sapien
gtagcctccattgatttatgaatgckctgaggtaaaatgaattagtctgc

SEQ ID NO: 12737 - DNA, 50 bp, homo sapien
taatgtctgggattaaacctaatacygaggaataccttgtccacccaagc

SEQ ID NO: 12738 - DNA, 50 bp, homo sapien
ggccaggtaatgttagaaaagaaccygaacataggcattgctattataga

SEQ ID NO: 12739 - DNA, 50 bp, homo sapien
atcttcctgccagatccgtcatctasaaggtggtttctaaaagatctcat

SEQ ID NO: 12740 - DNA, 50 bp, homo sapien
tattgtgaaatatgcaagaatatgcragcgtgtacacttagcatgtaaac

SEQ ID NO: 12741 - DNA, 50 bp, homo sapien
gtgaaaaacttaagctgctacatgamatgcaaaatcattaagcttcagag

SEQ ID NO: 12742 - DNA, 50 bp, homo sapien
ccctcatgaccttgccagccgtcccractaacagcctccgcatacctcca

SEQ ID NO: 12743 - DNA, 50 bp, homo sapien
caatcttgagttgttgaagttggatraaaagtgaagtcattattgggcat

SEQ ID NO: 12744 - DNA, 50 bp, homo sapien
ctgtccaagaagtccactccacagckatgggtcttgggactcttgtggct

SEQ ID NO: 12745 - DNA, 50 bp, homo sapien
aagaatgattttcaagtcacaataayctttttactattatctccactttt

SEQ ID NO: 12746 - DNA, 50 bp, homo sapien
agaaatatggaagttactaataagaygattaggatatatgtaacctattt

SEQ ID NO: 12747 - DNA, 50 bp, homo sapien
ggggctcacacaccagctctgtgaartggtatacagcaagcccttctctc

SEQ ID NO: 12748 - DNA, 50 bp, homo sapien
ctgaaacatgagcatgataagaatcyatagtcacacattgcttaatgacg

SEQ ID NO: 12749 - DNA, 50 bp, homo sapien
attagtcccctccaaagaattcacargccaataaatagatcagtcgctgg

SEQ ID NO: 12750 - DNA, 50 bp, homo sapien
gatgtgaagtatacttgtgtatcaaygtctattcctactacaaagtctct

SEQ ID NO: 12751 - DNA, 50 bp, homo sapien
tactgattccctaagaattaatatcygagcaagtttcttttttttcctgt

SEQ ID NO: 12752 - DNA, 50 bp, homo sapien
agcatttatgagatttagtttagcastcacatgtcccaggattacaagcc

SEQ ID NO: 12753 - DNA, 50 bp, homo sapien
cttagcaatattaagcgtgaaaaacraatttcagatatgaaagattatct

SEQ ID NO: 12754 - DNA, 50 bp, homo sapien
atcctccgggaaaggctcccagatasagttatgtgtgcagaggggctata

SEQ ID NO: 12755 - DNA, 50 bp, homo sapien
gttctacatttattcatgagaaaaastcctggcaaaactacaaatagaaa

SEQ ID NO: 12756 - DNA, 50 bp, homo sapien
gagtttgccttccaaacatggagatsaatatataatgttaggtagtaata

SEQ ID NO: 12757 - DNA, 50 bp, homo sapien
atttactgcttccttcttaggtagayatgggaatgaaaaatttctaggtc

SEQ ID NO: 12758 - DNA, 50 bp, homo sapien
actttgcacccttttttgggactaarcctctgaagtccgtgtgtctacaa

SEQ ID NO: 12759 - DNA, 50 bp, homo sapien
taaagtaatctggcatatatggttamattcaagatgttatggcagaagtg

SEQ ID NO: 12760 - DNA, 50 bp, homo sapien
ctcagtaatgagaaaccagtatcttyaacatcgtgttctgtgggtgatgc

SEQ ID NO: 12761 - DNA, 50 bp, homo sapien
cggtattcaatgatacaacagttgaraaggccagaagaaagttaacctag

SEQ ID NO: 12762 - DNA, 50 bp, homo sapien
cccaagccaaaaggaaacataaaagyctaacaaatggtttgcataaaaca

SEQ ID NO: 12763 - DNA, 50 bp, homo sapien
cataataagcttaagagattattcaycataagcatttaaatgcatttctc

SEQ ID NO: 12764 - DNA, 50 bp, homo sapien
tatgatagaactgggttcgaattcayaatctgtagaattcattatctcat

SEQ ID NO: 12765 - DNA, 50 bp, homo sapien
aaccagcctttgcataaaaaggtaakaggagtcttcaaaggcagcccaag

SEQ ID NO: 12766 - DNA, 50 bp, homo sapien
caataaatgatacactgggtctaaayggtacatagaaaagtacctcttcc

SEQ ID NO: 12767 - DNA, 50 bp, homo sapien
ctcaggttcaaaatctacccagagcracattccctttttaatctccttct

SEQ ID NO: 12768 - DNA, 50 bp, homo sapien
agagctgtgccatggtgctaaaaaayagtagagtcagagtcagagagtct

SEQ ID NO: 12769 - DNA, 50 bp, homo sapien
acaactaggatgaaatacaataaacygagcataaaactttttgcacagtt

SEQ ID NO: 12770 - DNA, 50 bp, homo sapien
ggaattttgttgagtccttctcatarctggttcaatgtatccataaacct

SEQ ID NO: 12771 - DNA, 50 bp, homo sapien
tggtaatgtgggttttgaggatccamagctctctactggttaagtgtgtg

SEQ ID NO: 12772 - DNA, 50 bp, homo sapien
ccctgtgtggaacctcaaagatgaaygtaaccaagcaagactaaaaatgc

SEQ ID NO: 12773 - DNA, 50 bp, homo sapien
ttcaactgttgtatcattgaataccraccaaaggagaagactctaaaaca

SEQ ID NO: 12774 - DNA, 50 bp, homo sapien
ttaaatcatggtgggttaatctataygtcaaatggtacctgcatgaattg

SEQ ID NO: 12775 - DNA, 50 bp, homo sapien
tatgatgatattaggcgggtaatacyatgaccaatttctaagacaaagtg

SEQ ID NO: 12776 - DNA, 50 bp, homo sapien
gctcttttttaaagacagccattatwagtcaatgatttgggcttcttggt

SEQ ID NO: 12777 - DNA, 50 bp, homo sapien
atacagtttcacaaacttggtcacakctctgaataatggaaataactcca

SEQ ID NO: 12778 - DNA, 50 bp, homo sapien
aaaaggtggaagggcttaatctcagrctaaaatatatttgttttgaaaca

SEQ ID NO: 12779 - DNA, 50 bp, homo sapien
accatggtgttctatgttctaaaacrcgtcccaagggctcatttacatat

SEQ ID NO: 12780 - DNA, 50 bp, homo sapien
agtaaagaagacgtcattcccactgwacctaaaatccaaaatccctacta

SEQ ID NO: 12781 - DNA, 50 bp, homo sapien
tagtgggtaaacaagataagcactaycaatagcatagtaaatgccaaggc

SEQ ID NO: 12782 - DNA, 50 bp, homo sapien
ttgcctgcactgacaaaggccatcayggaagaagtactaagtataacaaa

SEQ ID NO: 12783 - DNA, 50 bp, homo sapien
acatgaaacaacccactagacactaygagagaaatagaggaatgtgaagg

SEQ ID NO: 12784 - DNA, 50 bp, homo sapien
tactactttattcagcaggattaaayctgaataacttttggctgttgtgc

SEQ ID NO: 12785 - DNA, 50 bp, homo sapien
aaagactgacagtcttagagggtaasagtgtatcatcataaacttaatca

SEQ ID NO: 12786 - DNA, 50 bp, homo sapien
gaaaaaaggtaggtaaactgagatayatatgtaaaaaatgtcaagacagg

SEQ ID NO: 12787 - DNA, 50 bp, homo sapien
atagattctgtcacgtctcaaggtaygtatttattaaaacccatgggaat

SEQ ID NO: 12788 - DNA, 50 bp, homo sapien
aggcagcaaagagagatcaacctgaratgacttcataatctttgtgacta

SEQ ID NO: 12789 - DNA, 50 bp, homo sapien
gtgtccccagtgtcatctttatgtasagagaaaagtgagttagtgctttg

SEQ ID NO: 12790 - DNA, 50 bp, homo sapien
ctttagtcaacactaacagaattcayatttcagctagtcaacaaagcata

SEQ ID NO: 12791 - DNA, 50 bp, homo sapien
tatgttgacttcacctagatttaacraagatagaaaatatgtggcatata

SEQ ID NO: 12792 - DNA, 50 bp, homo sapien
actgagtccttacacacaaaaggtargccttgaggaggaatgatggtgtc

SEQ ID NO: 12793 - DNA, 50 bp, homo sapien
tcagagaaatagtccaagattctaaycaccaatttatgctgtctctcaaa

SEQ ID NO: 12794 - DNA, 50 bp, homo sapien
ctttctaaacaatagcaaatacttayaaatcttgtgaggaagcactgtct

SEQ ID NO: 12795 - DNA, 50 bp, homo sapien
tagaaaacaacaaatatcagaaaacratacaaatgcttgcaggcaacata

SEQ ID NO: 12796 - DNA, 50 bp, homo sapien
taaattcatgttttactattttataratgtttgcaggtgcttttaagaga

SEQ ID NO: 12797 - DNA, 50 bp, homo sapien
aaaatgctgcactctctgctagatayagtaacttccaatattcttattat

SEQ ID NO: 12798 - DNA, 50 bp, homo sapien
atgtgttatagagaatatttagagasaacaaaagaagattcggatttacc

SEQ ID NO: 12799 - DNA, 50 bp, homo sapien
aacatgtccatacgaaaacctacacrcataaatgtttatagcagctttat

SEQ ID NO: 12800 - DNA, 50 bp, homo sapien
ataaaaactagattattctagagtcyctgtgcttgacaagcttagaattt

SEQ ID NO: 12801 - DNA, 50 bp, homo sapien
tcaaggcaacactccctaaggaacarcaaatttctgtatttcagatgtct

SEQ ID NO: 12802 - DNA, 50 bp, homo sapien
gcaagacaataaccttccaagccagrcaattatcactgtaaaggactata

SEQ ID NO: 12803 - DNA, 50 bp, homo sapien
aggaatataaagtgcatctgacattsaaaaaacaggattttatagcaaga

SEQ ID NO: 12804 - DNA, 50 bp, homo sapien
gaataaggcatagatattaggaaacragtctcagccaatactattcatca

SEQ ID NO: 12805 - DNA, 50 bp, homo sapien
atcttaaaataggactgtgctgacayaatacaactcaagaaggaacaatg

SEQ ID NO: 12806 - DNA, 50 bp, homo sapien
caaaagataatggctactttgcttawgtcccaagaatgaaaataatatag

SEQ ID NO: 12807 - DNA, 50 bp, homo sapien
tgaacaacttgagcatcatcagtaaygggacaaattgaaaccttgtgcca

SEQ ID NO: 12808 - DNA, 50 bp, homo sapien
ggattagaaagtactaataattcaayggtaattcccagaattttaatatc

SEQ ID NO: 12809 - DNA, 50 bp, homo sapien
cagtaagactataactaaaacatggragataataatatacctcaagccaa

SEQ ID NO: 12810 - DNA, 50 bp, homo sapien
caagccaagcatacattttgtatgaraaattgaaataactaaggcagcac

SEQ ID NO: 12811 - DNA, 50 bp, homo sapien
gacagcaaagaaataaaatgctcagrataatttcccacttgagcactatg

SEQ ID NO: 12812 - DNA, 50 bp, homo sapien
ggtgaattctgtgaccttagagaaaygaggaatacctgcacattattggt

SEQ ID NO: 12813 - DNA, 50 bp, homo sapien
atatgacttttaattaaccctacaaygaagtatgaatgtatttattatac

SEQ ID NO: 12814 - DNA, 50 bp, homo sapien
gacagtgaaattataataaaatagcraacgtgattaaaagcaacatttgt

SEQ ID NO: 12815 - DNA, 50 bp, homo sapien
gtagagaaaaattgatattgttaggycaatcaatgaacttaagggctttt

SEQ ID NO: 12816 - DNA, 50 bp, homo sapien
gaagatatatagacagaaagcgaaartgacagaaagttttcagtgggact

SEQ ID NO: 12817 - DNA, 50 bp, homo sapien
agctcaaatcctataaaagactatayccaagagtaccagaaaaacaggta

SEQ ID NO: 12818 - DNA, 50 bp, homo sapien
aatttagggctctttgcaggtttcarcaattcattacttaccccagtcat

SEQ ID NO: 12819 - DNA, 50 bp, homo sapien
ttattgcttactaaggcaattttacsagggatttaaatccagactcttgc

SEQ ID NO: 12820 - DNA, 50 bp, homo sapien
tagacagaagtctcaactcctagagraaatggatccagagacagtaaata

SEQ ID NO: 12821 - DNA, 50 bp, homo sapien
ctatatttggaatagtattaagagawctgagtcttagagggagcagaatc

SEQ ID NO: 12822 - DNA, 50 bp, homo sapien
atctataaaacaataatgactagcargtataatgtgtgttatagtttgca

SEQ ID NO: 12823 - DNA, 50 bp, homo sapien
actgtaacatagactcatgactttaygcttctctggccccagtgagctcc

SEQ ID NO: 12824 - DNA, 50 bp, homo sapien
cttaccacatattatctgatgatcaygttgaaaaatacaaggctgctgtg

SEQ ID NO: 12825 - DNA, 50 bp, homo sapien
tgatttcatctgcgtgttacaggaargctgagagatgggaactgctatga

SEQ ID NO: 12826 - DNA, 50 bp, homo sapien
catgcgtttagtcacaaatacttaaygtaatcacaaaagcattaattact

SEQ ID NO: 12827 - DNA, 50 bp, homo sapien
tgtttccctcttctctcatttaacawcagccttttccgaatggctgcctc

SEQ ID NO: 12828 - DNA, 50 bp, homo sapien
ttgatggataaatcaattgcatagaygggaaaatgaagccttaaggcagc

SEQ ID NO: 12829 - DNA, 50 bp, homo sapien
tttcacaatttctttcttgtgtctcmacattttgtatgattcatgaaaat

SEQ ID NO: 12830 - DNA, 50 bp, homo sapien
tgcttcccctctgaaagtctttacawatttttcattatctttaggaactc

SEQ ID NO: 12831 - DNA, 50 bp, homo sapien
gaattcatctggaaaagaaagtaaamttctgatgccagctatggggaaaa

SEQ ID NO: 12832 - DNA, 50 bp, homo sapien
cagcactgaatattctcagcttaaaycttctcctatatctttctttccca

SEQ ID NO: 12833 - DNA, 50 bp, homo sapien
aatgagaaaattttccgctagaaccratagtaaaggatggtgagtttcca

SEQ ID NO: 12834 - DNA, 50 bp, homo sapien
aatcaggcccattgaagacgctagamaaaaaattaaaaccgcttccgaag

SEQ ID NO: 12835 - DNA, 50 bp, homo sapien
caactgcactctttccaaattttcgsatttctcattatctagcatttgaa

SEQ ID NO: 12836 - DNA, 50 bp, homo sapien
agtcaaagatcattattccttactawctagattttggagggtagttttat

SEQ ID NO: 12837 - DNA, 50 bp, homo sapien
taagaaatccaaaatgcttcttgccrcttaaaacttgtaactaaaaatat

SEQ ID NO: 12838 - DNA, 50 bp, homo sapien
agtaactgaaaaatattcttccataktagagtgaccgttgattttttgtt

SEQ ID NO: 12839 - DNA, 50 bp, homo sapien
catcaaatgacactaaaaatgtgaaygtatggagtgtattgcactagagc

SEQ ID NO: 12840 - DNA, 50 bp, homo sapien
agtgaaaatagaggatgctatgtgastatgtagcagtgcatctaatccag

SEQ ID NO: 12841 - DNA, 50 bp, homo sapien
tagaatgtgttaaaggaacaaataastacatgaggaaaattgtctaacag

SEQ ID NO: 12842 - DNA, 50 bp, homo sapien
tactagcttaacatccatggtaaaarttctaagtggcgaatattatttct

SEQ ID NO: 12843 - DNA, 50 bp, homo sapien
tttgcatttgctcactatcagagccrccttttgaacaagataagagtgaa

SEQ ID NO: 12844 - DNA, 50 bp, homo sapien
caagaccttcactgggtgttgggaayagtgcaacaggagacaaacaagga

SEQ ID NO: 12845 - DNA, 50 bp, homo sapien
attctatgctttttcttctaccagayatttcctgatcatacaaacacttt

SEQ ID NO: 12846 - DNA, 50 bp, homo sapien
aggcaatgatcttccttttgggcatraatactcattatcttcatgaattc

SEQ ID NO: 12847 - DNA, 50 bp, homo sapien
gtgtcaatcacaaataaaatcaacartcaaacccaattacttctgtctac

SEQ ID NO: 12848 - DNA, 50 bp, homo sapien
aattactttggctacatcccttatamatgaggagacattagtatatttta

SEQ ID NO: 12849 - DNA, 50 bp, homo sapien
attctcagtttaatttaacaatacamtctaaatgagaaggtttaagaagg

SEQ ID NO: 12850 - DNA, 50 bp, homo sapien
tgccaccacagccttccaactccacygggatctcctattatcctgtgcct

SEQ ID NO: 12851 - DNA, 50 bp, homo sapien
gatatcctgtatacctggtctggcaycttgctttagaatatgggattact

SEQ ID NO: 12852 - DNA, 50 bp, homo sapien
gaggtatctattctccattcctaaakgcctgatttgatcacaatcttagg

SEQ ID NO: 12853 - DNA, 50 bp, homo sapien
ttttaaatgaaatgagcagctttaakgacagatgtaaatcagggtctaga

SEQ ID NO: 12854 - DNA, 50 bp, homo sapien
tctatgacctaagttggaatctttcyagataaaaagttgattctaaatat

SEQ ID NO: 12855 - DNA, 50 bp, homo sapien
atttttatcaagttaaaatttcaaaycacacagttttctccttttcactt

SEQ ID NO: 12856 - DNA, 50 bp, homo sapien
ttcaccacataggcaacagtaaataygtacaggagaccacttgttctggt

SEQ ID NO: 12857 - DNA, 50 bp, homo sapien
ggggagaagttagtaggaaattactyaaagccagagagtatcagatttct

SEQ ID NO: 12858 - DNA, 50 bp, homo sapien
ataggctcagcattatccaacttaamtgtcacattccccataacttcttc

SEQ ID NO: 12859 - DNA, 50 bp, homo sapien
tgacataggtgattaaattatgctcmcaagatcagttcctagataattgt

SEQ ID NO: 12860 - DNA, 50 bp, homo sapien
ttagatatgccctaaggtattttacyaagtcataccagcacttgttgcta

SEQ ID NO: 12861 - DNA, 50 bp, homo sapien
acagagtctcattttgccaaaaatakaagcaacgcagaactatttcgtct

SEQ ID NO: 12862 - DNA, 50 bp, homo sapien
ttagctgaatcccaactgccctaaaygttagcttggaatccaactggaaa

SEQ ID NO: 12863 - DNA, 50 bp, homo sapien
tgatcacaaaagtctctttggttacyatttgaccaatacaaattagaaaa

SEQ ID NO: 12864 - DNA, 50 bp, homo sapien
atgttttacaggtaagtctacaagargttaagtgattccatatttagtat

SEQ ID NO: 12865 - DNA, 50 bp, homo sapien
gaattgtgcctgccacactcgttatsagagttcaggtcctcttctaagat

SEQ ID NO: 12866 - DNA, 50 bp, homo sapien
gtaataaatgatagattagttgtctraaaattaattctgactccttggaa

SEQ ID NO: 12867 - DNA, 50 bp, homo sapien
ggacaagacctcagcaagatacacastcctagcttctgtttccttatctc

SEQ ID NO: 12868 - DNA, 50 bp, homo sapien
caaatcagtgaaatgttacatgcaarttcttttaaaaagtggaaggtgtt

SEQ ID NO: 12869 - DNA, 50 bp, homo sapien
ctgttgctctttttgtttgtttgaayctttctatcagtggtccctgtaag

SEQ ID NO: 12870 - DNA, 50 bp, homo sapien
caccctagtttaaacaaatacatgaytacggttgtcaatagagatagata

SEQ ID NO: 12871 - DNA, 50 bp, homo sapien
atgcccagtaagccacaaacacttgsagtgaagcatcagaggatgaacta

SEQ ID NO: 12872 - DNA, 50 bp, homo sapien
tcctattcggtcatgactgataaaartgtcaaataatctcatagggaaag

SEQ ID NO: 12873 - DNA, 50 bp, homo sapien
ctgagcccggtaactaaatagggtakcaatcatttatcatcacatctcaa

SEQ ID NO: 12874 - DNA, 50 bp, homo sapien
ctctgtgcttatttgaaaggggatcragtaatactgaagaagagtgatgt

SEQ ID NO: 12875 - DNA, 50 bp, homo sapien
ggaataagaatggaccctattataawctaaactatgacgaatcatcatcc

SEQ ID NO: 12876 - DNA, 50 bp, homo sapien
gaagggttttagaaagatactttccyatacaatcatgcactgtgtaatca

SEQ ID NO: 12877 - DNA, 50 bp, homo sapien
gctgagcaggctaagaaattgcccaygttgtgtattgactgctagctata

SEQ ID NO: 12878 - DNA, 50 bp, homo sapien
ttaagtgaagtaattaaaatcaaacratactgagatacccttttgtacat

SEQ ID NO: 12879 - DNA, 50 bp, homo sapien
gacaggattagcatgcgggtcacatkaaagctcagctgtgaagggggcag

SEQ ID NO: 12880 - DNA, 50 bp, homo sapien
gattgcttaaatcaagcaccatgaasatataacttggaaattcatatagc

SEQ ID NO: 12881 - DNA, 50 bp, homo sapien
ttgaaaaactaaagcaatgctgctayataattctccaagttacatgctcc

SEQ ID NO: 12882 - DNA, 50 bp, homo sapien
ggctctcgttctgaaattgtataccraccagataagcatatcctgaaaga

SEQ ID NO: 12883 - DNA, 50 bp, homo sapien
tagcaagactatgttaactatgtagyataattgatggagtaagtaataca

SEQ ID NO: 12884 - DNA, 50 bp, homo sapien
caaaacatttgtaattcaatcatcckaattgtctaaaccctgcactcttt

SEQ ID NO: 12885 - DNA, 50 bp, homo sapien
aagcattgttttttatgttcataagwaagcatccaaatacaccatcagtg

SEQ ID NO: 12886 - DNA, 50 bp, homo sapien
caactcttgatgcatgaaagtgctcrgaaattttttcaacgaataaaaat

SEQ ID NO: 12887 - DNA, 50 bp, homo sapien
aacttatgttgattataattgaccastgcttgtctaggaattgtaaggat

SEQ ID NO: 12888 - DNA, 50 bp, homo sapien
tgaaaatcacaaatcctttatcatcrcaacctatgacactgtgctcatct

SEQ ID NO: 12889 - DNA, 50 bp, homo sapien
gctttgtgcacatctggcagtaacaktctgaggtcaatcctttacaaagt

SEQ ID NO: 12890 - DNA, 50 bp, homo sapien
tcttttgagcaaatgagctaataggkaaatgattgaaaaaggagggtttt

SEQ ID NO: 12891 - DNA, 50 bp, homo sapien
acaacacacatttatgtgttaattayagcgtgaagccctgacataatgca

SEQ ID NO: 12892 - DNA, 50 bp, homo sapien
tatcattgccatgtttcaatgaattyaagatgccattgaaagcatgcatc

SEQ ID NO: 12893 - DNA, 50 bp, homo sapien
taacaacaaactaaataagaatgctwacacggtctctctggtcagtgttt

SEQ ID NO: 12894 - DNA, 50 bp, homo sapien
agagtaggaatgcgttaatctttaascagaagcgtaatatatataaaaat

SEQ ID NO: 12895 - DNA, 50 bp, homo sapien
gacctgggcatctccaagaacaatcrattctactttccctattttcttgc

SEQ ID NO: 12896 - DNA, 50 bp, homo sapien
taagataaaatttcataaaagtaaartataatgactctaacttcaaaaat

SEQ ID NO: 12897 - DNA, 50 bp, homo sapien
ttttaaaagttatgccaatcattcaygtagagctaaacacaaaaaaggaa

SEQ ID NO: 12898 - DNA, 50 bp, homo sapien
agagtgttttgggcaacagtgcagaygtataaaagtgaattactcatttg

SEQ ID NO: 12899 - DNA, 50 bp, homo sapien
aaggcagaagtgagatgatctacgaytccatttacaagaatctaatatga

SEQ ID NO: 12900 - DNA, 50 bp, homo sapien
atatcctcttttttatggtacataartggaagttctaaatgaatgctaga

SEQ ID NO: 12901 - DNA, 50 bp, homo sapien
ttaagcaacactgtagagaaaaaaastactcttcactacaaatgtgacta

SEQ ID NO: 12902 - DNA, 50 bp, homo sapien
gttttcgaaaaaaacctgatttaaawttgaattgcatgttcacaaatctc

SEQ ID NO: 12903 - DNA, 50 bp, homo sapien
tattttgcatattagcttgacatacrgcgttaaaatgtcccaggacatta

SEQ ID NO: 12904 - DNA, 50 bp, homo sapien
tcaagaatggagctgtggactttcaygataagtgttacagctcttaaaga

SEQ ID NO: 12905 - DNA, 50 bp, homo sapien
gacatccagcgatattaagcaagtgyagataatgctctcaaacttcatca

SEQ ID NO: 12906 - DNA, 50 bp, homo sapien
ttaaaataattgctatagttctatayggtggataaaagaaaagtggttat

SEQ ID NO: 12907 - DNA, 50 bp, homo sapien
tgaaatagtctttactacatagtcawctgtgaattctttctttgaaaata

SEQ ID NO: 12908 - DNA, 50 bp, homo sapien
ttcctatggagtgttgcgcaaaggayacatggagaatttgtaagatggat

SEQ ID NO: 12909 - DNA, 50 bp, homo sapien
caagttgtctcaggttgggtttcacrgaagcagagcccaagatagggatc

SEQ ID NO: 12910 - DNA, 50 bp, homo sapien
ggcctctcaactggttcagcctgaayaattttgactgaaaaattaaagtt

SEQ ID NO: 12911 - DNA, 50 bp, homo sapien
cctaacttctgagcactgccttatascactattgttgttggaccagagtc

SEQ ID NO: 12912 - DNA, 50 bp, homo sapien
aggtgaataagaaagtaggcgctacraatgtaactttaaatagcaaaccc

SEQ ID NO: 12913 - DNA, 50 bp, homo sapien
ggattgtaacagtgtatgagtgacartctggagtccttggcacatatatt

SEQ ID NO: 12914 - DNA, 50 bp, homo sapien
gcaaacttgttaattgttattgaccratgcagctcacagtctattggtta

SEQ ID NO: 12915 - DNA, 50 bp, homo sapien
gttgttcaagtagtgttaaaagcaasagatttctagtacaaaaaaattga

SEQ ID NO: 12916 - DNA, 50 bp, homo sapien
gcatcctattgatttcgtaaatgaayatgcacagctgggttgttgattgt

SEQ ID NO: 12917 - DNA, 50 bp, homo sapien
tgtgggtagctccagagggcaattcyatgtctgtggatgaagagttagtg

SEQ ID NO: 12918 - DNA, 50 bp, homo sapien
taactctcaggagtcaattgttaaaygtctgagaattttgccagccagtt

SEQ ID NO: 12919 - DNA, 50 bp, homo sapien
ctgaatgctaccggtttcaaacacaraatctatcatgggtcttactttac

SEQ ID NO: 12920 - DNA, 50 bp, homo sapien
gctatcctagcactggaaaagatgaygacaattgtctaattcccactttc

SEQ ID NO: 12921 - DNA, 50 bp, homo sapien
caccaaatggctgcttcaggtaaaargttgcatgcttgactaaacctcat

SEQ ID NO: 12922 - DNA, 50 bp, homo sapien
ctattgcccaaacacttcatgttcamaggttaaagtcctaagtgccataa

SEQ ID NO: 12923 - DNA, 50 bp, homo sapien
tgttgtcattgtagaataccagaatkatactgctgtagaggaaatggtca

SEQ ID NO: 12924 - DNA, 50 bp, homo sapien
cttaagctagtaatactgtcaacatraacctgaaaatgagattgattggc

SEQ ID NO: 12925 - DNA, 50 bp, homo sapien
agcatctcataaccaatgatgactayaatcactatcacctaggcagctct

SEQ ID NO: 12926 - DNA, 50 bp, homo sapien
ccaatgccctaattttacaacagagrcccataaatattaaacagtgtaaa

SEQ ID NO: 12927 - DNA, 50 bp, homo sapien
gaagtttataacaacatctagttcasaaaaatattgatagacacagccat

SEQ ID NO: 12928 - DNA, 50 bp, homo sapien
tctcctgaaaagttggtactctagasactaatttcagaaacaggcatctt

SEQ ID NO: 12929 - DNA, 50 bp, homo sapien
gctcacaaattatgtatttttttccmaagtgaattggagctagctaaaat

SEQ ID NO: 12930 - DNA, 50 bp, homo sapien
aagtcatttatactgggccttcagcmaaagttctcaaagggattggtaag

SEQ ID NO: 12931 - DNA, 50 bp, homo sapien
gcccctacacctgcatgttgtttgcrcttcatttctccattatcgttcat

SEQ ID NO: 12932 - DNA, 50 bp, homo sapien
ctagaagtgctagactctgaaatcarcttaaataatcacactggggcaga

SEQ ID NO: 12933 - DNA, 50 bp, homo sapien
agatagtgaaacagcttcttttgaaraggattcaattttctccccgaaat

SEQ ID NO: 12934 - DNA, 50 bp, homo sapien
tgcacaattcagatcatgactgtgayagcaatgattatctcaaaaaaatc

SEQ ID NO: 12935 - DNA, 50 bp, homo sapien
gataattttagatttttttacttgcrgagtatcaatttgattcattccat

SEQ ID NO: 12936 - DNA, 50 bp, homo sapien
ttcttttaagaggtcatactccaatraagaatgtagatgagcaaaattat

SEQ ID NO: 12937 - DNA, 50 bp, homo sapien
atatacagaatacatttctatgaacyggttgctttaatctgtgaacattt

SEQ ID NO: 12938 - DNA, 50 bp, homo sapien
tttctgtgacatcccaaaatacataracaggtggttgtcctacttgatga

SEQ ID NO: 12939 - DNA, 50 bp, homo sapien
ctgttgcaggacagacggtactaaawtatactggtgatactaagcctgca

SEQ ID NO: 12940 - DNA, 50 bp, homo sapien
aaatacaatcaaagagtcaagttaayatgtgctatctaaactctaaagga

SEQ ID NO: 12941 - DNA, 50 bp, homo sapien
atttgaaccctaatatatgttacttyaagcctatctgattccaaatccaa

SEQ ID NO: 12942 - DNA, 50 bp, homo sapien
taaaatatccagtttacaacaaaaakaattatgagacaagcaaagaaata

SEQ ID NO: 12943 - DNA, 50 bp, homo sapien
aacttatgactggcctgaaaagaagrctatatcagagtttagaaaaaaaa

SEQ ID NO: 12944 - DNA, 50 bp, homo sapien
tttaacaagattaaattaacaaaacrcttttatcttgtcaacatttctaa

SEQ ID NO: 12945 - DNA, 50 bp, homo sapien
tggctatttgggatatctctctacarctgatgttgctcatctttttgctg

SEQ ID NO: 12946 - DNA, 50 bp, homo sapien
ggcacatattctccaaagtaaaaaawttagcaaactccatatagttcatt

SEQ ID NO: 12947 - DNA, 50 bp, homo sapien
ctacagaaatggaaatatagcttcastacattgtcaggataaattcattc

SEQ ID NO: 12948 - DNA, 50 bp, homo sapien
acttgttcatgaaaagatctatttcragtattctcctggaagcaagaacc

SEQ ID NO: 12949 - DNA, 50 bp, homo sapien
acgcggggctttctggcagatttaayaggtagtttggtggtgtctggatt

SEQ ID NO: 12950 - DNA, 50 bp, homo sapien
aggacataagtgagataatgaagtgsataattaatgacatactctttagg

SEQ ID NO: 12951 - DNA, 50 bp, homo sapien
cagtgaactcagagacatgcaaaaarttctccatgttaatactttaaata

SEQ ID NO: 12952 - DNA, 50 bp, homo sapien
gtgcctatctagcacaagtgaaataygtaatggtaaaaaatttggatttg

SEQ ID NO: 12953 - DNA, 50 bp, homo sapien
ccaaacaataccaaagtttttaccakggaataatgcagaacaaagcctat

SEQ ID NO: 12954 - DNA, 50 bp, homo sapien
aatattttaagctgaaatcatgacamggttttacagttcattatatttta

SEQ ID NO: 12955 - DNA, 50 bp, homo sapien
tctagcccatcttcctatcttcagasaggatttcatttataaattatcag

SEQ ID NO: 12956 - DNA, 50 bp, homo sapien
gcccaattaatgaaagagatttggaygcacagtagttttttattttatcc

SEQ ID NO: 12957 - DNA, 50 bp, homo sapien
cacaatccaaagcctaattatgatgmattacaataatcaaactctttttt

SEQ ID NO: 12958 - DNA, 50 bp, homo sapien
aatacatgttaattattgtctatgaycaatcacccatgatagaatcaggc

SEQ ID NO: 12959 - DNA, 50 bp, homo sapien
gtgcctagtgaatgagaagcacacamaaaaaaaatgaattacaagtcagg

SEQ ID NO: 12960 - DNA, 50 bp, homo sapien
ctcacgggatgatggtgtcagagacycttccttatagagcccttagctca

SEQ ID NO: 12961 - DNA, 50 bp, homo sapien
atcaggctctaagactgtttttgtcraagatctattttatttcttttttc

SEQ ID NO: 12962 - DNA, 50 bp, homo sapien
agcttatgagcctcaagatagaaaayaagtctttgggccggacacgatgg

SEQ ID NO: 12963 - DNA, 50 bp, homo sapien
gatagaatatcttcccagctgatacrcaattcctctaaagatgtcatcat

SEQ ID NO: 12964 - DNA, 50 bp, homo sapien
ggatgtcatttctcaccctctgacayggcctaagtactacattttcttac

SEQ ID NO: 12965 - DNA, 50 bp, homo sapien
tgggaagatattctatccaagccagracaggttttaggtgactgtagcat

SEQ ID NO: 12966 - DNA, 50 bp, homo sapien
ggcaaagttaagcccactccacttaygtattatcaccttttttaagggaa

SEQ ID NO: 12967 - DNA, 50 bp, homo sapien
acagctgcctcgttgttaacaatcaygtgtgccaattgcacagaaaatgt

SEQ ID NO: 12968 - DNA, 50 bp, homo sapien
ggagtctctggtgaggatctgtggartaagaacagggcaaaatcacttat

SEQ ID NO: 12969 - DNA, 50 bp, homo sapien
tgagtctcatatggaatgtaataatwatagtggctatgttgcaaggtgct

SEQ ID NO: 12970 - DNA, 50 bp, homo sapien
taaattagcagtctgatgccgagaaygtttaggctcattcctctaccagc

SEQ ID NO: 12971 - DNA, 50 bp, homo sapien
gaagtaaaacttggccaccaagcagyatagagagttctttccatgctttt

SEQ ID NO: 12972 - DNA, 50 bp, homo sapien
ttcaagctttctacatcatagagaayccagtgagctgcctctgaaatcac

SEQ ID NO: 12973 - DNA, 50 bp, homo sapien
gtacatatgacttaattttggattayactgtgaataaaatgtcgattaag

SEQ ID NO: 12974 - DNA, 50 bp, homo sapien
tttatgtacctttaaagaataatgcraagtcattgggacaaatttcaagt

SEQ ID NO: 12975 - DNA, 50 bp, homo sapien
tggattagaaacaaaagaatcaagarcatggaaaaactacccaaatgtgg

SEQ ID NO: 12976 - DNA, 50 bp, homo sapien
ccgatttccaaacttcacagtgttcwatgtaccgataataatgtttgaaa

SEQ ID NO: 12977 - DNA, 50 bp, homo sapien
cactaccaaaagtattaatggtatcratgtattgtctatgtgcattcatg

SEQ ID NO: 12978 - DNA, 50 bp, homo sapien
gttgccttatgcactttttgggctaygtgcttgtgcgtgcttttgtagta

SEQ ID NO: 12979 - DNA, 50 bp, homo sapien
aatatatttttttaattctcaaaaaratccatctagtagaacttccaaga

SEQ ID NO: 12980 - DNA, 50 bp, homo sapien
cacttagaattgacctcagataatarcacttcataaatacactacttaat

SEQ ID NO: 12981 - DNA, 50 bp, homo sapien
atattattatagtaaagaaaatccartaaagtccttgtgttcagtccaat

SEQ ID NO: 12982 - DNA, 50 bp, homo sapien
ttttcctgatataaactttgtgtcayaacctattcttgctcatttaacca

SEQ ID NO: 12983 - DNA, 50 bp, homo sapien
ttattctcgtttatagtatcaaggtraataattctgccttccatttcccc

SEQ ID NO: 12984 - DNA, 50 bp, homo sapien
ctaagagtaaattccagttctgataytacttaacttcagtctgaaaatga

SEQ ID NO: 12985 - DNA, 50 bp, homo sapien
atttgtttttggaagcaattttaaaygagagattgcagaccttccagatc

SEQ ID NO: 12986 - DNA, 50 bp, homo sapien
gtactgtcaaataatacctactctcraggaacataaaataactagaaagt

SEQ ID NO: 12987 - DNA, 50 bp, homo sapien
tgacccgtcccgtcctaggccatacractggagagttcttcatgacaatg

SEQ ID NO: 12988 - DNA, 50 bp, homo sapien
ttttcatttttatcttatagaaccaraattacatagcttacatttccttt

SEQ ID NO: 12989 - DNA, 50 bp, homo sapien
ggagctaagatgccaggagctcacgyaaaatgcttgaagaaaggggctta

SEQ ID NO: 12990 - DNA, 50 bp, homo sapien
ttatcttttcaaggtttcctataaaygaggctctttgagactaaaaaata

SEQ ID NO: 12991 - DNA, 50 bp, homo sapien
cttgcctattaatctgtatgtttcaygttaacgtattttgaatttaattg

SEQ ID NO: 12992 - DNA, 50 bp, homo sapien
tctgtctacctacacctttatctatwagcaatttatggatgttcttatag

SEQ ID NO: 12993 - DNA, 50 bp, homo sapien
agacatacagttagcattcagttaargttagcaattatcagttctctaac

SEQ ID NO: 12994 - DNA, 50 bp, homo sapien
gaatatttgcacataaaatggaagaygctgtacatgtgacacacgcaaac

SEQ ID NO: 12995 - DNA, 50 bp, homo sapien
cattttatctttgctcaaattgttgwagaatggtggcttttttcatggtt

SEQ ID NO: 12996 - DNA, 50 bp, homo sapien
ctaatgcatgttttaacatgatagaygtaatgcgttgtgtagctagtttt

SEQ ID NO: 12997 - DNA, 50 bp, homo sapien
ccttctgagcagaaaaatttcttacrcatcttatacgggttgtgcatgcc

SEQ ID NO: 12998 - DNA, 50 bp, homo sapien
tttgtaagaccctattttggagctaraaagttgaaggaagtgtaatttgt

SEQ ID NO: 12999 - DNA, 50 bp, homo sapien
ctagcagaaaatgtataacatgcatwaggaatatttttatacattttttt

SEQ ID NO: 13000 - DNA, 50 bp, homo sapien
ttatataacctaatacttaatatgcrctgagtaattctactgtaccccat

SEQ ID NO: 13001 - DNA, 50 bp, homo sapien
cttagaaatacaacaaattgtaagaytctaagtagccattgctgtaagtc

SEQ ID NO: 13002 - DNA, 50 bp, homo sapien
tgaggatatcctttaatattatgcarggcacttacgttgttaggacagac

SEQ ID NO: 13003 - DNA, 50 bp, homo sapien
actgaaactactcacatcaatgggaycaaatgacctccaagttaacaaat

SEQ ID NO: 13004 - DNA, 50 bp, homo sapien
gtttaatcgtgagtgtttagagaaasagttctccatattcctgagagtct

SEQ ID NO: 13005 - DNA, 50 bp, homo sapien
actttttataactacatactccctargtcttcaaaggtgcattgttcttg

SEQ ID NO: 13006 - DNA, 50 bp, homo sapien
caatatgccgtgacgagtatgataargcctaagtgaaacagtatgagaat

SEQ ID NO: 13007 - DNA, 50 bp, homo sapien
aacctcgagagtatggcactgactaygtgaagatcgaagttaggtatttc

SEQ ID NO: 13008 - DNA, 50 bp, homo sapien
tctttgcaaaaatggaaacactaagwcccacgaggtgaagtgacatttaa

SEQ ID NO: 13009 - DNA, 50 bp, homo sapien
aagccttctatccttacaactgccamatgaggaattattgatcattcaca

SEQ ID NO: 13010 - DNA, 50 bp, homo sapien
tagcatcttttgttatgctgtgaacsagagaggttgaaaaactatacagt

SEQ ID NO: 13011 - DNA, 50 bp, homo sapien
ctgtgatctttgaagtcctaggcaartaattgaaattgagaatgtcaagt

SEQ ID NO: 13012 - DNA, 50 bp, homo sapien
gatctacaggtaagaatgtcctctcraatattcttctatcccaaattgta

SEQ ID NO: 13013 - DNA, 50 bp, homo sapien
atatttgtaggctcttgggtcaatayaatgaaaagtaattgtattgaata

SEQ ID NO: 13014 - DNA, 50 bp, homo sapien
ccttcttctcttataaggacacgtckcattggctttaaggcccacttgga

SEQ ID NO: 13015 - DNA, 50 bp, homo sapien
tttattgaacacctgctatgcataayaacctatctctagaccatgaataa

SEQ ID NO: 13016 - DNA, 50 bp, homo sapien
tgtaagccttagcattatgtgtataktaagaactgagtgtgttcctccag

SEQ ID NO: 13017 - DNA, 50 bp, homo sapien
caaaataatcaagtgcttgctgaccyagaaaatctagagaagatcttcct

SEQ ID NO: 13018 - DNA, 50 bp, homo sapien
ggttgcatggtatctcagttcaacaygtccatacctgaagtcatgttctt

SEQ ID NO: 13019 - DNA, 50 bp, homo sapien
gcctgttgattgatttagaattaccracatcatccttgacatcaccctgt

SEQ ID NO: 13020 - DNA, 50 bp, homo sapien
ataaattggaatcaaagcaaagaacygagagtaaccaattcactcctaaa

SEQ ID NO: 13021 - DNA, 50 bp, homo sapien
tacagagtgtactctgaaataggtcraattaaaagaagtcctgattatgg

SEQ ID NO: 13022 - DNA, 50 bp, homo sapien
tggtattttctctttaacagactgaytcaccttctattttatgtgttttt

SEQ ID NO: 13023 - DNA, 50 bp, homo sapien
tatcaatatatttgaattactattamattaaggatatgtcaccatttaaa

SEQ ID NO: 13024 - DNA, 50 bp, homo sapien
ataatgttggaatttagcagaggtawatgtgtttaaaatagtctcattcg

SEQ ID NO: 13025 - DNA, 50 bp, homo sapien
tttgccccatgtctggaatatagttkaaaaagcaataaatatttgttgga

SEQ ID NO: 13026 - DNA, 50 bp, homo sapien
ctctgatgtcagaaccctttttgggracttaccatgatgggaacatacat

SEQ ID NO: 13027 - DNA, 50 bp, homo sapien
atccctttctgccttcatccaagttraaaatcttaaagtcacctctttcc

SEQ ID NO: 13028 - DNA, 50 bp, homo sapien
aagtttttgctttctgtctcacttcrcagccaatgaatgattgcctattc

SEQ ID NO: 13029 - DNA, 50 bp, homo sapien
ggcaggtataacatgtgattcatacrgaaagttaaaagagaaaaacgctg

SEQ ID NO: 13030 - DNA, 50 bp, homo sapien
ttaaacattcttctctgggaattgaygcaaacgcaaaagagaaaggaagg

SEQ ID NO: 13031 - DNA, 50 bp, homo sapien
ttttctgctaccagcattgtctgtaygtattcctttaaacattacttttt

SEQ ID NO: 13032 - DNA, 50 bp, homo sapien
actacaatttctagttttttccatcractaggaaagatgaaaggacttgt

SEQ ID NO: 13033 - DNA, 50 bp, homo sapien
acatacttataagtatgaggctatawctgagacttttccaggggcattta

SEQ ID NO: 13034 - DNA, 50 bp, homo sapien
cgcttttaaataaccatgtgtattargaaatgaaatttgaaaatacttat

SEQ ID NO: 13035 - DNA, 50 bp, homo sapien
ctggctgactattagtaaatttacakgctaggtaatcttcagatcctcta

SEQ ID NO: 13036 - DNA, 50 bp, homo sapien
tttataaaacattgtgattaaactayatgctttaaaacattattctgtgc

SEQ ID NO: 13037 - DNA, 50 bp, homo sapien
ggaagcctgcagttatcccagtaacmaattggccatactcttcttgaacc

SEQ ID NO: 13038 - DNA, 50 bp, homo sapien
caggataacttaatctatattaagakaaaaccatcactttctttggttta

SEQ ID NO: 13039 - DNA, 50 bp, homo sapien
agctgattcctgaactcatatttaawctctactgccagggaaatgctaca

SEQ ID NO: 13040 - DNA, 50 bp, homo sapien
tggatgctcagtgattctccacatcrcctaataatgggcagtaccgttca

SEQ ID NO: 13041 - DNA, 50 bp, homo sapien
atgtgctaatcagggatcaccagtawctagctaattgatatgaaagttat

SEQ ID NO: 13042 - DNA, 50 bp, homo sapien
agcatatattgagaacttactattaygcctggctctgtgctaagtatttt

SEQ ID NO: 13043 - DNA, 50 bp, homo sapien
tatccatgggatgatttttaaatgaygactttaattccccaatgcatcta

SEQ ID NO: 13044 - DNA, 50 bp, homo sapien
gagaggctgtattcatattatattayggtaaaagcctcaagaggtcagag

SEQ ID NO: 13045 - DNA, 50 bp, homo sapien
taaaatggcagtaatctgaagaatcyagaggatgataagaaacacgtcta

SEQ ID NO: 13046 - DNA, 50 bp, homo sapien
cacccacacagtctttcttaaacacrcatattgttctattacagctaact

SEQ ID NO: 13047 - DNA, 50 bp, homo sapien
aggatttcatagggagactatattayattaaggcaaaaagacagcagtca

SEQ ID NO: 13048 - DNA, 50 bp, homo sapien
gatgttgttcaagttaagggagatamagcagttgtctgataatagattaa

SEQ ID NO: 13049 - DNA, 50 bp, homo sapien
tacttaaatgtaagtgtatacctaaygagctcagaaccgtaacagttcta

SEQ ID NO: 13050 - DNA, 50 bp, homo sapien
aactatgcccttctggaaacagatgmacccctttgcgtatatcaaatctc

SEQ ID NO: 13051 - DNA, 50 bp, homo sapien
tgaacatttatttttatttctgtaamagtgactttatgaaaacaaagtag

SEQ ID NO: 13052 - DNA, 50 bp, homo sapien
tttttaaaaagagctcaatagtcaawagtagacttaactaaaactgatat

SEQ ID NO: 13053 - DNA, 50 bp, homo sapien
tccacacagaagcaatggtaagagargtctcctgagaggaagcagtgaga

SEQ ID NO: 13054 - DNA, 50 bp, homo sapien
gaacaccaaacaccaagctaggcacygaagttgaaaaatcctatcccaca

SEQ ID NO: 13055 - DNA, 50 bp, homo sapien
attctccctcctaattttttaaccaytcaatagatggcagatatatggca

SEQ ID NO: 13056 - DNA, 50 bp, homo sapien
aaataaccagctacaaacttcattcrcccaattatttctcctttcctggg

SEQ ID NO: 13057 - DNA, 50 bp, homo sapien
aaaacattcaagaagcgttcactaaytcaggtgggacatatactaattta

SEQ ID NO: 13058 - DNA, 50 bp, homo sapien
aaacaagggaatcagagctgcatggsataggcccaatcttacaaccaggt

SEQ ID NO: 13059 - DNA, 50 bp, homo sapien
cacaaggagaaatattggtacctagyaaagaagcattgtgacaaaagaga

SEQ ID NO: 13060 - DNA, 50 bp, homo sapien
aacactaggcttcactgcatgcaaaragtcttaacgctggatacacatcc

SEQ ID NO: 13061 - DNA, 50 bp, homo sapien
tcagtctgctattggccaatgtaaawtctgattctttttctgtttctaag

SEQ ID NO: 13062 - DNA, 50 bp, homo sapien
gcatacatgcttactgctttaaaaamgatgttagatgacttcccctggat

SEQ ID NO: 13063 - DNA, 50 bp, homo sapien
gttaggacaatattccaaaagctgaycttgtcctttagatatataatcca

SEQ ID NO: 13064 - DNA, 50 bp, homo sapien
tattacctcctttaaagatctaatcrcgtaaggatatttctgttaaattt

SEQ ID NO: 13065 - DNA, 50 bp, homo sapien
aatattattaatacatgcttacatayggtacagaaagtcattaaacactg

SEQ ID NO: 13066 - DNA, 50 bp, homo sapien
tgtagagcaattttttttccacctawcagggtatctggttctttaaatga

SEQ ID NO: 13067 - DNA, 50 bp, homo sapien
tgtaaggagaaaaaacttgaaatcartatgtacttcaattcaaattctga

SEQ ID NO: 13068 - DNA, 50 bp, homo sapien
aaagcttcattcagtggcttgcagaratttatagcagggaaattcaagca

SEQ ID NO: 13069 - DNA, 50 bp, homo sapien
gaagaaatgaactgattaaccacaartgcattattccaacaagccaaaag

SEQ ID NO: 13070 - DNA, 50 bp, homo sapien
catacagcattggtactacataggayaggaattaagaaagaataactttt

SEQ ID NO: 13071 - DNA, 50 bp, homo sapien
ctttggataggaattcaggatatgcragtcaaaagaggtttagtggctgg

SEQ ID NO: 13072 - DNA, 50 bp, homo sapien
ccccccctaaaaaaatctaatgcaaygatctaaaaattattcttagacta

SEQ ID NO: 13073 - DNA, 50 bp, homo sapien
gaagggaaatttctgccttcaagtakctaactctttaagaagtcttttaa

SEQ ID NO: 13074 - DNA, 50 bp, homo sapien
tttcgaaggctaagacctattgatayatactcatttaaattgtaaaatct

SEQ ID NO: 13075 - DNA, 50 bp, homo sapien
ttcaatcctggttgtttcttctttaygtggaaataagctaggaaatttgc

SEQ ID NO: 13076 - DNA, 50 bp, homo sapien
cagatttgtaacatgtgagatgcaamttagcgtattcttgaactcagttt

SEQ ID NO: 13077 - DNA, 50 bp, homo sapien
attgcgtatctcacctttaacctcartaacattattcattactttcctat

SEQ ID NO: 13078 - DNA, 50 bp, homo sapien
aatttgtccaaaagttagctttgtckacacccaggaattaccaaggacat

SEQ ID NO: 13079 - DNA, 50 bp, homo sapien
tctaggagattcttgtcctgtgatayagtatccttggccagttcatgtcc

SEQ ID NO: 13080 - DNA, 50 bp, homo sapien
ccaactttgagtggtgtctttgcctyaaccttttgcctataaagacccca

SEQ ID NO: 13081 - DNA, 50 bp, homo sapien
gatgtataaacgtagcaaaaaataargtttcagacaagtagtttttctta

SEQ ID NO: 13082 - DNA, 50 bp, homo sapien
aaaaatgccttcagccaacctttcaraagttcaccaacccttcgaggccc

SEQ ID NO: 13083 - DNA, 50 bp, homo sapien
ttattggctgattggaatggtgtaayggatgaaggccaggattggttgat

SEQ ID NO: 13084 - DNA, 50 bp, homo sapien
gcattagctggctaacctttcttcakatcatgtaagtcaacgtgaaaaga

SEQ ID NO: 13085 - DNA, 50 bp, homo sapien
ataattgagaagtacaggaaaaataygttcatttcacttgaagatggatg

SEQ ID NO: 13086 - DNA, 50 bp, homo sapien
tttcttcttcttgtgtactttgagartaattatgttttagaataattttt

SEQ ID NO: 13087 - DNA, 50 bp, homo sapien
attttacactctattgtctcattcawaaacagtcccattgcactaaagta

SEQ ID NO: 13088 - DNA, 50 bp, homo sapien
tgttttctggttcttcttaaataaakcatctcatcaatcatattaatata

SEQ ID NO: 13089 - DNA, 50 bp, homo sapien
gagtatttagtgagtgtattatagcratctttgttcaagacatcaagaaa

SEQ ID NO: 13090 - DNA, 50 bp, homo sapien
taataataatagcacttacgtagtasctagtatgtaaatgcacactatgt

SEQ ID NO: 13091 - DNA, 50 bp, homo sapien
ctcaacctcagtactgtgctactcayggacgtttctccatcgtggaaggc

SEQ ID NO: 13092 - DNA, 50 bp, homo sapien
tactgccctgcagaactaaatgcaasctcctcaacatatcttctggggcc

SEQ ID NO: 13093 - DNA, 50 bp, homo sapien
gggaatactattcttgacagataaartagaggttaatgggacagaaagca

SEQ ID NO: 13094 - DNA, 50 bp, homo sapien
ctagaaccatgtgctattgtagaaasatttcagaaaggtgtccctttccc

SEQ ID NO: 13095 - DNA, 50 bp, homo sapien
gactgttaaatacctcatattcctayccaacaatacaaatgacagtttca

SEQ ID NO: 13096 - DNA, 50 bp, homo sapien
tctctctttctttaaacggtagtaayctaagccagcaaactagcactcag

SEQ ID NO: 13097 - DNA, 50 bp, homo sapien
aaataaagttggccactaaacatgcrgaaaattttcaatctttattattt

SEQ ID NO: 13098 - DNA, 50 bp, homo sapien
aatagttaattctcatatttattccmatagctggtcttcatgtaagatat

SEQ ID NO: 13099 - DNA, 50 bp, homo sapien
atctagtgactatgattgtaatgagractcaaacgtgacatgaagccaaa

SEQ ID NO: 13100 - DNA, 50 bp, homo sapien
ttataatgcaagagcttttcttctgsatttcagaatttaagaatttctgc

SEQ ID NO: 13101 - DNA, 50 bp, homo sapien
aatggttcaaaatgtacaacttctayggaggataatttggcaatatctat

SEQ ID NO: 13102 - DNA, 50 bp, homo sapien
gagtcacgttagagcgggtataagaygaactgaccagcctggccggaacc

SEQ ID NO: 13103 - DNA, 50 bp, homo sapien
tgataccagttttctaatcgctaaamaggatattacttggtgaatcttca

SEQ ID NO: 13104 - DNA, 50 bp, homo sapien
gaagaggtaacatctccaaaaaatayccagtaaagtagatgatattctgt

SEQ ID NO: 13105 - DNA, 50 bp, homo sapien
gggacacacgcctattggagaagacrgtcagaaagttgtcagtagttgaa

SEQ ID NO: 13106 - DNA, 50 bp, homo sapien
gcatggaattcaagatgtttcattayctgatcccaatttttccttctagt

SEQ ID NO: 13107 - DNA, 50 bp, homo sapien
acttagatctgtaattttgcagtaartattaggagtttttggttctgttt

SEQ ID NO: 13108 - DNA, 50 bp, homo sapien
actaagaggttttctacatttaaaawtttctattggctgggtgcggtggc

SEQ ID NO: 13109 - DNA, 50 bp, homo sapien
ccagcaaaatgaagaaaaacccgcaracgctcttgtaggaaatgcaatta

SEQ ID NO: 13110 - DNA, 50 bp, homo sapien
aactaccatatattgtatggggaaarttactataggaagaaggtaggctg

SEQ ID NO: 13111 - DNA, 50 bp, homo sapien
ttcccatccgtcttgtgacccggaaycatggtgatctaaaagagccctgt

SEQ ID NO: 13112 - DNA, 50 bp, homo sapien
aagaaatgtacattgcaaggcaccaytctttgacattcaaacactcttat

SEQ ID NO: 13113 - DNA, 50 bp, homo sapien
atgaagttgggagaaactattttcastactataagcaatggcctgaaacc

SEQ ID NO: 13114 - DNA, 50 bp, homo sapien
gtggaccggtcctctctccattgtaraatctacccatccatctctgcttc

SEQ ID NO: 13115 - DNA, 50 bp, homo sapien
ctgaagattccaaacttaccttcaaragaatcagcatcatgcattagaaa

SEQ ID NO: 13116 - DNA, 50 bp, homo sapien
agcatggcttctcatcctggaatgawtaaaagtaccagaagcaagtggaa

SEQ ID NO: 13117 - DNA, 50 bp, homo sapien
ttactgggcctgtccatttatgtgargagatgtgaaaagataccatgtgc

SEQ ID NO: 13118 - DNA, 50 bp, homo sapien
ctaactaaggtgctcctcacacagartctccaggaagcagagatggatgg

SEQ ID NO: 13119 - DNA, 50 bp, homo sapien
gtagagtatagtaaatacatataccrgaaagggtcatttatcatcatcaa

SEQ ID NO: 13120 - DNA, 50 bp, homo sapien
tttcaaatattaccaatggcagtaasttaacacattcatgggagcaaagc

SEQ ID NO: 13121 - DNA, 50 bp, homo sapien
gacatctctgattgctccttcaacaragatccttttaatggtctatcctt

SEQ ID NO: 13122 - DNA, 50 bp, homo sapien
agattagcccttttcacgaaatacartgggatgatgataatattactatt

SEQ ID NO: 13123 - DNA, 50 bp, homo sapien
aaaacccttatgtgattgtacaagaygtattcattattcaagtacctgtg

SEQ ID NO: 13124 - DNA, 50 bp, homo sapien
taccttacttgcaggatttgttgtayacttattctggaggtaattctgaa

SEQ ID NO: 13125 - DNA, 50 bp, homo sapien
tttaagttacctcttatgacaatgartaagactaagatatttaatattga

SEQ ID NO: 13126 - DNA, 50 bp, homo sapien
aagattttgagagagagaaaaaggtsaaaggtagaaagacagggaaggtt

SEQ ID NO: 13127 - DNA, 50 bp, homo sapien
gttgaatttcctctaaaacctattascagagttacaatacaaaggcaaac

SEQ ID NO: 13128 - DNA, 50 bp, homo sapien
gaatagaattacagttttgttgacartgggctataatgttctttttctgg

SEQ ID NO: 13129 - DNA, 50 bp, homo sapien
cccttaaggaattattagttacctarcatgcacctgttacatatttcttg

SEQ ID NO: 13130 - DNA, 50 bp, homo sapien
aatatagaattacaagctcttttgakaaattctttgttaaaccataaatt

SEQ ID NO: 13131 - DNA, 50 bp, homo sapien
atgtcaaatgcctgtagtgtggcaayagaatgcttcatttcagtgggata

SEQ ID NO: 13132 - DNA, 50 bp, homo sapien
ccactgtgcctataatctgcactgasagacatgagatgttccataaaggt

SEQ ID NO: 13133 - DNA, 50 bp, homo sapien
ttctggccatacttctgtctctaaastatttctgctctaaccttgtctca

SEQ ID NO: 13134 - DNA, 50 bp, homo sapien
gatactcaagccttttgtaagaaggycctgttgtgaaccaatgaaagcaa

SEQ ID NO: 13135 - DNA, 50 bp, homo sapien
aaggtcctgttgtgaaccaatgaaascaaagatggtagtttttaagattc

SEQ ID NO: 13136 - DNA, 50 bp, homo sapien
agtaggtttatgtttcagtaagttaycctcattatgtaagtgggaaataa

SEQ ID NO: 13137 - DNA, 50 bp, homo sapien
caaatgggaaacgtggcttttagtgragtagtatgtgagaaagagaaatt

SEQ ID NO: 13138 - DNA, 50 bp, homo sapien
aaatgaagaaatgtccaagaaatgarattatgcagtctccttgggtaacg

SEQ ID NO: 13139 - DNA, 50 bp, homo sapien
caaaatactgattgagtatcttctaygtgtaagactgtgctagtttcaac

SEQ ID NO: 13140 - DNA, 50 bp, homo sapien
ataagttggctttatttgggaaaacrcatcgataagccaactgagataga

SEQ ID NO: 13141 - DNA, 50 bp, homo sapien
tcaaaatatgaggatattgtataatyaccttgaaacttaaaaaaaagtgt

SEQ ID NO: 13142 - DNA, 50 bp, homo sapien
aataaagccaacttatctgaaaatamattttgctatcagttcttaaaatt

SEQ ID NO: 13143 - DNA, 50 bp, homo sapien
tctagcatttgaagactttttaaccrcataacctagatcccgttgatttt

SEQ ID NO: 13144 - DNA, 50 bp, homo sapien
ctgaggcagtggaagcaatttgagcratgtgtggagtggagagagaacct

SEQ ID NO: 13145 - DNA, 50 bp, homo sapien
gttcaaaaacaccatccaattgctayagttggaacaagagctttaaagcc

SEQ ID NO: 13146 - DNA, 50 bp, homo sapien
atctccaatcatcagtctatagatargatcatctgggtactattctggga

SEQ ID NO: 13147 - DNA, 50 bp, homo sapien
tgttagtttcctagggctagcataayaaattggcactaactgggtgacta

SEQ ID NO: 13148 - DNA, 50 bp, homo sapien
gaacacctgaagtcaccagacaacasaagaggtaagtgaaccaccaaaat

SEQ ID NO: 13149 - DNA, 50 bp, homo sapien
ttgttcaaataaaacagaaagatatkaggtatatagtgacttttaaagat

SEQ ID NO: 13150 - DNA, 50 bp, homo sapien
tcccgcacatccaaagatatatccaygtcctaactcccagaacatgtaaa

SEQ ID NO: 13151 - DNA, 50 bp, homo sapien
atttcaagcaagcaagaaatgatcamattgttcaaataaaacagaaagat

SEQ ID NO: 13152 - DNA, 50 bp, homo sapien
atttctggcccttggagaggtttccrcagtgctggctgatcactcctgca

SEQ ID NO: 13153 - DNA, 50 bp, homo sapien
actctcagaaaatatgctattctcakaaaatttgttgagagtgttgaatt

SEQ ID NO: 13154 - DNA, 50 bp, homo sapien
gagatatcatcctccacacaaatcaractgctactttattataggccctt

SEQ ID NO: 13155 - DNA, 50 bp, homo sapien
ctatctaggcatattaatgaactaawttaagacagagcagagatatcatc

SEQ ID NO: 13156 - DNA, 50 bp, homo sapien
taggggacaatgacttcttgattcartaaccttcggaaaaggaagtagtg

SEQ ID NO: 13157 - DNA, 50 bp, homo sapien
catggacctgatctgcagctacttayatgacatgaggagcagctaatgag

SEQ ID NO: 13158 - DNA, 50 bp, homo sapien
gaaattgctattacaaatgattaagrcctccgaggtaatggaaccatttg

SEQ ID NO: 13159 - DNA, 50 bp, homo sapien
accggtagtaaaagctgacttgaaakaatgtggcaataaactttgcatca

SEQ ID NO: 13160 - DNA, 50 bp, homo sapien
gggaggtgacatctcatctagatcartgaagaatgagttgaggcaaaaaa

SEQ ID NO: 13161 - DNA, 50 bp, homo sapien
tccctgcataagattatatggaaatyagaattgttgatttatttctagca

SEQ ID NO: 13162 - DNA, 50 bp, homo sapien
ggatttgtgtgaatttcttaagttcracaagatcttcaaataaagaaata

SEQ ID NO: 13163 - DNA, 50 bp, homo sapien
catggagaactgaatcgcatctgaaytacatgcccaggattgtccttggc

SEQ ID NO: 13164 - DNA, 50 bp, homo sapien
ttccccaggatatggtagattaaacycagtcaccaaggctatctgacttg

SEQ ID NO: 13165 - DNA, 50 bp, homo sapien
tgcgctattacagtctgagaattacygctctaagagaatgtttgtgcttg

SEQ ID NO: 13166 - DNA, 50 bp, homo sapien
tttattaaactaggcttagaagtaawcatcttcagatttcatattctgat

SEQ ID NO: 13167 - DNA, 50 bp, homo sapien
tttcatattctgatattatcatcaawgtacttatatgtgtccagcaacac

SEQ ID NO: 13168 - DNA, 50 bp, homo sapien
tttttgtcttgagaatatgtctgcaytcctatttcttggtgcatcctgca

SEQ ID NO: 13169 - DNA, 50 bp, homo sapien
gcaagaaaacaagtatgactacaacygaatttacactgctcatgtcctct

SEQ ID NO: 13170 - DNA, 50 bp, homo sapien
ctttcagtctcaattaatctgtcacygtaatttactcatgcacagtttcc

SEQ ID NO: 13171 - DNA, 50 bp, homo sapien
ttgctttttcccttagattatttgawgattcttggtggaacgcaagaaat

SEQ ID NO: 13172 - DNA, 50 bp, homo sapien
gtacaatggtgagaacagtcatataraaagtttgcaaaaattctaaagtc

SEQ ID NO: 13173 - DNA, 50 bp, homo sapien
tttttgactatcttgtctgattctartaattcctctaccagttttttttg

SEQ ID NO: 13174 - DNA, 50 bp, homo sapien
aaggtgcattatctctcaatgtatayctttgcattactgttccctcaacc

SEQ ID NO: 13175 - DNA, 50 bp, homo sapien
atgaatttgccttatatctgacccayacataatgacgaagaaactaaaaa

SEQ ID NO: 13176 - DNA, 50 bp, homo sapien
ttatattccatcaaatagggtatatkagactctcagaaagtacgtaatga

SEQ ID NO: 13177 - DNA, 50 bp, homo sapien
agctgaagttcttaaacaatccatayctgtttgatcctagcttagacctg

SEQ ID NO: 13178 - DNA, 50 bp, homo sapien
gatcctgcatcaaaccttaccggaaygaaatgcccagaacacataataaa

SEQ ID NO: 13179 - DNA, 50 bp, homo sapien
catgcaccatgtgtagtgtaatagcraggcagcaaggcacagaaggaggg

SEQ ID NO: 13180 - DNA, 50 bp, homo sapien
aagaaatccgtgagagagattaacargttctaaattctacacctcatacc

SEQ ID NO: 13181 - DNA, 50 bp, homo sapien
ttgcagagttagtcttgtcagggaasaatttatctactatacaattcaga

SEQ ID NO: 13182 - DNA, 50 bp, homo sapien
tcaaattcagagtcagagctcccaamaaaattcagttaagaaatcacaac

SEQ ID NO: 13183 - DNA, 50 bp, homo sapien
gagaggagactggagatgtaaacacyagttggatcatggagggtctgtga

SEQ ID NO: 13184 - DNA, 50 bp, homo sapien
aagataaaccaggaagttgaatatamagagcttggaggaaccaacagcca

SEQ ID NO: 13185 - DNA, 50 bp, homo sapien
ctgtttcaaattttttaatacaaacrcctaatgcatctattttcagtctt

SEQ ID NO: 13186 - DNA, 50 bp, homo sapien
taaatttcaaacttctataaacttgsaagaaaggataaaaatactaggac

SEQ ID NO: 13187 - DNA, 50 bp, homo sapien
agtcaccctgttgaaacttttgcaawgataaggttatgaagctgtgagat

SEQ ID NO: 13188 - DNA, 50 bp, homo sapien
taggaactgttctggacacataaatyatctcattgaattcttgcaacaat

SEQ ID NO: 13189 - DNA, 50 bp, homo sapien
aagtaactttaatcattactgagcawctaatatatactaggaactgttct

SEQ ID NO: 13190 - DNA, 50 bp, homo sapien
gctagcagatatcatgaaatcattargttgtactttctcaccatgctcag

SEQ ID NO: 13191 - DNA, 50 bp, homo sapien
cagcctaggaatcggcctcaatccartccttttgtggcagaatagattgc

SEQ ID NO: 13192 - DNA, 50 bp, homo sapien
tgtcctctctaagatggaaagatgaygatttgtagtttaaaattggctgc

SEQ ID NO: 13193 - DNA, 50 bp, homo sapien
tttaaagggcaactctgattgcaggraagagattttattaaaaggaagaa

SEQ ID NO: 13194 - DNA, 50 bp, homo sapien
tccctactctacttactgtgtgaatrataagatgggaagacctcctgact

SEQ ID NO: 13195 - DNA, 50 bp, homo sapien
tgtgtgaatcagaacaaatgactaaygtcaaacctggatacagataaaaa

SEQ ID NO: 13196 - DNA, 50 bp, homo sapien
ctgctggagaggacttcatgtcaccyagaaatcttggactttgagtggga

SEQ ID NO: 13197 - DNA, 50 bp, homo sapien
atctgaaataacaggcttgggtgagwcaacgatatgtttaattttatatt

SEQ ID NO: 13198 - DNA, 50 bp, homo sapien
agatgaatagagagatgaagtttggyaagaatgtgtcagtttgcaagtag

SEQ ID NO: 13199 - DNA, 50 bp, homo sapien
gcactcctttcctcacctatctaaarcctacctgttcttcaaagttcaac

SEQ ID NO: 13200 - DNA, 50 bp, homo sapien
acatgaaagggatcactccaacaaaygttactacttattggaaatttaaa

SEQ ID NO: 13201 - DNA, 50 bp, homo sapien
acctagactgaaggtgtgagcgctcragtttacaaagtcaagttttgcat

SEQ ID NO: 13202 - DNA, 50 bp, homo sapien
attctgcacgaagtagtctgatgacmaacgctggcttttctgaggccaat

SEQ ID NO: 13203 - DNA, 50 bp, homo sapien
aataaacctagcatggcagattagcrgagaataagtcaagaagaattatg

SEQ ID NO: 13204 - DNA, 50 bp, homo sapien
tctcagcatgaactcctgagtgaagsctctcctcagcgtgactcaggaac

SEQ ID NO: 13205 - DNA, 50 bp, homo sapien
atatcataatgtgaataatatcataygggctgctataaaggtctgtggtc

SEQ ID NO: 13206 - DNA, 50 bp, homo sapien
aatatatttaattatgatttagtaaygtgtgcagtttttcaatatgacct

SEQ ID NO: 13207 - DNA, 50 bp, homo sapien
attcttttgtgaggttcttaactcaytctctaaggctaaaaaatgtgaaa

SEQ ID NO: 13208 - DNA, 50 bp, homo sapien
ctgaccctcaccaacactggcattaygattttgaaaagtcttgagtagtt

SEQ ID NO: 13209 - DNA, 50 bp, homo sapien
ttggacttctttctgctttttctagrcagccagcatctctctatcctttt

SEQ ID NO: 13210 - DNA, 50 bp, homo sapien
gcttactctctcatagtacccatcayatcgtgcaataaacgtctgcctcc

SEQ ID NO: 13211 - DNA, 50 bp, homo sapien
gtcctcggccaagtactgaaagcacrgctctgttttatcttttccagata

SEQ ID NO: 13212 - DNA, 50 bp, homo sapien
aatttagaatgatcttttaacatacsagtgtaggattgttttttacaggt

SEQ ID NO: 13213 - DNA, 50 bp, homo sapien
caatttcagatctgctgttaagacasggctttcaaataggctgttcggtt

SEQ ID NO: 13214 - DNA, 50 bp, homo sapien
tgacaggtgcttgtggaaatcttgcygatatgtgttgaggacgtgctggt

SEQ ID NO: 13215 - DNA, 50 bp, homo sapien
taagagtggaaggaaaggtgcaagayaaaaaagcaagtcagagatctgag

SEQ ID NO: 13216 - DNA, 50 bp, homo sapien
aatcttaggaaaattactttcccaaygttcacttttctcatatataaaat

SEQ ID NO: 13217 - DNA, 50 bp, homo sapien
tcttgactataaatcgctcaaagtasgagccatgtcttaatcacatttga

SEQ ID NO: 13218 - DNA, 50 bp, homo sapien
aaatataatcgtggcacaaacatacrataggcattcccattccacaagag

SEQ ID NO: 13219 - DNA, 50 bp, homo sapien
cttcagttttcccttaaataaaatawgaatgataaatacctataatacat

SEQ ID NO: 13220 - DNA, 50 bp, homo sapien
tatttgactagaggaagtaggaatayagtttaagaccaagactatgatag

SEQ ID NO: 13221 - DNA, 50 bp, homo sapien
tcagtgtttcctttgtcaggatccaygggaaaatatctctcaggttgtgc

SEQ ID NO: 13222 - DNA, 50 bp, homo sapien
ctgtaagtgaatgaattttgtgatgkattatattattatgccaaatattc

SEQ ID NO: 13223 - DNA, 50 bp, homo sapien
agtttgtgaccttaattagcttttaygttgttattcctacttttagcgaa

SEQ ID NO: 13224 - DNA, 50 bp, homo sapien
tagataagacacttgctaattcttaraaggactggaaagaaatacagcat

SEQ ID NO: 13225 - DNA, 50 bp, homo sapien
ctgacagttaccttttaaaatttgcrcacattatgattaaaattgggcct

SEQ ID NO: 13226 - DNA, 50 bp, homo sapien
gtggttggccaggccttcctcaccartggaatcagtggccaagaccagtg

SEQ ID NO: 13227 - DNA, 50 bp, homo sapien
tgaggctgagagaagttaagatcacmcaagtggcggcgctggtcaccttt

SEQ ID NO: 13228 - DNA, 50 bp, homo sapien
tctaggatgacaagcccagtgtatcrgaaaatacaaactaatctcaatac

SEQ ID NO: 13229 - DNA, 50 bp, homo sapien
aacaaaaataaccttgagaagcaatragtaacctacaactcatcatgata

SEQ ID NO: 13230 - DNA, 50 bp, homo sapien
aggggaaaaatcctctttagacagayatttgtgtattagtggcaaatgct

SEQ ID NO: 13231 - DNA, 50 bp, homo sapien
atattacagtcacatccatatttgasaaactggaatcacactacagaata

SEQ ID NO: 13232 - DNA, 50 bp, homo sapien
acaggaagatggtacttaagaatccrgaagcacaagaacaaaatgaattt

SEQ ID NO: 13233 - DNA, 50 bp, homo sapien
gctctaaatgcaaatgtgacaatgaygtggttcttccaattcagaagctc

SEQ ID NO: 13234 - DNA, 50 bp, homo sapien
gattatatagttctcatcattgcackagctcttatgtaacttaagtgtat

SEQ ID NO: 13235 - DNA, 50 bp, homo sapien
gaatccattgaaaagacattaataakatttgcttggaactatatactgaa

SEQ ID NO: 13236 - DNA, 50 bp, homo sapien
ttctgttttgcacccaggtatatgcygatcattctttcatttaaaaaata

SEQ ID NO: 13237 - DNA, 50 bp, homo sapien
ctggctataactgctggaacacctartagaaataaaaccacaacaacagc

SEQ ID NO: 13238 - DNA, 50 bp, homo sapien
cagtatctgcctagcaaagcaataawcctcatataatgttttaataacat

SEQ ID NO: 13239 - DNA, 50 bp, homo sapien
tttgcatactcttagaaatctgtcaytctcttatacactaatctctgtgt

SEQ ID NO: 13240 - DNA, 50 bp, homo sapien
ggccctgctcaaagaatcctggaaasaagttacaaattgaagtattcaac

SEQ ID NO: 13241 - DNA, 50 bp, homo sapien
caagttgccaaggggtctcgacttayagcaatctttcaaaggcctaggat

SEQ ID NO: 13242 - DNA, 50 bp, homo sapien
aattataactgggacaattatgacartgaaagagattagacctaaccagc

SEQ ID NO: 13243 - DNA, 50 bp, homo sapien
cattttcacaatattatttttcaagycccttgttggatcttaagagagga

SEQ ID NO: 13244 - DNA, 50 bp, homo sapien
gttctgatgggattggcatccatcgyaatccagtctgatgcctgtgcagt

SEQ ID NO: 13245 - DNA, 50 bp, homo sapien
agaattaaaattttgacctatctcaycaagcgagagggaggcaagcggag

SEQ ID NO: 13246 - DNA, 50 bp, homo sapien
ttaaatagcaaggctgtgtagtttayaccaagatgagtgatccagacaat

SEQ ID NO: 13247 - DNA, 50 bp, homo sapien
ttagtttcatggtcttcttcagctaragttaaaataagtcgtcaataaag

SEQ ID NO: 13248 - DNA, 50 bp, homo sapien
aaagaggtccccaagcctttttatcrctaatctctgaagtctatggttct

SEQ ID NO: 13249 - DNA, 50 bp, homo sapien
aaacaagttcgacttgaattcaggayaccttactacaagctaggggagtt

SEQ ID NO: 13250 - DNA, 50 bp, homo sapien
taccagtgctatttgtaatggtaccraaagataacacattggctaaagtt

SEQ ID NO: 13251 - DNA, 50 bp, homo sapien
actgtgaattaatttacgtagaaaamgataatctaggccgggcgcggtgg

SEQ ID NO: 13252 - DNA, 50 bp, homo sapien
ttcacagagaaggtcgtatttgcacygagacatgaaggattagtggactt

SEQ ID NO: 13253 - DNA, 50 bp, homo sapien
gctgaaaggttgctttagattttccrgagaaagactataaatccttaaat

SEQ ID NO: 13254 - DNA, 50 bp, homo sapien
ccaaccatcacctttaaggaattacrgataccctaagactctgggtgttt

SEQ ID NO: 13255 - DNA, 50 bp, homo sapien
ttggaaacctcagcgagtacatgcaraatataactacaactttgtaagag

SEQ ID NO: 13256 - DNA, 50 bp, homo sapien
cgataaacatggtattctcagaaagwatttttagaatggaagatgactta

SEQ ID NO: 13257 - DNA, 50 bp, homo sapien
tcatctcagcagccagcctctctcakgtataccaagaatggaagccgaag

SEQ ID NO: 13258 - DNA, 50 bp, homo sapien
tcacctttttgtcctgtttaataaayctttcctgtacccaaatcaatttc

SEQ ID NO: 13259 - DNA, 50 bp, homo sapien
gtagagagggaagaatcatggaagtsacagaaagacaagtgatgttgttt

SEQ ID NO: 13260 - DNA, 50 bp, homo sapien
aaattcctctggattccttcaaccaygtctatttgtttccctacatccaa

SEQ ID NO: 13261 - DNA, 50 bp, homo sapien
cttgggaagcttgaaatagctctgargtgagtatgggtcattttctactt

SEQ ID NO: 13262 - DNA, 50 bp, homo sapien
ttgagtggtcatttctgagagttgamatattgactaatttatttctctct

SEQ ID NO: 13263 - DNA, 50 bp, homo sapien
cttctttttgctttctaggcacatamtactctttgtattgatctgtttac

SEQ ID NO: 13264 - DNA, 50 bp, homo sapien
gagatcatatgaagcatatctcatgyaatctgaaacttgaggtagataaa

SEQ ID NO: 13265 - DNA, 50 bp, homo sapien
ccaaagcttaaaggggaactcatcayaaaagtactggagtacaggaccct

SEQ ID NO: 13266 - DNA, 50 bp, homo sapien
tcatgttagttgcatgattaaattargatcggaatgtattgctttttaat

SEQ ID NO: 13267 - DNA, 50 bp, homo sapien
gagacagtggcaaggttagaaaaaartcatgcccttggagcatgtgtgtt

SEQ ID NO: 13268 - DNA, 50 bp, homo sapien
agtgttcctgccgctagatagatacrgtaatgattttcctactgctccag

SEQ ID NO: 13269 - DNA, 50 bp, homo sapien
cattaaaacaaacaataaaagttcargttctttcagctgagacacagatt

SEQ ID NO: 13270 - DNA, 50 bp, homo sapien
gcttataacctaatgcaacctaagawactctgagaattaattagtagctg

SEQ ID NO: 13271 - DNA, 50 bp, homo sapien
ctgaccttcagataatttcctggtayccggttcatgattctttattcccc

SEQ ID NO: 13272 - DNA, 50 bp, homo sapien
ctttaaacaaaaagaaaattagagaytagatgcagagccactggctgaaa

SEQ ID NO: 13273 - DNA, 50 bp, homo sapien
ggtcttagaagctgcttcagaattarggtctctcttatcttgtttttccc

SEQ ID NO: 13274 - DNA, 50 bp, homo sapien
taaattagtgtgaagaactcagatcrctatattccttgggaattcttgtc

SEQ ID NO: 13275 - DNA, 50 bp, homo sapien
acaaagtaaacatgcagtgttgtaayaagttttaattaccaaacgataaa

SEQ ID NO: 13276 - DNA, 50 bp, homo sapien
gttcagaggcttgtatatagtttacrattcaaaatattatgaaattgaac

SEQ ID NO: 13277 - DNA, 50 bp, homo sapien
cttgggccgatgactacttgttttaygtttctggaagattttgattcaga

SEQ ID NO: 13278 - DNA, 50 bp, homo sapien
gctggtaacaaaatcttttcaggacrctcgtgcaacagtgaagctaaagt

SEQ ID NO: 13279 - DNA, 50 bp, homo sapien
atttttcagagaaccaaaggtaatayatcctgcattaaaatcactgagat

SEQ ID NO: 13280 - DNA, 50 bp, homo sapien
atatatcctgcattaaaatcactgaratacggatcagaagtcctgaattt

SEQ ID NO: 13281 - DNA, 50 bp, homo sapien
attgaaggtcttctatgcctaagacyaataattgctcctagacttttgag

SEQ ID NO: 13282 - DNA, 50 bp, homo sapien
ccatcagttattaaatcaaccttacygggaatgtggtctggtgtataact

SEQ ID NO: 13283 - DNA, 50 bp, homo sapien
ccctaagttcagttcttttgaggaaytagcactctttctgaaagttaaat

SEQ ID NO: 13284 - DNA, 50 bp, homo sapien
atgttatgccagtggttaatgtggayggttatgactactcatggaaaaag

SEQ ID NO: 13285 - DNA, 50 bp, homo sapien
gacatctaaactgtttactgctgacyatgaatttgccatactttgcagga

SEQ ID NO: 13286 - DNA, 50 bp, homo sapien
gtcataaattggtcagcattctggamatctgaagccttgagatattagta

SEQ ID NO: 13287 - DNA, 50 bp, homo sapien
ctttataaggtgattgtttcttttayggaatgtattaggtagatatcttt

SEQ ID NO: 13288 - DNA, 50 bp, homo sapien
actaggatataataaatgttcaaaawgttacttgttattattaactgtgc

SEQ ID NO: 13289 - DNA, 50 bp, homo sapien
ttaagtaagattgactttaccactawgggagtaattgtcaatgaatacca

SEQ ID NO: 13290 - DNA, 50 bp, homo sapien
taactttcatattctcttaaccgcaratgaaatgagcctcaaaacaaaca

SEQ ID NO: 13291 - DNA, 50 bp, homo sapien
taggtgtggttatcagagcaggtacwggctatttggagacatgcctccag

SEQ ID NO: 13292 - DNA, 50 bp, homo sapien
gcctgtacctgctctgataaccacasctaaatttaagcctatcctgaaac

SEQ ID NO: 13293 - DNA, 50 bp, homo sapien
aacaaagtcacagtgaaaagccaggmaactagactctgaccatcttaaag

SEQ ID NO: 13294 - DNA, 50 bp, homo sapien
ttaaaaattaggcttcgtatttcaawattagttctcaataaacaatcaat

SEQ ID NO: 13295 - DNA, 50 bp, homo sapien
atggaaaaagtcctctaagccaccaytgggagtacaaatcattactttat

SEQ ID NO: 13296 - DNA, 50 bp, homo sapien
tatctactctcattgatgaaatttakactcgattatcatacattgtagtt

SEQ ID NO: 13297 - DNA, 50 bp, homo sapien
tattatgtgttaaaaatgtatgaatsaggcaaggtcttgcatttcccctg

SEQ ID NO: 13298 - DNA, 50 bp, homo sapien
taggaagaagtttaaatttatgtcamcattctattcagaactagaagttt

SEQ ID NO: 13299 - DNA, 50 bp, homo sapien
taccaggctagtacctgagaaataasctgatttgggaaataaaatcttac

SEQ ID NO: 13300 - DNA, 50 bp, homo sapien
gtattctgtcctccaaaagtgtccaygaaggaggatctgctgagatgaca

SEQ ID NO: 13301 - DNA, 50 bp, homo sapien
caaaactcttaaaatattaagcgtargagtctattgttcctttgttttcc

SEQ ID NO: 13302 - DNA, 50 bp, homo sapien
gcttgttctttctctaagttatgaaraaacatgcacgcgcgcgcgcacac

SEQ ID NO: 13303 - DNA, 50 bp, homo sapien
acttttcctcctcagccaaaaatacyatttctctcatttaagcttccata

SEQ ID NO: 13304 - DNA, 50 bp, homo sapien
cgttaaaacttcatcttctttggccrctgtaaaaaagcaactgaatagag

SEQ ID NO: 13305 - DNA, 50 bp, homo sapien
atcctgtatcttctatctaatataarggcttacgtagaaggatgcatgga

SEQ ID NO: 13306 - DNA, 50 bp, homo sapien
aaaaaaagataaaaatgtacattcawccaattccatatcaaagcagtttt

SEQ ID NO: 13307 - DNA, 50 bp, homo sapien
acattggaagggagtactgaaaaaayggtctttcttgtgaggaggagatt

SEQ ID NO: 13308 - DNA, 50 bp, homo sapien
tcacatttcaaaagggattatagagyaaatgctagcatattgaataataa

SEQ ID NO: 13309 - DNA, 50 bp, homo sapien
gaaattggacatttagaaaattggayatgtagaaaattccatacttctcg

SEQ ID NO: 13310 - DNA, 50 bp, homo sapien
ctttatgcatggtgtaacattctackctgcctttggttactagtaagaga

SEQ ID NO: 13311 - DNA, 50 bp, homo sapien
aatgacataaaaaatcagagtgtaamcctaataaaatgtttactttacct

SEQ ID NO: 13312 - DNA, 50 bp, homo sapien
tcttaaccactcagccattctgtcaytgaatatggttttcaatagagttg

SEQ ID NO: 13313 - DNA, 50 bp, homo sapien
ttgggcctgtgtatatttgaaaatarcatacagtattcagtcgtttaagt

SEQ ID NO: 13314 - DNA, 50 bp, homo sapien
caaatttgctatttgaaataataaartgtttagtgctgtattgtaaaaat

SEQ ID NO: 13315 - DNA, 50 bp, homo sapien
tgctttttattcatcattcattcaaragacactaaagatccatagataaa

SEQ ID NO: 13316 - DNA, 50 bp, homo sapien
tcaaacagataatagtcagtattaargaaacctaaaagaacatacatata

SEQ ID NO: 13317 - DNA, 50 bp, homo sapien
aagcggtaaatatggtttgtagggcragaaagacaatgttaaatttgtct

SEQ ID NO: 13318 - DNA, 50 bp, homo sapien
atacaaaataatagaaatgacataartagttcatagagtcaatacctgca

SEQ ID NO: 13319 - DNA, 50 bp, homo sapien
acttgagtcttgccaataatgcaaaragagatcataagaaatagtctaga

SEQ ID NO: 13320 - DNA, 50 bp, homo sapien
ctctttatgcttaagatctaatcaasttagaagtattaaaagtctgatct

SEQ ID NO: 13321 - DNA, 50 bp, homo sapien
gctatttgtaatgctgcttattagakacatcgctgatcctcctgtcaact

SEQ ID NO: 13322 - DNA, 50 bp, homo sapien
cacctgccactctaactagaagatgyagaaccagaggtcgtattgaaaca

SEQ ID NO: 13323 - DNA, 50 bp, homo sapien
tctgaatcatcaaggacaaccatctyaaccatcagggacagcagtaaatc

SEQ ID NO: 13324 - DNA, 50 bp, homo sapien
tgctcataacaactaaaaactagcaragcaaccagaagtataatataaat

SEQ ID NO: 13325 - DNA, 50 bp, homo sapien
tgccttttaacagtgaatatacctargcagagagatttagggtgattttt

SEQ ID NO: 13326 - DNA, 50 bp, homo sapien
aaacagatgaacaagagagaaacaarcacgtatagtaatgctgcagtgca

SEQ ID NO: 13327 - DNA, 50 bp, homo sapien
tgcttttcagagagaaatcctcatgratagggcagtagggacgtctgaat

SEQ ID NO: 13328 - DNA, 50 bp, homo sapien
gtaggttcagagtagggcctaccgcragacatgatcctttattctaaagt

SEQ ID NO: 13329 - DNA, 50 bp, homo sapien
gaatataccagcctgacaaattaaartgaccatgctattagaacaagtct

SEQ ID NO: 13330 - DNA, 50 bp, homo sapien
aatagacataaaatagagaatgaaamgaggttaattttatgagcttaacc

SEQ ID NO: 13331 - DNA, 50 bp, homo sapien
agtaagtcaaatatgcagttgatgasattgtagtgtaataacgagaaagg

SEQ ID NO: 13332 - DNA, 50 bp, homo sapien
atcttagaacttccgggatgcaaccratctgtggtgcctgggttgcctgc

SEQ ID NO: 13333 - DNA, 50 bp, homo sapien
ttctcaaggtcatttatctaagtcawaagcaataagaaagaatgactact

SEQ ID NO: 13334 - DNA, 50 bp, homo sapien
catattatttgatgagtaagttagaraagaacctctgggaatgagaaaga

SEQ ID NO: 13335 - DNA, 50 bp, homo sapien
gcatctttatcataatgaattgcgayagataaaaattcagaacacttttt

SEQ ID NO: 13336 - DNA, 50 bp, homo sapien
gcttcagaggctgggggatgtggtayaaaaagtgctaaacttagagttgg

SEQ ID NO: 13337 - DNA, 50 bp, homo sapien
tactactaagcttttcgttcacacasagtttgcaaagcagtcatggagga

SEQ ID NO: 13338 - DNA, 50 bp, homo sapien
attcagagagacttgggaaagaataygaaataacttattaatgacttgaa

SEQ ID NO: 13339 - DNA, 50 bp, homo sapien
cgctcctcatatcatagaacaattaycttaatcataggaaagcttagaag

SEQ ID NO: 13340 - DNA, 50 bp, homo sapien
agctccagacagctggagtaaaatarcatttctcacaggtaaggatgtcc

SEQ ID NO: 13341 - DNA, 50 bp, homo sapien
taatggtcactctttcagtgaataayggagaaattcaagactatggaagt

SEQ ID NO: 13342 - DNA, 50 bp, homo sapien
cattgctgttactataaaaaatatckcagtttgggctgggtgtggtggct

SEQ ID NO: 13343 - DNA, 50 bp, homo sapien
aaagtggtttgtatttccagtgtcaktagagcttcctcactcttttcctg

SEQ ID NO: 13344 - DNA, 50 bp, homo sapien
aaatttttattcattacctcaccaasattatattatatgttttaacgctc

SEQ ID NO: 13345 - DNA, 50 bp, homo sapien
tgacaggaggattaaattaaagttaygtctacacggatgtcttccttgtg

SEQ ID NO: 13346 - DNA, 50 bp, homo sapien
tatgattgacactgccaaggaaaacrgttaacaggagacactaacttaga

SEQ ID NO: 13347 - DNA, 50 bp, homo sapien
ggctgaggaataaccttaagaactcraatccaagtatgagttgctagagt

SEQ ID NO: 13348 - DNA, 50 bp, homo sapien
atgtatatatatttttttgatgactraatgaacaaatcaaagtgtagagt

SEQ ID NO: 13349 - DNA, 50 bp, homo sapien
aaattaaattggtataccttaaatawatcatcctccctctctgccaaata

SEQ ID NO: 13350 - DNA, 50 bp, homo sapien
tgcctgagagaattggatttagaagkctatggaaattattaggaagatgg

SEQ ID NO: 13351 - DNA, 50 bp, homo sapien
cattgttgataggaagagaatactamattcaacatgtttcataggagact

SEQ ID NO: 13352 - DNA, 50 bp, homo sapien
tggatatagcttgataattggaatayagaaaagatgcaaaatttaagaaa

SEQ ID NO: 13353 - DNA, 50 bp, homo sapien
tcaaggctacaggatcctgatttacyaaaaagatgataccaaatacttgc

SEQ ID NO: 13354 - DNA, 50 bp, homo sapien
ctgaagtttggttctcatatcttaaragagaaatttatagcaataaacac

SEQ ID NO: 13355 - DNA, 50 bp, homo sapien
gtggataactggccctcacagctcasgtattttagctcatctgtaccagg

SEQ ID NO: 13356 - DNA, 50 bp, homo sapien
gtctccaaactggctgaatttaccayggactatttttctagcatttggat

SEQ ID NO: 13357 - DNA, 50 bp, homo sapien
gtgtagactgcaaaagagagtaataratccaaatgagtcctgtatgaatt

SEQ ID NO: 13358 - DNA, 50 bp, homo sapien
gaaaatagatgtttactctagtggayatttctggttaggatccagaatcc

SEQ ID NO: 13359 - DNA, 50 bp, homo sapien
tttgtgatctcatctgagtgttagamggaaagtcacatggtgaattcacc

SEQ ID NO: 13360 - DNA, 50 bp, homo sapien
ttagtcatttgtattcttttacccaycagtgatccaggttgcaaggtcag

SEQ ID NO: 13361 - DNA, 50 bp, homo sapien
atgtgctagtatcaaacgagacttcratttataggacttggattgctact

SEQ ID NO: 13362 - DNA, 50 bp, homo sapien
atttgaatcctggatctgatctttaygatcttaagcaagttaccaatctc

SEQ ID NO: 13363 - DNA, 50 bp, homo sapien
cattttaagagtgtcagaattgccawcctaactttcccatagcattgcaa

SEQ ID NO: 13364 - DNA, 50 bp, homo sapien
aattgaaagataggactttcttccakgaaaagatttcacatctctgtcct

SEQ ID NO: 13365 - DNA, 50 bp, homo sapien
ctgcagatgacctccagagcaccacraatactggttttgggactaaaaat

SEQ ID NO: 13366 - DNA, 50 bp, homo sapien
gaaatagtgccattcaacaacagaaygtgcagtgtgttttttgtttgttt

SEQ ID NO: 13367 - DNA, 50 bp, homo sapien
tgcattaatttgataataatgtgaartggtcctaagttattctgcaaatt

SEQ ID NO: 13368 - DNA, 50 bp, homo sapien
taacacatctttaatacaaaataacrggtatggatataatatcaacccat

SEQ ID NO: 13369 - DNA, 50 bp, homo sapien
atgaggatgtcactaactgtcctaawcttaagcattgtcgaaaataaaat

SEQ ID NO: 13370 - DNA, 50 bp, homo sapien
taatggtgatgtgcacggttcttatyacgctgccactgcctctcagcact

SEQ ID NO: 13371 - DNA, 50 bp, homo sapien
ctgggaaacatggatatgaatttagsaagaaaaatttaagaagacaaaac

SEQ ID NO: 13372 - DNA, 50 bp, homo sapien
tcatcaggcccatgaatggggaatarcttagtgctgagaggcagtggcag

SEQ ID NO: 13373 - DNA, 50 bp, homo sapien
cacttggcccacatgtaacaataaaracaagaccaatagccagccaagag

SEQ ID NO: 13374 - DNA, 50 bp, homo sapien
actgagatctattagaataatgcaaygttttttaaaaatttagtacacaa

SEQ ID NO: 13375 - DNA, 50 bp, homo sapien
taaataataacgaagatcacaatagkaataaatgatgaagacagtagtgc

SEQ ID NO: 13376 - DNA, 50 bp, homo sapien
acacacactgatattagaatcaaggyattttctgacatacacatcctcaa

SEQ ID NO: 13377 - DNA, 50 bp, homo sapien
aaaagttactttcattttctttaatsacatttttgtagaatggtatcaga

SEQ ID NO: 13378 - DNA, 50 bp, homo sapien
ttgaagtaatcaagaaaatttttaasctcgattcaaatttcaatacttaa

SEQ ID NO: 13379 - DNA, 50 bp, homo sapien
gtaagcgctaaatgtatttcggctayagtaagaatcagcattgaccataa

SEQ ID NO: 13380 - DNA, 50 bp, homo sapien
caagagtactagacaacgtataagcragtatttatataatgttgggatgg

SEQ ID NO: 13381 - DNA, 50 bp, homo sapien
ctagacctttttcaatacgcaaaacrgaaactatatccactaaacaccga

SEQ ID NO: 13382 - DNA, 50 bp, homo sapien
tgagttaattttttttggagttcacrcaatcagaagttttatcttctaga

SEQ ID NO: 13383 - DNA, 50 bp, homo sapien
ctaacataatacttgacatttactamgggctcaaataaatagatgtgatg

SEQ ID NO: 13384 - DNA, 50 bp, homo sapien
ccacaattctttcagaacacatcgaytacatatatacatatctccttaca

SEQ ID NO: 13385 - DNA, 50 bp, homo sapien
ttgagctattccactaatacaactayaagatcagtagagtcacaataaag

SEQ ID NO: 13386 - DNA, 50 bp, homo sapien
tatactatagccaagttgatacataraactgaccatcatgggagaccata

SEQ ID NO: 13387 - DNA, 50 bp, homo sapien
gagacagccactcccactggagaaargaatgtccctggtcctatgagaac

SEQ ID NO: 13388 - DNA, 50 bp, homo sapien
agatagatttcactaacatcgaaaamcttaaagatgaaataatgacttat

SEQ ID NO: 13389 - DNA, 50 bp, homo sapien
ttaagtcatttctcattaaaatatayctctactgcatattctggttgata

SEQ ID NO: 13390 - DNA, 50 bp, homo sapien
taagcagttgaaggctaaaggactaygtcttatttctcttggagcaagac

SEQ ID NO: 13391 - DNA, 50 bp, homo sapien
gcctgaatgcaccaatgtatgaaaakgaccataactatctccgggaagac

SEQ ID NO: 13392 - DNA, 50 bp, homo sapien
tttaagtaccctggtcttgagattasgcaatgattccaacactggtcatt

SEQ ID NO: 13393 - DNA, 50 bp, homo sapien
tcttaggggaagaaaatccactctaygtgactgattcaaacatgattcat

SEQ ID NO: 13394 - DNA, 50 bp, homo sapien
tgaattggatagtggttaagtatggkattttaatgacctgttacctgagt

SEQ ID NO: 13395 - DNA, 50 bp, homo sapien
tacaaaaaataaaggtgtatgcaggyaagacaattttgctcctttctcct

SEQ ID NO: 13396 - DNA, 50 bp, homo sapien
agtggtggaaatctattaaccaaacwagcaacaaggacaaaatataaaat

SEQ ID NO: 13397 - DNA, 50 bp, homo sapien
cagctcctgttatgtttccttctgaygttcctgctaatcttacatgaggt

SEQ ID NO: 13398 - DNA, 50 bp, homo sapien
taccctgtgatcttctcagagcttgyaaatggagtttttgatgccatagt

SEQ ID NO: 13399 - DNA, 50 bp, homo sapien
ttttcaaaaatagaaatgtatgtgasataagagtgttccttttgatattg

SEQ ID NO: 13400 - DNA, 50 bp, homo sapien
attcgtcatgcttgttactgcaatcratttctattttcctctaaacctcc

SEQ ID NO: 13401 - DNA, 50 bp, homo sapien
ttggggggaggtgtgtgtgtatttargaaatatgatgagttcactttctg

SEQ ID NO: 13402 - DNA, 50 bp, homo sapien
ttaaatcaaacaacggaagaatgacrcgtaacaaatatttaaaaggctaa

SEQ ID NO: 13403 - DNA, 50 bp, homo sapien
tatgttccatgacatgaaagacaacmattttttcttgtgttaattatctg

SEQ ID NO: 13404 - DNA, 50 bp, homo sapien
cctttaatatcagcttgaatggttargatacagttttcatacaggatata

SEQ ID NO: 13405 - DNA, 50 bp, homo sapien
gagaattattttccatttcaagtatmaaagtgaatgctttaataaaataa

SEQ ID NO: 13406 - DNA, 50 bp, homo sapien
ttattagtattcaatttccagacatragagttagcaaatgtcttaaagct

SEQ ID NO: 13407 - DNA, 50 bp, homo sapien
aaatgaacaatattagataacagaaratcagactgaaatatcatattgcc

SEQ ID NO: 13408 - DNA, 50 bp, homo sapien
ttcccaagatatctgagatgttacasagatccgagttgcacattaccatg

SEQ ID NO: 13409 - DNA, 50 bp, homo sapien
acttgtctaacattactccacacaamtaagaatggtcaaacggaaaatga

SEQ ID NO: 13410 - DNA, 50 bp, homo sapien
agcagattttattgtggagatgggasagtagtatggccagggaagacaat

SEQ ID NO: 13411 - DNA, 50 bp, homo sapien
cagaaaaaataactttctcattcagrcattcagctcatttatcaacagtg

SEQ ID NO: 13412 - DNA, 50 bp, homo sapien
aattgtaaataattatgtgaaggtamaaagttaacattagcgagattggc

SEQ ID NO: 13413 - DNA, 50 bp, homo sapien
tgtcttttaggacactaatgatccakatgtgggaactgtggtataccact

SEQ ID NO: 13414 - DNA, 50 bp, homo sapien
tcattctactttcatctgatagatasagtcaacaaaactaatttcacagc

SEQ ID NO: 13415 - DNA, 50 bp, homo sapien
aagctgtatttatgaatttcatcaayttagtgagacatatactaataaat

SEQ ID NO: 13416 - DNA, 50 bp, homo sapien
aaatacattaaacctctttccttaaytgattatgcagtcttgggtatgtc

SEQ ID NO: 13417 - DNA, 50 bp, homo sapien
tgaaccaagttcttacagtcttgaartaactgaaattcataaacctacat

SEQ ID NO: 13418 - DNA, 50 bp, homo sapien
tgcaaataaaatggtaaaacagcagraaatggaattatagctttcttttc

SEQ ID NO: 13419 - DNA, 50 bp, homo sapien
tcttattagttttttcctggtaatakctgctctttatgatttaaactcaa

SEQ ID NO: 13420 - DNA, 50 bp, homo sapien
agagagactagtaagatttgccatamatgttgtaagaattgatgaatcaa

SEQ ID NO: 13421 - DNA, 50 bp, homo sapien
ttaatgactatctgaatagactatarcatttaacaaacgatattgccaaa

SEQ ID NO: 13422 - DNA, 50 bp, homo sapien
ctgaatctaaaataactttcacataygttggtggttcaaaatctgaagac

SEQ ID NO: 13423 - DNA, 50 bp, homo sapien
attccatctaaatagatatggtagawgcataagaactgaataagtgcatt

SEQ ID NO: 13424 - DNA, 50 bp, homo sapien
agggtggaggaaacattgtctacaamtgaggtaaatgtaatgataacctt

SEQ ID NO: 13425 - DNA, 50 bp, homo sapien
gtcaaatacataaaaattaaacatgractggacaattataagatcttggg

SEQ ID NO: 13426 - DNA, 50 bp, homo sapien
tgttaaaatcagagtgttaggatttraaatagcccatgctagactttgtg

SEQ ID NO: 13427 - DNA, 50 bp, homo sapien
aagaggcttttaaaaggtcatgcaartaatgctgagttcatagtaacact

SEQ ID NO: 13428 - DNA, 50 bp, homo sapien
gtactacagatgttctttaagtatcrgaggtacatggaagttcctgggaa

SEQ ID NO: 13429 - DNA, 50 bp, homo sapien
gttttaatttttatcctgaatactaygaagattggtgaagaaaaaaacat

SEQ ID NO: 13430 - DNA, 50 bp, homo sapien
gttttgggatgaaactgtgtactacragcagtgcaagaatgtaagccctg

SEQ ID NO: 13431 - DNA, 50 bp, homo sapien
atttatgaacataggtaacattatcyacaaagaatttcactggaagaaag

SEQ ID NO: 13432 - DNA, 50 bp, homo sapien
cactcactatatctgatcatacaaayttagatgagacctcaataacacaa

SEQ ID NO: 13433 - DNA, 50 bp, homo sapien
atatccagttcatttataagccatargattttacctcctgaatatctctg

SEQ ID NO: 13434 - DNA, 50 bp, homo sapien
tagaagctgttccatttgacactacrataaaaggtagtaattggcaatgt

SEQ ID NO: 13435 - DNA, 50 bp, homo sapien
gcctttaagtttctagagatatttargcacagaaagaagaaagcttgtat

SEQ ID NO: 13436 - DNA, 50 bp, homo sapien
actgtgtctatgtcctagtactctgraagactgaatttaagagtgattct

SEQ ID NO: 13437 - DNA, 50 bp, homo sapien
gaagacatctagcttagacttgttaygaatgtttcaactactaccagatt

SEQ ID NO: 13438 - DNA, 50 bp, homo sapien
aagcctacaaaatttgcagtcgttaygttctaaagtttgaataagcttca

SEQ ID NO: 13439 - DNA, 50 bp, homo sapien
atgatctattctcaagagctactcartgaaagaaaaaagacctgaaataa

SEQ ID NO: 13440 - DNA, 50 bp, homo sapien
tttcaaaaagagtctgagagccttaygacatggcctttattgatttttcc

SEQ ID NO: 13441 - DNA, 50 bp, homo sapien
aaataataatgatttaacctacagargtccttaggaaacatttttcaaaa

SEQ ID NO: 13442 - DNA, 50 bp, homo sapien
aaagcagcttctgggcaccaccaaartaatggtcagagtggtactggctg

SEQ ID NO: 13443 - DNA, 50 bp, homo sapien
aagtagaattagtgacaatccacaamtatttatagggctattacactcat

SEQ ID NO: 13444 - DNA, 50 bp, homo sapien
atgatttagaacatagagaaactcayaccgtcaattcacctagttcttat

SEQ ID NO: 13445 - DNA, 50 bp, homo sapien
ttctagctgctggagccaagagttaygatagtgagatataccacactcac

SEQ ID NO: 13446 - DNA, 50 bp, homo sapien
agttaacagcttgagtactgaaatayggttcttcctcttatattacttga

SEQ ID NO: 13447 - DNA, 50 bp, homo sapien
attcttgatttgtgtaatggttagcragttatttgtggaattttacagta

SEQ ID NO: 13448 - DNA, 50 bp, homo sapien
tgatattctttttctatttagtcttkaaaagcatttacttaaagcttttt

SEQ ID NO: 13449 - DNA, 50 bp, homo sapien
ttctggcagggatattctaccaagcygaactatttttggataccagctaa

SEQ ID NO: 13450 - DNA, 50 bp, homo sapien
atgtgcaggtgtctttcagtgaacaraggggctaagtaattgatgaaatg

SEQ ID NO: 13451 - DNA, 50 bp, homo sapien
ttaactcatgaaatcacttacttaaraaaaattgactactcaaacaacta

SEQ ID NO: 13452 - DNA, 50 bp, homo sapien
ctgcaatctaggacctaatgtcaacraatatgatctaaggccccggaatt

SEQ ID NO: 13453 - DNA, 50 bp, homo sapien
gaaatggaccactgcatataccacayggatgcttttgttaggaccactgt

SEQ ID NO: 13454 - DNA, 50 bp, homo sapien
ttccactgggctggatacatgtagasgatgaatgacagcaggatgctgaa

SEQ ID NO: 13455 - DNA, 50 bp, homo sapien
gttagtctttgttctgtataactcaycctagaaacagtgaacttcaaaaa

SEQ ID NO: 13456 - DNA, 50 bp, homo sapien
aaagatattttgagcctaggaccttraagatataaagtggttcagcagta

SEQ ID NO: 13457 - DNA, 50 bp, homo sapien
cgggaagcccaatatagacttttcaraaacttctatttaacagcctttta

SEQ ID NO: 13458 - DNA, 50 bp, homo sapien
cctggtttaagcagaatggaacttamctcattttcatttgatctgtaata

SEQ ID NO: 13459 - DNA, 50 bp, homo sapien
agcccaatctgtgtcttgaagcaatsattatcttaataattgaagcagcc

SEQ ID NO: 13460 - DNA, 50 bp, homo sapien
ttatcttttagacaagaagagaataycaaaattatggcataaacttttaa

SEQ ID NO: 13461 - DNA, 50 bp, homo sapien
agggacactaccttatatagttgagwcatctttcatgagctctcctattc

SEQ ID NO: 13462 - DNA, 50 bp, homo sapien
ggggtcctggaccaagaatttttgaraaccgctcttataatcaaacacct

SEQ ID NO: 13463 - DNA, 50 bp, homo sapien
tacaatgaataaaagatcaaattccratgagtatctgaatcaagggaagg

SEQ ID NO: 13464 - DNA, 50 bp, homo sapien
tgtttacatgcagtgataatgttaayaaaactaggtcatcatctttaaac

SEQ ID NO: 13465 - DNA, 50 bp, homo sapien
atcccatttccttcaatgcttcttcmaaacctatgagcccttctcaaaac

SEQ ID NO: 13466 - DNA, 50 bp, homo sapien
atatccctttcattaacaatcaatcycaaaatggttagaagtatcagata

SEQ ID NO: 13467 - DNA, 50 bp, homo sapien
gtaaatgtgtgaaaacaatttatacrcaattcaatagactttgtaagatg

SEQ ID NO: 13468 - DNA, 50 bp, homo sapien
aaattaatcttacatgtacactgtcrgaaaactttcatttatcacagtta

SEQ ID NO: 13469 - DNA, 50 bp, homo sapien
ataggaagatacatggaaattagtarcaagtcagatttccctgttttatt

SEQ ID NO: 13470 - DNA, 50 bp, homo sapien
cacattgatcatctgaaatattttasaacccacaggatatgctggaggag

SEQ ID NO: 13471 - DNA, 50 bp, homo sapien
aaatgttatattttattaataaccayattttgtcagaaaagaggaaatgt

SEQ ID NO: 13472 - DNA, 50 bp, homo sapien
acagtaaaaagtgaagcctgaagaargttgacaaaaggaaaggaaagagc

SEQ ID NO: 13473 - DNA, 50 bp, homo sapien
cattacaccaatagtacatttttgayaaagcatagcaacaacacacagca

SEQ ID NO: 13474 - DNA, 50 bp, homo sapien
aaatgaatttggaaaacttcccagastattattgcttttataaggcaact

SEQ ID NO: 13475 - DNA, 50 bp, homo sapien
aactttttttatgtcgaagaatttcyctactatttctagtttgctatcaa

SEQ ID NO: 13476 - DNA, 50 bp, homo sapien
aaaatttatttgagctgaatcttacmaatcaaaatatcttctacatgaac

SEQ ID NO: 13477 - DNA, 50 bp, homo sapien
tttacttattttgctttaatgttgcrgaattatattgctattgtactttt

SEQ ID NO: 13478 - DNA, 50 bp, homo sapien
gacatcaatccacaagtttcaactayctattatctataatctctaattac

SEQ ID NO: 13479 - DNA, 50 bp, homo sapien
tataatgaaagcatttcaccttctarcaactgataggaataaccagcaat

SEQ ID NO: 13480 - DNA, 50 bp, homo sapien
aggaaaactatcttttttaagtataygcttaactgtttttgaacataaca

SEQ ID NO: 13481 - DNA, 50 bp, homo sapien
agctacctattttttcaacattcaartatgcattaattgtctacactttg

SEQ ID NO: 13482 - DNA, 50 bp, homo sapien
tagtgttaaatgtcgataggactcamaaaaggcaatgtctcacttctacc

SEQ ID NO: 13483 - DNA, 50 bp, homo sapien
caatagatgtgagcaaacctagtcastagaattactgtggacaatgagcc

SEQ ID NO: 13484 - DNA, 50 bp, homo sapien
tgtgaataatcaggctcttctataakgaaggtaagatacgaaacaaatat

SEQ ID NO: 13485 - DNA, 50 bp, homo sapien
gctttcaatttttgtaagtaaaaacwgtatatagagtcaattttgttcct

SEQ ID NO: 13486 - DNA, 50 bp, homo sapien
aaacccgaagggtcaggggttgtcasagagcccttttccggacagcctga

SEQ ID NO: 13487 - DNA, 50 bp, homo sapien
taatcttcctgaaacattacttagaygacatttttctggtcaaacacctt

SEQ ID NO: 13488 - DNA, 50 bp, homo sapien
ctcgtgatcatgtattcccactaacwgtgattccatgaatgaattatcat

SEQ ID NO: 13489 - DNA, 50 bp, homo sapien
cagttgaccatattttcttccatccrataccaattattgaatggttgaaa

SEQ ID NO: 13490 - DNA, 50 bp, homo sapien
ttaggcaaagcttaattacacatatsaagatctttatttatttttaaaat

SEQ ID NO: 13491 - DNA, 50 bp, homo sapien
atcttgaaataaatgtctattgatcraaatgaaataaaaattgcctcaaa

SEQ ID NO: 13492 - DNA, 50 bp, homo sapien
tcggtgtgtatgtgggtatatacaaytatctactcatggcatatatatac

SEQ ID NO: 13493 - DNA, 50 bp, homo sapien
tcttcttcatcagcactcttttctaycaaattgttcttgggaagtcatca

SEQ ID NO: 13494 - DNA, 50 bp, homo sapien
aaaatgcatgcaaatgttatttaacrccagtgaggagcctaaggaaacca

SEQ ID NO: 13495 - DNA, 50 bp, homo sapien
tattttatgtttgcactaaaatatartaaaatacagtattgtcttttcag

SEQ ID NO: 13496 - DNA, 50 bp, homo sapien
aaaacagaattgttgtttagaggaamcaagtttattgcattgcacaatct

SEQ ID NO: 13497 - DNA, 50 bp, homo sapien
accaaatcatttattacaaatcaaawtttcctacttattacagctaacaa

SEQ ID NO: 13498 - DNA, 50 bp, homo sapien
acatttaattgtgcatgattgaggaytatctctgtgttaatttaatggga

SEQ ID NO: 13499 - DNA, 50 bp, homo sapien
aacacttccagaatactagaataaartctcttaaaaatcagcttttaata

SEQ ID NO: 13500 - DNA, 50 bp, homo sapien
tgggtgctcttatactttggcaccamcaatttatactacaaaattatgga

SEQ ID NO: 13501 - DNA, 50 bp, homo sapien
gagacttacatgaagactctttgaayatttgaacgagttttggagatgca

SEQ ID NO: 13502 - DNA, 50 bp, homo sapien
tcaaagctggcaggtgctcactaaamagaacattaatttgggagatttaa

SEQ ID NO: 13503 - DNA, 50 bp, homo sapien
tatcaacacagccatttttatcccawagactaatgtttggcaacttgaag

SEQ ID NO: 13504 - DNA, 50 bp, homo sapien
acttgaaattactttcacttattaaratgcaatcaaggttttggtagctt

SEQ ID NO: 13505 - DNA, 50 bp, homo sapien
tgttatgctgactcttaggacatgcycttggaaacagtgccctttggata

SEQ ID NO: 13506 - DNA, 50 bp, homo sapien
aattaaatgagtgggtgaaatcatayaaaaataagtattcctaatcagta

SEQ ID NO: 13507 - DNA, 50 bp, homo sapien
atgaaattataaaaggataactaatwatagtgtaattgactatcttatgg

SEQ ID NO: 13508 - DNA, 50 bp, homo sapien
agataggtcatatgatattgtacagwcagaagagcaaaaacagagaagaa

SEQ ID NO: 13509 - DNA, 50 bp, homo sapien
aattacattgtatttgcccttgtatyactaggtgtcccagtgatgaggtg

SEQ ID NO: 13510 - DNA, 50 bp, homo sapien
ataaaactatgaatattaagagaacrctttatgctgttggcaatttcagt

SEQ ID NO: 13511 - DNA, 50 bp, homo sapien
agaatagtctctttgagactagtaartgatgtgggaaaacaagatatctg

SEQ ID NO: 13512 - DNA, 50 bp, homo sapien
attgtaaggcacttttcacgaataawaaccactgataatacatttagaaa

SEQ ID NO: 13513 - DNA, 50 bp, homo sapien
cctattttacctatgttgaatcaccraaggaaacaaggtcaaaacaaagt

SEQ ID NO: 13514 - DNA, 50 bp, homo sapien
gtgataaagatatagataatagatargtaaatcaaaattctagagataaa

SEQ ID NO: 13515 - DNA, 50 bp, homo sapien
catttaaataaattgagtatgtaaartgggacatgaacctttttagaagt

SEQ ID NO: 13516 - DNA, 50 bp, homo sapien
atgattaagcattctaatatgggaargatactggccaatagtatttaaca

SEQ ID NO: 13517 - DNA, 50 bp, homo sapien
gctttggtggtcatgtagggagaacraaaatggacttaatgtacacaaaa

SEQ ID NO: 13518 - DNA, 50 bp, homo sapien
aagattgcctctaaataggatgaagwagtatagaaatgaagccaagatgt

SEQ ID NO: 13519 - DNA, 50 bp, homo sapien
aacccacacagcacgttactgtaccraatactgtagtcagctgtaacaca

SEQ ID NO: 13520 - DNA, 50 bp, homo sapien
tctcttcttgaagcagttgttgcaaygttaattatcataaaaactttttt

SEQ ID NO: 13521 - DNA, 50 bp, homo sapien
tatgtattgttttgtggttaatcaayaactctaccttcgtgtaagggaaa

SEQ ID NO: 13522 - DNA, 50 bp, homo sapien
agcaactattttgagacttaatatcmatgtgtggttctaaaaatgagtta

SEQ ID NO: 13523 - DNA, 50 bp, homo sapien
aataagggttttttacttaatcagayattaggtaggaaataaatatggtt

SEQ ID NO: 13524 - DNA, 50 bp, homo sapien
ggtattaagatgccaatattctccaytcacaaagaagacacctgattcaa

SEQ ID NO: 13525 - DNA, 50 bp, homo sapien
agctttctctcagttagcttctgtakgttgtcatttggaaacggcaagaa

SEQ ID NO: 13526 - DNA, 50 bp, homo sapien
tcttaaggtttcaaatatttacccaygtagtcttcacatatgggttggta

SEQ ID NO: 13527 - DNA, 50 bp, homo sapien
aattttgctagatgtatagatttgaraaggatagcaatgtgtgatggatt

SEQ ID NO: 13528 - DNA, 50 bp, homo sapien
gaaagagcaatcaaggcagtgaaaaygatacagtcgaaggacccatggag

SEQ ID NO: 13529 - DNA, 50 bp, homo sapien
gcagctgatggaaaataattgtataygcaagagcttgtttggaatgtatc

SEQ ID NO: 13530 - DNA, 50 bp, homo sapien
caagagcttgtttggaatgtatcacracggaaactcaatatgacaaatca

SEQ ID NO: 13531 - DNA, 50 bp, homo sapien
tgagctgttaacatgctggaacataygtggcacactttccatgcgatgct

SEQ ID NO: 13532 - DNA, 50 bp, homo sapien
aggtcttggaattctgtgctgtaaaytgttgacacatgggtatgaaattt

SEQ ID NO: 13533 - DNA, 50 bp, homo sapien
gacaattccataaaactcagtaatayagtcaaagaaatgaacagtataca

SEQ ID NO: 13534 - DNA, 50 bp, homo sapien
ctcttcaacttactactatttgtagwatcaaagaactgtatattctgtca

SEQ ID NO: 13535 - DNA, 50 bp, homo sapien
gatagaagcttaggcattaacaggarcatgatgctgagatggtggaactg

SEQ ID NO: 13536 - DNA, 50 bp, homo sapien
tcttgcatttagctgcaagggcctckaacctaaatgactgatgtgcctag

SEQ ID NO: 13537 - DNA, 50 bp, homo sapien
atgttttacatgtggggatacagggwattaaatgcattggttatgatgga

SEQ ID NO: 13538 - DNA, 50 bp, homo sapien
ctactactcagtatctataaatacasaattgctacttgtataaattactc

SEQ ID NO: 13539 - DNA, 50 bp, homo sapien
tacctttcaaggtagtgttaagcccrgagcatggctatgttgcagtggtg

SEQ ID NO: 13540 - DNA, 50 bp, homo sapien
cttttcttctgtgcctgatttaatawccctgatcactaggacctatatta

SEQ ID NO: 13541 - DNA, 50 bp, homo sapien
atgtggaaatccgtatgagatgtgayagtttcagtaaatggcaataaaat

SEQ ID NO: 13542 - DNA, 50 bp, homo sapien
aattgagtttgggcattttggattaygccaaaggtccttagtcttgcatg

SEQ ID NO: 13543 - DNA, 50 bp, homo sapien
attataaatgttctcatcatttctayctaatcatcaaaattcatttgtgt

SEQ ID NO: 13544 - DNA, 50 bp, homo sapien
ccctatcatactctcttgagtttaayggcagattaactcttcatcatcct

SEQ ID NO: 13545 - DNA, 50 bp, homo sapien
ccttttttgtttgtttgtttcttccrgagtacctgactggcaaaatacta

SEQ ID NO: 13546 - DNA, 50 bp, homo sapien
ctttgtctattatttcaaactgtcayaggtcggctgactcttaaaataca

SEQ ID NO: 13547 - DNA, 50 bp, homo sapien
ttatcttactctactacaatagttawcacactcctttactttccccacag

SEQ ID NO: 13548 - DNA, 50 bp, homo sapien
ttttattaaaatttctccaagcatgyactgaatattcttttctagaaaga

SEQ ID NO: 13549 - DNA, 50 bp, homo sapien
taagaggtccctcagcctgatggcartagatttcaaattcacaacttata

SEQ ID NO: 13550 - DNA, 50 bp, homo sapien
cagtataggtaccagtctatttagaraagcgattgaggaggggaaaagca

SEQ ID NO: 13551 - DNA, 50 bp, homo sapien
ttctaacttaatcttttatagcccaytcatatcctattttttaagatttt

SEQ ID NO: 13552 - DNA, 50 bp, homo sapien
ccagtagctgaagccatgagttgaaygttgagattgtctaggggaccatt

SEQ ID NO: 13553 - DNA, 50 bp, homo sapien
gctgaaggataataatgttatgagargtttgttcctgttatattgttcat

SEQ ID NO: 13554 - DNA, 50 bp, homo sapien
atccaggtctaccaaaacctgcatcygaaataacttctaagaatgaactc

SEQ ID NO: 13555 - DNA, 50 bp, homo sapien
gcacaggaatggtaaccagttatcaractcagactaagaccaaatcagaa

SEQ ID NO: 13556 - DNA, 50 bp, homo sapien
agacaatatgactttatgcctggaaytattttaaaacatagtattagact

SEQ ID NO: 13557 - DNA, 50 bp, homo sapien
cattcacaaaaagaaaggaacaaatsaaaggtaccaccaatatttagaaa

SEQ ID NO: 13558 - DNA, 50 bp, homo sapien
cctagctgcaggctagctgctatgaygtttctaccttgaaccagtgccac

SEQ ID NO: 13559 - DNA, 50 bp, homo sapien
agtgagaaggaccacatcatataagrccctacaaatttggtggccaaatt

SEQ ID NO: 13560 - DNA, 50 bp, homo sapien
cagcaaataaaatatgatctcctgastactgccttttagtactttgtaat

SEQ ID NO: 13561 - DNA, 50 bp, homo sapien
ccacggcagttcacatgataatggaracccagtcctatctttcttttcat

SEQ ID NO: 13562 - DNA, 50 bp, homo sapien
ggcctaagagttaattttcaagtgcwatcaacacaaattgtttatttgcc

SEQ ID NO: 13563 - DNA, 50 bp, homo sapien
tatttatgcaaataaacctgcatgaracaaatgtgggttgttagtttagt

SEQ ID NO: 13564 - DNA, 50 bp, homo sapien
tttaacaaacattttgtgcaagttayacttttgtcttcatatttcttttg

SEQ ID NO: 13565 - DNA, 50 bp, homo sapien
agtacccatcacatttattctaaacsacacatgaaccgagaataattttt

SEQ ID NO: 13566 - DNA, 50 bp, homo sapien
tttcacttgttctatgtgcataaaarcatttgggacaaaaataaatgaag

SEQ ID NO: 13567 - DNA, 50 bp, homo sapien
atttgcaacaaacaagacccatatakgtacgtgtcaaaaacatgcagtga

SEQ ID NO: 13568 - DNA, 50 bp, homo sapien
gcttcttttggagtttaatataacayggatgtcagattgttggccttcca

SEQ ID NO: 13569 - DNA, 50 bp, homo sapien
tatacactaacaatgtccaactcgaraaggaaattaagaaaacaatacca

SEQ ID NO: 13570 - DNA, 50 bp, homo sapien
ttgatgatatgctgagaagggcttamggttgtagaaagagataatgtgaa

SEQ ID NO: 13571 - DNA, 50 bp, homo sapien
gtatccattatcaattgtgtttactraattcaaggtatttgctgtagcag

SEQ ID NO: 13572 - DNA, 50 bp, homo sapien
ccccatatagcttctgaacatagccrcagtagtaaccatagaaaggcact

SEQ ID NO: 13573 - DNA, 50 bp, homo sapien
gcttctccctgacttctagccttaaygctacctttccttaccccacttct

SEQ ID NO: 13574 - DNA, 50 bp, homo sapien
ccagcaacaccatcatcaacatctayataactatgccctaagctaggggt

SEQ ID NO: 13575 - DNA, 50 bp, homo sapien
atttgtaattttcttaaaatgttgamtatataacggtgatgaaagatgtt

SEQ ID NO: 13576 - DNA, 50 bp, homo sapien
tgaggtatgattaacctcttactccraacattgttaggagaagtaaatga

SEQ ID NO: 13577 - DNA, 50 bp, homo sapien
aactgatcaagcgcataataaattargaaaatgtttagccaggagtgata

SEQ ID NO: 13578 - DNA, 50 bp, homo sapien
tttgacaatctgtgttcttgtttaargtacgaactaaatcccacatagat

SEQ ID NO: 13579 - DNA, 50 bp, homo sapien
attgaataacgtcagttgtcttacartcgttctctgtttctactttttgt

SEQ ID NO: 13580 - DNA, 50 bp, homo sapien
gtctggctctcgggaaagagaactasgacaaggttgaagggaagggttgc

SEQ ID NO: 13581 - DNA, 50 bp, homo sapien
aagataatgagcataaaattaattayggacaatagtgaaaatattttaac

SEQ ID NO: 13582 - DNA, 50 bp, homo sapien
tggtatgttgccattctcaaatgaaytaagttttacaaagatcaaatgac

SEQ ID NO: 13583 - DNA, 50 bp, homo sapien
ggcaaagttcagttgtgtagaaccaygtaagctatgatgaagagtttgga

SEQ ID NO: 13584 - DNA, 50 bp, homo sapien
gtgctgcatagatgtgctacaattamctgtctatattgaagaagagaaac

SEQ ID NO: 13585 - DNA, 50 bp, homo sapien
ttgtttagaaaatgcctgaattaaaycgttcacctggttggtcttttctt

SEQ ID NO: 13586 - DNA, 50 bp, homo sapien
ttgatttgaaaatttatgtaggaatsatgtagttaaaattttgctttgtc

SEQ ID NO: 13587 - DNA, 50 bp, homo sapien
attgtagcacatctatgcagcactayattcactcttctaaacctcacaaa

SEQ ID NO: 13588 - DNA, 50 bp, homo sapien
cttttaatttcatataatgttggtakaaacacatgaggcttattcatttt

SEQ ID NO: 13589 - DNA, 50 bp, homo sapien
gctacctagtggatgaggaaaatgaygtcccagacaagatgatgatctga

SEQ ID NO: 13590 - DNA, 50 bp, homo sapien
caccaaatttgcttattcctgtaaawcactgatagagagtgtcacatgca

SEQ ID NO: 13591 - DNA, 50 bp, homo sapien
cataaataataaatctaatcctcaayggcaacagatttttgacttttggg

SEQ ID NO: 13592 - DNA, 50 bp, homo sapien
taatagacttaaaaaactgccatatmatatccatctaggttgcaggatct

SEQ ID NO: 13593 - DNA, 50 bp, homo sapien
gttggtgtaattgaaaacctctgtaygtcttatcagtatctcattataat

SEQ ID NO: 13594 - DNA, 50 bp, homo sapien
gattaaatgagataatataagtaaascactgagcacatttcctggcatat

SEQ ID NO: 13595 - DNA, 50 bp, homo sapien
ttgcaatgttgagatttgagaaataytagttctaattctagcggcatctt

SEQ ID NO: 13596 - DNA, 50 bp, homo sapien
agagtttgtgtgaaccttaaatgtayaatacttgtgaatataaaatacca

SEQ ID NO: 13597 - DNA, 50 bp, homo sapien
ccattatagtagttgctcattctacrcaaactcttatcttcaaatacatt

SEQ ID NO: 13598 - DNA, 50 bp, homo sapien
aaagactatagaggcttaaagtagasagatgctcataaatggagtttgga

SEQ ID NO: 13599 - DNA, 50 bp, homo sapien
gaccaagagaagaaaaatattcttcracggggagtcatagctgggagaat

SEQ ID NO: 13600 - DNA, 50 bp, homo sapien
tttcacttgctcaagtctgtgcaaarcagatacagatcttaaagttagaa

SEQ ID NO: 13601 - DNA, 50 bp, homo sapien
taaaaagattatgcagctctggaaayaagcatgtatactgaaaagataat

SEQ ID NO: 13602 - DNA, 50 bp, homo sapien
atctcagccttggagtttcctctcaytaaaaggcagaaaatctttagcaa

SEQ ID NO: 13603 - DNA, 50 bp, homo sapien
catgtagctctcatatagaaactaayattgtgaatagatacgtaaccttg

SEQ ID NO: 13604 - DNA, 50 bp, homo sapien
gtcaccacctagtaatcccacagtakataaattgtctttgtcctattgtg

SEQ ID NO: 13605 - DNA, 50 bp, homo sapien
atttcaattaatctatctgtccattwaatctgaatagacaaacttgagaa

SEQ ID NO: 13606 - DNA, 50 bp, homo sapien
gtgaattttattcatgactctataaraatgatttggcagaatctatcttc

SEQ ID NO: 13607 - DNA, 50 bp, homo sapien
ttaagagattagcttgaagaatgtayggacttcaaactaaaacttgaaag

SEQ ID NO: 13608 - DNA, 50 bp, homo sapien
ttttgatatatttatgcattgtaaartaatcaccacgttcaagctaatta

SEQ ID NO: 13609 - DNA, 50 bp, homo sapien
gaatggacaactcagttatgcttcakgttatcttagtagggagtatgtgg

SEQ ID NO: 13610 - DNA, 50 bp, homo sapien
ttccaattcgagaccatacaacaaaycttttcatcaaaagtaaaaatgga

SEQ ID NO: 13611 - DNA, 50 bp, homo sapien
aaaaatatattatgtataagactgamcacaatggtttgagtagcacagct

SEQ ID NO: 13612 - DNA, 50 bp, homo sapien
aaggtatcttttcaaaaatttaggastactatctacaggttaatatctag

SEQ ID NO: 13613 - DNA, 50 bp, homo sapien
accattatatgaatttatggcggaarttagaagcccagtgaaaacgtttt

SEQ ID NO: 13614 - DNA, 50 bp, homo sapien
taggatgctttttaattaaattgaastaccattagacagttctctccttt

SEQ ID NO: 13615 - DNA, 50 bp, homo sapien
atacagccacttattccttgcttcawgctatatggactttcagatgagtg

SEQ ID NO: 13616 - DNA, 50 bp, homo sapien
ttattgcaaaattgcaaagccttaaygataaagcaaaaacatcttcaacc

SEQ ID NO: 13617 - DNA, 50 bp, homo sapien
gttcttatatcaagattgcctgaagyatgggatttttatcaagtacttgg

SEQ ID NO: 13618 - DNA, 50 bp, homo sapien
tttttcagacaaataatatcaattcrgaaaaaataggtctttaaagaata

SEQ ID NO: 13619 - DNA, 50 bp, homo sapien
ccggacaaagtcaggtggtgagaaawtatacaagtcaagagaagagagtg

SEQ ID NO: 13620 - DNA, 50 bp, homo sapien
ccaccaaacaatacaactagaaacaygagaaattctacaaagcagaagaa

SEQ ID NO: 13621 - DNA, 50 bp, homo sapien
ggctttagtactgagtagaaagtgaraaagtaaattttaattaatttttt

SEQ ID NO: 13622 - DNA, 50 bp, homo sapien
gatacttttcttaggctatattagcmaaggtaacatcagtgagatagata

SEQ ID NO: 13623 - DNA, 50 bp, homo sapien
gtgtgtgcatgtttgtgtgtacaatragtgaacctagaaacctctgacta

SEQ ID NO: 13624 - DNA, 50 bp, homo sapien
tcaacaaaacaataaatttgattcascacacagaattaaaaacaaaaatt

SEQ ID NO: 13625 - DNA, 50 bp, homo sapien
ttttccacattaccatgtcaaagtcratagtaagaacataaagttttctc

SEQ ID NO: 13626 - DNA, 50 bp, homo sapien
agtttgatgatgactgttttcccaayataggagtatgcaattcttgtcct

SEQ ID NO: 13627 - DNA, 50 bp, homo sapien
ctgcaaataacagaaactctgattcratctttaaaaatttaaagaacaaa

SEQ ID NO: 13628 - DNA, 50 bp, homo sapien
tactaataaactcatatactcagtargctaatagaaaatgagcagaaata

SEQ ID NO: 13629 - DNA, 50 bp, homo sapien
ttcattagctataacatagttaaaaygtagcacctgcaataaatcaaagt

SEQ ID NO: 13630 - DNA, 50 bp, homo sapien
ctgtcaaaggatgagctgaataatayggttgaaagagtcctgctgttatt

SEQ ID NO: 13631 - DNA, 50 bp, homo sapien
agtgacttttgaagacgcacaataayggagacagtttggtaagaatctga

SEQ ID NO: 13632 - DNA, 50 bp, homo sapien
ggacgatgccttaatcttaagtgtcyatttgtgcagcattgacttagagc

SEQ ID NO: 13633 - DNA, 50 bp, homo sapien
agtatttagtgagtgattattgtagracaagtatttttctcagtgttttg

SEQ ID NO: 13634 - DNA, 50 bp, homo sapien
attaattagtatctatgcttacgtayggtcttatgtgaccctagccataa

SEQ ID NO: 13635 - DNA, 50 bp, homo sapien
aataaaattaaaatttgagtgacaayagatgtgtaaataatagcccagta

SEQ ID NO: 13636 - DNA, 50 bp, homo sapien
taccaatatgtattcatacatatgaytcaagatattcattatctcaaact

SEQ ID NO: 13637 - DNA, 50 bp, homo sapien
agatttatttcccatttcccatacaytggtaagatgcaaatgtcttacta

SEQ ID NO: 13638 - DNA, 50 bp, homo sapien
gtaagcctgagacatattgcactaargttttaaattatgttaatatcccc

SEQ ID NO: 13639 - DNA, 50 bp, homo sapien
aataacgtgatctccaactacagtamatctgcaataattttaagttaact

SEQ ID NO: 13640 - DNA, 50 bp, homo sapien
gatcaaaagtctatggcacagagaayaaataagttatatctgtgcatggt

SEQ ID NO: 13641 - DNA, 50 bp, homo sapien
gcaaaagaaatttgcactaagtacartgagataagtagggtgaaattatg

SEQ ID NO: 13642 - DNA, 50 bp, homo sapien
gcagttaaaattgctagagcctattyaaagttactggagagtaaaaagca

SEQ ID NO: 13643 - DNA, 50 bp, homo sapien
ataattaagcctagggactatcatargagtaaggtgaaacatagaacaca

SEQ ID NO: 13644 - DNA, 50 bp, homo sapien
gtggttctatgataaagactcttacraacgttgtgacaaaatatctaaaa

SEQ ID NO: 13645 - DNA, 50 bp, homo sapien
caccaatacaaataaaaccagaagtwaaaatgtaaaataaacacataggt

SEQ ID NO: 13646 - DNA, 50 bp, homo sapien
aaatcagttactaaaactggctcaaytgatgcggagaacatttagaacaa

SEQ ID NO: 13647 - DNA, 50 bp, homo sapien
tctatataccctctctgcaggttcayaattcttgttctacaattctaata

SEQ ID NO: 13648 - DNA, 50 bp, homo sapien
tcctgagttgcttttggtatatagtraaaggaagatatctagtttcaatc

SEQ ID NO: 13649 - DNA, 50 bp, homo sapien
atctacatagaattggtcaccacaasattggctggaataatagttcaaga

SEQ ID NO: 13650 - DNA, 50 bp, homo sapien
aacctaaagccttactccaagctctraagtaggttactggactttactgg

SEQ ID NO: 13651 - DNA, 50 bp, homo sapien
gatcacgaaaaagcaagtgagtatgyaatcagactattggctgcaaccct

SEQ ID NO: 13652 - DNA, 50 bp, homo sapien
tgctctaaaattgcctttaaaaataygtgcagactacaaaaaaaagcaaa

SEQ ID NO: 13653 - DNA, 50 bp, homo sapien
atctgatttcaaatgcccaatacaaygttaataatcttattaaaacttct

SEQ ID NO: 13654 - DNA, 50 bp, homo sapien
attgaatatataattgaggctattaycagacgtgcaaatatgcagccaga

SEQ ID NO: 13655 - DNA, 50 bp, homo sapien
aacagagttttcttacattataaaastgatgcttgtcttcaagatagttc

SEQ ID NO: 13656 - DNA, 50 bp, homo sapien
cacgtttaaagagattgaggtaaaakaaacatactgtaatatcttcagga

SEQ ID NO: 13657 - DNA, 50 bp, homo sapien
aggaataactgaatacaaaatggtaygctaattcaatctttctatctgga

SEQ ID NO: 13658 - DNA, 50 bp, homo sapien
aataggtgaaccattctggagcaaaytactaatataaattatttggaggt

SEQ ID NO: 13659 - DNA, 50 bp, homo sapien
tttcctgttattgctatccatataaraaattaccatgcaaagagatcttt

SEQ ID NO: 13660 - DNA, 50 bp, homo sapien
gtttcctgatacaacctgtacacaayttggtatattttattagtttgtgt

SEQ ID NO: 13661 - DNA, 50 bp, homo sapien
tattcctcttattttccttatctcartgaatggagaaatcatttaaatgc

SEQ ID NO: 13662 - DNA, 50 bp, homo sapien
tcgaattcctatttagaccttatgaraaagctaatatccctccttacacc

SEQ ID NO: 13663 - DNA, 50 bp, homo sapien
acaggtgtgagccaccacgaccagcsaaactttgtatatttttaagagac

SEQ ID NO: 13664 - DNA, 50 bp, homo sapien
ttgtcttcaagatagttcccgatatyacctagggtacctttagatcaatc

SEQ ID NO: 13665 - DNA, 50 bp, homo sapien
tcacttgctaatatcaactagatgamcttaaatagaacttagaaactaaa

SEQ ID NO: 13666 - DNA, 50 bp, homo sapien
tgaattctcatgcagctctgtaacayaacatttaattaactttaaagtca

SEQ ID NO: 13667 - DNA, 50 bp, homo sapien
cttctaactagcaggtctgtgcattsaaccattggaaactcaaatatttc

SEQ ID NO: 13668 - DNA, 50 bp, homo sapien
ggtattggagaataaactgtatggcmcattttttgaatctcctgacaatt

SEQ ID NO: 13669 - DNA, 50 bp, homo sapien
actttgtgccaccacatataatgtamgattgcataagtttaaatattcaa

SEQ ID NO: 13670 - DNA, 50 bp, homo sapien
aagcttaatagtaatatctacagacragttttttgcaagtcatttttatt

SEQ ID NO: 13671 - DNA, 50 bp, homo sapien
aaagcctccgagatgcagaggaacgrattctaaaggtacaggcatgagag

SEQ ID NO: 13672 - DNA, 50 bp, homo sapien
agaatacatagtatggaactttgtarcaagaggagctattgtgactaaaa

SEQ ID NO: 13673 - DNA, 50 bp, homo sapien
tatatctgttttaatttttgtcacayattaagatgattatagatgtatgt

SEQ ID NO: 13674 - DNA, 50 bp, homo sapien
tcataatttctataataatatcacartccctgccatgatgatacagattt

SEQ ID NO: 13675 - DNA, 50 bp, homo sapien
gcttgtagctgcttctcctgtatgaycaagaatttgtttttagttttgtg

SEQ ID NO: 13676 - DNA, 50 bp, homo sapien
tttctactatgggaatcagattcacyggttgttttaataaattctttctt

SEQ ID NO: 13677 - DNA, 50 bp, homo sapien
tgatttccactaactccaacattatrataaacaccaatataaaaataata

SEQ ID NO: 13678 - DNA, 50 bp, homo sapien
agtttgcattacctgtgggaaatctyaaattgccatgatgctaaatgaca

SEQ ID NO: 13679 - DNA, 50 bp, homo sapien
aaactcaattcttgacttctgtacaycggcagtcccaacaccacatggaa

SEQ ID NO: 13680 - DNA, 50 bp, homo sapien
ttttcccaagtcattctgatgtgaayaggtaaggaagaagaaagagtaat

SEQ ID NO: 13681 - DNA, 50 bp, homo sapien
agcttcttttctattattgcaatcaygttagaaataaatataaaatttaa

SEQ ID NO: 13682 - DNA, 50 bp, homo sapien
ccacgatccccaccacgtcagaaacrggtttgaatccttatggttgcaag

SEQ ID NO: 13683 - DNA, 50 bp, homo sapien
tattccttcacatattttgtcactasctggaaaatatgtttagaaactaa

SEQ ID NO: 13684 - DNA, 50 bp, homo sapien
ctagtgtagttgttactggtttccaratgattgcagtgtgattattctat

SEQ ID NO: 13685 - DNA, 50 bp, homo sapien
ggcaaaattccaattttgttcctaartgtacctaagatagagtattaata

SEQ ID NO: 13686 - DNA, 50 bp, homo sapien
gtgacagttgtagcagatatttcacwcatcatacaatgtaattggcattc

SEQ ID NO: 13687 - DNA, 50 bp, homo sapien
catatatgtaatctgttttctaaacratttccgcatatttattgccctag

SEQ ID NO: 13688 - DNA, 50 bp, homo sapien
tatttgactacccttaaatgttaaartgccacaattataatgaaatgaga

SEQ ID NO: 13689 - DNA, 50 bp, homo sapien
caacatctggaatactggtcttaaakaactattcctttgctcttgaactt

SEQ ID NO: 13690 - DNA, 50 bp, homo sapien
actttacttcagctccttttcagaaygaggtaaggttcataatgctcaga

SEQ ID NO: 13691 - DNA, 50 bp, homo sapien
tatgttctaaattctctcaaactttsaaacagcttgccttttctctcagt

SEQ ID NO: 13692 - DNA, 50 bp, homo sapien
caaatatgtgcatacaataaaaggaraatcagcttaaagaaaaagaaaga

SEQ ID NO: 13693 - DNA, 50 bp, homo sapien
ctaatttgatagagtattagtgacayaaagacaggctttagaaagattct

SEQ ID NO: 13694 - DNA, 50 bp, homo sapien
ttttcacttcataaagctgaaatgaraggtgttaagagcttttacttctg

SEQ ID NO: 13695 - DNA, 50 bp, homo sapien
ttgtgtgtgcatatatgtaaatatgwatgcatgtatatatatacatatgt

SEQ ID NO: 13696 - DNA, 50 bp, homo sapien
aatactttcgatggtcaaatacaaamttaggtcccagagtgcttttttaa

SEQ ID NO: 13697 - DNA, 50 bp, homo sapien
gaacccctatcccgaccacacttaarcatctacccataggagagaaatgc

SEQ ID NO: 13698 - DNA, 50 bp, homo sapien
tacaatattaagtatataattctgcyatatttgagtcaaatttacatata

SEQ ID NO: 13699 - DNA, 50 bp, homo sapien
aagagatttctgcttacacaagacawtcaattggtaacacggttttactg

SEQ ID NO: 13700 - DNA, 50 bp, homo sapien
aagtaatttgtttcatatctgttatyagggattcttgtttgtcaaattaa

SEQ ID NO: 13701 - DNA, 50 bp, homo sapien
gaatttgggggcatgctcactgtacracatatactacagcaaagcttttc

SEQ ID NO: 13702 - DNA, 50 bp, homo sapien
catccttcacaaagacaataaaattwaaaataatcctggaatatgtctgc

SEQ ID NO: 13703 - DNA, 50 bp, homo sapien
tgaaaaccactgatctagaaaaccarcattatgttaatgccttttataga

SEQ ID NO: 13704 - DNA, 50 bp, homo sapien
ctcaacaaaactttatcttgaagtaygcctttcctcagaattttaggttt

SEQ ID NO: 13705 - DNA, 50 bp, homo sapien
tttttgatttatagtagtaacctcamcatctaatattattccactatttg

SEQ ID NO: 13706 - DNA, 50 bp, homo sapien
ctatgcattgctgctgcagataactsaaattcatccatggctgtgcttgc

SEQ ID NO: 13707 - DNA, 50 bp, homo sapien
ttctatgagagtttatgttcattacrcctatacatatttttaaaatattt

SEQ ID NO: 13708 - DNA, 50 bp, homo sapien
atcttcacccacacatctagatgagraatatagcatagtatgagagtggc

SEQ ID NO: 13709 - DNA, 50 bp, homo sapien
tattgtttaggcacactgctattcamattggatataaattgggaatgtgt

SEQ ID NO: 13710 - DNA, 50 bp, homo sapien
atagttatacaagtaactgagaaacmaatatgcagttttttaggaaaaaa

SEQ ID NO: 13711 - DNA, 50 bp, homo sapien
tacatcattataataaatgtaaatamcttgtcttcacaatttatagaaca

SEQ ID NO: 13712 - DNA, 50 bp, homo sapien
gtttaaactcatatcttactttgaartgatacataatagatcctcaaaga

SEQ ID NO: 13713 - DNA, 50 bp, homo sapien
atcaaaataaatgctttcttgatcayagtcattaagtggccaggtttgtt

SEQ ID NO: 13714 - DNA, 50 bp, homo sapien
tgtcttcacagaggctattaactaawgggaaaaccagaaatcagatagtc

SEQ ID NO: 13715 - DNA, 50 bp, homo sapien
tataatatttaaaaacatattttaaratccagtggaaaatgttcataaaa

SEQ ID NO: 13716 - DNA, 50 bp, homo sapien
tcccatttattattctggtccagcaygcgttaaactagaaacacctaatg

SEQ ID NO: 13717 - DNA, 50 bp, homo sapien
aaagtgaaatagcaactaattttacratcataacttagaaaaattgttaa

SEQ ID NO: 13718 - DNA, 50 bp, homo sapien
attgagaatgaaagtaaggtatgaawtaatttgaaaaaaaaatgccaagc

SEQ ID NO: 13719 - DNA, 50 bp, homo sapien
atcattacaactgttaatatattctyactctcgctattatcagctaattg

SEQ ID NO: 13720 - DNA, 50 bp, homo sapien
cagagaaaagtggctaatatgaaaarcaccattagtagtagtgttataga

SEQ ID NO: 13721 - DNA, 32 bp, homo sapien
tataattttgagagtgragacaatttaagcaa

SEQ ID NO: 13722 - DNA, 50 bp, homo sapien
cttagctatgcactttagaaaaagckccaaagaagcatataaataaatct

SEQ ID NO: 13723 - DNA, 50 bp, homo sapien
gtatagctttgccacttactaattayctgaccctggtaaatcatttaagt

SEQ ID NO: 13724 - DNA, 50 bp, homo sapien
gctattataactatatgctgagttakgcaagtcctcacagttatccccaa

SEQ ID NO: 13725 - DNA, 50 bp, homo sapien
tgggtgaattctttccagaaatgtcmaattgcatcattataaatccaaca

SEQ ID NO: 13726 - DNA, 50 bp, homo sapien
ttaaaaatgcaaattcctaaatccawcaaagaattattggatcagaatca

SEQ ID NO: 13727 - DNA, 50 bp, homo sapien
gcaaactattttctttttgtagatargatgaacctttgtgctctatatcc

SEQ ID NO: 13728 - DNA, 50 bp, homo sapien
ttagacacattctcattaccacaggycacaatgatttctgcatctttcat

SEQ ID NO: 13729 - DNA, 50 bp, homo sapien
gtaatagaataagatttggctttatsacagtacagaagtgaatctttgaa

SEQ ID NO: 13730 - DNA, 50 bp, homo sapien
cttatttttaaaaattatgactggaygttagaataaaagttaagaaattc

SEQ ID NO: 13731 - DNA, 50 bp, homo sapien
gataaaatgattctaacatttgaccratgctacaactttaagattttttg

SEQ ID NO: 13732 - DNA, 50 bp, homo sapien
taaagtgaattgaaacctcataccayatatctcataatggattccagaac

SEQ ID NO: 13733 - DNA, 50 bp, homo sapien
gtaccagacagttcctctctaactcrgaatgttgtatttccagtccattt

SEQ ID NO: 13734 - DNA, 50 bp, homo sapien
ttattttaacagtacattatttttaygctttcagatgtttctttttgtct

SEQ ID NO: 13735 - DNA, 50 bp, homo sapien
agcttaggaagtatggattgctttaygatggatcctaaggtagaccttct

SEQ ID NO: 13736 - DNA, 50 bp, homo sapien
aaaccatcatttagatctgcttagargtgttggatgcagaaataacagaa

SEQ ID NO: 13737 - DNA, 50 bp, homo sapien
attctcacactatgtggttccctcartcaatgatgtaaaaatacaaaata

SEQ ID NO: 13738 - DNA, 50 bp, homo sapien
atggttaagctaaaacaatgatccartgatagagaactttcttgtcacgt

SEQ ID NO: 13739 - DNA, 50 bp, homo sapien
ttaactactgtacagtgctgttatcyctttttaaacattaatttagaact

SEQ ID NO: 13740 - DNA, 50 bp, homo sapien
tgttttacatatttatgaatttctcrcaggccccctaagggattcatttc

SEQ ID NO: 13741 - DNA, 50 bp, homo sapien
gatgcactgataataatcaatgttgyaattataccggctagatgacaatt

SEQ ID NO: 13742 - DNA, 50 bp, homo sapien
tctcatgattaatcttgatagaaaaktatccactgaaaatatgacaagaa

SEQ ID NO: 13743 - DNA, 50 bp, homo sapien
acttagttttaaggtgtaccaacaartgttataatacactaagaacaagg

SEQ ID NO: 13744 - DNA, 50 bp, homo sapien
aagaagcatacaaactcagagggtartaacaatggataagtaagtgaatc

SEQ ID NO: 13745 - DNA, 50 bp, homo sapien
aaggaaaaatgcaattagatggtaaragaagcatacaaactcagagggta

SEQ ID NO: 13746 - DNA, 50 bp, homo sapien
cgatatatacaacaataaatgctgtmaaaggactagaatataaacttaaa

SEQ ID NO: 13747 - DNA, 50 bp, homo sapien
aatggtctcaaggttgtataagtgawgtcaacttacagattattcataga

SEQ ID NO: 13748 - DNA, 50 bp, homo sapien
ttcagtaaacttttatgattttatcyctatatggcttgtgctcttaattt

SEQ ID NO: 13749 - DNA, 50 bp, homo sapien
aaagctgagtatacaaggaactatcrataatttactaggagtgatgtgta

SEQ ID NO: 13750 - DNA, 50 bp, homo sapien
agccaaaatcagcgattctcttggtsaaaaagcagacaggattctaaagt

SEQ ID NO: 13751 - DNA, 50 bp, homo sapien
tttttaacatccttacattcttgaartatatccatgtaaccaataacaag

SEQ ID NO: 13752 - DNA, 50 bp, homo sapien
gaaggccaccaaggctgtgaaactamgtcagatgatgatagagctgaggt

SEQ ID NO: 13753 - DNA, 50 bp, homo sapien
agtgcactataaaaaaaagaacttaygcactcctttctctctctctcccc

SEQ ID NO: 13754 - DNA, 50 bp, homo sapien
cctattaaataggaatggttcctgtsaatcagataagtactgcaaattta

SEQ ID NO: 13755 - DNA, 50 bp, homo sapien
attagcaagtcacaacagaaaacaaygcagaagtggagtatatgttttga

SEQ ID NO: 13756 - DNA, 50 bp, homo sapien
gggccttgtagaaatcaggaggttasactttattccaatttccgtaaaat

SEQ ID NO: 13757 - DNA, 50 bp, homo sapien
tagtctcactgtattttcttatacaytcaatactgcacacctgctcactc

SEQ ID NO: 13758 - DNA, 50 bp, homo sapien
ggcctggggaatatacatactaacakctactcctattcccagacagccgt

SEQ ID NO: 13759 - DNA, 50 bp, homo sapien
caagattcagttatcgattggtgtgsatgatagaagccacaaagctgtcc

SEQ ID NO: 13760 - DNA, 50 bp, homo sapien
aattacatttccttacttccatcaakgtgcaaattaaaagggctatagct

SEQ ID NO: 13761 - DNA, 50 bp, homo sapien
taggtttaatgaaatatggaagtagmagtgttaatatgatagctatgtgt

SEQ ID NO: 13762 - DNA, 50 bp, homo sapien
cattttataaccaaaacatagattaragtgttgttggatcctataaaata

SEQ ID NO: 13763 - DNA, 50 bp, homo sapien
tcagattgttttagattaggttaaaktacagtcatgcactgcataacaac

SEQ ID NO: 13764 - DNA, 50 bp, homo sapien
ttttaacatgaatggtgttggactaygtcatataccttttttaccgtggt

SEQ ID NO: 13765 - DNA, 50 bp, homo sapien
aatgccaagtgtatttggaaactggrcataatttatataacaagtgaatt

SEQ ID NO: 13766 - DNA, 50 bp, homo sapien
attttttgtacaattatttgtggtaycatagtggaatttataatgctcaa

SEQ ID NO: 13767 - DNA, 50 bp, homo sapien
attagggattcctttccatatataarctacaactttaaaagctatttgga

SEQ ID NO: 13768 - DNA, 50 bp, homo sapien
gtttaacatgttatatgactacattraaaaaataatcccattggacttct

SEQ ID NO: 13769 - DNA, 50 bp, homo sapien
gaggaagctgctgaagagaaattgargctagtagagagttggttcttgtc

SEQ ID NO: 13770 - DNA, 50 bp, homo sapien
atgggttgttttgtgatttactttcwcttaaaattacattatttacattg

SEQ ID NO: 13771 - DNA, 50 bp, homo sapien
gatcccattacaagacttttaaaaawtcctgacaagtgtgatattttagg

SEQ ID NO: 13772 - DNA, 50 bp, homo sapien
taattttacaactttggtgcttaatsatattatatgtatttgacatttca

SEQ ID NO: 13773 - DNA, 50 bp, homo sapien
atgggaaattagatatgtgtatagaygagaaatacataaagaaaaaaaga

SEQ ID NO: 13774 - DNA, 50 bp, homo sapien
ttaaaattatcaacctggtatgaagsctaatttaatgtattttttttggt

SEQ ID NO: 13775 - DNA, 50 bp, homo sapien
gatctgttccttggaattaccagacwaatgcgagagtagctgtagaggag

SEQ ID NO: 13776 - DNA, 50 bp, homo sapien
atcctacctcctaatctcaattgacrcaattttatctatcatggtgaaaa

SEQ ID NO: 13777 - DNA, 50 bp, homo sapien
caatctcacactcctaatttttaccmggcaaattataagattctactact

SEQ ID NO: 13778 - DNA, 50 bp, homo sapien
acaaaacttgataataaaactaatgraatgatatgacttgtaactatgta

SEQ ID NO: 13779 - DNA, 50 bp, homo sapien
aaatcatttcctctaaaattgtgagsactgaaaagtcaacaaatagataa

SEQ ID NO: 13780 - DNA, 50 bp, homo sapien
ggagaaagtgcttgcaaacatgaaaraggataattaaaatatatttttag

SEQ ID NO: 13781 - DNA, 50 bp, homo sapien
ctaatattgcaaaatttaaaatgtcrattccagaagacttcagtgttaag

SEQ ID NO: 13782 - DNA, 50 bp, homo sapien
ttctcttaaattttcacaataatgcratcaaattatattaaccatattct

SEQ ID NO: 13783 - DNA, 50 bp, homo sapien
atacaactctcttgcatataaaatayacttgaatccaaattacatttctg

SEQ ID NO: 13784 - DNA, 50 bp, homo sapien
gaaagcttaaccttaaacttatttgmaactgagaaatgttattttaaaac

SEQ ID NO: 13785 - DNA, 50 bp, homo sapien
gactttataataagggagaaatgaaraacattgcagtctaatgaggacaa

SEQ ID NO: 13786 - DNA, 50 bp, homo sapien
tctaagacaagggtaaaaataatcayacactgagtgatatttaatggcta

SEQ ID NO: 13787 - DNA, 50 bp, homo sapien
gtatcagcccttgtatagctgcaggsaacatctccacccaattctaggcc

SEQ ID NO: 13788 - DNA, 50 bp, homo sapien
ttattcttaaaatttatttatagtaygtcactaccatccaactcatatta

SEQ ID NO: 13789 - DNA, 50 bp, homo sapien
ttccctagaagaacatgaaacatcamtacatataatagacctcctgtact

SEQ ID NO: 13790 - DNA, 50 bp, homo sapien
atacccctgacctatctttcaactgyactaccctgcaagaaggcaggact

SEQ ID NO: 13791 - DNA, 50 bp, homo sapien
caatgcctaatttgcttaaatctggraaaatatttcatgcactgaaaaga

SEQ ID NO: 13792 - DNA, 50 bp, homo sapien
ctgggaaaatatttcatgcactgaawagagtaaataatgaagtaaaactg

SEQ ID NO: 13793 - DNA, 50 bp, homo sapien
agtataaagacagcctcaggctaacracctccagtttattcagtttaaca

SEQ ID NO: 13794 - DNA, 50 bp, homo sapien
acaactatcctcaagaagatattagraaatagaatccaacaatgagtaaa

SEQ ID NO: 13795 - DNA, 50 bp, homo sapien
taaggctgtgttaggcaaaggtatcygaactaccacatcaactctagaaa

SEQ ID NO: 13796 - DNA, 50 bp, homo sapien
atggaatgtaagagagtagaatagamtaggttgtatagaatagaaaaaaa

SEQ ID NO: 13797 - DNA, 50 bp, homo sapien
tagtgaggtctaatttccttactaayacagagtctagatacattaatcca

SEQ ID NO: 13798 - DNA, 50 bp, homo sapien
cttttgagtttttctacagatttaaracatttttcagttgtacttcgatt

SEQ ID NO: 13799 - DNA, 50 bp, homo sapien
ctgtctccagcaaccagtaaagagaraattgtaaatatcgcatgcttgga

SEQ ID NO: 13800 - DNA, 50 bp, homo sapien
attcaatgtaattttattttcctcaraagtactgtacaatagataaaaca

SEQ ID NO: 13801 - DNA, 50 bp, homo sapien
attagctccatttatgcttataaaaktatgtttgaaaccattttcaaacc

SEQ ID NO: 13802 - DNA, 50 bp, homo sapien
aagacaatgaatacatgaaagttatragtagcaacaaagaactgttttgt

SEQ ID NO: 13803 - DNA, 50 bp, homo sapien
atatttaaaatgatttatgtttccaygtgtatcaagaagaatattaaaca

SEQ ID NO: 13804 - DNA, 50 bp, homo sapien
caatgtattgttaaattatcaagtayggagcttagcatgatagaagttca

SEQ ID NO: 13805 - DNA, 50 bp, homo sapien
tgatgaaaactacattttatctactsaatgcatatttgttatgcacctaa

SEQ ID NO: 13806 - DNA, 50 bp, homo sapien
catggttaggggtggagagggaggcrataaagaattaacataatcaataa

SEQ ID NO: 13807 - DNA, 50 bp, homo sapien
aaaaaaattgataaccaattcaccartattgaagcagactgatatctagt

SEQ ID NO: 13808 - DNA, 50 bp, homo sapien
ccttaaaaccataattttaagcataycagaatcactcagttctaaattct

SEQ ID NO: 13809 - DNA, 50 bp, homo sapien
tgagacttccaagagcatccattaayagaatttagaactgagtgattctg

SEQ ID NO: 13810 - DNA, 50 bp, homo sapien
gcattcaaaaatgcaattaggaaaaytcgtacacgtgtctctggattggt

SEQ ID NO: 13811 - DNA, 50 bp, homo sapien
tcccctaagggtgaatgcagaattarcttgaaggagcagatttgctgtga

SEQ ID NO: 13812 - DNA, 50 bp, homo sapien
ttattcttgtattctcaaaaatgcarctcctaagtatatgaatattctcc

SEQ ID NO: 13813 - DNA, 50 bp, homo sapien
atggttattaaattactacataatcragacattttcttaggtaagtgtat

SEQ ID NO: 13814 - DNA, 50 bp, homo sapien
agccctcaataagaaagatatcataygttgtaatctggtatatatataca

SEQ ID NO: 13815 - DNA, 50 bp, homo sapien
agtgtgtattgttcttctgtacgtaygacaacagtttcttaccatgcctt

SEQ ID NO: 13816 - DNA, 50 bp, homo sapien
tgattctatggttccctcttcattaragactccctgttgtatattattga

SEQ ID NO: 13817 - DNA, 50 bp, homo sapien
cgccctcagagcaactttccatttakgatttagcttttctggatgtcata

SEQ ID NO: 13818 - DNA, 50 bp, homo sapien
acctaaataaatagccatcagatgayattatgggtcaatttatcataagg

SEQ ID NO: 13819 - DNA, 50 bp, homo sapien
gaggaaagctgcttttgttccaatargactatgccatggtttgaggttcc

SEQ ID NO: 13820 - DNA, 50 bp, homo sapien
agcatcatctgcatatacagtctatmaaattgtttcagattattttttca

SEQ ID NO: 13821 - DNA, 50 bp, homo sapien
tggcagaatcctgaattaagaggtayagtttccaaatggattccttggat

SEQ ID NO: 13822 - DNA, 50 bp, homo sapien
tcggttggtggaatttgtggatgagwaacccttggaaacagagggttgac

SEQ ID NO: 13823 - DNA, 50 bp, homo sapien
gtggcttcacagaaaacatgtatccrgctaataaatgggaggaggtcaac

SEQ ID NO: 13824 - DNA, 50 bp, homo sapien
tcctcttccccttttttagaatatasataaggtctaagttaagaagatat

SEQ ID NO: 13825 - DNA, 50 bp, homo sapien
aaacactagggaactcacccaagcamactttctcctgcagttctaaataa

SEQ ID NO: 13826 - DNA, 50 bp, homo sapien
aaactccatgtgcatgtatacacacsatatcatttgaatagagaacaatc

SEQ ID NO: 13827 - DNA, 50 bp, homo sapien
atagatacattttgattaggagatayggacattggtttgactaataagac

SEQ ID NO: 13828 - DNA, 50 bp, homo sapien
ttggctcagatatatacttttatacragcattgcaaacccagactataga

SEQ ID NO: 13829 - DNA, 50 bp, homo sapien
tggtaaagatgaatgtctacgtaggyatttcagttatcctcccaccactt

SEQ ID NO: 13830 - DNA, 50 bp, homo sapien
ttcttttaactggtgccagattgtaragcagtctcttgcacctttggact

SEQ ID NO: 13831 - DNA, 50 bp, homo sapien
tctctccagtagaatcctgtagataygtagctgtaccatatgactgacac

SEQ ID NO: 13832 - DNA, 50 bp, homo sapien
agggaatagagtgagacccaacttawctgagatgtaaggtaaaaggacac

SEQ ID NO: 13833 - DNA, 50 bp, homo sapien
aaaaaacatttcattaactcttgacwacattcctctatctaatttctcag

SEQ ID NO: 13834 - DNA, 50 bp, homo sapien
cgtggacagctctccacctcaaatgmatgaaaaatgactcaaatttttgc

SEQ ID NO: 13835 - DNA, 50 bp, homo sapien
agctgtaagattgccagtaacagtayctaccctgcctgctgtcaagtact

SEQ ID NO: 13836 - DNA, 50 bp, homo sapien
taattaattttcattgatttagaaakttgtacacttgtaatagaaagcaa

SEQ ID NO: 13837 - DNA, 50 bp, homo sapien
aatccttgagactcgatccttcagamactagaggctgttaagatgaaagc

SEQ ID NO: 13838 - DNA, 50 bp, homo sapien
gaccttggcatgaagtaacttttccraaattgtgaaacagcagctgtgtg

SEQ ID NO: 13839 - DNA, 50 bp, homo sapien
aagaagaaaaaaactctcattggatraaaattatataagaggaaaaacat

SEQ ID NO: 13840 - DNA, 50 bp, homo sapien
agtaaccagaatctgtttttttgcaytcaaacacaagaatattaaaaaca

SEQ ID NO: 13841 - DNA, 50 bp, homo sapien
catgaaaatgttttttactcacatartaaggattcaagataaaagcaggg

SEQ ID NO: 13842 - DNA, 50 bp, homo sapien
ggctgttcgatgtatacagtatctayagttattgcatgcaagagttctca

SEQ ID NO: 13843 - DNA, 50 bp, homo sapien
agcaacattattatctttaattctayataccactaccagtttggaatgaa

SEQ ID NO: 13844 - DNA, 50 bp, homo sapien
tttcaccacagtaattcatattagaratagaagcagttgcatgttaaata

SEQ ID NO: 13845 - DNA, 50 bp, homo sapien
aagtctggatttgtaagtggatcttraaacaatgacaaattcacaagtta

SEQ ID NO: 13846 - DNA, 50 bp, homo sapien
tactatatgacttgtatataaaagcygaacttatcctcatttattcattt

SEQ ID NO: 13847 - DNA, 50 bp, homo sapien
tactccagaaaaccaaatagtaagarccaatcatcaaaatagatcaatat

SEQ ID NO: 13848 - DNA, 50 bp, homo sapien
tgatgtcagaagccttgcttgttgaygacaaaaatatcatttgaggtcaa

SEQ ID NO: 13849 - DNA, 50 bp, homo sapien
gagtttatttctatttggctacttaygctccatacttactcaggcctaat

SEQ ID NO: 13850 - DNA, 50 bp, homo sapien
tttggtgaaaaatattttcactccaygtgttcattgtgtgtgcatgcctg

SEQ ID NO: 13851 - DNA, 50 bp, homo sapien
gggatttgtcattgtgtctgatcaayagagaaattattttcttacttagc

SEQ ID NO: 13852 - DNA, 50 bp, homo sapien
ttacagtaggtaaaagccttagagayatgcgtagggcagcgtctgccttt

SEQ ID NO: 13853 - DNA, 50 bp, homo sapien
caggcatctaaaccacacaacgtcaygaaaaaatgcaactgatagaggga

SEQ ID NO: 13854 - DNA, 50 bp, homo sapien
atgtcatatgaaacaaataggaataygatctagcatgacaaatgccaatt

SEQ ID NO: 13855 - DNA, 50 bp, homo sapien
attcagtgagtcaactattccataawtatttacaaagcattctattctgt

SEQ ID NO: 13856 - DNA, 50 bp, homo sapien
aacctaatgacaagacacatagcaakgcactttataaatcataaagcatt

SEQ ID NO: 13857 - DNA, 50 bp, homo sapien
aagtgttattgaatatagcctgcaaygataagacatatacttttctctgg

SEQ ID NO: 13858 - DNA, 50 bp, homo sapien
gtgttatatagggctcatccctgagragttcttaatctagtggaaaatct

SEQ ID NO: 13859 - DNA, 50 bp, homo sapien
gttgaggattctcctgataggtactraaaggttatactaaatgaaagtaa

SEQ ID NO: 13860 - DNA, 50 bp, homo sapien
cttttcctttggaactgttccctgartaacactttgtacttgaaacataa

SEQ ID NO: 13861 - DNA, 50 bp, homo sapien
taacaatttcactactctcttcaacrgcaaaggttgaaggaggcttttag

SEQ ID NO: 13862 - DNA, 50 bp, homo sapien
catggtttatttcattaaattgacamaacagatatatgtggttgatttga

SEQ ID NO: 13863 - DNA, 50 bp, homo sapien
tctacttggcccaaggtcatctaacsattttagcagcatcttcacactaa

SEQ ID NO: 13864 - DNA, 50 bp, homo sapien
tgcttattctccctttgtgcctttakaacagcaatgatatagctagaaac

SEQ ID NO: 13865 - DNA, 50 bp, homo sapien
ctaagcttaccattgttaaacttctsaaactaattcccagaaattatttt

SEQ ID NO: 13866 - DNA, 50 bp, homo sapien
cacaaagggagaataagcatttctcrgaagacatcggcggcggtaacaat

SEQ ID NO: 13867 - DNA, 50 bp, homo sapien
taatatgacatgatgtagtatagaartgggaaaataggctcttggataag

SEQ ID NO: 13868 - DNA, 50 bp, homo sapien
tgaaaggaaagtagttgaaagaatckgaaatgtcaacagatctgggctgc

SEQ ID NO: 13869 - DNA, 50 bp, homo sapien
ggcagcaacacattaatgatgcctamcacatctcactcaaggtcttagca

SEQ ID NO: 13870 - DNA, 50 bp, homo sapien
tagtatatatttgtgaagtacaaaaygatgtgatgatatgaatacaatgt

SEQ ID NO: 13871 - DNA, 50 bp, homo sapien
catcagcatgcttaggatttccttayctaggctctgctttttgttcacag

SEQ ID NO: 13872 - DNA, 50 bp, homo sapien
atactgaaactgagtaccctgaatgrcaatagatttcagagcctattcag

SEQ ID NO: 13873 - DNA, 50 bp, homo sapien
tcagggccccttttttcagtccagaygtagagctcactaaccctttcagc

SEQ ID NO: 13874 - DNA, 50 bp, homo sapien
taacagatattaacagagtctttcarccttcagtatatactggcatggta

SEQ ID NO: 13875 - DNA, 50 bp, homo sapien
tagcgtctctcaagctaatcacacgyattcaaaagcaatgtcagtttgtg

SEQ ID NO: 13876 - DNA, 50 bp, homo sapien
atgtcataggaagtattttctgtcamgttctggaagttatggttatagta

SEQ ID NO: 13877 - DNA, 50 bp, homo sapien
aatctgttggcatgcagtctcccaartctccatgtttatctgtttgtgat

SEQ ID NO: 13878 - DNA, 50 bp, homo sapien
aagaatttaacctatgggttctccamaaagacttattagcaaatatccac

SEQ ID NO: 13879 - DNA, 50 bp, homo sapien
tatattattgaagattgaaaagaacmattagtttaagaaacatctgaatg

SEQ ID NO: 13880 - DNA, 50 bp, homo sapien
atgtccttttatatgttcacatgtargcattggctaaaatcaaagtttga

SEQ ID NO: 13881 - DNA, 50 bp, homo sapien
agtccattgtaaacctcatctgtaayactattttgggccttctcttgagt

SEQ ID NO: 13882 - DNA, 50 bp, homo sapien
tgacctttgtcctcatccttgtataragagatcaaatcagtggggcattg

SEQ ID NO: 13883 - DNA, 50 bp, homo sapien
tacttcaataaagttggtctaagtaytaaacatggatttcaatcagtgat

SEQ ID NO: 13884 - DNA, 50 bp, homo sapien
aagatgtcggtacccatgaaaggtaycagataaacagataaatagatgct

SEQ ID NO: 13885 - DNA, 50 bp, homo sapien
ctagaatttaatttgcatgcttaaaygtattttcttctcaatccaccacg

SEQ ID NO: 13886 - DNA, 50 bp, homo sapien
ctcaaattataaaactactaaagaasaacattgtggaaattctccaggac

SEQ ID NO: 13887 - DNA, 50 bp, homo sapien
aaccactgcttatgtaattaaaaagyagaatcgacaagggaatgcacttt

SEQ ID NO: 13888 - DNA, 50 bp, homo sapien
ggtttgaaaacaatacataaagttayagaggaataaacaaggcaaataca

SEQ ID NO: 13889 - DNA, 50 bp, homo sapien
tattgttcaaatgaaaagtacttaamagaagcggaaatgaagcttaaggg

SEQ ID NO: 13890 - DNA, 50 bp, homo sapien
gctatcaatctctctaattaacatakaatcaatttcaaataacagcatct

SEQ ID NO: 13891 - DNA, 50 bp, homo sapien
tgtataagggactcttcgattggaamgaaactgtaaagtttttttcaact

SEQ ID NO: 13892 - DNA, 50 bp, homo sapien
aacactgaaaattccaactagggtayatgtaatgcttatctcaaatgtca

SEQ ID NO: 13893 - DNA, 50 bp, homo sapien
tttacaaaatgtcatgtaagaaataygtaaaaagtaagaaatataatcca

SEQ ID NO: 13894 - DNA, 50 bp, homo sapien
acacatacatatataactaaaaaackaatataaacagggatatatatgta

SEQ ID NO: 13895 - DNA, 50 bp, homo sapien
tggactttaccttctttgttgaataygtttctttaaaattggagcttatc

SEQ ID NO: 13896 - DNA, 50 bp, homo sapien
ataaaaaatgaacaaaataattcacwgatattttgcaaggaaaggtatgt

SEQ ID NO: 13897 - DNA, 50 bp, homo sapien
ttaaaattcaacttctctaattatakatctgtacttcttattagcattaa

SEQ ID NO: 13898 - DNA, 50 bp, homo sapien
tctaaggaacataataacttgataaygcttttggatgggccatcattaat

SEQ ID NO: 13899 - DNA, 50 bp, homo sapien
aaaatacatttatcatcttattgtaygtctggaattacgacagccatgga

SEQ ID NO: 13900 - DNA, 50 bp, homo sapien
gctatgacactgtttattagcagtckgacctgaaagttctcctaatagta

SEQ ID NO: 13901 - DNA, 50 bp, homo sapien
catcagtctaaacctgaaccctatgrcagttcaagacctctcccagggga

SEQ ID NO: 13902 - DNA, 50 bp, homo sapien
ccgtgattcatctctcagttgtacaratattcccaaattatacaaaacca

SEQ ID NO: 13903 - DNA, 50 bp, homo sapien
caaagtgatgtaataagctgcaacartctgcacatagtagcatctggata

SEQ ID NO: 13904 - DNA, 50 bp, homo sapien
gcagcagtcccatggtctctgaggcrctcttggagtcactttttcctttt

SEQ ID NO: 13905 - DNA, 50 bp, homo sapien
acaaacacatacacactgtcccatakatactcatgttacagttacaattt

SEQ ID NO: 13906 - DNA, 50 bp, homo sapien
aggcactccataagtactggatgaawtggataaaaggtagactacacagg

SEQ ID NO: 13907 - DNA, 50 bp, homo sapien
tggtgaagatgagcagtgagcagtaragggtgaaatttgttttctttttc

SEQ ID NO: 13908 - DNA, 50 bp, homo sapien
attatacatacggattattagagacraagaatgatacaggatcagatcat

SEQ ID NO: 13909 - DNA, 50 bp, homo sapien
cacccataaatgcaccaaagctcttraaattatacatacggattattaga

SEQ ID NO: 13910 - DNA, 50 bp, homo sapien
atgtaacctatgtttgttactgtgaraggaggatcaaatacaataatctc

SEQ ID NO: 13911 - DNA, 50 bp, homo sapien
atctttttaaaaagccaattggataygcttaacactcaccaagttgtttt

SEQ ID NO: 13912 - DNA, 50 bp, homo sapien
aaacagttgaattgaatttttagtcrctgcttctttaagtgaatcagaca

SEQ ID NO: 13913 - DNA, 50 bp, homo sapien
aactggtgctattgttgactacaagraataaagagaagggatatttacag

SEQ ID NO: 13914 - DNA, 50 bp, homo sapien
ggatcatatgaactttcagggataaygctagaggaatcatgatcaataac

SEQ ID NO: 13915 - DNA, 50 bp, homo sapien
tccccttcaggctgtgatatctgaamtatgtttattcttgagtaattgtc

SEQ ID NO: 13916 - DNA, 50 bp, homo sapien
actacaggagaaaattgtttcaggaraaggagtaaactaacaaatgtaaa

SEQ ID NO: 13917 - DNA, 50 bp, homo sapien
gaagttcacataggagatggtgaacraaacttatcctaacacatgaagct

SEQ ID NO: 13918 - DNA, 50 bp, homo sapien
cttatacagaatatctaagttttaaraagatttgttggatattattttag

SEQ ID NO: 13919 - DNA, 50 bp, homo sapien
aaaatagaatccttctctgatttaayggatgtattggtgcagaaattgaa

SEQ ID NO: 13920 - DNA, 50 bp, homo sapien
ggctaggattaggcagaaaaccgtgmagagtcaagaaatggaagcctccg

SEQ ID NO: 13921 - DNA, 50 bp, homo sapien
attattcatccttggctataatgatkaatgcagttaaactttgttgcaac

SEQ ID NO: 13922 - DNA, 50 bp, homo sapien
tgtttttaaggtgcagtagcccacasagtatttggaaaaagcaaaatcac

SEQ ID NO: 13923 - DNA, 50 bp, homo sapien
ggtataatattatcagtaaaagaagracaactcagacagcatctggcagt

SEQ ID NO: 13924 - DNA, 50 bp, homo sapien
aacatttaatcagaaattctgaaaarcaagatatgtaagcgaatgcctca

SEQ ID NO: 13925 - DNA, 50 bp, homo sapien
ctatgtaaaaacatgcaatctgatarctaagtgggtaccagaagaagatg

SEQ ID NO: 13926 - DNA, 50 bp, homo sapien
atcttagatgagctggactgatataragttgaaatgcttcagcttaagac

SEQ ID NO: 13927 - DNA, 50 bp, homo sapien
atcacaccagctgctgatttcgtccyagtgttttatcctgtcaataagaa

SEQ ID NO: 13928 - DNA, 50 bp, homo sapien
gtaaatctttttgaaatccaaataaycataatcatttatacaaatattct

SEQ ID NO: 13929 - DNA, 50 bp, homo sapien
tccgtttcaataggtaaggctctaakcattgaattttcttccttctagct

SEQ ID NO: 13930 - DNA, 50 bp, homo sapien
aatccaatcacaaatgatggttttasgaccaaactgtatttcttccaaac

SEQ ID NO: 13931 - DNA, 50 bp, homo sapien
gaagaaaacaactggtattactaaasatgaagttaactctgcccgaggtg

SEQ ID NO: 13932 - DNA, 50 bp, homo sapien
tcatagccatccctgtttgtggatayggaaagagttcagaccagggtaac

SEQ ID NO: 13933 - DNA, 50 bp, homo sapien
agagaatttgccttagagcactaaaygaggactgaagagtaatagttttg

SEQ ID NO: 13934 - DNA, 50 bp, homo sapien
atccgactgtgccagttccaatcttraaatcctttgatggctgtccttta

SEQ ID NO: 13935 - DNA, 50 bp, homo sapien
ttcttctctttaagtccaccagagckgacacagatttgggcacagccttt

SEQ ID NO: 13936 - DNA, 50 bp, homo sapien
taataatatttatttcactggctcamgttttcaaaaaaaagagtaacgtg

SEQ ID NO: 13937 - DNA, 50 bp, homo sapien
tttgtgatgattaagtgaaatctagragccagatatggtaatgaatcttg

SEQ ID NO: 13938 - DNA, 50 bp, homo sapien
gatatggtaatgaatcttgaacagamcttgttaaacatatttttaaaaag

SEQ ID NO: 13939 - DNA, 50 bp, homo sapien
aacatagaatatggatggactttgaygaaattaaatatttagcggtcaca

SEQ ID NO: 13940 - DNA, 50 bp, homo sapien
ggaagtatgcattcctgctttgttgsaaaacccatctatgaggtttgata

SEQ ID NO: 13941 - DNA, 50 bp, homo sapien
tatgtgtggggactaactaagaagarggaatataatttcctggggtgatt

SEQ ID NO: 13942 - DNA, 50 bp, homo sapien
aataagataacacataataccaattraaatggctaacattaatgttgaac

SEQ ID NO: 13943 - DNA, 50 bp, homo sapien
gaacctctgtgatttcataaaggtaygctattcaggtttgaaggccattt

SEQ ID NO: 13944 - DNA, 50 bp, homo sapien
gctctccctgtcaaaaaccatataaycacaacagtcgttgatcccaacat

SEQ ID NO: 13945 - DNA, 50 bp, homo sapien
ttctggagcagtgttctgtgtttaasggccacactggcaagagcgttctg

SEQ ID NO: 13946 - DNA, 50 bp, homo sapien
ccttttgtttactatgcaaaataacsgtaagtaggaattaaataaaactc

SEQ ID NO: 13947 - DNA, 50 bp, homo sapien
cacccctaccaaaaggaaaagaagayggcatttgtggtttccacagccca

SEQ ID NO: 13948 - DNA, 50 bp, homo sapien
ccctgcaacccacttggagattatayccttagattctgaacccttaactg

SEQ ID NO: 13949 - DNA, 50 bp, homo sapien
gactttcctttggagtagaaactaargtattataaatgcaacacagtcat

SEQ ID NO: 13950 - DNA, 50 bp, homo sapien
gttttatttatgggcttaaactaccraggaatacaatcttgggccttctc

SEQ ID NO: 13951 - DNA, 50 bp, homo sapien
taactggaatggtgagctaataagaygatgctgttttaagccgctaaata

SEQ ID NO: 13952 - DNA, 50 bp, homo sapien
ctgtaatgatgaaatttccagagacraatgagaaggcccaagattgtatt

SEQ ID NO: 13953 - DNA, 50 bp, homo sapien
ctcaaaacaggaattaagagtaaacygagcaacattaaagagtctaatag

SEQ ID NO: 13954 - DNA, 50 bp, homo sapien
acaagagagactaaaaaatggcaacraccaactggctaatcttattttta

SEQ ID NO: 13955 - DNA, 50 bp, homo sapien
aaactagattataaactgttttccasctttttggagctctctgtgcaggc

SEQ ID NO: 13956 - DNA, 50 bp, homo sapien
tgaagcaaagacaaatttgatggtcmatgcaaaaaagttggattgggcct

SEQ ID NO: 13957 - DNA, 50 bp, homo sapien
agcttgttcttcagcccaataatctraaacacatccggaaaacagtagcc

SEQ ID NO: 13958 - DNA, 50 bp, homo sapien
taaagaagatggtgaaatagccataycaactttaataatagcaagctaga

SEQ ID NO: 13959 - DNA, 50 bp, homo sapien
catttgcaaagtgatgttatttcagscaaggagaaaatattcaatcctca

SEQ ID NO: 13960 - DNA, 50 bp, homo sapien
atggctttaaaatgatgatgaataakgtcagggttctgatcataccaccc

SEQ ID NO: 13961 - DNA, 50 bp, homo sapien
acatgtttgcacacactcttgtgackaaagcccaatttttgtctgaaaat

SEQ ID NO: 13962 - DNA, 50 bp, homo sapien
gtaacaccattttacaaatgacataygttgcaaagtaaaaatctagtcat

SEQ ID NO: 13963 - DNA, 50 bp, homo sapien
atagaatactatattgggatctaaartgtaaggttgcaattcaaaattaa

SEQ ID NO: 13964 - DNA, 50 bp, homo sapien
tatgtcttgccaagtaagaaatccarctttttcatatgtgaacgcttaaa

SEQ ID NO: 13965 - DNA, 50 bp, homo sapien
acacaaacactaaatatggatttacyacaaaattatcttaacttggagag

SEQ ID NO: 13966 - DNA, 50 bp, homo sapien
tatccaaggttcagcatggattatayaccaagtgtctgattggccctgcc

SEQ ID NO: 13967 - DNA, 50 bp, homo sapien
ctgtgcctcataatgatattttagtsaagggtggaccacatatacaggag

SEQ ID NO: 13968 - DNA, 50 bp, homo sapien
agataaaaataactctggcatatacygggcttttaataagtatattttga

SEQ ID NO: 13969 - DNA, 50 bp, homo sapien
ggcactttacaagtacagaaatctgmaaagcacttaagaaactcttgttt

SEQ ID NO: 13970 - DNA, 50 bp, homo sapien
gaaaaaaaaatagactaacctaagastacatttattcactttttggttga

SEQ ID NO: 13971 - DNA, 50 bp, homo sapien
gtgattctcatgtaggttctctaacwatacttcaagaaagagttatccag

SEQ ID NO: 13972 - DNA, 50 bp, homo sapien
tattatttgcttgatccgtcaatgarctaaggtagtagtctttaaggctc

SEQ ID NO: 13973 - DNA, 50 bp, homo sapien
aatggttcctagaattgttttcacayggtcatatatttttgtaatatgtg

SEQ ID NO: 13974 - DNA, 50 bp, homo sapien
tacttaggtaatacagggaaaggaayattatgtactaaaacatgtatttt

SEQ ID NO: 13975 - DNA, 50 bp, homo sapien
ttatttatgttctctctccaggattkaataagaactaacaaatagaagca

SEQ ID NO: 13976 - DNA, 50 bp, homo sapien
atgctctatttcctatctttactcartattgcaatgtgcaatatgttatt

SEQ ID NO: 13977 - DNA, 50 bp, homo sapien
catttggaatcaaaagatctaaaagratgttgctaacaccagatgtacta

SEQ ID NO: 13978 - DNA, 50 bp, homo sapien
ggcttagagtagtctcaatgaagccratggcgtgtcttagaaaaaccgca

SEQ ID NO: 13979 - DNA, 50 bp, homo sapien
ctgacacaccgtatgtattttgggayaataaaagtccaagtaattacact

SEQ ID NO: 13980 - DNA, 50 bp, homo sapien
atatttatttagtgcttattgcaggmaaaactttgtactagacaccaggg

SEQ ID NO: 13981 - DNA, 50 bp, homo sapien
attgaatgtatataatatagcatatragtaatcaaaatgatttgaacttt

SEQ ID NO: 13982 - DNA, 50 bp, homo sapien
aaggaacaatgatatgccaaaagaaygatcgtattaaaggtagttttatt

SEQ ID NO: 13983 - DNA, 50 bp, homo sapien
ttccattctaatattttctgtagtgragatttgaaataactactagtatg

SEQ ID NO: 13984 - DNA, 50 bp, homo sapien
ttaatgcctaattaaatcttctatayatgtgttgtgcaaaacacatcaac

SEQ ID NO: 13985 - DNA, 50 bp, homo sapien
gacagaacaaaagagaacttcaagaytatcaagttcaaatgattcatttt

SEQ ID NO: 13986 - DNA, 50 bp, homo sapien
aacacaatgctaggtacaggtcccarcttttgaactataattgaatttaa

SEQ ID NO: 13987 - DNA, 50 bp, homo sapien
tattcttggactagaaatgtttttawaatattgcctaaaattatatcagt

SEQ ID NO: 13988 - DNA, 50 bp, homo sapien
ctcggatttggatagatcggttttamataccagtcctgccgttttgtacc

SEQ ID NO: 13989 - DNA, 50 bp, homo sapien
tttatgatctccattacatagacccractgaagttagtaagaagttaaat

SEQ ID NO: 13990 - DNA, 50 bp, homo sapien
ctttctctaacgaatgagactaacartgcaagccatctatttaatttgaa

SEQ ID NO: 13991 - DNA, 50 bp, homo sapien
aggaacattgcacaatttgtaaacayatggtattaaaatattacttatgt

SEQ ID NO: 13992 - DNA, 50 bp, homo sapien
gtgttctggaactagatagaggtgaygcttgcacaacattacgaatgttc

SEQ ID NO: 13993 - DNA, 50 bp, homo sapien
agaattacttcaaccatctgtacagwctagcaaaatattattctaagtgt

SEQ ID NO: 13994 - DNA, 50 bp, homo sapien
aaaatgtttagttttccttcattcayccttgttatttctcttctcaaacc

SEQ ID NO: 13995 - DNA, 50 bp, homo sapien
gacatacaagagagtcagccgcaaargatcatgaaagtttacatgaccac

SEQ ID NO: 13996 - DNA, 50 bp, homo sapien
gttaaaaagaataagagaactctacmgcatttaaataaatctgcagcctg

SEQ ID NO: 13997 - DNA, 50 bp, homo sapien
caataattctgattttcagaaacaayggtttggtagctattattagaatt

SEQ ID NO: 13998 - DNA, 50 bp, homo sapien
gttacaggagagaaagacatatttamatggcaaacagcagtgatggtttg

SEQ ID NO: 13999 - DNA, 50 bp, homo sapien
atggaggcagaggattgtctcctcaygtactcgggatgaattctaccccg

SEQ ID NO: 14000 - DNA, 50 bp, homo sapien
gtctgcctgtttttttcacaattaawtcaaaacttgtccatgcataagtt

SEQ ID NO: 14001 - DNA, 50 bp, homo sapien
tccaacaatatgggtcatctattacraaggaagaagagattgataatgtt

SEQ ID NO: 14002 - DNA, 50 bp, homo sapien
ttccccaaaagtgtttcagttctacraagtacaagtacagatatggttgc

SEQ ID NO: 14003 - DNA, 50 bp, homo sapien
tctaaaaatgtttgcaaattggcttwaaaacaggcagttttataaatttt

SEQ ID NO: 14004 - DNA, 50 bp, homo sapien
agtggttcctgtgataatgaaggacrgaaataaattactccagaggttct

SEQ ID NO: 14005 - DNA, 50 bp, homo sapien
gagttggaatcatgaaagtttgaggratcttatacagaaaaaaaaatgaa

SEQ ID NO: 14006 - DNA, 50 bp, homo sapien
atgtagatagtctggttaagaaaagkcatggtacctgttgtttaagtggc

SEQ ID NO: 14007 - DNA, 50 bp, homo sapien
acacacctagccatctaaggaaagcwcatactgtcatgatgttaaccaac

SEQ ID NO: 14008 - DNA, 50 bp, homo sapien
tatatattttcaatcccttttgaagwctaccagcaatagggagccaaagt

SEQ ID NO: 14009 - DNA, 50 bp, homo sapien
ccaatgtcagataacacatttgaaaytagactctaaacacaaatcatgca

SEQ ID NO: 14010 - DNA, 50 bp, homo sapien
ctagtttcaaatgtgttatctgacawtgggaaaatcaatacactttcagg

SEQ ID NO: 14011 - DNA, 50 bp, homo sapien
accgcattaatttaggaaaatgtaayctgtaagtccagttgacttaattg

SEQ ID NO: 14012 - DNA, 50 bp, homo sapien
tagtaatatttgtaatgttatagaaygttaaagcacgagttatgaacaca

SEQ ID NO: 14013 - DNA, 50 bp, homo sapien
tttatgaaagcaagaactgctgttaygtttaccaatatgtatctatccat

SEQ ID NO: 14014 - DNA, 50 bp, homo sapien
aatgacattatctgtcatagattacsaagcacacagtgattgcattggaa

SEQ ID NO: 14015 - DNA, 50 bp, homo sapien
aaggaagttccatattttttgctaawcttgagttctaagttgcttaatag

SEQ ID NO: 14016 - DNA, 50 bp, homo sapien
ggatcttatctccctttctaggccgraaaatcctagaggtttgccttttt

SEQ ID NO: 14017 - DNA, 50 bp, homo sapien
ctatggaaaaactacttttaatttgratgcttaatatttacaagctgcaa

SEQ ID NO: 14018 - DNA, 50 bp, homo sapien
gacccagactcttcagttgtaatgamagcagaggcaaaatgggctttgtg

SEQ ID NO: 14019 - DNA, 50 bp, homo sapien
ataatgaataccaggtaatcttatcracatttctatgataactactagcc

SEQ ID NO: 14020 - DNA, 50 bp, homo sapien
ggaaaacaaaatatattaggaccaaracacaatacccaagggggtggtca

SEQ ID NO: 14021 - DNA, 50 bp, homo sapien
ttacccaccatacaaaacatgcaacrgctctgatttgcccttgagacagt

SEQ ID NO: 14022 - DNA, 50 bp, homo sapien
caggcagagcacaagacacttcatayacacagtgttatttaattttctgc

SEQ ID NO: 14023 - DNA, 50 bp, homo sapien
tgtgttgtgctgatcaaacctcaaastgtcgggtcaaattatttccattg

SEQ ID NO: 14024 - DNA, 50 bp, homo sapien
aactcagaatataatcttaattggamgtagaatttacgcagatgtaatta

SEQ ID NO: 14025 - DNA, 50 bp, homo sapien
gaaagtaacaaatttcaggtaatgtraatccagattaatttagtcaatga

SEQ ID NO: 14026 - DNA, 50 bp, homo sapien
ttgataaatgaccatgttcacaaggraagatatacctcccataaagcttt

SEQ ID NO: 14027 - DNA, 50 bp, homo sapien
tgcaagaatggcctaatatattctargttgtgtttttcatgaggaacaga

SEQ ID NO: 14028 - DNA, 50 bp, homo sapien
taatacactgatggaaaaagcatcaktgacttacaacacagcaataatag

SEQ ID NO: 14029 - DNA, 50 bp, homo sapien
tattacttatttccttatcttgcacygggtttagtctaaatctaatctat

SEQ ID NO: 14030 - DNA, 50 bp, homo sapien
agtaatttcatgtttgcaatattaaytcttctttttgaaaccagtttgtc

SEQ ID NO: 14031 - DNA, 50 bp, homo sapien
gtttcggttttatttctttgtgacargagctgaccgtgatctaagtaaat

SEQ ID NO: 14032 - DNA, 50 bp, homo sapien
agacaaatattgtattagccgcttayatgtggaatctaaaacagttgccc

SEQ ID NO: 14033 - DNA, 50 bp, homo sapien
tttctacccaactcctcaattaacamagatgtaataatccaaactctata

SEQ ID NO: 14034 - DNA, 50 bp, homo sapien
cattctactttgccaggagtaagaaygagaaggagtttatgaaagtaaga

SEQ ID NO: 14035 - DNA, 50 bp, homo sapien
ttaacttctttaaatgaatattaaasgtgagccatgggctagtcaaaatg

SEQ ID NO: 14036 - DNA, 50 bp, homo sapien
attaaagctaaatacttaacttgaartgtatttggttcttcagattaagt

SEQ ID NO: 14037 - DNA, 50 bp, homo sapien
ttccccaaatatagaactacatttargtatatgcaggataataaagacat

SEQ ID NO: 14038 - DNA, 50 bp, homo sapien
gtatcattttttcaaactgcttttakaatctaactgcttgctaggttttt

SEQ ID NO: 14039 - DNA, 50 bp, homo sapien
cctccaataaaagtgggagatagcayacattctaaacaacagagtaagca

SEQ ID NO: 14040 - DNA, 50 bp, homo sapien
atttttggtattcatccatttttcckgagaacaacacttttctcattctt

SEQ ID NO: 14041 - DNA, 50 bp, homo sapien
accagtcacaaagtttctatgtaccyacaggattaaaaggattcaactaa

SEQ ID NO: 14042 - DNA, 50 bp, homo sapien
tcaatatgactagatgcatttcctaycatgtttaattcttctttgtctca

SEQ ID NO: 14043 - DNA, 50 bp, homo sapien
tttaaagttgccttcttctaaattcrccagtatttgttatctttgcatga

SEQ ID NO: 14044 - DNA, 50 bp, homo sapien
gtccttcttcctctgctcacacaaayggtgacaaatttctttattataaa

SEQ ID NO: 14045 - DNA, 50 bp, homo sapien
atttaaattagactttgaatatatgsataagttaagtagaaaggataaaa

SEQ ID NO: 14046 - DNA, 50 bp, homo sapien
aaaataattttcttccaagtgacaartgatgatctgtggattataaatat

SEQ ID NO: 14047 - DNA, 50 bp, homo sapien
ttcagtccttgtagcatgtatttccyacgttgttactattaaattattct

SEQ ID NO: 14048 - DNA, 50 bp, homo sapien
cctcaattgtatttattacaacacaytccatccgatgttattaactacag

SEQ ID NO: 14049 - DNA, 50 bp, homo sapien
ccagatgaagtcctctgaattgatawggcacatgggaatagaggtggggc

SEQ ID NO: 14050 - DNA, 50 bp, homo sapien
ccccaaatggcatatcaaaggcttcrctaattgaactgacattggaacaa

SEQ ID NO: 14051 - DNA, 50 bp, homo sapien
ctgaggagccaatttcatcccttggkcagtttataaccagaaagaataaa

SEQ ID NO: 14052 - DNA, 50 bp, homo sapien
ctaatctcaatatctctataaaaackgtatatgcccacaatgatcccatt

SEQ ID NO: 14053 - DNA, 50 bp, homo sapien
ccgtcaagcttctgtgggcaacaccrcctagagacatgctcctctcctcc

SEQ ID NO: 14054 - DNA, 50 bp, homo sapien
agagaaatgacttgtctgaattctcraagtatttagacttaaaatattga

SEQ ID NO: 14055 - DNA, 50 bp, homo sapien
tttacttattaatctgtaaaatgaargatgtaatttaataagctccaaag

SEQ ID NO: 14056 - DNA, 50 bp, homo sapien
tacatggaaagcatgaggcaaagaasgtaagttacaaagaagaactaaac

SEQ ID NO: 14057 - DNA, 50 bp, homo sapien
gtagatttcatcagataagctgtcaratgcttcatagaacatgccttgga

SEQ ID NO: 14058 - DNA, 50 bp, homo sapien
tagtctatacagaggaattgcagcayattaaacagaactcacaggaaatg

SEQ ID NO: 14059 - DNA, 50 bp, homo sapien
aggcaaagtagggcatctaatttagwcacaatacatcttcattgcactga

SEQ ID NO: 14060 - DNA, 50 bp, homo sapien
tctcacattcactttcattttaacaktaggtgcaactgacttgaaattca

SEQ ID NO: 14061 - DNA, 50 bp, homo sapien
tgacttgttctgtgctcttccagcayctattaaaatgaccatatattttt

SEQ ID NO: 14062 - DNA, 50 bp, homo sapien
caccttaaataggaagtacaaataaygactggaatgaatcccaaatcatt

SEQ ID NO: 14063 - DNA, 50 bp, homo sapien
ctgtctaatggctcatgtctcctaayagtctttagactccaccttcaaat

SEQ ID NO: 14064 - DNA, 50 bp, homo sapien
ctgcctcggcttcccaaagtactccrattatagctgtgagctaccacacc

SEQ ID NO: 14065 - DNA, 50 bp, homo sapien
ttaagctcacgccttaatcttataartgccataaataagcacacagagct

SEQ ID NO: 14066 - DNA, 50 bp, homo sapien
atttatatacatatttagcaataatracttgaggccatcaatactgtggt

SEQ ID NO: 14067 - DNA, 50 bp, homo sapien
ctctaaatcactgctctgtttatgayatcacaagaaaagatctactcttt

SEQ ID NO: 14068 - DNA, 50 bp, homo sapien
ggtcatttggcattgttaaattagcracaaattcttaataccaaggaaag

SEQ ID NO: 14069 - DNA, 50 bp, homo sapien
tgaagggattttcaaaccaatcagamcagcattaatccaccagtcaccac

SEQ ID NO: 14070 - DNA, 50 bp, homo sapien
gagcaaagaacatgtaacagcaggcrgagtgtatattccccaaagccacc

SEQ ID NO: 14071 - DNA, 50 bp, homo sapien
ttcagaagctagtagcattttcaaamtatatataagttgtaaaatggctt

SEQ ID NO: 14072 - DNA, 50 bp, homo sapien
aggcttgtgtttgtggtaagtataawgtaagcaagctctctattactttg

SEQ ID NO: 14073 - DNA, 50 bp, homo sapien
gtgttgcaagtagtggaaaactcaayggaaacagataaacaattagagga

SEQ ID NO: 14074 - DNA, 50 bp, homo sapien
tttagcacattgtggcaaggcttccyagaaatcaattctgaccactgagt

SEQ ID NO: 14075 - DNA, 50 bp, homo sapien
gtacagttgctggaaaataagtcaawgaaacactaatcacttcatttagg

SEQ ID NO: 14076 - DNA, 50 bp, homo sapien
atgatgaatgttgaatgactaccaaycaggttatattttattgcaaatta

SEQ ID NO: 14077 - DNA, 50 bp, homo sapien
aagacccttgggacagtagcttgcgyattgtgaataaaagagggtagtgg

SEQ ID NO: 14078 - DNA, 50 bp, homo sapien
tacttattattttttactacctagasaccaatatgtttggaaataaagag

SEQ ID NO: 14079 - DNA, 50 bp, homo sapien
taaatatcgtgctaagttctacttayactagctgtttgcaactgttcatt

SEQ ID NO: 14080 - DNA, 50 bp, homo sapien
aatagctgtttgaagaagctcaatgmaatttgatataacacagagcagga

SEQ ID NO: 14081 - DNA, 50 bp, homo sapien
tcacagcatgagaatgatttttagaraagtacaggataaaacttgggtag

SEQ ID NO: 14082 - DNA, 50 bp, homo sapien
agaaaacagcaaagtaaccataaatkaacatagaaagacctggaggaaac

SEQ ID NO: 14083 - DNA, 50 bp, homo sapien
tgcaggtttccttaaagtttgtttgyatgagagtaattaacttcaaggta

SEQ ID NO: 14084 - DNA, 50 bp, homo sapien
atcaacatattagtcaacaatttccyatgccattatagatacattataaa

SEQ ID NO: 14085 - DNA, 50 bp, homo sapien
agtttaaagaggcacaaaagagaaayaatgtttgaccaagataacttatt

SEQ ID NO: 14086 - DNA, 50 bp, homo sapien
acagataatagagggtagaatttgartaaagagactagctaaagaaaacc

SEQ ID NO: 14087 - DNA, 50 bp, homo sapien
ctactgatgcagtttgtattaacatraattagacatgttcattgaacatg

SEQ ID NO: 14088 - DNA, 50 bp, homo sapien
agcttttatgctagcagtttccagawattccactttgttttccaaaactg

SEQ ID NO: 14089 - DNA, 50 bp, homo sapien
agaaaaaggtttctgtgtaacttaaycagactgaacagctatttccactt

SEQ ID NO: 14090 - DNA, 50 bp, homo sapien
aatagggtgcttttgtaggctggaamggaaattgtattggatcagaatgt

SEQ ID NO: 14091 - DNA, 50 bp, homo sapien
gcaggctaaagaggaagaatttttaygaggtaggcttttgaaggtggcat

SEQ ID NO: 14092 - DNA, 50 bp, homo sapien
tgcttgaaaatgacttttgtgtttcmataatattaactgccaaccacatc

SEQ ID NO: 14093 - DNA, 50 bp, homo sapien
gaaacttaaagctaatcttaaaaacraatgagtcaataattcaaattcca

SEQ ID NO: 14094 - DNA, 50 bp, homo sapien
caactggcatatgatatattcttaamagtgaatctatagatgcttgaaat

SEQ ID NO: 14095 - DNA, 50 bp, homo sapien
taaaaaaaatatccaggcttgggtcyatagaatttcaacttcttatcttt

SEQ ID NO: 14096 - DNA, 50 bp, homo sapien
atagaaggcaatggtaattgatcaasactattctgagtaatgtcaattcc

SEQ ID NO: 14097 - DNA, 50 bp, homo sapien
cagggataagttccttctctaaccaygaaaactgatgtggtgacttctgc

SEQ ID NO: 14098 - DNA, 50 bp, homo sapien
ttcttaagtacaggccatccaagaastagctattcccaaattaattataa

SEQ ID NO: 14099 - DNA, 50 bp, homo sapien
cagtacttatctggataagttctacrgcaaatgtctactcctgaagtgac

SEQ ID NO: 14100 - DNA, 50 bp, homo sapien
aactttacatagctgctagacactcraacaagagtatgtgcacccaaaaa

SEQ ID NO: 14101 - DNA, 50 bp, homo sapien
aaaacagccatgatttcaggtaacaygcttagctttttaatttactgaag

SEQ ID NO: 14102 - DNA, 50 bp, homo sapien
tgtatgtttttccttgaccagcagarcagtgtttttaaatatgaatttga

SEQ ID NO: 14103 - DNA, 50 bp, homo sapien
tacattcagtcttagcggtaaaaaawtaaataactggataattatacttg

SEQ ID NO: 14104 - DNA, 50 bp, homo sapien
ttttaaaaattacaggattaaaacaragtaatttatagagagatgatttt

SEQ ID NO: 14105 - DNA, 50 bp, homo sapien
caaaatgtttttactcttagatgatyaaggataagttccaattaaatttc

SEQ ID NO: 14106 - DNA, 50 bp, homo sapien
acaaaaaaaaaatttgctgaattaasagaccaattttggatgtatatgtt

SEQ ID NO: 14107 - DNA, 50 bp, homo sapien
ttatgttgttttttgttctccatcartaaagcattttcatacttatctct

SEQ ID NO: 14108 - DNA, 50 bp, homo sapien
catttagagctcactatcttcatgasattctgttgtatatatgtttgtga

SEQ ID NO: 14109 - DNA, 50 bp, homo sapien
atattaggaaacaaagtgaaaaaaarttagtagaaatgattgacaaggag

SEQ ID NO: 14110 - DNA, 50 bp, homo sapien
agaatttgtgtttgcttcttctcgaygcttaccattttaagcttagtttt

SEQ ID NO: 14111 - DNA, 50 bp, homo sapien
gcaatatgaagtactataatgaaccrcagggtagcagatgggccctgggg

SEQ ID NO: 14112 - DNA, 50 bp, homo sapien
cagaggtatttcagacccgctattcmaaactttctcctgcaggctgggtg

SEQ ID NO: 14113 - DNA, 50 bp, homo sapien
attcattaccaccttcacctaaaccrcattttattccacttggaagcaag

SEQ ID NO: 14114 - DNA, 50 bp, homo sapien
ggtaggaattcgtactggtatcagakattttaggagagcatctatcacat

SEQ ID NO: 14115 - DNA, 50 bp, homo sapien
agggtcagaaactaccagaaattagraaattcacaactaatattagtcac

SEQ ID NO: 14116 - DNA, 50 bp, homo sapien
cttccaaaaagacaatcaaattatarctgtaaagaacaaaatatctagca

SEQ ID NO: 14117 - DNA, 50 bp, homo sapien
actccctaaggaaattggctgaaacyagttggatacactctgaaatattt

SEQ ID NO: 14118 - DNA, 50 bp, homo sapien
gtctggctttattaaattccatatayaggtgagactgcatctggaattgg

SEQ ID NO: 14119 - DNA, 50 bp, homo sapien
ccatcggtgtgataataagatgcaaytggtatgatttatcagaggatgac

SEQ ID NO: 14120 - DNA, 50 bp, homo sapien
aacattgtgtcaggcactgggctaaractgcaatctcatttatttgtcac

SEQ ID NO: 14121 - DNA, 50 bp, homo sapien
ctcatggcatggcttccctgttggaygtatatttgattatcaatatccca

SEQ ID NO: 14122 - DNA, 50 bp, homo sapien
taccagttgcatcttattatcacacygatggttcaattaactcacatcac

SEQ ID NO: 14123 - DNA, 50 bp, homo sapien
caataacccaaatcctcagaatcaawcaacctgtcggtcccttgtttaat

SEQ ID NO: 14124 - DNA, 50 bp, homo sapien
attggaaacttagaaaataaaaatgycacttagctctcaatatgaaatta

SEQ ID NO: 14125 - DNA, 50 bp, homo sapien
ttaaaagaaaataaatctggaaatayatgtgtgagaccaccacaggtaag

SEQ ID NO: 14126 - DNA, 50 bp, homo sapien
caaacgaaaaaattttaatacaaaasagctaatattattttaaaaataat

SEQ ID NO: 14127 - DNA, 50 bp, homo sapien
ctttgtaactagcaaagaaattaagmacagtatcataaacagctgtttca

SEQ ID NO: 14128 - DNA, 50 bp, homo sapien
gaagcttatatattaatacccaaggrccatttacagttctcatgcactgc

SEQ ID NO: 14129 - DNA, 50 bp, homo sapien
gagttgaccataaagttgcagttaayattttcacgcataattttttttct

SEQ ID NO: 14130 - DNA, 50 bp, homo sapien
ggtatatggaaggaacctgtgataaytccacattgtaggaggtaggacgt

SEQ ID NO: 14131 - DNA, 50 bp, homo sapien
acaatgcttaatcatctatgatataytaattgaagattgttatttgattt

SEQ ID NO: 14132 - DNA, 50 bp, homo sapien
gtataacaatgatcctcaattattaygttaagtgcatgaatagagatgtc

SEQ ID NO: 14133 - DNA, 50 bp, homo sapien
aatgaaaatatacacagaagaaatcrataaggcacatctgatattaaaga

SEQ ID NO: 14134 - DNA, 50 bp, homo sapien
tgggcttgtatatttcaagacagctraaccagaccacgagatgtatagat

SEQ ID NO: 14135 - DNA, 50 bp, homo sapien
tccctcctgcactgagtgtaggtagraagtccttggaaggctcccaaagt

SEQ ID NO: 14136 - DNA, 50 bp, homo sapien
atcgcatggcagttctattgttataygttcttgaatatgccttctccaag

SEQ ID NO: 14137 - DNA, 50 bp, homo sapien
ttgggtttttatattgattttagtaygctttatatatcattatcattaac

SEQ ID NO: 14138 - DNA, 50 bp, homo sapien
ttactaggagagatgtatttgtttaygtcatcattttacagattgtattg

SEQ ID NO: 14139 - DNA, 50 bp, homo sapien
cttcaaaattttttaaagtctattgyatcaaattgcaccatgatgtattc

SEQ ID NO: 14140 - DNA, 50 bp, homo sapien
atcaagcttttaaaaataatactgaytcaagctatctatagttgtattgt

SEQ ID NO: 14141 - DNA, 50 bp, homo sapien
aatattggctttatgaattctttaayatcttatctggcgggcttgatttg

SEQ ID NO: 14142 - DNA, 50 bp, homo sapien
ccattttacttcatctggtttcactraaattatctaaatagagcctccac

SEQ ID NO: 14143 - DNA, 50 bp, homo sapien
ctatgtaagaaatgcaaataataaaygaaaaggtgactaatgcttcctca

SEQ ID NO: 14144 - DNA, 50 bp, homo sapien
acttgcttgagtgagaattaactacycgatgctattaataaccatgaatt

SEQ ID NO: 14145 - DNA, 50 bp, homo sapien
taagatggagtttctttctcgaagcrcagaattttctccaagcttgtttc

SEQ ID NO: 14146 - DNA, 50 bp, homo sapien
aagtaatgttctcagaaattgctaargtaaagatgttcagattttaagta

SEQ ID NO: 14147 - DNA, 50 bp, homo sapien
gaagacagcttcctgtagtattaagragacatgatatgagtggatgcaaa

SEQ ID NO: 14148 - DNA, 50 bp, homo sapien
ttctctgtgacaagggatgtttgcartctgactaaagaggattatgtatt

SEQ ID NO: 14149 - DNA, 50 bp, homo sapien
gcttttagtgtgctccttttacaagwcaatccattcatggccttctacta

SEQ ID NO: 14150 - DNA, 50 bp, homo sapien
atcagagttgatgtttgtccctataraccattccctctcctaaaacgatt

SEQ ID NO: 14151 - DNA, 50 bp, homo sapien
ttgcgatggcttcacaacacataacrcttctccattgttgatatttttcc

SEQ ID NO: 14152 - DNA, 50 bp, homo sapien
tttgtttgatcacccaggtctgaacyctcttattgcataactaatgtata

SEQ ID NO: 14153 - DNA, 50 bp, homo sapien
ttaggttataatttccagctagctaygaccctgttaatgcataaattcca

SEQ ID NO: 14154 - DNA, 50 bp, homo sapien
tatttccaaactgagatttagaaccmacatatagatttaagtatttatca

SEQ ID NO: 14155 - DNA, 50 bp, homo sapien
tctttcctagttttatcactgtctaygcttaaatatcctgaaatctttta

SEQ ID NO: 14156 - DNA, 50 bp, homo sapien
aaagagagatgggtaattctatttcyaggaccactgttgtttctgttact

SEQ ID NO: 14157 - DNA, 50 bp, homo sapien
gcttaaaatgtacaaattgaggttayatgtgcatttcagtgacatcactt

SEQ ID NO: 14158 - DNA, 50 bp, homo sapien
tcctgacttggggatacctaattgcrctgtagttaactggatattatgtt

SEQ ID NO: 14159 - DNA, 50 bp, homo sapien
ttgtgcaatgatcaaattagtgtaaycagcattattcatcattgcaaaca

SEQ ID NO: 14160 - DNA, 50 bp, homo sapien
tccccaccacgatcctcttcaaacayaccatacatcagagacattcacgt

SEQ ID NO: 14161 - DNA, 50 bp, homo sapien
gcacaggaacagaaacaaagattaarcaaggaaaactggttggtgggcag

SEQ ID NO: 14162 - DNA, 50 bp, homo sapien
ataaacaatatcataaagggtcttaygctctctgctaaggaatttagatt

SEQ ID NO: 14163 - DNA, 50 bp, homo sapien
gaaatctgaaaaatgtttctcttagracttgatgtgggataaagcagaga

SEQ ID NO: 14164 - DNA, 50 bp, homo sapien
aggccaggccatttattcactgcccrggaataaagtacagtgatttaaat

SEQ ID NO: 14165 - DNA, 50 bp, homo sapien
acttccagatggtataagcagcaaasagttaaggaggttgtggtatttga

SEQ ID NO: 14166 - DNA, 50 bp, homo sapien
atcaagcaattgattgttggttcaaytatatgacaagattgctgcttttt

SEQ ID NO: 14167 - DNA, 50 bp, homo sapien
gcttttcgaatatggtaggatgttawatgtggtaaaaagaatggctctta

SEQ ID NO: 14168 - DNA, 50 bp, homo sapien
tgataatgatgggagcagtttgagasgtggttgaaactacaaggattttg

SEQ ID NO: 14169 - DNA, 50 bp, homo sapien
gtgacacagattcggaatttacattyaagatgcaggattataataaagat

SEQ ID NO: 14170 - DNA, 50 bp, homo sapien
tagtttctgctttgtggaaaacatamggcattccaacaaaatgtttaatg

SEQ ID NO: 14171 - DNA, 50 bp, homo sapien
aattccattatccatcaattaaacayaggtaagaagtaacagacagtgaa

SEQ ID NO: 14172 - DNA, 50 bp, homo sapien
acagtaaagtatttaagataactaayagggttttggctcatagtctgtgg

SEQ ID NO: 14173 - DNA, 50 bp, homo sapien
tgttcattcagctagtatttatcggrcacacatcatgtatcaggtgctag

SEQ ID NO: 14174 - DNA, 50 bp, homo sapien
agtgcctggatctacgtaagtgcacygatgaatttttttcaggtgattta

SEQ ID NO: 14175 - DNA, 50 bp, homo sapien
tcaggaaaagtcactatcagtatcawcattaaaaatagtgcctggatcta

SEQ ID NO: 14176 - DNA, 50 bp, homo sapien
aggaattctgtgtgagttggttctayatttacactataacaataatttag

SEQ ID NO: 14177 - DNA, 50 bp, homo sapien
ggtttccgcatgagttttgtcagtaraagtggaaactgtcagaagttagc

SEQ ID NO: 14178 - DNA, 50 bp, homo sapien
aaattcaatgtgtgaatagaatgtgmaatattcatagcagtgctggttaa

SEQ ID NO: 14179 - DNA, 50 bp, homo sapien
tattagaggtaaacagattttcttcrctagctaatattacatagggcaat

SEQ ID NO: 14180 - DNA, 50 bp, homo sapien
ccagacattttcacaaagagaatctyacttaatcctcaccatagtccttt

SEQ ID NO: 14181 - DNA, 50 bp, homo sapien
gagctgcaagtcatcctcattctaaytgtttcactcacagtcaggtcagc

SEQ ID NO: 14182 - DNA, 50 bp, homo sapien
taggctagtcactcaaaacacaatasaggtaaaaaatacaattatctgac

SEQ ID NO: 14183 - DNA, 50 bp, homo sapien
agcagtgtcctgacatgaattcttayaatcaatgtctgttcattcagcta

SEQ ID NO: 14184 - DNA, 50 bp, homo sapien
ttgctgctgtggggtgatagcctaaygaactgccacctagaatctcttag

SEQ ID NO: 14185 - DNA, 50 bp, homo sapien
ccattctttctccgcttctgtttaartcttagttcttcaggcccttgttc

SEQ ID NO: 14186 - DNA, 50 bp, homo sapien
agttttgtgttgagataattactgcrctaaagagagcatatgggctgtca

SEQ ID NO: 14187 - DNA, 50 bp, homo sapien
aagaatttgcttttttatcaatcacmatgtttattaacaggtgtgacatg

SEQ ID NO: 14188 - DNA, 50 bp, homo sapien
tatttaagttatctctggaaaattcraagttaccctgaaaattcaatcga

SEQ ID NO: 14189 - DNA, 50 bp, homo sapien
atggatatcaaagtgggttagccaaygcatatctcataatgacagcaagt

SEQ ID NO: 14190 - DNA, 50 bp, homo sapien
taatgttattacatcaacctctaaayacaagttctaaaacagatgtttct

SEQ ID NO: 14191 - DNA, 50 bp, homo sapien
actctgtgaagcttcgacattattayggtttattgtaaatgaagtgaaga

SEQ ID NO: 14192 - DNA, 50 bp, homo sapien
aggaaaaaaatggtcaccgtaactaygctaatagaatataaactcttata

SEQ ID NO: 14193 - DNA, 50 bp, homo sapien
ccattgccatgttagatgctggaacraaacagacactgtctcattactca

SEQ ID NO: 14194 - DNA, 50 bp, homo sapien
ataatttttagtctcttgctagatargtagttttatgttttatgtatttt

SEQ ID NO: 14195 - DNA, 50 bp, homo sapien
aaagttatagttatgaatttcaacaytagattcatggatttggtcataag

SEQ ID NO: 14196 - DNA, 50 bp, homo sapien
tctaccaggacagaaattagcctaasaaaggcccaccagaccatgatacc

SEQ ID NO: 14197 - DNA, 50 bp, homo sapien
tgattatagaaaataaattcattcastcatctaggataatggtccagaaa

SEQ ID NO: 14198 - DNA, 50 bp, homo sapien
aatagcaaatgcggccattgattgayggaaaatataggacacatgaacaa

SEQ ID NO: 14199 - DNA, 50 bp, homo sapien
gtgcttaaggatcatgagatgggtaragtagcctgggttatccagatgat

SEQ ID NO: 14200 - DNA, 50 bp, homo sapien
agttttaatcaacattcagtaagacyaggacaatacagaggaggatatgc

SEQ ID NO: 14201 - DNA, 50 bp, homo sapien
ggagacaactgaaacccaattaaagsaatgcagtgaaacaaaccaggaga

SEQ ID NO: 14202 - DNA, 50 bp, homo sapien
atgcccggcataaatcaaacggatarcttgtactgagaagtaacaagaca

SEQ ID NO: 14203 - DNA, 50 bp, homo sapien
gaacctatttcctactgaagtattcyagattatgagaaattctgtagata

SEQ ID NO: 14204 - DNA, 50 bp, homo sapien
tccagatatgaatatgaagacatacraaaaatacttagacaacatgtaaa

SEQ ID NO: 14205 - DNA, 50 bp, homo sapien
atgaactaagaaaaattgtactggayaagttaaacatggaaggaagactt

SEQ ID NO: 14206 - DNA, 50 bp, homo sapien
tagaactaatcaaagttgaattagamggcaagatgaaataaagattttaa

SEQ ID NO: 14207 - DNA, 50 bp, homo sapien
gaagtggtgcctgcagataaaagtasaatctacaacacagggtttcgtgt

SEQ ID NO: 14208 - DNA, 50 bp, homo sapien
cagcagcatagatgtcttgccactgyaacaatgtaaccatgtattattat

SEQ ID NO: 14209 - DNA, 50 bp, homo sapien
aatatattttcagagacatccctaayattttcaacatccagcaagccaca

SEQ ID NO: 14210 - DNA, 50 bp, homo sapien
atgaaagttacatgaaagtatgagayaactaagtttagaaatgcctaggg

SEQ ID NO: 14211 - DNA, 50 bp, homo sapien
ttcattttgaccatcatgttagcacrataatatatcttaatctcagtgat

SEQ ID NO: 14212 - DNA, 50 bp, homo sapien
gacaatatggctgagaagctctagayattttgcatagtgtcatatagctg

SEQ ID NO: 14213 - DNA, 50 bp, homo sapien
taaactttaaaaattgacagcttagraaagttaagatatataccaaataa

SEQ ID NO: 14214 - DNA, 50 bp, homo sapien
acacgcatttttatattttctagaaygattgtggcatttgtttctaggaa

SEQ ID NO: 14215 - DNA, 50 bp, homo sapien
taatcagctgctacagtgaagtataygccaaaggaggatatttaataggt

SEQ ID NO: 14216 - DNA, 50 bp, homo sapien
tccacgcctttaaatgccattcagayattgaactcttctaagttacacct

SEQ ID NO: 14217 - DNA, 50 bp, homo sapien
gtcttaagaattctcattacaattawctacaaactcaattattatcatgc

SEQ ID NO: 14218 - DNA, 50 bp, homo sapien
aggccttaatatgtaatttgttataygattaccttttgtatctttctaaa

SEQ ID NO: 14219 - DNA, 50 bp, homo sapien
tttggcacaaacatggatccttaaakattgttagaataaataaaagcctt

SEQ ID NO: 14220 - DNA, 50 bp, homo sapien
cactttagcctgacctaccctctacygctctacttgtctgctaattatgt

SEQ ID NO: 14221 - DNA, 50 bp, homo sapien
gttgcatacttagctgcttgagggartatcaaagaaaagtagaaaaatag

SEQ ID NO: 14222 - DNA, 50 bp, homo sapien
gaaatgtaaataattttgtgatgcaktatcaacattacttgtttatgatt

SEQ ID NO: 14223 - DNA, 50 bp, homo sapien
aaaaagaatcaaattcatacacttascaatttaacaaaacaaatatgcat

SEQ ID NO: 14224 - DNA, 50 bp, homo sapien
acttaattataaatgtagttctataygttcagattttggcacaggtttat

SEQ ID NO: 14225 - DNA, 50 bp, homo sapien
ctcgtgtgcgaacaattgaaaatacygctgttttaatctagtaaatttga

SEQ ID NO: 14226 - DNA, 50 bp, homo sapien
aaaaatcaaattatatttaagaaggwcatggatttcagtaaagattcctt

SEQ ID NO: 14227 - DNA, 50 bp, homo sapien
cagtttagtcctcatctcttttgtcyacagattgtttgcctatatatatt

SEQ ID NO: 14228 - DNA, 50 bp, homo sapien
tctgttccctggaatatttcctcatsaagggacttagttttttgttgttg

SEQ ID NO: 14229 - DNA, 50 bp, homo sapien
atatttatatgtaacttaccatatcracatactttcaaaaccatgatttt

SEQ ID NO: 14230 - DNA, 50 bp, homo sapien
tgacaaaccctcctttcagtgtatgmactagttggtgatttttaagctat

SEQ ID NO: 14231 - DNA, 50 bp, homo sapien
gttgttaacaaaataaataaaataaytggatacatgttaactctttaaca

SEQ ID NO: 14232 - DNA, 50 bp, homo sapien
ccttttcattagagtatcagagtacraaaacatgttcttatatttggaag

SEQ ID NO: 14233 - DNA, 50 bp, homo sapien
ggcagagaaaggaattctgtattgaraactggttgttaagctttcacagg

SEQ ID NO: 14234 - DNA, 50 bp, homo sapien
ggcatgacttatttcagtcctgttaygatgttagacatttttgaaacaat

SEQ ID NO: 14235 - DNA, 50 bp, homo sapien
tccaacttgcaagcatttggaaagawccagtgattgattaaaaaaggttg

SEQ ID NO: 14236 - DNA, 50 bp, homo sapien
tttactgctctaccagtagcagtaamgattatgcaaactcaaaagctaaa

SEQ ID NO: 14237 - DNA, 50 bp, homo sapien
aacattctgaaaaatgcactgaaaartaagtgtaggtactaagaatgaca

SEQ ID NO: 14238 - DNA, 50 bp, homo sapien
atattttaaaagatctggtgggcaayggcattagttttacagttcttaaa

SEQ ID NO: 14239 - DNA, 50 bp, homo sapien
aaataaaagccaattaaaattaaggraagtatataggcctgagttaataa

SEQ ID NO: 14240 - DNA, 50 bp, homo sapien
agaaatcacatatatctgaaaaacamtgtataataaaaatccaaaatata

SEQ ID NO: 14241 - DNA, 50 bp, homo sapien
ttcaactttaacccactatcattcartattcatctaggttttcaattatt

SEQ ID NO: 14242 - DNA, 50 bp, homo sapien
gtgggactggaattcttaaaaatgasaggcttcgacgaaatagataattg

SEQ ID NO: 14243 - DNA, 50 bp, homo sapien
ggaaaactagcattctaatgactgaygtaattaccttgtaatgaaatcct

SEQ ID NO: 14244 - DNA, 50 bp, homo sapien
caaatgttgattgcgagataaaatargaatataaatgacatattttcaaa

SEQ ID NO: 14245 - DNA, 50 bp, homo sapien
ggtgggatgaggtaagatagttacawgacacaacacattgattcatttgt

SEQ ID NO: 14246 - DNA, 50 bp, homo sapien
aagtccatgactgcatattcagaaasacttgtaaggttaagaactgccca

SEQ ID NO: 14247 - DNA, 50 bp, homo sapien
attttattactttgttgatgtaaaakgaccaaagcataatattggttgtt

SEQ ID NO: 14248 - DNA, 50 bp, homo sapien
gttgatatgttaaaaaaagatgcaaytgtgtcatttaaagttaatagaca

SEQ ID NO: 14249 - DNA, 50 bp, homo sapien
gattcatttgtctttcattaggttcycaacatcttcctaaaaatagaaga

SEQ ID NO: 14250 - DNA, 50 bp, homo sapien
aatcatagggaaattctcttataggsaggattattatggttcatttccta

SEQ ID NO: 14251 - DNA, 50 bp, homo sapien
aataaaataaatcattggacatacaytctatgcagttactctgaaataac

SEQ ID NO: 14252 - DNA, 50 bp, homo sapien
atagcatacttaacccaatgcagtayagttctaatctcttggctcatcag

SEQ ID NO: 14253 - DNA, 50 bp, homo sapien
ttatggaacaaaaagtgggtcacaaygtagatgcagctgcagaaagagac

SEQ ID NO: 14254 - DNA, 50 bp, homo sapien
aattaagtagcatcagattatgacamgggaagaagaattttgtggtggac

SEQ ID NO: 14255 - DNA, 50 bp, homo sapien
cagaatttattatgaacaatatatawgaaagcagaaaggcatgaactatc

SEQ ID NO: 14256 - DNA, 50 bp, homo sapien
tgcaagtagatatcaaactctatagwactgtgaagaagggctcaacacta

SEQ ID NO: 14257 - DNA, 50 bp, homo sapien
ctgtactgtagaaactagcctaaaaygtattgtcaaagggtcagtgtaaa

SEQ ID NO: 14258 - DNA, 50 bp, homo sapien
tttatgggaggcagagggaccaatgkacttttctctgtaaatgcttcatg

SEQ ID NO: 14259 - DNA, 50 bp, homo sapien
gtgctttgtcctatttatccttcatragtcagtatcccagaggttgtggt

SEQ ID NO: 14260 - DNA, 50 bp, homo sapien
ttacttatttttaggatctagaatcratctttcccagcttttgtaatata

SEQ ID NO: 14261 - DNA, 50 bp, homo sapien
tgaaataactaaagaataaagtctgyatatatgacataaatatatgtgat

SEQ ID NO: 14262 - DNA, 50 bp, homo sapien
acaatatgattcctaacagtgaaagsctaaggaagaagttaagattgacc

SEQ ID NO: 14263 - DNA, 50 bp, homo sapien
tgagttattggtgaatgacagtaacmagtcaaaattgaagtcttggtgta

SEQ ID NO: 14264 - DNA, 50 bp, homo sapien
ccaaaattaataattcctgattctcrattatttatttatttttttgaaac

SEQ ID NO: 14265 - DNA, 50 bp, homo sapien
aagtttatgcctctatgactttgtayattatgttgaaatttaaataaaca

SEQ ID NO: 14266 - DNA, 50 bp, homo sapien
tatgtgtaaatgtttttaataaaaakctgtctagttattaaagtttatgc

SEQ ID NO: 14267 - DNA, 50 bp, homo sapien
taaatggtggtcacaatactgtagaktagcacatgcctacaaaatgatca

SEQ ID NO: 14268 - DNA, 50 bp, homo sapien
gcctgattagatcagatatatatacragtgtgtccatacatttagttgaa

SEQ ID NO: 14269 - DNA, 50 bp, homo sapien
catacatttagttgaagagaaatacrgaagagaaataagatgtagtcagc

SEQ ID NO: 14270 - DNA, 50 bp, homo sapien
acactaaaacaataggaagtacatgyattgttagaagtactagcaaggaa

SEQ ID NO: 14271 - DNA, 50 bp, homo sapien
atgtaaccattaactgatgcaatgartatgtcctaaaacatttccagtat

SEQ ID NO: 14272 - DNA, 50 bp, homo sapien
gtctcaatttctgtttccatctaggycagaacgaagaacacctttactcc

SEQ ID NO: 14273 - DNA, 50 bp, homo sapien
aattatatctaaacatgtataggcaracaatagtaaatgctatatttatt

SEQ ID NO: 14274 - DNA, 50 bp, homo sapien
atggtagtttgaaaactgacagtgamaaacctataaagcacattattatt

SEQ ID NO: 14275 - DNA, 50 bp, homo sapien
ctgggattctcttttcttatactacyaattggaaactctgtctaggttga

SEQ ID NO: 14276 - DNA, 50 bp, homo sapien
ctcttctcttttctcctaagcaacaytctaattttgtcttacacctcaat

SEQ ID NO: 14277 - DNA, 50 bp, homo sapien
accttagctcactccatcttccttcraaaattttaactttgtgtcacttt

SEQ ID NO: 14278 - DNA, 50 bp, homo sapien
attttaatcctcaaaatccttgactsaaacttgtccccacttcccagcaa

SEQ ID NO: 14279 - DNA, 50 bp, homo sapien
aacaataaaaagctatgcaaactaarttagaatgttaaataagtctgtca

SEQ ID NO: 14280 - DNA, 50 bp, homo sapien
aagggtaaactaaatgtgtgatagayaattacagttaaaaaaatgatatg

SEQ ID NO: 14281 - DNA, 50 bp, homo sapien
catcccaaacataggcgatttctcaratgaacagattagacagttgattt

SEQ ID NO: 14282 - DNA, 50 bp, homo sapien
tgagaacttgcctaatgtcacatggycagtatatagtagggaagaaacaa

SEQ ID NO: 14283 - DNA, 50 bp, homo sapien
tttctttccttggattctttagagawatacgtgtagaacatgttcagtaa

SEQ ID NO: 14284 - DNA, 50 bp, homo sapien
tcattgcttctgtgttcaatcaataygcagtacatagctttttcccttaa

SEQ ID NO: 14285 - DNA, 50 bp, homo sapien
actgtactatgtaatagaacaccaawatttattcttcctgtctaactgta

SEQ ID NO: 14286 - DNA, 50 bp, homo sapien
gatggtttaatttctcttcagtattyaaatcagaggaaatggaaactaga

SEQ ID NO: 14287 - DNA, 50 bp, homo sapien
gaaaagccatatttacattgattaaytggactatatttgacaaatagata

SEQ ID NO: 14288 - DNA, 50 bp, homo sapien
caaatcatatgaagggagaaaatacygcgactcaatgtaaaactcaataa

SEQ ID NO: 14289 - DNA, 50 bp, homo sapien
atgtgtgataattcaacatcctacamatttttctccaattaatgttttgg

SEQ ID NO: 14290 - DNA, 50 bp, homo sapien
ctaggcatttaacaaagaaaaatgaraatacattagaatcaaatacttgt

SEQ ID NO: 14291 - DNA, 50 bp, homo sapien
agactacataccatattcagttttcrccatttctttacatgtatccacac

SEQ ID NO: 14292 - DNA, 50 bp, homo sapien
tcttcaaaattaaggataactatgayagacctctgtagtggaaagatata

SEQ ID NO: 14293 - DNA, 50 bp, homo sapien
agaactgtgctaggaaaggaattatmagaaacagtgctagtttagctaag

SEQ ID NO: 14294 - DNA, 50 bp, homo sapien
atctttaaacagcaattgctaagaayttactccctgcaatttggagctgg

SEQ ID NO: 14295 - DNA, 50 bp, homo sapien
atgaaaatgcatgcatatatcacacyataacttatctgcattttagacat

SEQ ID NO: 14296 - DNA, 50 bp, homo sapien
tatgtagctttacacttatatatgaygatttccctctgtgccaaatggaa

SEQ ID NO: 14297 - DNA, 50 bp, homo sapien
tatcaaggcaataataattacttagwatttgaactgtaaatatgactacc

SEQ ID NO: 14298 - DNA, 50 bp, homo sapien
cataagaatctgctactacttatctsaaactatcaattatcaaaatcagt

SEQ ID NO: 14299 - DNA, 50 bp, homo sapien
tcattataaatagtatctttccctaygatatgttaagttacaatcataaa

SEQ ID NO: 14300 - DNA, 50 bp, homo sapien
tggtttttatgctcataatcagtaaracttaaaggaaacatttgaggaaa

SEQ ID NO: 14301 - DNA, 50 bp, homo sapien
acaaaagcttccaagctgatagaaarcagatgtgttgtatttgaaatcta

SEQ ID NO: 14302 - DNA, 50 bp, homo sapien
actaaatttgaagaaagctaagaacraatatgtatcatgaaagccaaaat

SEQ ID NO: 14303 - DNA, 50 bp, homo sapien
gaagctgtagattgctatggtagtawagacattttagtaataatatgact

SEQ ID NO: 14304 - DNA, 50 bp, homo sapien
ttaataaataaaactttaatatcatraatctgagaaaagacaaaataaag

SEQ ID NO: 14305 - DNA, 50 bp, homo sapien
aaaaatactaaaataaatgttaacamccacgataactgcgtttagtctga

SEQ ID NO: 14306 - DNA, 50 bp, homo sapien
gtcataataagctatcaagtggaacmagttattttgtgtgtgtgtttata

SEQ ID NO: 14307 - DNA, 50 bp, homo sapien
tagtagtacatggacacaactttaayctttaggtctttggaaaaaatata

SEQ ID NO: 14308 - DNA, 50 bp, homo sapien
atccatccatgtctctgcaaagtacwcgtattagtcagggttctctagag

SEQ ID NO: 14309 - DNA, 50 bp, homo sapien
tatattgtcaatgatgataaggcaaytcatgatttacagttttcttttat

SEQ ID NO: 14310 - DNA, 50 bp, homo sapien
ttcactgattgaatgacctacttaayatatgaatgaatgtgttacaggag

SEQ ID NO: 14311 - DNA, 50 bp, homo sapien
tggtcatatttttctccatcacggarctaccttcattatactctctagca

SEQ ID NO: 14312 - DNA, 50 bp, homo sapien
cgtgagtacttcacaacctgttattyaaaggtccaccgtattgcccattt

SEQ ID NO: 14313 - DNA, 50 bp, homo sapien
ggtttcccttagtttttctttgctcrattttatctatgtgtgtctcagaa

SEQ ID NO: 14314 - DNA, 50 bp, homo sapien
taacaaatatgtgttatctatactcraagtccaatttgcttaccacttac

SEQ ID NO: 14315 - DNA, 50 bp, homo sapien
gggcaaagtactttaaaaaggatatyatacagagaaggtaatccagaaat

SEQ ID NO: 14316 - DNA, 50 bp, homo sapien
ttgcacaagctatttacatacctagwcaactctttccccaaattctcaca

SEQ ID NO: 14317 - DNA, 50 bp, homo sapien
agtatcttttgatgtgaaagtgttayataggagtgtaaaaacataagaaa

SEQ ID NO: 14318 - DNA, 50 bp, homo sapien
caaggcagaatttttaagagcacacsaattaggctgaaatatactctact

SEQ ID NO: 14319 - DNA, 50 bp, homo sapien
ttggctactaaatatatttcataaaratcgaaagtatgctagtagcagta

SEQ ID NO: 14320 - DNA, 50 bp, homo sapien
gtactctggaaaaagacaataggtayataaaacaaagatggaagacaatg

SEQ ID NO: 14321 - DNA, 50 bp, homo sapien
tagaatttggttactaaagatcataygaaatcatgtaaatattgtaaatc

SEQ ID NO: 14322 - DNA, 50 bp, homo sapien
cagagaacctagaaaactctcaatgratttagttactgcccttggtaaat

SEQ ID NO: 14323 - DNA, 50 bp, homo sapien
gcaaaatgatgtacagattttaatarcacacaaaagagttacgtgtacta

SEQ ID NO: 14324 - DNA, 50 bp, homo sapien
aaagtaaagcttatagttgctatacrgagcaggaatttcactagcacaaa

SEQ ID NO: 14325 - DNA, 50 bp, homo sapien
taacacagaaacaaataaccttaagrctgaatagaaaggcatagtatttt

SEQ ID NO: 14326 - DNA, 50 bp, homo sapien
gttaatgtgttgttcattgatgttamaattatcacctttgcacttaataa

SEQ ID NO: 14327 - DNA, 50 bp, homo sapien
acctacgattgctgtcaaagggtccratatcactactagcaagggaaatt

SEQ ID NO: 14328 - DNA, 50 bp, homo sapien
acttttcactgtttctttttctccawgattatagtagcctgggactccaa

SEQ ID NO: 14329 - DNA, 50 bp, homo sapien
aaagttagttgcttcaattacaatayccaaaagttataattaggtaaagc

SEQ ID NO: 14330 - DNA, 50 bp, homo sapien
tgacattagacctacccacttcatgratgttagttaaattttttagatct

SEQ ID NO: 14331 - DNA, 50 bp, homo sapien
ataaatccatattgtgaccttatcartatattcatccatattgtgatctt

SEQ ID NO: 14332 - DNA, 50 bp, homo sapien
aaagctttaatttcaaatgcagatamaagggagaaaagaataacaataga

SEQ ID NO: 14333 - DNA, 50 bp, homo sapien
gattattttatatatgataatatacygtaaaatcaactctacaaatgtaa

SEQ ID NO: 14334 - DNA, 50 bp, homo sapien
tagaaatggtttaatgtgcataatgwagcgttataactaacatcaagacc

SEQ ID NO: 14335 - DNA, 50 bp, homo sapien
ataatgatttagatgaaaaaacaaascagttctcttagtcataaaaatat

SEQ ID NO: 14336 - DNA, 50 bp, homo sapien
attaagggtaaattatgttaggaagsaatgttggagttgaaaacagaata

SEQ ID NO: 14337 - DNA, 50 bp, homo sapien
aattaaaacttatacctatctagaayggaaggatacttataatcagcaca

SEQ ID NO: 14338 - DNA, 50 bp, homo sapien
tttccagctggaaaagccacacctcraagattctgtgacaatatcactgg

SEQ ID NO: 14339 - DNA, 50 bp, homo sapien
aatgactattgatggtaatttttgakgaatgttattggctatgactatct

SEQ ID NO: 14340 - DNA, 50 bp, homo sapien
caaagatcttgaaagagcttgttgarctaacccacctacgattgctgtca

SEQ ID NO: 14341 - DNA, 50 bp, homo sapien
tgatatttgaaagaaaaaattgcgargtcgatctacctgtcgactatcaa

SEQ ID NO: 14342 - DNA, 50 bp, homo sapien
ttgcctaccctagattaggaggatakgttgaaaagtcaattagcaatctt

SEQ ID NO: 14343 - DNA, 50 bp, homo sapien
tgatgagcaagctattcaaaacatakgtaggctatttaaagcttgccctt

SEQ ID NO: 14344 - DNA, 50 bp, homo sapien
atactctgaagcataatggtgaaggmaataaaacttatagaccaaataat

SEQ ID NO: 14345 - DNA, 50 bp, homo sapien
cccatgacagcaacagaggttaaaasagttacgagcataaagctgcacta

SEQ ID NO: 14346 - DNA, 50 bp, homo sapien
tctctgaatttgccacttaatttgaygtggcacttcccactggagtggtc

SEQ ID NO: 14347 - DNA, 50 bp, homo sapien
tagggttgaaaattccaccatctgastagctctattaccattataattta

SEQ ID NO: 14348 - DNA, 50 bp, homo sapien
ctgcagtttcaaggtaaaagctatcraatctttgcgtatatacatgtttg

SEQ ID NO: 14349 - DNA, 50 bp, homo sapien
tctgcccttaaggcatcattaagaawaccagttgttattgaatagcagac

SEQ ID NO: 14350 - DNA, 32 bp, homo sapien
tgaagatatctctgaartgcaaacttttgact

SEQ ID NO: 14351 - DNA, 50 bp, homo sapien
tcaaataccatctattcatcattaaygtagcttaaaaacttactataata

SEQ ID NO: 14352 - DNA, 50 bp, homo sapien
gagttattcaattacatagcgaaaayacttagttaataaaagtttaatac

SEQ ID NO: 14353 - DNA, 50 bp, homo sapien
gggtgcataaggttacaaaaattggrcacatcaaggaagcagcttcagtt

SEQ ID NO: 14354 - DNA, 50 bp, homo sapien
tctatttgtcctccactcagatgtawcaattctagctcatgaattctttt

SEQ ID NO: 14355 - DNA, 50 bp, homo sapien
tggatttctctactatcagataaacsctttgctctggcctatttaataaa

SEQ ID NO: 14356 - DNA, 50 bp, homo sapien
atctttccttatcgcttaacatcccscctaaagtgaggggaaatttacat

SEQ ID NO: 14357 - DNA, 50 bp, homo sapien
tgacacctgcaacccagcagtatacrggttttgaaaaactgggcttgcct

SEQ ID NO: 14358 - DNA, 50 bp, homo sapien
tcccattttctgtgactgaagtcaaygaaaatctacaattactcaattag

SEQ ID NO: 14359 - DNA, 50 bp, homo sapien
aaacctgcaacattatattctaatcratgttatatgacctgaaaggaatt

SEQ ID NO: 14360 - DNA, 50 bp, homo sapien
tggtggtggtattacctggaagtaarggtgtcattatcaaagcttcagag

SEQ ID NO: 14361 - DNA, 50 bp, homo sapien
accagattcatcaattccaaactaasatgctttgggcaaagtttcataaa

SEQ ID NO: 14362 - DNA, 50 bp, homo sapien
ctataatcacttttcaaatctccaaytattaacacagcattctcttttgc

SEQ ID NO: 14363 - DNA, 50 bp, homo sapien
ctggtatttcaatcctatcctaactraatataaacacagcttttacaacc

SEQ ID NO: 14364 - DNA, 50 bp, homo sapien
agttatagaatacccttgtcattcayggcagttaacagctgccattttaa

SEQ ID NO: 14365 - DNA, 50 bp, homo sapien
atggtggatatctttaaacagattaygagacattttgtatacgtcagtat

SEQ ID NO: 14366 - DNA, 50 bp, homo sapien
ttagcaaccacttaagttatgattcyacctggctttgcaaatcagataat

SEQ ID NO: 14367 - DNA, 50 bp, homo sapien
gtcatctctgttttttcgaaacttgyaatgagagctagaataaattaggt

SEQ ID NO: 14368 - DNA, 50 bp, homo sapien
cattgatttgatacataatttgaaasattacatactaacaataggtttta

SEQ ID NO: 14369 - DNA, 50 bp, homo sapien
tattttatgcactgtggagacttgasaaataatggagacagaacaaataa

SEQ ID NO: 14370 - DNA, 50 bp, homo sapien
gtaattgaggcaattcttgaaaaatratacattcttagtgaaaaataata

SEQ ID NO: 14371 - DNA, 50 bp, homo sapien
catcaccaacctaagaatcaagagaygactggcttaggttatattgagaa

SEQ ID NO: 14372 - DNA, 50 bp, homo sapien
ttaggtaggcattgtaggtttatgamaaagtagaagaattgaagcaaggt

SEQ ID NO: 14373 - DNA, 50 bp, homo sapien
ttgggagcatcagagggagttaacawgacagtgaaaaattatctaagcag

SEQ ID NO: 14374 - DNA, 50 bp, homo sapien
agcagcccaagatctggcctatggamgttttgatgctcatatctctacca

SEQ ID NO: 14375 - DNA, 50 bp, homo sapien
ccccacctcaagatgttgagagaagyaggctgattacatggtgtattcca

SEQ ID NO: 14376 - DNA, 50 bp, homo sapien
tttttcagcaccattatgaacttacrggaccactatcataaatgcagtct

SEQ ID NO: 14377 - DNA, 50 bp, homo sapien
tgtacacataatatacatgtatataraaggtacatctgatcacattgctt

SEQ ID NO: 14378 - DNA, 50 bp, homo sapien
atgttttgaaactcaatatcatagayggttgttgtagatggtgttcatcc

SEQ ID NO: 14379 - DNA, 50 bp, homo sapien
gattttagcaatgtttggcccacacratatacctctgtctacaccctaca

SEQ ID NO: 14380 - DNA, 50 bp, homo sapien
gaaacattaaagagaaaatgaaaaaygtacaactcttataatggaaatga

SEQ ID NO: 14381 - DNA, 50 bp, homo sapien
tctagactagagagtatatacatacratgacttagttgtcttagtatgtt

SEQ ID NO: 14382 - DNA, 50 bp, homo sapien
gcgttttgtagatatgttctaggaaraagttttttatgcttaaatgacct

SEQ ID NO: 14383 - DNA, 50 bp, homo sapien
aaagagacatgggctatagtgaaaawtttggaagatattatctaattttt

SEQ ID NO: 14384 - DNA, 50 bp, homo sapien
agtattccagatcagctaatatttaygtgttccagaggagttaacgatag

SEQ ID NO: 14385 - DNA, 50 bp, homo sapien
ggacagcaaaataattttgcaaaacratcacattttaaaatcagcttttt

SEQ ID NO: 14386 - DNA, 50 bp, homo sapien
ggtttaggatagagcaataagggcayaaagaaacataaattaattttctc

SEQ ID NO: 14387 - DNA, 50 bp, homo sapien
aatctcacctgttttcaaacccaaarttaaagtcaaagaagcaatagaaa

SEQ ID NO: 14388 - DNA, 50 bp, homo sapien
actagaatattggtgtacttaaagcratcatgaagataatatttttttct

SEQ ID NO: 14389 - DNA, 50 bp, homo sapien
atcttactttagaaacacaaaaatayggtgtcataaattattataaaatg

SEQ ID NO: 14390 - DNA, 50 bp, homo sapien
cgtttgataatagcctgtttcgctcrgaaaatgttaatttggctgttatt

SEQ ID NO: 14391 - DNA, 50 bp, homo sapien
cttctcttaaattttatctattacawgttgaaatgctaaagaagagaaag

SEQ ID NO: 14392 - DNA, 50 bp, homo sapien
cggtatttccttctacttttaaatawcttgacttctgcctaaattccccc

SEQ ID NO: 14393 - DNA, 50 bp, homo sapien
gaaccacacttcttcctacgacttayataagatttatgggtgccttcctt

SEQ ID NO: 14394 - DNA, 50 bp, homo sapien
ttaaatacaccttttgatggtatcawctctttcctatcagacctgcagga

SEQ ID NO: 14395 - DNA, 50 bp, homo sapien
aatctaaattcttttgtccagaaaamaataggtgagagaagcataatgcc

SEQ ID NO: 14396 - DNA, 50 bp, homo sapien
taagtagctaatggatcaaaagaackgttataaactgaattcttcactgt

SEQ ID NO: 14397 - DNA, 50 bp, homo sapien
agtaatgtatgctatctgtacgtgtyaaaatcttcacatgcaattattta

SEQ ID NO: 14398 - DNA, 50 bp, homo sapien
ttatcactttccagctgcagcgtaaytgaggcaatcctctagatatatct

SEQ ID NO: 14399 - DNA, 50 bp, homo sapien
aagagtctcagattaaagaataatayggttttcagctaatcttttctttc

SEQ ID NO: 14400 - DNA, 50 bp, homo sapien
ttaaactattttctactccatgactraaaagtaaaaatgtgttttgtaaa

SEQ ID NO: 14401 - DNA, 50 bp, homo sapien
agaattttcctcaccttaatgttaaycttagcaatgtgtcttagtctgct

SEQ ID NO: 14402 - DNA, 50 bp, homo sapien
caacgactttttagttgaattcgcartattatttttttcttctggtcacc

SEQ ID NO: 14403 - DNA, 50 bp, homo sapien
ttatcctcacctgtggtccccatcamtaatagagctacgaatgccaagtt

SEQ ID NO: 14404 - DNA, 50 bp, homo sapien
ggagaattgtaaaaataaaatgtacracaaacatgtagcagctacattgc

SEQ ID NO: 14405 - DNA, 50 bp, homo sapien
tttggaaatcacacatttaatctcargtcattttcagataggaaaactga

SEQ ID NO: 14406 - DNA, 50 bp, homo sapien
cattcagtctactatagttactccaygatgacaccagctggcaattgttt

SEQ ID NO: 14407 - DNA, 50 bp, homo sapien
acctctgagattcatagggatattaratcatctctttccatctcttctga

SEQ ID NO: 14408 - DNA, 50 bp, homo sapien
aggcatacaaatttattaaagtgccyatgaacacaagagactcaaagaag

SEQ ID NO: 14409 - DNA, 50 bp, homo sapien
tgacgggaccccatcaacaagtgcaragtgaatttcatgagctagaagcc

SEQ ID NO: 14410 - DNA, 50 bp, homo sapien
agaaaagatggtcttgcttgtttcayagaaagcaggtattaaagtgtgga

SEQ ID NO: 14411 - DNA, 50 bp, homo sapien
caggtgcttaatttttttcaatctcmatctatcccacacatcttttacaa

SEQ ID NO: 14412 - DNA, 50 bp, homo sapien
aggcccttgataaagtaagtaaaaarcgcacatgtttagtatacagcaaa

SEQ ID NO: 14413 - DNA, 50 bp, homo sapien
tgcatttcagggccctgtctatgcamataaagagaaacattgtgccgtaa

SEQ ID NO: 14414 - DNA, 50 bp, homo sapien
ccaaaatctctgaactcttctattaygtgcttcaatcagagtgaggaatg

SEQ ID NO: 14415 - DNA, 50 bp, homo sapien
tttggaacaatgagttctcaaaacartcttcctccaagatgtgtcctgtt

SEQ ID NO: 14416 - DNA, 50 bp, homo sapien
tattggtattcttggataatgttaarggatagtaaaatcaggaaaacagc

SEQ ID NO: 14417 - DNA, 50 bp, homo sapien
ccgactatgtgtattatgaacaagawaagaaagagaagtgcagtgtctgg

SEQ ID NO: 14418 - DNA, 50 bp, homo sapien
agctatttttcaatgagagtagccaygactagttactaagcttaaacttt

SEQ ID NO: 14419 - DNA, 50 bp, homo sapien
caggcacaaaagaactctggagttayctgaaacatatagtgcccctcatt

SEQ ID NO: 14420 - DNA, 50 bp, homo sapien
ttttatgatagggctatgcatttcamattagacagtatttgctaatgcat

SEQ ID NO: 14421 - DNA, 50 bp, homo sapien
tgaatttgagtacagcaaactcaatkagctatattctaggtttgaacctc

SEQ ID NO: 14422 - DNA, 50 bp, homo sapien
atccggtgtgtcttccttgttgtcgragtggattgctggttggaaggtag

SEQ ID NO: 14423 - DNA, 50 bp, homo sapien
tctgtaaacagatccattcattctgwatatacatggcctgcatcactaga

SEQ ID NO: 14424 - DNA, 50 bp, homo sapien
tttgtaatgtgtcatttccaaaatascttcttcgtatatcgtatttttct

SEQ ID NO: 14425 - DNA, 50 bp, homo sapien
tctttatagcctttagcatgacctayggcaatcctgctttcttgttttgt

SEQ ID NO: 14426 - DNA, 50 bp, homo sapien
gtgctttttatggtcattcttaatayggagtgcacctatttcatattcct

SEQ ID NO: 14427 - DNA, 50 bp, homo sapien
gtcctcaagtctcaggagaaattcaygcttctacagcctctacttctgtg

SEQ ID NO: 14428 - DNA, 50 bp, homo sapien
ctgtgatagatctctccacatttaargaattcagcacttttgtccattct

SEQ ID NO: 14429 - DNA, 50 bp, homo sapien
aaaagtaaaagatcaacagatttgayaccattcaagtgtgaaacatttat

SEQ ID NO: 14430 - DNA, 50 bp, homo sapien
ccctcagacactctggcatatagatraggaaataaaaatgtgatggaaag

SEQ ID NO: 14431 - DNA, 50 bp, homo sapien
atttttaaatttaacaaaagatcatragtaaaccagaaaaaaaagaaata

SEQ ID NO: 14432 - DNA, 50 bp, homo sapien
tagagacagacatttctacaatctayaggtttcccatttatgctaactgg

SEQ ID NO: 14433 - DNA, 50 bp, homo sapien
aataaattcatatattaagtgatcaycaattctatggaaagtggtaattt

SEQ ID NO: 14434 - DNA, 50 bp, homo sapien
aaaacttactatattttaaaaatacwctctgctatagccatctaattatt

SEQ ID NO: 14435 - DNA, 50 bp, homo sapien
tatttattattactatatatctctcyagttagtttccatttttacttcta

SEQ ID NO: 14436 - DNA, 50 bp, homo sapien
ctgcttgttaccacaatatgcagcargtataacatcacaaatgcaccctt

SEQ ID NO: 14437 - DNA, 50 bp, homo sapien
atctcactctgagtccatctttctayaaaatttgctggtgtcagcaatcc

SEQ ID NO: 14438 - DNA, 50 bp, homo sapien
agatgtgaatcaaaccatgaggtctractatagggttaaaaggtagattc

SEQ ID NO: 14439 - DNA, 50 bp, homo sapien
ttattccgtacaaaagcattctatgrattccattgctacagtcatgtttt

SEQ ID NO: 14440 - DNA, 50 bp, homo sapien
tttacagagtataaatttagaaaaamgccatcatttagtatttgaaaaag

SEQ ID NO: 14441 - DNA, 50 bp, homo sapien
actgtcaaatgaatagaaatctctgragaagtgtgttccaagcagaatat

SEQ ID NO: 14442 - DNA, 50 bp, homo sapien
aattaaagcatttcaattttattcarcattcgctatcatgaagaaagaat

SEQ ID NO: 14443 - DNA, 50 bp, homo sapien
ggcataccagatcctacctcatggarccctaccgtaactctatattctta

SEQ ID NO: 14444 - DNA, 50 bp, homo sapien
gaggcaggaggatcatttgcgctgargatgtctaggctgcagtgagctgt

SEQ ID NO: 14445 - DNA, 50 bp, homo sapien
attttcacagtgaatataatctcatraaagaataaatgttctgtcatttt

SEQ ID NO: 14446 - DNA, 50 bp, homo sapien
aaaagcttgtatgtttccatttattsaaatcttttcagaaaataaaaaca

SEQ ID NO: 14447 - DNA, 50 bp, homo sapien
gtattttattttttgaagtgtcaaaygcttttcttaactagcaaataaaa

SEQ ID NO: 14448 - DNA, 50 bp, homo sapien
gagtctccagatttatttcctgttaygctcagagaagatttaaataaagt

SEQ ID NO: 14449 - DNA, 50 bp, homo sapien
acacatttatcttcaactgcttgaawttaacagtaaaacaatcagaaaac

SEQ ID NO: 14450 - DNA, 50 bp, homo sapien
ggaaaaaaagtgagtgtgtcaaaacragtctcaaaagctctgcctagatc

SEQ ID NO: 14451 - DNA, 50 bp, homo sapien
aattattattttactaatatcctgamtatctgaatatctcatagagactt

SEQ ID NO: 14452 - DNA, 50 bp, homo sapien
aatgtacaaaggtgtgatatatgtaygtaatggcaaataaactagtattg

SEQ ID NO: 14453 - DNA, 50 bp, homo sapien
ccataattctcgatggcattttagckcctctgttattgtctatactaaag

SEQ ID NO: 14454 - DNA, 50 bp, homo sapien
atgactagggaaccactttggtcacygcttccgatcttaactagctgtta

SEQ ID NO: 14455 - DNA, 50 bp, homo sapien
tctaacaaattatcatttgtccagamatacgtttttaatgtgtttaatgt

SEQ ID NO: 14456 - DNA, 50 bp, homo sapien
gaggagattaactgaagtttagctayatttaagtgtcaagtttatggagt

SEQ ID NO: 14457 - DNA, 50 bp, homo sapien
acttttcaaatatcactctcaggcamtcgtaaaatgaaaatagaaataaa

SEQ ID NO: 14458 - DNA, 50 bp, homo sapien
caagatatcccctggaactctaatcyaattaatggtattatatcttttga

SEQ ID NO: 14459 - DNA, 50 bp, homo sapien
agctttcatatacgcacaacgttcasaaaatgaaaatgaacatttctcag

SEQ ID NO: 14460 - DNA, 50 bp, homo sapien
aagtccaaaatcttcaggataaaccrgcaggctacatacccagagaagag

SEQ ID NO: 14461 - DNA, 50 bp, homo sapien
tccctttgtgtttgaaaaagttagaygctttgattttgttgataccagaa

SEQ ID NO: 14462 - DNA, 50 bp, homo sapien
ccaaatttacaaatgtactcttttargcctacatgaactgggtgtagttc

SEQ ID NO: 14463 - DNA, 50 bp, homo sapien
gctttgattttgttgataccagaaayggatgaaactggtgtgcatcaggg

SEQ ID NO: 14464 - DNA, 50 bp, homo sapien
tacacatatgagactttaagcaaatmagttaatctctttggtttttaatt

SEQ ID NO: 14465 - DNA, 50 bp, homo sapien
cgccactttaaaatccaactgtgaaytggtcgcatctctaggatacactc

SEQ ID NO: 14466 - DNA, 50 bp, homo sapien
actcgtagatacatacacaggagaaytgaaaacgtatatttacacacaaa

SEQ ID NO: 14467 - DNA, 50 bp, homo sapien
tgaagagaggcttgggaatggtataraccaaattcaagagggagagttat

SEQ ID NO: 14468 - DNA, 50 bp, homo sapien
tacaagctggtatctttaatagtcasgtactaaaactaaatatcatatat

SEQ ID NO: 14469 - DNA, 50 bp, homo sapien
cagtgaataagatgaaaataaggtaygcaaattaagccacattggaaaac

SEQ ID NO: 14470 - DNA, 50 bp, homo sapien
catgagaagcataatcagtgagaaayattaactggtatctactccctaca

SEQ ID NO: 14471 - DNA, 50 bp, homo sapien
ttcacaaaaacccataaaattatgcmaaaattggtttgagggcataaaat

SEQ ID NO: 14472 - DNA, 50 bp, homo sapien
gaaaaactagtgttacagattctgaytaacagttcattttatgacccacc

SEQ ID NO: 14473 - DNA, 50 bp, homo sapien
ttgatattcctttactttagacagasattaacatcagaaggccaagggta

SEQ ID NO: 14474 - DNA, 50 bp, homo sapien
ttacattctccatgtagtataaataycaaatgaatgtagtagttatgcct

SEQ ID NO: 14475 - DNA, 50 bp, homo sapien
gtcttttcactttacagtataccacygctcacttcctcttagctcagctt

SEQ ID NO: 14476 - DNA, 50 bp, homo sapien
gtcatttgtttggagcacaaactcawtattgttccaaaagacagctattt

SEQ ID NO: 14477 - DNA, 50 bp, homo sapien
ttccatcaagaccaaatatttccatyagcataatactgttcggatcccat

SEQ ID NO: 14478 - DNA, 50 bp, homo sapien
ccttcctgtttgtgacagtaaatgayggaacactttatcaattcttcttt

SEQ ID NO: 14479 - DNA, 50 bp, homo sapien
ttttttataatttttctttcttaaakcatacagtcttgttattattcagt

SEQ ID NO: 14480 - DNA, 50 bp, homo sapien
gacttactttaaagtaggccacttaygatgtaacttatgtatatttatat

SEQ ID NO: 14481 - DNA, 50 bp, homo sapien
tgattcaagtgaattctgtgtaaaartaaaaatgagttgtcaagctttta

SEQ ID NO: 14482 - DNA, 50 bp, homo sapien
ccacaactaatccaatagctggtagmaaaaaatgacacaagctatgtcaa

SEQ ID NO: 14483 - DNA, 50 bp, homo sapien
tgcccttggttggtataaagtccagkcatcctgattcaagtgaattctgt

SEQ ID NO: 14484 - DNA, 50 bp, homo sapien
gagcctgggaaacaaatcttttagcygaacatattgctacacttgataat

SEQ ID NO: 14485 - DNA, 50 bp, homo sapien
acaaactgaccagaagtcccagatarcacatttattaatataccttttac

SEQ ID NO: 14486 - DNA, 50 bp, homo sapien
acttgggcaaccaagatgtgccttaygtagagttgtcctggaaatctaca

SEQ ID NO: 14487 - DNA, 50 bp, homo sapien
tgataagagccaactagtttaaactyaaggcagtgttgggaatattttat

SEQ ID NO: 14488 - DNA, 50 bp, homo sapien
agtaattttttgagaattttttataycctactgactcatgtcactcatgt

SEQ ID NO: 14489 - DNA, 50 bp, homo sapien
ttcaatgcctagtgatgaaatcacartgagaaaaatataaaacgcccata

SEQ ID NO: 14490 - DNA, 50 bp, homo sapien
tcaaatcttttaatcaacgaagatgmaactaactcctcccttcccccaaa

SEQ ID NO: 14491 - DNA, 50 bp, homo sapien
aaaacaaacgtcttaagtagttgtckaattcagtaagcaaaaacgctact

SEQ ID NO: 14492 - DNA, 50 bp, homo sapien
gtgactgatcttatatctgatctcakccagtgtttaattccttttaaaac

SEQ ID NO: 14493 - DNA, 50 bp, homo sapien
gacgaggggaaaacaggagcttaaamgaattaaaacatgttggggagtgg

SEQ ID NO: 14494 - DNA, 50 bp, homo sapien
taagaagtactaatggctaaaaatartaagaaataataacaacacagagt

SEQ ID NO: 14495 - DNA, 50 bp, homo sapien
cgattctaaacctgagctgagctttyaaaccatatttttgtattcagagg

SEQ ID NO: 14496 - DNA, 50 bp, homo sapien
gcaggggactaagaattttgtgaaargtcataaaaagtctattggagttc

SEQ ID NO: 14497 - DNA, 50 bp, homo sapien
tctgaaaatgacaagtgtcatagccrctgatgtagagacttgtattcctt

SEQ ID NO: 14498 - DNA, 50 bp, homo sapien
gcctagcattcaaagtagaatagcartatcaaaatgtgtaggaagcttta

SEQ ID NO: 14499 - DNA, 50 bp, homo sapien
agaacacctgtagcagaagtttaaaraagaaatgtatttgtgtgagactc

SEQ ID NO: 14500 - DNA, 50 bp, homo sapien
agtcacaagatgtatctctagcaacraagacatagccctgcacatactaa

SEQ ID NO: 14501 - DNA, 50 bp, homo sapien
ctttatgattaaagttctattgcaaygccacagattttaggggcagctag

SEQ ID NO: 14502 - DNA, 50 bp, homo sapien
ttctatttgactcaattatgcacaartcagcacataataatttaatcaag

SEQ ID NO: 14503 - DNA, 50 bp, homo sapien
gactccatccaaaaatactatgtcartataagaacgtaaagaaaaatgca

SEQ ID NO: 14504 - DNA, 50 bp, homo sapien
gagttttcaaagagttaagtacaaaytaaatgcagttcaacaaaagcaaa

SEQ ID NO: 14505 - DNA, 50 bp, homo sapien
gaaaggaatttttgctgcaagttaartataagtccactgaaacaggatgc

SEQ ID NO: 14506 - DNA, 50 bp, homo sapien
taattttttcatgaacatctagaaastaagagcatttttaaaacattttc

SEQ ID NO: 14507 - DNA, 50 bp, homo sapien
gagcaatttcttatatataaaagccratacagatgtgaacacatacatac

SEQ ID NO: 14508 - DNA, 50 bp, homo sapien
ttataatttgcaatggccttttttgmatatctaatgttaattttaatcca

SEQ ID NO: 14509 - DNA, 50 bp, homo sapien
aaaaaaaagcgatattgtttcagacrctaggatctactctcttacacagt

SEQ ID NO: 14510 - DNA, 50 bp, homo sapien
actgagttcatttcagatttcttcasgttgttcatgtagtggggcaactg

SEQ ID NO: 14511 - DNA, 50 bp, homo sapien
gtatattatctaaataatagtcattraacatataggaaaaatatatctga

SEQ ID NO: 14512 - DNA, 50 bp, homo sapien
agtcctctgcaaaagacagagatccrcacatttttggacaaaggcattta

SEQ ID NO: 14513 - DNA, 50 bp, homo sapien
agagaaacacctggatcagtcctcargaaaaagatttaaatttcatcctg

SEQ ID NO: 14514 - DNA, 50 bp, homo sapien
cttcttatcataatcatatttttccrataccagaatcaaggtgcactgtg

SEQ ID NO: 14515 - DNA, 50 bp, homo sapien
gctgatggactggtggactgactcartgaatgctgtagaaccactgaagc

SEQ ID NO: 14516 - DNA, 50 bp, homo sapien
ctatttcttattctgatatgtaaaayctataggaaccatcgtgttataaa

SEQ ID NO: 14517 - DNA, 50 bp, homo sapien
tactgcaaacaaaaatgaaactcacraatatgatccaaatgttaaatgta

SEQ ID NO: 14518 - DNA, 50 bp, homo sapien
ctgctgacttgtatctcattctttcragagctatatcctatagaacctgc

SEQ ID NO: 14519 - DNA, 50 bp, homo sapien
aagacacaggatactacagaaatgcwctatgatctattgtaatgctgttt

SEQ ID NO: 14520 - DNA, 50 bp, homo sapien
ttttctggtccaatgcacaggataaygaatttcagtgattccaataaaca

SEQ ID NO: 14521 - DNA, 50 bp, homo sapien
attgtttaaggtcaaattacagcatraagttgatatctggtaaaatatca

SEQ ID NO: 14522 - DNA, 50 bp, homo sapien
agttttgtcatttgtaaactggcaakgtatcatctcgtgggattgatctg

SEQ ID NO: 14523 - DNA, 50 bp, homo sapien
aatatccaaacatgattatcacctaygagtatttcatttattaatagcct

SEQ ID NO: 14524 - DNA, 50 bp, homo sapien
ttaaaagtatcctattattgatacaygaacatttaggattgctgttttat

SEQ ID NO: 14525 - DNA, 50 bp, homo sapien
aatagagaaagacagtccaagtgagragaatatagcaagggaagtaagag

SEQ ID NO: 14526 - DNA, 50 bp, homo sapien
aagaaattatggttttcatgtgtcaraagtaataattttaaagcagagaa

SEQ ID NO: 14527 - DNA, 50 bp, homo sapien
tgtgaactcatgtgaaaattcctaaygttgaacatgcagggagaacccag

SEQ ID NO: 14528 - DNA, 50 bp, homo sapien
gcaaatcttatcatgttgcaccttasgacatctttgaatcacacctactt

SEQ ID NO: 14529 - DNA, 50 bp, homo sapien
gacttggaatgagattgatatgtgayaagggtggtatcgctacaaaggga

SEQ ID NO: 14530 - DNA, 50 bp, homo sapien
ggcaggtggactgtcaaacgtgctakgaaaagcgaagtgaaacctgtcgt

SEQ ID NO: 14531 - DNA, 50 bp, homo sapien
gcaaagagtaccgaggatgcctaaarcaccatgataaaatttggggtatg

SEQ ID NO: 14532 - DNA, 50 bp, homo sapien
gagaaatttaattatagcttcataakaatgtctagatcatttaaaaagtc

SEQ ID NO: 14533 - DNA, 50 bp, homo sapien
aagttttggcttaaagatgaaattaygtcttgggcgctctgcttttggga

SEQ ID NO: 14534 - DNA, 50 bp, homo sapien
aaaattcgtgaatgctttatgctaaraaaatattgggttacgtggcctct

SEQ ID NO: 14535 - DNA, 50 bp, homo sapien
cactggaaacctaatgacaaaactcwatgactgctggcaataacacacag

SEQ ID NO: 14536 - DNA, 50 bp, homo sapien
cattgtcctatctcagaaaatgcagsatagttccagattgaagcagaatc

SEQ ID NO: 14537 - DNA, 50 bp, homo sapien
tcttgacacctccccttttaaaagamtaagagaaacagaggcacaaagtt

SEQ ID NO: 14538 - DNA, 50 bp, homo sapien
cctgcacactaactgaatctgatacrctaacatgctctatacatctgttt

SEQ ID NO: 14539 - DNA, 50 bp, homo sapien
tagatacatgtaaactatcagttgcwcaattagatggtaactttttaaaa

SEQ ID NO: 14540 - DNA, 50 bp, homo sapien
atccttgggttgtactgcaaatacasgtctactgttaaagtccgttgttt

SEQ ID NO: 14541 - DNA, 50 bp, homo sapien
ataaatcacatctcaactgattaagkcctctaggtataaataccaggtac

SEQ ID NO: 14542 - DNA, 50 bp, homo sapien
aacaaatcaacagtattaaggagaaygtttgacataaaaagtcatgtttt

SEQ ID NO: 14543 - DNA, 50 bp, homo sapien
acatatcatgttaaaactataattgwagcagttatccaatcttccgcatt

SEQ ID NO: 14544 - DNA, 50 bp, homo sapien
aaaagcggaatcagtagtatcagccraagaaactcacttagctagaacgt

SEQ ID NO: 14545 - DNA, 50 bp, homo sapien
agcagctaagtcttatgatggtgacscacttctcttcagtttctcttcca

SEQ ID NO: 14546 - DNA, 50 bp, homo sapien
agaagaagaatggtactggcatttgsattatttaatttcacagctactga

SEQ ID NO: 14547 - DNA, 50 bp, homo sapien
tttggtgatttcttttggataaaagwctcacatttggaaacagctagctg

SEQ ID NO: 14548 - DNA, 50 bp, homo sapien
aatttttattgtataaattatcccartcaaaacttgtattaacctctgat

SEQ ID NO: 14549 - DNA, 50 bp, homo sapien
aggtgttactaataaataaatgtaasagttctaaggaatatggcctttga

SEQ ID NO: 14550 - DNA, 50 bp, homo sapien
gcccacctgaactcggtctgaggaasaagattacattcaggcttgagctt

SEQ ID NO: 14551 - DNA, 50 bp, homo sapien
tgtgaactcgctgctaaacattcctraccaggtatcctccttcctggctg

SEQ ID NO: 14552 - DNA, 50 bp, homo sapien
aatatctcaggttacaaggccaaccyatgcaaatcagtggcactgctata

SEQ ID NO: 14553 - DNA, 50 bp, homo sapien
tgttttttgaatccagctcgtaaagyctataattaggaggaagcatcaaa

SEQ ID NO: 14554 - DNA, 50 bp, homo sapien
atcagtgctcagcttaaggctcaagragaataactttagatcaccagtgc

SEQ ID NO: 14555 - DNA, 50 bp, homo sapien
tgatatacatactatattaaggctgyagttgataccctgacaagtatgta

SEQ ID NO: 14556 - DNA, 50 bp, homo sapien
caacttgtgtaaagtgcacagtacakggtaagcactccacaaagtctaat

SEQ ID NO: 14557 - DNA, 50 bp, homo sapien
aatcatttgttcagcataaaaacatragccaagttgtgagaatgttgaac

SEQ ID NO: 14558 - DNA, 50 bp, homo sapien
agcaattgttatttttgcctaaatarcagcgtctgattactgaaaaaaaa

SEQ ID NO: 14559 - DNA, 50 bp, homo sapien
gggggctggattacttgaatccaaastgatgtgatgaataacaaggatct

SEQ ID NO: 14560 - DNA, 50 bp, homo sapien
aaaaaattactccttatagtaaacartctacaagcctctgtccacaatta

SEQ ID NO: 14561 - DNA, 50 bp, homo sapien
agcttatcatttaagaatcactcaargtagtctcaaaacacaagtagggt

SEQ ID NO: 14562 - DNA, 50 bp, homo sapien
tataattatgaccgtcatgtaaatakgatagtaattctcaaagaagcgct

SEQ ID NO: 14563 - DNA, 50 bp, homo sapien
ttttgtgtatgagaaaactgcagcaytgataagtcgaatccacccgagtg

SEQ ID NO: 14564 - DNA, 50 bp, homo sapien
tattttatatcactttaagcaaactraacaagtgaatatacaatgccttg

SEQ ID NO: 14565 - DNA, 50 bp, homo sapien
ccctagcaatattaaggctgtagccrcaagtaaaggatatatgaagtgaa

SEQ ID NO: 14566 - DNA, 50 bp, homo sapien
atgtatgcggctccacttgagaccasgtatcaggatgttcagagggagcc

SEQ ID NO: 14567 - DNA, 50 bp, homo sapien
ttccctcaaataattattctctcaartagttgtttacttttacttctctc

SEQ ID NO: 14568 - DNA, 50 bp, homo sapien
atcatctaaacaccacacattcctamatgaactgcatcagctcaacctca

SEQ ID NO: 14569 - DNA, 50 bp, homo sapien
gtacccggcacttccaacctgctcayatcataacttagatagtggttcac

SEQ ID NO: 14570 - DNA, 50 bp, homo sapien
actgccaaggtatcagataaaatgtwaaatagagaaagccttcgagagga

SEQ ID NO: 14571 - DNA, 50 bp, homo sapien
tttccctttagttaatatagtcactkaataatccaaacttattacaaaaa

SEQ ID NO: 14572 - DNA, 50 bp, homo sapien
gacagagttctcaagacacctttacracagtctggagatggttaggtccc

SEQ ID NO: 14573 - DNA, 50 bp, homo sapien
acctccaataaactctaattttgaawtgtaaacaagtataaccactaata

SEQ ID NO: 14574 - DNA, 50 bp, homo sapien
agccctgctgacccaagttcatcaayatccacgctgttaagacaccattc

SEQ ID NO: 14575 - DNA, 50 bp, homo sapien
tttttaagaggtcaagtatatttaastgtttgatcatataacagatttcc

SEQ ID NO: 14576 - DNA, 50 bp, homo sapien
tgatgttgccaaagaatgaagaaaawgatacgtagcacatgccttggtgg

SEQ ID NO: 14577 - DNA, 50 bp, homo sapien
ttggctgttttggagaagttggagasaaataatttcttaagatgaaggta

SEQ ID NO: 14578 - DNA, 50 bp, homo sapien
taactccctagccatatactcttaastaagctgaaggcaagcagggcctt

SEQ ID NO: 14579 - DNA, 50 bp, homo sapien
accaatcccgaggtgcctaaggaacrgcgtgaagtgagcaggggctgcct

SEQ ID NO: 14580 - DNA, 50 bp, homo sapien
aaaagaactttctgcactattaaagraaagctaatacaaaagtaaactga

SEQ ID NO: 14581 - DNA, 50 bp, homo sapien
tagaattccagttattttccaggtayagctcaaatgcctttcctgatgta

SEQ ID NO: 14582 - DNA, 50 bp, homo sapien
ttttctttaaacaataattctaagtyaccataatctttcatttatgcatt

SEQ ID NO: 14583 - DNA, 50 bp, homo sapien
gtttgtaggctaaaaatttgacctgrcagccattggagctgctgtgtcat

SEQ ID NO: 14584 - DNA, 50 bp, homo sapien
tttattttctgtgtgatatgaggagratacatcacctgtagagggggaaa

SEQ ID NO: 14585 - DNA, 50 bp, homo sapien
tagagcaagcataatatacaatgcargagacatttgataaacaatgatct

SEQ ID NO: 14586 - DNA, 50 bp, homo sapien
gctaagtggcatccagacagaacacrgagaagctcctcgattgcgtctct

SEQ ID NO: 14587 - DNA, 50 bp, homo sapien
ggcattcttagtcacaagctgtttayggttaagaaacaaattaataatgt

SEQ ID NO: 14588 - DNA, 50 bp, homo sapien
tggaattttgattgggttgattttaragaaattgaaatgttttcataata

SEQ ID NO: 14589 - DNA, 50 bp, homo sapien
agacagatagccatgcagaatttacrattaaatactaaaccatgtgtacc

SEQ ID NO: 14590 - DNA, 50 bp, homo sapien
ttagaagctcttctggtcatagaacrattatttcaacagttttcctcaaa

SEQ ID NO: 14591 - DNA, 50 bp, homo sapien
atctcaaattactctataccttttcsacagctttcattcaagcttttgtt

SEQ ID NO: 14592 - DNA, 50 bp, homo sapien
ggtatagagtaatttgagatatttayatggtaaaacctgcagcatgtctg

SEQ ID NO: 14593 - DNA, 50 bp, homo sapien
acaactagatcccatgtcagtctcaygtcaaaaatctgacctggtaactg

SEQ ID NO: 14594 - DNA, 50 bp, homo sapien
tatacacaattcaagcaaaacttackaaatacatgaaaagattggaacag

SEQ ID NO: 14595 - DNA, 50 bp, homo sapien
gaagttaatagaaaacttttgagacratggcatactcttagacaacaatg

SEQ ID NO: 14596 - DNA, 50 bp, homo sapien
aaggttctatgtcactgcttatttaygagtttgttattattgtttgaaaa

SEQ ID NO: 14597 - DNA, 50 bp, homo sapien
ggctccaaatgaagcctccaaataartggactgaaaggtaagatggcaca

SEQ ID NO: 14598 - DNA, 50 bp, homo sapien
tttgtgattttgtttgcccaaactcrctgctattaataagtgacggttga

SEQ ID NO: 14599 - DNA, 50 bp, homo sapien
acaacctgctcctccttcttttctckagttttctattaatggcctcatca

SEQ ID NO: 14600 - DNA, 50 bp, homo sapien
ggagagacgtttgacctgcagatgcrgagtggaaattcttggtagttaga

SEQ ID NO: 14601 - DNA, 50 bp, homo sapien
ttcatggagtgatgtgtagactggasagctgattgcaacgtttgcgcttt

SEQ ID NO: 14602 - DNA, 50 bp, homo sapien
agacaaggaggcaacacaactccacrctttgctgtctgtgtggagactga

SEQ ID NO: 14603 - DNA, 50 bp, homo sapien
gtaagattttggagtctagcaaacgwagggtatccacaaaactcacaaag

SEQ ID NO: 14604 - DNA, 50 bp, homo sapien
attgcacactaaataaatgctagtaycagaatttttgtttcagtgattct

SEQ ID NO: 14605 - DNA, 50 bp, homo sapien
aggaaagcctagaatgtgtttgtcaycaagatcaaaaggtgaaagagttt

SEQ ID NO: 14606 - DNA, 50 bp, homo sapien
cacagaagagaattcatttcaacaayctaatagtccagtaccacacacgt

SEQ ID NO: 14607 - DNA, 50 bp, homo sapien
catctcctctcctgattcactacaaytgggactaatcatgcctttcagga

SEQ ID NO: 14608 - DNA, 50 bp, homo sapien
tggtaatgaataaacatatgcaaaargacaatcagttgcaggtgtgttgc

SEQ ID NO: 14609 - DNA, 50 bp, homo sapien
tcatggccttggtttccatctgaatsatccgggcagagtctcacaccaag

SEQ ID NO: 14610 - DNA, 50 bp, homo sapien
tatctgtctcaaatattcttctctamacgagattatttgcctgctttttt

SEQ ID NO: 14611 - DNA, 50 bp, homo sapien
ttgggatataatagttcaaagactaycagagtaattccaagacatgaatt

SEQ ID NO: 14612 - DNA, 50 bp, homo sapien
ttcagattttcttgatgtggtagaargtaggttttcagtaaagactgagg

SEQ ID NO: 14613 - DNA, 50 bp, homo sapien
agggttgttttgaagcaaaaattaasatatttagaacagtgcctgacata

SEQ ID NO: 14614 - DNA, 50 bp, homo sapien
tgtacatatcttgtatccgaatttcrcagtaaataatcattactgttgaa

SEQ ID NO: 14615 - DNA, 50 bp, homo sapien
gtgcctgacatacagtatgtgctatmaacatatcgattattgtaattcaa

SEQ ID NO: 14616 - DNA, 50 bp, homo sapien
tgtcacctcctttggtgtcacaacartaatagtcatcgagagacgttgct

SEQ ID NO: 14617 - DNA, 50 bp, homo sapien
gttcctttcataagacccatcaaacmagtgcaggttgcttcgaaatttaa

SEQ ID NO: 14618 - DNA, 50 bp, homo sapien
tttcttgtactattataccaagaacraggtgacaagcaggagcggatttt

SEQ ID NO: 14619 - DNA, 50 bp, homo sapien
gtggtaatgtgtgacaggagtcctargaaactaatgtattgtggattcaa

SEQ ID NO: 14620 - DNA, 50 bp, homo sapien
ttattttgtccggcttaatgacacartgagagtatttcaagcaaattatg

SEQ ID NO: 14621 - DNA, 50 bp, homo sapien
caactgtctccacactggattttctsaacacacaagccagggaggtcaac

SEQ ID NO: 14622 - DNA, 50 bp, homo sapien
aggatggataatttgagtcatagaamggttaaatagcttgcttgaaacta

SEQ ID NO: 14623 - DNA, 50 bp, homo sapien
ttctcttattgttgctgacaattaarccacatagcatttatataggctgg

SEQ ID NO: 14624 - DNA, 50 bp, homo sapien
cagtgatagaaatgactattacttamgaactagaacgtttgctccaaaag

SEQ ID NO: 14625 - DNA, 50 bp, homo sapien
taaggaaagtaacaataaaaaagaakatgcttcgtatacaagacttttcc

SEQ ID NO: 14626 - DNA, 50 bp, homo sapien
gaaaataccaataagcacattaaacwaaagaggagttaagaggcaataag

SEQ ID NO: 14627 - DNA, 50 bp, homo sapien
tttattttctgcttttattatttaastcctttttcactatagaacttgaa

SEQ ID NO: 14628 - DNA, 50 bp, homo sapien
ggaatagaacacagtgtatcagaaakaagggcagcaagcaatctgaacaa

SEQ ID NO: 14629 - DNA, 50 bp, homo sapien
gccaattgaaatattgtcatttgtawtaataaaacctatatatgattagc

SEQ ID NO: 14630 - DNA, 50 bp, homo sapien
ctgaatgactcccaactttttatcaygaagaactcctttcctttacttct

SEQ ID NO: 14631 - DNA, 50 bp, homo sapien
ccaagaaatgaggctgcggtggtaarcaagagagatacaatgcctgcctt

SEQ ID NO: 14632 - DNA, 50 bp, homo sapien
agtttctggttataaaattgtagatsaggattaatgattattaagcccgg

SEQ ID NO: 14633 - DNA, 50 bp, homo sapien
tcatagttattgtaagttatattccraagtttaactggaaaaatattatt

SEQ ID NO: 14634 - DNA, 50 bp, homo sapien
tttttccaaatggctgagcagatacsatttgaaaacccatcttactttca

SEQ ID NO: 14635 - DNA, 50 bp, homo sapien
gtttcttcttctctccatggcggaasaatgaagtacgtcaataaagcatg

SEQ ID NO: 14636 - DNA, 50 bp, homo sapien
tttcccactttagtgaaatatggcaycacccaggacgatcacttaggatg

SEQ ID NO: 14637 - DNA, 50 bp, homo sapien
tttgctggtataacagttaaaagatsagaatcagtttgcaagaggaacca

SEQ ID NO: 14638 - DNA, 50 bp, homo sapien
gagtaaggggaacagtaatgagagaygaggttagacaggctgacagagcc

SEQ ID NO: 14639 - DNA, 32 bp, homo sapien
tcagaaccagagaaccraatcaatgccttgtt

SEQ ID NO: 14640 - DNA, 50 bp, homo sapien
ccattcagaggctttctgtttctcaygtttctagaacatcctaagcttgt

SEQ ID NO: 14641 - DNA, 50 bp, homo sapien
tccaggcttaagtacccatgttcccraatcttgatgacatcttaacactt

SEQ ID NO: 14642 - DNA, 50 bp, homo sapien
tctaccataaacaagcatgctaacargacagagatgaatcattaaactac

SEQ ID NO: 14643 - DNA, 50 bp, homo sapien
cttattcattgctgtaagtttcaaartacctttattagcactacagctcc

SEQ ID NO: 14644 - DNA, 50 bp, homo sapien
gaagggtaggagtgggtataaaggayggtaagagagaggaggctttatat

SEQ ID NO: 14645 - DNA, 50 bp, homo sapien
ctccagcctcaagaatgaggaagackgatgatacctttggcctgagaaag

SEQ ID NO: 14646 - DNA, 50 bp, homo sapien
cagattcccctacatcggttatacaygaaatgccgaggaccattcgtcac

SEQ ID NO: 14647 - DNA, 50 bp, homo sapien
aagttcattttcctttataattataygttatttgctgtattttgtgtttt

SEQ ID NO: 14648 - DNA, 50 bp, homo sapien
atgggagacagttttttagcacttayaatgagaggcaatgttgtaaggac

SEQ ID NO: 14649 - DNA, 50 bp, homo sapien
tgctactccacaaaatgttcactcayatgtttatgtatcgcgttagtgac

SEQ ID NO: 14650 - DNA, 50 bp, homo sapien
accttgagcatcacacaaattcatcraacacagtaaagtctaacatgcaa

SEQ ID NO: 14651 - DNA, 50 bp, homo sapien
aatcagtaaatgttgaaacttgaaaygctcattcaatttaaaggttcttg

SEQ ID NO: 14652 - DNA, 50 bp, homo sapien
ctttgtgataccaaaactagcatacyctaattgtagaaaatacaaaacat

SEQ ID NO: 14653 - DNA, 50 bp, homo sapien
cctgccatggaaatatgactcctaamgtatgtcaagggaaattggccaaa

SEQ ID NO: 14654 - DNA, 50 bp, homo sapien
agcctcccaaatctgcattttctcakgtgcggaataaagggctgggatct

SEQ ID NO: 14655 - DNA, 50 bp, homo sapien
cttaaatttgcaggctttttattaayggtgatctatttcatttaaagcag

SEQ ID NO: 14656 - DNA, 50 bp, homo sapien
gtatcttaaaattagcctcattgccmaaatataggtactggaggatggag

SEQ ID NO: 14657 - DNA, 50 bp, homo sapien
tacgagttccattaatatagatgaamattacacataggtatccagaaaag

SEQ ID NO: 14658 - DNA, 50 bp, homo sapien
ctctgatattggttctacatgttcasagtaagtccctggtttgggtatat

SEQ ID NO: 14659 - DNA, 50 bp, homo sapien
tgaaaaaaggcacaataattgaaacyggatgaactcctttcatagagtac

SEQ ID NO: 14660 - DNA, 50 bp, homo sapien
taatcatgaacctgtctggtaggctyacaattttttttttcaataaattt

SEQ ID NO: 14661 - DNA, 50 bp, homo sapien
gtggtcctaagggcttaataatcatsaacctgtctggtaggctcacaatt

SEQ ID NO: 14662 - DNA, 50 bp, homo sapien
atctgagctgatcttctaccaccaasttcttatggaaacagactgcatca

SEQ ID NO: 14663 - DNA, 50 bp, homo sapien
atatacaaaatgctatttatcttaawcaaccggaaattatacatgtattt

SEQ ID NO: 14664 - DNA, 50 bp, homo sapien
attcctcttgatttttctagaactayggtaaagtacaccttccccgtact

SEQ ID NO: 14665 - DNA, 50 bp, homo sapien
atctctgattctgttggctaactaargaccatcctaggacagtctcggtt

SEQ ID NO: 14666 - DNA, 50 bp, homo sapien
gtatataccattgaatagtcaagcarcatttaatttaaaccttactcatc

SEQ ID NO: 14667 - DNA, 50 bp, homo sapien
ctgcaaggaactgcaggagacctcayctataaccaccaactgaaagacaa

SEQ ID NO: 14668 - DNA, 50 bp, homo sapien
cctattatgggagtggcaagacaackgctcctgttactatccacgctttc

SEQ ID NO: 14669 - DNA, 50 bp, homo sapien
agtgacctgaaaatgccttgtggaartggacagaagagaaggaggggctg

SEQ ID NO: 14670 - DNA, 50 bp, homo sapien
gcaaagtggtaagactccagctctamagaaataagcaaatagatcaatac

SEQ ID NO: 14671 - DNA, 50 bp, homo sapien
gtcaaaggaagacatgaataagatargaattaaaatagactttcaaatat

SEQ ID NO: 14672 - DNA, 50 bp, homo sapien
gcaactggcaaccggcaaatggcagmatggtgaaagataggaaacaatgg

SEQ ID NO: 14673 - DNA, 50 bp, homo sapien
tggaataatctcctctgggaactaargccacttacaaggaaatatttgaa

SEQ ID NO: 14674 - DNA, 50 bp, homo sapien
tggggtcattggagacattgctgaaraagtacttgtcacatagcagtatc

SEQ ID NO: 14675 - DNA, 50 bp, homo sapien
agactaaagttgaagatacacaaaaktcctagagtagagcacttgggcag

SEQ ID NO: 14676 - DNA, 50 bp, homo sapien
agtgtgacgatagagaatgcatagaygatgaaacagaagaaatatgtgga

SEQ ID NO: 14677 - DNA, 50 bp, homo sapien
ggtgggggggcatttttcacattgaygattaaagccttgtaacatgttaa

SEQ ID NO: 14678 - DNA, 50 bp, homo sapien
tacctttctcctgaagatgaattaayaactgaccaattctctggagctga

SEQ ID NO: 14679 - DNA, 50 bp, homo sapien
tgtattgatattacaggatcactagmagtatagatctagtagcacttaat

SEQ ID NO: 14680 - DNA, 50 bp, homo sapien
ttttttgtgacttttcttgctgtcartaccttatgatgataatctgatta

SEQ ID NO: 14681 - DNA, 50 bp, homo sapien
tcaagtcctcggacaaaaatctcaaygccatggactattcagaaggctcc

SEQ ID NO: 14682 - DNA, 50 bp, homo sapien
tcaaaacgatataactaaaaggacawtctatcatttaataaattggattt

SEQ ID NO: 14683 - DNA, 50 bp, homo sapien
attatggcattagaaattggaagtamgtggaatgttgttgaggctgggag

SEQ ID NO: 14684 - DNA, 50 bp, homo sapien
tatgatcatttgtgcaaagttaatcrctcataccaactgtattggatcag

SEQ ID NO: 14685 - DNA, 50 bp, homo sapien
agattgaaaacggtcctattccatgyactactaagatctgaaaacaaaaa

SEQ ID NO: 14686 - DNA, 50 bp, homo sapien
tctgtacaagtcattcctctatcaaygattatgctttttcttctggagga

SEQ ID NO: 14687 - DNA, 50 bp, homo sapien
ttttaaattatgcttttctattttaygcagcaggtttagatctaaaagta

SEQ ID NO: 14688 - DNA, 50 bp, homo sapien
cataagaattcagttttggtgttaamgatgttttcattctcggtgttccc

SEQ ID NO: 14689 - DNA, 50 bp, homo sapien
gaattactagatattagcaaatctayatgtgatctattagaaagagaatg

SEQ ID NO: 14690 - DNA, 50 bp, homo sapien
ctagcactgagctgaccattttctaygcacaaccttgattagttctcacg

SEQ ID NO: 14691 - DNA, 50 bp, homo sapien
ttacatctactttaacatacagaaastcaggttgtcatctatgggctagg

SEQ ID NO: 14692 - DNA, 50 bp, homo sapien
gcgtctcggctatgttatagctatcrcgaatgaaacctaaaaatcaactg

SEQ ID NO: 14693 - DNA, 50 bp, homo sapien
ttaaaatgcagtatggcctaaaaaaytgagtgagttcccttcaattttcc

SEQ ID NO: 14694 - DNA, 50 bp, homo sapien
tttcatttaggttttcaatctgggaygcacttagcaatagccaacactga

SEQ ID NO: 14695 - DNA, 50 bp, homo sapien
cagaaacagctcaatttatctcagaratgaaggtttcactagcttgggcc

SEQ ID NO: 14696 - DNA, 50 bp, homo sapien
aatataatagagacatatataaaccyatctgaccagcaaacccaggttaa

SEQ ID NO: 14697 - DNA, 50 bp, homo sapien
caatggacctttattattccttttawgtgtccagcattttatttccctga

SEQ ID NO: 14698 - DNA, 50 bp, homo sapien
aattaatcagttcacaaagacttcaycattcctatccaaacttttccttg

SEQ ID NO: 14699 - DNA, 50 bp, homo sapien
cactgtagacaaggaaagcaacctayaaaaacgtgctctaaccagctcaa

SEQ ID NO: 14700 - DNA, 50 bp, homo sapien
catggggctttaataatttgtttgargtgaatttacagagaattggtcat

SEQ ID NO: 14701 - DNA, 50 bp, homo sapien
tccaaattgctgagtgtggacagcaratggattcgtttgtgctggctggg

SEQ ID NO: 14702 - DNA, 50 bp, homo sapien
taaaacaagattttagttgctttcartaacctaaacctgcaagcaaagtt

SEQ ID NO: 14703 - DNA, 50 bp, homo sapien
gtttaaggatgcccatgctttggaayaaaagagaaagtaagagcaaagga

SEQ ID NO: 14704 - DNA, 50 bp, homo sapien
cagaatgaaaatacacaaccaagaawactactgaatatcttaagggtttg

SEQ ID NO: 14705 - DNA, 50 bp, homo sapien
aacatcagaagggccagatctcagaracgggatgccaggatacatttatc

SEQ ID NO: 14706 - DNA, 50 bp, homo sapien
tttatagcctgggtgttaattcttaygatataaaggaccatgaatgaatc

SEQ ID NO: 14707 - DNA, 50 bp, homo sapien
aagaaagaaatcaaatatcctagtasgagcagagaggcgagagctgaaaa

SEQ ID NO: 14708 - DNA, 50 bp, homo sapien
actggccaacagcatcataatcagcrcagtctaattaaacaaatatagac

SEQ ID NO: 14709 - DNA, 50 bp, homo sapien
gtttagaaagggtggagaataatgakataaccaaatatgaaaaataattg

SEQ ID NO: 14710 - DNA, 50 bp, homo sapien
cacagcaagcagggaaactgactccrgcaatggaaatcactggtgttgcc

SEQ ID NO: 14711 - DNA, 50 bp, homo sapien
atcgcgctatacatatttcctgaacygaagggaccattccaagtgtcttc

SEQ ID NO: 14712 - DNA, 50 bp, homo sapien
aaaatttagggactcaaagaccttargaaacctcaccatggcctctgcag

SEQ ID NO: 14713 - DNA, 50 bp, homo sapien
ttattttcactaatctgttaggtaartcagaacaatataaaatttagcag

SEQ ID NO: 14714 - DNA, 50 bp, homo sapien
aaaaggagaaatctttaccttcaaayatatccggacattttactcttctt

SEQ ID NO: 14715 - DNA, 50 bp, homo sapien
cacaacgtgatattaactccagtgarcctaaatagatggaacgagtactc

SEQ ID NO: 14716 - DNA, 50 bp, homo sapien
attgaaagagaaagcataaagtagcraaaatcctttccagattaaaaaac

SEQ ID NO: 14717 - DNA, 50 bp, homo sapien
atgttaaagcatcaaatacagatacyagagaatgtcattatcacagaaac

SEQ ID NO: 14718 - DNA, 50 bp, homo sapien
ttggctagttcctagaggtaaagaaytcacttgcaagtgtgcctttcaaa

SEQ ID NO: 14719 - DNA, 50 bp, homo sapien
tatgtttatgcttaaaatatatgaartaccttagagacacacagagagag

SEQ ID NO: 14720 - DNA, 50 bp, homo sapien
actggtccctgcctttgaacagcaaytccactcgggcgtggtgagatgca

SEQ ID NO: 14721 - DNA, 50 bp, homo sapien
tttctgaggcattaaattatcagccyggcaatctttattttattttgtat

SEQ ID NO: 14722 - DNA, 50 bp, homo sapien
tttaaatcaaattttagctggaagcmcagtagaaaaggcctcagaaggtg

SEQ ID NO: 14723 - DNA, 50 bp, homo sapien
ctcatttatcctacggtactaggcaygaccagtgaccatcaggctgcctg

SEQ ID NO: 14724 - DNA, 50 bp, homo sapien
atcaaaagacgtagagtggctgaagsaataaggaaaacgaaacagaacat

SEQ ID NO: 14725 - DNA, 50 bp, homo sapien
atctgatttgtgagtagctatctgcrctttttctttttgtgtgtgtggga

SEQ ID NO: 14726 - DNA, 50 bp, homo sapien
acctcattttttggatatgttttacyacttatgttatctgattttcctag

SEQ ID NO: 14727 - DNA, 50 bp, homo sapien
gcctactaggagcttatgtacatgaygaactgatagacaaaggcataaaa

SEQ ID NO: 14728 - DNA, 50 bp, homo sapien
ccacagtagcacttccttgccatgcraccttagcaaatggcttaactcgc

SEQ ID NO: 14729 - DNA, 50 bp, homo sapien
ggagggggaggcacatgccaaagccsaggggtgacaagaagctgggcact

SEQ ID NO: 14730 - DNA, 50 bp, homo sapien
ctctgctttgttactttcctttgccyatttaatctacattttatgttttg

SEQ ID NO: 14731 - DNA, 50 bp, homo sapien
gagatgtaaatatttatgtcaaccaygaccataggttgtaggaacaacga

SEQ ID NO: 14732 - DNA, 50 bp, homo sapien
aggtggagaccaactggacatatgcraattcaacagtcaaggcaatttct

SEQ ID NO: 14733 - DNA, 50 bp, homo sapien
cccctttctaatattacttgaattaraaggcttcccaggctggtgagctg

SEQ ID NO: 14734 - DNA, 50 bp, homo sapien
ctcacatttcaccaaagaaatgaacygaggtagagagttaaagtaatttg

SEQ ID NO: 14735 - DNA, 50 bp, homo sapien
tgtaaagatcatgggctttggcattraaaaggacaggtttggaatttcag

SEQ ID NO: 14736 - DNA, 50 bp, homo sapien
gaatcaaagtgacttcttctgttgartaagaatgtctgagggtggagtgt

SEQ ID NO: 14737 - DNA, 50 bp, homo sapien
taaaaaccttttgaattctccttaakctggtaagaaagcaaagaatactc

SEQ ID NO: 14738 - DNA, 50 bp, homo sapien
gcttggggagaggctgagaaatcaasagaccaagggaagacattcactcc

SEQ ID NO: 14739 - DNA, 50 bp, homo sapien
tttcaaggctcatcccaaacctaccraatcaaagtgacttcttctgttga

SEQ ID NO: 14740 - DNA, 50 bp, homo sapien
gttgagctcaaaaccaaatctgaaaytgaagcccagagacaatgcatcac

SEQ ID NO: 14741 - DNA, 50 bp, homo sapien
tttcaaataagcttacagtctgagawaatggagtttaaaacttcaactta

SEQ ID NO: 14742 - DNA, 50 bp, homo sapien
aaaggctacaggctgcctggaagtayaatgcaaaagagagagagggctgt

SEQ ID NO: 14743 - DNA, 50 bp, homo sapien
catttttttcacagtctactctagayataaagccctggtgtcatttttta

SEQ ID NO: 14744 - DNA, 50 bp, homo sapien
ttctacagtgtttcacattttttcartctctattgtagtctcacttggag

SEQ ID NO: 14745 - DNA, 50 bp, homo sapien
gcatacgagaggaggtgaagtcacaygtccaagctgggttgggggaagct

SEQ ID NO: 14746 - DNA, 50 bp, homo sapien
tgggctttgactggagaatcggagaygccttgtgtaggataactgcgcta

SEQ ID NO: 14747 - DNA, 50 bp, homo sapien
cattgaaggataaacaaatagtttasacaaatatgctttcaacccttcat

SEQ ID NO: 14748 - DNA, 50 bp, homo sapien
tacagaggggcccatccactcctaarcgggtctccaggaggcttggtttg

SEQ ID NO: 14749 - DNA, 50 bp, homo sapien
atcacacttcaccctgtcattaatcycttgttattctcaaatctttgtga

SEQ ID NO: 14750 - DNA, 50 bp, homo sapien
aactttgctgaattttttccaccatragatctcttcctggattccggcca

SEQ ID NO: 14751 - DNA, 50 bp, homo sapien
gaatcaacatatctttagaggaaaamatttctggaatatgttagctcaac

SEQ ID NO: 14752 - DNA, 50 bp, homo sapien
ccaaaaaaaaaaaaatactaaacgcraatatgatctaaaacaaggaagag

SEQ ID NO: 14753 - DNA, 50 bp, homo sapien
caaatccagagaagtaacgtgcccartccttaacaatgaaatgtgtaacc

SEQ ID NO: 14754 - DNA, 50 bp, homo sapien
aaatatagctgctgcttgctaaataygatccgagtaaaatgcaaacttac

SEQ ID NO: 14755 - DNA, 50 bp, homo sapien
ccatttccattgtgtatattcaccaygtctccagtatccattcctccatg

SEQ ID NO: 14756 - DNA, 50 bp, homo sapien
taactgtttctaagatttgtgacacygtccatctggaatatgcactaaag

SEQ ID NO: 14757 - DNA, 50 bp, homo sapien
tgagaattttgagtcattctggaacsaagagtttcttctaaagcaactgg

SEQ ID NO: 14758 - DNA, 50 bp, homo sapien
atacagtcttttcaattttccttgcraagacacagcatcagtttggatga

SEQ ID NO: 14759 - DNA, 50 bp, homo sapien
gatacatgggaactggcacatgagamgcacacttttgtaagtagggagat

SEQ ID NO: 14760 - DNA, 50 bp, homo sapien
agattatgatcaagattaatgtcaaytctaggataaccactaaaaaacag

SEQ ID NO: 14761 - DNA, 50 bp, homo sapien
agatatgaaatgcctattgtgaccaytagatataaagatgacaaaaaatt

SEQ ID NO: 14762 - DNA, 50 bp, homo sapien
catatttgcatttaatatattacatragcacatagcatgcataaacacac

SEQ ID NO: 14763 - DNA, 50 bp, homo sapien
ttattactttacacagaaaagagccratgttatgtaaataggagaaatgt

SEQ ID NO: 14764 - DNA, 50 bp, homo sapien
cactttattaaaatttctctaaaacrcaaattttgaatgttataaacaag

SEQ ID NO: 14765 - DNA, 50 bp, homo sapien
aggcaattatgctcaatttcaattcraatttcctttttttttagctttat

SEQ ID NO: 14766 - DNA, 50 bp, homo sapien
atttgcgttttagagaaattttaatwaagtgaagacaagctacattttga

SEQ ID NO: 14767 - DNA, 50 bp, homo sapien
ccaattcagggttcttcctttccatragaatgcaagtgaattacaatggg

SEQ ID NO: 14768 - DNA, 50 bp, homo sapien
aagctagtcccaaatgactagcccartggattctcaaaactttctttata

SEQ ID NO: 14769 - DNA, 50 bp, homo sapien
actgagattttgatctttgaaagtgraagatgatagactccaatggggag

SEQ ID NO: 14770 - DNA, 50 bp, homo sapien
aatgtaaaggctagtcttcatcttgsatatgttcattttagtctgatttc

SEQ ID NO: 14771 - DNA, 50 bp, homo sapien
gtgtaaactctcttaaacttaggaamaaggctaaagacatttatcacttg

SEQ ID NO: 14772 - DNA, 50 bp, homo sapien
tgtctatgtaatttagttgcaaaacsatgtagacttgagagattgctaaa

SEQ ID NO: 14773 - DNA, 50 bp, homo sapien
tttacctgctgtcagccaagaaatarctaggaaagctgattttccaaaag

SEQ ID NO: 14774 - DNA, 50 bp, homo sapien
ctaaattacatagacacaactaataygaaaagtgtttagggtcaaaaatg

SEQ ID NO: 14775 - DNA, 50 bp, homo sapien
caattacactggttggagttagccaygaattaatgagtgtagttgtaggg

SEQ ID NO: 14776 - DNA, 50 bp, homo sapien
atccctgatggatgcgacggaaagayatttcagagaacaggctgtgtaat

SEQ ID NO: 14777 - DNA, 50 bp, homo sapien
cacatatttagaatctaaattacaartactccttagaattactaaaaata

SEQ ID NO: 14778 - DNA, 50 bp, homo sapien
gaatatagatttaatttcacttttaygataacagttttgtaaatatttgg

SEQ ID NO: 14779 - DNA, 50 bp, homo sapien
tccaggcaaaagaactaagttgtatraccatatagaaacaaggaaaagaa

SEQ ID NO: 14780 - DNA, 50 bp, homo sapien
cccagcaaaggcaaagtagaaataayatgcagaagaagagatcagatcat

SEQ ID NO: 14781 - DNA, 50 bp, homo sapien
ttgatgctaactgagtatggacaccrcaaatgtttttttattccggaata

SEQ ID NO: 14782 - DNA, 50 bp, homo sapien
tagatctaagcttgctgtatttttgyaacaagaacttaaaagaagaacaa

SEQ ID NO: 14783 - DNA, 50 bp, homo sapien
aacccctcttattttcttaagaatcyattaggatgaggttcacctttgaa

SEQ ID NO: 14784 - DNA, 50 bp, homo sapien
atgctgttattctggacaaagaataygtcaggtgaagaagaaactataca

SEQ ID NO: 14785 - DNA, 50 bp, homo sapien
atagtctactttagtcttcctatgayactctgtgatatgtaccattttta

SEQ ID NO: 14786 - DNA, 50 bp, homo sapien
tgccaggaacaattaaagattggaargtagactatttttagtgacctatc

SEQ ID NO: 14787 - DNA, 50 bp, homo sapien
gatcaaaatctcagttcatttactcmaagaaagctaattaaattgtactc

SEQ ID NO: 14788 - DNA, 50 bp, homo sapien
ttccttctttcctctcatcgagaaayaaataagttttgtggaacaggggt

SEQ ID NO: 14789 - DNA, 50 bp, homo sapien
tatgcactggacattaaaatctctaytactgtttcaataataaactacta

SEQ ID NO: 14790 - DNA, 50 bp, homo sapien
actctggagaagctgatatgcctaaygacgtatgacatgacatggggata

SEQ ID NO: 14791 - DNA, 50 bp, homo sapien
atactaaaacacagataataactagwagacatttaagaaaagcctgtgtc

SEQ ID NO: 14792 - DNA, 50 bp, homo sapien
ctggggcaagcaatttaaactctccraacttcaatttccgtagtcataaa

SEQ ID NO: 14793 - DNA, 50 bp, homo sapien
cctcttgtaaaggaggcaaaacatasaggtcgttttctcttcgaacttgg

SEQ ID NO: 14794 - DNA, 50 bp, homo sapien
aaaaagtgtacatgacgcaacacgayagcttttttttctcattagcaaag

SEQ ID NO: 14795 - DNA, 50 bp, homo sapien
gtctcactatcagaaggattcaatayggacattctttgtatttaatctag

SEQ ID NO: 14796 - DNA, 50 bp, homo sapien
gctatcatctgtatgttttatcagawagttctagaaatgagcagttttga

SEQ ID NO: 14797 - DNA, 50 bp, homo sapien
ggtcagtggtgcattttaggatttcrcattaacccaacaccctggggctt

SEQ ID NO: 14798 - DNA, 50 bp, homo sapien
gcctagtttcactactcataaaaaarttcataacaacattgcattacgat

SEQ ID NO: 14799 - DNA, 50 bp, homo sapien
attatcctttttagaaaataagatamcttcattaaggagagtagttcttc

SEQ ID NO: 14800 - DNA, 50 bp, homo sapien
cgtcataagaaacatacttaagaaartggaatctactataaggatgttat

SEQ ID NO: 14801 - DNA, 50 bp, homo sapien
aagctatgctgagctaggtactgaakagtttctcacaaacaagaagatat

SEQ ID NO: 14802 - DNA, 50 bp, homo sapien
ttttgtttcctgaagtaccttattcycatactgttgtgacctctttctaa

SEQ ID NO: 14803 - DNA, 50 bp, homo sapien
ctgctaccatttgctcttgaagccaygaaattggtcagagcagcacatta

SEQ ID NO: 14804 - DNA, 50 bp, homo sapien
cttagcacatatccttttctctaacrcttgcaaaatctttcaaatctagc

SEQ ID NO: 14805 - DNA, 50 bp, homo sapien
aaaacaaaagaatagttaaataaatraatcgcctatttccatgatttgaa

SEQ ID NO: 14806 - DNA, 50 bp, homo sapien
ccaaggttgaagatttaccctctagyctaatttctgccccaaagtatgcc

SEQ ID NO: 14807 - DNA, 50 bp, homo sapien
aaggccaatgtaaagttatgttgtawctacctcatagttttgcagaggca

SEQ ID NO: 14808 - DNA, 50 bp, homo sapien
gacaaatttctccaggaaggctaacmaaatcgtgaaaaggtgcttttttt

SEQ ID NO: 14809 - DNA, 50 bp, homo sapien
atttttcatttgctctgtaattatcygaacctttgcaaacactgtgattt

SEQ ID NO: 14810 - DNA, 50 bp, homo sapien
aagctttagccaaatcattcatttartaaacatatattgagcttccctaa

SEQ ID NO: 14811 - DNA, 50 bp, homo sapien
ttactgcctagcttcaattaattcaytctcaaggatctaaataaaaataa

SEQ ID NO: 14812 - DNA, 50 bp, homo sapien
attggttatgtctgctttatagtaawgttattgttgattgatttgccttt

SEQ ID NO: 14813 - DNA, 50 bp, homo sapien
aaatgtccctttgaacagggtctctyagaacaaatagaagaaaagaccaa

SEQ ID NO: 14814 - DNA, 50 bp, homo sapien
gtatctcacctccgggggtccatcasaaggccgatttccttaggtaagta

SEQ ID NO: 14815 - DNA, 50 bp, homo sapien
atgtcatttcagatgatagagtcatragttggttactgaaataaatatac

SEQ ID NO: 14816 - DNA, 50 bp, homo sapien
agccctgaggtacctgttaaactcaygtccacaaaactgaggaatcaccc

SEQ ID NO: 14817 - DNA, 50 bp, homo sapien
acgcatgtgacaacacagtcaatagyattaggttggtacaaaagtaattg

SEQ ID NO: 14818 - DNA, 50 bp, homo sapien
accacctgccaaggcatacaatccgsacaaagtaaaccatcataatttca

SEQ ID NO: 14819 - DNA, 50 bp, homo sapien
ggatagttattgtgtaggcaaatgaygtgttagatgcagtattaaagtta

SEQ ID NO: 14820 - DNA, 32 bp, homo sapien
cgtcacggcaacgacayggtgtaaagtattcc

SEQ ID NO: 14821 - DNA, 50 bp, homo sapien
attgaacaagatcaagatttgaataygttagcccttttgacaatctgaag

SEQ ID NO: 14822 - DNA, 50 bp, homo sapien
agataaggaaagtctaaagctcgaaygaagcaataatatttgctaaaaat

SEQ ID NO: 14823 - DNA, 50 bp, homo sapien
aagaacagtcctagcaactagagaaycatgtttcataagtctgctatccc

SEQ ID NO: 14824 - DNA, 50 bp, homo sapien
gtgctatcattggagtgatacaggawaatctttaattgtgtgtgccattt

SEQ ID NO: 14825 - DNA, 50 bp, homo sapien
ttgaatccaataaccttgtcaatggraattgtgaatgctaagggctgagc

SEQ ID NO: 14826 - DNA, 50 bp, homo sapien
tcatcacatcttaaccgacctgagcrcataaacataacgtcctcatgtct

SEQ ID NO: 14827 - DNA, 50 bp, homo sapien
catgtgaaaacacgatgttcagaaayggtcacaatagaagccatgcagag

SEQ ID NO: 14828 - DNA, 50 bp, homo sapien
attaaagttgctttcactcaaagackgtaagatataaagaaaagttattt

SEQ ID NO: 14829 - DNA, 50 bp, homo sapien
aaatgtttagctttcttctaagagaytcaactgctatatctaatgtaaaa

SEQ ID NO: 14830 - DNA, 50 bp, homo sapien
gtattaaatgaattaaatgagggagratgttaattactataaagttcttg

SEQ ID NO: 14831 - DNA, 50 bp, homo sapien
ttcaatgtaaccacacatttctccayggtcttccgcaatgccatggtctc

SEQ ID NO: 14832 - DNA, 50 bp, homo sapien
attggtcctgcacactggcaatagaratggtgggaaagctatggtgtttg

SEQ ID NO: 14833 - DNA, 50 bp, homo sapien
gtgcacgtgtgtgcagtcaaatacaygttgagtaaaggtaaagtctagct

SEQ ID NO: 14834 - DNA, 50 bp, homo sapien
ctcatttcatctttgcaacccaactragtagatactattatcactttaaa

SEQ ID NO: 14835 - DNA, 50 bp, homo sapien
aataaaatccttgtgagtgaaaacaraattggaaagctcatatttattaa

SEQ ID NO: 14836 - DNA, 50 bp, homo sapien
cacacactcaagtttaagaccaaaartggtgtcaatcaggatgactgcag

SEQ ID NO: 14837 - DNA, 50 bp, homo sapien
aaagttattaagtattttaagagacratgaaaataaaatgctccagtagt

SEQ ID NO: 14838 - DNA, 50 bp, homo sapien
gcacaagggtaggctccacggggtayatccaaggcagaaatccaagtgag

SEQ ID NO: 14839 - DNA, 50 bp, homo sapien
aaacgtgtcctaactatgacacagargcaacttagttttctctttttctc

SEQ ID NO: 14840 - DNA, 50 bp, homo sapien
gaaattggaaatcgtgatatattctsaaagggaaacaagaaaggccccac

SEQ ID NO: 14841 - DNA, 50 bp, homo sapien
atgcatttctttagggcccacagackcatggacctaacttaaatctgttt

SEQ ID NO: 14842 - DNA, 50 bp, homo sapien
catgctttttccttttataataaagkccgaatcattatgaatatatgtgt

SEQ ID NO: 14843 - DNA, 50 bp, homo sapien
aaatagattctgattgttttattaamtacttgctcttaggaaagaaaatt

SEQ ID NO: 14844 - DNA, 50 bp, homo sapien
tccactgccaccacctcttgtctcayggatcacaaatctggagctcaaat

SEQ ID NO: 14845 - DNA, 50 bp, homo sapien
ttctaactgaatttttattagtgcawaatatttgtatatatttatggggt

SEQ ID NO: 14846 - DNA, 50 bp, homo sapien
agtacatgcctgttacttttctcgaygctttcacttgtccctcatttcat

SEQ ID NO: 14847 - DNA, 50 bp, homo sapien
atggtcttgggtgataactttaaagrcctatgatgaaatcaaatttttgt

SEQ ID NO: 14848 - DNA, 50 bp, homo sapien
tgaattgtatgtgtcaaccttgcacrcagattttaacatctatcttgctt

SEQ ID NO: 14849 - DNA, 50 bp, homo sapien
agaagtatagtcacttccatttaacwcgaggactcttagctagggtagtc

SEQ ID NO: 14850 - DNA, 50 bp, homo sapien
ttcatatgacattcttcacaatttaygcttctacggttattttaatttga

SEQ ID NO: 14851 - DNA, 50 bp, homo sapien
ctagcggggttagagctggcagaaayggatctaataaaatgtatcaacaa

SEQ ID NO: 14852 - DNA, 50 bp, homo sapien
aggaaggatcaagtagtataaacaaycattaaattcagctgctacacttt

SEQ ID NO: 14853 - DNA, 50 bp, homo sapien
gcataagaatctatagcataaaagamaatgatgtgaattaacactgcagc

SEQ ID NO: 14854 - DNA, 50 bp, homo sapien
aacaacgtctacctcatagtgttaaragttaatgcactgatgttctcact

SEQ ID NO: 14855 - DNA, 50 bp, homo sapien
gggggagtactttgcttcctgattayggggagtgatgtgaagccacgaac

SEQ ID NO: 14856 - DNA, 50 bp, homo sapien
ctctggttttttcaggtggaactacrcttatttctcaaaattatgtgttt

SEQ ID NO: 14857 - DNA, 50 bp, homo sapien
tccctgattaagcaattcctcctagkattcgttcttatggaaacttgtct

SEQ ID NO: 14858 - DNA, 50 bp, homo sapien
gatttatggattcagcactaataaastgtggattggaagtttaactgaaa

SEQ ID NO: 14859 - DNA, 50 bp, homo sapien
aaggattaaactagcaatgtctttaygactctatgacctagcaataagct

SEQ ID NO: 14860 - DNA, 50 bp, homo sapien
tatgcctgttttcagatgtagaaacsatagagagattaaacaacttgtag

SEQ ID NO: 14861 - DNA, 50 bp, homo sapien
tagtccaagatcataatgaggatgarattgaaatagtctgttgatctcat

SEQ ID NO: 14862 - DNA, 50 bp, homo sapien
actgtagtctttaagtgtttttaccsgatcaaggcatagaaatatcataa

SEQ ID NO: 14863 - DNA, 50 bp, homo sapien
ctcttaataataatacctgtctagaraaaagtattaaaaactagcatact

SEQ ID NO: 14864 - DNA, 50 bp, homo sapien
ggtgaagtgggtgcatctaattaacrgcataagcaacacttcttggaaaa

SEQ ID NO: 14865 - DNA, 50 bp, homo sapien
ctcataatttcagtagtcatcaagamgtaatttatattataaaataatgg

SEQ ID NO: 14866 - DNA, 50 bp, homo sapien
ccatccctaaaatgccgaataaatgwcatactatcttgaaacagtttgct

SEQ ID NO: 14867 - DNA, 50 bp, homo sapien
ggagattttgaaagtatgctctgtayggaaaacggaggaataattaaatc

SEQ ID NO: 14868 - DNA, 50 bp, homo sapien
acagtgtgagatgaataaaggcaacrataaggtgttaggaaattatgaaa

SEQ ID NO: 14869 - DNA, 50 bp, homo sapien
gtggaactggaatttcattctcctayggacttgctctgaacaacagttaa

SEQ ID NO: 14870 - DNA, 50 bp, homo sapien
tgcatttccaaatctcccaatccaarttagcctttattctaatagagata

SEQ ID NO: 14871 - DNA, 50 bp, homo sapien
gagtcctctctttgaattgaactgaracacagaggagtttattgacttcc

SEQ ID NO: 14872 - DNA, 50 bp, homo sapien
ttcatatttcctgaaatgttacactyaatctttcaaataattgttacaca

SEQ ID NO: 14873 - DNA, 50 bp, homo sapien
atttgtgtgttctgaaaagaaggtasataaaatataaaaactagcctacc

SEQ ID NO: 14874 - DNA, 50 bp, homo sapien
gaaacggcctggaaaacagattatartaggcataatgcactcccaacaaa

SEQ ID NO: 14875 - DNA, 50 bp, homo sapien
tcatgagaaatctagtttacaaatayagccgtggagtcctttaagataat

SEQ ID NO: 14876 - DNA, 50 bp, homo sapien
gagaaattattatgggaactataaargcactcatagccacttgtaaattg

SEQ ID NO: 14877 - DNA, 50 bp, homo sapien
gagatttgtttgatttgaggcaagasaattcatctataatgtcaaaatca

SEQ ID NO: 14878 - DNA, 50 bp, homo sapien
gaggaaggagtggcagtcaaccgacycttgaacattctcaatacatgcct

SEQ ID NO: 14879 - DNA, 50 bp, homo sapien
taagaaggtattatttaacttctggrcattcatatttaagtataggaaaa

SEQ ID NO: 14880 - DNA, 50 bp, homo sapien
ggtgacacaggagtccagactaaaawgtatgagtatgagttcaggaaagg

SEQ ID NO: 14881 - DNA, 50 bp, homo sapien
taagtacattcacattgtattaccaygatccatttccagaacttctttat

SEQ ID NO: 14882 - DNA, 50 bp, homo sapien
gtcaaatagccagagctgtcttataygtacccaatactattttatgaatg

SEQ ID NO: 14883 - DNA, 50 bp, homo sapien
gctaactggtactgtcctttccttcmaaatgccatgacatctctaacttt

SEQ ID NO: 14884 - DNA, 50 bp, homo sapien
ttgggttgaatatgtgagaatagaargtaaaagtggagaatatcttttta

SEQ ID NO: 14885 - DNA, 50 bp, homo sapien
atgcatgtgtgctccaaaggaaagasgtatgattagtgacgagggcatgt

SEQ ID NO: 14886 - DNA, 50 bp, homo sapien
tcttctgcatagctcctattgggttraaatgctaattatgacattttcac

SEQ ID NO: 14887 - DNA, 50 bp, homo sapien
ctaagttgctgacaccattatatgcratcaaaacagacaaggtgaaatag

SEQ ID NO: 14888 - DNA, 50 bp, homo sapien
atccaatgtgcggtgtttgttcaaakagccatagaccctcagtatcagaa

SEQ ID NO: 14889 - DNA, 50 bp, homo sapien
cagacttgaaggtcaagtacactaayaaagcatgttacaaaccaggaacg

SEQ ID NO: 14890 - DNA, 50 bp, homo sapien
atgactcatagttaatttctagcacygaatgattggttggtatttactta

SEQ ID NO: 14891 - DNA, 50 bp, homo sapien
tgtaggtgagcatagagctgtttaargtttatcctagaaaatgttgttga

SEQ ID NO: 14892 - DNA, 50 bp, homo sapien
tggacacattgtttaacctctctgcrcatgattttctcgccagtggagcg

SEQ ID NO: 14893 - DNA, 50 bp, homo sapien
tcctgaaaaggtaataatttgagtartacatggaaggcatgtgaatatat

SEQ ID NO: 14894 - DNA, 50 bp, homo sapien
tggatgtagaaaatgattttccatayatgaatgtcattactagccatgtg

SEQ ID NO: 14895 - DNA, 50 bp, homo sapien
gtgatgacaaaaaatttagtccttcrcaacactagtcttctgacaagggc

SEQ ID NO: 14896 - DNA, 50 bp, homo sapien
ttgtaagcttaccaaaagtcagttakatttgttcccagaactgttgatgc

SEQ ID NO: 14897 - DNA, 50 bp, homo sapien
caaatagataacaaagtgctgcaaaktgtgccaacattatagctttgctt

SEQ ID NO: 14898 - DNA, 50 bp, homo sapien
catcttatcaaagacctatgtatcayggacctgctctgtcacgcactgca

SEQ ID NO: 14899 - DNA, 50 bp, homo sapien
tgcaaaaatactaatgtcagcaatawctgtaaaagagaaaaaatggaaac

SEQ ID NO: 14900 - DNA, 50 bp, homo sapien
gagcaatggtagggagaactttcccraaggttggataatccatttccaag

SEQ ID NO: 14901 - DNA, 50 bp, homo sapien
attacactgctatatcaattcctaartcttcaagcaattaaccaaattat

SEQ ID NO: 14902 - DNA, 50 bp, homo sapien
tcaaataaaagtgcatttctaaatgraactgattagactaggttctttgt

SEQ ID NO: 14903 - DNA, 50 bp, homo sapien
accgaaagggacatgttattccacasagtgaagggtctgtgagagaccga

SEQ ID NO: 14904 - DNA, 50 bp, homo sapien
tgatgatttgcaaatatagtcaaatraaagtgcatttctaaatggaactg

SEQ ID NO: 14905 - DNA, 50 bp, homo sapien
aacagaatttgaggaattacctctgmattacatggcacttgatgctgtaa

SEQ ID NO: 14906 - DNA, 50 bp, homo sapien
aggattagtagtgtacttgataagaragacaaaattctgagatagcttct

SEQ ID NO: 14907 - DNA, 50 bp, homo sapien
gaaaatattgtagaaatcagtcttayggtctcagttgggaagggaagact

SEQ ID NO: 14908 - DNA, 50 bp, homo sapien
acccatcattttatttctatgactcraggtttgcaaatatcatctttaac

SEQ ID NO: 14909 - DNA, 50 bp, homo sapien
gaactgggtttggagttaattttacyctgtacttatgacttaaaaccgga

SEQ ID NO: 14910 - DNA, 50 bp, homo sapien
gatgttagacagcttcaactccatamgtttgtgaaatacatggatgtaac

SEQ ID NO: 14911 - DNA, 50 bp, homo sapien
tgcaatcactgcctgggtgtcttcawtaagatgctgtgctgtgatgtggg

SEQ ID NO: 14912 - DNA, 50 bp, homo sapien
ctcaaaactctctgctttagtttaayctctgctacagctgggtgttccat

SEQ ID NO: 14913 - DNA, 50 bp, homo sapien
ttttgttgtatggcagtgacacctasattattatttcttaatataattcc

SEQ ID NO: 14914 - DNA, 50 bp, homo sapien
tgtacttcattcacgggtagttaaartcagctttcaaacacagctagagc

SEQ ID NO: 14915 - DNA, 50 bp, homo sapien
tgaattttaatatgaaacacagtggwatagatcccagatgttctgaaagt

SEQ ID NO: 14916 - DNA, 50 bp, homo sapien
acaagaaggcatcagcccttagggaycatagaatgtaaacaaatggactg

SEQ ID NO: 14917 - DNA, 50 bp, homo sapien
tgcacttcaattttcacaaatcctaygatgagagtcctgttattccattt

SEQ ID NO: 14918 - DNA, 50 bp, homo sapien
ctttgcacacaacgacaaatcttacraaacaagtagagcacggaaacata

SEQ ID NO: 14919 - DNA, 50 bp, homo sapien
gctgataattaaatacagatttataygcctcaatttaaaatgctctgggc

SEQ ID NO: 14920 - DNA, 50 bp, homo sapien
aggtatagttcagaccaaatagttargttgcatagtaaagcattatttta

SEQ ID NO: 14921 - DNA, 50 bp, homo sapien
tcaaagagaaatataggttctacaaragtccttatgtgaaaacgtagacc

SEQ ID NO: 14922 - DNA, 50 bp, homo sapien
tagatttctcaacataaatatgttaycaagtagaattccataattagcaa

SEQ ID NO: 14923 - DNA, 50 bp, homo sapien
agcttgattaacaaacgttttattcycattgatcagtgaagacaagcagt

SEQ ID NO: 14924 - DNA, 50 bp, homo sapien
atttactgaggaaggtctagatttcyaatatttcttgaattgtgtgtgtg

SEQ ID NO: 14925 - DNA, 50 bp, homo sapien
tagatattaacaggtcaaacaaatakggctatcccagttaattagtttaa

SEQ ID NO: 14926 - DNA, 50 bp, homo sapien
gacggactcaggcttgtcaagaaaawcatgaaagaaaataggaaagggtt

SEQ ID NO: 14927 - DNA, 50 bp, homo sapien
cagtgggccagatttgaccctctacrcatagttcatggacccctgtttta

SEQ ID NO: 14928 - DNA, 50 bp, homo sapien
aagacttaaaatggatagtatgtacraagggaagatcaaaaacctaagaa

SEQ ID NO: 14929 - DNA, 50 bp, homo sapien
aaagaatatattgtcttgattatagwaagaaacctcttcctttaaaaaaa

SEQ ID NO: 14930 - DNA, 50 bp, homo sapien
tgcattattaaaaggcatctcattaygatggaaattatgaccttgtcacc

SEQ ID NO: 14931 - DNA, 50 bp, homo sapien
cttaagtaagtcacttggtggctacratatgaatggtgttctctagaatt

SEQ ID NO: 14932 - DNA, 50 bp, homo sapien
ctctgtccaaacacactttgtatggkatatgacatatgaaaacacacaat

SEQ ID NO: 14933 - DNA, 50 bp, homo sapien
tagtcctaagaaaataatgattaccrcaagtcccggaaatctcacacgat

SEQ ID NO: 14934 - DNA, 50 bp, homo sapien
aggataaataaatggctctataagayaactttgaaatattcaatgtaact

SEQ ID NO: 14935 - DNA, 50 bp, homo sapien
agtgaataaaatgttgctcagagaasttaaataacctgcatatggccata

SEQ ID NO: 14936 - DNA, 50 bp, homo sapien
aagtaataactgcattccttttacaytatagaaggtgcttacctaaaata

SEQ ID NO: 14937 - DNA, 50 bp, homo sapien
atagaggagacatagactgtaacctmaaagatgtccagaaagattaagct

SEQ ID NO: 14938 - DNA, 50 bp, homo sapien
tgcctcaaccagcatttactcaaacragaggagatttacggcttgctata

SEQ ID NO: 14939 - DNA, 50 bp, homo sapien
gcacagagaaagaataggctttcaaratagaaatgtaatgcaaattaagt

SEQ ID NO: 14940 - DNA, 50 bp, homo sapien
tactagcacctattttctatgacatkacttaatttgcattacatttctat

SEQ ID NO: 14941 - DNA, 50 bp, homo sapien
gagtgatggcaaaatgggtgaaaackcaggtagccaatgactctccctga

SEQ ID NO: 14942 - DNA, 50 bp, homo sapien
tacacacatacacacatgactatatraaataacatacaaatctgaatgtg

SEQ ID NO: 14943 - DNA, 50 bp, homo sapien
ctccattattacccactgtatcaaaytccttctctattacatttaaccaa

SEQ ID NO: 14944 - DNA, 50 bp, homo sapien
cacgagttttgtatttgatcttaccrggatttgatgtaagaagacttggg

SEQ ID NO: 14945 - DNA, 50 bp, homo sapien
ttgttttacagcagtagttctgccawtcgtaagtgaaatgtggtctgttc

SEQ ID NO: 14946 - DNA, 50 bp, homo sapien
aatacttatatatctaaactatgaayacagaagtacagtgttatgggaaa

SEQ ID NO: 14947 - DNA, 50 bp, homo sapien
tttcagagttttctaattaaccccartgaaatttcaaacacagttttttc

SEQ ID NO: 14948 - DNA, 50 bp, homo sapien
aggaaacttgataaattcttattcayccatagtttatcactttagaaatt

SEQ ID NO: 14949 - DNA, 50 bp, homo sapien
acctgtagaaaatccggcaaatctcraacatttcaagaaactatatgaac

SEQ ID NO: 14950 - DNA, 50 bp, homo sapien
aagacatattagtgaatgttacaaargccctaaggagataatactctttc

SEQ ID NO: 14951 - DNA, 50 bp, homo sapien
atggtaatttctatagcaagagtaasaggtgtttggtgtagatttagtgt

SEQ ID NO: 14952 - DNA, 50 bp, homo sapien
ggtgtagatttagtgtcagcaataayacaaatctctcccatagcactcac

SEQ ID NO: 14953 - DNA, 50 bp, homo sapien
ttgatgtcatcgttttctagcctgcratagagatatataataatgataga

SEQ ID NO: 14954 - DNA, 50 bp, homo sapien
gcctagatcgatgtggaaaagatccrattgcaaattaattagtgaaggca

SEQ ID NO: 14955 - DNA, 50 bp, homo sapien
aaaatgactaattacttcacagatakaatcatgagcagtactgactttac

SEQ ID NO: 14956 - DNA, 50 bp, homo sapien
atatgatggtgagtcatttcactacrctgacttttagctttctaatctgt

SEQ ID NO: 14957 - DNA, 50 bp, homo sapien
tctaatctgtacagttataatctgtraagttttctaatctgtaaagctat

SEQ ID NO: 14958 - DNA, 50 bp, homo sapien
catatttgtatattccttttgcatayggttatagctttacagattagaaa

SEQ ID NO: 14959 - DNA, 50 bp, homo sapien
aattgtttaaataaggacctcaggcraggattgtagcccaaatcctatat

SEQ ID NO: 14960 - DNA, 50 bp, homo sapien
tagttactaaaatttgctagctaaamattggccagtttcaacctgcttaa

SEQ ID NO: 14961 - DNA, 50 bp, homo sapien
ttaacctttcttaatgtagtgaaacrcaactatcaaatcttaacaagaaa

SEQ ID NO: 14962 - DNA, 50 bp, homo sapien
ccacatcccaagtctttctgaaagargtttagagtcttgataagattatt

SEQ ID NO: 14963 - DNA, 50 bp, homo sapien
tggttgagcttgaaatggattttagraaatgtggtccttactttgtagtt

SEQ ID NO: 14964 - DNA, 50 bp, homo sapien
aggtagtagacataaaaataatttarccaataaatctgaaactttcaaat

SEQ ID NO: 14965 - DNA, 50 bp, homo sapien
cggttgttctaccctaataccagaamcaggaaggctaactaagcctttaa

SEQ ID NO: 14966 - DNA, 50 bp, homo sapien
gacttgcctcatctctgagaagaagraagtgaggtcatttgctgaaaaga

SEQ ID NO: 14967 - DNA, 50 bp, homo sapien
aatgaaattgaaacaagaaaacaacsataacaacaaccataaaactggag

SEQ ID NO: 14968 - DNA, 50 bp, homo sapien
taaatatatttaagtaaccattatcraaagtcaagaatattacttgcttt

SEQ ID NO: 14969 - DNA, 50 bp, homo sapien
taaaaatgagtttaaatgcttgaackcagccattatgcacaaggtatcaa

SEQ ID NO: 14970 - DNA, 50 bp, homo sapien
taattctatataaaatttagccctayataatcaagttcattacaagaaaa

SEQ ID NO: 14971 - DNA, 50 bp, homo sapien
aactggaactcctggtgcctaagacmaaaggatattagtgtaaagaaagt

SEQ ID NO: 14972 - DNA, 50 bp, homo sapien
ttcctatgcctgtcaattttctagayactatatgtactttttagaggaag

SEQ ID NO: 14973 - DNA, 50 bp, homo sapien
atgaaatagtctcttttaatttgctwagatttatggacatgatattatgt

SEQ ID NO: 14974 - DNA, 50 bp, homo sapien
tggctgatttttgagaagatactgcraggtgaaatggtggaaatgagctc

SEQ ID NO: 14975 - DNA, 50 bp, homo sapien
gtctaaaatatacactttaacattaycttgctagtattggtacctcaaaa

SEQ ID NO: 14976 - DNA, 50 bp, homo sapien
agaatggaagaattacaacataatcmgatagagggaacttggggactcag

SEQ ID NO: 14977 - DNA, 50 bp, homo sapien
agaataatggcactcaatattaatamaaatttctgtttagcttttagtgt

SEQ ID NO: 14978 - DNA, 50 bp, homo sapien
ctattaagtttctgtcaagtataccraagactacatagtcttatgaccac

SEQ ID NO: 14979 - DNA, 50 bp, homo sapien
ggtatatttactaagaaataatgaamaagaaccacgtaggaatatccaag

SEQ ID NO: 14980 - DNA, 50 bp, homo sapien
gtgcaaggaccctggaaaaagatagrataagtaaatacgtatgaaatttt

SEQ ID NO: 14981 - DNA, 50 bp, homo sapien
gagacagagcaatagggtcataacakagagaaagaacatcaaggtcagaa

SEQ ID NO: 14982 - DNA, 50 bp, homo sapien
aaagtttggaaaaaatgtgattcaasagcaggttggtccctctgaagggg

SEQ ID NO: 14983 - DNA, 50 bp, homo sapien
agaaacaagctattcacagtgtgggmaaaacactcctagagaaagtaaag

SEQ ID NO: 14984 - DNA, 50 bp, homo sapien
ttacatacagctgcactggacacaasttactctcatgtaaccacaaaaca

SEQ ID NO: 14985 - DNA, 50 bp, homo sapien
atgtgaataatatgtctgagggagamtatcttgacaatttttgtctacat

SEQ ID NO: 14986 - DNA, 50 bp, homo sapien
ataaatcaattgtttaacagtggtargttcaccatgtgttctgagtactt

SEQ ID NO: 14987 - DNA, 50 bp, homo sapien
tccaggtgcaccaagtgaaggtccaygtaagcctcttgaaacaggagaaa

SEQ ID NO: 14988 - DNA, 50 bp, homo sapien
ggctgattttaagaataattagaaaygagcatatggcagaaggcaaggaa

SEQ ID NO: 14989 - DNA, 50 bp, homo sapien
atccctcaaggtggtttgctctgacmattttgaggagggctgattttaag

SEQ ID NO: 14990 - DNA, 50 bp, homo sapien
gtgttgacattttggtttataatcaygtccaagtcctgagtgcttctctg

SEQ ID NO: 14991 - DNA, 50 bp, homo sapien
taagaaattttccaaaaaaaattagycaatccttgccataaaaattatct

SEQ ID NO: 14992 - DNA, 50 bp, homo sapien
agcttttacactgttttccaaataartgctgggaagttccctgcatccct

SEQ ID NO: 14993 - DNA, 50 bp, homo sapien
acttgaagcttgagtcaaaacttcayagtatgtttcaatgtttttgaagt

SEQ ID NO: 14994 - DNA, 50 bp, homo sapien
caataagttatgtcaattgtcaaagyacatgtctgaattatagatgagag

SEQ ID NO: 14995 - DNA, 50 bp, homo sapien
gaataaaggaggttttagtaagaaarttatgctacagaccaaaagtgaag

SEQ ID NO: 14996 - DNA, 50 bp, homo sapien
cacatcaagtgtatttaggtggaatsagaaacgtatttttaagacttctt

SEQ ID NO: 14997 - DNA, 50 bp, homo sapien
cgtcagaataaaaacgttgcccttasatacagctgcactggacacaagtt

SEQ ID NO: 14998 - DNA, 50 bp, homo sapien
tccccctatttattttgtgattagcratttagttttggcaaattatgcaa

SEQ ID NO: 14999 - DNA, 50 bp, homo sapien
gctttagcccttggtctcagcgctcyagctcttttcttctttttacttta

SEQ ID NO: 15000 - DNA, 50 bp, homo sapien
aattattattccaaaccttctcatargagcaaaaattagttctgtctttg

SEQ ID NO: 15001 - DNA, 50 bp, homo sapien
aactgctcagatttcttctggttaasacttaggagcaaatgaaacaaagg

SEQ ID NO: 15002 - DNA, 50 bp, homo sapien
tattcctccaggtcctgtacttcccrgactcatagttttcttgtttttat

SEQ ID NO: 15003 - DNA, 50 bp, homo sapien
ttcttgtttttattggttgattaaakgtttagcctaacttattgactaaa

SEQ ID NO: 15004 - DNA, 50 bp, homo sapien
agatgaagctactgacctttttctcrgaaatgcatagacacaaaaagtat

SEQ ID NO: 15005 - DNA, 50 bp, homo sapien
tctcaatgacctgaaaaatgaccaamtgcattaaaagttcttggggtgca

SEQ ID NO: 15006 - DNA, 50 bp, homo sapien
aggtcaagggattaaggtctggaaarttaagaattctgttctgaaatggc

SEQ ID NO: 15007 - DNA, 50 bp, homo sapien
caataaatggagagcatctttccaaygtcatagtcttaaatagatctata

SEQ ID NO: 15008 - DNA, 50 bp, homo sapien
tccacatcctggaagcagtaatgacmaaggcagaaaaaattagattctga

SEQ ID NO: 15009 - DNA, 50 bp, homo sapien
agcgcttagtccggagttaattatcraccactactacccagattaagggt

SEQ ID NO: 15010 - DNA, 50 bp, homo sapien
gccaaagattgcaatagacactttayaatagaacagttgcagaaatgtat

SEQ ID NO: 15011 - DNA, 50 bp, homo sapien
tatttgattgtagaatttcggaaaaytgtagacatttcagaaaattggtg

SEQ ID NO: 15012 - DNA, 50 bp, homo sapien
ctatataatatgaaaaacattttaamtccgtattatgacaaatgtttaca

SEQ ID NO: 15013 - DNA, 50 bp, homo sapien
aggaaaagtttagatatataggttayaataatttcgacatttcatataca

SEQ ID NO: 15014 - DNA, 50 bp, homo sapien
taaccccaagagttaacagattaaarcagaagactattctcaaaattctt

SEQ ID NO: 15015 - DNA, 50 bp, homo sapien
ttaccatccagaattggtttagatgraagtattctctagctcagaaaatt

SEQ ID NO: 15016 - DNA, 50 bp, homo sapien
ggataaccctaaagatcacacttacmaaaagcattgaatagaggcttaag

SEQ ID NO: 15017 - DNA, 50 bp, homo sapien
cactgggtagggctgcacagtctaayaggatgaccacttgacccacatgg

SEQ ID NO: 15018 - DNA, 50 bp, homo sapien
aaatgctcttgacaattgtggatgaygcatgctcttacagacactgctga

SEQ ID NO: 15019 - DNA, 50 bp, homo sapien
gtttgtgagcaaggaagtcacctacyatttacttctgcaaaggtctctat

SEQ ID NO: 15020 - DNA, 50 bp, homo sapien
tacaacatttaagcctgggaaacatraaggctttctttctaactttaaag

SEQ ID NO: 15021 - DNA, 50 bp, homo sapien
gacttcttaatcataaaagtaaatgyaattggtatgaaatattcagaagt

SEQ ID NO: 15022 - DNA, 50 bp, homo sapien
tacaagcttgtactcattctctccaygttgtattaagttttatatttgac

SEQ ID NO: 15023 - DNA, 50 bp, homo sapien
agcttcaggagacacttgccacaccrataatggaaaatgagggtaactgc

SEQ ID NO: 15024 - DNA, 50 bp, homo sapien
catctactacctgctgggtccacatsaactgtttaattgtgcctctcaaa

SEQ ID NO: 15025 - DNA, 50 bp, homo sapien
agaggggctcctcacaacctctttcwagttcaaatttgagtgaagcttgg

SEQ ID NO: 15026 - DNA, 50 bp, homo sapien
aaagtgggaatgaacattttctttaygcctgtataggtctatacatttcc

SEQ ID NO: 15027 - DNA, 50 bp, homo sapien
aaatcaaaccatggatttggataagrctccagggaaagtgtgaagagtaa

SEQ ID NO: 15028 - DNA, 50 bp, homo sapien
catctgaatgtggtataccaggagamctgccttaattttggcatctgcac

SEQ ID NO: 15029 - DNA, 50 bp, homo sapien
atataatgcaagtttttcattactarggacagatcaaagatctctgattc

SEQ ID NO: 15030 - DNA, 50 bp, homo sapien
tgaggatgagagaccagggctacgcratgaggaagaagtggcttccaggt

SEQ ID NO: 15031 - DNA, 50 bp, homo sapien
gaataccaaggccttgatgtgtccartatttactcaggagcttcactaca

SEQ ID NO: 15032 - DNA, 50 bp, homo sapien
agttctggaaccaccatttcctcaayggagatcatacgtacaaaagcagt

SEQ ID NO: 15033 - DNA, 50 bp, homo sapien
tctctgcatatcatctcacatgatawctcttgtcttaaaaattcattatt

SEQ ID NO: 15034 - DNA, 50 bp, homo sapien
aaaaagaacaaatgattattacattmaaccaacggatgaatctccaacat

SEQ ID NO: 15035 - DNA, 50 bp, homo sapien
tcttggactttggagacatcaccaasgtgtatatagttgtgggtattttt

SEQ ID NO: 15036 - DNA, 50 bp, homo sapien
agagtatttgctctatacatatatcraaaatacacagttaatgtttagaa

SEQ ID NO: 15037 - DNA, 50 bp, homo sapien
atctaggacagcctataccttgcacmaagaatgctaccaaattccaacca

SEQ ID NO: 15038 - DNA, 50 bp, homo sapien
gggcttctaatgatcttgtagtgaaygtagtaacctatagatagttttgc

SEQ ID NO: 15039 - DNA, 50 bp, homo sapien
tataaatgctggattgactggtacaygaaaaaaatgaatataagctttag

SEQ ID NO: 15040 - DNA, 50 bp, homo sapien
gtagaaggtctgagactcaaataacragttacctacctaggaagagcctt

SEQ ID NO: 15041 - DNA, 50 bp, homo sapien
ttcataaaaatatagatcaaaaaaaktgttaataatattgaagtggttac

SEQ ID NO: 15042 - DNA, 50 bp, homo sapien
ggagcacctcctgggaaattcactcmaagtggctactgctctgtctcctg

SEQ ID NO: 15043 - DNA, 50 bp, homo sapien
aagcttttgttaatgttcacatatayaggtgtaattgattgtaaaaattg

SEQ ID NO: 15044 - DNA, 50 bp, homo sapien
gcatgcttgctcccagagaaagacartaaaagagccagagctctctgtct

SEQ ID NO: 15045 - DNA, 50 bp, homo sapien
ttcccaattcataaatgttcccagtsaaatactatatatgcgaaacacct

SEQ ID NO: 15046 - DNA, 50 bp, homo sapien
catttttatttttttattgtgaagaytctacgaaaatattttgttaattc

SEQ ID NO: 15047 - DNA, 50 bp, homo sapien
cttgcctttttaaacttttaatctaygcattccacttagtagcatcaact

SEQ ID NO: 15048 - DNA, 50 bp, homo sapien
gaaagattctgatggatctgggtcaygttgattatgtagaaagcagagtc

SEQ ID NO: 15049 - DNA, 50 bp, homo sapien
tcttattggtaattcttggtgtgcamgtctagaatattttcaacacctcg

SEQ ID NO: 15050 - DNA, 50 bp, homo sapien
acacttagaaaaaaacgttttaccargtatctgagcatcccttaacccag

SEQ ID NO: 15051 - DNA, 50 bp, homo sapien
tctttaatattccaatagctgaaatmatataacaacagggcgaaagcaat

SEQ ID NO: 15052 - DNA, 50 bp, homo sapien
tatcagactaagctccttgaatcttraagaaccttggcaagtgcttatct

SEQ ID NO: 15053 - DNA, 50 bp, homo sapien
tgatacagatttgcagcatttctgasactaaaagaataggaaactacttt

SEQ ID NO: 15054 - DNA, 50 bp, homo sapien
tagtctgctggataacaaattacccyaaaactcagcagatgcaaaccaca

SEQ ID NO: 15055 - DNA, 50 bp, homo sapien
aaggtaggtaaggtaagtaggagtayagtgattttgtaactatataaacc

SEQ ID NO: 15056 - DNA, 50 bp, homo sapien
aaagaaacaaccaacagagtgaaaakgtaatctacagaatgggagaaaat

SEQ ID NO: 15057 - DNA, 50 bp, homo sapien
tatttggacaaaggctaatctctcaytcatatgtaaatattttgggaata

SEQ ID NO: 15058 - DNA, 50 bp, homo sapien
aaaaaaaaaactgcccagtgaccgaytcattcattaggctttttgcatct

SEQ ID NO: 15059 - DNA, 50 bp, homo sapien
tttttttaagtatactcaggtaaccsaggagtatcattttgagacccagg

SEQ ID NO: 15060 - DNA, 50 bp, homo sapien
tctgattcttatccttttgtggtgaytattattctggaaattttaggaac

SEQ ID NO: 15061 - DNA, 50 bp, homo sapien
tctaccctttattctaggccaattckattcacatcaaatcttacaaataa

SEQ ID NO: 15062 - DNA, 50 bp, homo sapien
tgcctccctctgtcccgtcaccgaastaacagttatgccttgcctttcag

SEQ ID NO: 15063 - DNA, 50 bp, homo sapien
gcctagattcctgtgactcattgtasagttggacagttaaagtacaaatt

SEQ ID NO: 15064 - DNA, 50 bp, homo sapien
tctgtttgtatctttgaatgactaayacgttatgcctttgagatctccat

SEQ ID NO: 15065 - DNA, 50 bp, homo sapien
tttaaatgtctgaaattagaacagawtagcagaagtaatatagtctatag

SEQ ID NO: 15066 - DNA, 50 bp, homo sapien
ttctactttgctcatctgtgagttayaacagatgatctctaagacctctt

SEQ ID NO: 15067 - DNA, 50 bp, homo sapien
aacatcttatatcttgcttataattsaaaatgttcttagtgcttctgaat

SEQ ID NO: 15068 - DNA, 50 bp, homo sapien
tagtgatactatttcttaaagtacaractaaaatctcattttactaaaat

SEQ ID NO: 15069 - DNA, 50 bp, homo sapien
tctttttctttcatgtccattcttaygataagcaattcttcactcattaa

SEQ ID NO: 15070 - DNA, 50 bp, homo sapien
ctatactgaaattactcaggaacaawctattttgaggctcctaaattggt

SEQ ID NO: 15071 - DNA, 50 bp, homo sapien
acattatgaagttttgccacctgaartgttcttagctataataatgataa

SEQ ID NO: 15072 - DNA, 50 bp, homo sapien
ggtgccacgttcagatctagtaccaygaaggtaaacaagaccggttcctg

SEQ ID NO: 15073 - DNA, 50 bp, homo sapien
acagaagcaaacgaaactcccaaccrcaatgacttgagaaacaatctgga

SEQ ID NO: 15074 - DNA, 50 bp, homo sapien
gccttaaaattctgtgggtttatgakatcctagcaacagaaaggcatttt

SEQ ID NO: 15075 - DNA, 50 bp, homo sapien
cagatctatctgcctttcagtgcacrggaataagaaaaagtaaagtagag

SEQ ID NO: 15076 - DNA, 50 bp, homo sapien
atagagagcctgttgtaaggttagcmattttggttactgtctcttctcag

SEQ ID NO: 15077 - DNA, 50 bp, homo sapien
attttaaaattgatcaaatcttagtraagttccatgaaaaactaaagctt

SEQ ID NO: 15078 - DNA, 50 bp, homo sapien
agatccagggaccccaggttttgaamcatagagtcagaatgtctatctca

SEQ ID NO: 15079 - DNA, 50 bp, homo sapien
tgttaactggtcatatcgtggcctasgttttcaggtaacaggttagcaac

SEQ ID NO: 15080 - DNA, 50 bp, homo sapien
agcatactcctgtcttgggtgtagayatgaatatttatgagaaccagaaa

SEQ ID NO: 15081 - DNA, 50 bp, homo sapien
aagggaagatataaaacactcaatayctgaaatagttgtggaaacatttc

SEQ ID NO: 15082 - DNA, 50 bp, homo sapien
ttaacaaccatttatgccaactacaracagaagatctgatggaataaagg

SEQ ID NO: 15083 - DNA, 50 bp, homo sapien
ttattttctgtcagattttgggtacygaataagccaagagggcatactgc

SEQ ID NO: 15084 - DNA, 50 bp, homo sapien
ttgggaataaacttatcaaaagagarctgtgacctttgaggataaagtca

SEQ ID NO: 15085 - DNA, 50 bp, homo sapien
tttgcaacgaaaattgctttcatagraaatgtggaaatggctgtgtagat

SEQ ID NO: 15086 - DNA, 50 bp, homo sapien
gtcagcacctcctcctgaatacacastctgggccaaccctttacataaac

SEQ ID NO: 15087 - DNA, 50 bp, homo sapien
ggagacaggggtctagaaggtgatamatttagtcagttatgactgttaga

SEQ ID NO: 15088 - DNA, 50 bp, homo sapien
agactgggaacttggaaggtggttargattaacagcagaaaaaaagctgg

SEQ ID NO: 15089 - DNA, 50 bp, homo sapien
cttcactgggataccatgtgagagasagaaacagactcacaagcctgttc

SEQ ID NO: 15090 - DNA, 50 bp, homo sapien
ggaaagaggacctggtaggttttcaraactcgagacaggagcccatctcc

SEQ ID NO: 15091 - DNA, 50 bp, homo sapien
catgaaactaggtaatttttaaggcratatttcatctcctctctgggcaa

SEQ ID NO: 15092 - DNA, 50 bp, homo sapien
acacatgttgaaaatggatggtttarcatgctttattgccataatatgtg

SEQ ID NO: 15093 - DNA, 50 bp, homo sapien
tcaaatggaaaagagggactcgggcyatgaatctcagagttaaagtaggg

SEQ ID NO: 15094 - DNA, 50 bp, homo sapien
caattaccagcaactccagatcatargtctcagtgcaggcaagcttcaga

SEQ ID NO: 15095 - DNA, 50 bp, homo sapien
ggggtgcagcaaaaaggaggatttaycttgagaattcctcttccctcatg

SEQ ID NO: 15096 - DNA, 50 bp, homo sapien
gcacatgcaccccactggcttgcctyaaatgtttaaacccattataaaca

SEQ ID NO: 15097 - DNA, 50 bp, homo sapien
aagtgggcaagattctatttccgagwcccaaaaggcttcctggcacatgc

SEQ ID NO: 15098 - DNA, 50 bp, homo sapien
aagcttaatagttaaggccacatagyattgtttatgggtaggccaagaca

SEQ ID NO: 15099 - DNA, 50 bp, homo sapien
acatagctgagaaagaagattgttcmataactggtgctgagtcaactagt

SEQ ID NO: 15100 - DNA, 50 bp, homo sapien
atatacctgttgataagactgaattyaataagacaacatttgtaatgatc

SEQ ID NO: 15101 - DNA, 50 bp, homo sapien
caaataaacctgaatccttttttacrccatatagaaaaagcaatttcagt

SEQ ID NO: 15102 - DNA, 50 bp, homo sapien
ccaactaactataatatatattccawattgctttgattgatatctcagat

SEQ ID NO: 15103 - DNA, 50 bp, homo sapien
ttcatagtctctaatttaccacttcmatagttgccaactaactataatat

SEQ ID NO: 15104 - DNA, 50 bp, homo sapien
caactattgaagtggtaaattagagrctatgaagaaaattgacttttcag

SEQ ID NO: 15105 - DNA, 50 bp, homo sapien
ctcagaaccactaccatagccttctraaaagtcaattttcttcatagtct

SEQ ID NO: 15106 - DNA, 50 bp, homo sapien
tgtcatcagtgatgcagttctgttayctcatcttcacaattccatctgat

SEQ ID NO: 15107 - DNA, 50 bp, homo sapien
acaggcaggtaatgcaattcagttaygtaggtatggacagatacagtaca

SEQ ID NO: 15108 - DNA, 50 bp, homo sapien
atgtccttagcacagtgtccagcacrctacatatgcacagctattaatat

SEQ ID NO: 15109 - DNA, 50 bp, homo sapien
taagactttggatttgatattggaamgagttaagacgttgggggactgtt

SEQ ID NO: 15110 - DNA, 50 bp, homo sapien
tagtcttccccatattgtgattaaastcctcatttttctcattttgtagg

SEQ ID NO: 15111 - DNA, 50 bp, homo sapien
gaatatcccacccacaattaaggtamaatctggtcacataactttttccc

SEQ ID NO: 15112 - DNA, 50 bp, homo sapien
ggaacttgaatttgaataaaagaaartatcttctccaccttttacaatat

SEQ ID NO: 15113 - DNA, 50 bp, homo sapien
aaaatattttgttgttaaaaggtacyatagaattgcaaaaataagccatg

SEQ ID NO: 15114 - DNA, 50 bp, homo sapien
attgttggattttaatatttgactayctgttgaatgtgagataataattt

SEQ ID NO: 15115 - DNA, 50 bp, homo sapien
ttatcaaatggtaactgtgtaaatgmatactaaaggcttgatttgacatt

SEQ ID NO: 15116 - DNA, 50 bp, homo sapien
aaatccagcaagctaggaagagataygtatatgtggctcaggaagatctg

SEQ ID NO: 15117 - DNA, 50 bp, homo sapien
gagcagaaagcttctataggaatacycattctcaaaggagggaggaagtg

SEQ ID NO: 15118 - DNA, 50 bp, homo sapien
caattccattgacaaagggttgaagscttactggcacaagaagcttaagc

SEQ ID NO: 15119 - DNA, 50 bp, homo sapien
acttgatgcacaacaaatggatataktaagaaaacagggattgaaaaaga

SEQ ID NO: 15120 - DNA, 50 bp, homo sapien
tcatatacccagtgctttagtaaaamtggattagaagttcttcctgtaca

SEQ ID NO: 15121 - DNA, 50 bp, homo sapien
ggagttcctggctatgattatcctgycaaacttaggactccaccaactgc

SEQ ID NO: 15122 - DNA, 50 bp, homo sapien
ctctgttgagatcgcataattgctayagatatgtttccaagttaactggt

SEQ ID NO: 15123 - DNA, 50 bp, homo sapien
taggcataatttaagacaaaagagayggtaatggtagaaaagagataaaa

SEQ ID NO: 15124 - DNA, 50 bp, homo sapien
ctcaagaagaaaatctaaaaattacrctaggattaaatccgactccattt

SEQ ID NO: 15125 - DNA, 50 bp, homo sapien
tgataaatttatgttgctgataatarctcagaagtactcttggatgaata

SEQ ID NO: 15126 - DNA, 50 bp, homo sapien
taattttttaaaattttccacatgaygtatttatctctaaaatgttaatt

SEQ ID NO: 15127 - DNA, 50 bp, homo sapien
tgttgttttaagccactcagtctacrgtacttggttttggcaggcctagg

SEQ ID NO: 15128 - DNA, 50 bp, homo sapien
tgtcatatgtatggtattaaaataayccatgtctggaattacgtttgtaa

SEQ ID NO: 15129 - DNA, 50 bp, homo sapien
tcctccaagagtttggggcgcggacyggagtaccttgcgtgcagttatgt

SEQ ID NO: 15130 - DNA, 50 bp, homo sapien
cattccctgtttttgtggatttatakgttttacaaacttttactatcatt

SEQ ID NO: 15131 - DNA, 50 bp, homo sapien
tatttattgacaggccttattctagyaactgacaatgtagcagagaatag

SEQ ID NO: 15132 - DNA, 50 bp, homo sapien
atgtaatcttacatggcagatgagaytcagtaggatcttgagatggagat

SEQ ID NO: 15133 - DNA, 50 bp, homo sapien
tatataaataattcaataacaagaasagacaacttaatttttaaaaacag

SEQ ID NO: 15134 - DNA, 50 bp, homo sapien
aacaagaaatgggtcaggaagaataygagccttgtccttgcagattttct

SEQ ID NO: 15135 - DNA, 50 bp, homo sapien
ggagagactgcacttgagttgacacratgctgttaccacaatggaaagaa

SEQ ID NO: 15136 - DNA, 50 bp, homo sapien
taacaaaatatgtgagagacttataygctaaattgcaaaatactgttgag

SEQ ID NO: 15137 - DNA, 50 bp, homo sapien
tgggggcaatgagtcgggtataaacrgagcttctttcctatgcctccctc

SEQ ID NO: 15138 - DNA, 50 bp, homo sapien
taagccatacattcacttcatacagratccttcagaatttaaatgcaatt

SEQ ID NO: 15139 - DNA, 50 bp, homo sapien
agtgcattatgatgccttcaattaayagggaacagctgctaggtaattaa

SEQ ID NO: 15140 - DNA, 50 bp, homo sapien
agaaccctgccacctttagaatccgwcaaatctactaggaacatgaccaa

SEQ ID NO: 15141 - DNA, 50 bp, homo sapien
tgcctgggttccggctcggttatcaytaatcactcccccacttagcattc

SEQ ID NO: 15142 - DNA, 50 bp, homo sapien
acagttgcatttacagagcatatcawgggtcctgtcatgttaaaggaact

SEQ ID NO: 15143 - DNA, 50 bp, homo sapien
cctgttgactacgtaacgtggccaaytaccctgactgctagcatttcata

SEQ ID NO: 15144 - DNA, 50 bp, homo sapien
aaccagacgggcctccttatccaaartatttcatgctgagatgctgaagg

SEQ ID NO: 15145 - DNA, 50 bp, homo sapien
aggaagcaatattatacagagcccayaattcctgttggcacagtggcatc

SEQ ID NO: 15146 - DNA, 50 bp, homo sapien
aagaccaccactttccagggatgcaygtcacaaatctttttcttgcatgt

SEQ ID NO: 15147 - DNA, 50 bp, homo sapien
ctgaaatatataaatccacataccaraactgtagatgcttttgtatgtaa

SEQ ID NO: 15148 - DNA, 50 bp, homo sapien
ttccttctgtgcttctaatttggaartcctggaacccaaatcagcttgct

SEQ ID NO: 15149 - DNA, 50 bp, homo sapien
cttttaatcagagagatacttgcagwcctattacctaaattgaaacagcc

SEQ ID NO: 15150 - DNA, 50 bp, homo sapien
ctgttagcttcaaagtctttgtaackgagagtcttcacccaagagcacag

SEQ ID NO: 15151 - DNA, 50 bp, homo sapien
ctgttaccttggagagccagtgttaraagtgaagtgaagataaagttgct

SEQ ID NO: 15152 - DNA, 50 bp, homo sapien
aatggaaataattttattcttctaartgactcctagttgcttttgtacac

SEQ ID NO: 15153 - DNA, 50 bp, homo sapien
tcatcttcagaaggctgtccttaggyagaattaaacccagtcagagcccc

SEQ ID NO: 15154 - DNA, 50 bp, homo sapien
agttaatatacgctaagttgggtaayaggatcagattctttacagtaaag

SEQ ID NO: 15155 - DNA, 50 bp, homo sapien
tgatagccttaagtaattgccagagkaagtcccgcaaaccttacgtttat

SEQ ID NO: 15156 - DNA, 50 bp, homo sapien
gcaaaccttacgtttatgacaagaaygaattggtccattttgaggagtga

SEQ ID NO: 15157 - DNA, 50 bp, homo sapien
gaaaagctggtctttggaaagggaaygaaactgacagtaaacccatgtaa

SEQ ID NO: 15158 - DNA, 50 bp, homo sapien
tataatgccaggtttagatgcttacyattacacacttctcttcattacag

SEQ ID NO: 15159 - DNA, 50 bp, homo sapien
tttgccgagacagggatttcaaaagraggataagattagataatgaagag

SEQ ID NO: 15160 - DNA, 50 bp, homo sapien
gtttaacacttcaaatcttcatttcragagttccacagaaaattcaacat

SEQ ID NO: 15161 - DNA, 50 bp, homo sapien
aatatttatcatgactgttttatggmaagtacacagaatgggttctaaaa

SEQ ID NO: 15162 - DNA, 50 bp, homo sapien
ctgtgttactggaaagaccgtggaartcccctgtaagaaccctgagcccc

SEQ ID NO: 15163 - DNA, 50 bp, homo sapien
tttacttcttatatccgttcagtcaycaaatacttctgattccttcattg

SEQ ID NO: 15164 - DNA, 50 bp, homo sapien
gctggttacttttccagcctagtccraaagactgtaaccataacaaaaca

SEQ ID NO: 15165 - DNA, 50 bp, homo sapien
aaaataaagatactcttggaattgcraagctcagaaagtattctgcatgc

SEQ ID NO: 15166 - DNA, 50 bp, homo sapien
tctgtaaaatgttcagtacaggacayggcaaactttcaatcatgctgtta

SEQ ID NO: 15167 - DNA, 50 bp, homo sapien
gcacttgactcagcaggttcaaatamacttttggttctggatcaattgcc

SEQ ID NO: 15168 - DNA, 50 bp, homo sapien
aatggttcagatacaaactctctaayacattgtttccctttttttgttta

SEQ ID NO: 15169 - DNA, 50 bp, homo sapien
gggcccaggcaggacaaggaaaccaygccagttgtgtaaacaggaagatt

SEQ ID NO: 15170 - DNA, 50 bp, homo sapien
aagtggctttaacatatctgaacacrcaatagctaagacccaaactggga

SEQ ID NO: 15171 - DNA, 50 bp, homo sapien
acaagatatggtagaattgactgaayatggaaaactaaaccagagaaggg

SEQ ID NO: 15172 - DNA, 50 bp, homo sapien
tgcttcatcacccttgtcctaagcaytcattacatttgcatcacaggccg

SEQ ID NO: 15173 - DNA, 50 bp, homo sapien
aaatccaattatttatggaaaatccyagtagctagatggtaacagagcaa

SEQ ID NO: 15174 - DNA, 50 bp, homo sapien
gagcaattgatacacataacaatgcrgatgtatctcaaggctgagtgaaa

SEQ ID NO: 15175 - DNA, 50 bp, homo sapien
tctcactacatgggtgatactttaastagagtctgcgcccagccgaactc

SEQ ID NO: 15176 - DNA, 50 bp, homo sapien
agcaattcttttactgatgacaagcmgagtaaaataatttttgaatttat

SEQ ID NO: 15177 - DNA, 50 bp, homo sapien
taaattcaagttaagaaataaaagaytaagtactgcatatacgcattaat

SEQ ID NO: 15178 - DNA, 50 bp, homo sapien
tttgttttccacaaatttgaaagaayggcaataatgctaaagcttttata

SEQ ID NO: 15179 - DNA, 50 bp, homo sapien
ccaagattctgactctctcttgggaygaacaaggtctcttggcttcttcc

SEQ ID NO: 15180 - DNA, 50 bp, homo sapien
tacttatggccttgcaaataacccayggtctcttggtcgatgaacaaaat

SEQ ID NO: 15181 - DNA, 50 bp, homo sapien
gtcagcagcagcctaaggtctctgayggctatctggcaccatgctggact

SEQ ID NO: 15182 - DNA, 50 bp, homo sapien
ccagtgctaaattccaacaaagggcratgcggcctattgtggggctaaga

SEQ ID NO: 15183 - DNA, 50 bp, homo sapien
gtgaagacttaacagatactgccaaygcatttagtaagaatattatctgc

SEQ ID NO: 15184 - DNA, 50 bp, homo sapien
gcagtatctgttaagtcttcacttaygctattggtttgataaaaatactg

SEQ ID NO: 15185 - DNA, 50 bp, homo sapien
tcaagacaaattaatcaatcacaggragaaaggaggcgattaggtgacct

SEQ ID NO: 15186 - DNA, 50 bp, homo sapien
gaaaaaataataaacaaatataggcrcattatgtccaataaaaagataaa

SEQ ID NO: 15187 - DNA, 50 bp, homo sapien
aatagtcaaggatatagaagaaaacygagtatctaggaagaaacaaaata

SEQ ID NO: 15188 - DNA, 50 bp, homo sapien
gaagttaattgttatggagtgatcaraagatgtttccctggctcctgcaa

SEQ ID NO: 15189 - DNA, 50 bp, homo sapien
gaactggtgactttgggtccttccaytatgcttcatctgaccttcagaaa

SEQ ID NO: 15190 - DNA, 50 bp, homo sapien
ctatgcttcatctgaccttcagaaartattgttccaatcctttgccaaag

SEQ ID NO: 15191 - DNA, 50 bp, homo sapien
attatacttgagtgtacaaaagctawgtagattaatgaaaataaattatc

SEQ ID NO: 15192 - DNA, 50 bp, homo sapien
actctgtaaccatctgaattgattcrcagctttatttgtaaaggaaaaga

SEQ ID NO: 15193 - DNA, 50 bp, homo sapien
tttgaagcaggccttagttttttgcmagcgtaactaacatttggggatcg

SEQ ID NO: 15194 - DNA, 50 bp, homo sapien
gaaaaacacaggagaaagtcatgatratcacattatagaggcttataaaa

SEQ ID NO: 15195 - DNA, 50 bp, homo sapien
ctcaccaagaaggcagtcacacttaygtttttatgtatttgttgaagagt

SEQ ID NO: 15196 - DNA, 50 bp, homo sapien
gcagggcccctgcctcactttgggasaagaaagccttagtggggagaaat

SEQ ID NO: 15197 - DNA, 50 bp, homo sapien
tggatcccagaagcactaactacaaygcctaagcaaaaacagacttgcta

SEQ ID NO: 15198 - DNA, 50 bp, homo sapien
caggccaacttctacttggaagctastaaccttcgaccagttagataaga

SEQ ID NO: 15199 - DNA, 50 bp, homo sapien
gcgagaggctgctgagggtggtgacrgcatactacactcaccttcccctc

SEQ ID NO: 15200 - DNA, 50 bp, homo sapien
agggagcttaggagcctcaagaataygccgaatgcttgaaaagcagtatg

SEQ ID NO: 15201 - DNA, 50 bp, homo sapien
tgtggctaagtttctaaatgggttcratagataatgactgtccatagcaa

SEQ ID NO: 15202 - DNA, 50 bp, homo sapien
tatgtttattatgttaagttttaaartaatagatggacaggtgagttttc

SEQ ID NO: 15203 - DNA, 50 bp, homo sapien
tgttacataaagtttgatgcagcggrattcttaaaatttctccaggagta

SEQ ID NO: 15204 - DNA, 50 bp, homo sapien
tgaaagacacaagccaagaaataaargtagtgaaggaataatgatatgaa

SEQ ID NO: 15205 - DNA, 50 bp, homo sapien
ttatatcagtttgtacctttttctcratatactttcattttcctgagtag

SEQ ID NO: 15206 - DNA, 50 bp, homo sapien
ataaaaatgatttgaaagtaatccartacttgacattaggtgaaactatt

SEQ ID NO: 15207 - DNA, 50 bp, homo sapien
tgattcttattacactgcttcaataractcctaaatactctagttgtcca

SEQ ID NO: 15208 - DNA, 50 bp, homo sapien
aagtatctttcttgcatctcaaatcmagtaggcattactgcataaataaa

SEQ ID NO: 15209 - DNA, 50 bp, homo sapien
taagaattccaggtttactcttctarcattcatgaagctaatcactcaaa

SEQ ID NO: 15210 - DNA, 50 bp, homo sapien
tacttttactgagatgaagaaaaaamagctatatgagaaggaagaattca

SEQ ID NO: 15211 - DNA, 50 bp, homo sapien
agaataaaaaatgatattagaagagragtcaattctaataagaaaaatat

SEQ ID NO: 15212 - DNA, 50 bp, homo sapien
tcatattcattttttctctgtaacarggacaaaacatctagtttcaccca

SEQ ID NO: 15213 - DNA, 50 bp, homo sapien
agtaaatcaaactctgatagaaaagyctaatgcattcttctgtaaaatga

SEQ ID NO: 15214 - DNA, 50 bp, homo sapien
cttggcaaataaagtgagtgaaaaaytttaggatcttttaacttcttact

SEQ ID NO: 15215 - DNA, 50 bp, homo sapien
tggtttctagtttctagttactcaartagccattcatctccagctcaact

SEQ ID NO: 15216 - DNA, 50 bp, homo sapien
cataacatgcataacctttactccartacacaataagttcctcatttcca

SEQ ID NO: 15217 - DNA, 50 bp, homo sapien
tatttgtcattatgcattgactgcawgtaataaaagttgttaatttgaga

SEQ ID NO: 15218 - DNA, 50 bp, homo sapien
tcagtatgtggaaaagagtagaaggyatggtgactatagcttggaggtta

SEQ ID NO: 15219 - DNA, 50 bp, homo sapien
gcacagtacatgacgctgagcataamggcgggaaagagatcacagttcct

SEQ ID NO: 15220 - DNA, 50 bp, homo sapien
gcccgcgccaaacaggaagaatctaycgccttgacacttcacgttgtaaa

SEQ ID NO: 15221 - DNA, 50 bp, homo sapien
tttctgtggttctgtatctagaacaygtttatctaactaccccaaactca

SEQ ID NO: 15222 - DNA, 50 bp, homo sapien
aacaagttggaaggtattctggtgawcctgtggacattggttatctgtct

SEQ ID NO: 15223 - DNA, 50 bp, homo sapien
caaagaggaataactacaattttccyactctccagacatctccagaggtc

SEQ ID NO: 15224 - DNA, 50 bp, homo sapien
ctggatttttaaagacataaggtctraccatagttccagaattcagaggc

SEQ ID NO: 15225 - DNA, 50 bp, homo sapien
aataagaaaaagacaaagactatgayacaggaacttcacagtggtataaa

SEQ ID NO: 15226 - DNA, 50 bp, homo sapien
aaatgtccagaatatcgttaagataraaagttaatacataatgagtacaa

SEQ ID NO: 15227 - DNA, 50 bp, homo sapien
ttcgaaagcaaaaacagtataaaaawtcttctaaattcaaaacttccaag

SEQ ID NO: 15228 - DNA, 50 bp, homo sapien
gtctttcatagatgcacctctacatsatagctttaaaaaataactaggca

SEQ ID NO: 15229 - DNA, 50 bp, homo sapien
tgaatacttgttaagatttgaactartaggatgaaaggagctgtttagat

SEQ ID NO: 15230 - DNA, 50 bp, homo sapien
gattgaaaagttgaagggatttttgsaatattaggcatccgaaatgtcgg

SEQ ID NO: 15231 - DNA, 50 bp, homo sapien
aacattgtgtcccaagaacttcattwaaaaagctgggtagtggtgcccag

SEQ ID NO: 15232 - DNA, 50 bp, homo sapien
cattatcactgatgctattgagcccrcttagcatcagaatcacaagttta

SEQ ID NO: 15233 - DNA, 50 bp, homo sapien
atttcatcaaccagtgtgctggtcarctaccaagtcatattagatgcttt

SEQ ID NO: 15234 - DNA, 50 bp, homo sapien
gactcactgaagtttcagattccctsacagataagaagactacctcattc

SEQ ID NO: 15235 - DNA, 50 bp, homo sapien
tcagagaaatgcaaaccaaagctacratgagttatcaccttaccccagtt

SEQ ID NO: 15236 - DNA, 50 bp, homo sapien
gggaggccaggttgccatataaggargtcaggtaagccttatggagaagg

SEQ ID NO: 15237 - DNA, 50 bp, homo sapien
gaagtcaagatcataattttagtcarcatcattctaagatctggcaaatg

SEQ ID NO: 15238 - DNA, 50 bp, homo sapien
tctctgataatctttcttttttaccsaaatcatattttccatggatggtg

SEQ ID NO: 15239 - DNA, 50 bp, homo sapien
taaattaggagagataattagtgacyattgcaggaggtccaacttctaga

SEQ ID NO: 15240 - DNA, 50 bp, homo sapien
tctcatgctgctgtcacctgcatccratagaccctgaaacactgaaattt

SEQ ID NO: 15241 - DNA, 50 bp, homo sapien
gcaaaagccatcttctgatggtaaamttgagagccagtcaaatgtcaact

SEQ ID NO: 15242 - DNA, 50 bp, homo sapien
tgagaatttgcaaaatattacaggarctcttcttctttctcttcagaacc

SEQ ID NO: 15243 - DNA, 50 bp, homo sapien
aagaaatgtaaagttttagtggaaaragttctgacgtagtaaggttttag

SEQ ID NO: 15244 - DNA, 50 bp, homo sapien
cactcatttctttagagtattttaaytgaagtatatattacatgatatta

SEQ ID NO: 15245 - DNA, 50 bp, homo sapien
gcactgctttgactctccttccatamagggaaaagactcatgggggcctg

SEQ ID NO: 15246 - DNA, 50 bp, homo sapien
attgagactagtaagatatttcagtwacacccagcatttagttatttgac

SEQ ID NO: 15247 - DNA, 50 bp, homo sapien
tttcatgaagtattctacacagctawgatgcttttcaagctagaggtgct

SEQ ID NO: 15248 - DNA, 50 bp, homo sapien
tgcatatcatcagatattataagtasagatatgttctagttataaatata

SEQ ID NO: 15249 - DNA, 50 bp, homo sapien
tataaattatcaaaccgacttacatraacacatctgctcatctaagatac

SEQ ID NO: 15250 - DNA, 50 bp, homo sapien
tgggggaccaagctgtttactgagaygacactgggaacactttgtacatt

SEQ ID NO: 15251 - DNA, 50 bp, homo sapien
tttagagtatatcattaactggttcyattctgtatcctatccaaagtcta

SEQ ID NO: 15252 - DNA, 50 bp, homo sapien
cttattaatgcatgcagctagtctcygaagagagaaagagaataattttt

SEQ ID NO: 15253 - DNA, 50 bp, homo sapien
gcttctctaaccctataactttgcartctcttccttgcctaccttttcat

SEQ ID NO: 15254 - DNA, 50 bp, homo sapien
aaggtttcatgtgaagagtagaggargatgtccctgtaacaattaagagt

SEQ ID NO: 15255 - DNA, 50 bp, homo sapien
attatgtagagttgcatctaataggwattactacgaggagtggataaaag

SEQ ID NO: 15256 - DNA, 50 bp, homo sapien
ttgtagagagctcacttatctactcygagaatttttgtcttttaactgct

SEQ ID NO: 15257 - DNA, 50 bp, homo sapien
aaggctttccttcctcattcaaacargtatcatctttccaacaacaacaa

SEQ ID NO: 15258 - DNA, 50 bp, homo sapien
aaatatatacctcctagaaaagtacragtcatactgaacaaacactgaac

SEQ ID NO: 15259 - DNA, 50 bp, homo sapien
tgttgctgtcaacagtttaagtcacmattttgaagtgtgtgcctaataaa

SEQ ID NO: 15260 - DNA, 50 bp, homo sapien
atcactcagctgaagatctcccttaraagtttcacctcatccttttcgtt

SEQ ID NO: 15261 - DNA, 50 bp, homo sapien
aaagacagcagcttgtcacttatgcratctacgtagagaagttaatttca

SEQ ID NO: 15262 - DNA, 50 bp, homo sapien
tacacaaaactcaaaaatttaagtcsaatgtgtgcagaatcccagaggct

SEQ ID NO: 15263 - DNA, 50 bp, homo sapien
atgagaaaatgaatatcttttataaytgagaaccagacttcttagaactc

SEQ ID NO: 15264 - DNA, 50 bp, homo sapien
tggcacatggtaggtgtcctcatctyactaattcacatcacaagcttgtg

SEQ ID NO: 15265 - DNA, 50 bp, homo sapien
ttagctcttcaaacaagttacacaakttacaatttatttcaaacaaacag

SEQ ID NO: 15266 - DNA, 50 bp, homo sapien
aaggttaagtggctatatatttaacycagagtaatgatctcacaaggcaa

SEQ ID NO: 15267 - DNA, 50 bp, homo sapien
tgccacgagtaaagtgaggtgctcaraaaacgaggtttgttctgctacta

SEQ ID NO: 15268 - DNA, 50 bp, homo sapien
ggccactaattatccactaattgacmgaaaaaaactgaaggacagagagg

SEQ ID NO: 15269 - DNA, 50 bp, homo sapien
ttccttaggataaattcatagaagtsaaattactttacccatgtacattt

SEQ ID NO: 15270 - DNA, 50 bp, homo sapien
tagcctcttgcatttgtcatgattarctcatcaatattgacatactgtta

SEQ ID NO: 15271 - DNA, 50 bp, homo sapien
agggagaaggttaataactcattctraaaatacctgtaagatttagccat

SEQ ID NO: 15272 - DNA, 50 bp, homo sapien
agcaagaatgaagggaccctttatayaattacacaaccattctcatttat

SEQ ID NO: 15273 - DNA, 50 bp, homo sapien
tttaagaaagtcattccactcttcayatttaataagacagctattgatcg

SEQ ID NO: 15274 - DNA, 50 bp, homo sapien
ctctcacctatgctgtgacaaaccartgggtaccgaaatatgcttcatgg

SEQ ID NO: 15275 - DNA, 50 bp, homo sapien
cttattttgaacatggactctgtaawcatatttgagctgctgaatacttc

SEQ ID NO: 15276 - DNA, 50 bp, homo sapien
aggtgatcctcctgtctcagtgttayaaagtttccgtgccgcaaaagaaa

SEQ ID NO: 15277 - DNA, 50 bp, homo sapien
gcactggctaatcataaagggtgcartcagtatataaacattatctatct

SEQ ID NO: 15278 - DNA, 50 bp, homo sapien
aatggagatctattcattaggaccayaaaataaaatggaaatctgttttc

SEQ ID NO: 15279 - DNA, 50 bp, homo sapien
agaaaaatgcaacattgatggtcttraaaatggaggaaatgggccacaag

SEQ ID NO: 15280 - DNA, 50 bp, homo sapien
ttcatttgttaatcactagattcaaygtaattaggaaaactataaaatct

SEQ ID NO: 15281 - DNA, 50 bp, homo sapien
tgcagaactttatcttttatgtcaaygtccatcagtaaagatctaatgta

SEQ ID NO: 15282 - DNA, 50 bp, homo sapien
tgtataattcatctgctttggtaatyagaattgccgtaatagaatttcgt

SEQ ID NO: 15283 - DNA, 50 bp, homo sapien
tccctcagccctggatggccatctakaacacaggagaatcaaatagcaaa

SEQ ID NO: 15284 - DNA, 50 bp, homo sapien
gccagcccagactcaaagggatgaayattagactccatctttcaaaagga

SEQ ID NO: 15285 - DNA, 50 bp, homo sapien
agttaaactttgtgtctcctttatarccttatatacttctgtgcagcacc

SEQ ID NO: 15286 - DNA, 50 bp, homo sapien
ttttatattagtaattatattcagargacttgatgttttaccacttaata

SEQ ID NO: 15287 - DNA, 50 bp, homo sapien
catcaaaaactattatgaccttatayatcttcgcgttggcacttgcagaa

SEQ ID NO: 15288 - DNA, 50 bp, homo sapien
ttatgtgtagttttgacctgattaaytaaagggccaaaaatagttattga

SEQ ID NO: 15289 - DNA, 50 bp, homo sapien
ttggaaaacagttctgtggaagttayagggcactcagagaatgcaaactt

SEQ ID NO: 15290 - DNA, 50 bp, homo sapien
aagggcttagactggaaatcatttayaatttgtctccattctttacacta

SEQ ID NO: 15291 - DNA, 50 bp, homo sapien
tgtcctatcattcctttttcattccwctggctctgaaaaaaaattctaaa

SEQ ID NO: 15292 - DNA, 50 bp, homo sapien
caaatatacagcaaactctagagaayaacagcaaacatcttgatcactta

SEQ ID NO: 15293 - DNA, 50 bp, homo sapien
gtacaaataccttttctaattcttayggcaagaaaaacttttatttattt

SEQ ID NO: 15294 - DNA, 50 bp, homo sapien
gtataggaagatgacaatagactgawgatatgtcctgtgagaaaatgcct

SEQ ID NO: 15295 - DNA, 50 bp, homo sapien
taggaaataataatgaggcagatacyatggctgaggaaaaaggaggtcag

SEQ ID NO: 15296 - DNA, 50 bp, homo sapien
actgctgtttgaaggagtgcacttasataaatgataggttaggttactga

SEQ ID NO: 15297 - DNA, 50 bp, homo sapien
tgagacaggcataggactgacattcrcattctaaaggaaaaaaaaaaaaa

SEQ ID NO: 15298 - DNA, 50 bp, homo sapien
ttgctgattaagtctcttatcttgcyctaaatatcattagcccacttgcc

SEQ ID NO: 15299 - DNA, 50 bp, homo sapien
tgtacattaatttattaaggagaaaycatataggaaaatatgctaaaatt

SEQ ID NO: 15300 - DNA, 50 bp, homo sapien
tgatcagtgtgaacgacagggttacyaagtagagagaatctgacaccacg

SEQ ID NO: 15301 - DNA, 50 bp, homo sapien
gaattctcaaagtttggtcctgccartaagtagtacatccagatatatgc

SEQ ID NO: 15302 - DNA, 50 bp, homo sapien
tggacataaaaccaaggaaatatacrccttgatggaaacagatatcctgg

SEQ ID NO: 15303 - DNA, 50 bp, homo sapien
aaaacagtgttggtacttagtagacrgattatggacatcaccagcagaaa

SEQ ID NO: 15304 - DNA, 50 bp, homo sapien
agggtatataaagagaagcatataargtatttggaaggaaaggcattttg

SEQ ID NO: 15305 - DNA, 50 bp, homo sapien
tcctgaaaactaggcactgctcttawctttacttagtattttcctctttc

SEQ ID NO: 15306 - DNA, 50 bp, homo sapien
agtgaatcaaatggatagattgaatragcgtctgaaattctacttattta

SEQ ID NO: 15307 - DNA, 50 bp, homo sapien
tgtcatgttttaggcagatgtggcayagttaatgtgtatagaatgggcac

SEQ ID NO: 15308 - DNA, 50 bp, homo sapien
tgtgtgtgacagatccaatagcctaratccagtttttcaggaaaggttga

SEQ ID NO: 15309 - DNA, 50 bp, homo sapien
atgcacataaagttcctggtagttcycaataaattaatgcattttacttc

SEQ ID NO: 15310 - DNA, 50 bp, homo sapien
ctccagtggtaacccagaatattaayggtaaatagaggaaagaagcttca

SEQ ID NO: 15311 - DNA, 50 bp, homo sapien
aagaaaaagtatacgatctgaggaaycaagaggttaaaaatgtactctat

SEQ ID NO: 15312 - DNA, 50 bp, homo sapien
agacgaattggactcagataaggaascgtttacttctcagtatttcctag

SEQ ID NO: 15313 - DNA, 50 bp, homo sapien
actgtgtagtcttttgaagagaaaayggccttcactgctggctaattcac

SEQ ID NO: 15314 - DNA, 50 bp, homo sapien
acaatggcacctctctgtacaagccrctaatcactagtaggtagcataat

SEQ ID NO: 15315 - DNA, 50 bp, homo sapien
cccaatgtgcaggagcaacaatttcycaaaaactggatctggatgcattt

SEQ ID NO: 15316 - DNA, 50 bp, homo sapien
gcaacctaatatgaatatcaagagaygttgcatggaaaagcaggcagtgc

SEQ ID NO: 15317 - DNA, 50 bp, homo sapien
tctagaagcacacaatattcatctamcctcattggtgattttaattttga

SEQ ID NO: 15318 - DNA, 50 bp, homo sapien
ctgaacaatttttctctccactatayctagtttttctttttctttttctg

SEQ ID NO: 15319 - DNA, 50 bp, homo sapien
caagcgtacctatatgtagattctgkaaacctcatgccgaggtagagatt

SEQ ID NO: 15320 - DNA, 50 bp, homo sapien
gacatgcttttctgtatgctgctaaraatgtttaacaaagagataaaaca

SEQ ID NO: 15321 - DNA, 50 bp, homo sapien
cccaggcgagcaaccatgatggctcraagcagatataaggagagaaaata

SEQ ID NO: 15322 - DNA, 50 bp, homo sapien
acaggaggggagccctttttaagcastgaaggatagcaacaccccactga

SEQ ID NO: 15323 - DNA, 50 bp, homo sapien
gtgaaagacaaaatgagagcttaackcagcagggttgcaggaaagggttt

SEQ ID NO: 15324 - DNA, 50 bp, homo sapien
atatttgtttccactactcttttcawctactgcaagtcactttatcattt

SEQ ID NO: 15325 - DNA, 50 bp, homo sapien
aatgaagaaatattggatggtattaraatgagaaatgaaagatttgaaaa

SEQ ID NO: 15326 - DNA, 50 bp, homo sapien
ttttcatcccttaatatactgtaatsaatctacctctaggtaaagagttc

SEQ ID NO: 15327 - DNA, 50 bp, homo sapien
atctgcccttttgtttgcagctttaracatcaaggtgaaaatagttcttt

SEQ ID NO: 15328 - DNA, 50 bp, homo sapien
agactgtatttgcatgtactatacaraaggtggagcacatgccaattatc

SEQ ID NO: 15329 - DNA, 50 bp, homo sapien
gatgctcacatcatgtaggccagaaytcagcgtctggacgcaccaaagtc

SEQ ID NO: 15330 - DNA, 50 bp, homo sapien
cagaatctagcaaaaataatgctccraaatagcagtgagagctgggcaag

SEQ ID NO: 15331 - DNA, 50 bp, homo sapien
tgaagttaaactaaattattcttcayccactggtcagggctataacaatg

SEQ ID NO: 15332 - DNA, 50 bp, homo sapien
actatatttttattgtgtattagtayactttctctttcaaaaatcaagtg

SEQ ID NO: 15333 - DNA, 50 bp, homo sapien
agaatgatcttgatttttacaacaaycttcagaggtgaatatttacagct

SEQ ID NO: 15334 - DNA, 50 bp, homo sapien
ctcatccgtataatacaaataataamaccttcctcattgaaattaaataa

SEQ ID NO: 15335 - DNA, 50 bp, homo sapien
aattagtacttacaacttttctatawacctgagtacaaaattcagagaaa

SEQ ID NO: 15336 - DNA, 50 bp, homo sapien
cctttgtcttctttccaacaaagaartggtttaatccttcaaagcctgag

SEQ ID NO: 15337 - DNA, 50 bp, homo sapien
tgattaatccaaatagaagaaataaytgtcctacttgttaggtactcata

SEQ ID NO: 15338 - DNA, 50 bp, homo sapien
tgagatgtgaataagtcctatgcagyaagtcttcacgcattaaagaaaat

SEQ ID NO: 15339 - DNA, 50 bp, homo sapien
ttcagtgattcattcccaaatgagaygataaaaatagaaccaaagtagtt

SEQ ID NO: 15340 - DNA, 50 bp, homo sapien
tgctgcaaatctgcctggtcctcatyaggctatcttccttctctttgtca

SEQ ID NO: 15341 - DNA, 50 bp, homo sapien
attctaactttgtggttttgttaggyaaagatagagccaatgaatctaga

SEQ ID NO: 15342 - DNA, 50 bp, homo sapien
aatgttcttggtattatattaagacrgcattggatgatttaaaaaaaatc

SEQ ID NO: 15343 - DNA, 50 bp, homo sapien
ccagatgtttgcttgacaaattacarctctgaattcttgatccagtgttt

SEQ ID NO: 15344 - DNA, 50 bp, homo sapien
attgataagctatagagtcttgatgkcaaatgagtatgattcttcctaac

SEQ ID NO: 15345 - DNA, 50 bp, homo sapien
tttgccgagttatctaacatcaaccratttttgagacactgaaacaggta

SEQ ID NO: 15346 - DNA, 50 bp, homo sapien
aacttttatttttaatggaaactcayaatggtgcagcttattggtattaa

SEQ ID NO: 15347 - DNA, 50 bp, homo sapien
gctgtttaaagatattgcctgaagaraacatttagaaagctcttgggttg

SEQ ID NO: 15348 - DNA, 50 bp, homo sapien
aggggacatttctcattcatccaggractactgtgtctgggaggggggtg

SEQ ID NO: 15349 - DNA, 50 bp, homo sapien
acttctattaatcatatttgtttatkaatttcctagatataagtttattt

SEQ ID NO: 15350 - DNA, 50 bp, homo sapien
acgtactctgaaagccatttaaagcratgagagatttaagaaaaataatt

SEQ ID NO: 15351 - DNA, 50 bp, homo sapien
cccataatgacacattattctgacaygaagcgaggtctaagaacttcaat

SEQ ID NO: 15352 - DNA, 50 bp, homo sapien
atccctagggtataaacagaatgcaracaaattatttactaaggcataac

SEQ ID NO: 15353 - DNA, 50 bp, homo sapien
tgagccatataaatgtattttttaayctaagatggcttcttcttatcatt

SEQ ID NO: 15354 - DNA, 50 bp, homo sapien
aaaaaattacacaggtactatccaaytagttgaaagcctctgggaactaa

SEQ ID NO: 15355 - DNA, 50 bp, homo sapien
atgataaagcccgttcaaacttttayatagtaatgaaataaattaaccag

SEQ ID NO: 15356 - DNA, 50 bp, homo sapien
aaaaggcttaccttataactctatawatcttgcaaattttaatttgcata

SEQ ID NO: 15357 - DNA, 50 bp, homo sapien
tttaacttttttaaatcaaacatcartataaaatcagtctgaaaccaaaa

SEQ ID NO: 15358 - DNA, 50 bp, homo sapien
gtcagatatagttgagcaagcaacgragttaggaaaaagtgtggaaagca

SEQ ID NO: 15359 - DNA, 50 bp, homo sapien
gccacagaaaatggatatattttcayggttctcctggatatacttgaaac

SEQ ID NO: 15360 - DNA, 50 bp, homo sapien
cattccaccacacacttttgtctcakgaataagtcagtcagattaacaga

SEQ ID NO: 15361 - DNA, 50 bp, homo sapien
aatatagtccccagccactataaaastctaatgtgaaagttctgggtttt

SEQ ID NO: 15362 - DNA, 50 bp, homo sapien
tcaggaataagtcagtcagattaacrgacccctacctatctagaattatt

SEQ ID NO: 15363 - DNA, 50 bp, homo sapien
ctcctgggtctctagcttgctaaatragacctgtcaacctctgtaatcat

SEQ ID NO: 15364 - DNA, 50 bp, homo sapien
caaccagaaacaaagtatacacctayaaaaatgaattaaattattggagt

SEQ ID NO: 15365 - DNA, 50 bp, homo sapien
ttttatttcactttatctcattttamctcctgatcctaaatgtaggcatt

SEQ ID NO: 15366 - DNA, 50 bp, homo sapien
tgagtcctaaggatgagttttctgastaaaaatggaattatagatggact

SEQ ID NO: 15367 - DNA, 50 bp, homo sapien
ttgcagcttcaacatagagaatctgmagacactaaacttcaacccacaag

SEQ ID NO: 15368 - DNA, 50 bp, homo sapien
tcaaattaactactagttcttctaayactttggacttctcccttgtggta

SEQ ID NO: 15369 - DNA, 50 bp, homo sapien
ttctcctgctccacctttcctagaaygcttcctaatttatccaacgaact

SEQ ID NO: 15370 - DNA, 50 bp, homo sapien
tagtacattgtaagtgtatttaacargcagctatcagtattaaggctgtg

SEQ ID NO: 15371 - DNA, 50 bp, homo sapien
atgtttctcattaagagtcgtaacarcattcttattgttatctgtagtat

SEQ ID NO: 15372 - DNA, 50 bp, homo sapien
acattgctgtttcttaatttatcaawgaaagcaattttaatagactccct

SEQ ID NO: 15373 - DNA, 50 bp, homo sapien
ctatttcattttacacaaaatttgayatcccgttttgactccccatcttt

SEQ ID NO: 15374 - DNA, 50 bp, homo sapien
aagatgctggtttaaatggtctggaytaagtgctgggcattggcacttta

SEQ ID NO: 15375 - DNA, 50 bp, homo sapien
ttgtattgaggcatttatgaaatcawccacgtagagcacttaactctgtg

SEQ ID NO: 15376 - DNA, 50 bp, homo sapien
atgcaaggttagaaatagtatagacratgcaggccataaggcaggataaa

SEQ ID NO: 15377 - DNA, 50 bp, homo sapien
tatattaatgcctgagtgaaatggamatcttatgaaacaatcttgaagag

SEQ ID NO: 15378 - DNA, 50 bp, homo sapien
ctgtgatcttccatctatggtttcarataagttcctgctttgcttcttga

SEQ ID NO: 15379 - DNA, 50 bp, homo sapien
tgagaaagagaggataaaaggtagaygccacaagagaatgtagtattagg

SEQ ID NO: 15380 - DNA, 50 bp, homo sapien
tgatccctgagttaggagaccatcasattcggcaagaggacttacctgtg

SEQ ID NO: 15381 - DNA, 50 bp, homo sapien
tgacttattagaagtaaaggagacayatttgtgcagatgaaacttcctct

SEQ ID NO: 15382 - DNA, 50 bp, homo sapien
tagacattgtagattgctgatatcartaagtaggagtctgatattaataa

SEQ ID NO: 15383 - DNA, 50 bp, homo sapien
aaggagacaatttcatcaggtcttaygggcatctgtaaatatagctaaga

SEQ ID NO: 15384 - DNA, 50 bp, homo sapien
cctatcagggatgcgacaaaattgawactagtgtgcctttccaaagcaat

SEQ ID NO: 15385 - DNA, 50 bp, homo sapien
cccagactcaagaaggattaagtacrctcctcaattaaaagccaaggtag

SEQ ID NO: 15386 - DNA, 50 bp, homo sapien
tttttgctatgaaactagaggagtaytaaccattcccacttgaaaactgg

SEQ ID NO: 15387 - DNA, 50 bp, homo sapien
actacaacaattattaggaaatctcyatgctaatcaaagtataacctaca

SEQ ID NO: 15388 - DNA, 50 bp, homo sapien
aaacttttgtctataattgcaaataygttttatctcattcattttactgt

SEQ ID NO: 15389 - DNA, 50 bp, homo sapien
ctggcattgtgctgattcccaataamgtattttcaaattaaagctcttcc

SEQ ID NO: 15390 - DNA, 50 bp, homo sapien
tcataaatgaactcttcagaaatcartacgaagagactaacattacaagg

SEQ ID NO: 15391 - DNA, 50 bp, homo sapien
gagatacagtctgcatcttgagatakaattgttgcatctgtcttcttatc

SEQ ID NO: 15392 - DNA, 50 bp, homo sapien
accctaatcagatttccagtatgtawcacagacaggtacagaatcactgg

SEQ ID NO: 15393 - DNA, 50 bp, homo sapien
aagcacctcaggcaaagccatcaacrattactttatactgtttacaaagt

SEQ ID NO: 15394 - DNA, 50 bp, homo sapien
cacagaaaggattaatgccacatgartattctcctatgattgtgtagctg

SEQ ID NO: 15395 - DNA, 50 bp, homo sapien
tgaagtcaggaattatggttcagatsaaagttgcagctttcttgtggcac

SEQ ID NO: 15396 - DNA, 50 bp, homo sapien
actttaaagtataaattcatgaaccraattaattatgagatacattaatc

SEQ ID NO: 15397 - DNA, 50 bp, homo sapien
cacagttactgggtttatttgttaaygcaatattcggaaatgttatgaac

SEQ ID NO: 15398 - DNA, 50 bp, homo sapien
ccgagttacaactctggctccaagayggtgtgaaaggagtgatcagacag

SEQ ID NO: 15399 - DNA, 50 bp, homo sapien
aaacagatgtatgattggttctacckaagattacatttctcaattccaac

SEQ ID NO: 15400 - DNA, 50 bp, homo sapien
taccagcataaagtagcacaatttayacacaatctaaagctctaaggaat

SEQ ID NO: 15401 - DNA, 50 bp, homo sapien
agttatatacattatgtgacaactayacaataagtttgttttaatttagt

SEQ ID NO: 15402 - DNA, 50 bp, homo sapien
gctgacatggttatgtttggaacaayaggcatctttacaattacagattt

SEQ ID NO: 15403 - DNA, 50 bp, homo sapien
tgggaagactgttctgggtttacaaygacataatgtatagtcccctcacc

SEQ ID NO: 15404 - DNA, 50 bp, homo sapien
tgtcagccagtggggttctctgtcaycagatggctttgttaatttgcaaa

SEQ ID NO: 15405 - DNA, 50 bp, homo sapien
tttatatcctccttcaagtaatgtaygaaagctctgagactagtatatgt

SEQ ID NO: 15406 - DNA, 50 bp, homo sapien
gtgacttagggcaaattagttaaccrcagttttctaatctgtaaaatggg

SEQ ID NO: 15407 - DNA, 50 bp, homo sapien
taaaatttgtagcaaaattactaaamgtgaacaggctgtttgaggtagca

SEQ ID NO: 15408 - DNA, 50 bp, homo sapien
ccaaaactcaaccatttatttattcmaaagagtcaaaagtctcattaatg

SEQ ID NO: 15409 - DNA, 50 bp, homo sapien
taagtcacatgttaataggtgctatraccaggattcaaatcagtgtaatg

SEQ ID NO: 15410 - DNA, 50 bp, homo sapien
catacctaggtgctgattgggtagcygagacaaaagtaggaattcaaagg

SEQ ID NO: 15411 - DNA, 50 bp, homo sapien
tgagatgataaaacaacaggtggtcratgagttttataaacctatacctg

SEQ ID NO: 15412 - DNA, 50 bp, homo sapien
taagcttctaagatgatgttattaasagtaaaagtaaagaaaacaaacat

SEQ ID NO: 15413 - DNA, 50 bp, homo sapien
caaaatgtaccctctgactaacctcmaatataagcgtgacgtcattttta

SEQ ID NO: 15414 - DNA, 50 bp, homo sapien
gaagcttcctctagattcttaagccrctgctcatggaatctcacatttcc

SEQ ID NO: 15415 - DNA, 50 bp, homo sapien
agtataatcagtcaattcaatcagaraaatttaaagtacaatggtaattt

SEQ ID NO: 15416 - DNA, 50 bp, homo sapien
gaaaacagataaattctaggttataraaggccacggaggactatggaagc

SEQ ID NO: 15417 - DNA, 50 bp, homo sapien
ggggtttgctgaggcttggcctactsagcaagatccactcaagaccctgt

SEQ ID NO: 15418 - DNA, 50 bp, homo sapien
actctctgcttctttccaaatgtcartcctcagaactttctcacacactc

SEQ ID NO: 15419 - DNA, 50 bp, homo sapien
cttccaatgaagagacagaattagakacaagaacagaacaaaaggtttag

SEQ ID NO: 15420 - DNA, 50 bp, homo sapien
ctttgagtttctgaaaaggcttttargatcaaaatttctgaaacactcca

SEQ ID NO: 15421 - DNA, 50 bp, homo sapien
gagggaggtacaaaacaagttaacaygtggataccagcatataatttgtt

SEQ ID NO: 15422 - DNA, 50 bp, homo sapien
ctgtccttagggcaccctattgacartgtatactccaccccttggctgac

SEQ ID NO: 15423 - DNA, 50 bp, homo sapien
cttgctgccaccctacctgagaacartgtacagtaagatctttgtagttg

SEQ ID NO: 15424 - DNA, 50 bp, homo sapien
caatatatacatttctgtgtttggcyaggttctataaggtagagtaaatc

SEQ ID NO: 15425 - DNA, 50 bp, homo sapien
aataacaggtgattgaattacatggraagataatgcatttggatttgaag

SEQ ID NO: 15426 - DNA, 50 bp, homo sapien
tactggcctcatctctcataagcaamcaattatttctaagcttatgtaag

SEQ ID NO: 15427 - DNA, 50 bp, homo sapien
ctttctcaaagatgattcaggttccyaaatgtaaaatgaaaatcattcat

SEQ ID NO: 15428 - DNA, 50 bp, homo sapien
aatgtccaataaaaaatagtctgctsaatttgcaaatttgcaccagagtc

SEQ ID NO: 15429 - DNA, 50 bp, homo sapien
taatataaaatatagtcttatttcckgaatcatggatcacctgaaccaca

SEQ ID NO: 15430 - DNA, 50 bp, homo sapien
atagctgtgtttatctgctaaggaawcttggctctggtttatattcatat

SEQ ID NO: 15431 - DNA, 50 bp, homo sapien
tgtagatgcagtgtgtgattaactawatatgaaactgccaaatagttttc

SEQ ID NO: 15432 - DNA, 50 bp, homo sapien
caatgtgtgaaatgtcatacagagcygagaattagtcttggccgctgctc

SEQ ID NO: 15433 - DNA, 50 bp, homo sapien
tgaaaagaccagtacattatttaaamaaccagagagttatttggtattaa

SEQ ID NO: 15434 - DNA, 50 bp, homo sapien
attcagctgaaaatacttttttgtastaacacattgctttggattaatca

SEQ ID NO: 15435 - DNA, 50 bp, homo sapien
agtgaatgcagccagagactatttamagtggttcagcattcattaactac

SEQ ID NO: 15436 - DNA, 50 bp, homo sapien
ccacagttgttcttatgtgagataawgaaaatcctctggtaaggtacctt

SEQ ID NO: 15437 - DNA, 50 bp, homo sapien
ttcttaatttcactgacttcagcgaygattgcagacttgcagtttaagta

SEQ ID NO: 15438 - DNA, 50 bp, homo sapien
aggaacgtcaaggtcatgggaaataraaggcagttctacacagactgcag

SEQ ID NO: 15439 - DNA, 50 bp, homo sapien
agctacaaagaacacatttcaaacamcttgtgcagttcccttgaacctcc

SEQ ID NO: 15440 - DNA, 50 bp, homo sapien
gaatttagctagagaaaatgaaggaraatagttcagataagaagaatggc

SEQ ID NO: 15441 - DNA, 50 bp, homo sapien
gggaggtctatcggcttcttttgacycttaggataccacttactcaaaca

SEQ ID NO: 15442 - DNA, 50 bp, homo sapien
ctataagatctactcttgtctcacamtgaaaaataagaattcagtaaaga

SEQ ID NO: 15443 - DNA, 50 bp, homo sapien
aagacaacaatgataagtcacagtayggacaacttcaaaaaacaagggtt

SEQ ID NO: 15444 - DNA, 50 bp, homo sapien
ctctgattgaggttggtatagtctcyaaaggtggtaatgccatggtctct

SEQ ID NO: 15445 - DNA, 50 bp, homo sapien
gactctaaggaaggcataataaaaargtcatagggttaacagcaaatgga

SEQ ID NO: 15446 - DNA, 50 bp, homo sapien
caataaagactgatgagatgcagatraaacaactgtgaactataacctct

SEQ ID NO: 15447 - DNA, 50 bp, homo sapien
ggggcagccttttatacagtggaaaygtgggattgaactaaaaacaaaag

SEQ ID NO: 15448 - DNA, 50 bp, homo sapien
ttaaaaagctttaaggttatctcaakctcttaagttgtgaggccattaac

SEQ ID NO: 15449 - DNA, 50 bp, homo sapien
gtaaacgagattgcctgaaatcctaygtagtttatagaacatcatagagc

SEQ ID NO: 15450 - DNA, 50 bp, homo sapien
tgcaggacataccttcatgaatgaamtattattgtggcccacggtaatgg

SEQ ID NO: 15451 - DNA, 50 bp, homo sapien
gaagggaaggagagatgtatgaagasagctaaaagataatatgagtttaa

SEQ ID NO: 15452 - DNA, 50 bp, homo sapien
tttttctaatgacattaatccacaaygctctgggtttccaagaataaaag

SEQ ID NO: 15453 - DNA, 50 bp, homo sapien
gtggtagatgacattatctctagatkaagtttgaagacactgagactaaa

SEQ ID NO: 15454 - DNA, 50 bp, homo sapien
acaaggactactaagcatttgttcaygtatgtcagctcagtgaatgatca

SEQ ID NO: 15455 - DNA, 50 bp, homo sapien
agttttcctcaagtgccttctagaaytgtagaggactgtaagcattcagc

SEQ ID NO: 15456 - DNA, 50 bp, homo sapien
aacaaatgcttagtagtccttgtcaraaaaacagtgcctctctgtagtga

SEQ ID NO: 15457 - DNA, 50 bp, homo sapien
cagagtccaggtgtcaaatggcgaawctgttttgcaagtcagtgcgcata

SEQ ID NO: 15458 - DNA, 50 bp, homo sapien
agctagtgtagaaattacattaagargaacaaatctcattgccaaatata

SEQ ID NO: 15459 - DNA, 50 bp, homo sapien
gtcagggtataaataaactcgagaawgataaatgtcaaggacagtgacag

SEQ ID NO: 15460 - DNA, 50 bp, homo sapien
tgttaggctgccataacgaagtaccrcaaattggcgtcagggggttctgg

SEQ ID NO: 15461 - DNA, 50 bp, homo sapien
tccataggaaataaaggtgagaagargtaaaaaatattgtaccttggggg

SEQ ID NO: 15462 - DNA, 50 bp, homo sapien
tttctagcctttcagcctaacttaastgtatccttgccattttgagtaaa

SEQ ID NO: 15463 - DNA, 50 bp, homo sapien
gtactatgctgtttaatataagaacragcagtggtgaatacgtaattttc

SEQ ID NO: 15464 - DNA, 50 bp, homo sapien
gagcagcctgctctctcgtagggcarctcttcagagattgtgtttcatga

SEQ ID NO: 15465 - DNA, 50 bp, homo sapien
gagtgccaaaatgtaaaccagcctayaaatttctcaggagccaatcaaaa

SEQ ID NO: 15466 - DNA, 50 bp, homo sapien
gactaagtatctaatgataggaggaktcccgcgcttgagctgctactaaa

SEQ ID NO: 15467 - DNA, 50 bp, homo sapien
tggagagtagctgagtgcaggtacasagtagatgagaattagatttaaca

SEQ ID NO: 15468 - DNA, 50 bp, homo sapien
aggacaggcttcatttgttccgtcaycgttctgttatggcttttatctgt

SEQ ID NO: 15469 - DNA, 50 bp, homo sapien
tcagtgctgtcctaaagctagtttcraaattatggaaaggtttctgaaac

SEQ ID NO: 15470 - DNA, 50 bp, homo sapien
tgaattcaacatcctgggattctagyctaagcagtagagcctgtgatcaa

SEQ ID NO: 15471 - DNA, 50 bp, homo sapien
tgcagggcggaggatagaatgcaaaygaagggttgtccttccagttatcc

SEQ ID NO: 15472 - DNA, 50 bp, homo sapien
ctgcagttaaccctctcgtaaataayggcagggacaacactaaaagtacc

SEQ ID NO: 15473 - DNA, 50 bp, homo sapien
tactgacatacttcctaggttcaccraaacccacacatggcccacaggta

SEQ ID NO: 15474 - DNA, 50 bp, homo sapien
accctcctgccttttttgtttccaartgtcattcacaaaatagacaaaaa

SEQ ID NO: 15475 - DNA, 50 bp, homo sapien
gggttttctccaatttctctgttaayttaaaatgaagcaaccagaacaag

SEQ ID NO: 15476 - DNA, 50 bp, homo sapien
agcaaaagtacataaaatggattacrggaagaacaagaaccaacggcaag

SEQ ID NO: 15477 - DNA, 50 bp, homo sapien
acaccccttccttaccaactaagccrgagattttgtgttaatcatgccca

SEQ ID NO: 15478 - DNA, 50 bp, homo sapien
tgtcatctaataatcctagtaattayagaaaatacggcaaactcatccta

SEQ ID NO: 15479 - DNA, 50 bp, homo sapien
ctttctagtaagctagattgaacaamcaggcatcccaggaagaggcagag

SEQ ID NO: 15480 - DNA, 50 bp, homo sapien
taaaataaattgttggcccagaatastacacccatgaaaatatatctttc

SEQ ID NO: 15481 - DNA, 50 bp, homo sapien
tattatgtttttttttcagtagtgtkaattaatccttttgtgctgtgttt

SEQ ID NO: 15482 - DNA, 50 bp, homo sapien
caaagcactgagtcatccaacactcratcacatatggctctgcttcgcct

SEQ ID NO: 15483 - DNA, 50 bp, homo sapien
ctaaaaaagcttttcatctgatccaygacccactttgcttcctgtacttc

SEQ ID NO: 15484 - DNA, 50 bp, homo sapien
aattagaattgggaatcactaatacraattttaagtttgttgaaaattat

SEQ ID NO: 15485 - DNA, 50 bp, homo sapien
atagcctatcatccaacttgccttaraagtaaataacaattgccttttgc

SEQ ID NO: 15486 - DNA, 50 bp, homo sapien
aacagaccaggttttgataccagaaraactgcatggtgtctatgatgtta

SEQ ID NO: 15487 - DNA, 50 bp, homo sapien
tgggggtcaaaatggacattgccaasgtcaaatgaggggagtgaggaggc

SEQ ID NO: 15488 - DNA, 50 bp, homo sapien
tgttctctggatcttatcaattataraagttagcccaccagaaatatttg

SEQ ID NO: 15489 - DNA, 50 bp, homo sapien
tctgggaaagagacaatttacctacrgactaccaataccttctatatatg

SEQ ID NO: 15490 - DNA, 50 bp, homo sapien
attattttaaagtatctgctgattaygaaatgcaaaacaatgataataac

SEQ ID NO: 15491 - DNA, 50 bp, homo sapien
gatgaggatattttgaagattaccaygaaagaatacaaccacaaagataa

SEQ ID NO: 15492 - DNA, 50 bp, homo sapien
aacatttcaccttaagtgatttgtargtatcctgccatcttgaatccttt

SEQ ID NO: 15493 - DNA, 50 bp, homo sapien
acaagtgcttcttcctgaggctcaartgtctaggcagctgatcactggct

SEQ ID NO: 15494 - DNA, 50 bp, homo sapien
tattacttgccacttcctgccagcartctaccaattcattagcagagagt

SEQ ID NO: 15495 - DNA, 50 bp, homo sapien
taagtgcatgccagtcacaggtataytaaattgtcttagccctcttgcat

SEQ ID NO: 15496 - DNA, 50 bp, homo sapien
cttccagctattactaactagtgacraacatctccaaccactgtaggcaa

SEQ ID NO: 15497 - DNA, 50 bp, homo sapien
aatgttcatggactgacttgtttcayaatgctgagtctaaagtcaactgt

SEQ ID NO: 15498 - DNA, 50 bp, homo sapien
taattctgcttaacgtgttttataargccaacataaccttcatacccaaa

SEQ ID NO: 15499 - DNA, 50 bp, homo sapien
atagttttggtttactctagtcttaygtgcaagtgtgaatattgagtttt

SEQ ID NO: 15500 - DNA, 50 bp, homo sapien
tgtccacattaaagtttgacatctayggagctagacaagggagtaataca

SEQ ID NO: 15501 - DNA, 50 bp, homo sapien
cctgatctccttgttgcattccgcayacatattctcaactcttcctgaat

SEQ ID NO: 15502 - DNA, 50 bp, homo sapien
ttcatcagttctccctagccactcartccaggttttaatatagctggaat

SEQ ID NO: 15503 - DNA, 50 bp, homo sapien
tgctttgctttagagctgttacttckctgaaaataaaaagatctccaaag

SEQ ID NO: 15504 - DNA, 50 bp, homo sapien
ccttcacatctcttaaaaaaagatascacatcaacatttgtttgtgaaaa

SEQ ID NO: 15505 - DNA, 50 bp, homo sapien
cctgtcaccgctgctcgggcgattawgctccgtggcagcagccatgatat

SEQ ID NO: 15506 - DNA, 50 bp, homo sapien
cttgaacatatcttttggcgggcctwagcatttatttattttgatacata

SEQ ID NO: 15507 - DNA, 50 bp, homo sapien
tgtaggggaaggagagaatcttgaawtgacagactatttattcagtgaaa

SEQ ID NO: 15508 - DNA, 50 bp, homo sapien
ttactttagattatcatgtttagatyatcacgggagacatttggggtgta

SEQ ID NO: 15509 - DNA, 50 bp, homo sapien
gttaacccggttacttttgatttacrctgtttcactgaataaatagtctg

SEQ ID NO: 15510 - DNA, 50 bp, homo sapien
aacaatacattatgtacaccatttayaggagggtaacacaaaccttgaca

SEQ ID NO: 15511 - DNA, 50 bp, homo sapien
aagtcaccagatatgaagcagattayagagaacaaaggtaagtcccaaat

SEQ ID NO: 15512 - DNA, 50 bp, homo sapien
aaaagcttttcttatttacaaaagcractaatttgacactgacagtagtt

SEQ ID NO: 15513 - DNA, 50 bp, homo sapien
gtgactcaagtgtccaaaagaaaacygcttatatttgcagactaaaacct

SEQ ID NO: 15514 - DNA, 50 bp, homo sapien
tgaaaagccaaaaggattacggaaaratgattatagctagagagttctgc

SEQ ID NO: 15515 - DNA, 50 bp, homo sapien
acttaagtataaatgcaatcatacamtatttgtttttttgtgactggctt

SEQ ID NO: 15516 - DNA, 50 bp, homo sapien
cgaaaactctgaacaccaagacaccyatgagtttcctggctggcaatact

SEQ ID NO: 15517 - DNA, 50 bp, homo sapien
cttgttctttcttgaggaacataaaygagtctctcaacttctattgtttc

SEQ ID NO: 15518 - DNA, 50 bp, homo sapien
taattggacccatttgagagaaagamacattgaggagaaaaaccagaatg

SEQ ID NO: 15519 - DNA, 50 bp, homo sapien
tgctgaattgaaatgagaatatgaaycaaacattaagacttatttttcta

SEQ ID NO: 15520 - DNA, 50 bp, homo sapien
tgccgaaaataagcccggagactaasgcaccttgtagggaagagaaggac

SEQ ID NO: 15521 - DNA, 50 bp, homo sapien
tctcagtgcctcccagaaaattccaygatagataaaaataatgtctaggt

SEQ ID NO: 15522 - DNA, 50 bp, homo sapien
gactttgaagagagtcgggcctgaamctagtctgccatcttactttgctt

SEQ ID NO: 15523 - DNA, 50 bp, homo sapien
agttaccaatatttatcgaccatcargtatgccaaatcagaataatacaa

SEQ ID NO: 15524 - DNA, 50 bp, homo sapien
tataactaatacaaaatgtactttgkaacttgtcgccagatatttttttc

SEQ ID NO: 15525 - DNA, 50 bp, homo sapien
tttgtgaacagccatctcaaccctayaaggcatgtgaggattttaagtga

SEQ ID NO: 15526 - DNA, 50 bp, homo sapien
ttacagtgtattttcatgtgtaccartgaaattactgtgttaatgtatca

SEQ ID NO: 15527 - DNA, 50 bp, homo sapien
agttatgtgttgtttcaaagataaayttctgtcatctgagtatcagatcc

SEQ ID NO: 15528 - DNA, 50 bp, homo sapien
aattgtatctcacttattactggcasaggatctgatactcagatgacaga

SEQ ID NO: 15529 - DNA, 50 bp, homo sapien
tggtgttcctgaggaatatgataaayctagaagtttggaaaacatatttg

SEQ ID NO: 15530 - DNA, 50 bp, homo sapien
ccaaatggcttgcttatttttatcaygtcaattgcttttctatagtaaag

SEQ ID NO: 15531 - DNA, 50 bp, homo sapien
cctactataaactcagaatggactargcacttaaaaaaagccaaattaaa

SEQ ID NO: 15532 - DNA, 50 bp, homo sapien
tgcaactgccttccctgctgactatragattcttaatgacatggaccttg

SEQ ID NO: 15533 - DNA, 50 bp, homo sapien
accgtattgagcacagattaaactgraatggactttagcattgtttagca

SEQ ID NO: 15534 - DNA, 50 bp, homo sapien
ctccatccaccaggagactctagagraaccgcaaaagcgcactccaggaa

SEQ ID NO: 15535 - DNA, 50 bp, homo sapien
gaggaagagaatatgcaatttgaccsaagttaacctcagtaccattcctc

SEQ ID NO: 15536 - DNA, 50 bp, homo sapien
caaaacattattttctccataagtcrctttaaaaagctaacagagaactt

SEQ ID NO: 15537 - DNA, 50 bp, homo sapien
gggacttctggattgatcattttgayagaaatggctggtcaactcctagt

SEQ ID NO: 15538 - DNA, 50 bp, homo sapien
gggtctggacccaactatagaaagcraaaacagggattggtcataacagt

SEQ ID NO: 15539 - DNA, 50 bp, homo sapien
ccattttgtcaagaaagaatagagcragcactataaacatttaccgtttt

SEQ ID NO: 15540 - DNA, 50 bp, homo sapien
tgggaactcgggatgcgaagctgacraggatccagtccactgggcgaggc

SEQ ID NO: 15541 - DNA, 50 bp, homo sapien
tcagttagtattgtattagtatggcyaggttctacatatttggatttata

SEQ ID NO: 15542 - DNA, 50 bp, homo sapien
actgcatgtatgtcaggcagggataycatgtgtcgctcacgaattaagcc

SEQ ID NO: 15543 - DNA, 50 bp, homo sapien
gaaaaataaattaaagaggatggaayaaataattggatcaagttagaaaa

SEQ ID NO: 15544 - DNA, 50 bp, homo sapien
tgaggtcctcttggagctcctggtastaagagaggtgagaggcaaatcct

SEQ ID NO: 15545 - DNA, 50 bp, homo sapien
tgatcttgccttatttgttctcctayaacgtgtatgcatgaggagccccc

SEQ ID NO: 15546 - DNA, 50 bp, homo sapien
tgcatttaagatgacctggagaatakacagcatactccgtagttattgag

SEQ ID NO: 15547 - DNA, 50 bp, homo sapien
tgtagcatttatggtaacagctgtayggttaaactttaggcacaaactga

SEQ ID NO: 15548 - DNA, 50 bp, homo sapien
cgtgagatactgctccttttgtaaaygttaaaagccacaaatcttttttt

SEQ ID NO: 15549 - DNA, 50 bp, homo sapien
tgtattaagtagagatactatactaytagcctttgctgcatgtatataca

SEQ ID NO: 15550 - DNA, 50 bp, homo sapien
ctagcataagattaatctttaaaagwctgcaaccaccagtaggagcagta

SEQ ID NO: 15551 - DNA, 50 bp, homo sapien
attatgttttttagcagtcaggtcamtataagtttctataaatacaatat

SEQ ID NO: 15552 - DNA, 50 bp, homo sapien
acagggagaaggttcatgcgcacackgatacctggcagggatggaactgg

SEQ ID NO: 15553 - DNA, 50 bp, homo sapien
ttatctataactggagattcagtgcsaaccaaataaatacaatccctcct

SEQ ID NO: 15554 - DNA, 50 bp, homo sapien
ttagctcctagtaagtagtcagcaamttattgccttaaacttcctaatac

SEQ ID NO: 15555 - DNA, 50 bp, homo sapien
gccctgtgtcctgtctgtaagttcayattgtacttgagctagtatgtgtg

SEQ ID NO: 15556 - DNA, 50 bp, homo sapien
cacagcggtctgccagaaacagcgasacataagagtgccctgggcctagc

SEQ ID NO: 15557 - DNA, 50 bp, homo sapien
atttctaatgtataatcactggacaytggagtagacacatatttttagca

SEQ ID NO: 15558 - DNA, 50 bp, homo sapien
ctccctcctaactctgaatattaacmatcctcccagaagacaccgttagc

SEQ ID NO: 15559 - DNA, 50 bp, homo sapien
aattactgatatttggaaatttctargagtatgtcacttagaaatgaata

SEQ ID NO: 15560 - DNA, 50 bp, homo sapien
aaagtacttgttaagtgaaggcataytataaattactgatatttggaaat

SEQ ID NO: 15561 - DNA, 50 bp, homo sapien
ttactattaagattatcatgtttgawcacaaattcaagatgtctttaaat

SEQ ID NO: 15562 - DNA, 50 bp, homo sapien
cattttaatacttttcaaatagtcayctactctgttcatgaattatagtg

SEQ ID NO: 15563 - DNA, 50 bp, homo sapien
tgctaaaaaatactctttatctaaarttctgaagacagaagaatgaagtc

SEQ ID NO: 15564 - DNA, 50 bp, homo sapien
agagctttttagcataactcggagcrcataggcaatcaagaaaacattgg

SEQ ID NO: 15565 - DNA, 50 bp, homo sapien
gtgtcattcaccgtgtgtgtccaaaygtcttctttttatatagaaacagt

SEQ ID NO: 15566 - DNA, 50 bp, homo sapien
aagtcacagggcagaagctgtgcacrcggaagaggtatgcaacttattgt

SEQ ID NO: 15567 - DNA, 50 bp, homo sapien
acacaatgacccactcaaactatgarataggtatcactcagatcaggtga

SEQ ID NO: 15568 - DNA, 50 bp, homo sapien
ctataaatggtacttaggacctttamcctcaaggacaccaaagcttgtaa

SEQ ID NO: 15569 - DNA, 50 bp, homo sapien
tggaaaccttcaaacacggtttacayggattacctcatttaagtcttaca

SEQ ID NO: 15570 - DNA, 50 bp, homo sapien
tcccctaatctgctttccatactacyggatgcttgcattggtgtctaaaa

SEQ ID NO: 15571 - DNA, 50 bp, homo sapien
tgaattgttgatatttgactttcaayacagttactggttcacaaaaaacc

SEQ ID NO: 15572 - DNA, 50 bp, homo sapien
tgcaacatgctaccttctcaagtgawatctgtgaggatctgatgccagtg

SEQ ID NO: 15573 - DNA, 50 bp, homo sapien
gattaattaacaagcatgttccatamgaaaggtttggaataagatcttca

SEQ ID NO: 15574 - DNA, 50 bp, homo sapien
tcccactggcccacccatcatggaakaatgcatcatgactttgctaggtt

SEQ ID NO: 15575 - DNA, 50 bp, homo sapien
ctctggtgatgtggtacctaaatgcyctacgttgataatataaaccttta

SEQ ID NO: 15576 - DNA, 50 bp, homo sapien
tataagtaatctggagatgatttgargtatagaagtggatatgagttagg

SEQ ID NO: 15577 - DNA, 50 bp, homo sapien
ggaagatccagccaatgacttgatargacaataggaagatttcagagtcc

SEQ ID NO: 15578 - DNA, 50 bp, homo sapien
tcatatatagagatttacaaagatamcaatatgctacaaaaaatgcaaga

SEQ ID NO: 15579 - DNA, 50 bp, homo sapien
ttaagctcactgaaagtttaaattgyagtagctctgtaggaaatataaat

SEQ ID NO: 15580 - DNA, 50 bp, homo sapien
aagtactcccaacaccatttatgtakaatttatcacagcagtgatacgca

SEQ ID NO: 15581 - DNA, 50 bp, homo sapien
cccgtggatacgtatctgccatatasagacatcattatgaacatccttct

SEQ ID NO: 15582 - DNA, 50 bp, homo sapien
ctggaaatgctgaagggacagcccawtagagtataaaattgtaggtttgc

SEQ ID NO: 15583 - DNA, 50 bp, homo sapien
gattagttatctatgttgtgtaaaaractaccctgaatcttagtggttta

SEQ ID NO: 15584 - DNA, 50 bp, homo sapien
aataagaaaattcattctcttaacgraaataatcatctttgctttactga

SEQ ID NO: 15585 - DNA, 50 bp, homo sapien
cctaattacatacaattccttggtamacaatatgatacaggatatttttt

SEQ ID NO: 15586 - DNA, 50 bp, homo sapien
atattgccactgactgtgacatctaygttaaagttggaaaataggtgcta

SEQ ID NO: 15587 - DNA, 50 bp, homo sapien
acccaggtcttcctaagctgccaaartataagcctctctagtcatcccac

SEQ ID NO: 15588 - DNA, 50 bp, homo sapien
aacatatttgcaaaattattaaataygaaagtgggtggtagtttggttat

SEQ ID NO: 15589 - DNA, 50 bp, homo sapien
gctgatttttgtttcagaggttaccrggaaaataattacaccagtctgac

SEQ ID NO: 15590 - DNA, 50 bp, homo sapien
taaagtgaccatataactcatctagsctacaactagtatcagttcctttt

SEQ ID NO: 15591 - DNA, 50 bp, homo sapien
caagactctgtcacccaggaaaccasgtaatatcatggaaaattgtgcag

SEQ ID NO: 15592 - DNA, 50 bp, homo sapien
ctctcctggtttttcctatctcctcyaagttaaaggttttgagagcttgt

SEQ ID NO: 15593 - DNA, 50 bp, homo sapien
aagcttaggtaatagggaatatccartaagagatccagaccatggagcta

SEQ ID NO: 15594 - DNA, 50 bp, homo sapien
tagatcatccatctatattatactgmaacttgcaaaagcagtgatttcta

SEQ ID NO: 15595 - DNA, 50 bp, homo sapien
aaagcttaaaaagagaggcattccaractccaagtaaggatttctattat

SEQ ID NO: 15596 - DNA, 50 bp, homo sapien
attttaagtaattttccttttgtcaytaagagtagtttagttttgctata

SEQ ID NO: 15597 - DNA, 50 bp, homo sapien
tgctgggaaatgtatctggcttaagkaggaaattaaatgaaaattgcaat

SEQ ID NO: 15598 - DNA, 50 bp, homo sapien
gggcatatgagttttatgaattagayacaagttactgcaactaaaagaag

SEQ ID NO: 15599 - DNA, 50 bp, homo sapien
catgtgattactaaatttctgaaaarggaggttattattaatcatgtaat

SEQ ID NO: 15600 - DNA, 50 bp, homo sapien
catgttggtgaattggcagacataarcgaactcatatactattggtggga

SEQ ID NO: 15601 - DNA, 50 bp, homo sapien
tctttttgaaatggtgggaagactcyattaataattacaattcaacatgt

SEQ ID NO: 15602 - DNA, 50 bp, homo sapien
ttaatcattcagtgttgatgtgcaarcataaccaaactataacagaattt

SEQ ID NO: 15603 - DNA, 50 bp, homo sapien
atagcaggagaatcaaccggaactcrgaggtattggagtgagagtataaa

SEQ ID NO: 15604 - DNA, 50 bp, homo sapien
gctttattgaatagccttgttaaaawttacttattaatactaacttgtgc

SEQ ID NO: 15605 - DNA, 50 bp, homo sapien
ttgctctcctttaatctttgctaaakgttgaattctgttaactaaaaaga

SEQ ID NO: 15606 - DNA, 50 bp, homo sapien
tgaaattaaaatgtggtccaacatamacaactagtcaatacttaggtctt

SEQ ID NO: 15607 - DNA, 50 bp, homo sapien
cgagagactacaggcaatcatctcasaattttactgctggaaggatacgg

SEQ ID NO: 15608 - DNA, 50 bp, homo sapien
agtctttggagcataaacaaatgaaycttttcaccagaacatattgtcaa

SEQ ID NO: 15609 - DNA, 50 bp, homo sapien
ttctcagattataggaaatggaaacrgcatgtttttgttgtgtgtctgct

SEQ ID NO: 15610 - DNA, 50 bp, homo sapien
aatattaataagtggaacatgataamtatgactggtatgcatcattaata

SEQ ID NO: 15611 - DNA, 50 bp, homo sapien
agaaaaagaacaataaatgtaaagamgtagcaattcaaaaacaatatgta

SEQ ID NO: 15612 - DNA, 50 bp, homo sapien
gcttttgggaagaggtgacaaataakgtgtttacttagttagcaaagagg

SEQ ID NO: 15613 - DNA, 50 bp, homo sapien
attcttataccttgtcccttatagasagatactggtagctacattctcta

SEQ ID NO: 15614 - DNA, 50 bp, homo sapien
actatttaatgttacactttgactayaaacttatctttctccttacaagc

SEQ ID NO: 15615 - DNA, 50 bp, homo sapien
ggccaaggaaaggccttgatatccartgagtcaaatgaaaaataaaagta

SEQ ID NO: 15616 - DNA, 50 bp, homo sapien
gcattttgatacacattacaaacctsaatccactatttctgacccctaag

SEQ ID NO: 15617 - DNA, 50 bp, homo sapien
taaagagtaattattgaaatcaaagmctaaactgagtgcattggcaatga

SEQ ID NO: 15618 - DNA, 50 bp, homo sapien
tgctgcagccttattaatctgataasaggtctacagttgtaaactggaac

SEQ ID NO: 15619 - DNA, 50 bp, homo sapien
taatattttttgattccaaagccatraaatatacttgaagaggggataca

SEQ ID NO: 15620 - DNA, 50 bp, homo sapien
aaatatgtgcaaggttttataaaggyccttcacaaaagcaggagatgtaa

SEQ ID NO: 15621 - DNA, 50 bp, homo sapien
attattctaaagtgctaccgggagasaaatgtaaatattgcactgggtag

SEQ ID NO: 15622 - DNA, 50 bp, homo sapien
ccactttttagtaaatctgaccgaawattttgatcacctgctgttttatt

SEQ ID NO: 15623 - DNA, 50 bp, homo sapien
atttttgttttaatttgacactttaygtttaatcatgtgaataaatccac

SEQ ID NO: 15624 - DNA, 50 bp, homo sapien
ctatgaggctgtaaatatgcagagasagacttgaaatagccatgcagaaa

SEQ ID NO: 15625 - DNA, 50 bp, homo sapien
gttctaatatatttaaatgatacaakaatcttcactaactacatttctct

SEQ ID NO: 15626 - DNA, 50 bp, homo sapien
tccccagatacttatatgaatcatcmaggttagaactgtttttttctgga

SEQ ID NO: 15627 - DNA, 50 bp, homo sapien
taaagagaccagtaacaaatatagaraggcatgtatactagcatatataa

SEQ ID NO: 15628 - DNA, 50 bp, homo sapien
aagaaaacatttgagttgcaaatacygtattaaaagtggacactgcttat

SEQ ID NO: 15629 - DNA, 50 bp, homo sapien
agaggttgcatctgtagactagggawgtatgtggtcagagtttagggaaa

SEQ ID NO: 15630 - DNA, 50 bp, homo sapien
aaaatgagagcacacactacttcaaracagtgttaatcaagacagtgtag

SEQ ID NO: 15631 - DNA, 50 bp, homo sapien
ggatgagaaagaaaatggagatatayggaaacaagaaaattgcaacagaa

SEQ ID NO: 15632 - DNA, 50 bp, homo sapien
ttagtggaggtgttcatgagaagaaytgacagctctagaggtttttatag

SEQ ID NO: 15633 - DNA, 50 bp, homo sapien
atgctacaaacgctgataagctatawcgaaatttagtctaaaaggacctt

SEQ ID NO: 15634 - DNA, 50 bp, homo sapien
agctattgtagcatgagaaaattgaytattcttgaacttccctcaaaatc

SEQ ID NO: 15635 - DNA, 50 bp, homo sapien
gtatgattgaaggtgcaggtaccacyattgtgcttggccttgcaccttga

SEQ ID NO: 15636 - DNA, 50 bp, homo sapien
taatattgctttggctaggactcttraaaaaatggccaaaattaaaatat

SEQ ID NO: 15637 - DNA, 50 bp, homo sapien
gattttattggagtcagccaaactcygagttgttgtaccaaaaaaatttc

SEQ ID NO: 15638 - DNA, 50 bp, homo sapien
gccaataactagccaagagattgaaycatagtaaaaagtttgccatgaaa

SEQ ID NO: 15639 - DNA, 50 bp, homo sapien
cagacttgatctatgatattaactcratctttcagtctattttatgtgtt

SEQ ID NO: 15640 - DNA, 50 bp, homo sapien
tttggaagtaagttattttgccatastaagtacacagattctcatcgatg

SEQ ID NO: 15641 - DNA, 50 bp, homo sapien
caaattatatattaaaatgtaagaarggcaaaagaaacaataaaacctca

SEQ ID NO: 15642 - DNA, 50 bp, homo sapien
taactttaaacctagagaagcaaaakaataatccgatatttaataaccaa

SEQ ID NO: 15643 - DNA, 50 bp, homo sapien
gattattcttttgcttctctaggttkaaagttatttacatttgatatttg

SEQ ID NO: 15644 - DNA, 50 bp, homo sapien
gtaatctgatatctgggagcgagtasagaacaaagaaataagtaatggtt

SEQ ID NO: 15645 - DNA, 50 bp, homo sapien
tatgagtactttctctgaaaataccraatcctctaacaataattgttgtc

SEQ ID NO: 15646 - DNA, 50 bp, homo sapien
actcagaaccacattacttaaaatgmaaatgtttagtgtcacataaggtg

SEQ ID NO: 15647 - DNA, 50 bp, homo sapien
acaggtggtgaaaataatgttgatamaatgaaagactttatatccacaag

SEQ ID NO: 15648 - DNA, 50 bp, homo sapien
ccttctggggaggttaagagtagcaygaagaatttaagatgacaacaaga

SEQ ID NO: 15649 - DNA, 50 bp, homo sapien
tgattcagtcttgatatgtggtataygtttaggaatttatctatttcttc

SEQ ID NO: 15650 - DNA, 50 bp, homo sapien
gacaaaaagcatggttatcacagtcyactaccattcattacttggctact

SEQ ID NO: 15651 - DNA, 50 bp, homo sapien
ccaacacaggaaaaagaagagaagaygaatggagagagagtaagtggcct

SEQ ID NO: 15652 - DNA, 50 bp, homo sapien
tgtcatttttattataacattgttascttaaattatgtcaggttttattt

SEQ ID NO: 15653 - DNA, 50 bp, homo sapien
ataaaatggagatgaagaagtttcarcatcgggaccataattcaattctc

SEQ ID NO: 15654 - DNA, 50 bp, homo sapien
tgggaagtcacctcactggtttcacrcttcattagccagagcaactactt

SEQ ID NO: 15655 - DNA, 50 bp, homo sapien
acagcttagaaatatagaggacaaasctacctctggctagatggatgcca

SEQ ID NO: 15656 - DNA, 50 bp, homo sapien
ggcatctagaaagagaaataacataygtaaaggcacatgaatggaaattt

SEQ ID NO: 15657 - DNA, 50 bp, homo sapien
ctccaggaacacctttttctccaccrcaattgtaatcagtagttaggaga

SEQ ID NO: 15658 - DNA, 50 bp, homo sapien
attcatatctatatgtacacccagaytatacaacatttgtcaggaagcct

SEQ ID NO: 15659 - DNA, 50 bp, homo sapien
tttttccctcctctaaaatataatcrcattaaaaacacttgccaaaggtg

SEQ ID NO: 15660 - DNA, 50 bp, homo sapien
tattcatcccatacacttttcctagsagcctgtgagagtgctgcactatc

SEQ ID NO: 15661 - DNA, 50 bp, homo sapien
ctctcctttgatttatggaaacatcrcctccagcacagttcaacacagga

SEQ ID NO: 15662 - DNA, 50 bp, homo sapien
atgtgggttgggagacactgtgtggycatctttgaaaacaaaatctgcca

SEQ ID NO: 15663 - DNA, 50 bp, homo sapien
aaaatctataacttatttgtcttacrcattataagtttaattacataatg

SEQ ID NO: 15664 - DNA, 50 bp, homo sapien
gggaactttggtgggaatagcttcawgccaggaaatagctttacagtggc

SEQ ID NO: 15665 - DNA, 50 bp, homo sapien
taatttcttctgcctcgcttctcaamctatttaaataagactgtgcatat

SEQ ID NO: 15666 - DNA, 50 bp, homo sapien
aaattgtcctcctatagctgagatakgccatctgaaaatgctagcatgca

SEQ ID NO: 15667 - DNA, 50 bp, homo sapien
agtcatctctaaatatttaatactgwatgatactcctaaattgtcctcct

SEQ ID NO: 15668 - DNA, 50 bp, homo sapien
tctatgtactcatgttttgataaggraaataaaatattcccagtattctt

SEQ ID NO: 15669 - DNA, 50 bp, homo sapien
tagaacaaacagcctgtttcacattwaatattattaactgcatgatccct

SEQ ID NO: 15670 - DNA, 50 bp, homo sapien
tgattattttaataggctgtactaawccattttatatttgaaataaataa

SEQ ID NO: 15671 - DNA, 50 bp, homo sapien
agagtaataggattctacattatcayaactttggtggatcctttcagggg

SEQ ID NO: 15672 - DNA, 50 bp, homo sapien
ttaattaaaaagccatggatgtattmaataatggattaaatgtttttcat

SEQ ID NO: 15673 - DNA, 50 bp, homo sapien
tagaactgtctcccaagaagttggawctcaaaggattatatctgtagggt

SEQ ID NO: 15674 - DNA, 50 bp, homo sapien
acctagtctcaggaattgtggtatarcagcataaaatgaaccaagacacc

SEQ ID NO: 15675 - DNA, 50 bp, homo sapien
tcaagagagaaaaatatgaaaagtcrgaaacatctttcaaaatataataa

SEQ ID NO: 15676 - DNA, 50 bp, homo sapien
ttggaattcaaaagttttatcacacrgctaactgtcctgatgataccaga

SEQ ID NO: 15677 - DNA, 50 bp, homo sapien
agcaataatcattattatgataaaaygttgtgtattacagaaataaccac

SEQ ID NO: 15678 - DNA, 50 bp, homo sapien
ttctttccaattaatttttgttgacygattaaccatcctcacgccacacc

SEQ ID NO: 15679 - DNA, 50 bp, homo sapien
tcagtttccagatcttgctatgaaaraataagtttgacaaaagagcaagt

SEQ ID NO: 15680 - DNA, 50 bp, homo sapien
aaatttgtattttattatctatctgkatctaggagccttactataaatta

SEQ ID NO: 15681 - DNA, 50 bp, homo sapien
cctttcctcgggtcatcttttcaaartcatatgccttcccctagtagttt

SEQ ID NO: 15682 - DNA, 50 bp, homo sapien
aatcctaaatgctgagaagagtagayattaggcattcaacagcagatgca

SEQ ID NO: 15683 - DNA, 50 bp, homo sapien
cagttttttaatgaggactccactgraacactaaaaaactagtagtagat

SEQ ID NO: 15684 - DNA, 50 bp, homo sapien
gaaagaaaacatatcttaagatacawctgtcttggtagagtccataattt

SEQ ID NO: 15685 - DNA, 50 bp, homo sapien
taccccacagcccgataggccctaaractcacactttgcaatgaacttgg

SEQ ID NO: 15686 - DNA, 50 bp, homo sapien
ctgtaaagaaagccaaattttcatamagagagatagatataggattcaca

SEQ ID NO: 15687 - DNA, 50 bp, homo sapien
acatctggacacttggatacttaacygagataggcaaaatgccagtagga

SEQ ID NO: 15688 - DNA, 50 bp, homo sapien
tgttgttttatgctgctaagttttasagatgatatgttttctatttagca

SEQ ID NO: 15689 - DNA, 50 bp, homo sapien
catccagaccatgccagcctaaataratatacagctgatttaaaatacca

SEQ ID NO: 15690 - DNA, 50 bp, homo sapien
cctgttaggaaaacttcgactgtaaytgaagatttgctctaagcttaatg

SEQ ID NO: 15691 - DNA, 50 bp, homo sapien
gcttatagaatgcctgagattttcasaatcaggttgaatgagggacctaa

SEQ ID NO: 15692 - DNA, 50 bp, homo sapien
tactcttataaaaactatccattccygagcaaacgtattctcaggaatac

SEQ ID NO: 15693 - DNA, 50 bp, homo sapien
ggacggattctcagagagagtaaaawagccatgagattcatacaaaataa

SEQ ID NO: 15694 - DNA, 50 bp, homo sapien
tatctttgcattaataggcatactarattcaaatgcaaaataactatctt

SEQ ID NO: 15695 - DNA, 50 bp, homo sapien
tcagcttcttattctacgataccaasacaggttttcaatgtttgtttgtt

SEQ ID NO: 15696 - DNA, 50 bp, homo sapien
agtcttggagtccatgattttaacaytatattgtgatgctttcagtgtaa

SEQ ID NO: 15697 - DNA, 50 bp, homo sapien
tatccacctaaatatcatttttaaawttctgacttacttgatttgattat

SEQ ID NO: 15698 - DNA, 50 bp, homo sapien
gcataactacattccacgatggacayaactaggccagacatatagtctct

SEQ ID NO: 15699 - DNA, 50 bp, homo sapien
tttttcagtcattatattttgaataygatatgcctaaaagaagaaaaatg

SEQ ID NO: 15700 - DNA, 50 bp, homo sapien
taagttatgaaattatacacatgtgsaaatagagtacttttattatttta

SEQ ID NO: 15701 - DNA, 50 bp, homo sapien
gaaaagtgaaatagtctgcacttccrcacaatatgtctttccttcctgtc

SEQ ID NO: 15702 - DNA, 50 bp, homo sapien
attatataagagactttgacaagacratctaacatctaggatatttcata

SEQ ID NO: 15703 - DNA, 50 bp, homo sapien
tcagttttaatgggattctatgcaastcattgtggtagataaataccaga

SEQ ID NO: 15704 - DNA, 50 bp, homo sapien
agaatagcccactattaaaaagaaayggctgcactcccaaatacagtttt

SEQ ID NO: 15705 - DNA, 50 bp, homo sapien
taattttttatctttgactttagacratcataaaattaaaaaactagata

SEQ ID NO: 15706 - DNA, 50 bp, homo sapien
aaagtaagtcactctttctgctctgracctattaattcaaaggaagaaaa

SEQ ID NO: 15707 - DNA, 50 bp, homo sapien
aaaaggcactaagttgatattttcartactagtagtagcacaacctggaa

SEQ ID NO: 15708 - DNA, 50 bp, homo sapien
tgtgaactgataaataagataaaaastaacaccagatgtgactgttttat

SEQ ID NO: 15709 - DNA, 50 bp, homo sapien
aaaatagcaagaaatattgcttccargagaacatgaatttctaaagtagt

SEQ ID NO: 15710 - DNA, 50 bp, homo sapien
gatattgacgaccctatcacttagcmaagaagaaataaaaaatatactat

SEQ ID NO: 15711 - DNA, 50 bp, homo sapien
gattttatcaagcaggataatgttasactagcagcagcagaaaacttcat

SEQ ID NO: 15712 - DNA, 50 bp, homo sapien
tttacattctctttctctgcgctgargtaagtcagtgtgtattttttctc

SEQ ID NO: 15713 - DNA, 50 bp, homo sapien
tgaagttgagaactgattgtgatctyaacaaagtctatgagatagtctcc

SEQ ID NO: 15714 - DNA, 50 bp, homo sapien
tttttccaaatggaaactgaaagcaraaaagttggcctagaatcaataat

SEQ ID NO: 15715 - DNA, 50 bp, homo sapien
gactagttcaggtgggagataataaragcctgagccaaagtgagagtaat

SEQ ID NO: 15716 - DNA, 50 bp, homo sapien
agagtagcaagctttcaaatgaagamgttctcaagttgctatcagaatat

SEQ ID NO: 15717 - DNA, 50 bp, homo sapien
aaaatactcctcattataacagattkaagtcaaaatgattaaaatacaac

SEQ ID NO: 15718 - DNA, 50 bp, homo sapien
actaaaggttctccttcctctcttayggattttgcatagattccccccac

SEQ ID NO: 15719 - DNA, 50 bp, homo sapien
taccgagttgtgtagttatgctcaayatgattcagcttcttgcctctttt

SEQ ID NO: 15720 - DNA, 50 bp, homo sapien
aaagtatcagctatctttgttaaaartacctgaatgcaactagatacatt

SEQ ID NO: 15721 - DNA, 50 bp, homo sapien
tcaaaagaagacatacaagtggcaartagatatattacaagatgcataat

SEQ ID NO: 15722 - DNA, 50 bp, homo sapien
ttcatcaagcaggagcaaaccagcawctctaaattaagtggaatactaag

SEQ ID NO: 15723 - DNA, 50 bp, homo sapien
acgaacactcttctttttccaaacayaagtgtgataggtaggtagtatct

SEQ ID NO: 15724 - DNA, 50 bp, homo sapien
aattcaaagtggtactccagaatacrcaaatgataagcaaaacagcttta

SEQ ID NO: 15725 - DNA, 50 bp, homo sapien
acaggactccaaacaggaaggagaarattgcattcaagatcactgtgcaa

SEQ ID NO: 15726 - DNA, 50 bp, homo sapien
ggctagtaggaagattaacagtatamattaaggattcttactcagagtag

SEQ ID NO: 15727 - DNA, 50 bp, homo sapien
ttaatgtcaccacatgctgagcatascccctactttgcaagtataagtac

SEQ ID NO: 15728 - DNA, 50 bp, homo sapien
ataataatttacttttcaatttagarcaacttagtggacgtactcaatta

SEQ ID NO: 15729 - DNA, 50 bp, homo sapien
ataaactaagacccagagagaataayggtgtagctataggcagaaatgaa

SEQ ID NO: 15730 - DNA, 50 bp, homo sapien
ttgactgttctatacaattgcaaatkactcaaacttgttaaaacttaggg

SEQ ID NO: 15731 - DNA, 50 bp, homo sapien
aatgagatcattctaaattaaattawctgcctgaaaagacactattttaa

SEQ ID NO: 15732 - DNA, 50 bp, homo sapien
aaacatattatgtgaccctgacgacygtaacctttacgaaagtcaaaatt

SEQ ID NO: 15733 - DNA, 50 bp, homo sapien
tcagataactatcaaacgtaaattawcttccacaaatttgagtgctacta

SEQ ID NO: 15734 - DNA, 50 bp, homo sapien
gaaaagggtcatacaaattcagaaakctaaaaacattacaaatgaatgga

SEQ ID NO: 15735 - DNA, 50 bp, homo sapien
taaattctccatattgaaactctaaytggcattattaacattgcttcatc

SEQ ID NO: 15736 - DNA, 50 bp, homo sapien
ttgagctgtttggcaagtgtgtcacrgatttaggctaaacaagaaagaga

SEQ ID NO: 15737 - DNA, 50 bp, homo sapien
ttgctcatagtactggatactgagargtttaaaatcatggcaccaagaga

SEQ ID NO: 15738 - DNA, 50 bp, homo sapien
cacgtcccctattggcatgaagcccraactattcaacccagtaaataaaa

SEQ ID NO: 15739 - DNA, 50 bp, homo sapien
ggtaggtcaaagcactgtactgaaakatgttcccagccagaagaatcatt

SEQ ID NO: 15740 - DNA, 50 bp, homo sapien
agacagagtttagtagcactttcatraggtacagagatatggaagagggg

SEQ ID NO: 15741 - DNA, 50 bp, homo sapien
ttacttgttctaatttttgttgccaytaggtttctaaattttcagtaaaa

SEQ ID NO: 15742 - DNA, 50 bp, homo sapien
cgtgacaagaaacaccaaaccagcartcttatttttaaattttaataaat

SEQ ID NO: 15743 - DNA, 50 bp, homo sapien
tattttcatttaagtgaaaggattgmatatggaaagagtgagggagtgtg

SEQ ID NO: 15744 - DNA, 50 bp, homo sapien
tgatgcagctggcccacttaggatcracttttcaggtgttcttcttcagt

SEQ ID NO: 15745 - DNA, 50 bp, homo sapien
gaggcatggtcttaattctaagctaraagaaacaacaagcaaaagcatac

SEQ ID NO: 15746 - DNA, 50 bp, homo sapien
tacaaaatctctactatttctcatgwatgtggatttcacaatctgctctc

SEQ ID NO: 15747 - DNA, 50 bp, homo sapien
gtttttgaaaagactaatagattcarctaggtttccctacttgccctgga

SEQ ID NO: 15748 - DNA, 50 bp, homo sapien
catcttaccaagtgattaagaaaaaycgatgaagctcagcctcagactgc

SEQ ID NO: 15749 - DNA, 50 bp, homo sapien
gaatttaaagagtctaatatggtcargtgttaaaattctttcatatctgt

SEQ ID NO: 15750 - DNA, 50 bp, homo sapien
atgaaaaataatcttaatgtcttcartcaaaatcgcatcttcattttctt

SEQ ID NO: 15751 - DNA, 50 bp, homo sapien
agccactgaatcatagaaattttgcrctcccactaagcagatattatgag

SEQ ID NO: 15752 - DNA, 50 bp, homo sapien
ggatttaagtatacatttcagtctasagagattaaaaatgatgtcattag

SEQ ID NO: 15753 - DNA, 50 bp, homo sapien
ttttgccagctgcctatgtggactayagtaacttgttgcactccttgtgt

SEQ ID NO: 15754 - DNA, 50 bp, homo sapien
agaagactccaagaaatttgggataygttaaatgaccaattataagaaga

SEQ ID NO: 15755 - DNA, 50 bp, homo sapien
cccagtagatttgacctgaacctggragatatttgaaaatccatcaaata

SEQ ID NO: 15756 - DNA, 50 bp, homo sapien
tgtttcagtgctgccaacaaagtcayctagtattttgaaaggaaggtgac

SEQ ID NO: 15757 - DNA, 50 bp, homo sapien
caaagtagttaatttcaggaaaatargtataagcataagatatataataa

SEQ ID NO: 15758 - DNA, 50 bp, homo sapien
cacacccttttagaggtgttcagcaytacatgaccgttagactatgacat

SEQ ID NO: 15759 - DNA, 50 bp, homo sapien
tagaattacctttctaaaacctagartcagtatgcttctgcccaatgctc

SEQ ID NO: 15760 - DNA, 50 bp, homo sapien
aggctcaaaaatgtaattttgttccrgattagaagaaaagagaaatagct

SEQ ID NO: 15761 - DNA, 50 bp, homo sapien
tccagagggccttagacatctctcaracttttcattcagtgcatgttttt

SEQ ID NO: 15762 - DNA, 50 bp, homo sapien
atagaagcctcttggtcttctataargctgagggtaaatataggcagtaa

SEQ ID NO: 15763 - DNA, 50 bp, homo sapien
cgttaagtgaaataagacaggaacasaaagttaaacatcatatattctca

SEQ ID NO: 15764 - DNA, 50 bp, homo sapien
ctctattatgttgaagaactatctamagacaaacaatgtagcttagcttg

SEQ ID NO: 15765 - DNA, 50 bp, homo sapien
tctttagtgttatttccattatatcsactagcttttgcaaaacataatga

SEQ ID NO: 15766 - DNA, 50 bp, homo sapien
cactgcatccccaaataaaaaagatragaatcatagcaacatttggttgc

SEQ ID NO: 15767 - DNA, 50 bp, homo sapien
tgtccttaccatgttaccattttagragaagaattcagcatttccccagt

SEQ ID NO: 15768 - DNA, 50 bp, homo sapien
tgagtctaattaaaattctatttcarccctagggcatctcaatctctgat

SEQ ID NO: 15769 - DNA, 50 bp, homo sapien
tctggcttcagatggcaattattaaygtttgctaaataataaaagttgac

SEQ ID NO: 15770 - DNA, 50 bp, homo sapien
gtagttgagaaggagagaatagggcragatttttgagagaatacaaaatt

SEQ ID NO: 15771 - DNA, 50 bp, homo sapien
atgtggcattgcacttatgtctgaawggtaattctgcttatcaagctaag

SEQ ID NO: 15772 - DNA, 50 bp, homo sapien
tattgtctcttgattgagcagtagawcattagagccataaaaatttgttt

SEQ ID NO: 15773 - DNA, 50 bp, homo sapien
tatatgttttgtaaattgcttcagartaggtaaattgtctattgtgggaa

SEQ ID NO: 15774 - DNA, 50 bp, homo sapien
gctcagtcaatgctcaggaatttcgkattgtagacatatcctctttaaca

SEQ ID NO: 15775 - DNA, 50 bp, homo sapien
caatttgaatcagcataagactctayatcagtttttgaaagcccttttct

SEQ ID NO: 15776 - DNA, 50 bp, homo sapien
caagcatgtaacatacatatgttgasattgctatgcttaacattatatat

SEQ ID NO: 15777 - DNA, 50 bp, homo sapien
aatgaccactgggactaaagagagcrcaacggaagtagttctgccagaag

SEQ ID NO: 15778 - DNA, 50 bp, homo sapien
aagtagatcattattgtcattaaaartaggacattctaacagcttgaatt

SEQ ID NO: 15779 - DNA, 50 bp, homo sapien
tggtcattgatcttactccagatacrcccattataaaactgtaattagaa

SEQ ID NO: 15780 - DNA, 50 bp, homo sapien
tggtatccctttaaaaaattagtgamaatatgaaaatacagttccttata

SEQ ID NO: 15781 - DNA, 50 bp, homo sapien
gtatactatttattgtgtagaattaygcaaattaaagagaggtctataaa

SEQ ID NO: 15782 - DNA, 50 bp, homo sapien
tctgattatcagagtcggttactacrgatcgtttacattaagtgtggtta

SEQ ID NO: 15783 - DNA, 50 bp, homo sapien
caaattcaattttacctatatatgasaaccttttgagagactgggtccca

SEQ ID NO: 15784 - DNA, 50 bp, homo sapien
tgttatatgaaactggaattttcatwataacatacaatttatgttggtag

SEQ ID NO: 15785 - DNA, 50 bp, homo sapien
atagcaccgacagagtaaaatgtcasatcataacacctatatgactatat

SEQ ID NO: 15786 - DNA, 50 bp, homo sapien
aaaacatgatggtggtctagtaaaakttcacttgattccacttttcttga

SEQ ID NO: 15787 - DNA, 50 bp, homo sapien
cttaaagtagaaattttaattcaagrcaactttcacaaaatacaattatc

SEQ ID NO: 15788 - DNA, 50 bp, homo sapien
attattggtttttgttaagtctacaytctaatagggagtcataacctaat

SEQ ID NO: 15789 - DNA, 50 bp, homo sapien
aaacgttttctttgtaaatgtaattsaaccaaaaaatactcctctggtat

SEQ ID NO: 15790 - DNA, 50 bp, homo sapien
ggcaaataggtttttctttataggtsaattctgaataaatggaagtggct

SEQ ID NO: 15791 - DNA, 50 bp, homo sapien
ttgtgaagaaaaacatatgaatttcyctgacattgcagtgacaaggcttt

SEQ ID NO: 15792 - DNA, 50 bp, homo sapien
gacagatactttctgatgtcttgaayatagcaacagtgatcccacagtga

SEQ ID NO: 15793 - DNA, 50 bp, homo sapien
ctgttattttgactgcctttaacccrcttggcaacttgagaatcgttttg

SEQ ID NO: 15794 - DNA, 50 bp, homo sapien
ggagaacttgaaggaaacgtgattaragggctatgcgagaacgctctctt

SEQ ID NO: 15795 - DNA, 50 bp, homo sapien
ctaagaacaacacaaatatttgttaygaatcctcactatatccattattt

SEQ ID NO: 15796 - DNA, 50 bp, homo sapien
taggaacttgtcttagcaagaattamcctgtctgttaaggagcattcccc

SEQ ID NO: 15797 - DNA, 50 bp, homo sapien
agcagaatctcttcagatccttcaaygcttgcaggttctccaattccttg

SEQ ID NO: 15798 - DNA, 50 bp, homo sapien
agagattataggagtgaatgtgtaaygcaaaaggcttaaaagatattttc

SEQ ID NO: 15799 - DNA, 50 bp, homo sapien
catttactgcaccgtgagttactgamatatttagacttattgctagtaaa

SEQ ID NO: 15800 - DNA, 50 bp, homo sapien
tgaagatggggaacactagattacargtctgttctctgataatgactcac

SEQ ID NO: 15801 - DNA, 50 bp, homo sapien
ttaaaacactcaatgtgatgtgtagraagagtaaattcacctgactaaag

SEQ ID NO: 15802 - DNA, 50 bp, homo sapien
aaacaaactttctaaatgaatcagartagaagaagatgcttaaacatgct

SEQ ID NO: 15803 - DNA, 50 bp, homo sapien
attaattcacaagtgaaaatctttcratcaacatgaggtagaaagtacca

SEQ ID NO: 15804 - DNA, 50 bp, homo sapien
ggagaaaagaaaatgtttcactcaartaaaaagagaaggtgggcagggac

SEQ ID NO: 15805 - DNA, 50 bp, homo sapien
ttgaatggtgaatgagtactgaatcraaatttgcaaatggaagatttatg

SEQ ID NO: 15806 - DNA, 50 bp, homo sapien
gtcctatgggacatttagaatctgaygcagaaactagttaactcttacct

SEQ ID NO: 15807 - DNA, 50 bp, homo sapien
aaaatgattgaactttcacaagatcraggcaaatattttaagcctgcagt

SEQ ID NO: 15808 - DNA, 50 bp, homo sapien
ttattcaagttatattcataggtcawctccttgaaaagctcacatcctta

SEQ ID NO: 15809 - DNA, 50 bp, homo sapien
gctgtgccctttttggagcaagtgaytattgaccagaagttcattttctt

SEQ ID NO: 15810 - DNA, 50 bp, homo sapien
tggagtaaacaattctgttacccaartgaaagatcccataatggggagga

SEQ ID NO: 15811 - DNA, 50 bp, homo sapien
ttgaaggcaattacaatattgtaacygacaaatgattttggcatgaacta

SEQ ID NO: 15812 - DNA, 50 bp, homo sapien
actgggttaatctcctgagttttgasagccggttttgttccttgagtttc

SEQ ID NO: 15813 - DNA, 50 bp, homo sapien
atttttagaaattattgcaattaaastaacaaatgtctatatattttgtg

SEQ ID NO: 15814 - DNA, 50 bp, homo sapien
ttgatttaactgtatttgaatgatarcaatgcctaaaatcttgatgactt

SEQ ID NO: 15815 - DNA, 50 bp, homo sapien
tgtgtttggttacaaggtgaagccgmaaacgtacagtaaaaaacagagta

SEQ ID NO: 15816 - DNA, 50 bp, homo sapien
gttcgttttagcatcttctctattgkaactatttttttgtactcagattg

SEQ ID NO: 15817 - DNA, 50 bp, homo sapien
ttcaattttgctcccttttcaaccaycttaggcattcgtttttaataagt

SEQ ID NO: 15818 - DNA, 50 bp, homo sapien
tctccaaatcatacatatttcttgaygagtaggtatcagagtctcttaga

SEQ ID NO: 15819 - DNA, 50 bp, homo sapien
tccaaatctttcttaccaagcaacaygttcacactgtttaatcacatcag

SEQ ID NO: 15820 - DNA, 50 bp, homo sapien
gtggttagaaaaaggcttatagtcarccactgagaatttgccaccattgt

SEQ ID NO: 15821 - DNA, 50 bp, homo sapien
gtcttgtacacatgaatagaccatawaatgtaatataaacaaacataaaa

SEQ ID NO: 15822 - DNA, 50 bp, homo sapien
gtaacatattaaagtttaataatccyagatatttgccaagaaagggcttt

SEQ ID NO: 15823 - DNA, 50 bp, homo sapien
acattagtatgcaaagacagattaartaaataatgcaaattaattgcatt

SEQ ID NO: 15824 - DNA, 32 bp, homo sapien
attacaaccaattggasaacgtagaaggaatt

SEQ ID NO: 15825 - DNA, 50 bp, homo sapien
tacacagaaaaaaaagtcatctctawtaatatctctgtgttgaacaggca

SEQ ID NO: 15826 - DNA, 50 bp, homo sapien
tattgtccccttttatcttgagggarctgtattttgaaatatgaatgtaa

SEQ ID NO: 15827 - DNA, 50 bp, homo sapien
ctaatttaatcatcacacatttatayagctcgtgttacacacacagtacg

SEQ ID NO: 15828 - DNA, 50 bp, homo sapien
aactatatcatctacctaaatgaaasagacttggaaatatttgtcatata

SEQ ID NO: 15829 - DNA, 50 bp, homo sapien
tagttgcaacttcatacagttattgkaaaattatctgagtttaaaatgaa

SEQ ID NO: 15830 - DNA, 50 bp, homo sapien
gacttttgcagatgtctggagagaaktgaagaggcaattaattacaggtt

SEQ ID NO: 15831 - DNA, 50 bp, homo sapien
ttaagaagatctagccaaaataatcmatgaaggttgctacactaaacaac

SEQ ID NO: 15832 - DNA, 50 bp, homo sapien
cctaactgtagatcataccagttcargagcagatagcctgcctggtctat

SEQ ID NO: 15833 - DNA, 50 bp, homo sapien
gttctgacactgtatactaaaaacartatctgtaatctcagggaaaagca

SEQ ID NO: 15834 - DNA, 50 bp, homo sapien
atactgactaatatcatttggaccaytacatagatttcatagatagcact

SEQ ID NO: 15835 - DNA, 50 bp, homo sapien
agtaagtagttgaggtgatttgtaasctaagctgaattttagactggtga

SEQ ID NO: 15836 - DNA, 50 bp, homo sapien
tgtgaagtggattgaaccataagaaytgcctgggaaaagaaaagaataaa

SEQ ID NO: 15837 - DNA, 50 bp, homo sapien
attagcctggcacaatgtgcattcartaacctgtaatcaactactaagta

SEQ ID NO: 15838 - DNA, 50 bp, homo sapien
tcatgtccttctctatgtagatttaygagggtttctgctgacacgaagta

SEQ ID NO: 15839 - DNA, 50 bp, homo sapien
gaggttttacttcttggagagtttasaattgcttgcatttcaaaaagaac

SEQ ID NO: 15840 - DNA, 50 bp, homo sapien
ttattagtagggaaaaagaaatcackgaagattggatattcacaaagatg

SEQ ID NO: 15841 - DNA, 50 bp, homo sapien
aaggacagcaggagtcttccaggtasaatagagaaagtaaggaaacccac

SEQ ID NO: 15842 - DNA, 50 bp, homo sapien
atcagtactctttgatgatatagaaytattcaaaacatcttctcttaatc

SEQ ID NO: 15843 - DNA, 50 bp, homo sapien
tgttagcttagcagagaaatgccacrattagatcagagttagaatgttaa

SEQ ID NO: 15844 - DNA, 50 bp, homo sapien
cagaatggatactagggaggcaaccrcaatcctcaaatccttcatatcat

SEQ ID NO: 15845 - DNA, 50 bp, homo sapien
tctcaaaataaataataactagtgargttgaatatgtatttattgggtac

SEQ ID NO: 15846 - DNA, 50 bp, homo sapien
tctctcattaatcatctacatcaaamtactcattatgttattgtgcaaaa

SEQ ID NO: 15847 - DNA, 50 bp, homo sapien
ggttttgtctcactcgtagccctaartgaaatctcttctaccaattcatc

SEQ ID NO: 15848 - DNA, 50 bp, homo sapien
tgctaaaccttgcttgttcagtgtayggactttttggaaacctaatcatc

SEQ ID NO: 15849 - DNA, 50 bp, homo sapien
tttcagtggtctcagtggggaccaasgtttgtgtagaggacctaataaac

SEQ ID NO: 15850 - DNA, 50 bp, homo sapien
cagggacatttatttagcataataakgggatttagcagaagcattttttg

SEQ ID NO: 15851 - DNA, 50 bp, homo sapien
tcagatcctcagtttcctgtctacartaatgaatttgggcagaacctgta

SEQ ID NO: 15852 - DNA, 50 bp, homo sapien
aaaaggcttcaaaaaatagtagagcrcaaataataaaaactcacaatggt

SEQ ID NO: 15853 - DNA, 50 bp, homo sapien
ctgtctccctgctaatgaagggtaayagtctgcagtaaagtggccccctg

SEQ ID NO: 15854 - DNA, 50 bp, homo sapien
aatagccctctgtgttacaggtttargcatatgggtttggatctcccagt

SEQ ID NO: 15855 - DNA, 50 bp, homo sapien
taattttgtaaatacctcgattaacrcagtagcagatttttttttgagct

SEQ ID NO: 15856 - DNA, 50 bp, homo sapien
gttcatcaaacaacaccattaatagrataaattgaatgaaaaagcaagct

SEQ ID NO: 15857 - DNA, 50 bp, homo sapien
atttatcttgctcttttatggacctsaggatgttcaaaaggacttttctt

SEQ ID NO: 15858 - DNA, 50 bp, homo sapien
atgttaagaaagcaatgataagtaaraatatcctacatttgtacaaatgt

SEQ ID NO: 15859 - DNA, 50 bp, homo sapien
gtgtcctgtggtgatttctaaagaaygctatccttaccatgagtgtctag

SEQ ID NO: 15860 - DNA, 50 bp, homo sapien
aacttgcgatgttatataataatgaktactgaacgctagtgatgaagcta

SEQ ID NO: 15861 - DNA, 50 bp, homo sapien
cttatgcatgtcacctaaggaatgcrgatgctctcactgtgtcctggcct

SEQ ID NO: 15862 - DNA, 50 bp, homo sapien
cacacttaagtatagattacgattgragtaaaatcatttttaggctcatc

SEQ ID NO: 15863 - DNA, 50 bp, homo sapien
ctgttgtttgtaacctaaaatcttcsctgatacacagtttaattgcaatg

SEQ ID NO: 15864 - DNA, 50 bp, homo sapien
cctcatctgcaaagaagaaagttgaygacactgaccttacaggattgttg

SEQ ID NO: 15865 - DNA, 50 bp, homo sapien
tctgatttaaacatcttgtgtatagwccaatatgctttcagaattacatt

SEQ ID NO: 15866 - DNA, 50 bp, homo sapien
ttctgcacttcctggctctaatgtaygtattattcactgatctttggcaa

SEQ ID NO: 15867 - DNA, 50 bp, homo sapien
atggatgctatgtaataaaaaggacygtaacagggagagagataagaagg

SEQ ID NO: 15868 - DNA, 50 bp, homo sapien
atcatcattatcattatcctcatcamtaacattaccttttttccaggccc

SEQ ID NO: 15869 - DNA, 50 bp, homo sapien
caattgttaagctgatcttcctgtgwaatccgaggtagaaatatatgctg

SEQ ID NO: 15870 - DNA, 50 bp, homo sapien
aacagatgagaaaactgggaaactcrgaaggatcctacagttagtcaatg

SEQ ID NO: 15871 - DNA, 50 bp, homo sapien
ccacctgacccatccactcttagtaygtcttcctatctatgtttattctc

SEQ ID NO: 15872 - DNA, 50 bp, homo sapien
ttcaggcaatagaatgcctctgatarctgcatcccataagtacgacgtct

SEQ ID NO: 15873 - DNA, 50 bp, homo sapien
tagataataattttatactcacttaycttggtatcattctgttagtaaat

SEQ ID NO: 15874 - DNA, 50 bp, homo sapien
aacaaacagcatagcactatcttacraggaagcatctttgctggagaggg

SEQ ID NO: 15875 - DNA, 50 bp, homo sapien
ttacctcacattgagctttcctggcrattaaaaaaatatgcaatttagga

SEQ ID NO: 15876 - DNA, 50 bp, homo sapien
ttctcactggtgatattaatcttaamatttagtctctgacatactttcta

SEQ ID NO: 15877 - DNA, 50 bp, homo sapien
cttgaagctttgagaacgggtcttayaaagttctaatactaaatatagtc

SEQ ID NO: 15878 - DNA, 50 bp, homo sapien
ctttaaattattctgcagcctcacaratatgctagcaaggtccagatctc

SEQ ID NO: 15879 - DNA, 50 bp, homo sapien
tcgtgcaagggtaatcattacattaygtataactgccagtggccctgctt

SEQ ID NO: 15880 - DNA, 50 bp, homo sapien
atagattcaacaaatagagaaaccaygaaatatgctaatagcatcacaat

SEQ ID NO: 15881 - DNA, 50 bp, homo sapien
atctaatcaggagctaggtgacccayatatatcctcaggttccaatgctg

SEQ ID NO: 15882 - DNA, 50 bp, homo sapien
gtgatgtgagtgagttattaatcctkacctaagtactcagcattaagtgg

SEQ ID NO: 15883 - DNA, 50 bp, homo sapien
gggacagccatccacatagttcaaayggctgtagatctcaattcattcta

SEQ ID NO: 15884 - DNA, 50 bp, homo sapien
ttggcaattactcagagatgtttacraggatttatttcttagagtggttt

SEQ ID NO: 15885 - DNA, 50 bp, homo sapien
aacatttctaactggctgttcttcawacattagcataatgccaagggtgg

SEQ ID NO: 15886 - DNA, 50 bp, homo sapien
tgacttctacctcttgttaatcacaraagttcttaagatggtttttgtct

SEQ ID NO: 15887 - DNA, 50 bp, homo sapien
aatacaatgtttctctttgatttcaygtgtatatcatttcctccacctgg

SEQ ID NO: 15888 - DNA, 50 bp, homo sapien
tcaacatttaatatataccacttggraaaactctacttacaatagcatgc

SEQ ID NO: 15889 - DNA, 50 bp, homo sapien
attaaaattcacgtacatggccaaakaataaaaaaaaaagcagttccatt

SEQ ID NO: 15890 - DNA, 50 bp, homo sapien
ttctgaagtagcccatacactcttaygtgatctgatataaaagttgtcct

SEQ ID NO: 15891 - DNA, 50 bp, homo sapien
aaaaatctgcactttgaatacactgyaggtgattcttatgcacacagaag

SEQ ID NO: 15892 - DNA, 50 bp, homo sapien
ttcccttaactaattacataatatcyaacccattttcttaaaagtaaaac

SEQ ID NO: 15893 - DNA, 50 bp, homo sapien
tcaaagcatgatttatacacagaatsaaaccctaactctaaaactaaaaa

SEQ ID NO: 15894 - DNA, 50 bp, homo sapien
gcagttcttgacatgtaatgtcacaygtattcatagtaagcatgcacaca

SEQ ID NO: 15895 - DNA, 50 bp, homo sapien
cattggaataaatgcttgcccattarattcaactctacactttgaaagta

SEQ ID NO: 15896 - DNA, 50 bp, homo sapien
tacctagtacacattttttaagtacrgatgacaattagtggcaagaaaag

SEQ ID NO: 15897 - DNA, 50 bp, homo sapien
aaaatacatgcacaaacaaaacttargtaacttggattatctttcatctt

SEQ ID NO: 15898 - DNA, 50 bp, homo sapien
taaaggtgtgaagaattaacctgcaracctagttttctgaacataatcct

SEQ ID NO: 15899 - DNA, 50 bp, homo sapien
aagataggagtcatattatttgtagractttatcaatacaaattttacaa

SEQ ID NO: 15900 - DNA, 50 bp, homo sapien
tgctgcattttttgagatggttacakgcttaccttagggaatggcatgtc

SEQ ID NO: 15901 - DNA, 50 bp, homo sapien
cagataaaaatcaacactggtttcarctactgcagcaattgcagtgatag

SEQ ID NO: 15902 - DNA, 50 bp, homo sapien
taacaagatttcttttcatacattcyacccaggagaggaggccaaggtgg

SEQ ID NO: 15903 - DNA, 50 bp, homo sapien
gctacaaggaagtcattggagtggaytcaaaaggaacaagaggaagtaaa

SEQ ID NO: 15904 - DNA, 50 bp, homo sapien
tactaataggaacaaggctaacataygcactctcaacctaagttcgggtg

SEQ ID NO: 15905 - DNA, 50 bp, homo sapien
ttaatttgaactattttaactctcartaatgtgtttatgtaatgcatttt

SEQ ID NO: 15906 - DNA, 50 bp, homo sapien
ctagaaaacaaatatccaagaaatcygaatgtcactgcttaggcattata

SEQ ID NO: 15907 - DNA, 50 bp, homo sapien
ctattccaagtttactcccttaaatmattagctgctgttaatagtattat

SEQ ID NO: 15908 - DNA, 50 bp, homo sapien
gaaaaaaatttgcattttgccagagyattaacaacctgatggggatgacc

SEQ ID NO: 15909 - DNA, 50 bp, homo sapien
ttacaataagagcactttctagtgayagttttccaggatttttcattgtc

SEQ ID NO: 15910 - DNA, 50 bp, homo sapien
ttagatgtttcagtacagaagtaaarttgatttggttacacagaagtgaa

SEQ ID NO: 15911 - DNA, 50 bp, homo sapien
tacaggccagaagcacaccagcaaayggctaaattaagatgaaattaatt

SEQ ID NO: 15912 - DNA, 50 bp, homo sapien
ctgctaaatgcaaagtaattctaccrgcactgatgtttaagacaatacag

SEQ ID NO: 15913 - DNA, 50 bp, homo sapien
acatttggaggaaaagtaagtaacgycatataaaatcctcattgcacaaa

SEQ ID NO: 15914 - DNA, 50 bp, homo sapien
gaggagaaaaaggtccataggaacarccaataattttggaacactacagt

SEQ ID NO: 15915 - DNA, 50 bp, homo sapien
tgtacatgaaagaaagatgctactaygcagctcaagagttaatctaaaga

SEQ ID NO: 15916 - DNA, 50 bp, homo sapien
ttcacaaagggatttgaggtaaagaygcattcctgaatggccttctcatt

SEQ ID NO: 15917 - DNA, 50 bp, homo sapien
cttgagctcattttgttccattctcmgaacggctagtgctcatggaatat

SEQ ID NO: 15918 - DNA, 50 bp, homo sapien
acaagtctaaaagctatgtaattgawatgtaagtgagatacaagatttgg

SEQ ID NO: 15919 - DNA, 50 bp, homo sapien
aaggaatgtgttaataatctgacacratggaatccagataaaagtatatc

SEQ ID NO: 15920 - DNA, 50 bp, homo sapien
ctatcttaggcagtgagcatctaaaktattgttccttaactagtacctcc

SEQ ID NO: 15921 - DNA, 50 bp, homo sapien
caccccaaataattttataacaggayagatgtagagtacaacaagtaagc

SEQ ID NO: 15922 - DNA, 50 bp, homo sapien
agggttagaaataggtttcaagttawgttatacagaatcatctttatgta

SEQ ID NO: 15923 - DNA, 50 bp, homo sapien
cacagcttcactaaaaaaacagacartgctggagctcaggaaggtaaatt

SEQ ID NO: 15924 - DNA, 50 bp, homo sapien
accttatttgtatgcctggctctacrctatgagtaaatagacctatatat

SEQ ID NO: 15925 - DNA, 50 bp, homo sapien
tttaaaaaatatcctaaattgtattsaaggagagctaaggaccctattta

SEQ ID NO: 15926 - DNA, 50 bp, homo sapien
gtttctatctctaaggtagcattcgycactttggtatgaagttgatgtga

SEQ ID NO: 15927 - DNA, 50 bp, homo sapien
ctacaaactgggacatctcagggaaractcatccataaatacatctctga

SEQ ID NO: 15928 - DNA, 50 bp, homo sapien
atgccatcatgtgaacactcatagcraaagtacaaaatggcagaagaaaa

SEQ ID NO: 15929 - DNA, 50 bp, homo sapien
tttctttatcttggtatttacttctmaaacttcacttttcatagctgtaa

SEQ ID NO: 15930 - DNA, 50 bp, homo sapien
ccaaatacatctgtctacacttgaargcagcaaaacacatttgagaattt

SEQ ID NO: 15931 - DNA, 50 bp, homo sapien
gcaggggctgctcagcaacacatgaraaatccaatttgcaataaaatcat

SEQ ID NO: 15932 - DNA, 50 bp, homo sapien
gaaagtcatgtgttgtaagtgaacayagacaaaagtagagacttctgaga

SEQ ID NO: 15933 - DNA, 50 bp, homo sapien
ggttaagcaaaaaaagaacaattaamtcacagttcagagacctccaggag

SEQ ID NO: 15934 - DNA, 50 bp, homo sapien
tattcatcttaactcaaccggaagaygctcactaatagagtagtatatgc

SEQ ID NO: 15935 - DNA, 50 bp, homo sapien
tccttaaaaattgtttgttaaatggmagcctaacaataaatcaaaaagtc

SEQ ID NO: 15936 - DNA, 50 bp, homo sapien
acgagggaacatgaaaaaatgcagaygcaggaaagaataatatatttggg

SEQ ID NO: 15937 - DNA, 50 bp, homo sapien
caaagcaaatgtctttaaaaggaaaytgtctctccaattattggagtttt

SEQ ID NO: 15938 - DNA, 50 bp, homo sapien
tgaattgtgcccaatacattcaatarcgaaaatccagcatgtttatccaa

SEQ ID NO: 15939 - DNA, 50 bp, homo sapien
actatctcttagatgttcatgtaaaytatggtgcagtagaatgctcctaa

SEQ ID NO: 15940 - DNA, 50 bp, homo sapien
tgcataaatggactttgtgcctaagraaatgtactaagtctttgaactgg

SEQ ID NO: 15941 - DNA, 50 bp, homo sapien
tgtcttcctccctctttattgggcasagtcttggttctccactctggatg

SEQ ID NO: 15942 - DNA, 50 bp, homo sapien
ataccattccttcattttaattaagyatgcgttataggatatcagtcaca

SEQ ID NO: 15943 - DNA, 50 bp, homo sapien
ggcaatttggctattaaaataaatgyattaggattatcagactgtttaat

SEQ ID NO: 15944 - DNA, 50 bp, homo sapien
gaaaaaggccaacttaatgtcttackgaatgaaggatgaaagggatgacc

SEQ ID NO: 15945 - DNA, 50 bp, homo sapien
aacacaaaggagttgcactacaatayggtttgagttgctaccagcttgaa

SEQ ID NO: 15946 - DNA, 50 bp, homo sapien
tttcctctttttttccttaatggcaygttgtttcccaagagtcacaggtg

SEQ ID NO: 15947 - DNA, 50 bp, homo sapien
aacacgtggaacgaactcagtcttcyagaattctgtagtgggtgtgtgtg

SEQ ID NO: 15948 - DNA, 50 bp, homo sapien
gaccagatgattagaattttttgacrcatgatcacagcattctctccacc

SEQ ID NO: 15949 - DNA, 50 bp, homo sapien
ctcatgttctattggcagaatggagraactaacccattcattataagacc

SEQ ID NO: 15950 - DNA, 50 bp, homo sapien
gatacttattgcagttcctgacatayagtagtttttcagtgtatttagtt

SEQ ID NO: 15951 - DNA, 50 bp, homo sapien
tcccttccaattttagcaagtagaayggcacagctgaaagcttaatggcg

SEQ ID NO: 15952 - DNA, 50 bp, homo sapien
acatactcacccccattacccagaayagttaacagctactctctcccaac

SEQ ID NO: 15953 - DNA, 50 bp, homo sapien
atacttgaagggtcaaataaatgcastagcttaaaaattaaattaaatat

SEQ ID NO: 15954 - DNA, 50 bp, homo sapien
ttatcatttgcccaggagcagcatcragtacacagaggactgctggacct

SEQ ID NO: 15955 - DNA, 50 bp, homo sapien
ccaaaactgagtgtgaaataaggacrcgttggccttttgcttatggcaag

SEQ ID NO: 15956 - DNA, 50 bp, homo sapien
tgcttagagagaaccaatataaaatwaagtaagtcaaaaagctccaggag

SEQ ID NO: 15957 - DNA, 50 bp, homo sapien
ctgaaaattatttgttgtttatgtawcattcacaatttgacataaccctg

SEQ ID NO: 15958 - DNA, 50 bp, homo sapien
gttcatatgccaataatatccgtaaygtaaatttgtgttcttaatacgtg

SEQ ID NO: 15959 - DNA, 50 bp, homo sapien
cttttcaaagtaagttgcagatatcratatacttttttccaaataactca

SEQ ID NO: 15960 - DNA, 50 bp, homo sapien
atattagtcttattactaattttcasgtcttttgctgggagatgctttaa

SEQ ID NO: 15961 - DNA, 50 bp, homo sapien
acagctgggagaactgaggtctgaayataaatagtaatgtttctcctact

SEQ ID NO: 15962 - DNA, 50 bp, homo sapien
gtaatcacaattgcagtttattacaraaaaaataatacacatgaaaatct

SEQ ID NO: 15963 - DNA, 50 bp, homo sapien
tctgctccataataagcaccacaatyattacaggctatgagattcatttt

SEQ ID NO: 15964 - DNA, 50 bp, homo sapien
atctggcatctccaccttttgaagasgcatctggacttctcctaaagagt

SEQ ID NO: 15965 - DNA, 50 bp, homo sapien
cagggttaaaaataataaatgtgaartcccaaatacagtgccttctatat

SEQ ID NO: 15966 - DNA, 50 bp, homo sapien
catactttcagtgataaaagtgatayctttagtagacaatttcaaatgat

SEQ ID NO: 15967 - DNA, 50 bp, homo sapien
aaagtaagaagatgctgtatgtcaaytgtaaggcaagaactgtggtttag

SEQ ID NO: 15968 - DNA, 50 bp, homo sapien
aaccctcaccacttgactgtattcartatcccttaatgataaaaactctc

SEQ ID NO: 15969 - DNA, 50 bp, homo sapien
aattgaacaaatgaatgaaagtaagragatgctgtatgtcaattgtaagg

SEQ ID NO: 15970 - DNA, 50 bp, homo sapien
gttatactctcacactgctggtagamgtgcaaattagatttcattttgga

SEQ ID NO: 15971 - DNA, 50 bp, homo sapien
gggagacaattcagagtccgacagcsagctgcattcagggttcaaagtgg

SEQ ID NO: 15972 - DNA, 50 bp, homo sapien
tctttccttcaagggaactatcatcycataaaaatgtaataaatacttgc

SEQ ID NO: 15973 - DNA, 50 bp, homo sapien
ctgggaaaactttgaaggatgatgargagccatccaggttgagatgtaaa

SEQ ID NO: 15974 - DNA, 50 bp, homo sapien
aaaaaaaataagagatctaattttaraatcaactggcctctgcacacacg

SEQ ID NO: 15975 - DNA, 50 bp, homo sapien
cttagttttgtcacttaccgtgttaycctgagcaagtttttaacttctca

SEQ ID NO: 15976 - DNA, 50 bp, homo sapien
gcccattggaatcagcatcttaaagwctgtccactgggcacaataggccc

SEQ ID NO: 15977 - DNA, 50 bp, homo sapien
ggtgacataagcaatgctagcttgayagaaaggccttcagagagtctctg

SEQ ID NO: 15978 - DNA, 50 bp, homo sapien
tttttcatcctgtttctcctgttaakaatcctaaaactagtagtatttat

SEQ ID NO: 15979 - DNA, 50 bp, homo sapien
caaaaatgctctctgaggaatctgarctaaacacagctcatggcaatata

SEQ ID NO: 15980 - DNA, 50 bp, homo sapien
gtagaagttttcttttttttcattcrctcaggtagacgtgttttccaatc

SEQ ID NO: 15981 - DNA, 50 bp, homo sapien
aagttatgacaaagtagtcagcaagycacctagggtctcaaccagagact

SEQ ID NO: 15982 - DNA, 50 bp, homo sapien
ggttattttggctttacagttcaaartctggatggcagagcctcaaggca

SEQ ID NO: 15983 - DNA, 50 bp, homo sapien
tcctcctcctccaaaagcaccattastaaccaggcatccagggaaagcac

SEQ ID NO: 15984 - DNA, 50 bp, homo sapien
gttggtctattactgtaacctaaaaytgaataacattggtaagcaatttt

SEQ ID NO: 15985 - DNA, 50 bp, homo sapien
gggtgttaagtcccgtgtagaattayctaatagtaatgaggtgtcggcag

SEQ ID NO: 15986 - DNA, 50 bp, homo sapien
acacattaattttttgaattgaatgmagatggttttaaaagaagtttact

SEQ ID NO: 15987 - DNA, 50 bp, homo sapien
tcctccacagctgctagaacccaccratttgtgctgtgtcccagacttta

SEQ ID NO: 15988 - DNA, 50 bp, homo sapien
gggaaccttagcacaaggatccttcragaagattcagggagaaaggatta

SEQ ID NO: 15989 - DNA, 50 bp, homo sapien
aagacagaaggtctagaaaatagaarccaggcctaggagtcagcaaccca

SEQ ID NO: 15990 - DNA, 50 bp, homo sapien
aatggacaactctttagtgagctaayacagatcatgcggctgccacacag

SEQ ID NO: 15991 - DNA, 50 bp, homo sapien
ccaaactcacagtaattcccagagtracaattcacacacccctatcattt

SEQ ID NO: 15992 - DNA, 50 bp, homo sapien
aaattaaatcctgcatttgatttacmaaaagcaaacaacaacaacaaaaa

SEQ ID NO: 15993 - DNA, 50 bp, homo sapien
aaaatgctcaagaaaaccaatttcartagctgggcctaaaacaatattac

SEQ ID NO: 15994 - DNA, 50 bp, homo sapien
gagatggatagtggtagtggccgtawaacaataggaatgtacttagtacc

SEQ ID NO: 15995 - DNA, 50 bp, homo sapien
cttgcaagactggagtacggtattayaactggatattcacattgataaag

SEQ ID NO: 15996 - DNA, 50 bp, homo sapien
ccattttcatgatctattcaggtatraaaatctttagatgagacatccac

SEQ ID NO: 15997 - DNA, 50 bp, homo sapien
agaagagaacttaccttggtagaagraacgccctcattctttaaatggac

SEQ ID NO: 15998 - DNA, 50 bp, homo sapien
tgaagttggacagtttagtcttgaartgattcatcggaactgtaaagtta

SEQ ID NO: 15999 - DNA, 50 bp, homo sapien
ttttttcctttgttcatgtttcaggkaagtctacatttcatcaattacaa

SEQ ID NO: 16000 - DNA, 50 bp, homo sapien
gttctccctctcaatccagctgttamaaatcttcccaccctccttttcag

SEQ ID NO: 16001 - DNA, 50 bp, homo sapien
gattatctcaccttagcagattagaraagagcaagtttcaaaaactgcac

SEQ ID NO: 16002 - DNA, 50 bp, homo sapien
tgatttttatgtatattcttattaakgtttcatatctgacttgggaatta

SEQ ID NO: 16003 - DNA, 50 bp, homo sapien
agaatggtgatgggtttcttctataygctaagcactcagaataccaagat

SEQ ID NO: 16004 - DNA, 50 bp, homo sapien
tttaaccatgctagttcaattgaatwacagtgctgccagtgggtttactc

SEQ ID NO: 16005 - DNA, 50 bp, homo sapien
aaaaaactgtaagccagcttttatcscatgatgcttatatgtactaggaa

SEQ ID NO: 16006 - DNA, 50 bp, homo sapien
caaaaattgactaagaagattatgcracattgctcagaaatcccattcaa

SEQ ID NO: 16007 - DNA, 50 bp, homo sapien
attttactttggctttaatagaggcraacttattaaaaagatttgaaaat

SEQ ID NO: 16008 - DNA, 50 bp, homo sapien
tgccatgaagaggccagaggaggatraataccatgaaacagaaaccagga

SEQ ID NO: 16009 - DNA, 50 bp, homo sapien
gggtgggcctgtcagaattgtcatcrctcactctgttgacttccagcagc

SEQ ID NO: 16010 - DNA, 50 bp, homo sapien
tctaaaagccagactgtgggctaaaytccagatctggggggagaaaatcc

SEQ ID NO: 16011 - DNA, 50 bp, homo sapien
ttaagctcccacctcaacatttagcrcagattttgatggacaccaatatt

SEQ ID NO: 16012 - DNA, 50 bp, homo sapien
gataaacatgtctttgttttttatayctggtgacgttatttgaggtcttt

SEQ ID NO: 16013 - DNA, 50 bp, homo sapien
gcaccaagctttaaagtttcaatccyaaccaacttgtttttcaggtgccc

SEQ ID NO: 16014 - DNA, 50 bp, homo sapien
actgctttgatttttggttatgtcarggccagttaagtataccctagtgc

SEQ ID NO: 16015 - DNA, 50 bp, homo sapien
ataaaaatgaaatcaccagggagaaragcaattgactgagtttccatagt

SEQ ID NO: 16016 - DNA, 50 bp, homo sapien
atttaccctaccacctcacagtaaasgttgctagaaagactgtcacaata

SEQ ID NO: 16017 - DNA, 50 bp, homo sapien
atgtacaaccataatgcaataacacmggtagaaaaattttagagctgtta

SEQ ID NO: 16018 - DNA, 50 bp, homo sapien
tgaatagggcctttttaatcctatcsaaggtatgtctgaatccaaatctt

SEQ ID NO: 16019 - DNA, 50 bp, homo sapien
ctatctgcttccctctatcagaaagmacgcagtaggcttggtgatggtac

SEQ ID NO: 16020 - DNA, 50 bp, homo sapien
tatgataatggcctcatgcccatatragtaagtgtccattttttgtttag

SEQ ID NO: 16021 - DNA, 50 bp, homo sapien
ttttttcttatgatgcagatttttgmaaaggtttcttatctaaatgttct

SEQ ID NO: 16022 - DNA, 50 bp, homo sapien
tttatgaggtttaaggaaagaatcaygaactattatatcaggcaacataa

SEQ ID NO: 16023 - DNA, 50 bp, homo sapien
aaaatcctaagattttcaataaaackaagtatttgtcctgaaagtctgcc

SEQ ID NO: 16024 - DNA, 50 bp, homo sapien
ttaattcattgattctgtaagaagayagtctcattatattgctcaagtca

SEQ ID NO: 16025 - DNA, 50 bp, homo sapien
atggtgtatacttacaggcattttarctatcagaagactccctcacttag

SEQ ID NO: 16026 - DNA, 50 bp, homo sapien
atgctcagataatgcataggaaataygacttgagcaatataatgagacta

SEQ ID NO: 16027 - DNA, 50 bp, homo sapien
cacacacatcaagacaccataatacrggcaattgtgtgacactgatcaag

SEQ ID NO: 16028 - DNA, 50 bp, homo sapien
ttctgggggattattttagctctgayaaagggcgttctgggacatgtatg

SEQ ID NO: 16029 - DNA, 50 bp, homo sapien
agtcagcagagctcaggaagctgaakccttgtctcagaggttagtgctcc

SEQ ID NO: 16030 - DNA, 50 bp, homo sapien
taggtccaatttagatagcaaagaamcatttattgatgtgatgtattgct

SEQ ID NO: 16031 - DNA, 50 bp, homo sapien
tgattcagccaaccacaagtacaagwcattaacatggggtgatgaacacc

SEQ ID NO: 16032 - DNA, 50 bp, homo sapien
ccctgcctggtccatgctcgctctcyagtcactttccttagttagtatca

SEQ ID NO: 16033 - DNA, 50 bp, homo sapien
tatttactgcacaggagggcctgtakagtaaaatcttcaaggtccacctg

SEQ ID NO: 16034 - DNA, 50 bp, homo sapien
atacaatatgattaggcctgcaataygatttcccattttgtttcctagtc

SEQ ID NO: 16035 - DNA, 50 bp, homo sapien
atacactattatagaaatgaacaaakgtcacgaacgaagaggtcaataat

SEQ ID NO: 16036 - DNA, 50 bp, homo sapien
tttctggactagttaattgcctcacragttcttttcctaggaatttataa

SEQ ID NO: 16037 - DNA, 50 bp, homo sapien
catctcagcttgttgggattctacckgatgaagtgaactacacctcactc

SEQ ID NO: 16038 - DNA, 50 bp, homo sapien
taattatattaggatcttgattatcyactccatactaagtaaatttcata

SEQ ID NO: 16039 - DNA, 50 bp, homo sapien
gtaaaaaatgatttcattgtgattaygttaaaatttttgatgtctctttc

SEQ ID NO: 16040 - DNA, 50 bp, homo sapien
aagttgtctgtcaaaattaatagggyattgctgcttcttatagaacaaaa

SEQ ID NO: 16041 - DNA, 50 bp, homo sapien
tatgatgatgtagagtatctattcarcagtcaattaaccgtttaacatat

SEQ ID NO: 16042 - DNA, 50 bp, homo sapien
aaatagcaagtcagagaatcaaaagrccaatacattgattaattcctatg

SEQ ID NO: 16043 - DNA, 50 bp, homo sapien
tctcaggtaaaatttaggtgaaatasatctttgtaagtctcaattaccca

SEQ ID NO: 16044 - DNA, 50 bp, homo sapien
atttgtgtttgtttagtgatgaaaartctccaatattaatattaatcttt

SEQ ID NO: 16045 - DNA, 50 bp, homo sapien
tgaaaagaattttttataattcagcyctgtttactaatacatctttttta

SEQ ID NO: 16046 - DNA, 50 bp, homo sapien
agctttgggtacttgaggcttgctgsagtgaaaagaattttttataattc

SEQ ID NO: 16047 - DNA, 50 bp, homo sapien
atgcatgctgtgatctaggcaaagtraattcctgagtgcctcccacttac

SEQ ID NO: 16048 - DNA, 50 bp, homo sapien
ttcatagaactggcatcgggaatagyatgcaactgttaaaaaaatcatgg

SEQ ID NO: 16049 - DNA, 50 bp, homo sapien
gacagaactgggctaattttaagaayctgaaggcaaggccagcttataga

SEQ ID NO: 16050 - DNA, 50 bp, homo sapien
gccttttgggccagggcagctaataygtgtgataaagtcatgcatggaac

SEQ ID NO: 16051 - DNA, 50 bp, homo sapien
ttgacttccaacttttaattttgacygtaataattatatactttctctaa

SEQ ID NO: 16052 - DNA, 50 bp, homo sapien
cccaacatccattaggcaatttaccraaaggggcagaggggagattaaga

SEQ ID NO: 16053 - DNA, 50 bp, homo sapien
ctgctgatctagacgtgctgaatgtwaatataatgagcacgcattttctc

SEQ ID NO: 16054 - DNA, 50 bp, homo sapien
gaaatctgtcttctgatatttatacyggatggattctttacctgtatttt

SEQ ID NO: 16055 - DNA, 50 bp, homo sapien
ctgttttatctcattagctatctctwaaggaaatcacatcatattaaata

SEQ ID NO: 16056 - DNA, 50 bp, homo sapien
actatatatgtacatgtaatggtgaygtatgtattttccattctttacta

SEQ ID NO: 16057 - DNA, 50 bp, homo sapien
atataaaatcacatttaacctgtaaygtattgtaagatgagtgttggtga

SEQ ID NO: 16058 - DNA, 50 bp, homo sapien
catagtaaacacctaataaatattgmagactgaatgactataataggaaa

SEQ ID NO: 16059 - DNA, 50 bp, homo sapien
gagattaatatcttaaaaagacatcmatcgagcttctggaattgaaaaac

SEQ ID NO: 16060 - DNA, 50 bp, homo sapien
gaaaaaagaaactaggttcaatgaaragtggccaactttcttcttcccac

SEQ ID NO: 16061 - DNA, 50 bp, homo sapien
acggacaatcaaatactgtacaaaaygttagaaagaaatatttgttaaaa

SEQ ID NO: 16062 - DNA, 50 bp, homo sapien
tctaatgtgttgccagaggattaaaygctatcaccatgtttcaggcagtg

SEQ ID NO: 16063 - DNA, 50 bp, homo sapien
aggatgatggcagagattatgaggayctttattaggtaaatattattcct

SEQ ID NO: 16064 - DNA, 50 bp, homo sapien
aatgttttcattttctttctatggcraagtgttcaatctggaggcagtaa

SEQ ID NO: 16065 - DNA, 50 bp, homo sapien
cactagaggtataacccactggggcygagctatactaatagagctggtct

SEQ ID NO: 16066 - DNA, 50 bp, homo sapien
caaggtcagataggaagctagaggcygagcaggatttaatccgagtcgtc

SEQ ID NO: 16067 - DNA, 50 bp, homo sapien
cattcttctttcacaatttcaggacyagaaacttgccttcctctcactgg

SEQ ID NO: 16068 - DNA, 50 bp, homo sapien
gcagttcaagatgagttggacacaaycaagaaaaatagggaacaaatatg

SEQ ID NO: 16069 - DNA, 50 bp, homo sapien
aaatttcagaaactgctacaaaaatratagaaacattgactaaaaatcag

SEQ ID NO: 16070 - DNA, 50 bp, homo sapien
ttcatggaattgttataagagagackggcttctgtgaggtgtaagacttt

SEQ ID NO: 16071 - DNA, 50 bp, homo sapien
tacaggcactatggttatatagtaartgctcgctaaatgatagttgctta

SEQ ID NO: 16072 - DNA, 50 bp, homo sapien
tcacctacaggatatgtaactgctayctataaagaaagtaaggatgtagt

SEQ ID NO: 16073 - DNA, 50 bp, homo sapien
aattacaacatcagcctctgtagacrcagctaaggagtctgcattttaag

SEQ ID NO: 16074 - DNA, 50 bp, homo sapien
taaaaggacacacacacgataatgaraataaaacggtacaggaaatcagg

SEQ ID NO: 16075 - DNA, 50 bp, homo sapien
ttctcttagtacatttttctctggaygctaccttcagctttagaaaagtt

SEQ ID NO: 16076 - DNA, 50 bp, homo sapien
gactatacgttattgtgtgtaaaaaygataaaacatgctgttatttgtaa

SEQ ID NO: 16077 - DNA, 50 bp, homo sapien
aagataaatgacatccttggccttcyaggttggttgatcttctggtgata

SEQ ID NO: 16078 - DNA, 50 bp, homo sapien
tctagctagaggggtttagtggaaayggcagtcaagatatgctggaggga

SEQ ID NO: 16079 - DNA, 50 bp, homo sapien
acaattaatggtctttttactagaaygacaaatgtattgcataaaacaat

SEQ ID NO: 16080 - DNA, 50 bp, homo sapien
tggcaacctgtatatatacaaaagargcaaattatacttatatatcactt

SEQ ID NO: 16081 - DNA, 50 bp, homo sapien
atgtggagtggaatgtgagtataatkaggcggtagctcatgtcctgacag

SEQ ID NO: 16082 - DNA, 50 bp, homo sapien
aagcctgagatgtcaggtgataaaamttcatgtttcttccaaggacagaa

SEQ ID NO: 16083 - DNA, 50 bp, homo sapien
atattctttgccttggatgtttaacmaagtatcaacgcctggagaaaaga

SEQ ID NO: 16084 - DNA, 50 bp, homo sapien
gaagcacagtccatcaattgtttcayggaaaagctagcaaaagaattagc

SEQ ID NO: 16085 - DNA, 50 bp, homo sapien
tgtttcagagtgacttcatacaaaaygtagtatttctggaatcactcaac

SEQ ID NO: 16086 - DNA, 50 bp, homo sapien
atgatctccagctgttttcacttccragattttaactttttcttttgtgg

SEQ ID NO: 16087 - DNA, 50 bp, homo sapien
tatttgcaactcaatttaaaaataayttaagcattttcttacttctagtt

SEQ ID NO: 16088 - DNA, 50 bp, homo sapien
cattaaacctttaatttattctctayctcattttcttgttgcagctttac

SEQ ID NO: 16089 - DNA, 50 bp, homo sapien
aaatgagcaattatttaaagtagtcraaagcagtatttttttttcctcta

SEQ ID NO: 16090 - DNA, 50 bp, homo sapien
tgccaataagtttaacatttcattgsagcaattattacgtgtctggggtt

SEQ ID NO: 16091 - DNA, 50 bp, homo sapien
tcatctgtgtttactgaaagcatccrgcatatcttatgagacacgtggtg

SEQ ID NO: 16092 - DNA, 50 bp, homo sapien
ctgttaagtgttgacaggtaccagasattcacgttccaggctcttccata

SEQ ID NO: 16093 - DNA, 50 bp, homo sapien
tcctaacccagagtagaggctttgaraagttttacaatgtgatgacaata

SEQ ID NO: 16094 - DNA, 50 bp, homo sapien
tttatcaggagttaaatacatagagmatgctgtaagaatcttttaaatag

SEQ ID NO: 16095 - DNA, 50 bp, homo sapien
tgagtatgagtaactaggcaaagaargagacctctgtaaaatgtaatgtt

SEQ ID NO: 16096 - DNA, 50 bp, homo sapien
ctctgtgacactctgacatttctccrgacttaacctgtcttttcaatccc

SEQ ID NO: 16097 - DNA, 50 bp, homo sapien
ttctgaatgtagaaaattattattaygatgtagcattttaaatgttttag

SEQ ID NO: 16098 - DNA, 50 bp, homo sapien
ttcataaaaatacagataggtagtayaacaaaatcaggaaagcaataaat

SEQ ID NO: 16099 - DNA, 50 bp, homo sapien
tttaggcttcctagttgacatctgaytatacctcaaaaaccaaatactat

SEQ ID NO: 16100 - DNA, 50 bp, homo sapien
agggccttaatatgcccattaaaaargaatcatataacagcaacatcatt

SEQ ID NO: 16101 - DNA, 50 bp, homo sapien
ctatgaacatgcagtgtttgaggaayggacacactagatatcaaatagag

SEQ ID NO: 16102 - DNA, 50 bp, homo sapien
tacagttatacataaaaagaacaggsatggttatttaaaaagtgcttcta

SEQ ID NO: 16103 - DNA, 50 bp, homo sapien
cgatttaaaacatatggattgtttaygtctctaatcttacatttaatcct

SEQ ID NO: 16104 - DNA, 50 bp, homo sapien
aataagaatatagataaagcacttarcatttgatgaacattcagtatatg

SEQ ID NO: 16105 - DNA, 50 bp, homo sapien
tacatacatattcaatttacatgaakttcaaatatgtgcaaaactaaatg

SEQ ID NO: 16106 - DNA, 50 bp, homo sapien
tacttaaagttttttcaaagcaagayggattgtattaaatgggcaaaaga

SEQ ID NO: 16107 - DNA, 50 bp, homo sapien
aatcttgtacattcagaatcacccartggattattttcaggttaaattct

SEQ ID NO: 16108 - DNA, 50 bp, homo sapien
gtagaatgttatttctaggccgagayagtaatggccttgaagaaccttag

SEQ ID NO: 16109 - DNA, 50 bp, homo sapien
tactactccctttctcccatgaaackcaagtatagcctgctacaggagca

SEQ ID NO: 16110 - DNA, 50 bp, homo sapien
ttctttttctttcatcagggcatagyatttagactacaggtcccattaag

SEQ ID NO: 16111 - DNA, 50 bp, homo sapien
catcctctcaataggataaggagaakatacgcttttctgagatttacaat

SEQ ID NO: 16112 - DNA, 50 bp, homo sapien
tattatctaaactgattttatcaaawtagctttcccaagtaaaaactaga

SEQ ID NO: 16113 - DNA, 50 bp, homo sapien
gtcaccaatccccaggccacaaaccrataccatggtacccagggttgggg

SEQ ID NO: 16114 - DNA, 50 bp, homo sapien
taagacaagtttgattacaaggcatyacggtggctggaaggaagaaccca

SEQ ID NO: 16115 - DNA, 50 bp, homo sapien
ttaatgtaaaatgaattggttaaatratcggctgaatatacatttttgtt

SEQ ID NO: 16116 - DNA, 50 bp, homo sapien
gctaacgtgaacacagacactccaawggtggaaaagattaagaaatggtc

SEQ ID NO: 16117 - DNA, 50 bp, homo sapien
tagtccttttctttactgcccatgayacttcatacttcagaaattctgaa

SEQ ID NO: 16118 - DNA, 50 bp, homo sapien
aataccaatgggcaccctggtaacaytacaaaactgaagatggagctgga

SEQ ID NO: 16119 - DNA, 50 bp, homo sapien
ccctccctccctttttcccaccaaakaggcagtgatgccacaggaattca

SEQ ID NO: 16120 - DNA, 50 bp, homo sapien
gttgaagttgttttctttaactaacyataagacttgaagccagttagaac

SEQ ID NO: 16121 - DNA, 50 bp, homo sapien
cttttgacagctacatgacttacacmatacagaacagtactggacaaaag

SEQ ID NO: 16122 - DNA, 50 bp, homo sapien
gctgtgtgaacttgaactacttatayacctttctgagatgggttctttta

SEQ ID NO: 16123 - DNA, 50 bp, homo sapien
caaaagcaacttgaaaatgctttgcrcccataattaaactctttatttca

SEQ ID NO: 16124 - DNA, 50 bp, homo sapien
tctaatgtttcttcaaggtctaaaaytgtacgattctatgatttcttatt

SEQ ID NO: 16125 - DNA, 50 bp, homo sapien
tacagagcataaggctacatgcggtracaatatagttatagtataattat

SEQ ID NO: 16126 - DNA, 50 bp, homo sapien
tgtgtgctatggtttattattcaagyctcaaacattactctgcaaacaat

SEQ ID NO: 16127 - DNA, 50 bp, homo sapien
gcttatggaggtgactataattgaartggttaatgtaaatactacttgta

SEQ ID NO: 16128 - DNA, 50 bp, homo sapien
aacagtgtggataaatctagtcccartaagtcaccactactacagttgag

SEQ ID NO: 16129 - DNA, 50 bp, homo sapien
cgtggaagtatgctcggtcatacaaygagaggaagtgaatttaaacaggg

SEQ ID NO: 16130 - DNA, 50 bp, homo sapien
actctcagccacgccaggtgagagargtgggtaaaagctactcaaaatgg

SEQ ID NO: 16131 - DNA, 50 bp, homo sapien
taatttatatatacctcttctaccaytcattggctggagtagttgaacag

SEQ ID NO: 16132 - DNA, 50 bp, homo sapien
cattttggtgtcctgggatgataaakgaagatgattgtgacaatatggat

SEQ ID NO: 16133 - DNA, 50 bp, homo sapien
ccagaaatttgatggcattttaagawagttagcatcccaatagtcaggtg

SEQ ID NO: 16134 - DNA, 50 bp, homo sapien
tccttctggtcagagattgtgaagawccctgtcctggttatggagcaagt

SEQ ID NO: 16135 - DNA, 50 bp, homo sapien
gtctgtcaagtgatggttaatataartaagaacatctgtccttgttaaag

SEQ ID NO: 16136 - DNA, 50 bp, homo sapien
cttttgagtgactttctcacttcacrctcaatgtcagtcactcacagaga

SEQ ID NO: 16137 - DNA, 50 bp, homo sapien
caaacttatacatttaaccaagtaamctcattgccatatgctgtgtgtgt

SEQ ID NO: 16138 - DNA, 50 bp, homo sapien
tctgggtcttgtcaggtggtataacscttgcaagccctaaaaacccttga

SEQ ID NO: 16139 - DNA, 50 bp, homo sapien
cttgggtttaagttgatctacttaamagatcctcacttggacatgaacta

SEQ ID NO: 16140 - DNA, 50 bp, homo sapien
aaagtttcctttggttaagtgtgtcrgaacttgtctacgaagaagcagaa

SEQ ID NO: 16141 - DNA, 50 bp, homo sapien
aacagaattttgcataaatagcagaycttagtcactgaataccccattaa

SEQ ID NO: 16142 - DNA, 50 bp, homo sapien
tacttaacagatcctcacttggacaygaactatagaggccagtaaatgga

SEQ ID NO: 16143 - DNA, 50 bp, homo sapien
atccttattctgtgaaggctctacartgacctctgccttagacaggttcc

SEQ ID NO: 16144 - DNA, 50 bp, homo sapien
gcatcagaacatattggtcaaaggastaaggctgtggtacaacatggcca

SEQ ID NO: 16145 - DNA, 50 bp, homo sapien
tagacagacaagcatctggattcttsaactgactgtctctaccacatccc

SEQ ID NO: 16146 - DNA, 50 bp, homo sapien
gaggaaagaacatagaggaaaaaaawtagatcatgtgtgtttctggctgc

SEQ ID NO: 16147 - DNA, 50 bp, homo sapien
tctgttaatttacaatggtttagaasaagactttgatggaaggtactaga

SEQ ID NO: 16148 - DNA, 50 bp, homo sapien
ggcttgggtttaataggaggttttcratattatgaatagtcagtgaattc

SEQ ID NO: 16149 - DNA, 50 bp, homo sapien
aaatctgtaaagactcaatgtaagaragataaaatttttcactgttaggg

SEQ ID NO: 16150 - DNA, 50 bp, homo sapien
tgtattttgaacatgatctgtattayctctctgtagccatgatggacttg

SEQ ID NO: 16151 - DNA, 50 bp, homo sapien
atgtctggaagaacttacagtgatarcaagtatatatagtgtataaaaga

SEQ ID NO: 16152 - DNA, 50 bp, homo sapien
tcaatctacttattgaatggaacaarcccagttctggaaaactttcttta

SEQ ID NO: 16153 - DNA, 50 bp, homo sapien
aatgcaatatgtttattggcttagayctgggcatgagcgctatctgaaag

SEQ ID NO: 16154 - DNA, 50 bp, homo sapien
cataactataaccaagaccataacayggcacctttcctcactgccccgag

SEQ ID NO: 16155 - DNA, 50 bp, homo sapien
ttttgttcacaactttattcgagcasctagaacaggaccactcatgtagt

SEQ ID NO: 16156 - DNA, 50 bp, homo sapien
aaatgaaaataaatgcagtcatctawgagttttattaagagttttaatta

SEQ ID NO: 16157 - DNA, 50 bp, homo sapien
acactaacaatcattttggtaaacaygttcgtacagataagcaatcatga

SEQ ID NO: 16158 - DNA, 50 bp, homo sapien
aaataaattctcatagagatgtataraggagcaagctgagtctgcactgt

SEQ ID NO: 16159 - DNA, 50 bp, homo sapien
ttgtctttgtaacagggatgctctcyataggtgtacctcaaaatctccct

SEQ ID NO: 16160 - DNA, 50 bp, homo sapien
tgtgatattctaccaatcaatgaagragttgtggttgataaagtgaacaa

SEQ ID NO: 16161 - DNA, 50 bp, homo sapien
agttctgaccccagttaactgtaackgtgcaacgagatttgcagtacatt

SEQ ID NO: 16162 - DNA, 50 bp, homo sapien
ttcatgtccatatgggatgagggaartaaaatcttaatgtgataacgcat

SEQ ID NO: 16163 - DNA, 50 bp, homo sapien
gtctctaatgaagtagaagatggtamaaattgttaatgagaagatatgga

SEQ ID NO: 16164 - DNA, 50 bp, homo sapien
ttggctgtgcttgtataaatattaaygggagactgctccgaccttccatc

SEQ ID NO: 16165 - DNA, 50 bp, homo sapien
attgagtgcacctggagcaaaaaaargtcttgacacgaaaaaatatatat

SEQ ID NO: 16166 - DNA, 50 bp, homo sapien
caaggcagatgtaacaatgttgtacraaatagagttcagggtgaaaagca

SEQ ID NO: 16167 - DNA, 50 bp, homo sapien
actgtttcaatctgggcttatacacraatcctcatctctcaatgccaggg

SEQ ID NO: 16168 - DNA, 50 bp, homo sapien
aaatacagtaagatgaaaagggtgcraccgagaaagcatccaaagatgtt

SEQ ID NO: 16169 - DNA, 50 bp, homo sapien
agaggttcagtaacttttccaaaatsatatgacacaaaggcagaaaaacc

SEQ ID NO: 16170 - DNA, 50 bp, homo sapien
cttgagtttgtatctacatatagaaytggatgtctcaaatctaatatcca

SEQ ID NO: 16171 - DNA, 50 bp, homo sapien
gaaaattagtgagtcattcacaacartatgtaattttaacacatggcttc

SEQ ID NO: 16172 - DNA, 50 bp, homo sapien
gagccaacaaaccaaaccaaacccaygtaattgtgacattttgtgttggc

SEQ ID NO: 16173 - DNA, 50 bp, homo sapien
caaaattaccatctgacaaagaccartctaaaaggaaagacccagggcta

SEQ ID NO: 16174 - DNA, 50 bp, homo sapien
gtgaatcattctgaactaaacgataygtgttttgcagttttttatccagt

SEQ ID NO: 16175 - DNA, 50 bp, homo sapien
tctctgtgactcccagtccaatgccrcttctagtacacttcattagtatc

SEQ ID NO: 16176 - DNA, 50 bp, homo sapien
taaagaaacacgtgttaaagtagtgraattaaagtcaaaagaaaccatcc

SEQ ID NO: 16177 - DNA, 50 bp, homo sapien
atcttgggggagcataagagatggaygttgaggccttgttgaaagtccaa

SEQ ID NO: 16178 - DNA, 50 bp, homo sapien
gcagaaaatatttctcagactaaaaygattcaaaagaagttaattggaat

SEQ ID NO: 16179 - DNA, 50 bp, homo sapien
cattccttttataaaaaggaatatawcaatgaagtagggttggggggggg

SEQ ID NO: 16180 - DNA, 50 bp, homo sapien
caagtcctttcacttcccagagcctyaaatataggataatgtcactgacc

SEQ ID NO: 16181 - DNA, 50 bp, homo sapien
agactgagaaaaaggttaccagggaratgtgtcgtcttaacacttcttca

SEQ ID NO: 16182 - DNA, 50 bp, homo sapien
ggcaatctagcctaattattctattkaaatctctcactttggatgccttc

SEQ ID NO: 16183 - DNA, 50 bp, homo sapien
agccttatttctttatcaattatatracaacagtaacaaaaacagaaagg

SEQ ID NO: 16184 - DNA, 50 bp, homo sapien
tcccctgcctgatcagatgagcaatsaaaatgtcccacacccccagacca

SEQ ID NO: 16185 - DNA, 50 bp, homo sapien
aattacaaggaaggtgtttacatagkaggatactcaaacttctctatttg

SEQ ID NO: 16186 - DNA, 50 bp, homo sapien
tgcacaccattaaagtctctgcttakggatactgagaaaaaaaaaaaaaa

SEQ ID NO: 16187 - DNA, 50 bp, homo sapien
aattttgtgaagtcaatcacgtaagwccttatgtaaatcttattaaacag

SEQ ID NO: 16188 - DNA, 50 bp, homo sapien
tttagtctcctaattcacctcatcaygtaaaagcaactctctaagtttgt

SEQ ID NO: 16189 - DNA, 50 bp, homo sapien
atttgctccaacattccgtatgagawccatggcaaactgtctttgtgtca

SEQ ID NO: 16190 - DNA, 50 bp, homo sapien
tccagggctgtgggaaaaaagttgamtatttcagtgcaagttctattgac

SEQ ID NO: 16191 - DNA, 50 bp, homo sapien
aaaatacaccatactttctggataayggagaaagataatgttctgtaaag

SEQ ID NO: 16192 - DNA, 50 bp, homo sapien
cacaggtagctgatggagctttgcgratggtttcctaatgcctgagatgg

SEQ ID NO: 16193 - DNA, 50 bp, homo sapien
gtgaaaaggggatgtgcaatcaaaasgatacggtgtcttgagggagggaa

SEQ ID NO: 16194 - DNA, 50 bp, homo sapien
ataaatgataattgaaatggtaacaraatatttaatatgaagttgaagtc

SEQ ID NO: 16195 - DNA, 50 bp, homo sapien
acagctaatttagtgtttagcctcaygatttgattcttaccagctaaagg

SEQ ID NO: 16196 - DNA, 50 bp, homo sapien
tttgttccttctaattctgaatgtayattgtatcttaccaagatcattcc

SEQ ID NO: 16197 - DNA, 50 bp, homo sapien
attgtctaagttcacctacagtgccraagaaatggaacaatccaaacagg

SEQ ID NO: 16198 - DNA, 50 bp, homo sapien
tgggcggaggatatacacacaccggraacatcccaaaaagctgcatctgc

SEQ ID NO: 16199 - DNA, 50 bp, homo sapien
cattccttaggctgctataagtggcrcacttggcaagagttttaaggcag

SEQ ID NO: 16200 - DNA, 50 bp, homo sapien
tgagagagagtgattctacaaagatmagatcatgcagggtgttgctgaag

SEQ ID NO: 16201 - DNA, 50 bp, homo sapien
cctgagctttgtattaaattcttaastgtcataagctatttcataagata

SEQ ID NO: 16202 - DNA, 50 bp, homo sapien
aatataaccatcaaatctgactgtaragggatggaacattttattaaatt

SEQ ID NO: 16203 - DNA, 50 bp, homo sapien
tactgccttctagtttaacaaattaygacacatttcatcttttagggtac

SEQ ID NO: 16204 - DNA, 50 bp, homo sapien
aaatgatgtcctttctcagtcaccarggtgtggttatttggttttatgta

SEQ ID NO: 16205 - DNA, 50 bp, homo sapien
aacttttttcttttggtgcctaaaakaactggcaaatgctataatccaaa

SEQ ID NO: 16206 - DNA, 50 bp, homo sapien
tgggtagaaatataactgagaggctraataaaaactttggcagagatgtc

SEQ ID NO: 16207 - DNA, 50 bp, homo sapien
tggtattcactcagaaaacattaccygcagtaggagaaacatgactttat

SEQ ID NO: 16208 - DNA, 50 bp, homo sapien
agggccttgaagagacagacattaaycaggaacctggagaatcaagctct

SEQ ID NO: 16209 - DNA, 50 bp, homo sapien
gttagccaaggtaggggaagtgtaasaaatggccattctggaaagaaata

SEQ ID NO: 16210 - DNA, 50 bp, homo sapien
aaagacccgaatctcaaggatcaaakggatcatgcagtatagagataaaa

SEQ ID NO: 16211 - DNA, 50 bp, homo sapien
cttaccttcacctggtccctaacacrcaaattggagtctccccttttcca

SEQ ID NO: 16212 - DNA, 50 bp, homo sapien
aggctgttttcagaataatctttgayggctttcagtcagacttatgtttc

SEQ ID NO: 16213 - DNA, 50 bp, homo sapien
gaataggtaagaacctaaaaatcagmatataaggccagctatagctgcag

SEQ ID NO: 16214 - DNA, 50 bp, homo sapien
atgttttaacatgaagtatgatgtaygcttttgatctattgcaagttgaa

SEQ ID NO: 16215 - DNA, 50 bp, homo sapien
gtgcccaaataccagtccctccttartaagcagccttttagacctaacct

SEQ ID NO: 16216 - DNA, 50 bp, homo sapien
gtacatgcatcagcaacgtgtcaaamtcctgaagggtgaagagagttagc

SEQ ID NO: 16217 - DNA, 50 bp, homo sapien
gtagaattgatattactcttccatarcggttagaatttctgaagtggaac

SEQ ID NO: 16218 - DNA, 50 bp, homo sapien
acttcaaaataaagttgtaacttgaktagaggaaaggtaagatgctgact

SEQ ID NO: 16219 - DNA, 50 bp, homo sapien
gacgaggaacttaggagttgagggasagaagccttcagagggagtgcagg

SEQ ID NO: 16220 - DNA, 50 bp, homo sapien
atgtttagctaaactctgggttacartattagacatagaatgctgaatta

SEQ ID NO: 16221 - DNA, 50 bp, homo sapien
aagaaaaaacaggagaaaatcttcaygttgggatacgataagatttctta

SEQ ID NO: 16222 - DNA, 50 bp, homo sapien
cccctgccatgagatgttgtcaaaaktaaaggagatggagtctttaaagc

SEQ ID NO: 16223 - DNA, 50 bp, homo sapien
ttttaaacaagcttagatatctcccratttaatactctttcttcacccac

SEQ ID NO: 16224 - DNA, 50 bp, homo sapien
cctcctaggatgataatgctaatacragaatctccttgaagacagccatg

SEQ ID NO: 16225 - DNA, 50 bp, homo sapien
cacccagtggctgagcaggaacatargaaagggactctttatcaccccat

SEQ ID NO: 16226 - DNA, 50 bp, homo sapien
taggcctgggcttcctaaggaaataygaacccagagaaccatgaactttc

SEQ ID NO: 16227 - DNA, 50 bp, homo sapien
acactcacgcatgattgcatgctcasaggaaaggatataagaagcttcac

SEQ ID NO: 16228 - DNA, 50 bp, homo sapien
agtagcttaagtatggccttccagcyagagactcctgagcagccggaaag

SEQ ID NO: 16229 - DNA, 50 bp, homo sapien
gcatacgcactgacgttgacccatasaagtctaggcatctgttaagtgtt

SEQ ID NO: 16230 - DNA, 50 bp, homo sapien
cttaatttctagggtaagggtatacmattgcttttaattcttctcaattc

SEQ ID NO: 16231 - DNA, 50 bp, homo sapien
ctcctcatgtaactcaacttctgtayccttggaggtagttttatttacat

SEQ ID NO: 16232 - DNA, 50 bp, homo sapien
tgaaggggtccaaaataaatctgacyggcagtttgaaggcctataagaga

SEQ ID NO: 16233 - DNA, 50 bp, homo sapien
cccttcaagataccatacagaagtcraacatagttcttcatgcatgaatt

SEQ ID NO: 16234 - DNA, 50 bp, homo sapien
cactccacgtcaacatgatactgatsacaagcgcatttccttgcttttgc

SEQ ID NO: 16235 - DNA, 50 bp, homo sapien
accttatagaaattttatttcgttcwcattatttttgataattttgattt

SEQ ID NO: 16236 - DNA, 50 bp, homo sapien
ttgccactccacaaggactcagctayataacttccaataatcataaatta

SEQ ID NO: 16237 - DNA, 50 bp, homo sapien
ctgaagattccagagaatgacccaaytaagtacccagaggtccccgctca

SEQ ID NO: 16238 - DNA, 50 bp, homo sapien
actatctcaccctttctgtgtacaawgtggagtttcaataaggagccagg

SEQ ID NO: 16239 - DNA, 50 bp, homo sapien
ggaagaagccaaggacagaggtcaaygaaaacaaagttgtctgggctgag

SEQ ID NO: 16240 - DNA, 50 bp, homo sapien
aaaaattaaaaaaatgtttcttggaygattagaagaaatggagcctatta

SEQ ID NO: 16241 - DNA, 50 bp, homo sapien
aagtatgtattaataggtgtgataayattctttgtttttagggttttata

SEQ ID NO: 16242 - DNA, 50 bp, homo sapien
tgttacactgattttcctagattaarcagaatgtacccaacttgatatag

SEQ ID NO: 16243 - DNA, 50 bp, homo sapien
tgtgctgaactgtgatttaaaaaatwatgtgaggtggctcagaaaggcag

SEQ ID NO: 16244 - DNA, 50 bp, homo sapien
aggttttagtaccagaaagacctgamgtgacctcaaaggacaatactcta

SEQ ID NO: 16245 - DNA, 50 bp, homo sapien
atatgattacaatataatttggagamcattaagctgtttttctctgtttt

SEQ ID NO: 16246 - DNA, 50 bp, homo sapien
aaaaagaacccatattctggctggcratattagaaaaagataaatgaaat

SEQ ID NO: 16247 - DNA, 50 bp, homo sapien
aaacccaggagcaaatttatcacaamgaggtttattaaacttgtaaactc

SEQ ID NO: 16248 - DNA, 50 bp, homo sapien
agaagggaaatcaggaagacaaaacrgtaaattacctaccacaaatccaa

SEQ ID NO: 16249 - DNA, 50 bp, homo sapien
acaataatgcttagaattttctgcartaaagatcgttcttcagttagaaa

SEQ ID NO: 16250 - DNA, 50 bp, homo sapien
cagctatttttctagaggcctgaatragtcagaacaagaaaatgattaat

SEQ ID NO: 16251 - DNA, 50 bp, homo sapien
accccttcagtaaccattgtactacygcatgtgatgcccttagattctcc

SEQ ID NO: 16252 - DNA, 50 bp, homo sapien
tttggcacacaagtcaataaacacaytggagattaacagcaaagagataa

SEQ ID NO: 16253 - DNA, 50 bp, homo sapien
gttgcatgttattctctagaactgcsatgagcctaaagccatccaaagca

SEQ ID NO: 16254 - DNA, 50 bp, homo sapien
gtgaggacttcaggttgaacgtgaayagcacctgtcataggagagggagt

SEQ ID NO: 16255 - DNA, 50 bp, homo sapien
gagggatgatcataccttgaggtgartaacagtgcagaatgtgcatacag

SEQ ID NO: 16256 - DNA, 50 bp, homo sapien
tacttattgcagaaaggatccaaccrctgttttatcgcaaattatcatat

SEQ ID NO: 16257 - DNA, 50 bp, homo sapien
tctatttaagtgaaaggtctgttaayggcaaatctaaggaaagagaaagc

SEQ ID NO: 16258 - DNA, 50 bp, homo sapien
tgatttttgtgttgtctaacaaataygtttgtggtatctacttcatccag

SEQ ID NO: 16259 - DNA, 50 bp, homo sapien
actctatagttaattctttcacgaamccattatttggtaacatagttaac

SEQ ID NO: 16260 - DNA, 50 bp, homo sapien
gctgatcactttccgttataggctamggtcattgtgataatgttggtcaa

SEQ ID NO: 16261 - DNA, 50 bp, homo sapien
gacaaatggtaaatagcaatgggaamgttttgatcaagagctacataaat

SEQ ID NO: 16262 - DNA, 50 bp, homo sapien
tcacctgaaacaggagatggtgaaaytctggggtgataaaagaaagcata

SEQ ID NO: 16263 - DNA, 50 bp, homo sapien
gtcttatcaatagcattgatacaaarttagttaagataatgtaccctata

SEQ ID NO: 16264 - DNA, 50 bp, homo sapien
gattcaagcaatctctgtcaaaataycaggcagctttttttgtttatttt

SEQ ID NO: 16265 - DNA, 50 bp, homo sapien
cttaagtcttctcaaagatgtgttcrcagaaatcatgattttaagctaaa

SEQ ID NO: 16266 - DNA, 50 bp, homo sapien
tgatacacaagaacagttagttataygctttgaccttgattgtgagccac

SEQ ID NO: 16267 - DNA, 50 bp, homo sapien
actgtaacagaagcaattagatggcmacacaagttttaggccacataaga

SEQ ID NO: 16268 - DNA, 50 bp, homo sapien
aaatatgttggacatgtttttaagasgaagatcttgttcagcttttggct

SEQ ID NO: 16269 - DNA, 50 bp, homo sapien
acattgtgggggattatgtaacaaargaaatgactgtgactcaaggggta

SEQ ID NO: 16270 - DNA, 50 bp, homo sapien
cactcagtggcttcctaaattttcayaagcatttccatgtattaattata

SEQ ID NO: 16271 - DNA, 50 bp, homo sapien
caggccaacaaagtttcacagttcaygtcaagcatccagaccttcagtac

SEQ ID NO: 16272 - DNA, 50 bp, homo sapien
ttgaacaaagtaaattaagtttctaygtatgatggtttctaaacacctaa

SEQ ID NO: 16273 - DNA, 50 bp, homo sapien
atgatgaaaaataataatgaggttcrcattaaacctttgaattggatcaa

SEQ ID NO: 16274 - DNA, 50 bp, homo sapien
aattccccatccaggataactaaagscctctcttcatttgaataaaaaca

SEQ ID NO: 16275 - DNA, 50 bp, homo sapien
aactcaaactcagaatagcagaaaakgaataggattaaggtctcaagatt

SEQ ID NO: 16276 - DNA, 50 bp, homo sapien
tgaaatgggatataagttgaaaagaractaagggatttttgaaattaaat

SEQ ID NO: 16277 - DNA, 50 bp, homo sapien
gggctcaggaggaaccataatgccaratgacacagtcacatggaagggca

SEQ ID NO: 16278 - DNA, 50 bp, homo sapien
agcaactgggttgttttgctcgaaaycttttgctcttaatgacttttaaa

SEQ ID NO: 16279 - DNA, 50 bp, homo sapien
ccaagaaccaggagacaagcaaaaasggaatgtgaacagttaaatacttc

SEQ ID NO: 16280 - DNA, 50 bp, homo sapien
tatggttattccttccaattgcaccrctagatttttggtttgtttccaaa

SEQ ID NO: 16281 - DNA, 50 bp, homo sapien
cataggtaaaatcctttcctaacaayggtttctgtacagtaaaatccttt

SEQ ID NO: 16282 - DNA, 50 bp, homo sapien
aagaccttcagtagcaaatgaaagasgaagtgtagtaattgacatgggaa

SEQ ID NO: 16283 - DNA, 50 bp, homo sapien
gccaggctaagcactcaaaagtaaaytccacttctgagttccactggatt

SEQ ID NO: 16284 - DNA, 50 bp, homo sapien
ggtgctgggggagcagtaaaattcasggaccaccacatggaaattctaat

SEQ ID NO: 16285 - DNA, 50 bp, homo sapien
cctgtgatgctctccttaccaccatsaacacttgcctttgcctagttaac

SEQ ID NO: 16286 - DNA, 50 bp, homo sapien
tttaaacttatagcaaactttctgayatatatgccctaacgcaaattctt

SEQ ID NO: 16287 - DNA, 50 bp, homo sapien
ttcatagagcttccagaagagtgtgraagatggataggtaaacagataag

SEQ ID NO: 16288 - DNA, 50 bp, homo sapien
agcctgttgttctttcttacagtaaygctcctaaaccagtgtttttcaga

SEQ ID NO: 16289 - DNA, 50 bp, homo sapien
tttcactaatgcatgagagctacaaragagccgaactctacatgggtgag

SEQ ID NO: 16290 - DNA, 50 bp, homo sapien
gatctcataacaactgtgtaacatakgtaggactatataattatgtctag

SEQ ID NO: 16291 - DNA, 50 bp, homo sapien
gcctgtccagaagcatcatgacccaygtaaggtagaggagatgtgcaaag

SEQ ID NO: 16292 - DNA, 50 bp, homo sapien
aacttttatgtaaattggctatgacrcctgtgcaggggcccagatttaga

SEQ ID NO: 16293 - DNA, 50 bp, homo sapien
aaaaaagaaaccacagagttagctgmaacttaaggtaactagaaaggctc

SEQ ID NO: 16294 - DNA, 50 bp, homo sapien
aggcagtggagtgggggtattgtgawcctattgattggatttcaggtcct

SEQ ID NO: 16295 - DNA, 50 bp, homo sapien
atcaaaatttgactctactctctatkaacttgggacctatagtaaattgt

SEQ ID NO: 16296 - DNA, 50 bp, homo sapien
tactccattctacttggaaggaaagyctcaacacataggttttcctaaaa

SEQ ID NO: 16297 - DNA, 50 bp, homo sapien
aacaatctcttccaatcaataggcasagtctaggtttatgaaacgggcct

SEQ ID NO: 16298 - DNA, 50 bp, homo sapien
tatatgtaaatgtaagtagtgcttaycgtatttctgtttagaaagtaact

SEQ ID NO: 16299 - DNA, 50 bp, homo sapien
tctagtccagcctttgtcacaggaamtctcaatatgcctgaaccttggta

SEQ ID NO: 16300 - DNA, 50 bp, homo sapien
tcggtttgaaaatggattgctctacrctgagagagaggccacagcagctg

SEQ ID NO: 16301 - DNA, 50 bp, homo sapien
gcatatttctagtaagatcaataaastaccagcaacaaaactcacagaat

SEQ ID NO: 16302 - DNA, 50 bp, homo sapien
tagagatacaataatgtaaaaataayggatagaggtatcataaattattg

SEQ ID NO: 16303 - DNA, 50 bp, homo sapien
gtcagctctaggcaagagccatagasagaaaagaattttgagaaagttga

SEQ ID NO: 16304 - DNA, 50 bp, homo sapien
tccatttccatgggactgatttaacrgaagtttcaattaccacccctccc

SEQ ID NO: 16305 - DNA, 50 bp, homo sapien
gagaagcttcacgatcccttacttawggccacagagttcatcagcttccc

SEQ ID NO: 16306 - DNA, 50 bp, homo sapien
gcaactcactaagaatgtgttcaacrgtggactaagtatttaaagctttt

SEQ ID NO: 16307 - DNA, 50 bp, homo sapien
gggaataatactatctaaaactaatracgtctacattttctgtacccata

SEQ ID NO: 16308 - DNA, 50 bp, homo sapien
aaaaggaaaataaacattatagttawgttacaggtaaagaaacaaggtaa

SEQ ID NO: 16309 - DNA, 50 bp, homo sapien
atttcacatggtaaatactctgtaartatggtagaatgagaaaatgaata

SEQ ID NO: 16310 - DNA, 50 bp, homo sapien
aaatttgtattttaaaaaatctaccygcaaatactttatgttcaacatgc

SEQ ID NO: 16311 - DNA, 50 bp, homo sapien
gagataaatttttcttgccgcttacrcctggttgttctcccaccctgctc

SEQ ID NO: 16312 - DNA, 50 bp, homo sapien
ctcaatgaaatgaacagccctgttayaggtagaggatgacaccatattat

SEQ ID NO: 16313 - DNA, 50 bp, homo sapien
gagagataaggaataaagaagagacraaaagagtgatggaggaagaggat

SEQ ID NO: 16314 - DNA, 50 bp, homo sapien
ccttccaatgcaccagaaaaacagasgacatatgtaaatacttaaggtca

SEQ ID NO: 16315 - DNA, 50 bp, homo sapien
tgatcaccggtatagacagtgacatsagacatctttcattagccctactc

SEQ ID NO: 16316 - DNA, 50 bp, homo sapien
atgaaaatgcaaagacaaaactcaayacgtggctaatcttccagtagatg

SEQ ID NO: 16317 - DNA, 50 bp, homo sapien
acatggcaagttgatgtagcccaaayagtaaataatctggataatctatt

SEQ ID NO: 16318 - DNA, 50 bp, homo sapien
aaaaaaaaaaaggaaaaaaggagaargtgacttaaagaatcaggatttgg

SEQ ID NO: 16319 - DNA, 50 bp, homo sapien
atttgccagacatgatccctttagasaaatctagtatctaaaacctgaat

SEQ ID NO: 16320 - DNA, 50 bp, homo sapien
tttacatgttttttagttacaaccawctcatgcaaattgttacagtatgt

SEQ ID NO: 16321 - DNA, 50 bp, homo sapien
ggcagagagacaagcagctgaacgtsaaaaggagaagcaactgagtgtcc

SEQ ID NO: 16322 - DNA, 32 bp, homo sapien
aagcaactgagtgtccsaaactataaacagat

SEQ ID NO: 16323 - DNA, 50 bp, homo sapien
aagctttgcatatgtgagatggcaasgttctttcctacatctatttttga

SEQ ID NO: 16324 - DNA, 50 bp, homo sapien
gtgctgatagcaaccctggaagaacraagtgtgacaaaacctcaggttcc

SEQ ID NO: 16325 - DNA, 50 bp, homo sapien
aagtgggaatgcagtttggctagtgmaagtggcagatttcctctgccttc

SEQ ID NO: 16326 - DNA, 50 bp, homo sapien
atgcagagagggaagctgccctggaragttatccagattgcttgaatact

SEQ ID NO: 16327 - DNA, 50 bp, homo sapien
gtacaggagctgggggaatgtggcargaatgaaccccgtactggtactgg

SEQ ID NO: 16328 - DNA, 50 bp, homo sapien
tacctcagaatgtgaccttatttagrcaggattttacagaggtaagcaag

SEQ ID NO: 16329 - DNA, 50 bp, homo sapien
actccttgcagcataatgaggtcacmgggtaaacccatggatgttcaaat

SEQ ID NO: 16330 - DNA, 50 bp, homo sapien
aacaagcctaaggaactctgtactcrctgtgcacaggcaggtggagcgga

SEQ ID NO: 16331 - DNA, 50 bp, homo sapien
gatttttccccatttagaatagaacraaatcaagaatataggaagaaata

SEQ ID NO: 16332 - DNA, 50 bp, homo sapien
ctgactcaccctgtccatcaagaaaracaatggtacccagagatggaaac

SEQ ID NO: 16333 - DNA, 50 bp, homo sapien
ttgatccttaacttgggcatagtatyaaatgctgtacatgagataattgg

SEQ ID NO: 16334 - DNA, 50 bp, homo sapien
cacacaaccatctacaaaccaaaaayggacccagtctctggtctgaggag

SEQ ID NO: 16335 - DNA, 50 bp, homo sapien
gcttcctgaaagcctgcttactgtaygagttctaaatgctttatgtacac

SEQ ID NO: 16336 - DNA, 50 bp, homo sapien
tttgtagaactgatgatatatgactkagagatacagtctcagctacaact

SEQ ID NO: 16337 - DNA, 50 bp, homo sapien
ctgcagctcatcagggtattaattakcctgagtttgttatttatcactcc

SEQ ID NO: 16338 - DNA, 50 bp, homo sapien
agtttccgataaagctaagactcccrgaagagcgtaagtcaagtagccaa

SEQ ID NO: 16339 - DNA, 50 bp, homo sapien
gggaagcccggtttatgctctgaagragaaaaccagtaagtaatagtaga

SEQ ID NO: 16340 - DNA, 50 bp, homo sapien
ccaccaaggatgattcctactgattsaaactaagaaaatgtggcaccttt

SEQ ID NO: 16341 - DNA, 50 bp, homo sapien
tgttctgatccccttacggagttacsatcatcaaaaacaactttaaacaa

SEQ ID NO: 16342 - DNA, 50 bp, homo sapien
tgttagctaaaattattatgatatcmcttatcctgagaacatagtaagca

SEQ ID NO: 16343 - DNA, 50 bp, homo sapien
agtgtcttataaataagtagaaatgscacattaaacacaagtttgctaga

SEQ ID NO: 16344 - DNA, 50 bp, homo sapien
cccatattagagagccttataatcaygttaatcaagtacttatgggagct

SEQ ID NO: 16345 - DNA, 50 bp, homo sapien
caatgtttgccatttttgaaaagaargtgaagaaagaggaaaagaacagc

SEQ ID NO: 16346 - DNA, 50 bp, homo sapien
actttccatcactggtggaatataaytgaatccaagataattttaagcct

SEQ ID NO: 16347 - DNA, 50 bp, homo sapien
agtgtaactagcatatagtcttacayacagcagatgcttacttactcact

SEQ ID NO: 16348 - DNA, 50 bp, homo sapien
aacttctttttcttttaaaagaggarcacttctaaccattttctgaggca

SEQ ID NO: 16349 - DNA, 50 bp, homo sapien
tgaagctgtacctagagaggacatcrctttatggtggtggagagcacaga

SEQ ID NO: 16350 - DNA, 50 bp, homo sapien
aagaaggatttgaggtatattatgcrgaagtttatcactccatcaattaa

SEQ ID NO: 16351 - DNA, 50 bp, homo sapien
gtattttattttacttttcgttatasagtcttctcgattattttaactaa

SEQ ID NO: 16352 - DNA, 50 bp, homo sapien
actgcttaacataattatgcacgggmattttggttgatccagcatggtta

SEQ ID NO: 16353 - DNA, 50 bp, homo sapien
tatgggcaattcaatactgtacttaygacaacaacaacaacaacaaaggc

SEQ ID NO: 16354 - DNA, 50 bp, homo sapien
taagcttcttgaaaaattagtgagaycgtttcttatgacctatgaaccag

SEQ ID NO: 16355 - DNA, 50 bp, homo sapien
tttattgtggaaaacattgaacaaasgcgaaactagaaaaaatagtaaca

SEQ ID NO: 16356 - DNA, 50 bp, homo sapien
gacatatcacaaattgtagcatctascagccatatctagcacatagaagt

SEQ ID NO: 16357 - DNA, 50 bp, homo sapien
ttttctccattcaatctaatttctayggctagaactagagtagctaagag

SEQ ID NO: 16358 - DNA, 50 bp, homo sapien
tggctctgcctacatatctcagaagragactaatcagaatcaggaagaat

SEQ ID NO: 16359 - DNA, 50 bp, homo sapien
tatatttaatagacaaagaaatcacyatatatttaagcaagaaaatagat

SEQ ID NO: 16360 - DNA, 50 bp, homo sapien
tacaaataatacaaagatatgccaaygtaaaatatcattattataatgtt

SEQ ID NO: 16361 - DNA, 50 bp, homo sapien
ttaacagatgggagaaaataaacaaytatacgggacactatctcaagctt

SEQ ID NO: 16362 - DNA, 50 bp, homo sapien
tggctcatcacaattaatgaaagatragcgctatataagtttctcctctg

SEQ ID NO: 16363 - DNA, 50 bp, homo sapien
cacatcaaatcctgttacctcttaaytatacacactaatgaagggataaa

SEQ ID NO: 16364 - DNA, 50 bp, homo sapien
cattctcaagttgttgctgagagtgyaaaatggttcagctccaaatggag

SEQ ID NO: 16365 - DNA, 50 bp, homo sapien
gtggccatgcctgacttctccataamctgaatcaagccaagtatatataa

SEQ ID NO: 16366 - DNA, 50 bp, homo sapien
ccaggcataacatatgaagtatcgayagggaaagtgaaagatatggcacc

SEQ ID NO: 16367 - DNA, 50 bp, homo sapien
atgtaccactcatgtaacctacttaygtttgcaaccacaaagatcccatt

SEQ ID NO: 16368 - DNA, 50 bp, homo sapien
gcagtctaataattgggagggaaaaygaagtataaggctaaatgaagtag

SEQ ID NO: 16369 - DNA, 50 bp, homo sapien
tcctctaagatactctataattagascagtttcttactaatagtatacat

SEQ ID NO: 16370 - DNA, 50 bp, homo sapien
atactatcctgtccacaaactgattsaaaggttctattcatctgacttac

SEQ ID NO: 16371 - DNA, 50 bp, homo sapien
taagaagtaatctggcctcgaatackctatcatgctaacaaatgtggacc

SEQ ID NO: 16372 - DNA, 50 bp, homo sapien
ataacactcttagctggttctgttaygcacgaaaatttgaaaatcagagt

SEQ ID NO: 16373 - DNA, 50 bp, homo sapien
cttttcctacattgagagagctaagmatctgatggagaaaagaaacacac

SEQ ID NO: 16374 - DNA, 50 bp, homo sapien
aaatataacacttaagaagcaaagayagattgagtttaaatgatgttgtt

SEQ ID NO: 16375 - DNA, 50 bp, homo sapien
ccctcattaagacatttatggacaayctttaacttggcattgttttcaga

SEQ ID NO: 16376 - DNA, 50 bp, homo sapien
cctggctccctagggatggggtcacrgatgtgtttatcttgttggaggag

SEQ ID NO: 16377 - DNA, 50 bp, homo sapien
tgtaaacaatgtagctacccgatagyagaaaaaaggataaataatttata

SEQ ID NO: 16378 - DNA, 50 bp, homo sapien
tgactttaatagaaaagtattctaaragcagtactcaaagtattcaaccc

SEQ ID NO: 16379 - DNA, 50 bp, homo sapien
tccaggtgtggtctacatgatattaratggagatatttttctgaaagcaa

SEQ ID NO: 16380 - DNA, 50 bp, homo sapien
cagggaagatggcagaacctgacaaygttaaggcaggctgctgccactgc

SEQ ID NO: 16381 - DNA, 50 bp, homo sapien
ccataaagctttccttcactgttaargcaaaattactttttgtacattgg

SEQ ID NO: 16382 - DNA, 50 bp, homo sapien
ggtggtggacttgagtgtctacttaygcgcagagattttcagtcttttat

SEQ ID NO: 16383 - DNA, 50 bp, homo sapien
taggcgtaagccagcactcctggccyaaggtttttactgagggttgctca

SEQ ID NO: 16384 - DNA, 50 bp, homo sapien
aagtccaccaccaactctgaatgcawctaacctaaggaaccatgccatct

SEQ ID NO: 16385 - DNA, 50 bp, homo sapien
ctaacaaccaacaactactaatagamcacctgtgaccctgagctttgtag

SEQ ID NO: 16386 - DNA, 50 bp, homo sapien
gtcagggcttggcgcatgtctgtggwagaaggtgcctttcccattgttct

SEQ ID NO: 16387 - DNA, 50 bp, homo sapien
ggtagaaaaaaaaaatcttgtgggaratcataaagacaggtcactactgt

SEQ ID NO: 16388 - DNA, 50 bp, homo sapien
attctctgctcagccactaacacaaraggagatggccacacacatagaat

SEQ ID NO: 16389 - DNA, 50 bp, homo sapien
tggtatggtgtatgcttactaactakgtatttgttacagaaattcaaata

SEQ ID NO: 16390 - DNA, 50 bp, homo sapien
ttaatgaattagtcttaggtaataaytgtgggttcagattattggtgttt

SEQ ID NO: 16391 - DNA, 50 bp, homo sapien
agttaatccctgaatttatttgggaractcatcagtttagaaacctatgg

SEQ ID NO: 16392 - DNA, 50 bp, homo sapien
tgagcaaataatacacatatacaaasaaagttaataaaagaatttgtgat

SEQ ID NO: 16393 - DNA, 50 bp, homo sapien
aacttcaaacacgctatcatgttaakatcaaaattttatgaaatcaaaat

SEQ ID NO: 16394 - DNA, 50 bp, homo sapien
atgaattggtaaagattgaaaaagayggtatggatgtgtttgaattattc

SEQ ID NO: 16395 - DNA, 50 bp, homo sapien
ttagaatacttttctattaaagtcaraatgagagaaactttttaaagcct

SEQ ID NO: 16396 - DNA, 50 bp, homo sapien
tgcgcagaggctgaattcctccatcmagagagtgccagggtgcctccagc

SEQ ID NO: 16397 - DNA, 50 bp, homo sapien
tacacagaagctgaaagcacagtgcmgaaatggttatatttagaccctgg

SEQ ID NO: 16398 - DNA, 50 bp, homo sapien
agacatttatggaagaaagagatcaycatggtctgggaaaagcttttgtg

SEQ ID NO: 16399 - DNA, 50 bp, homo sapien
agccagcacaacctgattattcctaygaacagattcttgatgtgactgaa

SEQ ID NO: 16400 - DNA, 50 bp, homo sapien
tcagtaaatgagcactgccttatagratattgctgaatatgtcttgaata

SEQ ID NO: 16401 - DNA, 50 bp, homo sapien
atgtgagtgcaggaattgtttggccyattgctttctgatggatcttttcc

SEQ ID NO: 16402 - DNA, 50 bp, homo sapien
ttcagaaatttttcttcttcatccartgatattgtagctcttattactaa

SEQ ID NO: 16403 - DNA, 50 bp, homo sapien
ttcatctcctgtgctctgggaaatcrctaccaccctctaattggatgttg

SEQ ID NO: 16404 - DNA, 50 bp, homo sapien
gatgttaccaagttgttcacttctamatcagtcatatctaaatcacacgt

SEQ ID NO: 16405 - DNA, 50 bp, homo sapien
attctcttaaagctgatatttcaacygtagagccataattttatctctaa

SEQ ID NO: 16406 - DNA, 50 bp, homo sapien
agtaacacagtgataaaagatttccrcatgggaagagtttaagcttttta

SEQ ID NO: 16407 - DNA, 50 bp, homo sapien
tcctttacttgatcatctcgaaaacygttacaaccacagcaattataatc

SEQ ID NO: 16408 - DNA, 50 bp, homo sapien
tattactgtggccacagctcctatawaccagaaccagagtgatgtgaagt

SEQ ID NO: 16409 - DNA, 50 bp, homo sapien
aatgtgaatagggcagtaaagcctgmaaacaacagcaacaaaagaatgtt

SEQ ID NO: 16410 - DNA, 50 bp, homo sapien
tcctgatgcaggactcatacccagayggtctagccctcagacaactttga

SEQ ID NO: 16411 - DNA, 50 bp, homo sapien
tacttttttttaacgctgtcaccgargtagaatagatattcaatggagcc

SEQ ID NO: 16412 - DNA, 50 bp, homo sapien
ctaatatgatattgtatgtaagtgayggtaactaacatttacatctaatt

SEQ ID NO: 16413 - DNA, 50 bp, homo sapien
ttaaacagattcatcctatgtggaaktcttcactgtcttaagctacagct

SEQ ID NO: 16414 - DNA, 50 bp, homo sapien
cagaatgacacttgaaagatgcctargatttctactgctgctcttagaat

SEQ ID NO: 16415 - DNA, 50 bp, homo sapien
tgttctactgttgatgtgcttattamcatgtcactccccactcaggatcc

SEQ ID NO: 16416 - DNA, 50 bp, homo sapien
tgcttccacctgttgcccaagtgaaratgttgaggctgtaatctttgtgg

SEQ ID NO: 16417 - DNA, 50 bp, homo sapien
attgtactcactgtaacaacgataamataaaatagtggcataaatgcccc

SEQ ID NO: 16418 - DNA, 50 bp, homo sapien
ctggacactgccaattccattctccyaagcaagagcaagggcttttcaac

SEQ ID NO: 16419 - DNA, 50 bp, homo sapien
agcctactgcccagttctgaatccartctcatcagtctgccacactggag

SEQ ID NO: 16420 - DNA, 50 bp, homo sapien
gtattgctgggatgaagagggagaargaatgcctgttggttcacctgtgg

SEQ ID NO: 16421 - DNA, 50 bp, homo sapien
actccagggtcatgactgggaactayaattttcacatcttcttctataag

SEQ ID NO: 16422 - DNA, 50 bp, homo sapien
agcctggactgaaagcacctgtttcratcttatgtgctgaaagcaaaacc

SEQ ID NO: 16423 - DNA, 50 bp, homo sapien
cagctattcaccacctggaacctcaygtgaagcagcttctctcaggaatg

SEQ ID NO: 16424 - DNA, 50 bp, homo sapien
actgctataaagaactgcctgaaackaggtcatttataaaggttaaattg

SEQ ID NO: 16425 - DNA, 50 bp, homo sapien
acaatgtctagtcacttaacctcacmgggcagatttgctcaactaataag

SEQ ID NO: 16426 - DNA, 50 bp, homo sapien
atttctggaaggaagtggccagcacrcaggtagacagctgcagcagtggc

SEQ ID NO: 16427 - DNA, 50 bp, homo sapien
caatcggattttcatgtcctggaaartttcagcaccattgttcctcccag

SEQ ID NO: 16428 - DNA, 50 bp, homo sapien
gggaacttgggcatcctagtagagamcattacaaagtgatggagttggtg

SEQ ID NO: 16429 - DNA, 50 bp, homo sapien
ctttgtgatcacagtcaagggagaartcaagaagagggaagtgtaatctg

SEQ ID NO: 16430 - DNA, 50 bp, homo sapien
ttactgaaagtaaatctgtggctcaragagacttcggtattcttttccct

SEQ ID NO: 16431 - DNA, 50 bp, homo sapien
ctagggggtaatgtgctagggtgcartaagttaagtgttagtcacatatt

SEQ ID NO: 16432 - DNA, 50 bp, homo sapien
attaaacagttacctaatacaaagamaatctaggctgaatagcttcaaat

SEQ ID NO: 16433 - DNA, 50 bp, homo sapien
ttaaaggtgaaatattgttagcctamgtaatctctactcttttgtgtccc

SEQ ID NO: 16434 - DNA, 50 bp, homo sapien
tggtaacagcaaaaatgacccaccartggaagaagctggcttcactgccc

SEQ ID NO: 16435 - DNA, 50 bp, homo sapien
gcctcatcagtgtgtgtccaacctakctgggctcacagaagcttggatag

SEQ ID NO: 16436 - DNA, 50 bp, homo sapien
tttctaagggtattcttttctaaccrgaccacgaaatctccaggctacct

SEQ ID NO: 16437 - DNA, 50 bp, homo sapien
aacaaaaaaacaccattacatcagasagaatgcatttttgatatacaccc

SEQ ID NO: 16438 - DNA, 50 bp, homo sapien
gaagactgttgtacatctgtttaccwattctactggggaacttcctaccc

SEQ ID NO: 16439 - DNA, 50 bp, homo sapien
ttctggcccaaatatgaatctagaaytgtgcttaggaaagaccctgagaa

SEQ ID NO: 16440 - DNA, 50 bp, homo sapien
caatcatccttatcctcaggcatgaytcagaaggagaaacaaagtcaaac

SEQ ID NO: 16441 - DNA, 50 bp, homo sapien
tgaaaagggaaagctgatagaaggayagcttaccgagaaaaaggaatagc

SEQ ID NO: 16442 - DNA, 50 bp, homo sapien
accataccacagaaaagtatttgccrcatcccacaccctcaacgctccta

SEQ ID NO: 16443 - DNA, 50 bp, homo sapien
acttctgaaaccaacttccttaaacyctcatgtataaggtagctatacac

SEQ ID NO: 16444 - DNA, 50 bp, homo sapien
ttaacattttggtgggacccttaaarttcagattcttcctgagatatatg

SEQ ID NO: 16445 - DNA, 50 bp, homo sapien
gattatagtagcattcctactctaayagtaccttcttcccaaggctgcca

SEQ ID NO: 16446 - DNA, 50 bp, homo sapien
gcagatgaggaatctaaggctcatakgtcagtaagccagtaaaaggcaga

SEQ ID NO: 16447 - DNA, 50 bp, homo sapien
catgatggtataagagctctaagtayatgaagtttacacagaatttatgt

SEQ ID NO: 16448 - DNA, 50 bp, homo sapien
aaggtcaggaatagcttatttaggasatggagagtttctgggccaggcgc

SEQ ID NO: 16449 - DNA, 50 bp, homo sapien
aaaaaaaattatgtgtagacctcacrgatgcttatgggttgaaactggct

SEQ ID NO: 16450 - DNA, 50 bp, homo sapien
ccaaacttttaaagccagtgagctawaagttaatgcctttataaaggaat

SEQ ID NO: 16451 - DNA, 50 bp, homo sapien
ccactttaagcttctttcttttacayccgggcactaaaaatagccggcta

SEQ ID NO: 16452 - DNA, 50 bp, homo sapien
tccagtccacaataagttaaatcackatgttaaatgaaccttgagttatg

SEQ ID NO: 16453 - DNA, 50 bp, homo sapien
cgaggttgtaaagaaccttgtatgcygagtaggaaatgttcatctttatt

SEQ ID NO: 16454 - DNA, 50 bp, homo sapien
tctatttggtgtttgaattatagaaygcttcatgaattggattaattaat

SEQ ID NO: 16455 - DNA, 50 bp, homo sapien
atcagagaactattagtagcaatcayatataacattttgccttctggcag

SEQ ID NO: 16456 - DNA, 50 bp, homo sapien
cttcattactgaaggatgtgtaataycaaatcgcgtatcactgcagggga

SEQ ID NO: 16457 - DNA, 50 bp, homo sapien
gctcaagaaacttatgacatagtaayccttctgtatacatcctatagaat

SEQ ID NO: 16458 - DNA, 50 bp, homo sapien
tgtgagagaggcagacaacagataarcaaatagatatactgtatcagatc

SEQ ID NO: 16459 - DNA, 50 bp, homo sapien
atacggcaggtttgtatggtctatarctaagaggtttattttttccagat

SEQ ID NO: 16460 - DNA, 50 bp, homo sapien
ttatcaaaacttaagatttagcttayatgctttagatcttttttccatta

SEQ ID NO: 16461 - DNA, 50 bp, homo sapien
agtgtaaaattcttcactgacctagrattataacaactagcattcattca

SEQ ID NO: 16462 - DNA, 50 bp, homo sapien
gtttgaaagcatctgaattaggacaygaagacccaagtacaagcgacaga

SEQ ID NO: 16463 - DNA, 50 bp, homo sapien
ttcccactttttcaggggattaactraggcaccgtaagatgcaactctct

SEQ ID NO: 16464 - DNA, 50 bp, homo sapien
aggacaagaaaagcactgtataaaawgtctgaaacaaaactagtttgcat

SEQ ID NO: 16465 - DNA, 50 bp, homo sapien
ggtatttacaccaaaagtcaatgtasaaaaagaaactaacatagcaattt

SEQ ID NO: 16466 - DNA, 50 bp, homo sapien
ggcctgaaattgtcaaatgaatgaaygcctcatcctcttgctggtgactg

SEQ ID NO: 16467 - DNA, 50 bp, homo sapien
atgttggtgatgaaaatcaaagacaygtagactttctatgtgaacaacag

SEQ ID NO: 16468 - DNA, 50 bp, homo sapien
gtttcaggaagcttgtccaggtatcyatgagacaatcatcaaatcgttga

SEQ ID NO: 16469 - DNA, 32 bp, homo sapien
tctcttccaggcttaaygaggtgttgtgggct

SEQ ID NO: 16470 - DNA, 50 bp, homo sapien
aagaagtgtgatggatcaggattggwatatgtggacaggcctgagtgaga

SEQ ID NO: 16471 - DNA, 50 bp, homo sapien
caggaactatttcaacaggaaatgcyatatgaggtctattgagaacattg

SEQ ID NO: 16472 - DNA, 50 bp, homo sapien
ctgtccccaggggccagctgcataayatgaatagatgaaatagaccagac

SEQ ID NO: 16473 - DNA, 50 bp, homo sapien
atttctccctcaactcttgaccctastaattattatgtactaatctgttc

SEQ ID NO: 16474 - DNA, 50 bp, homo sapien
gctgtgatttacaactcaagtgacartcaatcattagaagtaacttatag

SEQ ID NO: 16475 - DNA, 50 bp, homo sapien
ccaccttgacattaattatgcaccaygatgtttagagagcaactccgagc

SEQ ID NO: 16476 - DNA, 50 bp, homo sapien
aatgaagatattttggaatttgacargagagttttttaacttatgcctaa

SEQ ID NO: 16477 - DNA, 50 bp, homo sapien
tttcagaagaagacatagagatacgyagttatttgcctaagctttgagga

SEQ ID NO: 16478 - DNA, 50 bp, homo sapien
attattgcagaactcccattgcaaaygctttgttgggtacagattaaaat

SEQ ID NO: 16479 - DNA, 50 bp, homo sapien
ctaatccttatttcttcctttagcaycattagcccttgtaggtggcatct

SEQ ID NO: 16480 - DNA, 50 bp, homo sapien
gttttgtttatgccattgcttagaasaattatttttaaatcacatttcag

SEQ ID NO: 16481 - DNA, 50 bp, homo sapien
gttctaccctgtgatcacatatgaartcacccagaagttagttttcaggc

SEQ ID NO: 16482 - DNA, 50 bp, homo sapien
tattgccatcctcactcaatgacccrgaatgacaaagaagccgctaccag

SEQ ID NO: 16483 - DNA, 50 bp, homo sapien
gcctgagacttgtgaatgataattgragctaaccagaggttttacagtga

SEQ ID NO: 16484 - DNA, 50 bp, homo sapien
atgagatttggagcaaggtctagaarctcatatcagcaaggagtaagtat

SEQ ID NO: 16485 - DNA, 50 bp, homo sapien
cgacaatcacagcttttacatgttayaattgagttatttctataacagaa

SEQ ID NO: 16486 - DNA, 50 bp, homo sapien
gcgggagttcttcgtccacttagtarctagactccctgtacactgagatg

SEQ ID NO: 16487 - DNA, 50 bp, homo sapien
atgttttgcctaagatttattgcacraaatttgaatatggtagcaatgat

SEQ ID NO: 16488 - DNA, 50 bp, homo sapien
ctgtagagcttgaagatctttcaaastccatgatcacctcatgacaatga

SEQ ID NO: 16489 - DNA, 50 bp, homo sapien
atagagcacatatttaagacaccggkaggcattaggtctaagggctagaa

SEQ ID NO: 16490 - DNA, 50 bp, homo sapien
cattcatttatttggttttaagttayatgtgttataaaatctgtttctta

SEQ ID NO: 16491 - DNA, 50 bp, homo sapien
gtaaagagaaatgttttaatacacartgatgtttgggctatattctacag

SEQ ID NO: 16492 - DNA, 50 bp, homo sapien
tacaaagtaaactatcaatgccaacrggattagaatgaaaactatgattt

SEQ ID NO: 16493 - DNA, 50 bp, homo sapien
ttccctttgtttttctcattgctcarcaagtatttcaggagtgcctactg

SEQ ID NO: 16494 - DNA, 50 bp, homo sapien
ggaattttaccaccttttacccagayctgcaaaccatgttgttaatactc

SEQ ID NO: 16495 - DNA, 50 bp, homo sapien
cttcccctaaatggaattccacttaygatgcattttgtcagccagatttc

SEQ ID NO: 16496 - DNA, 50 bp, homo sapien
gccatttgcagaatacaagatttcargtgaaaggtgacagaggaaaatat

SEQ ID NO: 16497 - DNA, 50 bp, homo sapien
tcttgagttttgatatgaattatgaraactgagaatttgacactgaccta

SEQ ID NO: 16498 - DNA, 50 bp, homo sapien
tggaagagctccagatcttgcatcamaattagcctcttgaatgggctttt

SEQ ID NO: 16499 - DNA, 50 bp, homo sapien
ctttttttctcctttttttcaacaaytgaacacagtaaacaggaattaca

SEQ ID NO: 16500 - DNA, 50 bp, homo sapien
cgtgatgggccatccaagattgtaaygggcgatcattggaaacaaagatg

SEQ ID NO: 16501 - DNA, 50 bp, homo sapien
tccatgagaaactgtgcaggggatamatggccaaataatagcatgcacta

SEQ ID NO: 16502 - DNA, 50 bp, homo sapien
gaagcttttgtcagttgaaacctctsagaaaataaagctgaagtgggtga

SEQ ID NO: 16503 - DNA, 50 bp, homo sapien
ccatctgatacatgcatccttgtaartaaagggataatttgtcctacttt

SEQ ID NO: 16504 - DNA, 50 bp, homo sapien
cttatgtaaaaggattcagtttaaargaaattgggtaataattaagggca

SEQ ID NO: 16505 - DNA, 50 bp, homo sapien
atcttggtccataattttacccactractcttgcaatcaagggggataaa

SEQ ID NO: 16506 - DNA, 50 bp, homo sapien
gtctttagcatcccaaaaggactcastgacactccatcccttgcatgctt

SEQ ID NO: 16507 - DNA, 50 bp, homo sapien
gagatgtcccctaatcatttttagaytaagtgcatgcaatttcacataca

SEQ ID NO: 16508 - DNA, 50 bp, homo sapien
tctaggcttcacccaaataccaacartaagaacttgagtagttcctggga

SEQ ID NO: 16509 - DNA, 50 bp, homo sapien
gatctatcttctttcaactacctcayacaacctctctgttaaagcttacc

SEQ ID NO: 16510 - DNA, 50 bp, homo sapien
ccctctaacggtggcatttccaccakactcttgagttttcagtttgaggg

SEQ ID NO: 16511 - DNA, 50 bp, homo sapien
atgcattcatagtgcattcattccartattcatttcttccttgggtcctg

SEQ ID NO: 16512 - DNA, 50 bp, homo sapien
gggattagttaactaaatgatggtamacctacggacagaacactgcagtg

SEQ ID NO: 16513 - DNA, 50 bp, homo sapien
atcaaagcaaaagcagattagtcaasaacaaaggtcatggcaacagtttt

SEQ ID NO: 16514 - DNA, 50 bp, homo sapien
tccctcaggagtgctaagccagcgartattttgattttatggccctgggc

SEQ ID NO: 16515 - DNA, 50 bp, homo sapien
ttccggaaaaccgtatttaaaagcakgattgacgaccaaagaaaaatgag

SEQ ID NO: 16516 - DNA, 50 bp, homo sapien
tttcacagtaagtagcgaagggcagrctataacaatttgttgagtaccta

SEQ ID NO: 16517 - DNA, 50 bp, homo sapien
gaaaaggggcttatgcctcaaaatayaggcctggaatccaagaagactgg

SEQ ID NO: 16518 - DNA, 50 bp, homo sapien
tcagttcaatgtgggtttctgtcacrctatcaactaaagaagatcttaac

SEQ ID NO: 16519 - DNA, 50 bp, homo sapien
atttcagttaaaaaaatagattaaargcacaaaatagatttccaaacaaa

SEQ ID NO: 16520 - DNA, 50 bp, homo sapien
agaggcttaattgcagggaatttagraaaagtaagtctatcaaaaggttg

SEQ ID NO: 16521 - DNA, 50 bp, homo sapien
ttgataatgtcaccaagagtttactmaaccagaaattttactgagagcac

SEQ ID NO: 16522 - DNA, 50 bp, homo sapien
taattttcagaaaaattgtgctacarctaggatgtgatatttaattattt

SEQ ID NO: 16523 - DNA, 50 bp, homo sapien
ccatgaaggtcaaacaaggcataatsagacacacagtgttttttattctt

SEQ ID NO: 16524 - DNA, 50 bp, homo sapien
agaggtactcacagtctgatgaggasacagacatagaagacacagagtag

SEQ ID NO: 16525 - DNA, 50 bp, homo sapien
acactagggcttcaatatatgtcaayttcctgcaggaaaaatgaacaaaa

SEQ ID NO: 16526 - DNA, 50 bp, homo sapien
tataaagcttccttttagagtttcarataagtgggagcaaatataaggat

SEQ ID NO: 16527 - DNA, 50 bp, homo sapien
taaataaaaagcaccagaaatattamatttttagttcaaagattattcac

SEQ ID NO: 16528 - DNA, 50 bp, homo sapien
ttttaaaccttacctgtccttatgayaactaatactgtcatgcaaaatcc

SEQ ID NO: 16529 - DNA, 50 bp, homo sapien
aatcaggaactaccagacagtaagarctttaggcattaaagcaagagtaa

SEQ ID NO: 16530 - DNA, 50 bp, homo sapien
gtctcgttgtgatgggttgggccaaragaacagtgttaactgataaattg

SEQ ID NO: 16531 - DNA, 50 bp, homo sapien
gagagtaaaacacgcatacaaatgamaagtatggttattatggtctcttg

SEQ ID NO: 16532 - DNA, 50 bp, homo sapien
cttttgtggtgttctcaaaatcacaycacgtaggcagctgctcctacaca

SEQ ID NO: 16533 - DNA, 50 bp, homo sapien
aagctttggataaattatggagttgscaaatacttgttgatgaatgtata

SEQ ID NO: 16534 - DNA, 50 bp, homo sapien
gtaagataatgtctcatctaatagcratatcagtaaagagatggaaatta

SEQ ID NO: 16535 - DNA, 50 bp, homo sapien
gtgtccgcttggaaagcctggactgratcagcatctacctgtttagttac

SEQ ID NO: 16536 - DNA, 50 bp, homo sapien
gggataacagaacaaaatgagacaasagccatgaaattgaaatggtgtgg

SEQ ID NO: 16537 - DNA, 50 bp, homo sapien
ttgggaaagcccagtggtttgattcraggatgactagaatttagagcaaa

SEQ ID NO: 16538 - DNA, 50 bp, homo sapien
aatatttagccattaaataactgatyacaaacatggtgagttttataaga

SEQ ID NO: 16539 - DNA, 50 bp, homo sapien
gaccccaggacagaagtcataaaatyagaggtctccaaaattttttgctt

SEQ ID NO: 16540 - DNA, 50 bp, homo sapien
ttagcttgtagaaagcactaaagaakcacaagtcaaatgaatgaataaaa

SEQ ID NO: 16541 - DNA, 50 bp, homo sapien
agatgttctttatgacatcaacctcraaaatgtaaaggatatattcaaaa

SEQ ID NO: 16542 - DNA, 50 bp, homo sapien
tatagcagatgctgtatgcaatatcyctaacaaatccatttctccactct

SEQ ID NO: 16543 - DNA, 50 bp, homo sapien
tgtgttggccttttagagtctgacayggtatttgggaccctccatgagat

SEQ ID NO: 16544 - DNA, 50 bp, homo sapien
ctgcacactcctttcttcacccaggmcaacgagtttgtggaagttcccat

SEQ ID NO: 16545 - DNA, 50 bp, homo sapien
actaaccgtcacacttagcaataaarcgttgagatgcctgtttctttagg

SEQ ID NO: 16546 - DNA, 50 bp, homo sapien
caaagctgtaatttctgcctatcacyggcttttgaatagattatgaactc

SEQ ID NO: 16547 - DNA, 50 bp, homo sapien
gtgtgagattcacattctgtaaccaycagtgtgacatgggtcctgaacag

SEQ ID NO: 16548 - DNA, 50 bp, homo sapien
tttgtgtctctttatacctggagtasacatgaatcctccccactcagctt

SEQ ID NO: 16549 - DNA, 50 bp, homo sapien
atatttttgtaaattggaacccaagsatttcaggcctggtgggatgataa

SEQ ID NO: 16550 - DNA, 50 bp, homo sapien
tggtccctgatgaacttctgacaaayggaaaagattgcatactttgcaga

SEQ ID NO: 16551 - DNA, 50 bp, homo sapien
ctgggctttggagggtgagcacaatsagtaggtggcagtaagacagaagg

SEQ ID NO: 16552 - DNA, 50 bp, homo sapien
ctagggtgaagtgctgtctagttaakaataaggccaggtatacaaaactc

SEQ ID NO: 16553 - DNA, 50 bp, homo sapien
cagagctctggaatcccagatgggaraatcggttaagcacaggagtttga

SEQ ID NO: 16554 - DNA, 50 bp, homo sapien
tgtgctcccacctaccttaggcagaygctcagtaccttttcagccccagg

SEQ ID NO: 16555 - DNA, 50 bp, homo sapien
gaagatgttgacgtattttctgaacycttactaattgcctccatttttat

SEQ ID NO: 16556 - DNA, 50 bp, homo sapien
atgcaacctatcactgaaatgactayctcaagctgtttctctctatctcg

SEQ ID NO: 16557 - DNA, 50 bp, homo sapien
caatagaaacatcatccttataacamctgttcagtgtggttgtgtgcatg

SEQ ID NO: 16558 - DNA, 50 bp, homo sapien
gttcgataattatgtaaattagctgrcaattagataatgtcactcacttt

SEQ ID NO: 16559 - DNA, 50 bp, homo sapien
tcagactcatgccataactaatagcragacagattggcaaaccttgtcta

SEQ ID NO: 16560 - DNA, 50 bp, homo sapien
ggggcacagagaccaatagagttaasgacttacgggagaatatgtaagaa

SEQ ID NO: 16561 - DNA, 50 bp, homo sapien
ccattgctttttgttgctctaagcawtattaagtcttggttctaagcccc

SEQ ID NO: 16562 - DNA, 50 bp, homo sapien
gaatgcagctgctttccaaagggcarctttaggctatataacaaaagtgg

SEQ ID NO: 16563 - DNA, 50 bp, homo sapien
tggtgcctcctgaggtttctgtttcscaatcagggtacgggttccattct

SEQ ID NO: 16564 - DNA, 50 bp, homo sapien
atttgccttctcctcctgagttgcckactttcttctaacggaagcattaa

SEQ ID NO: 16565 - DNA, 50 bp, homo sapien
aatctccttcatttgtccataagaayattgatttgtttatgccacagata

SEQ ID NO: 16566 - DNA, 50 bp, homo sapien
ctcaggtaaacacatttatagtaagracagtaaagccaatccctggctga

SEQ ID NO: 16567 - DNA, 50 bp, homo sapien
atgatgccatttttaaaacgtacaarggatgtaaatagatatttctccaa

SEQ ID NO: 16568 - DNA, 50 bp, homo sapien
ttacagcagtactgactgaatgactsaaactggtagatgaactcatcaat

SEQ ID NO: 16569 - DNA, 50 bp, homo sapien
atcaaaaactccatctagtatttacrcaaaactgtctcggatttgactga

SEQ ID NO: 16570 - DNA, 50 bp, homo sapien
cagatggcatgaagctgggacctaaytgaagatctacctattgagacagc

SEQ ID NO: 16571 - DNA, 50 bp, homo sapien
agaagcgaaccatgatatcatgatargatgtaaagaattaaaagagatac

SEQ ID NO: 16572 - DNA, 50 bp, homo sapien
ccttgtggcaatactgttgttttagwcattatgtttaattgtcaagaaag

SEQ ID NO: 16573 - DNA, 50 bp, homo sapien
cttgcagctttcaatccaaatcccargtaactgtaaaatacaggattgac

SEQ ID NO: 16574 - DNA, 50 bp, homo sapien
tcccttccttgatagccattctatgraggaaaagattatgttgaattggg

SEQ ID NO: 16575 - DNA, 50 bp, homo sapien
gtgtctgcagaaatcccaggctttamgaatacattcagcaggagcttgct

SEQ ID NO: 16576 - DNA, 50 bp, homo sapien
ctgtaacatttgaccagtatcttacrctttctaatatgtgctcttatatt

SEQ ID NO: 16577 - DNA, 50 bp, homo sapien
tatcccaaaacattcctaaaacatakgtgtcttatgggatttgtggtaag

SEQ ID NO: 16578 - DNA, 50 bp, homo sapien
tttaaatttgccaattatatttcacygtctagataaaagaacaaagtaga

SEQ ID NO: 16579 - DNA, 50 bp, homo sapien
tgaatatgtgttacaaacctttccakgaagcagagttaaactgagaagat

SEQ ID NO: 16580 - DNA, 50 bp, homo sapien
accatgtagacagatcttgattctayggcaaaaatgatctgagaaactgg

SEQ ID NO: 16581 - DNA, 50 bp, homo sapien
agagaaagctcgttttatatctctayaggtactgtcataccaatgaagca

SEQ ID NO: 16582 - DNA, 50 bp, homo sapien
aaagaaattggtcactgaccagaaaycttgagcttgacttacaggatggt

SEQ ID NO: 16583 - DNA, 50 bp, homo sapien
agattcgtccctgctctgattttaartgggtagccagaccctttagaatt

SEQ ID NO: 16584 - DNA, 50 bp, homo sapien
aactgcactatagaccaaataatatraacctaacgacatttacagaatat

SEQ ID NO: 16585 - DNA, 50 bp, homo sapien
aggggacaaacagccaaaccgtatcrccttcatagttctaaatcatgttt

SEQ ID NO: 16586 - DNA, 50 bp, homo sapien
aagctgttgttcccagggcacaatamacttcatttatacaagcttcagtg

SEQ ID NO: 16587 - DNA, 50 bp, homo sapien
aatttaagactccggttgggtgtcasagatggtacactaaaattgcaaat

SEQ ID NO: 16588 - DNA, 50 bp, homo sapien
atttaaaactgaatagaaaaagacartcaatagttgccaataccaagatg

SEQ ID NO: 16589 - DNA, 50 bp, homo sapien
tgagttctgagatataaatgccatakgtgatatcaatcttgagaaagccg

SEQ ID NO: 16590 - DNA, 50 bp, homo sapien
atttagttgatggagggagtagaacyggtaatactcacagtgtcaaggtt

SEQ ID NO: 16591 - DNA, 50 bp, homo sapien
ccttcaaacagctcttactgaaaacscgctaactgctcggctttgtgcgg

SEQ ID NO: 16592 - DNA, 50 bp, homo sapien
gggaagcatgtgatgatgacagatayaatccacaaatatgacggccaaca

SEQ ID NO: 16593 - DNA, 50 bp, homo sapien
tttgtacctctgatgttctgatttcyagctatgtgctccaatcgttaaat

SEQ ID NO: 16594 - DNA, 50 bp, homo sapien
ttgtgtttgaatctgaccactgtgawtatctcaaggataccataagagct

SEQ ID NO: 16595 - DNA, 50 bp, homo sapien
aaggtgaaggatatagagggacacayggatgattgacgagaataatttct

SEQ ID NO: 16596 - DNA, 50 bp, homo sapien
cttttcctacttgacgtatttgttgsatttgtccctcagagttcactcag

SEQ ID NO: 16597 - DNA, 50 bp, homo sapien
tagctgtgagatgggttcggaccatkatatccagtttaatactatttggg

SEQ ID NO: 16598 - DNA, 50 bp, homo sapien
ttgagaaacagacttcacttctcgayaggaaaaatttaactaattgtggc

SEQ ID NO: 16599 - DNA, 50 bp, homo sapien
aacgtactctaaaaatctcataacaytatccctattcaccttttccatac

SEQ ID NO: 16600 - DNA, 50 bp, homo sapien
agtttggtttaaggctgagaccagaraaagatcattgtaattctgggctg

SEQ ID NO: 16601 - DNA, 50 bp, homo sapien
tatttagtccaaatcttgactcttayacagatggatgtctttgcctgtca

SEQ ID NO: 16602 - DNA, 50 bp, homo sapien
cttatattatgtcatataatcaaaasatggtgtctggattttcagtattg

SEQ ID NO: 16603 - DNA, 50 bp, homo sapien
aggatctcagtgtagccctatattcrcaatgaccattacattatgattgc

SEQ ID NO: 16604 - DNA, 50 bp, homo sapien
tcctaggaaaacacagagaagtacayagtgaccttagcagatagggaagg

SEQ ID NO: 16605 - DNA, 50 bp, homo sapien
gggaaggttggttctctttcaatatyactacacattatcacaagagaaat

SEQ ID NO: 16606 - DNA, 50 bp, homo sapien
ttttttgctattattcagtttactargcatttttacaaatgtttttgtat

SEQ ID NO: 16607 - DNA, 50 bp, homo sapien
tattatctccaaaataggattaaaartggattgcaaatagtgatctgggt

SEQ ID NO: 16608 - DNA, 50 bp, homo sapien
ttaccacttttttttttaaggtagcmactaatatggtgatcatgttcagg

SEQ ID NO: 16609 - DNA, 50 bp, homo sapien
taatgttcgattttcacaaggtctaygacgatcaagaaatttcactcttt

SEQ ID NO: 16610 - DNA, 50 bp, homo sapien
tctcagtgggctgttatgagaaatasaatagataatcttgagtacctagc

SEQ ID NO: 16611 - DNA, 50 bp, homo sapien
tttagagaagagtttctgtgaaagastacactaactggtttacagaatgg

SEQ ID NO: 16612 - DNA, 50 bp, homo sapien
aggtatttacttctttctagctatamacctactatacggcatcttcttcc

SEQ ID NO: 16613 - DNA, 50 bp, homo sapien
cctgacagcacaaatttcatactgcrcttcagagtcatcatcactcactg

SEQ ID NO: 16614 - DNA, 50 bp, homo sapien
catgtcttgccttcttcacccgacaytctcattcaaccaattccagcaac

SEQ ID NO: 16615 - DNA, 50 bp, homo sapien
acaaacactttaagttggtcaaagayattgattgagattcctaacttgac

SEQ ID NO: 16616 - DNA, 50 bp, homo sapien
taaatttagtttattttaaaggaaargtcatcatatacttttctgagaaa

SEQ ID NO: 16617 - DNA, 50 bp, homo sapien
gggacactgtgaatgtactttccctracaataagaagacatgtaatgagt

SEQ ID NO: 16618 - DNA, 50 bp, homo sapien
aactctttgtgggtgctttcacataygcttacctaatttaatccttggag

SEQ ID NO: 16619 - DNA, 50 bp, homo sapien
tcattatttatagagacctaggtcgyatgactgaagatgactctgttccc

SEQ ID NO: 16620 - DNA, 50 bp, homo sapien
tttgttcctgaagccacaggcaatayatgaatttgaagaccagagaggct

SEQ ID NO: 16621 - DNA, 50 bp, homo sapien
taagagtaaaatctctgacaatgtaygcttttccctcaagatttatcagc

SEQ ID NO: 16622 - DNA, 50 bp, homo sapien
aagcttacagttagctaaccaagtgyaaggcacaaatccgtgtaaacgct

SEQ ID NO: 16623 - DNA, 50 bp, homo sapien
attgaggcttgagaacatttcttaargtttcataaaatcgctagtagtat

SEQ ID NO: 16624 - DNA, 50 bp, homo sapien
gtgatggagaaagccatcaagagaarggtctcatacttatatgctagata

SEQ ID NO: 16625 - DNA, 50 bp, homo sapien
ctctatggagaacaagggtattgccrgaaaagatactttcgaaacctatt

SEQ ID NO: 16626 - DNA, 50 bp, homo sapien
gaatgattccatctcctccagacagwacgttacactaattgatatccctc

SEQ ID NO: 16627 - DNA, 50 bp, homo sapien
ctaaatattaaataaatacattatcwcaagtcatacagtaaaattctaaa

SEQ ID NO: 16628 - DNA, 50 bp, homo sapien
ttaagaagacaaaattaggaagccaygggtagcagaagacatgtataaga

SEQ ID NO: 16629 - DNA, 50 bp, homo sapien
tgtgatgttgaagatgcctacctatraagtcacaaattgtgagacacaca

SEQ ID NO: 16630 - DNA, 50 bp, homo sapien
atgggttgattcactcaaggtttcaygggttgaatataatttttgcataa

SEQ ID NO: 16631 - DNA, 50 bp, homo sapien
tgatcccttcttttctaatttgcccratgagtaaacaattttatctaaat

SEQ ID NO: 16632 - DNA, 50 bp, homo sapien
attatctctattctttcttctaaacsatgttatctcattatctctttgat

SEQ ID NO: 16633 - DNA, 50 bp, homo sapien
ttggtgttttgcctttaggccatcastctagtcttggctcttaagctcta

SEQ ID NO: 16634 - DNA, 50 bp, homo sapien
cattaaaatgggctttttaaagttakgttgcctttattatttagaagact

SEQ ID NO: 16635 - DNA, 50 bp, homo sapien
gtttaggttggaggattaattggaarctgtgaggctattcctatgatata

SEQ ID NO: 16636 - DNA, 50 bp, homo sapien
ttatttttagttgtaagaaatcataygtattttgtacttcagtttgagaa

SEQ ID NO: 16637 - DNA, 50 bp, homo sapien
atgttgctgatctttaaagtacataycctgttttctgttctaataaatag

SEQ ID NO: 16638 - DNA, 50 bp, homo sapien
ggggctaacagctaagaaggttacawggcaatcagattctcataattttt

SEQ ID NO: 16639 - DNA, 50 bp, homo sapien
atttgcaaattgctcaccattctcartaatgtgataaaacctcaagtttc

SEQ ID NO: 16640 - DNA, 50 bp, homo sapien
caagtagaaaatcttagaaatgtgawcagtatcatttattccatatatct

SEQ ID NO: 16641 - DNA, 50 bp, homo sapien
aactcagaggcaaacttttaggagcyaaggatggacttttgctgccatct

SEQ ID NO: 16642 - DNA, 50 bp, homo sapien
aagggtctattttctcccttggcaamaaaagcgtttatcaatgaaccata

SEQ ID NO: 16643 - DNA, 50 bp, homo sapien
agcatggtaatacaagtcatagtaayctagaaactcactacaaatagata

SEQ ID NO: 16644 - DNA, 50 bp, homo sapien
actaatttttaagatattttccaaaygttggttgccaggaagaaaaatgg

SEQ ID NO: 16645 - DNA, 50 bp, homo sapien
taacaccaactggtagtcctctaacraaattcagttctgacactatctac

SEQ ID NO: 16646 - DNA, 50 bp, homo sapien
attaccaattaccattcaattaccamggtacatattgcttggtctttgaa

SEQ ID NO: 16647 - DNA, 50 bp, homo sapien
tttggaatctgtcaaaactgggcaayggtaaagttaatatgacagtgaaa

SEQ ID NO: 16648 - DNA, 50 bp, homo sapien
tacatattgcttggtctttgaagcarcactatgcattttaaaaaggtcta

SEQ ID NO: 16649 - DNA, 50 bp, homo sapien
aacaacacaaagtaacaaaataaacygcatatctgaaaggaaaattaaag

SEQ ID NO: 16650 - DNA, 50 bp, homo sapien
tgcagtttctttctgttgaaaatggracatacgattaaatgcctgaaatg

SEQ ID NO: 16651 - DNA, 50 bp, homo sapien
taaaagcaatcttaagcaaaacctartagaaagcaagatttactaggttt

SEQ ID NO: 16652 - DNA, 50 bp, homo sapien
aatacccttgtaatattgtcaggtayattttgaagtgaagagttttcaat

SEQ ID NO: 16653 - DNA, 50 bp, homo sapien
aaagaacatagtgattacatgaaaarcaaataaattggtgttgcagagca

SEQ ID NO: 16654 - DNA, 50 bp, homo sapien
ttagtaatacataccaagaagttgcratgtacagcattttatgcagtgtg

SEQ ID NO: 16655 - DNA, 50 bp, homo sapien
ttggagacacatttagaggaaaataragatggtaataattaaattgcatt

SEQ ID NO: 16656 - DNA, 50 bp, homo sapien
acctaattttaaagtatcttttgtcraggaacatgttggtgtttagaatt

SEQ ID NO: 16657 - DNA, 50 bp, homo sapien
agctcaacgatgtatctcacttttargtatgcgcatatatgactcgtggg

SEQ ID NO: 16658 - DNA, 50 bp, homo sapien
ggtgttgatttcatgtagatgtttgyaataaaagcagttatcccaaatta

SEQ ID NO: 16659 - DNA, 50 bp, homo sapien
gtggcaatggtgactagttttagtasaatggtcagggacacactatttga

SEQ ID NO: 16660 - DNA, 50 bp, homo sapien
atctaacctcagacttagcagttacrccgtctaataagctggccccttct

SEQ ID NO: 16661 - DNA, 50 bp, homo sapien
cagaaaaattgtaaatcacagtttgragagtggcagccaattcctcgttc

SEQ ID NO: 16662 - DNA, 50 bp, homo sapien
tcactgcttgaattaaatgggaatasgactcttgcctccttattacagaa

SEQ ID NO: 16663 - DNA, 50 bp, homo sapien
tgtaaataaaggtgtggtgaattaayaacttcattaaaaaatgaatgact

SEQ ID NO: 16664 - DNA, 50 bp, homo sapien
tagtggagtttcatctatcatgaacrgagaacataactaggaatctgctg

SEQ ID NO: 16665 - DNA, 50 bp, homo sapien
tattgctaggtggtatgttttaacgraaaattctaatactgtcttttatt

SEQ ID NO: 16666 - DNA, 50 bp, homo sapien
gaagtgtgacaaggtgcatataagamagtccagtagaaaagtaaagaaga

SEQ ID NO: 16667 - DNA, 50 bp, homo sapien
agtcatctggtaaagagacaagttayattattcacataaaatataatgcc

SEQ ID NO: 16668 - DNA, 50 bp, homo sapien
agccaaagtgaggaatgaagacgaargacaaattgtttagcactagtaga

SEQ ID NO: 16669 - DNA, 50 bp, homo sapien
aatggaatacgtgtaataggtacaaraactatctgatatcacccagttta

SEQ ID NO: 16670 - DNA, 50 bp, homo sapien
gaaaaagaaacacatgacaggtggartaagtcagcacatagaaattctgt

SEQ ID NO: 16671 - DNA, 50 bp, homo sapien
aaaaaaaaattaattttatgaatgaracaagaggcaaatctgggtatgca

SEQ ID NO: 16672 - DNA, 50 bp, homo sapien
aaagctaatctgagaaataccttacraaagatatgtttacagaaaaggca

SEQ ID NO: 16673 - DNA, 50 bp, homo sapien
atgtctaggacattgactgtaaaacragggaatatgaaacctctttgaaa

SEQ ID NO: 16674 - DNA, 50 bp, homo sapien
acaacacaaatgtgttatcttatagwcctggatgtcacagtacaggacga

SEQ ID NO: 16675 - DNA, 50 bp, homo sapien
atacataacaaaacagaaaatcttaygtctccttcacaagaggaatacac

SEQ ID NO: 16676 - DNA, 50 bp, homo sapien
acgtggtaaaatatgaatggaccctraatccaattacataaagaatatta

SEQ ID NO: 16677 - DNA, 50 bp, homo sapien
accatgtgatgtttttccagaaaaargttccaatcttcaatggtcaataa

SEQ ID NO: 16678 - DNA, 50 bp, homo sapien
ctcagttttcaaactctttttcttayggcttgcctacacttgtcactatt

SEQ ID NO: 16679 - DNA, 50 bp, homo sapien
ctaggttcccgcctcatcatgaccartaaagttatccggtgaagacgctt

SEQ ID NO: 16680 - DNA, 50 bp, homo sapien
aaatgttcagagattcactgcttaamatatgcttattaatctgtattata

SEQ ID NO: 16681 - DNA, 50 bp, homo sapien
gaaataattgaggctggcttattgcratcagtcctatcacatccaactct

SEQ ID NO: 16682 - DNA, 50 bp, homo sapien
acaaacattttacgtatcagaagcayataccttggagaaacaatgttata

SEQ ID NO: 16683 - DNA, 50 bp, homo sapien
ctccgccattcaaccatacacagtasaggattcaaaacatggcaccatga

SEQ ID NO: 16684 - DNA, 50 bp, homo sapien
tagctcaataatttctttcattaacrccctgtaaactatgaatttcaaag

SEQ ID NO: 16685 - DNA, 50 bp, homo sapien
actctcttcttgtattggctattackctcatcacaagttatctgatttat

SEQ ID NO: 16686 - DNA, 50 bp, homo sapien
tatcgcactaagaatggtttgaagaygttatattccatgttgactttata

SEQ ID NO: 16687 - DNA, 50 bp, homo sapien
tcactcttggtcagattagattacayggtcccttcttatgactattttaa

SEQ ID NO: 16688 - DNA, 50 bp, homo sapien
acagtgtagttcaatttcagtactayaggctttgtaataaaagatgcttg

SEQ ID NO: 16689 - DNA, 50 bp, homo sapien
ccagaaatgcctaagaaagctcttamataaagtcagagataatgtgcctg

SEQ ID NO: 16690 - DNA, 50 bp, homo sapien
aacattagtggtacataagagaatarcgatcacagtgaccttggtatgtt

SEQ ID NO: 16691 - DNA, 50 bp, homo sapien
agtatttcttacctgttatataacaracgagttctcatatgtatgtgtgt

SEQ ID NO: 16692 - DNA, 50 bp, homo sapien
aaatctactgtgctgccagttatatraaagtgtagcatgtaaaattatgc

SEQ ID NO: 16693 - DNA, 50 bp, homo sapien
gtcttgtatgtatcatgagtaagcartaatattaggagagcacaacatgt

SEQ ID NO: 16694 - DNA, 50 bp, homo sapien
ctgtagtgagacaaaaagtgagaacscttgaaaactggctgacgtttttg

SEQ ID NO: 16695 - DNA, 50 bp, homo sapien
acacatttgttcatcaattcaaaaarcatccattgactgctttcactctt

SEQ ID NO: 16696 - DNA, 50 bp, homo sapien
acattattcccataatgattctgacragccctgcctacgctgtttcaggg

SEQ ID NO: 16697 - DNA, 50 bp, homo sapien
ataatccaggtactctgtcctggaaygtcttgttggattatttgaacctg

SEQ ID NO: 16698 - DNA, 50 bp, homo sapien
acaagtagcttcctttgaattcccayggccgattattttcagtataccag

SEQ ID NO: 16699 - DNA, 50 bp, homo sapien
gagcattcatatattatattgtctamtaagtggtttcgctgtttaaatgt

SEQ ID NO: 16700 - DNA, 50 bp, homo sapien
tccaagtcagactgaaagtactacaratcagtgttgttcaatcagcactt

SEQ ID NO: 16701 - DNA, 50 bp, homo sapien
ctctactcagctgctgtttagtcaaygttgcgcatacaactctatcaaag

SEQ ID NO: 16702 - DNA, 50 bp, homo sapien
taccatttgttttgacattaaaggayaccttgcctctttggctgtccaat

SEQ ID NO: 16703 - DNA, 50 bp, homo sapien
gggctttctttattaagtggcatacraaaaggagaggcttaggtataaag

SEQ ID NO: 16704 - DNA, 50 bp, homo sapien
atattatttatattttactacaacckgaaatctactataattcttggaaa

SEQ ID NO: 16705 - DNA, 50 bp, homo sapien
gtatacatgtagacagatttaatgawgtaatataatggtgatctggaatt

SEQ ID NO: 16706 - DNA, 50 bp, homo sapien
gttcctgttttcccattgtaaatccrcaggcttccttatctcctcatctg

SEQ ID NO: 16707 - DNA, 50 bp, homo sapien
ggaaacagagacacaaagacacaaartgaattgtcccagataacatgatt

SEQ ID NO: 16708 - DNA, 50 bp, homo sapien
attgagaatgtgttatgagacaaaayctgtggataagacagtgaaagaaa

SEQ ID NO: 16709 - DNA, 50 bp, homo sapien
ataaataggcattggtgtatggttayataaataatgttggctatatttga

SEQ ID NO: 16710 - DNA, 50 bp, homo sapien
ttccagtataaaatggccacggcaartcctttatctaatttccaggcaat

SEQ ID NO: 16711 - DNA, 50 bp, homo sapien
aaatgacagggctgtctttaaaagcratgccactgggatactagtgaata

SEQ ID NO: 16712 - DNA, 50 bp, homo sapien
ttatctatagcagagataggacatasagaaagagaattttttgctctctc

SEQ ID NO: 16713 - DNA, 50 bp, homo sapien
gaactctcctttccttaaatgcctakgttactttatttgccaaacagttc

SEQ ID NO: 16714 - DNA, 50 bp, homo sapien
taggggaatgcccatatatttcaaamaggaagctgagtagagtgttgtag

SEQ ID NO: 16715 - DNA, 50 bp, homo sapien
acctgtataaaagcacagatttagaytaacttcatggacccagagtaaag

SEQ ID NO: 16716 - DNA, 50 bp, homo sapien
aacagttccatttcatgcagttgaamtccatcttatctccaaggtaggta

SEQ ID NO: 16717 - DNA, 50 bp, homo sapien
tagccagaagcacaacagaaatttayctccttcagatatgttcctatggt

SEQ ID NO: 16718 - DNA, 50 bp, homo sapien
gtgcttttggatcctgaactgtttcraactctggctaacatgttcaagag

SEQ ID NO: 16719 - DNA, 50 bp, homo sapien
aatccccctcctttatggactacacycttatttcttaaaactcctatgct

SEQ ID NO: 16720 - DNA, 50 bp, homo sapien
ttaaaatcagactaatttaaggaaasacatataaatcctaatcacttttt

SEQ ID NO: 16721 - DNA, 50 bp, homo sapien
aaatataatcttgcctaatatcagaytcaaagttaaagattccctttctc

SEQ ID NO: 16722 - DNA, 50 bp, homo sapien
catattacttatggtaacaaacaacyaaccaaataagagtgatctcttga

SEQ ID NO: 16723 - DNA, 50 bp, homo sapien
tgggaaatatttgagcagcagaaacwcatctctcccagttggagtctcaa

SEQ ID NO: 16724 - DNA, 50 bp, homo sapien
ttgtaaaacatgtgctatggaaatawtatgggaagaaagagtaaaactgt

SEQ ID NO: 16725 - DNA, 50 bp, homo sapien
ttagccaaaccaattccaaatgtttsaaaagaaattatgggaagaactaa

SEQ ID NO: 16726 - DNA, 50 bp, homo sapien
attctatttttcccattgcttttagraggatctcttaaaaatataaatta

SEQ ID NO: 16727 - DNA, 50 bp, homo sapien
gaatagcttgtgacatttaactgaawgggtagatgtaggtaagacgtagg

SEQ ID NO: 16728 - DNA, 50 bp, homo sapien
agagtttaagcaatgggcatagacasagatcctttcagcttaatgtctac

SEQ ID NO: 16729 - DNA, 50 bp, homo sapien
gtactactctgtgtgtatggtatacyggagaatataatattggacaaaat

SEQ ID NO: 16730 - DNA, 50 bp, homo sapien
cacaattctagtttttgaaaaaatgrcacattacttttggaataaattgc

SEQ ID NO: 16731 - DNA, 50 bp, homo sapien
ttctatggaagaacaaagtttaatasagtggaaatataatttttcaaaga

SEQ ID NO: 16732 - DNA, 50 bp, homo sapien
ttttttagtccagttttattctacaygttatatacacctacatctatgac

SEQ ID NO: 16733 - DNA, 50 bp, homo sapien
ttaaatggtcttcctaaggtatttawcaaagtcatgtcacaaaatacatt

SEQ ID NO: 16734 - DNA, 50 bp, homo sapien
cattcccccctttttttttaaagcasaaacttgccaacttgccaggaaaa

SEQ ID NO: 16735 - DNA, 50 bp, homo sapien
tttaaaagctctatttgattatctamcaatctgagcagtgaaaggacaaa

SEQ ID NO: 16736 - DNA, 50 bp, homo sapien
ttatggtgttcattttgtcaccttcrctggaagacattactgcagtagcc

SEQ ID NO: 16737 - DNA, 50 bp, homo sapien
tctaccctaccctttaagtgaatgartataaaactgaatctattgttttt

SEQ ID NO: 16738 - DNA, 50 bp, homo sapien
ttatccccatttacacatcagtataytaagagccatataatttaagtgaa

SEQ ID NO: 16739 - DNA, 50 bp, homo sapien
tgttatttaatttactgtaataaaartgatcctccttctgctataggttc

SEQ ID NO: 16740 - DNA, 50 bp, homo sapien
cactgtactattcttaatatcttgayggtgactcctcccttagttgcaac

SEQ ID NO: 16741 - DNA, 50 bp, homo sapien
aaactttatggtacttgaacaataaygctgactgaacttaatggttaata

SEQ ID NO: 16742 - DNA, 50 bp, homo sapien
tttcattccctattcattcttaaacyctactaatgtcagagagaattatg

SEQ ID NO: 16743 - DNA, 50 bp, homo sapien
aaaacatggaacaaatcaatgatacygtaatcagctgctagtggctgatt

SEQ ID NO: 16744 - DNA, 50 bp, homo sapien
tttcctcccttctgctatcctctcaygaaggttttcagacttatccaagc

SEQ ID NO: 16745 - DNA, 50 bp, homo sapien
attacctagacactggacttgataaygtattaaagttatttaaaaagcac

SEQ ID NO: 16746 - DNA, 50 bp, homo sapien
accattcatagaaattcattccgaakagttgattccaaagtttgtgccaa

SEQ ID NO: 16747 - DNA, 50 bp, homo sapien
aaacttccagcaatagatcatcttgsagtacatcacttcagataaaaaga

SEQ ID NO: 16748 - DNA, 50 bp, homo sapien
tcagagtctttatctttatacttacraaaaaaatatcagttaaatgtctt

SEQ ID NO: 16749 - DNA, 50 bp, homo sapien
aaaatgtatttatgctttcacttcawggtaattttatcagaggggctggg

SEQ ID NO: 16750 - DNA, 50 bp, homo sapien
ttggataattcacaggccgatggtcrctcagcaagtgaggaatggatgca

SEQ ID NO: 16751 - DNA, 50 bp, homo sapien
tttctggtgggttatgaggctctcarataacatcaaaaggcagtatttga

SEQ ID NO: 16752 - DNA, 50 bp, homo sapien
tgaaatataaagttggaggtttcaartagtaattcagctatcttgggttt

SEQ ID NO: 16753 - DNA, 50 bp, homo sapien
ctttatctacttggactgaactacartgatacacataagttgatgtgaag

SEQ ID NO: 16754 - DNA, 50 bp, homo sapien
atgtcataaaacataggagcatagtmaagtagagtactaagcaaaacacg

SEQ ID NO: 16755 - DNA, 50 bp, homo sapien
taaacaaatctctttacctgacacarctatctaattgcagcaacaatctg

SEQ ID NO: 16756 - DNA, 50 bp, homo sapien
agagtgaaacctaactagaccttcakaatttctcaagagtgtaatgtcat

SEQ ID NO: 16757 - DNA, 50 bp, homo sapien
gcacattttgtaacgtcatttcccamaataaatataagaaacaaaatctg

SEQ ID NO: 16758 - DNA, 50 bp, homo sapien
tttatgagtctgtgtgagccaaagayacgatagctggaaaaatcacatgt

SEQ ID NO: 16759 - DNA, 50 bp, homo sapien
aaaacaaatattattagatctaaacraagaggtacattgcaaacaatatt

SEQ ID NO: 16760 - DNA, 50 bp, homo sapien
acaacaaatttaacagaagaaaagayagtgtaacaccttgtgatatagga

SEQ ID NO: 16761 - DNA, 50 bp, homo sapien
gagatgtgcttagtaaatatagccargtgaatagtctttccaaaaatcta

SEQ ID NO: 16762 - DNA, 50 bp, homo sapien
taaaacaggaggtgataattggaacyaatgggaattgcaaggttgcaatg

SEQ ID NO: 16763 - DNA, 50 bp, homo sapien
tacttccccattggatcattcccgcrcttgactccataaatgagcttgtt

SEQ ID NO: 16764 - DNA, 50 bp, homo sapien
cctcatcagagttactgtgtgagcartgaaacagtttggccttgtttgtc

SEQ ID NO: 16765 - DNA, 50 bp, homo sapien
tcttggcagcgacttgaccttatcaygagtttgttttctcatatgtaaaa

SEQ ID NO: 16766 - DNA, 50 bp, homo sapien
gtgcggccccactacctaaccacctraagatttgaaattggtgtctttaa

SEQ ID NO: 16767 - DNA, 50 bp, homo sapien
accaagcacaggtatgcaggttatayacagtacgtgcttgccctacaatt

SEQ ID NO: 16768 - DNA, 50 bp, homo sapien
gtgtcagcataaagaatatgcaaagyaatacaatagtatgatttatgcaa

SEQ ID NO: 16769 - DNA, 50 bp, homo sapien
gttgagaagattcattctgtgcttasagggtgttgtgaaaatggattctt

SEQ ID NO: 16770 - DNA, 50 bp, homo sapien
tttgttcactgcacaaatattttcckagaatttgtcataagagaaatctc

SEQ ID NO: 16771 - DNA, 50 bp, homo sapien
tagtcaaataagcaatgatctgatastagcccttagagaatgggtagtac

SEQ ID NO: 16772 - DNA, 50 bp, homo sapien
tgaactatcaaggcctgattttgaargactccggactccatgcaaagtgt

SEQ ID NO: 16773 - DNA, 50 bp, homo sapien
aatatttattcattggaatcataatyataggccttttgaaaggatcatag

SEQ ID NO: 16774 - DNA, 50 bp, homo sapien
gattccattttatctgccctaataaraacacagacttttatctgtttaca

SEQ ID NO: 16775 - DNA, 50 bp, homo sapien
tgcccttgtaatagtaatagctctaracatatagagaagggccagggaag

SEQ ID NO: 16776 - DNA, 50 bp, homo sapien
tcttacttttattattggatttctakcatctctatagcattttaggtaaa

SEQ ID NO: 16777 - DNA, 50 bp, homo sapien
agcacagagggcatcaggacaaatcrgaatagcagctccatgatgtttgt

SEQ ID NO: 16778 - DNA, 50 bp, homo sapien
catgaatgagatctactttataatasagaatacattaaaccataaatgta

SEQ ID NO: 16779 - DNA, 50 bp, homo sapien
agaaaacctccaaaaaccagtgcaayagctgccacaagacagagtagttg

SEQ ID NO: 16780 - DNA, 50 bp, homo sapien
taaatctcagttttttattcttaaakgttgaatattgagatatcttaagc

SEQ ID NO: 16781 - DNA, 50 bp, homo sapien
tagtttttaatatttgctctaataaytaacaacagaagtttatataaaga

SEQ ID NO: 16782 - DNA, 50 bp, homo sapien
ttatgtggaagctaaacctcacagaygtcacaagtgatatattaggtgga

SEQ ID NO: 16783 - DNA, 50 bp, homo sapien
ctacatgctggcttatcaagttaggyaataattgctggtaacaggaaaca

SEQ ID NO: 16784 - DNA, 50 bp, homo sapien
catgtgccagtaccacaccctaacawcttacaacatttctgatttgctac

SEQ ID NO: 16785 - DNA, 50 bp, homo sapien
tacaactctctatcaccttatagtawacatgttccctaggtgtccaaatg

SEQ ID NO: 16786 - DNA, 50 bp, homo sapien
gttggatacagacttcatacctcaartcaccgaaagaaatactcattttg

SEQ ID NO: 16787 - DNA, 50 bp, homo sapien
gacagtatccccgagcatagaagcaycactaacatagattgtgccggaag

SEQ ID NO: 16788 - DNA, 50 bp, homo sapien
tgctcctcctgggacatttcctaacrccttaaacagctactccacctttt

SEQ ID NO: 16789 - DNA, 50 bp, homo sapien
tattttcatgatatatctttttgcgrcccttatatttgagtgtgtagatg

SEQ ID NO: 16790 - DNA, 50 bp, homo sapien
gaagaggggatatacttggtagaaamgttttatatcaactaccacaaaag

SEQ ID NO: 16791 - DNA, 50 bp, homo sapien
ctacagaagttttgtacctacataawaattatcatcaataacaacacata

SEQ ID NO: 16792 - DNA, 50 bp, homo sapien
attgaacctagagcagtcaacttacragaaaaaagtgccttttaaaaggg

SEQ ID NO: 16793 - DNA, 50 bp, homo sapien
cacattcacgatatctccagctcagyatttgaataaccctctgactgggg

SEQ ID NO: 16794 - DNA, 50 bp, homo sapien
tatcctttgatgggattaactacaaycaaagtgaagtttaggacggagta

SEQ ID NO: 16795 - DNA, 50 bp, homo sapien
agcaattctgaattaagaaccacagyctaaaatgtttgtagtagtaaact

SEQ ID NO: 16796 - DNA, 50 bp, homo sapien
tattcgtaagaaataattgaagaggycatttcctaaaatcagagtataga

SEQ ID NO: 16797 - DNA, 50 bp, homo sapien
tatcaagtgttcagatatgcttttaygatccacaatttagcagtggaaac

SEQ ID NO: 16798 - DNA, 50 bp, homo sapien
tctattccaactaaaatggcttagcygaaagtatttcaaaatttatttaa

SEQ ID NO: 16799 - DNA, 50 bp, homo sapien
gaacatgaaatatcagtgataatgaygataatggtaatacttactactgt

SEQ ID NO: 16800 - DNA, 50 bp, homo sapien
agttacatttatttatgttctattcyaactaaaatggcttagctgaaagt

SEQ ID NO: 16801 - DNA, 50 bp, homo sapien
caaatgtcactgctcctctcggtccrgcttcttagagcaattacatgcac

SEQ ID NO: 16802 - DNA, 50 bp, homo sapien
ataatatatgatttgaccaaatacartacctatgtaaatccttgtaaggc

SEQ ID NO: 16803 - DNA, 50 bp, homo sapien
agggaagaggggaagagtcttaatamcctggctgaactaatccccatttg

SEQ ID NO: 16804 - DNA, 50 bp, homo sapien
ctcattgctaccctatcctagtcttkaacccaagaagaagtacgccagag

SEQ ID NO: 16805 - DNA, 50 bp, homo sapien
aactgaaaaaccagtatctgaaaaaygaagctgtgaatatataccacatg

SEQ ID NO: 16806 - DNA, 50 bp, homo sapien
ggactttctcatccttgtttgaaacygtctaggggctctgtgtggtggtt

SEQ ID NO: 16807 - DNA, 50 bp, homo sapien
ctctgaggctgccaaggaattatgcraaggacttatgaatccatgtacac

SEQ ID NO: 16808 - DNA, 50 bp, homo sapien
ccaggtttcaggattgccttagctaygggtcatgtgatatttgggagacc

SEQ ID NO: 16809 - DNA, 50 bp, homo sapien
atgagagagtggagggatctgctaartatctggacagagggcttttgaca

SEQ ID NO: 16810 - DNA, 50 bp, homo sapien
ggcagaaaggcagagtagaaattaamgatttatagggtactgtgtagaca

SEQ ID NO: 16811 - DNA, 50 bp, homo sapien
agattctttcagctgacatgagaaartaagactcacaggatgtaggtttg

SEQ ID NO: 16812 - DNA, 50 bp, homo sapien
gggttccagggctaaaagttagcacyagctccgggctaaattctgagcta

SEQ ID NO: 16813 - DNA, 50 bp, homo sapien
gggcaggtatctggaaaccaggcaayatacgccttgggcatctgattctt

SEQ ID NO: 16814 - DNA, 50 bp, homo sapien
agcttgtcaagatattttgactgtawagtaccctagtgggatggcacatg

SEQ ID NO: 16815 - DNA, 50 bp, homo sapien
ttgagattttggtgctccaagtgggmaaatcagagtctgtattacccttc

SEQ ID NO: 16816 - DNA, 50 bp, homo sapien
gtgtgcctctatttttgttatcgcastcttaaaagaaaagatatacttgg

SEQ ID NO: 16817 - DNA, 50 bp, homo sapien
cataaccaagcacatatattaagtgyagcattgacccagaggaactaggc

SEQ ID NO: 16818 - DNA, 50 bp, homo sapien
aagcttattttggtaaatggccacargagtactcaccacttctcctgtgc

SEQ ID NO: 16819 - DNA, 50 bp, homo sapien
gactctctgatcttaacctttacatratacccacagaaaatggaatagaa

SEQ ID NO: 16820 - DNA, 50 bp, homo sapien
agttcatttagttgttaaaattataygtgcaattgttccaaagaccaagt

SEQ ID NO: 16821 - DNA, 50 bp, homo sapien
tctgggacactagggtcgtctaaagyatgttccatgaaactattccttta

SEQ ID NO: 16822 - DNA, 50 bp, homo sapien
tctcttggaaggagtgtctcattaaktgccctggccaggtaatcttgctc

SEQ ID NO: 16823 - DNA, 50 bp, homo sapien
tcaccctggacctgcatatgagctaytacatttgcataaacaatgaccta

SEQ ID NO: 16824 - DNA, 50 bp, homo sapien
cattttatgatactgttgaatgaaarctatagtaaaagatgtgggttcta

SEQ ID NO: 16825 - DNA, 50 bp, homo sapien
aggtgattactctaatggcaataatraaacgcgtgtttcagtgtctacag

SEQ ID NO: 16826 - DNA, 50 bp, homo sapien
ttgaaattgaaatgacagtaggctcraccaaatttctaaaacccctcaga

SEQ ID NO: 16827 - DNA, 50 bp, homo sapien
ccattgcttaattagctgccttagckcctctcactcccacctgccgcaat

SEQ ID NO: 16828 - DNA, 50 bp, homo sapien
tgtgcattctgagaatataatgtaarctgtctgaacctccatttccccat

SEQ ID NO: 16829 - DNA, 50 bp, homo sapien
tactaaaaattatgaattaggtaaakgctagtgcgttaaatcttagatta

SEQ ID NO: 16830 - DNA, 50 bp, homo sapien
gcactgacttttgccgtctttcaacyacagtgctttgggcgacaactgtc

SEQ ID NO: 16831 - DNA, 50 bp, homo sapien
cagtcacatacgatgagaatcacagratgccagccccagaacctccactt

SEQ ID NO: 16832 - DNA, 50 bp, homo sapien
tccagcatgccagagtcaggatggamggaactcaatgtcctttctcaagt

SEQ ID NO: 16833 - DNA, 50 bp, homo sapien
ctgctgtcaacaaatttcaatctagyatgtctgttatcttcccaaagcac

SEQ ID NO: 16834 - DNA, 50 bp, homo sapien
gttgcacatcacaggtcatgttcaaygagaagccagttgtctgccccaga

SEQ ID NO: 16835 - DNA, 50 bp, homo sapien
ggagaaagcaactatggcatttcaakaactcaaggaagaaaagaaaacct

SEQ ID NO: 16836 - DNA, 50 bp, homo sapien
ttcatttcatgtcagtgtttataaaygggattgtaagcctccgagtgctc

SEQ ID NO: 16837 - DNA, 50 bp, homo sapien
agctggacttgtatctcccaaataarcattttaagcagagagatttaata

SEQ ID NO: 16838 - DNA, 50 bp, homo sapien
cacagcagataaactgaggaagtgcsgcacaggtggaatcacgtggctga

SEQ ID NO: 16839 - DNA, 50 bp, homo sapien
cgaaacgccagttggaagtagatcamatcaatactcacatctctaaatta

SEQ ID NO: 16840 - DNA, 50 bp, homo sapien
gagatgagatcatcctggattcagastaggccctaaatccagtgactggt

SEQ ID NO: 16841 - DNA, 50 bp, homo sapien
ataattttaagtttctattggacaartgactcaatttatggaaaatcaga

SEQ ID NO: 16842 - DNA, 50 bp, homo sapien
caacattgtgctcctaacaatattcrcaattactttcatttatttcacaa

SEQ ID NO: 16843 - DNA, 50 bp, homo sapien
ctaatatagagtgggattaaaaggayagcctacaattgcttaaaattaat

SEQ ID NO: 16844 - DNA, 50 bp, homo sapien
ttccgtcagaaggaacatcatatccrgccatgtatctttttatgatgtta

SEQ ID NO: 16845 - DNA, 50 bp, homo sapien
cccatcacagagtaggtcaagcctcrcccacaatactgccggggatgggg

SEQ ID NO: 16846 - DNA, 50 bp, homo sapien
ctgacctctgctcacactcacagcarcattgcaagtgcctgtttccccac

SEQ ID NO: 16847 - DNA, 50 bp, homo sapien
ttgcataggtcagcttgaatgcatawgtgaaagtgtcctgcttgcatgcc

SEQ ID NO: 16848 - DNA, 32 bp, homo sapien
aagggctgtttgttgamtaaacaatgaatgaa

SEQ ID NO: 16849 - DNA, 50 bp, homo sapien
caaatatttctgatccatttaaaaarggaaggataagctacactgggctt

SEQ ID NO: 16850 - DNA, 50 bp, homo sapien
cttcttctttcttctatctgcaataycttcctgtattctcacactcttga

SEQ ID NO: 16851 - DNA, 50 bp, homo sapien
cctcacccctatgcttaattaagtcraaaatactcattctctgtaagacg

SEQ ID NO: 16852 - DNA, 50 bp, homo sapien
agctacagaatgcaggcagatcctcmaaggtatgataacagggtctcagc

SEQ ID NO: 16853 - DNA, 50 bp, homo sapien
attcttctatttataaatctggaaarttgtatgaatcactctaaggtggc

SEQ ID NO: 16854 - DNA, 50 bp, homo sapien
ttgttttcccctctttcagggttcamagtgctttacttccagttgcaaat

SEQ ID NO: 16855 - DNA, 50 bp, homo sapien
tgtgcagaacccaacaaatccaggaygagctgttgtgcatagaaaacaaa

SEQ ID NO: 16856 - DNA, 50 bp, homo sapien
tgtagagtgcaatctcaagaggtaaracaaatgagagggcatttccccct

SEQ ID NO: 16857 - DNA, 50 bp, homo sapien
atgacctgagtgacctcagcattcawcgggttctccctcatttccaaagg

SEQ ID NO: 16858 - DNA, 50 bp, homo sapien
actggttatcaatactggtactaaarttgtagaaagtgatgggaggaaac

SEQ ID NO: 16859 - DNA, 50 bp, homo sapien
actcagctagcattttttggatagasagatggatgaacaagacttactgc

SEQ ID NO: 16860 - DNA, 50 bp, homo sapien
cagcccactttcacacccactgggcratacactttccatttccactctcc

SEQ ID NO: 16861 - DNA, 50 bp, homo sapien
tgctttggccagaatcctccccgctsacgttttatcttagtacctctgca

SEQ ID NO: 16862 - DNA, 50 bp, homo sapien
cctgagatcagagaaaggcccttgargaagcatatctaacaggagaagga

SEQ ID NO: 16863 - DNA, 50 bp, homo sapien
aagccacattcctctcaaggctctarataatttgaagttccaatagcttt

SEQ ID NO: 16864 - DNA, 50 bp, homo sapien
agctaaatttaccagatgaggaagamacttagctgcagagatatttctaa

SEQ ID NO: 16865 - DNA, 50 bp, homo sapien
gcagtatgatgggttttcttagcaawctgaggtaatcacactaaccactt

SEQ ID NO: 16866 - DNA, 50 bp, homo sapien
aacttctaacaatctgaaaactcacrctcggaagacccaaggattctcct

SEQ ID NO: 16867 - DNA, 50 bp, homo sapien
gcatgactacctgatgagtttgctaygaagagttcaggatagtgcccaga

SEQ ID NO: 16868 - DNA, 50 bp, homo sapien
agttttcttgatctgattataaatasgcttttttttcttattaagagatt

SEQ ID NO: 16869 - DNA, 50 bp, homo sapien
gacggtggtgagcaccctcatctcartcctggaaaaataccagccccggg

SEQ ID NO: 16870 - DNA, 50 bp, homo sapien
tgttgaattacttttggctatttgayggaactcctttgaaagtgattcca

SEQ ID NO: 16871 - DNA, 50 bp, homo sapien
ccatttttctactgactctataatawcttttgtcatgtaaacattttaaa

SEQ ID NO: 16872 - DNA, 50 bp, homo sapien
caagagaccccaagactgtttcaacraaacagtgaatgaatgagtgacgg

SEQ ID NO: 16873 - DNA, 50 bp, homo sapien
aacagatatctgagctcttattatgyatcagcctctcttctaggcactgc

SEQ ID NO: 16874 - DNA, 50 bp, homo sapien
tactttggttataacttgttttgatragaggggtagaaataccaaaacaa

SEQ ID NO: 16875 - DNA, 50 bp, homo sapien
caggtgtggatgttgagttttactaygggaatcattccagcctgacaaaa

SEQ ID NO: 16876 - DNA, 50 bp, homo sapien
gagcgtgctatgcctccgaagaatcrctcaccttcagggaggagggctgt

SEQ ID NO: 16877 - DNA, 50 bp, homo sapien
gtgaaaagtgctttagaatgagatayattatcctactgtatctcatctaa

SEQ ID NO: 16878 - DNA, 50 bp, homo sapien
caggggtcagggtagaacaggtgatraaatgacagctcccacaggcaggc

SEQ ID NO: 16879 - DNA, 50 bp, homo sapien
gactaaaggtcagggtagagaaatcrcttctttttcaaactccatatgcc

SEQ ID NO: 16880 - DNA, 50 bp, homo sapien
aaattggcagaagagctcagatttgragtatatttttaacatagggccaa

SEQ ID NO: 16881 - DNA, 50 bp, homo sapien
gcagtagccattgtgtcattaaatamtaacttctaggaagcaagatatgt

SEQ ID NO: 16882 - DNA, 50 bp, homo sapien
tagctgagagcctcaattagacatcrccttataactttctgaagccttaa

SEQ ID NO: 16883 - DNA, 50 bp, homo sapien
gctcaggaccccaatgagattcactraaaatccacaaagtttttaagaaa

SEQ ID NO: 16884 - DNA, 50 bp, homo sapien
cataattttgattccaaagctcctayatataaacatgggataagccatct

SEQ ID NO: 16885 - DNA, 50 bp, homo sapien
cgacccaaatggatagctgggatcayagtagaatggaaattgtgtttact

SEQ ID NO: 16886 - DNA, 50 bp, homo sapien
cccaaacctaccgtaagaatccaaamaattatagaaatggctgggatttt

SEQ ID NO: 16887 - DNA, 50 bp, homo sapien
ttcaaaaaatatttaactgaggcacrctatattgatgttctactgttttt

SEQ ID NO: 16888 - DNA, 50 bp, homo sapien
attccccaccgccacccacaccagaracgctactgtatttacttcatccc

SEQ ID NO: 16889 - DNA, 50 bp, homo sapien
tgtgcaccggcattatgtcaaacackaagattcaagcatgcaggaacttg

SEQ ID NO: 16890 - DNA, 50 bp, homo sapien
ttagcgggccacatacttcattagakgcttcctaggtctgctccttagat

SEQ ID NO: 16891 - DNA, 50 bp, homo sapien
atcttttgagattttcacttcctgcygagatattagtcattagaaacttg

SEQ ID NO: 16892 - DNA, 50 bp, homo sapien
gtgctttcctagagctcttacaatcyagtagtgttcacaacactcataca

SEQ ID NO: 16893 - DNA, 50 bp, homo sapien
aacaaatcttgttattctttttaggrcaatgtagatgatcaaatgatgtc

SEQ ID NO: 16894 - DNA, 50 bp, homo sapien
aatcttaaaccaaactgaaggtccamctggaaaggaatagttgaataaaa

SEQ ID NO: 16895 - DNA, 50 bp, homo sapien
tttagctttatttatactgtcaaaawcttaaaccaaactgaaggtccaac

SEQ ID NO: 16896 - DNA, 50 bp, homo sapien
tttcctcctttgtgaaatgggatcayaatactagtctcacaggtatggtt

SEQ ID NO: 16897 - DNA, 50 bp, homo sapien
gctataacaaggaggacacatagaargtctagaagatatatggatgacta

SEQ ID NO: 16898 - DNA, 50 bp, homo sapien
tgtatttaaagattagccaagagtaygcaagatgatagaataaagggcca

SEQ ID NO: 16899 - DNA, 50 bp, homo sapien
caatgaaaggtcattgagatgaatayatatcaagtcctgatatctcaatt

SEQ ID NO: 16900 - DNA, 50 bp, homo sapien
gtccattttgtctatccatgggataygaccatgagcgcggggaagagctc

SEQ ID NO: 16901 - DNA, 50 bp, homo sapien
acaagcacagagaaaaatccttaccygggcacagctgattatcttgtgct

SEQ ID NO: 16902 - DNA, 50 bp, homo sapien
gcagaaccagaaagaactaaaactakggtaaccattgcacagcataaaga

SEQ ID NO: 16903 - DNA, 50 bp, homo sapien
gtgatattacaatttctaaaacttcrcctgtggctaattggaatgagatg

SEQ ID NO: 16904 - DNA, 50 bp, homo sapien
catctggctatcacagtgagctcaamttagaaactgcaataaacctgggg

SEQ ID NO: 16905 - DNA, 50 bp, homo sapien
tttctggtgctaggtttgtagacacygggcatatattccagactattggc

SEQ ID NO: 16906 - DNA, 50 bp, homo sapien
cattcttcttcctgtcagattatcayagcaactcttccaactacagtaaa

SEQ ID NO: 16907 - DNA, 50 bp, homo sapien
tgtcaaggttatcactgggtcttgaycttagggtgccaaaggagactcct

SEQ ID NO: 16908 - DNA, 50 bp, homo sapien
ttccaatatgtgaatattaacatagrccaatgacattattacagaagctt

SEQ ID NO: 16909 - DNA, 50 bp, homo sapien
ccaccatccgccacttaaactgggaygcgacatacgtacctaggtgtctg

SEQ ID NO: 16910 - DNA, 50 bp, homo sapien
cagctctagtgttggcttttggaaaytcacgttggcttttcaaaagcttc

SEQ ID NO: 16911 - DNA, 50 bp, homo sapien
tcaaaattcaattgctacaaaaatcraaacttgtcagactttttgcttta

SEQ ID NO: 16912 - DNA, 50 bp, homo sapien
tcatataaccagcataattttgaagrccattaagcctttatgaagtcaat

SEQ ID NO: 16913 - DNA, 50 bp, homo sapien
tacaaagggataatgtgatgtcttaygggtaaaaaaattataaaacacag

SEQ ID NO: 16914 - DNA, 50 bp, homo sapien
cgaaggacaaaaagatatatagataygatgcttgcagtagtaaaggtgga

SEQ ID NO: 16915 - DNA, 50 bp, homo sapien
atgactggttatcatctaactatgcrgacattttagcagaattcaggccc

SEQ ID NO: 16916 - DNA, 50 bp, homo sapien
gtataactatagcctaagatagttayagcattgaggaggaaaggtaccca

SEQ ID NO: 16917 - DNA, 50 bp, homo sapien
ttcagcttttgcagaagtactttgtwaatcagcccaacagctttctgatg

SEQ ID NO: 16918 - DNA, 50 bp, homo sapien
atctgtttaatgacttgcagcaaagraaaaaacatatactatgttgccaa

SEQ ID NO: 16919 - DNA, 50 bp, homo sapien
ttattcctctggaagtgatggggaaytggttacatctttcttggccacct

SEQ ID NO: 16920 - DNA, 50 bp, homo sapien
ccaaacattggcatgttaatatatayaagcgcagtttaacaaactgactt

SEQ ID NO: 16921 - DNA, 50 bp, homo sapien
gctgaaaaatatcaaacccttatgaragttagcttatacttggaacatcg

SEQ ID NO: 16922 - DNA, 50 bp, homo sapien
actaaattggcttaattgtaccccaragatgcccacaaaatgctgaattg

SEQ ID NO: 16923 - DNA, 50 bp, homo sapien
acagaaggaaaactggaaaattcacsaatacatgggaaatgaaataacat

SEQ ID NO: 16924 - DNA, 50 bp, homo sapien
atgtactgtcctttatttgtgagaayaccatagacaggctgttcctagac

SEQ ID NO: 16925 - DNA, 50 bp, homo sapien
gactggaagagctgttttacatagargatattgagagagaagattggaga

SEQ ID NO: 16926 - DNA, 50 bp, homo sapien
cttgctcatctttgagcatcattcaygtggtatcagtttacttccccatc

SEQ ID NO: 16927 - DNA, 50 bp, homo sapien
tcttttctctttgcatgtaaaagaaygcataaggttcctgcaaaatgtct

SEQ ID NO: 16928 - DNA, 50 bp, homo sapien
actactttagtgtgtttgaatgcatraactatttttagatatttattggt

SEQ ID NO: 16929 - DNA, 50 bp, homo sapien
acattttttttgtaaaagagcaacaygtattattctgaacacggttgagt

SEQ ID NO: 16930 - DNA, 50 bp, homo sapien
agaggagtcattgagtgtttcttcartagagttaacaaatgtcccagtgt

SEQ ID NO: 16931 - DNA, 50 bp, homo sapien
acccctttctccacctgaagaaatayatccggatttttgatgattagctt

SEQ ID NO: 16932 - DNA, 50 bp, homo sapien
cccagtggcttgtgagggagagagcraagaaaactacaaataatgaggat

SEQ ID NO: 16933 - DNA, 50 bp, homo sapien
ttatacttggaacatcggataacatyaatgacaaattagcgtcatttatc

SEQ ID NO: 16934 - DNA, 50 bp, homo sapien
gatttatttatttatcaaacccttayatagtacttgctatgtgtaatgat

SEQ ID NO: 16935 - DNA, 50 bp, homo sapien
cttgagaaacagaaatgtgatactcragtttctactaaatacgcatggaa

SEQ ID NO: 16936 - DNA, 50 bp, homo sapien
aaggaataaagcacaaagaccaagaygcgggacacagggaacagaaaact

SEQ ID NO: 16937 - DNA, 50 bp, homo sapien
tatgtgctgatctttttagctatcaragacatgtgatttagtattacttg

SEQ ID NO: 16938 - DNA, 50 bp, homo sapien
taagaaatttagaaatcaaatgtaaratatgggaataaatgatttttact

SEQ ID NO: 16939 - DNA, 50 bp, homo sapien
tagaagcccaaccaacactgaatgargaagctctacaacggctgtaggac

SEQ ID NO: 16940 - DNA, 50 bp, homo sapien
gctctgcttcatagtagctattatayggttcttaggcacaatttaaagct

SEQ ID NO: 16941 - DNA, 50 bp, homo sapien
tcaaatcaaaatcatgtctatagcgraggaagttctaattttattcctat

SEQ ID NO: 16942 - DNA, 50 bp, homo sapien
caatcaatcaatcaatcaatctgcamcaatgaaaccttgccgacacaagt

SEQ ID NO: 16943 - DNA, 50 bp, homo sapien
atctgctgattgctgctgcggcagaragaggaggacagccagcctcgcac

SEQ ID NO: 16944 - DNA, 50 bp, homo sapien
tctattcttttctccagaacctttcratcttctactctcaattctaatac

SEQ ID NO: 16945 - DNA, 50 bp, homo sapien
taactttctaactttctaagagtaayaactggaaaatttagaaaataaaa

SEQ ID NO: 16946 - DNA, 50 bp, homo sapien
gggagtgacttgaaaagtaccatgastataacccttccctgaagtgtagg

SEQ ID NO: 16947 - DNA, 50 bp, homo sapien
aggcgtgcctggtgggaggagaaagkatctgacgtgatgctgctgacctc

SEQ ID NO: 16948 - DNA, 50 bp, homo sapien
tttctctgacaatctcttacttaccrggcagtagtataaagcctggcaca

SEQ ID NO: 16949 - DNA, 50 bp, homo sapien
cacttatatctacaaagtgaagagtwaccgatctactcagagcgtggcat

SEQ ID NO: 16950 - DNA, 50 bp, homo sapien
acagctaagagcaaaggaggccggamcacatccaatggcagcgccgagac

SEQ ID NO: 16951 - DNA, 50 bp, homo sapien
taatctccatattttgtgatcgttarccgtatggacaacaccccctttgc

SEQ ID NO: 16952 - DNA, 50 bp, homo sapien
aggggattcaagctgtattctgttarctctctcttaagcaccatttgacg

SEQ ID NO: 16953 - DNA, 50 bp, homo sapien
gccctatctgatgccagtgctaaggraaggtgaagatgatccctgtcgtg

SEQ ID NO: 16954 - DNA, 50 bp, homo sapien
atctttctggccttctcttatgccawcccatctctgttccctcatgttct

SEQ ID NO: 16955 - DNA, 50 bp, homo sapien
cctgaaaagatatgtaacatacggcractgttaatctcttcattaaaaag

SEQ ID NO: 16956 - DNA, 50 bp, homo sapien
accacaaaggtaacagtcatcttcaratattattgacaaatagcaataat

SEQ ID NO: 16957 - DNA, 50 bp, homo sapien
atatggtgcttggaactggatacaayataaataccctgtaaacatggacg

SEQ ID NO: 16958 - DNA, 50 bp, homo sapien
atcatttagagatcatcagaaacaarttaagtttgaatatgaaagcttcc

SEQ ID NO: 16959 - DNA, 50 bp, homo sapien
gtgagaagcaggtgattgctgatacracttataaggggtgtggttccagt

SEQ ID NO: 16960 - DNA, 50 bp, homo sapien
agtgcagaatctgaaccggtttctaygatgtactacaccaaactcttctt

SEQ ID NO: 16961 - DNA, 50 bp, homo sapien
cagtgaatttacatcttagaagactsacattaacttatgcttgaatgaaa

SEQ ID NO: 16962 - DNA, 50 bp, homo sapien
cactgcctgctagatttatttacaawtactacaaataactcatcgtaggc

SEQ ID NO: 16963 - DNA, 50 bp, homo sapien
atctatagatatggtgaatctgaaamggaccaacaaaaagaataaaaaag

SEQ ID NO: 16964 - DNA, 50 bp, homo sapien
aactaagcactgtattttattttccygaagatgtggcacacagctgattc

SEQ ID NO: 16965 - DNA, 50 bp, homo sapien
cgagtggcttccttctccttttaagscgtccttcagggcagttcagaaaa

SEQ ID NO: 16966 - DNA, 50 bp, homo sapien
gttcctcgagcagagttcatctaacrcttcacctcctgtctctgtctccg

SEQ ID NO: 16967 - DNA, 50 bp, homo sapien
gtccatcattttgaaagtttgcctcracaagcagcaggactgagaagtta

SEQ ID NO: 16968 - DNA, 50 bp, homo sapien
agacatcagaagttaaagcccatgayataatgagtgaaaacatgcatagt

SEQ ID NO: 16969 - DNA, 50 bp, homo sapien
ctttggtggttcacttttgagttcamattttttagtgtgatctggccctt

SEQ ID NO: 16970 - DNA, 50 bp, homo sapien
ccagagcctgtgaacttgttgtttcygaaaaaggagtcagttgctattgg

SEQ ID NO: 16971 - DNA, 50 bp, homo sapien
gaaatgttggtcctcactgatggaartaattgattgcaatacaaaaagat

SEQ ID NO: 16972 - DNA, 50 bp, homo sapien
gtcacattttgtgttttcttcaaaaytgaattgagcttaaactctggatt

SEQ ID NO: 16973 - DNA, 50 bp, homo sapien
tacaccaaaagtagacagcaagctamattctactataccagataaaaata

SEQ ID NO: 16974 - DNA, 50 bp, homo sapien
acttttgttgaggtgcttattcttaracaggttgttatatgcatttgaac

SEQ ID NO: 16975 - DNA, 50 bp, homo sapien
gcaaagctctctttgcaacgatgaamccggacaacaccaggcggcccagt

SEQ ID NO: 16976 - DNA, 50 bp, homo sapien
tcacttaaatttggcattagtaaggwccctagcagaaggccagtttgtaa

SEQ ID NO: 16977 - DNA, 50 bp, homo sapien
agtatgaaaacatgaattagtcaacmaaaatcatgttggtattttcgccc

SEQ ID NO: 16978 - DNA, 50 bp, homo sapien
aggtatttccaaggtgtcttccaagwactaacatgaagtatgtaacagag

SEQ ID NO: 16979 - DNA, 50 bp, homo sapien
aggggactgaggaatcagctaccaasaaccgtgggaatggagacctaggc

SEQ ID NO: 16980 - DNA, 50 bp, homo sapien
tgataactttgttaatttgaatatamagtgaccactctgtacaatttcta

SEQ ID NO: 16981 - DNA, 50 bp, homo sapien
cgtggctttgttctcttacttccaaycaaaacaaaagaccaaaagagaag

SEQ ID NO: 16982 - DNA, 50 bp, homo sapien
aacactttctgaggattaaatagtaygctgcgttaaacacttctgaatgc

SEQ ID NO: 16983 - DNA, 50 bp, homo sapien
agcttggcacaggataggatatgcastagatactcaacaaatatcattga

SEQ ID NO: 16984 - DNA, 50 bp, homo sapien
accctgagtgtgcccgatctcgtctraatatcagtcttgttcctaaataa

SEQ ID NO: 16985 - DNA, 50 bp, homo sapien
cctaagcacccttcacctcattcaaygaatttcccaggcctagccagtct

SEQ ID NO: 16986 - DNA, 50 bp, homo sapien
tactgtgttaattttacataaataarcaggatgaaataataagtatactt

SEQ ID NO: 16987 - DNA, 50 bp, homo sapien
tggtcccctgtccaaatcttccacaygagctctggtgcctccaccaatga

SEQ ID NO: 16988 - DNA, 50 bp, homo sapien
attataagaaaaaagagaataagaayctgaataatatccctacagacaac

SEQ ID NO: 16989 - DNA, 50 bp, homo sapien
tgatcattcttcatatctggctaacmaactcttctgaaaggcctctccct

SEQ ID NO: 16990 - DNA, 50 bp, homo sapien
gtaactcacctgtcaaaaggtataaygaaaagactacaaactttgtatag

SEQ ID NO: 16991 - DNA, 50 bp, homo sapien
actgacggcctgcaccaacttagacrgtcacagtcatgaaaagtgcacag

SEQ ID NO: 16992 - DNA, 50 bp, homo sapien
attatacagattaactgataagatastaataatttgattgataaaatggg

SEQ ID NO: 16993 - DNA, 50 bp, homo sapien
cagatagctttctggcacatgtattsaaggccaacccaaatctataaatg

SEQ ID NO: 16994 - DNA, 50 bp, homo sapien
caggattgactcagaattaaacgtayaatgaacagcataccgaaggcaaa

SEQ ID NO: 16995 - DNA, 50 bp, homo sapien
gtgtgcttgggcacgcgtatgtgtayattaaagaagggccagcaagttta

SEQ ID NO: 16996 - DNA, 50 bp, homo sapien
cagaagagcctggtaatctcaagcayatcacctccaggcctcaccttccc

SEQ ID NO: 16997 - DNA, 50 bp, homo sapien
gatccttaaagtcaataggaagtaascgactgattctggataaacctttt

SEQ ID NO: 16998 - DNA, 50 bp, homo sapien
actgggttgcacttcacaggcaccaratacggaggacagtttggattcca

SEQ ID NO: 16999 - DNA, 50 bp, homo sapien
aataactataatctgggataagtaaytcatcacatatactttaatatgtg

SEQ ID NO: 17000 - DNA, 50 bp, homo sapien
tgtcccttactgttatctataaaaamtaaacctgctttacataacttgtg

SEQ ID NO: 17001 - DNA, 50 bp, homo sapien
tcacatttcaacatgagattggaaaraacatccaaatgatatcacagatg

SEQ ID NO: 17002 - DNA, 50 bp, homo sapien
cctcaatactcatagatgccaacacmatttcatgggaagtgggtcaagtc

SEQ ID NO: 17003 - DNA, 50 bp, homo sapien
aggattagagttagagttattactgsactacaagaactcctattttaaat

SEQ ID NO: 17004 - DNA, 50 bp, homo sapien
cattttgctccagcacactcaacacygacggcaaacaagcacctgcatga

SEQ ID NO: 17005 - DNA, 50 bp, homo sapien
ggtcacagcacgatgctatggaaatyatggttgcttgacattaacccagc

SEQ ID NO: 17006 - DNA, 50 bp, homo sapien
ctaccactgtgccttaaatcagtaaytggctcacttaagtttgttatttc

SEQ ID NO: 17007 - DNA, 50 bp, homo sapien
atgcctatctccaattttcttcaaartgtatcaaagaataggatgagttg

SEQ ID NO: 17008 - DNA, 50 bp, homo sapien
acataagggatcctgtaaggttgcamagtaaaacaagacttcctgaatga

SEQ ID NO: 17009 - DNA, 50 bp, homo sapien
atgggggcatttcataattatgaaakaaccaattcatcagaggacaataa

SEQ ID NO: 17010 - DNA, 50 bp, homo sapien
cccttaacattatgccaggtattatraagcaatctaattttatggcacat

SEQ ID NO: 17011 - DNA, 50 bp, homo sapien
acttccttattttgtaaagaactaaygaatgtgtacagattatgatgaga

SEQ ID NO: 17012 - DNA, 50 bp, homo sapien
tggaaattccgtaatgttacagatasgtttgaaaaacattttctcccaag

SEQ ID NO: 17013 - DNA, 50 bp, homo sapien
aaaacaaaatgcaagggaacactgaygccaatgctgaatcatgaagagaa

SEQ ID NO: 17014 - DNA, 50 bp, homo sapien
gcctggaagcttattccagaaatcartaattagttatgtctgagaaattg

SEQ ID NO: 17015 - DNA, 50 bp, homo sapien
tttgaaaaaatatgctaatcactgasagataaatacaaattcaaacaaac

SEQ ID NO: 17016 - DNA, 50 bp, homo sapien
tgctcgacagcaggtttgagctagargaagaaggactcagcaaacttgaa

SEQ ID NO: 17017 - DNA, 50 bp, homo sapien
cttgcccacaaaattaccaaatatcyacgtgatggttctgctttcgtttt

SEQ ID NO: 17018 - DNA, 50 bp, homo sapien
aaagaaattcagaagaaattgaaaartttattgaagcagataaaaacggc

SEQ ID NO: 17019 - DNA, 50 bp, homo sapien
gtcaaattggaaatataatgagtaamtgccgaaaataaatattctacatg

SEQ ID NO: 17020 - DNA, 50 bp, homo sapien
cagtgcttagggtctctgtgactacraggtatgtttctgatagagaagca

SEQ ID NO: 17021 - DNA, 50 bp, homo sapien
gtggggctccgggtttatctcatcayacgggttctaaaactttgttcctt

SEQ ID NO: 17022 - DNA, 50 bp, homo sapien
ttttgaccatgtctacagcccttaaytataccccttgcatccatcgtctg

SEQ ID NO: 17023 - DNA, 50 bp, homo sapien
atactttttaaagctatagaaaaaaratacctgtgtctctagtggttact

SEQ ID NO: 17024 - DNA, 50 bp, homo sapien
cttcaaagttgcttgctttatcctaytaccagaatcactcgtaaacttgg

SEQ ID NO: 17025 - DNA, 50 bp, homo sapien
ttcaaggggaaaatgtatcataaggraagacaattaaaagttaaaactgg

SEQ ID NO: 17026 - DNA, 50 bp, homo sapien
tcaatttaaataatctattccacaaraaacaagtctaaagaacgtctttt

SEQ ID NO: 17027 - DNA, 50 bp, homo sapien
caagttctctttttaacaaatacacrcatccttggtcttgagttgacacc

SEQ ID NO: 17028 - DNA, 50 bp, homo sapien
cagaggataaaatacaaggcttgaaygggccaaattcctggacaggcaca

SEQ ID NO: 17029 - DNA, 50 bp, homo sapien
tcctctacctgttcagataagcaagraatttgcccatacaaatcagttta

SEQ ID NO: 17030 - DNA, 50 bp, homo sapien
cactgttgtgtattacttttacttgraaaagaagctattatcattcctac

SEQ ID NO: 17031 - DNA, 50 bp, homo sapien
ttagcttgctttttcagactttaccmaataatatatcagctatcggggga

SEQ ID NO: 17032 - DNA, 50 bp, homo sapien
ggttaactcagctcagtataaataamaacacatgcttaacaatacatgtg

SEQ ID NO: 17033 - DNA, 50 bp, homo sapien
agtcagtgaatggggattttttgtaycaaataccaagacgataagttgaa

SEQ ID NO: 17034 - DNA, 50 bp, homo sapien
cactgtgagttggacatgagctaaawatctactgattacctgacctccat

SEQ ID NO: 17035 - DNA, 50 bp, homo sapien
gaaaagtagtataatagagaagatargaacgaaagtcagtgccagatgtc

SEQ ID NO: 17036 - DNA, 50 bp, homo sapien
aacaaggtgggcatagttactgtaaygaatagcagagacaaagcaacagt

SEQ ID NO: 17037 - DNA, 50 bp, homo sapien
aaagtagacacatgtatatcggcaayaataggtagcactcgaacctttca

SEQ ID NO: 17038 - DNA, 50 bp, homo sapien
ccctgcctcatgcatatgcaaataayctgaggtcttctgagataaatata

SEQ ID NO: 17039 - DNA, 50 bp, homo sapien
cttaagattttcggaactccatttckccacttgggctggatcacaggagc

SEQ ID NO: 17040 - DNA, 50 bp, homo sapien
atgatcaccgaccatatggttaaaayagcaaatgggaatgaagaaaaaag

SEQ ID NO: 17041 - DNA, 50 bp, homo sapien
taagacccagatataattcatcaaartcaaatacgtttaattgctttgta

SEQ ID NO: 17042 - DNA, 50 bp, homo sapien
tggttgactagctttaggatgcttayagactggtttctgttttaaaaggt

SEQ ID NO: 17043 - DNA, 50 bp, homo sapien
acagtaggagttctataataaaacaycaagtagattggaatgtccaaact

SEQ ID NO: 17044 - DNA, 50 bp, homo sapien
tatatctgttttcatagaggaagaargcgatgtgtaacatagactattat

SEQ ID NO: 17045 - DNA, 50 bp, homo sapien
ttagttttttgcatctctcttgtacygatgagccatacctctcagccttc

SEQ ID NO: 17046 - DNA, 50 bp, homo sapien
acaacaggggacccttttcctgtaaygtacaatagtagttttcatagttt

SEQ ID NO: 17047 - DNA, 50 bp, homo sapien
gcaaaaggaagattaatagaagaaarggtatgtaaaattttattttaaat

SEQ ID NO: 17048 - DNA, 50 bp, homo sapien
atacgtaggtgttaaactaatgcacrgattaaactataagggcaaagaaa

SEQ ID NO: 17049 - DNA, 50 bp, homo sapien
gatctttgcatttatgttcatgagasagatggttcatatcattttccttc

SEQ ID NO: 17050 - DNA, 50 bp, homo sapien
aaaattatccactcttttcaaatccyatcagcttggccacacagactggt

SEQ ID NO: 17051 - DNA, 50 bp, homo sapien
cagaaaatgtatggtttctgacaacmgtataattaagctaggactatata

SEQ ID NO: 17052 - DNA, 50 bp, homo sapien
gaaaagcatcttcaaatacttgactyagcatatctttcttctttagactt

SEQ ID NO: 17053 - DNA, 50 bp, homo sapien
gattcaattgctaatggagagatgartatcattatgtaagtctaaagaag

SEQ ID NO: 17054 - DNA, 50 bp, homo sapien
ggagagctactcatagtcacattcartcgatccctgggaaacatgtggca

SEQ ID NO: 17055 - DNA, 50 bp, homo sapien
aaggtaagagagaaaaggtcttctayggccctggttatcaccagagtagt

SEQ ID NO: 17056 - DNA, 50 bp, homo sapien
aatgttggtactgttctctttctcarctgaatagtgttaacacaggtgtg

SEQ ID NO: 17057 - DNA, 50 bp, homo sapien
gcaacttatgccatttcttcatgcasaggtgaattagaataactttaaag

SEQ ID NO: 17058 - DNA, 50 bp, homo sapien
ttcaacctggaccctaaatccctctraataacttgactctgttcatacac

SEQ ID NO: 17059 - DNA, 50 bp, homo sapien
tgataaagatgattttctgtaggtascagacgatataattaccagcatta

SEQ ID NO: 17060 - DNA, 50 bp, homo sapien
cacagatctccctccttattcttcasaacaagaatccgtcaaataagtaa

SEQ ID NO: 17061 - DNA, 50 bp, homo sapien
ggagatgaggctgtaacaattgtgcraggcatactcccaagatccagatt

SEQ ID NO: 17062 - DNA, 50 bp, homo sapien
ttagagacagcaaagctggtaaggargtgtctagaaaaggaccattggat

SEQ ID NO: 17063 - DNA, 50 bp, homo sapien
aacgagatagcatcctgttaacaagsagtagcagacttcccatgttacat

SEQ ID NO: 17064 - DNA, 50 bp, homo sapien
tcatctctatcgctttggaatgttayatagactgcatttgcatttaccta

SEQ ID NO: 17065 - DNA, 50 bp, homo sapien
agttcatcaagaatgtgcttcatcartaatactaaatctctaaatgttta

SEQ ID NO: 17066 - DNA, 50 bp, homo sapien
tccatttcccctctcccactctctakgcaatgcaaattcttaaaacaagg

SEQ ID NO: 17067 - DNA, 50 bp, homo sapien
tcatttttttagtctggataatacaygttcttggacctcttcaagaatag

SEQ ID NO: 17068 - DNA, 50 bp, homo sapien
aacacaacattgcccattcatgaacrgtccaaaatgtaaaaggtgctctg

SEQ ID NO: 17069 - DNA, 50 bp, homo sapien
ccagctgcacagtcacagcacataaygtagaactcggctgcgtatcaaca

SEQ ID NO: 17070 - DNA, 50 bp, homo sapien
ggcttaaagacaaaagtgtcagagargtcaaaggtggtttccttatgtga

SEQ ID NO: 17071 - DNA, 50 bp, homo sapien
tgtaaacaaaacaagcgaacaaccamtcgatgttgcctgaatgcgggggc

SEQ ID NO: 17072 - DNA, 50 bp, homo sapien
aaaaccacatctctactaaatatacraacagaattggctgggtgtggtgg

SEQ ID NO: 17073 - DNA, 50 bp, homo sapien
tcaaatgtcttaatggataaggaaasagcccagtgagataacctgacttt

SEQ ID NO: 17074 - DNA, 50 bp, homo sapien
cattaatatatccagaatttaaaacrgttcaatttctccagacccaggga

SEQ ID NO: 17075 - DNA, 50 bp, homo sapien
atgggggaaatgaagagaaaaatacraggtggaacaaaataaagttatat

SEQ ID NO: 17076 - DNA, 50 bp, homo sapien
cttaaagttaccacatgtgggtaaasatcccaggtgctcaacagaaaaga

SEQ ID NO: 17077 - DNA, 50 bp, homo sapien
cctttgtgcatattgttttctctacrgaaacccgcagtcaaatattcttg

SEQ ID NO: 17078 - DNA, 50 bp, homo sapien
cagtaagtgatggatcagggattcaractctgcattctaccgcatcattt

SEQ ID NO: 17079 - DNA, 50 bp, homo sapien
cctaagtacgagagaaaagatagatyatacattgaagagggacaggctga

SEQ ID NO: 17080 - DNA, 50 bp, homo sapien
aacaaaggagtaataaaggaataaasgacctacaaagcaaccagaaaaca

SEQ ID NO: 17081 - DNA, 50 bp, homo sapien
aatgtgctgataccgggtgattacartcttctagtagtgagaagggaaaa

SEQ ID NO: 17082 - DNA, 50 bp, homo sapien
catttttttttttaatttggaacggraaacaaatcatagagccttgtttg

SEQ ID NO: 17083 - DNA, 50 bp, homo sapien
tcatcacttcttaggtttgttcaacrctagtttcttatgttgccaatatg

SEQ ID NO: 17084 - DNA, 50 bp, homo sapien
atagtttgcaataaactctgtgggaygctcgccacttcaatcctgaaaaa

SEQ ID NO: 17085 - DNA, 50 bp, homo sapien
tctgcaggtctgttcgctcagcatcygatgagtgattctggctgtctgct

SEQ ID NO: 17086 - DNA, 50 bp, homo sapien
gataatcaaagatttacccattaaayacaaatcaacagagtgagagtggc

SEQ ID NO: 17087 - DNA, 50 bp, homo sapien
ttcactgctctcgtaaagagtaataygttacagagctaagaggtgtcagt

SEQ ID NO: 17088 - DNA, 50 bp, homo sapien
ggtttcctctcttggcaaacatagargctcaactgtgttctctgaggccc

SEQ ID NO: 17089 - DNA, 50 bp, homo sapien
aagtatctagcccagatctaggccayggaagactccctgtagcaacatac

SEQ ID NO: 17090 - DNA, 50 bp, homo sapien
aaatgtaagaaaacacaccaaattaygatcagtggctatttctaggtagc

SEQ ID NO: 17091 - DNA, 50 bp, homo sapien
gcaacatactgtgtagcaataattaygttaggtgctatagacgacataaa

SEQ ID NO: 17092 - DNA, 50 bp, homo sapien
gcacccagcctattcattaattttgraaggtgatagttaattacaagttt

SEQ ID NO: 17093 - DNA, 50 bp, homo sapien
ccatgattggaaaggttgggatgccrgaccaaagtgttgagttgttttaa

SEQ ID NO: 17094 - DNA, 50 bp, homo sapien
ttaaatgcattctcattatcctgcaygttcaatcaaggaaattgaggcaa

SEQ ID NO: 17095 - DNA, 50 bp, homo sapien
ttgcattatatatggcagagctcaaygtaagaacttcctgttttatcagc

SEQ ID NO: 17096 - DNA, 50 bp, homo sapien
tcacagctgatggtggcaaataaccsatgcagagtactgaaatgagccag

SEQ ID NO: 17097 - DNA, 50 bp, homo sapien
tttctttctgtttggaatatggacargatgtggcctctagcttgtgtgtg

SEQ ID NO: 17098 - DNA, 50 bp, homo sapien
agtttgatcttttcattgacactacsaatctctctctctctctctttcaa

SEQ ID NO: 17099 - DNA, 50 bp, homo sapien
gaatgaggagcaaagagtaagaaacrgaatgagctgtgtacaaatatgta

SEQ ID NO: 17100 - DNA, 50 bp, homo sapien
gtcccttaaaccaacacccatgtccyagttatttaagtggtttaattcat

SEQ ID NO: 17101 - DNA, 50 bp, homo sapien
ttagaatatttgggtctaatatctgyaataaggcaagaataaagcttgag

SEQ ID NO: 17102 - DNA, 50 bp, homo sapien
acaaagtcatattttttatactttcrattggcgattttgaacattgcagg

SEQ ID NO: 17103 - DNA, 50 bp, homo sapien
ttcagtaagtcagaacgtagatccayagagtgacgtgatttttcagttct

SEQ ID NO: 17104 - DNA, 50 bp, homo sapien
cccccacgtagctaactgataagaamggtggagatagtgataagacagac

SEQ ID NO: 17105 - DNA, 50 bp, homo sapien
tatgtgagtttagttctgagctttcwattctgttttattggtatacatgt

SEQ ID NO: 17106 - DNA, 50 bp, homo sapien
aggttatgaaatttccatcttgttcmacttcagagaagtagagtatgttc

SEQ ID NO: 17107 - DNA, 50 bp, homo sapien
atgtatgaaaccttaaaatagaacaygggataagaggtctaaagtgaatc

SEQ ID NO: 17108 - DNA, 50 bp, homo sapien
tgtttcctcctaggagtttatggggycaggtcttatgttaagtctataat

SEQ ID NO: 17109 - DNA, 50 bp, homo sapien
aaacataagcagaatgttaaaatatkagtgatgacctgaaacagagcctg

SEQ ID NO: 17110 - DNA, 50 bp, homo sapien
ctgacacacgctgctgaagtaagtarccttgcgccttgggactgggcctg

SEQ ID NO: 17111 - DNA, 50 bp, homo sapien
tttctgtagatttctctttcatcaarcaaataaagatgagaccaatgtcc

SEQ ID NO: 17112 - DNA, 50 bp, homo sapien
tccttcaacctcacctttgaatgtargctgttaagtctgaccacaactat

SEQ ID NO: 17113 - DNA, 50 bp, homo sapien
aagtggagacagtgagaattcaggckgaaattactagaaaaccccaggaa

SEQ ID NO: 17114 - DNA, 50 bp, homo sapien
ctgagcaatggacatagctctcataygaaccttttcagctaacaccggat

SEQ ID NO: 17115 - DNA, 50 bp, homo sapien
ttcaggccacgcatgtaactcagggycagttctcttaatgctctcatttt

SEQ ID NO: 17116 - DNA, 50 bp, homo sapien
gtcacaaaatttacaggttgtaatayaatagcaagaatagcaacaaacaa

SEQ ID NO: 17117 - DNA, 50 bp, homo sapien
gctccaaacacgaattttgcttctamgaccctgtaagctgtgggttgtac

SEQ ID NO: 17118 - DNA, 50 bp, homo sapien
gtgtgtatcgattttacctgtcgaaygtctgcatttgatgcagttctccc

SEQ ID NO: 17119 - DNA, 50 bp, homo sapien
ccttcgttttaaaaagtactgatacyaattcatctgaggaaatctaagac

SEQ ID NO: 17120 - DNA, 50 bp, homo sapien
gggcaggactacttcaggaatacaaygtttaagtaaaagaggttggggtc

SEQ ID NO: 17121 - DNA, 50 bp, homo sapien
tattgtctgttgaatgtggcctagaraacattgatcagatttcatcccta

SEQ ID NO: 17122 - DNA, 50 bp, homo sapien
catcacgattatttatggatctcaamggaacagggcccagcaaaaatgag

SEQ ID NO: 17123 - DNA, 50 bp, homo sapien
tcactccaagctctctgctatccaarttgataaggccacaaaagtgaact

SEQ ID NO: 17124 - DNA, 50 bp, homo sapien
tgcctgcatcctccttggagcaatcycatagtttccaagggtcccagagg

SEQ ID NO: 17125 - DNA, 50 bp, homo sapien
gaataaaaaggctggccaagttatgratacaagatggcaagttatccttt

SEQ ID NO: 17126 - DNA, 50 bp, homo sapien
actcatagcacctagtatttaggaayaaaaaggctggccaagttatgaat

SEQ ID NO: 17127 - DNA, 50 bp, homo sapien
gatgttaaacatttatgttgggcagyaacaataagtactcaccaaatttt

SEQ ID NO: 17128 - DNA, 50 bp, homo sapien
aaataaataggcttaacccatagaargtcacataggaatacatgcagctt

SEQ ID NO: 17129 - DNA, 50 bp, homo sapien
atagttaactctttagtattttacartctactcgatgaattgaacttttt

SEQ ID NO: 17130 - DNA, 50 bp, homo sapien
gcttgagcctctgataaagtcacgcrattgaattttagccccagtaggtt

SEQ ID NO: 17131 - DNA, 50 bp, homo sapien
atctgtaacattacggaatttccaaygatgttatattttgaaatatcaat

SEQ ID NO: 17132 - DNA, 50 bp, homo sapien
gactaatatagtggggatgggccgaygaagaactccgttgacagggatcc

SEQ ID NO: 17133 - DNA, 50 bp, homo sapien
acagggatccaccattttatgaccaygtagagtattttcactgccctgga

SEQ ID NO: 17134 - DNA, 50 bp, homo sapien
acacaccattctatatccaagtcagkatgtatttgttgagacctactgtg

SEQ ID NO: 17135 - DNA, 50 bp, homo sapien
ttgattgatcccttaagtatcagtgratcaaattatgtgtgctaaggaat

SEQ ID NO: 17136 - DNA, 50 bp, homo sapien
cttgggaaatattttcaatagtcaarttaaagtacacttgatgaaaatgt

SEQ ID NO: 17137 - DNA, 50 bp, homo sapien
caggttggccaccttgcaggatgtarccctttataagaaaaaagtctcct

SEQ ID NO: 17138 - DNA, 50 bp, homo sapien
tttgtattttattaaggactgatgamtaatacaaatataaacttaaaata

SEQ ID NO: 17139 - DNA, 50 bp, homo sapien
agcgtgagacagtaagcagcctctcrcaaacgttcgccttagagtgagat

SEQ ID NO: 17140 - DNA, 50 bp, homo sapien
agggttgaattcttctggtgctaggygagatcaattattttgatacagtc

SEQ ID NO: 17141 - DNA, 50 bp, homo sapien
tgattcaattggtttagaattcaacrgttacttgtcatctcccacatggt

SEQ ID NO: 17142 - DNA, 50 bp, homo sapien
ataagttgtatgaaacaaccagaaawctctctcactaaatgtaggtcctt

SEQ ID NO: 17143 - DNA, 50 bp, homo sapien
gtgtgaaacactgcacctggcctgayctgtcaactgtaaacattatcttt

SEQ ID NO: 17144 - DNA, 50 bp, homo sapien
ccttctttataaacattagaggataygtccaaattttcacacacacacac

SEQ ID NO: 17145 - DNA, 50 bp, homo sapien
ctgctgcctgactgctcctttgccaractcttattcatctcttgattggc

SEQ ID NO: 17146 - DNA, 50 bp, homo sapien
cagagttaaaagccagctagtaagcracggagctgagattcaaatacacg

SEQ ID NO: 17147 - DNA, 50 bp, homo sapien
agcaacaacaacaattccagcaagtkaatgtacgtttttgaatttaagct

SEQ ID NO: 17148 - DNA, 50 bp, homo sapien
tttgtcacactgctcaagagcttccraatgggatcagtcagacttatttg

SEQ ID NO: 17149 - DNA, 50 bp, homo sapien
tgtcagccagagctgcagtcttatcrgaagggttccctgggaaaccatcc

SEQ ID NO: 17150 - DNA, 50 bp, homo sapien
aataacagaatggttctgtgaatgaygccatagccactcaacaaggcaca

SEQ ID NO: 17151 - DNA, 50 bp, homo sapien
agatcagcaaggcaatcaggtacacraagggttaagaaaaggcattaggg

SEQ ID NO: 17152 - DNA, 50 bp, homo sapien
tgttttgtgcagtcactcccgggcasactttcctactgcaactccactcc

SEQ ID NO: 17153 - DNA, 50 bp, homo sapien
tttcctgtgccccaacacctatcacyggatcttccttccagactgtgatt

SEQ ID NO: 17154 - DNA, 50 bp, homo sapien
agttacctgcaatcaaatgcagtccraaaaattaaatggaaatttccaga

SEQ ID NO: 17155 - DNA, 50 bp, homo sapien
acatttctggtgttagcatcaatatkaaacatagcctctgataaatcata

SEQ ID NO: 17156 - DNA, 50 bp, homo sapien
tctgcattatgctgcagcaaagatakgagttggaacttatatttaaggga

SEQ ID NO: 17157 - DNA, 50 bp, homo sapien
ttctttgctgtggaaggctgtcctaygtactgtaaaatgtttagtagcat

SEQ ID NO: 17158 - DNA, 50 bp, homo sapien
atagtttgaaattagaataccattarctgaatttaccaaatcgccaacct

SEQ ID NO: 17159 - DNA, 50 bp, homo sapien
gtcaggcatgggttagtgacacaaaycacttggtaattaaaaaccccttg

SEQ ID NO: 17160 - DNA, 50 bp, homo sapien
atggatcacagaaactccacaaatarcatcggtgacacacctatggctct

SEQ ID NO: 17161 - DNA, 50 bp, homo sapien
ggagtgtccaagatcaggacgacctracaattttctctttgattcatgag

SEQ ID NO: 17162 - DNA, 50 bp, homo sapien
agtagcacaaatgaacttttgcctaygtaaaaaatagaacattgcttagc

SEQ ID NO: 17163 - DNA, 50 bp, homo sapien
cagcaaatcagtacaacgtggtgatyatcaaacatcataaatccatgaag

SEQ ID NO: 17164 - DNA, 50 bp, homo sapien
catgaggagggcttgccaaggcaaaygtaacatgtttttgagggcagcaa

SEQ ID NO: 17165 - DNA, 50 bp, homo sapien
tttcttgttctagatctatttacackaaacctctgacatctgtgtagctt

SEQ ID NO: 17166 - DNA, 50 bp, homo sapien
tctttctcagcaaatattcaggtacracccttgcccagcctaccttccaa

SEQ ID NO: 17167 - DNA, 50 bp, homo sapien
actgatgaatgattaagatccttcayggcaaagactgcaggctgcttacc

SEQ ID NO: 17168 - DNA, 50 bp, homo sapien
atttacttaaattcacagaaggatasattcacacaagtggatttttattg

SEQ ID NO: 17169 - DNA, 50 bp, homo sapien
ccccattggacctgtaagtgtctaamcctgggctgattctgtaacctgcc

SEQ ID NO: 17170 - DNA, 50 bp, homo sapien
ggctgggaggtaagttcatgctacaktgaactgctgtatttcagtctagc

SEQ ID NO: 17171 - DNA, 50 bp, homo sapien
tcagcatctttgactctcaattttcwcaagggtaaaataagagatgtaga

SEQ ID NO: 17172 - DNA, 50 bp, homo sapien
tatgcttttcttgccctactattackcaattcaagtcaactcagcaaatg

SEQ ID NO: 17173 - DNA, 50 bp, homo sapien
attacaaagccagtatatgcccgaawaaggatagaatggattttcttgct

SEQ ID NO: 17174 - DNA, 50 bp, homo sapien
ggaccagtgtcgctggcacagtttcratgctgaagctgcccactgagtta

SEQ ID NO: 17175 - DNA, 50 bp, homo sapien
aggtacaaaacagaagttaaggtacraaccatggtgaacacaagcttgct

SEQ ID NO: 17176 - DNA, 50 bp, homo sapien
attaacctctaactactatataacamgggtacatagctataagttgctgt

SEQ ID NO: 17177 - DNA, 50 bp, homo sapien
caatagacatttctccaaacgactayagaaatgtccactaagggcataaa

SEQ ID NO: 17178 - DNA, 50 bp, homo sapien
cgttttggctgcaggtgattataacrataagtgttaggggtaattgtgtt

SEQ ID NO: 17179 - DNA, 50 bp, homo sapien
ctgtgttgataatgaggaagaataawcaacctctaaatacaagtgctttg

SEQ ID NO: 17180 - DNA, 50 bp, homo sapien
aaagttgaatcttcaaatcctgtaamtgtggagttttaatttagagcatt

SEQ ID NO: 17181 - DNA, 50 bp, homo sapien
ccatgcaagtacactttgatggaacyagaccatgcaagtacactttcatg

SEQ ID NO: 17182 - DNA, 50 bp, homo sapien
taaatatcttcttcatgtaaagataygttaggaaaagaattacagaagat

SEQ ID NO: 17183 - DNA, 50 bp, homo sapien
ttacaataaacttcagtaactatgakcccccagcttctgtgttacaaaat

SEQ ID NO: 17184 - DNA, 50 bp, homo sapien
actcattttaatctatcagaatgacrcttaatatataaatttctttatgc

SEQ ID NO: 17185 - DNA, 50 bp, homo sapien
ccataactgttggagttctctgataygtagttgtctttcctactaggcta

SEQ ID NO: 17186 - DNA, 50 bp, homo sapien
aaatgatcagacatggtgcccagtayagaatgagtgaaaagaggatgatg

SEQ ID NO: 17187 - DNA, 50 bp, homo sapien
tgtacacacttagaggccacatggarcttctcctcacttttttttttttg

SEQ ID NO: 17188 - DNA, 50 bp, homo sapien
ctaattacaaaaaataatggatcaartgtcttaagggaaatgccaggtac

SEQ ID NO: 17189 - DNA, 50 bp, homo sapien
atttgttaatactgacagtgttgtcyaagtaaattgcaagatatatcatt

SEQ ID NO: 17190 - DNA, 50 bp, homo sapien
gagaacgtttgaaaagtcaaggttcyatgacctaaaaaatgcatagggtg

SEQ ID NO: 17191 - DNA, 50 bp, homo sapien
agtgacaggactgggttccagggcaygtaaatggtgtccacctgagatgc

SEQ ID NO: 17192 - DNA, 50 bp, homo sapien
tttgactcttttcgttgacatcttaygtggtttaaaactgtgagagactg

SEQ ID NO: 17193 - DNA, 50 bp, homo sapien
cattttgctttttgtttcagcaagaycataatcaatggtatacaacagtg

SEQ ID NO: 17194 - DNA, 50 bp, homo sapien
tccactgttagctgagtgttttgaayatctgatttgtcctgtccatgtat

SEQ ID NO: 17195 - DNA, 50 bp, homo sapien
acccagtaaggtgaaaggaaaactargagtgggaagtcaaagtgaaggag

SEQ ID NO: 17196 - DNA, 50 bp, homo sapien
agaatattgagggctaagagagaagyagacgtgaacaagttaagagcgtg

SEQ ID NO: 17197 - DNA, 50 bp, homo sapien
gatgatgagagggtaaaactgattasgatactcggaaacgcttggtgata

SEQ ID NO: 17198 - DNA, 50 bp, homo sapien
attttacacccactgcttttctgaawtacttatcccagttccttaggtct

SEQ ID NO: 17199 - DNA, 50 bp, homo sapien
aaaaactcctccttcaatatctggargaagctacccttgagagacaaatt

SEQ ID NO: 17200 - DNA, 50 bp, homo sapien
tgttttggtgtttgctaactgatcaygaataatttgcatatctctcattg

SEQ ID NO: 17201 - DNA, 50 bp, homo sapien
ttcttgtccaaaacaggtaagataasagttgtgttaagtgtggactggct

SEQ ID NO: 17202 - DNA, 50 bp, homo sapien
tctatctcctcatctgagtaaacacsaccaactattacccagttgttcaa

SEQ ID NO: 17203 - DNA, 50 bp, homo sapien
tggaacaccagctgtctgtagttaaygattcagagtgctggtcaaggcgt

SEQ ID NO: 17204 - DNA, 50 bp, homo sapien
ttagcaacatattatcatcttggaaygtgacattattaaaccctcctaat

SEQ ID NO: 17205 - DNA, 50 bp, homo sapien
actttttaactgaaatgctacttgartattgctcccttaaattattaatt

SEQ ID NO: 17206 - DNA, 50 bp, homo sapien
ttggtttacttctctgtacagaagartaagtaactcataagggtgttagg

SEQ ID NO: 17207 - DNA, 50 bp, homo sapien
gtgtgagttctctcatagacacagcrgaagaggttttttggttttgtttt

SEQ ID NO: 17208 - DNA, 50 bp, homo sapien
tttcacactacctacacactatggamcagatatctaaaactggtgctgtc

SEQ ID NO: 17209 - DNA, 50 bp, homo sapien
cagattgctggatatttctgacatayaagactcaattaggaaaagacaaa

SEQ ID NO: 17210 - DNA, 50 bp, homo sapien
ttactatttcccttgaagataggacyctttgtggtagtaatacgttttag

SEQ ID NO: 17211 - DNA, 50 bp, homo sapien
aattaagctcaaagaagttaggtaasaaggatcacataactagtgtgtaa

SEQ ID NO: 17212 - DNA, 50 bp, homo sapien
aagccttctcttatatttaaagggamcttccaactttctattagatattt

SEQ ID NO: 17213 - DNA, 50 bp, homo sapien
agtaaagcaggataaaaggattaagrcaagtgagaactcatattgaatac

SEQ ID NO: 17214 - DNA, 50 bp, homo sapien
ttttttggtcatgaaagaaacaatcyattatctgtacatcagttttgtgc

SEQ ID NO: 17215 - DNA, 50 bp, homo sapien
ggccttttatgaagcaaatttctatwaactgaacaatttaaaggaattaa

SEQ ID NO: 17216 - DNA, 50 bp, homo sapien
ttctatactttcgacaagattgacartatgtagcatgatgagttaaattt

SEQ ID NO: 17217 - DNA, 50 bp, homo sapien
taaggagagattgaatatccagagasagttcatttgaggcatcctgatag

SEQ ID NO: 17218 - DNA, 50 bp, homo sapien
tcaagttctgaagatgtcataaaaaygtcttctgctttacttgcatatgg

SEQ ID NO: 17219 - DNA, 50 bp, homo sapien
gtctgccgtcattgtgtaactgggcyattgtgactcctgatatagaaatg

SEQ ID NO: 17220 - DNA, 50 bp, homo sapien
taaaagttcaggaaacatggatttamaaaactgggaataactatccagtc

SEQ ID NO: 17221 - DNA, 50 bp, homo sapien
ggttacatagtaactggctggtagaygcatagctaacattatacaaagta

SEQ ID NO: 17222 - DNA, 50 bp, homo sapien
ccatatacaaaaagcaaataaaaackgattgacgacttggatttaaaacc

SEQ ID NO: 17223 - DNA, 50 bp, homo sapien
ccacattcagttgcctattgattgtraagaggattctgcagtggggtgct

SEQ ID NO: 17224 - DNA, 50 bp, homo sapien
tgaacagtgctttggttttagaaagwagttgatttattggagaatcagct

SEQ ID NO: 17225 - DNA, 50 bp, homo sapien
atgctattatattgtttggtatacakgcctttgattgctagaattattct

SEQ ID NO: 17226 - DNA, 50 bp, homo sapien
tctttgtaaattattcatgctaaccmagtctcagtataggttgcctaatg

SEQ ID NO: 17227 - DNA, 50 bp, homo sapien
tcctaatccttacctaaaggccacayagtacgtgatattattgtattatc

SEQ ID NO: 17228 - DNA, 50 bp, homo sapien
tttatggaacatgcatggagtattayggacagtatatgaactcagtgatg

SEQ ID NO: 17229 - DNA, 50 bp, homo sapien
cacttctaacctcttggactagcgaygccccttgtttgccatgctctagg

SEQ ID NO: 17230 - DNA, 50 bp, homo sapien
agcttctcccaatgttatcatcctayattaccagggtacgtttgtcaaaa

SEQ ID NO: 17231 - DNA, 50 bp, homo sapien
agtatgatttcagtggatgaactaayggataataattcacaatttggact

SEQ ID NO: 17232 - DNA, 50 bp, homo sapien
agtacctacttcaagagttgctaacrggacttaatgagttaattaataca

SEQ ID NO: 17233 - DNA, 50 bp, homo sapien
gtggtatatgcagcatctggatctaygaaagttaaccacaattagggcca

SEQ ID NO: 17234 - DNA, 50 bp, homo sapien
catagcaatgagaacaaagaacttayaaaagtacacagcaacatggatga

SEQ ID NO: 17235 - DNA, 50 bp, homo sapien
taaggcccatttaatatccatggaaycttttgagtctttttaagacaagt

SEQ ID NO: 17236 - DNA, 50 bp, homo sapien
agccactgaaagagagtgttaagtayggctgtttatcaacaattgctacc

SEQ ID NO: 17237 - DNA, 50 bp, homo sapien
ccttgttctattcttattgggacacsctgcctgtcaaacatacttttttt

SEQ ID NO: 17238 - DNA, 50 bp, homo sapien
gtatgttgacatcctcaccactcaaygcctctaaattaaacagtatatat

SEQ ID NO: 17239 - DNA, 50 bp, homo sapien
aattctgtcttagaaaatccaattayatgaatctatccttggtgtaatag

SEQ ID NO: 17240 - DNA, 50 bp, homo sapien
ggatgtcaacatactgcttttcatarcctgtggtgagaattcctcttgga

SEQ ID NO: 17241 - DNA, 50 bp, homo sapien
tttattcacaaattaggtagggtgaraaactatgtggcattcctgttgct

SEQ ID NO: 17242 - DNA, 50 bp, homo sapien
agcagcgactagaagtttgttctaamgtgagcctttctcaggccattctg

SEQ ID NO: 17243 - DNA, 50 bp, homo sapien
aagctcccagtcacaatagttttatwagcatagcatggaccatttgtaag

SEQ ID NO: 17244 - DNA, 50 bp, homo sapien
cgagccactctgcctggcctaagaaytatctaccatagcaatgagagtag

SEQ ID NO: 17245 - DNA, 50 bp, homo sapien
cagtatagactttcagcttctaaacraaatggagtaacacagagtaacag

SEQ ID NO: 17246 - DNA, 50 bp, homo sapien
tgatgtacatttagacggatgaatgsaatacaaggaaaacccatttagtg

SEQ ID NO: 17247 - DNA, 50 bp, homo sapien
atcctcttgacaagaaccgcagttarcaggtgaaaaaatagttgactgaa

SEQ ID NO: 17248 - DNA, 50 bp, homo sapien
ctccctttgaaaatgagtaaaaaacmatgagtggacatgggcaaaataag

SEQ ID NO: 17249 - DNA, 50 bp, homo sapien
ctccaatcagatttttctgtgcttayagcgcctctcttgtcaacaacact

SEQ ID NO: 17250 - DNA, 50 bp, homo sapien
tgcttctgatggctgtcaatgagaayagctctatgtggtatcctcacata

SEQ ID NO: 17251 - DNA, 50 bp, homo sapien
gtattcagaaagtccttttgaatcaycttttagacataaggacttataaa

SEQ ID NO: 17252 - DNA, 50 bp, homo sapien
aatgacatgtttcttagtaattgaasaaaatatgtaactattctcagttg

SEQ ID NO: 17253 - DNA, 50 bp, homo sapien
acatattcaagccagggaatcttacrctatctgcaggcactgtgttctaa

SEQ ID NO: 17254 - DNA, 50 bp, homo sapien
acacatttaaagaaatcagttgttaygacaggactggtaattaattctta

SEQ ID NO: 17255 - DNA, 50 bp, homo sapien
tagggaagaacaagaaaggatcgaayataggaaaataagtttatgttgga

SEQ ID NO: 17256 - DNA, 50 bp, homo sapien
gaacataagagaaaaacctcagttakgatccctgctcatctgtttatact

SEQ ID NO: 17257 - DNA, 50 bp, homo sapien
gaagtataatagtaatattttgtaasagaattatgaaactcactaagttc

SEQ ID NO: 17258 - DNA, 50 bp, homo sapien
aaacattgcccagtagtgaggaagamaactactcccgataaagtgatttt

SEQ ID NO: 17259 - DNA, 50 bp, homo sapien
ctcaggctttctagatcacagatacmattatgacaagattatttcaacag

SEQ ID NO: 17260 - DNA, 50 bp, homo sapien
agaaggggatttttcttaaaggttayatcaaaaatagtagttctacaaat

SEQ ID NO: 17261 - DNA, 50 bp, homo sapien
aagagttggcttcccttgacggatayagcctttacttactgaattgctag

SEQ ID NO: 17262 - DNA, 50 bp, homo sapien
aaaattagaacaaagacaaattaaarttagaaatagtggtaagaaaaatt

SEQ ID NO: 17263 - DNA, 50 bp, homo sapien
tcaggcaggcaggaaacatggtggasagaacaaaagatttagcttatctg

SEQ ID NO: 17264 - DNA, 50 bp, homo sapien
ttgttggtttaaaataactctacttmaaattgaatctcaagaatatattt

SEQ ID NO: 17265 - DNA, 50 bp, homo sapien
atataactaaatattataaccagcargatatattggataaaatcaacttt

SEQ ID NO: 17266 - DNA, 50 bp, homo sapien
gtatttggcagtgtctatatggaatmaaaaacttgcattaaaatggagaa

SEQ ID NO: 17267 - DNA, 50 bp, homo sapien
actgtcataattgccatcattaggayaagctgcctcaatcgacatttatt

SEQ ID NO: 17268 - DNA, 50 bp, homo sapien
attacattgaggataagttgaaagaragtgtcaaggggaaaatggaattg

SEQ ID NO: 17269 - DNA, 50 bp, homo sapien
aaaaacatctctttctggtgatgtamgaactggccagatgtcactggact

SEQ ID NO: 17270 - DNA, 50 bp, homo sapien
acctgaaataagcaagaataagatargtaaagacagactgttcaaaatgc

SEQ ID NO: 17271 - DNA, 50 bp, homo sapien
gagaagtttcatcaaactaaaacacraagtaacaaatatcacaaaatcta

SEQ ID NO: 17272 - DNA, 50 bp, homo sapien
aaggcaagtgaagctaaatctgagaygaaaaaataacatgtgcaaactct

SEQ ID NO: 17273 - DNA, 50 bp, homo sapien
ttcatcacttggtttccaaggtctartaatccctcaagaatttagagtgt

SEQ ID NO: 17274 - DNA, 50 bp, homo sapien
tgtaaaatttaacataatttttgackgctagtatatggaaataaatttta

SEQ ID NO: 17275 - DNA, 50 bp, homo sapien
ctaaatggaacaaaacaaggaggatraaccaattctcagagccaagaggg

SEQ ID NO: 17276 - DNA, 50 bp, homo sapien
gaccaacaagtgtattccattttacratactgagttgtatctacacatgt

SEQ ID NO: 17277 - DNA, 50 bp, homo sapien
agtgttgagccctctgacatatccarctcttaactctctctgtgagaagt

SEQ ID NO: 17278 - DNA, 50 bp, homo sapien
attaggaactctgaataactctagakaccatccactgcaagaggccagtg

SEQ ID NO: 17279 - DNA, 50 bp, homo sapien
aataagcaaaagaattgaccatcccragagatgagtagtacggaagcgaa

SEQ ID NO: 17280 - DNA, 50 bp, homo sapien
aatccctggagtgcacctacatgccwatataccatcaagtgcaggccatt

SEQ ID NO: 17281 - DNA, 50 bp, homo sapien
atagggctaatttatcctaaagataytagacatttttataacagactaaa

SEQ ID NO: 17282 - DNA, 50 bp, homo sapien
caccaactcgccaccatagcccaagratgttctctggagcccagctacac

SEQ ID NO: 17283 - DNA, 50 bp, homo sapien
ccagtccttgggctgccagtctgtarctctgaataaaatggactgcataa

SEQ ID NO: 17284 - DNA, 50 bp, homo sapien
tatggaagtctctaaaggaattggartattaaaagtgaattaatttacct

SEQ ID NO: 17285 - DNA, 50 bp, homo sapien
gcaccgctctacaacttgatattackactgttctctagagtcatccaaaa

SEQ ID NO: 17286 - DNA, 50 bp, homo sapien
cagcaggaggcagaaaactactcaaytgtggtcatgtatctgaaggatat

SEQ ID NO: 17287 - DNA, 50 bp, homo sapien
agatccagcctatctgtgcttcttcrgaaactctcttagaaatagcttct

SEQ ID NO: 17288 - DNA, 50 bp, homo sapien
actcttttctaacataatatctcaaygttctcctatgcattatttaatag

SEQ ID NO: 17289 - DNA, 50 bp, homo sapien
cccaagatttcctcactccatagtaragtagttttaaattttcagtagtg

SEQ ID NO: 17290 - DNA, 50 bp, homo sapien
attgatgctttatgtatatcctgtcycaatttgtctgttcactgtaaaga

SEQ ID NO: 17291 - DNA, 50 bp, homo sapien
tgaatatgtgaatatccaatgaatasaatagctgctcaaagaatattcgt

SEQ ID NO: 17292 - DNA, 50 bp, homo sapien
cctatctccctttctacttaaaaccrccaatctaatttgtatgaaacatt

SEQ ID NO: 17293 - DNA, 50 bp, homo sapien
actgtaaagatataatttttttaagmagctataccactgacaacaattta

SEQ ID NO: 17294 - DNA, 50 bp, homo sapien
actcagtaacgaatttaaagttctarctatgagccaggaactgttctagg

SEQ ID NO: 17295 - DNA, 50 bp, homo sapien
caacagcttatcacattgtaacctcrattatcgctcagttctccaagaaa

SEQ ID NO: 17296 - DNA, 50 bp, homo sapien
tgcccattcaattattgcttaagaaygtttagtccacctgaccccatagc

SEQ ID NO: 17297 - DNA, 50 bp, homo sapien
cttttctttaggactaattgaaatckgaggtagtagatgatgcaggctct

SEQ ID NO: 17298 - DNA, 50 bp, homo sapien
gccactggattcaattgtgcacgaarccatataagttatgtggaccaaga

SEQ ID NO: 17299 - DNA, 50 bp, homo sapien
taaaagtatgattcctaacataaaawctctaagtggtgtatcttaagctt

SEQ ID NO: 17300 - DNA, 50 bp, homo sapien
tgttaggaatcatacttttagagacraactgttcttgggctggagctatg

SEQ ID NO: 17301 - DNA, 50 bp, homo sapien
cttaaacaactgtttgcagatccaaygggtttgttatgatgcaaaatgca

SEQ ID NO: 17302 - DNA, 50 bp, homo sapien
gtgttgcatttggcttaagaagacaygttgagtttaaaatgatggtggaa

SEQ ID NO: 17303 - DNA, 50 bp, homo sapien
gttgatgtttatcgtataagaccctsaccctatgtacctcaactgactca

SEQ ID NO: 17304 - DNA, 50 bp, homo sapien
tgagggttaattccaggagtattagrcaatcatgactggagaaggagcca

SEQ ID NO: 17305 - DNA, 50 bp, homo sapien
ggtttgatatctgcctgtactataaygtagcatttgaggagtgctgtgtt

SEQ ID NO: 17306 - DNA, 50 bp, homo sapien
acccataacatgttccagaaaaataygaaatgacatgttgaagagcattt

SEQ ID NO: 17307 - DNA, 50 bp, homo sapien
gcaaagtgtgctacgctattgtagayatttaagcggtcaatgcaatttaa

SEQ ID NO: 17308 - DNA, 50 bp, homo sapien
actgtttaaacatttgttcattgacyctgtgattctctcaggctcactgt

SEQ ID NO: 17309 - DNA, 50 bp, homo sapien
ggtaggacgaggctatactatttgarcaatgtaatggtggacaacatgac

SEQ ID NO: 17310 - DNA, 50 bp, homo sapien
aaaggggttgcagaattaagttccasgataaaatactgtccaaggggaga

SEQ ID NO: 17311 - DNA, 50 bp, homo sapien
tttaactatttactgaaagtttgccyatctcagctctacgtttgtaactg

SEQ ID NO: 17312 - DNA, 50 bp, homo sapien
caacttataagagcataattaaaacrctcacttcacagctctaccttcca

SEQ ID NO: 17313 - DNA, 50 bp, homo sapien
tgccttagtggaagttccatcttgasaatttcttgcttagtggagtaaag

SEQ ID NO: 17314 - DNA, 50 bp, homo sapien
ctataaagcacacttttctcttttawcggcatctgctgacatggtgcata

SEQ ID NO: 17315 - DNA, 50 bp, homo sapien
tgagaaacaaaagacagtggacaaayggaattcaaaaccagttgtgtatt

SEQ ID NO: 17316 - DNA, 50 bp, homo sapien
acttccaaagaatgaggctcagaccrattgtgtatttccaagaaagcaaa

SEQ ID NO: 17317 - DNA, 50 bp, homo sapien
tgcatccttgtaccttggtatggcamcttgtacctccatgggcagcagct

SEQ ID NO: 17318 - DNA, 50 bp, homo sapien
tgagggctttaaatcacttagtctcraccctctgcctactctgtgagctt

SEQ ID NO: 17319 - DNA, 50 bp, homo sapien
aaattttcagggatactattgttacycatttatactccatcaattcctac

SEQ ID NO: 17320 - DNA, 50 bp, homo sapien
aacattttctccatcaaggatgttakctttcagtccaatggcaagtctgg

SEQ ID NO: 17321 - DNA, 50 bp, homo sapien
tgtcccataacccattcaccagaacrcagtatggataagagacaggagaa

SEQ ID NO: 17322 - DNA, 50 bp, homo sapien
acagctcccctctatctagagcatamaatcttcactccatagtggggcac

SEQ ID NO: 17323 - DNA, 50 bp, homo sapien
ctaaggttttcttaggttctctttgyaatgaaaagctatgttgccattag

SEQ ID NO: 17324 - DNA, 50 bp, homo sapien
tcttctaactgtgtccacacttggcrgaaaggtgaaggagctctctgggg

SEQ ID NO: 17325 - DNA, 50 bp, homo sapien
gattctgtttatttaaaaagcaacaycaggaaattaatatatttgtcatg

SEQ ID NO: 17326 - DNA, 50 bp, homo sapien
aaggaatctaggaattcttatgcaawtctaaactttcagctcttcatgta

SEQ ID NO: 17327 - DNA, 50 bp, homo sapien
aaagcagaaaagctgtacattaggaygtgagattaaagttttgattttga

SEQ ID NO: 17328 - DNA, 50 bp, homo sapien
ttttctttgagaattcaactcgaagkatagtgaggaaaatgcctgatttt

SEQ ID NO: 17329 - DNA, 50 bp, homo sapien
gaaggcaattaaaaatgtctagtcgsaagacttctaaacttcatcagtgg

SEQ ID NO: 17330 - DNA, 50 bp, homo sapien
aataaacaattaaccctaccacaatrataatagtactatgattcagccat

SEQ ID NO: 17331 - DNA, 50 bp, homo sapien
tttgaattcatatattttgttctcartaaggtcacaaattccatcttacc

SEQ ID NO: 17332 - DNA, 50 bp, homo sapien
ctgtaaaaaatagataaatatgacayctggtgaaagctctaatgaatgaa

SEQ ID NO: 17333 - DNA, 50 bp, homo sapien
aggaagtagggaatgcaaaactctaygtataacaaatggtaagatatgaa

SEQ ID NO: 17334 - DNA, 50 bp, homo sapien
tcagagggttctgtggtgtcaatagraactacattgaagctgcaatgagg

SEQ ID NO: 17335 - DNA, 50 bp, homo sapien
agccatctgttcaatgctttctgtayaaaaatggcaggacatgctaaaaa

SEQ ID NO: 17336 - DNA, 50 bp, homo sapien
gagatggagacatatttattctccaytaattccttttgaggacgccatta

SEQ ID NO: 17337 - DNA, 50 bp, homo sapien
tgaaaactcaagagaatcttgaaacygctgcaaaaatatgttaacctggt

SEQ ID NO: 17338 - DNA, 50 bp, homo sapien
aaaattatcactcagattcagtcaastagaaaccactttagtcagagaat

SEQ ID NO: 17339 - DNA, 50 bp, homo sapien
tctgtataatctgtattatccaaaarcaaatgtctacctaactaattgtc

SEQ ID NO: 17340 - DNA, 50 bp, homo sapien
ccctgaccaatatccctgtttctgasattgcaaattctgtcctattcatc

SEQ ID NO: 17341 - DNA, 50 bp, homo sapien
ttctaaaaagcgtagataagccacasgtgcaaatgcatcagctgaatgta

SEQ ID NO: 17342 - DNA, 50 bp, homo sapien
aagtcctaacatggacattctagaargaaactgtaagatgctcagcctta

SEQ ID NO: 17343 - DNA, 50 bp, homo sapien
gggttgtctctgaaatgaaaaagaarttagttctgaacaacttagtaact

SEQ ID NO: 17344 - DNA, 50 bp, homo sapien
ttccaatgtgtcaataaaatctccartccaaactttctaacttgcctttg

SEQ ID NO: 17345 - DNA, 50 bp, homo sapien
gttttattagagctatgctttatgakgtattaggcactaatcttatttaa

SEQ ID NO: 17346 - DNA, 50 bp, homo sapien
acttaatcttgcagttccttaaaagyatcatgctcttcttgcatccaatc

SEQ ID NO: 17347 - DNA, 50 bp, homo sapien
aaataatttctaatctgtgtattaayctactccaggaaagagaagcactc

SEQ ID NO: 17348 - DNA, 50 bp, homo sapien
accagaaacgtacatggtaagttaaygggtgcaaaatgcaggctctttgt

SEQ ID NO: 17349 - DNA, 50 bp, homo sapien
tcaccatcctagtccaacttattacratgttttgcccggactacagctct

SEQ ID NO: 17350 - DNA, 50 bp, homo sapien
atatgtatttgtgaataacagaagayacaatgacatggtgatggtaacac

SEQ ID NO: 17351 - DNA, 50 bp, homo sapien
atcttctgttattcacaaatacataygaaagagccagaatacgcccagtg

SEQ ID NO: 17352 - DNA, 50 bp, homo sapien
atctaataacaacactatgttttgayatgaaaatccagtttaaaacccac

SEQ ID NO: 17353 - DNA, 50 bp, homo sapien
gataaattgaatcacagtacattgargaaatctagaaatgttacccatgt

SEQ ID NO: 17354 - DNA, 50 bp, homo sapien
tgtgtttgggtcatccaaatgtttgratatatgttaggccatgtccatgg

SEQ ID NO: 17355 - DNA, 50 bp, homo sapien
ccagtagaattttacttcacatgatragattctcctaaaatgacatagga

SEQ ID NO: 17356 - DNA, 50 bp, homo sapien
ggggaaattgtctgtatgtcctccaygtctagacaacgatatttctgcca

SEQ ID NO: 17357 - DNA, 50 bp, homo sapien
cctttccttggtatgtttctaaataygctcatgtccttctccagtgtatt

SEQ ID NO: 17358 - DNA, 50 bp, homo sapien
ttaaaatataatcataacggatcacrgcagatataaaaattctgggaccc

SEQ ID NO: 17359 - DNA, 50 bp, homo sapien
ccagtgcatgtaagggaattcaatgyaccactcggaagttcatatgtact

SEQ ID NO: 17360 - DNA, 50 bp, homo sapien
agttgggttgttacctgcctggtaawtcccaaacttcagagatcaatgtg

SEQ ID NO: 17361 - DNA, 50 bp, homo sapien
ccccagattttcatgttgaattaccrctcacagtttctaaatgaacatgc

SEQ ID NO: 17362 - DNA, 50 bp, homo sapien
ttatagctttaatgcctgtggcacaytgattacttttcaagattttgagg

SEQ ID NO: 17363 - DNA, 50 bp, homo sapien
tcttccatggtttacatgtggattayctaggaaaagactaatcctccttt

SEQ ID NO: 17364 - DNA, 50 bp, homo sapien
gccacagtaaacaactgagtgtgatyaagttgtgagaacagtctaacctc

SEQ ID NO: 17365 - DNA, 50 bp, homo sapien
tgaaatcaaggccacatcatctctamggatttgagcttcagtggcatttg

SEQ ID NO: 17366 - DNA, 50 bp, homo sapien
aatggtgtcactagggagagtgaaargtctcttgtggtaactagatggga

SEQ ID NO: 17367 - DNA, 50 bp, homo sapien
gtcctttccagtcttagttatcacaycaattcacgttggacacaaatcta

SEQ ID NO: 17368 - DNA, 50 bp, homo sapien
atccaggagtagaattaatggtgtcrgaagcatgaacactattaaactgc

SEQ ID NO: 17369 - DNA, 50 bp, homo sapien
caaagtggtaaaattatggatgacaygtatctctttttaaaattcttcag

SEQ ID NO: 17370 - DNA, 50 bp, homo sapien
aagaacaatcacttagttaagtggaygttaggaaagacatttcctcatcc

SEQ ID NO: 17371 - DNA, 50 bp, homo sapien
tctatcaattcttttattgccattamtaatgacgaatgtttaagtcctgt

SEQ ID NO: 17372 - DNA, 50 bp, homo sapien
caaacactgtggaatgggtaactgawccagtattcaatgataaactcaga

SEQ ID NO: 17373 - DNA, 50 bp, homo sapien
gtacactgtccctgaagttcccttayatctgaaatctgtgttttatcagt

SEQ ID NO: 17374 - DNA, 50 bp, homo sapien
gtcagttttaacactatgaaacaaayggatgatagatttcctcatcccta

SEQ ID NO: 17375 - DNA, 50 bp, homo sapien
aagaatattaatgaccatttggagayaacagctatggtcacaaataatac

SEQ ID NO: 17376 - DNA, 50 bp, homo sapien
cccttgaatgtattatttgggaaacyaattggaaaataaggacgttcaga

SEQ ID NO: 17377 - DNA, 50 bp, homo sapien
agaatcctcttcatttgcctattggkaacaaccctcaatgcattagttgc

SEQ ID NO: 17378 - DNA, 50 bp, homo sapien
atcagtgcagtggccttgtttgtgaraaattgatgtgaggttcttaacgg

SEQ ID NO: 17379 - DNA, 50 bp, homo sapien
actctaaaaagtatttagcaagtcartaagtatatatcgctaccatcgct

SEQ ID NO: 17380 - DNA, 50 bp, homo sapien
agcccacggagagctttctaactaakcaccaaaactgagcaactctcaag

SEQ ID NO: 17381 - DNA, 50 bp, homo sapien
atatagatacagaggattgtagttayggtttaatcatcttctgtttcttt

SEQ ID NO: 17382 - DNA, 50 bp, homo sapien
tagactcaacttgctgattacgtagratttaaatcatgtactcttattag

SEQ ID NO: 17383 - DNA, 50 bp, homo sapien
gacttaagaaccagaccttaagatayggtggacagtcaactatttgtaca

SEQ ID NO: 17384 - DNA, 50 bp, homo sapien
attgttagccctatagtgattactcygaattattttagaataagctagtg

SEQ ID NO: 17385 - DNA, 50 bp, homo sapien
ttccctcctccttctctctagttcarcagatttatatctcaaggagagca

SEQ ID NO: 17386 - DNA, 50 bp, homo sapien
acccacatgttaacactgacattgayctgttctctttgaattgcaagaac

SEQ ID NO: 17387 - DNA, 50 bp, homo sapien
atatttgccaaagataaactgggtcraggagatcttttgattgccaacat

SEQ ID NO: 17388 - DNA, 50 bp, homo sapien
ctttggaaaccagtaaggagtcactyaggtaaaaatgtgtctaaagaaac

SEQ ID NO: 17389 - DNA, 50 bp, homo sapien
tctcactcctggactggcaatctacsgctgctttattcataaagcttcac

SEQ ID NO: 17390 - DNA, 50 bp, homo sapien
gactttccctgtggcctctgcacaargtgaccgtcttcagttttgaattt

SEQ ID NO: 17391 - DNA, 50 bp, homo sapien
catctcctaacactcctagaggtaayttaaactgcatacacacacatata

SEQ ID NO: 17392 - DNA, 50 bp, homo sapien
atgtaaggccaaactgctaaagacayggaaagttttatattaatggtgaa

SEQ ID NO: 17393 - DNA, 50 bp, homo sapien
gatcaccacagacctgctttaaccaycttaactgcaaccaccttgttctt

SEQ ID NO: 17394 - DNA, 50 bp, homo sapien
ggaaggactggactttcaatgcaggwcaatcactctgcagcacaaagggt

SEQ ID NO: 17395 - DNA, 50 bp, homo sapien
actgtgtacatgtctgtctcccttaygaaactgagtagtcatccatgagt

SEQ ID NO: 17396 - DNA, 50 bp, homo sapien
aaccgaacacattacctggaatgaamtgagactggaattataaattatgg

SEQ ID NO: 17397 - DNA, 50 bp, homo sapien
tttcccttaaggatggacaccagaarggttataagtctgctagcatgtgt

SEQ ID NO: 17398 - DNA, 50 bp, homo sapien
atcggagattatctgatttgcataarctcttactaaaatactgttaatgt

SEQ ID NO: 17399 - DNA, 50 bp, homo sapien
ataaataatagtttatttgcgcctawggcagaaaggataaagagtcagtg

SEQ ID NO: 17400 - DNA, 50 bp, homo sapien
cttatgtgcaatttctgtgttcaccyaaaaggatgtcattttccaggagc

SEQ ID NO: 17401 - DNA, 50 bp, homo sapien
acaaatgcaacaagtaaaccttggaktagatgattctggattttaaaata

SEQ ID NO: 17402 - DNA, 50 bp, homo sapien
tgttaattgataagaagtgtgagtawctttcaacttctctgcatatttga

SEQ ID NO: 17403 - DNA, 50 bp, homo sapien
agaataataagaaccaactacaaaaygtgaaagaatattacataaacaaa

SEQ ID NO: 17404 - DNA, 50 bp, homo sapien
ttctaatgacaaaggaagtggtgatyagtctgcagcacagtgcagaagtc

SEQ ID NO: 17405 - DNA, 50 bp, homo sapien
agttgaactctgaagacatttgcaayttctgccttaaaccttctgagagg

SEQ ID NO: 17406 - DNA, 50 bp, homo sapien
caatgagaaacaccaggaatgtctgycacttggccagttcctgtgtctcc

SEQ ID NO: 17407 - DNA, 50 bp, homo sapien
aattctataaggacagagatggccamggaaagtcttaaaggatatatggg

SEQ ID NO: 17408 - DNA, 50 bp, homo sapien
tcccccgatgggattcgaaaggtatratacacagctttgtatggaatctg

SEQ ID NO: 17409 - DNA, 50 bp, homo sapien
ttcttcctccatttcagaaggtctaytactgatcttagctaatcttccca

SEQ ID NO: 17410 - DNA, 50 bp, homo sapien
gggtgctgtaccctgcaagtcctccragatctaatctcaccccatctggt

SEQ ID NO: 17411 - DNA, 50 bp, homo sapien
gaagtgccagtttcttgttctgttayatatccaatgtcccatgtgtcatc

SEQ ID NO: 17412 - DNA, 50 bp, homo sapien
tactgactgtgtgagaattctcaagmaccaaatgttataaggagtagaaa

SEQ ID NO: 17413 - DNA, 50 bp, homo sapien
agttttgctctattagttcacaagakagctgattgaagagcctggcattt

SEQ ID NO: 17414 - DNA, 50 bp, homo sapien
cttctaagccgatttagggaaatgaygggagatagtaagccccttctcaa

SEQ ID NO: 17415 - DNA, 50 bp, homo sapien
gtaacagagctctgatattcctctaygcagcttttagtgctctagaaatg

SEQ ID NO: 17416 - DNA, 50 bp, homo sapien
aaaacctcaggcaaatcattagccayatagtatcttgcagaagagaagga

SEQ ID NO: 17417 - DNA, 50 bp, homo sapien
tattctgatggttatgtagaagatgkattgctgtggtgataaatctgatg

SEQ ID NO: 17418 - DNA, 50 bp, homo sapien
aattcaatgaagacttctatcagacratccctgaagttcctttgaatcat

SEQ ID NO: 17419 - DNA, 50 bp, homo sapien
aaacctggtggtggtagcaataaaayggaattgaagagatgtgaaagaag

SEQ ID NO: 17420 - DNA, 50 bp, homo sapien
ctagcagaatgactaaaggatgaacsagtaacaacaaaacaacaaaaaga

SEQ ID NO: 17421 - DNA, 50 bp, homo sapien
gcctagaccagtaactgaaacataayagagtcttaatgtatttttgttga

SEQ ID NO: 17422 - DNA, 50 bp, homo sapien
cacccttagctatcatttccttgaawgagacaatatcactgaagcttcat

SEQ ID NO: 17423 - DNA, 50 bp, homo sapien
gctcacacagttctggtaaatgaagyctctctaagaatgcagcccctctc

SEQ ID NO: 17424 - DNA, 50 bp, homo sapien
ctaaagcagccagaaagtaatgccaygctcccaaaagttcagagtgacaa

SEQ ID NO: 17425 - DNA, 50 bp, homo sapien
agagcattttatttatttgtttgcaytgaattaaatctggatttgttttg

SEQ ID NO: 17426 - DNA, 50 bp, homo sapien
aagcttgggctttctcatgttgaaaktcttacttggtcttattttctgct

SEQ ID NO: 17427 - DNA, 50 bp, homo sapien
aataactttctctttcaggcaattayatgaactagaggcacaatagttta

SEQ ID NO: 17428 - DNA, 50 bp, homo sapien
agatttggagaagaaaagatagaccragtggtagagcaagagatatcatg

SEQ ID NO: 17429 - DNA, 50 bp, homo sapien
cagaaggaaagctcttctttacagaraatatgccagttgatggtggagaa

SEQ ID NO: 17430 - DNA, 50 bp, homo sapien
gcattcattaaggactggatcatggrcattccactaagcactggtgataa

SEQ ID NO: 17431 - DNA, 50 bp, homo sapien
aaagagtactgcttgaagcaaaatartactgtaaacattaggaatggata

SEQ ID NO: 17432 - DNA, 50 bp, homo sapien
tgaaggacatagtcaaggccctaggyaagtagtggtgtcaggtttggaat

SEQ ID NO: 17433 - DNA, 50 bp, homo sapien
actttaggtttgttttcagttaaagragttagatcatgtattgtcatata

SEQ ID NO: 17434 - DNA, 50 bp, homo sapien
tctcaggataaaggctgtaaagacaytgacaaagaagtgacattttctct

SEQ ID NO: 17435 - DNA, 50 bp, homo sapien
acttactaaactcacattttcagcaratatagttaaggtaggtcttttca

SEQ ID NO: 17436 - DNA, 50 bp, homo sapien
ctctgaccacagctccagagggcccraagcaatatgtggtattgtggcca

SEQ ID NO: 17437 - DNA, 50 bp, homo sapien
aatcatacatagcttagggatatagraaaacactgtcccaactctcagaa

SEQ ID NO: 17438 - DNA, 50 bp, homo sapien
aagggaacttggtttcttgacctaartgaaagttataaagaaatacagag

SEQ ID NO: 17439 - DNA, 50 bp, homo sapien
acatggtgaagtaggactgccaaaamtcctctctttcctaaaagcaatga

SEQ ID NO: 17440 - DNA, 50 bp, homo sapien
ctctataataatctcatttaaaccaygagattctgatgattttgtgatgc

SEQ ID NO: 17441 - DNA, 50 bp, homo sapien
gcatatggaaatttagataaggaaaygattgcagagacacgaaaagggct

SEQ ID NO: 17442 - DNA, 50 bp, homo sapien
aggatgctaaaaactaaatctggcarctgataccatggtagttttcattt

SEQ ID NO: 17443 - DNA, 50 bp, homo sapien
ctcctgttgctaatgacagtcttagratcataagggaaacttatagagtt

SEQ ID NO: 17444 - DNA, 50 bp, homo sapien
ttgcttcatttactggcatctaaagyatttaagcaggttcttcctcttgg

SEQ ID NO: 17445 - DNA, 50 bp, homo sapien
atcatacacagagggtaattaactgmaggtgccgaagaggtaaagtcaat

SEQ ID NO: 17446 - DNA, 50 bp, homo sapien
tctgcctggaccttctgctcctgcawctgagaggtgttcatcaatatctc

SEQ ID NO: 17447 - DNA, 50 bp, homo sapien
gctccaaaaggttttgattgtcataytacattttctgttgcatagaaata

SEQ ID NO: 17448 - DNA, 50 bp, homo sapien
ctagcctttcctcatttccttaaaayattctgatagcagtgatgcagttt

SEQ ID NO: 17449 - DNA, 50 bp, homo sapien
gagtaaaaaaagcatccgtagctcamgggtacctgtagaacactctctgt

SEQ ID NO: 17450 - DNA, 50 bp, homo sapien
ggagttcttgttggcttgaatgtaaytgtgcaacatctgtcagtcatgct

SEQ ID NO: 17451 - DNA, 50 bp, homo sapien
tgttaggcaccatgccaggctctgtraatggtagaaggtggcaaaacaga

SEQ ID NO: 17452 - DNA, 50 bp, homo sapien
tttttctctttttcttttctttaaamttatgtatacagcccacttttacc

SEQ ID NO: 17453 - DNA, 50 bp, homo sapien
ggttgttacctacctttcagaattayaaggatcaaatgaaatgtcaaaac

SEQ ID NO: 17454 - DNA, 50 bp, homo sapien
tattcctcatcttagcgcactataayctggttcactcttgccatcttctc

SEQ ID NO: 17455 - DNA, 50 bp, homo sapien
agtgtatttagccatttcaagtctayagtagaatacggcattaaatgata

SEQ ID NO: 17456 - DNA, 50 bp, homo sapien
tatgctaaagtatttgactaaagccrctgaaaaaaggagtggtaatcaac

SEQ ID NO: 17457 - DNA, 50 bp, homo sapien
gcaatagtagccacaaaagaaaatayacgaaggtcaagctataatggaaa

SEQ ID NO: 17458 - DNA, 50 bp, homo sapien
acaccaaaatcggaaaaagacataasaagaaaagacatatcagaccaata

SEQ ID NO: 17459 - DNA, 50 bp, homo sapien
cttatcttttttctaattgctacttyaactttctgtttgcatacaagaat

SEQ ID NO: 17460 - DNA, 50 bp, homo sapien
agtggtgagggcaatcttctttatawcatctattgattcaaatactaatc

SEQ ID NO: 17461 - DNA, 50 bp, homo sapien
agccaattcttaaaaacacttcaatrattacttgtcttcacattggctac

SEQ ID NO: 17462 - DNA, 50 bp, homo sapien
aataaacataaaacaaagagcacatrataagtcattagcaaaaaacaaaa

SEQ ID NO: 17463 - DNA, 50 bp, homo sapien
gtcttcacattggctaccaatgaccyaaagtatttaagcatgtcaaacca

SEQ ID NO: 17464 - DNA, 50 bp, homo sapien
tgcctctttgaggttgtttcttcctraagtatggaggactccctgctttg

SEQ ID NO: 17465 - DNA, 50 bp, homo sapien
ttactaagtctcagagggtgtgaacygaaataatctccttcatcctgaac

SEQ ID NO: 17466 - DNA, 50 bp, homo sapien
agtaggaacaccctaataacagacayggaggcatcaggccactgaagcag

SEQ ID NO: 17467 - DNA, 50 bp, homo sapien
cttttctcataaatagatacgaatcyacgaatcacgcgtagcatattaat

SEQ ID NO: 17468 - DNA, 50 bp, homo sapien
tgagtcccagttaagagccaagcaaygaatggagaaatcagagagctgag

SEQ ID NO: 17469 - DNA, 50 bp, homo sapien
aatttttttcttgatgactcagtcastatcaaggacattaggtagcaaaa

SEQ ID NO: 17470 - DNA, 50 bp, homo sapien
atgttagcctttttcccttaagccartcaaagaggaactagacccacaga

SEQ ID NO: 17471 - DNA, 50 bp, homo sapien
agctgatgttgaaaattcgagacacmctttatattgctggcaggtaattt

SEQ ID NO: 17472 - DNA, 50 bp, homo sapien
acaaatactccagcttatatttaggyagtcaacaagcatttaaaattcaa

SEQ ID NO: 17473 - DNA, 50 bp, homo sapien
ttttagtttatagaaagatgtttaakaaattcggcaccttttcatgtaat

SEQ ID NO: 17474 - DNA, 50 bp, homo sapien
tcacttcttattcttactaatttctyaagggcaaaacaccatgtctctac

SEQ ID NO: 17475 - DNA, 50 bp, homo sapien
catgtgcttattggccatttttgtawcttgtttggagaaatgtctattca

SEQ ID NO: 17476 - DNA, 50 bp, homo sapien
atacttgtcaattattattatgtaarctggacattcttattccttgggga

SEQ ID NO: 17477 - DNA, 50 bp, homo sapien
tagtgcaatcaccttttgcttctctsaaaacacttttaataatgtcctat

SEQ ID NO: 17478 - DNA, 50 bp, homo sapien
tattatagtgtatgctgttgtgtcaygttaaaaaaaactcatggtacttt

SEQ ID NO: 17479 - DNA, 50 bp, homo sapien
tactagaatgtcacagaggtaataaytaaactcccaattgtttaaatttt

SEQ ID NO: 17480 - DNA, 50 bp, homo sapien
ctgggtatccatttcaggtgttaaamtcacttctcaagggcccacaactg

SEQ ID NO: 17481 - DNA, 50 bp, homo sapien
gagatagttgactaatcctcaatatrataattgctacaaacaagaaataa

SEQ ID NO: 17482 - DNA, 50 bp, homo sapien
aaatgcaaggtacaaacattcccaamgctgagcagccaccccagccattc

SEQ ID NO: 17483 - DNA, 50 bp, homo sapien
aagttaatttggctaaatatttgtaktaactgggtgatgccaatcccagg

SEQ ID NO: 17484 - DNA, 50 bp, homo sapien
aatataaaataagtgattgatgtcamagtgcagactgtatctagtgcata

SEQ ID NO: 17485 - DNA, 50 bp, homo sapien
aatttcaaaataaagcaagaggttcmatcctgaagatattttattcatgt

SEQ ID NO: 17486 - DNA, 50 bp, homo sapien
aggttaaacaacttgctcaggatacrcatctaataatgagggaaaatggg

SEQ ID NO: 17487 - DNA, 50 bp, homo sapien
agtacaacaacttaagggtgtttgayagcctgaacataatcttttgggtt

SEQ ID NO: 17488 - DNA, 50 bp, homo sapien
cagcagtggtgacagcagctactacrgccataaaagtaactgacctctgc

SEQ ID NO: 17489 - DNA, 50 bp, homo sapien
ttgggacatggggccatatttcaagsagcaagccaagatagaaatggaat

SEQ ID NO: 17490 - DNA, 50 bp, homo sapien
attcagactatattaacaagtctcaygtctgtccattcctctcaatttct

SEQ ID NO: 17491 - DNA, 50 bp, homo sapien
gcaccttgatgagcaggtcccctacragcctattatttagggatcctaaa

SEQ ID NO: 17492 - DNA, 50 bp, homo sapien
tactgcattccaggcctgtgctgggwactttaatacagggctttacaaac

SEQ ID NO: 17493 - DNA, 50 bp, homo sapien
tgctgttaagcttactcaactgtgcratgggaaatgtcctgtgtggatag

SEQ ID NO: 17494 - DNA, 50 bp, homo sapien
aatatatatttttatatttttgacawcattttattatttgttttctgctt

SEQ ID NO: 17495 - DNA, 50 bp, homo sapien
tccccaccatgcctgtcatctttccragacaatgctcctatattctacac

SEQ ID NO: 17496 - DNA, 50 bp, homo sapien
cccacatagaatgatggaggggggartagagcctacctcattaattctgt

SEQ ID NO: 17497 - DNA, 50 bp, homo sapien
tatactttcaaatacattcctagaaragaaatacttagtccagggttgga

SEQ ID NO: 17498 - DNA, 50 bp, homo sapien
aaagatgattccataacacagaaggragtacattttattaacatgaccta

SEQ ID NO: 17499 - DNA, 50 bp, homo sapien
tttactatgctaattacctcaaagcragggcactttaggaacagcaaata

SEQ ID NO: 17500 - DNA, 50 bp, homo sapien
acgtggtctacatatacaaagagaaygtgggagtgcaccctaactgaaaa

SEQ ID NO: 17501 - DNA, 50 bp, homo sapien
tctttttcttagttctcatgaagcaraatttctccttataaaatagcata

SEQ ID NO: 17502 - DNA, 50 bp, homo sapien
aaaattcctaaaaactagtggcaaaytcataagaaaaaagattccattga

SEQ ID NO: 17503 - DNA, 50 bp, homo sapien
tggccctaattcacctctgataacarcgtcacctaaatctgatgttgaga

SEQ ID NO: 17504 - DNA, 50 bp, homo sapien
atttctagccacatgagtgaaactaracatgaccctctgcagattagtgg

SEQ ID NO: 17505 - DNA, 50 bp, homo sapien
gagtgctttgatttgcttttataacrgtaggactggtttgggtggcgcta

SEQ ID NO: 17506 - DNA, 50 bp, homo sapien
gagtgcaaaagtagaagaaacagtaygggttagaattggctttgctccag

SEQ ID NO: 17507 - DNA, 50 bp, homo sapien
ctgtgtccaaaattaagagagaaccrcagctgtacaaacagactgaaaag

SEQ ID NO: 17508 - DNA, 50 bp, homo sapien
tgtgagagaaatctcaggaaaattaygttactaggaaaccaaaaaggttt

SEQ ID NO: 17509 - DNA, 50 bp, homo sapien
tttgtaatcactcaacagatacataytacacactgctacagatcaggtag

SEQ ID NO: 17510 - DNA, 50 bp, homo sapien
ctagacacaagtcaactcagcaatayctagtagagtggtggccactgctg

SEQ ID NO: 17511 - DNA, 50 bp, homo sapien
gaactcagagaatgagaaatggaaaygatattgggcactgtgactaagat

SEQ ID NO: 17512 - DNA, 50 bp, homo sapien
tgctaaaatagaacatatatgtgtaragcaaaaatattttatccttcctc

SEQ ID NO: 17513 - DNA, 50 bp, homo sapien
acagctatgcctatcattgctgaaarctacttatcacaaagacctggtta

SEQ ID NO: 17514 - DNA, 50 bp, homo sapien
ctccaatgtgtgttcttgagttataygcttgatacatctgcctatctctc

SEQ ID NO: 17515 - DNA, 50 bp, homo sapien
cttcttgtaatttcttcttctttaayggttatctgccacttgcccctgtt

SEQ ID NO: 17516 - DNA, 50 bp, homo sapien
  misc_feature (43)..(43): n is a, c, g, or t
atctaacacaaagcctattttatcayaaagtgttgactatctnaagtaat

SEQ ID NO: 17517 - DNA, 50 bp, homo sapien
ttcttcatcccttttactccggaaargtccattaattcttggtggttcgt

SEQ ID NO: 17518 - DNA, 50 bp, homo sapien
gcggtatgtttcagcttattataccratgattgtgttatttccctggatg

SEQ ID NO: 17519 - DNA, 50 bp, homo sapien
caaactgcaaatccgttaaagatacmgctagttcctctctttcacaagat

SEQ ID NO: 17520 - DNA, 50 bp, homo sapien
gctggaccactttcccttactcatartaccatctggcatttgcaacagta

SEQ ID NO: 17521 - DNA, 50 bp, homo sapien
gggcccaagtttcaaatacatacaargaagtcatatttatagaagcgact

SEQ ID NO: 17522 - DNA, 50 bp, homo sapien
tttaactctagttcattacagtcaasgatttaatctctgatggcagggaa

SEQ ID NO: 17523 - DNA, 50 bp, homo sapien
gatcacaagctttgggaaggcaggawctcttttgtgtagattgctgttga

SEQ ID NO: 17524 - DNA, 50 bp, homo sapien
agagctggccactagccatctaaacsagaaaacatggagcagctcatttt

SEQ ID NO: 17525 - DNA, 50 bp, homo sapien
aggcaccagcatgatgcctagcatayagtaggttctcaagagttaattaa

SEQ ID NO: 17526 - DNA, 50 bp, homo sapien
atggtccagataggtcaaactaaccrcaatattcccttaaaccaaagcct

SEQ ID NO: 17527 - DNA, 50 bp, homo sapien
aatgagtcttaggtagtagccaatayaagactttttattatttctccctt

SEQ ID NO: 17528 - DNA, 50 bp, homo sapien
gtgtgtcttttctgacaactgcaatkagtcttaggtagtagccaatacaa

SEQ ID NO: 17529 - DNA, 50 bp, homo sapien
agcaccatatgctgccctgacagaayctttgcacagtatgaaataattcc

SEQ ID NO: 17530 - DNA, 50 bp, homo sapien
gaagctgttcttgtctggattaagakagtcatccccatttatctgcagct

SEQ ID NO: 17531 - DNA, 50 bp, homo sapien
tctgagtccttacctcatttccaacycttgtctgagatggctggaaataa

SEQ ID NO: 17532 - DNA, 50 bp, homo sapien
acctctcatcaaaatatgtgagctcyaatatgatacaataacaaaacaag

SEQ ID NO: 17533 - DNA, 50 bp, homo sapien
aatcactgtgctgggagtatggccarataaatagaagagggtctgaggta

SEQ ID NO: 17534 - DNA, 50 bp, homo sapien
aggcattttggggaacagaacctacmgatcttgtcacatgactgctacag

SEQ ID NO: 17535 - DNA, 50 bp, homo sapien
cttactaccttatagttaccatacasagataagtcagaaagtctatgttt

SEQ ID NO: 17536 - DNA, 50 bp, homo sapien
ggttaagtcagaatagtttgaggaastctaggaatgtggctcagagatga

SEQ ID NO: 17537 - DNA, 50 bp, homo sapien
tcatctacatggaggaatcacacaaytgtttaggaaagagacctccttgt

SEQ ID NO: 17538 - DNA, 50 bp, homo sapien
aggtgttggtctttgtgaaaagggcrgataagaagtcttcttttccttat

SEQ ID NO: 17539 - DNA, 50 bp, homo sapien
ctttttattttcattttgtcttagcwagagaactaattgaagcaattttt

SEQ ID NO: 17540 - DNA, 50 bp, homo sapien
aggatacaaactatagatcatgttawcaaacaggtatattggctgtcaag

SEQ ID NO: 17541 - DNA, 50 bp, homo sapien
atttcaacagactacctattactagraaaagctatagaaacagatacatc

SEQ ID NO: 17542 - DNA, 50 bp, homo sapien
ggtagtaagttttcagtttgtgatayccagtaaacagtgagttgtgtctg

SEQ ID NO: 17543 - DNA, 50 bp, homo sapien
ggacagattgcttccaccagaggtaygatttcctgaagtccaggctggta

SEQ ID NO: 17544 - DNA, 50 bp, homo sapien
atgtttaattatctgacagaaaatasagagtctggaatgtagtgctcaga

SEQ ID NO: 17545 - DNA, 50 bp, homo sapien
gtgtctcgcccctgtcagctgaatgratgtgacactgcttgcgcataatg

SEQ ID NO: 17546 - DNA, 50 bp, homo sapien
gtatttgccaagaatcctgatttaastatgtctttctacaactgtaaaca

SEQ ID NO: 17547 - DNA, 50 bp, homo sapien
atatttaaatatatggaaatcgaaakttattttcctgtgttaccataacc

SEQ ID NO: 17548 - DNA, 50 bp, homo sapien
aggttcaatatcactcctgaagttaycaaaatacatgtctgagaagcaaa

SEQ ID NO: 17549 - DNA, 50 bp, homo sapien
ctcaccagcttgcttctgtgactcaygaaaaggaggaaggaaagaaatgg

SEQ ID NO: 17550 - DNA, 50 bp, homo sapien
taccgatcttgtcacatgactgctamagagggatcaggagaagtcacaga

SEQ ID NO: 17551 - DNA, 50 bp, homo sapien
ttttctaggtaaagaaactaaagccmagtgggataaaatggactccaagc

SEQ ID NO: 17552 - DNA, 50 bp, homo sapien
gcaatgatgataacttaattgtgaayagtttgagcatataggtacaagaa

SEQ ID NO: 17553 - DNA, 50 bp, homo sapien
gttactgggagaaacacctaatgtgratgaagaaggaacaaatataaagc

SEQ ID NO: 17554 - DNA, 50 bp, homo sapien
aatttcagacaaattgaaactaaacmcatgactaataagtaagtcaaaga

SEQ ID NO: 17555 - DNA, 50 bp, homo sapien
ctctctcgactcatatactcatttayaattgccttctatttgtatggcct

SEQ ID NO: 17556 - DNA, 50 bp, homo sapien
cagaggcttcacttagaaaggaaacragaacactactgctctgtggtagg

SEQ ID NO: 17557 - DNA, 50 bp, homo sapien
gggagcagagacagcaactgaaaaaktgatggtgaagtcatggtgaggaa

SEQ ID NO: 17558 - DNA, 50 bp, homo sapien
gatagttttaagattttcatagttaygttcctaaatgatattgagtcaaa

SEQ ID NO: 17559 - DNA, 50 bp, homo sapien
aatattgagcttggctctttaagtcrcccagtaggaaatccatcgggata

SEQ ID NO: 17560 - DNA, 50 bp, homo sapien
ctcaactccttcacattagggtctayatcccgatggatttcctactgggc

SEQ ID NO: 17561 - DNA, 50 bp, homo sapien
tcacagttagaagggactgctgatakaatttagttcatcctttattatct

SEQ ID NO: 17562 - DNA, 50 bp, homo sapien
gatatataatttattgctgaacattsaagtttaaagttttaaaaattttc

SEQ ID NO: 17563 - DNA, 50 bp, homo sapien
aaattctcatgaaagaaatccaagargaacctaaatagagagatatattc

SEQ ID NO: 17564 - DNA, 50 bp, homo sapien
atggcatgctgtgttggactgggaawtaccgttggtagtggtgcttctct

SEQ ID NO: 17565 - DNA, 50 bp, homo sapien
gacataaagccaccgtgagagatacrataaataagttttaagataagaat

SEQ ID NO: 17566 - DNA, 50 bp, homo sapien
aaggtaaagggaaaggagcaggatamatattacaatcagagaataaaagc

SEQ ID NO: 17567 - DNA, 50 bp, homo sapien
caaagatgaaaatcatcagggctgcrctcaaatggtatctttagcttcaa

SEQ ID NO: 17568 - DNA, 50 bp, homo sapien
gaaaatacactataacctggataacyggccaaaagacacaaatgaaattc

SEQ ID NO: 17569 - DNA, 50 bp, homo sapien
gatttcatattgtggaatgattatarctctagactaatatttataactaa

SEQ ID NO: 17570 - DNA, 50 bp, homo sapien
catagaagccacacaggattgtttcratgtgaagacagatctcagggttt

SEQ ID NO: 17571 - DNA, 50 bp, homo sapien
ggccaacttatactcagaacagtggraaattatatatgtagatcaaaact

SEQ ID NO: 17572 - DNA, 50 bp, homo sapien
aatggttaagctaggtaagatataayagactggctaaactggggaaagaa

SEQ ID NO: 17573 - DNA, 50 bp, homo sapien
aagcaacttgccctaggcacagtacragtaagtttggtgcctatttttgt

SEQ ID NO: 17574 - DNA, 50 bp, homo sapien
aatgatatatagaattgcttgtaaaytcaccttgtcactcaacattaaat

SEQ ID NO: 17575 - DNA, 50 bp, homo sapien
tgcaaaccatcccagcatcttttaasagaaggaagaggacactgagttag

SEQ ID NO: 17576 - DNA, 50 bp, homo sapien
gataatacaacttcctaaatttgcayagtaaatagaacacaacccacaaa

SEQ ID NO: 17577 - DNA, 50 bp, homo sapien
actccctcattcaacgcgttagtaawtgcaagcagaaagggctaagtaac

SEQ ID NO: 17578 - DNA, 50 bp, homo sapien
aaaaattaatgatattttactgatasaccaggatgtctgataagagatgg

SEQ ID NO: 17579 - DNA, 50 bp, homo sapien
ctgcaaaactagaatatttttactcmaggatagacagtttgaaaccttca

SEQ ID NO: 17580 - DNA, 50 bp, homo sapien
taactcacttaagggctttaaatcaytataagtccctccagctttcactg

SEQ ID NO: 17581 - DNA, 50 bp, homo sapien
gttggagcagatgtccttgacttggrattcagttacagttatcatttccc

SEQ ID NO: 17582 - DNA, 50 bp, homo sapien
tgggcctgctaatagcaaggtgtcayataatagtgatccttaagaggggg

SEQ ID NO: 17583 - DNA, 50 bp, homo sapien
attttagcaaatgtgtaatcacttayagaatgtttatacttccagaatcc

SEQ ID NO: 17584 - DNA, 50 bp, homo sapien
ttcatacgacatgagttttcagtaayaaacagaagtcactgaagggttct

SEQ ID NO: 17585 - DNA, 50 bp, homo sapien
aaaaaaaaaaatgtagtaaaattcarggcccattatctgacaaaaatgaa

SEQ ID NO: 17586 - DNA, 50 bp, homo sapien
gcatcacaggtcgaggaaacagaackgaaacatgcttatctgaagacaga

SEQ ID NO: 17587 - DNA, 50 bp, homo sapien
acctagagtacccgatatactgtcaycctggaattctctttaatagctaa

SEQ ID NO: 17588 - DNA, 50 bp, homo sapien
aacaaatgaacatcaagtagaatgasaattggcaaatttttcttaaaggg

SEQ ID NO: 17589 - DNA, 50 bp, homo sapien
aaaaaattttattcctcaaactgatsaagcaggtaatatccataacttat

SEQ ID NO: 17590 - DNA, 50 bp, homo sapien
gaatgtgatttttttcacttacacargtataggctttttaatatttccac

SEQ ID NO: 17591 - DNA, 50 bp, homo sapien
gtacataaagcctggagttccataamacttagtattaactagatattcaa

SEQ ID NO: 17592 - DNA, 50 bp, homo sapien
accatgggctgtttggtgtaaatcaraggattagaaatcaacgttctgcc

SEQ ID NO: 17593 - DNA, 50 bp, homo sapien
gagtatagtccagtgatcatagcaascaatcctagtctgaattctagtcc

SEQ ID NO: 17594 - DNA, 50 bp, homo sapien
ttcttggagaacccaatctgagatamcatggaaccattaaaaaaaaaaaa

SEQ ID NO: 17595 - DNA, 50 bp, homo sapien
cacaacacagaatactacattatgamgggtgaccaggagtcaggaaatgt

SEQ ID NO: 17596 - DNA, 50 bp, homo sapien
accacatctttctcctgcaacttgaytaatgtccttgtacagtactgtga

SEQ ID NO: 17597 - DNA, 50 bp, homo sapien
gagctagaaagcttgagttaattacyagcaaaacatattatgttggttgt

SEQ ID NO: 17598 - DNA, 50 bp, homo sapien
tggagagatgatagttaacttggaartaaagtaatgatcaagaagaaatc

SEQ ID NO: 17599 - DNA, 50 bp, homo sapien
aatgatcccatatgaaaaggtacaaycgtggtagatcatctgtaatttct

SEQ ID NO: 17600 - DNA, 50 bp, homo sapien
ccaagcttctgagctcaaaacaacawgagactgcctagtgaataggcgct

SEQ ID NO: 17601 - DNA, 50 bp, homo sapien
ttataaatggatttgatgaagaatamaatgaataaagtataagctgcaga

SEQ ID NO: 17602 - DNA, 50 bp, homo sapien
ggctttgacttgttgtttactagccraatttctaagacatagttttgaag

SEQ ID NO: 17603 - DNA, 50 bp, homo sapien
gcttaattatatgggtctcaatggcyagaactgcattctctgctcagtct

SEQ ID NO: 17604 - DNA, 50 bp, homo sapien
tcagaggtatggagatgtcatttgargttttctatagaggtctcactagg

SEQ ID NO: 17605 - DNA, 50 bp, homo sapien
tagaaaacttcaaatgacatctccayacctctgagtaatatgaatctcct

SEQ ID NO: 17606 - DNA, 50 bp, homo sapien
ttggctgcaaatactatttttaaaaytgcttatgactgtaaagcaacttt

SEQ ID NO: 17607 - DNA, 50 bp, homo sapien
attgtgattatattccataataatarcataaacctttagacccatggctt

SEQ ID NO: 17608 - DNA, 50 bp, homo sapien
ctttattcaagtacagaaaagaaagraagaatgcggtcagtattcatacc

SEQ ID NO: 17609 - DNA, 50 bp, homo sapien
caaatgctgattatggtgactttgcragaaaaataggacatgatcttctt

SEQ ID NO: 17610 - DNA, 50 bp, homo sapien
tggcagagattgctggttatccaccrattccattcttcccttcttccata

SEQ ID NO: 17611 - DNA, 50 bp, homo sapien
tattgttctcttcactgcaaaactastagaatgcttacatattttaggta

SEQ ID NO: 17612 - DNA, 50 bp, homo sapien
cagttgtaaaacagaaccaagcacasaatttaagcaattcatctcttgaa

SEQ ID NO: 17613 - DNA, 50 bp, homo sapien
acttctagtaaacattcatcgaatcracgcacaactatttattgtacaat

SEQ ID NO: 17614 - DNA, 50 bp, homo sapien
ggtttcactttggtggctagataaaytggtttcttggatttcactgcaag

SEQ ID NO: 17615 - DNA, 50 bp, homo sapien
tcaggtcactcagtggttcatcttaragttgtttctagactagatattta

SEQ ID NO: 17616 - DNA, 50 bp, homo sapien
tcttagaggaacaagagaaaaactargtaaatttgagtaacagagaatgg

SEQ ID NO: 17617 - DNA, 50 bp, homo sapien
tcattatttttttacacagtgaactsaaccacgtactttggaaggcagac

SEQ ID NO: 17618 - DNA, 50 bp, homo sapien
agaccatgtatttgcaggtggttcaractgggaaagaacctaggttatat

SEQ ID NO: 17619 - DNA, 50 bp, homo sapien
cagtgtattatgggaaacttttggcmagtataaaatataacctaggttct

SEQ ID NO: 17620 - DNA, 50 bp, homo sapien
ctgacaggtttgttgatggactagaygttgatggaaatttgaaggaaaaa

SEQ ID NO: 17621 - DNA, 50 bp, homo sapien
tttctggacgtccatttaatactcargagtctagttcactccattcaaaa

SEQ ID NO: 17622 - DNA, 50 bp, homo sapien
aacagactgcctaggatttgtttgawacccattgaacatggaagatgtgg

SEQ ID NO: 17623 - DNA, 50 bp, homo sapien
aatcaagtaattcaactaacacaaaygataacataatacaacaccaagta

SEQ ID NO: 17624 - DNA, 50 bp, homo sapien
taccgtaaaggttttctaaaattacrgatgtctgaaccacctctgacacc

SEQ ID NO: 17625 - DNA, 50 bp, homo sapien
actgtagctagaattttgtgtactaygctgactcaaaattcgaggctagg

SEQ ID NO: 17626 - DNA, 50 bp, homo sapien
catctgctgctgctcagctgtttggrattaaatatttgcaggtttgacac

SEQ ID NO: 17627 - DNA, 50 bp, homo sapien
ttaattctaggtcagccatagatcasagtcctgctttccactcccagaac

SEQ ID NO: 17628 - DNA, 50 bp, homo sapien
tggcctgacttactgctggtcacgaygtctcttgatatctctggctcctc

SEQ ID NO: 17629 - DNA, 50 bp, homo sapien
tgtagtctctgttgcaactactcaaygctgccattacagcaaccagagac

SEQ ID NO: 17630 - DNA, 50 bp, homo sapien
tgaggaggaggaaaaggccaaagaaygatgttagtgttactgcctttcct

SEQ ID NO: 17631 - DNA, 50 bp, homo sapien
aattaggacccatggcttaggaaaaytacacctcaaatattcataaagaa

SEQ ID NO: 17632 - DNA, 50 bp, homo sapien
atatataaatctatttatatctgctraatactcaaacttactactttggt

SEQ ID NO: 17633 - DNA, 50 bp, homo sapien
agagatgctttggccaaaaactgaaygtgtatttatgtaaacaaattaca

SEQ ID NO: 17634 - DNA, 50 bp, homo sapien
aactggaacatctgtccagttaggckactaatccagtcctttttcattcc

SEQ ID NO: 17635 - DNA, 50 bp, homo sapien
agctagggatatgagacaacaccgasagtggtgacctagagatgctttgg

SEQ ID NO: 17636 - DNA, 50 bp, homo sapien
tacatacaaagatatctgctgtattkaaattcttattaaaagctccaata

SEQ ID NO: 17637 - DNA, 50 bp, homo sapien
acaaaacacgcagtatgtctgattamacagaaggattaaaactgttgtgt

SEQ ID NO: 17638 - DNA, 50 bp, homo sapien
taattggaaccctggcacatcaggcyaacgttgtatttaggctttttgct

SEQ ID NO: 17639 - DNA, 50 bp, homo sapien
tagagaactactgtactagataaacrcaagtcaaagccctttttaaaaaa

SEQ ID NO: 17640 - DNA, 50 bp, homo sapien
catgattgatgatgtgggaaagtaartgcatgcctcaaagtttaacaaca

SEQ ID NO: 17641 - DNA, 50 bp, homo sapien
ccacgcaagctttggtatgctgcackctctccaaacagtatggctaccct

SEQ ID NO: 17642 - DNA, 50 bp, homo sapien
cagtcttggagaatgaaaccatttaycacaaacctcttatctgaagaaaa

SEQ ID NO: 17643 - DNA, 50 bp, homo sapien
aaaaaaagaaaaggaagaatacttayacttagtgaaataaataaccttat

SEQ ID NO: 17644 - DNA, 50 bp, homo sapien
aacagccggtgttcctggatcttaayctacctaccggcaaggatacttcc

SEQ ID NO: 17645 - DNA, 50 bp, homo sapien
gtgaaagctttatgtacacatgcaamtagtgggatcataatcttactgcc

SEQ ID NO: 17646 - DNA, 50 bp, homo sapien
agtctgcaaaaaggaaaaaggcttgmaactcagttatgtatgaattaaaa

SEQ ID NO: 17647 - DNA, 50 bp, homo sapien
atcttcaaaacgcaaacatcagaacygcctatttccacaggtccaagcaa

SEQ ID NO: 17648 - DNA, 50 bp, homo sapien
tatttgttacttcactggtattcackccagtttaaacattctcttctaca

SEQ ID NO: 17649 - DNA, 50 bp, homo sapien
tttttttaagtaacagctaacattasgataaaaatcatagaacattttac

SEQ ID NO: 17650 - DNA, 50 bp, homo sapien
agtgtgacacagacacggacagtgaraataaaagcagaaattggctggag

SEQ ID NO: 17651 - DNA, 50 bp, homo sapien
gaatttagccttgtttgtgtcataaygaaatcactaggtgtttcatagtg

SEQ ID NO: 17652 - DNA, 50 bp, homo sapien
gatgtgacaattgccatgggtttcgyacgcacaggtcctacaaaaagtca

SEQ ID NO: 17653 - DNA, 50 bp, homo sapien
agcttagcagtagtgagacctcgcaratactacttaaccaggtgatccag

SEQ ID NO: 17654 - DNA, 50 bp, homo sapien
gggtgaagggtatatgtgaattctaygtactgactttgaaacttttgtgt

SEQ ID NO: 17655 - DNA, 50 bp, homo sapien
catggctccacctcagggagctgacmgatggtgatttattccacaaaata

SEQ ID NO: 17656 - DNA, 50 bp, homo sapien
agatcatttcttcactttccttcaaytcagtccagtggctacactcctaa

SEQ ID NO: 17657 - DNA, 50 bp, homo sapien
atgtctctcattgaatgaatctccaygtcacaatttcaaaaagtacaatc

SEQ ID NO: 17658 - DNA, 50 bp, homo sapien
tcacttcagtgggtctccatttcctyaacggaggagtgctctctagagcc

SEQ ID NO: 17659 - DNA, 50 bp, homo sapien
attttatctttaccttcatatcaatyaattcatgtatggaaaagctttga

SEQ ID NO: 17660 - DNA, 50 bp, homo sapien
acattactatactgaaagctgtaggyaagtataagacaatggtaagtatt

SEQ ID NO: 17661 - DNA, 50 bp, homo sapien
caccattttacaggcttcagtccaartgtggttggaggtaatattgtcat

SEQ ID NO: 17662 - DNA, 50 bp, homo sapien
aacacaaaagatttctgggactaaaygtatgaagatttctctccacacac

SEQ ID NO: 17663 - DNA, 50 bp, homo sapien
aatacttaaatgtggaaaaaacccartagtcaggaggtatcttttttttt

SEQ ID NO: 17664 - DNA, 50 bp, homo sapien
ctagagaaacagaaccaataggatgmagatatataaagagatttgttatg

SEQ ID NO: 17665 - DNA, 50 bp, homo sapien
ataatcaacataaatctcctgtagcyatggaacagaataaggacagggaa

SEQ ID NO: 17666 - DNA, 50 bp, homo sapien
taactaagtactttctggaaatataygttgaaccctgtaaaaatctcatt

SEQ ID NO: 17667 - DNA, 50 bp, homo sapien
aagtgtgtttttcatttttgagaacyagtgcttaggagtaagtacaggtt

SEQ ID NO: 17668 - DNA, 50 bp, homo sapien
attataatttatatctgtaatgaacwcatggtaccagaattattcattgg

SEQ ID NO: 17669 - DNA, 50 bp, homo sapien
agtctttacgtggtggtgtgggaacsaaaatcaattacttctcatactaa

SEQ ID NO: 17670 - DNA, 50 bp, homo sapien
caaacaaaaagaagttgccattttckaattccgattatttggaatgcatt

SEQ ID NO: 17671 - DNA, 50 bp, homo sapien
catgctcttgtaatcagagaaatcaygcggagaagcacagaagctaatgg

SEQ ID NO: 17672 - DNA, 50 bp, homo sapien
aagttaacaactgagaaattagaagraaaacgccattattgtgttatata

SEQ ID NO: 17673 - DNA, 50 bp, homo sapien
acaacccttcacactaacgaaatagrcaatgacccctcaccactgaagta

SEQ ID NO: 17674 - DNA, 50 bp, homo sapien
gttatgcagtcaagtggcagaattckaaatggctatgaaccaatcattta

SEQ ID NO: 17675 - DNA, 50 bp, homo sapien
agcttcacctttttcctagacgtgayacaaacagatccaccttcaaactg

SEQ ID NO: 17676 - DNA, 50 bp, homo sapien
tgtttattaaagttcattatttaccrctcaaaagggttattattctaaag

SEQ ID NO: 17677 - DNA, 50 bp, homo sapien
aaaaacagagcattagtaggtactcrctcaaatacctacagatgctcttt

SEQ ID NO: 17678 - DNA, 50 bp, homo sapien
ctgttaaagtctcccactattactayatggaagtctaagtctctttgaag

SEQ ID NO: 17679 - DNA, 50 bp, homo sapien
cacatcttatggcctgggctgtgttwaaaagacctggaagtgctagagcc

SEQ ID NO: 17680 - DNA, 50 bp, homo sapien
accgtaatcttttgagctctgataayattttgtgtctctatcataagaca

SEQ ID NO: 17681 - DNA, 50 bp, homo sapien
gttcattattttatatgttaataatsagaggagcttttcttatttcctgg

SEQ ID NO: 17682 - DNA, 50 bp, homo sapien
taagtgtggggtctaataactcaaasaatgaatcccttctaataggctaa

SEQ ID NO: 17683 - DNA, 50 bp, homo sapien
accagcagggcacggtagatactccraagtagagcaggcaagaaaatgaa

SEQ ID NO: 17684 - DNA, 50 bp, homo sapien
agagaaccaaagtagaattcttgcartgaaactttaagagaagcataaaa

SEQ ID NO: 17685 - DNA, 50 bp, homo sapien
tcgaaagaacaattttcttctgtaaygagcccttcctgtgaagcggccgt

SEQ ID NO: 17686 - DNA, 50 bp, homo sapien
gagcagacgtggggccttgagagtaygtgaagcatttgcaaaagtgacct

SEQ ID NO: 17687 - DNA, 50 bp, homo sapien
tctctggtctgggcgcctggatagtyacgcatggagtccgcgaggtgctg

SEQ ID NO: 17688 - DNA, 50 bp, homo sapien
attttctactactctgcataggttawgaaaaatcaaaatttgctttcttt

SEQ ID NO: 17689 - DNA, 50 bp, homo sapien
catctacgtggaatgtcaattttaartaagagtgaggacatgggtgtgtt

SEQ ID NO: 17690 - DNA, 50 bp, homo sapien
gaggaatcttctgaaccatctttcaracagccctcacttacgcctgcacc

SEQ ID NO: 17691 - DNA, 50 bp, homo sapien
gctagatacagtagtaacagattccwccattaagaactaattcccatgtt

SEQ ID NO: 17692 - DNA, 50 bp, homo sapien
acaaaaatgacagcatttgttccaargcaccaacagtataacgcttttta

SEQ ID NO: 17693 - DNA, 50 bp, homo sapien
cacactcaaaccccgaagttgaggayatggatttaaacatctgaaccatt

SEQ ID NO: 17694 - DNA, 50 bp, homo sapien
gctgatggcatttgggcagatatgaygtgtatctctttcaggtctttccc

SEQ ID NO: 17695 - DNA, 50 bp, homo sapien
taaaagaagttaaatcatgtggtacrgacatttagatagatttgatcaat

SEQ ID NO: 17696 - DNA, 50 bp, homo sapien
atatttaaaaaaattgctggtaaagkccttggagcatcagcaactcaacc

SEQ ID NO: 17697 - DNA, 50 bp, homo sapien
gacaagagacctctagtgggagctcrgaagaaagtaatgaaggtgagcag

SEQ ID NO: 17698 - DNA, 50 bp, homo sapien
tcccaaataatctctcagcaatcaaytaaatttctgtggtgcagattcag

SEQ ID NO: 17699 - DNA, 50 bp, homo sapien
tatattctgccttgctcacaaaggamaagttaaagaacagctgcttcctc

SEQ ID NO: 17700 - DNA, 50 bp, homo sapien
actggacttgctgttggagtggatayggagaatgagagaaaggtaataca

SEQ ID NO: 17701 - DNA, 50 bp, homo sapien
agtcaaggaaccaagatatgaccatsagcagactcaagatggtgaaaagc

SEQ ID NO: 17702 - DNA, 50 bp, homo sapien
gcacatttgtaagaccctgaaaagaygtgtccataatacttacacttgga

SEQ ID NO: 17703 - DNA, 50 bp, homo sapien
aaatgtgcctgtctagtatgaattayagagaatcagtgttaaaagggact

SEQ ID NO: 17704 - DNA, 50 bp, homo sapien
aactacacctcccatatacgaccggwaatgtgaaataagatttattttac

SEQ ID NO: 17705 - DNA, 50 bp, homo sapien
ctcaaccagggtccttaatccatcakagaggctttcatcctaatccaaac

SEQ ID NO: 17706 - DNA, 50 bp, homo sapien
aatttatcctgtctgcaaatctagarggataatataatatgaagataaaa

SEQ ID NO: 17707 - DNA, 50 bp, homo sapien
ccccttagctatgagatgccttctarggcccactggtacacatttctcat

SEQ ID NO: 17708 - DNA, 50 bp, homo sapien
acacaatcatgataatttaaatcaawcttttttgcctctcaggttcaagt

SEQ ID NO: 17709 - DNA, 50 bp, homo sapien
atttattcgttaatatttgaaaacastattatgagtatcattgtacagtt

SEQ ID NO: 17710 - DNA, 50 bp, homo sapien
tcttctaggctaatgctctttacackatactccagatcctctttcccaaa

SEQ ID NO: 17711 - DNA, 50 bp, homo sapien
catacacagtctttctctactgacasatcggctactctcaaaacaaaaaa

SEQ ID NO: 17712 - DNA, 50 bp, homo sapien
aaaatcacattttaaagctaccctcyaaatatgaatgaggtttgaatagg

SEQ ID NO: 17713 - DNA, 50 bp, homo sapien
taattcatttattaattatgctaacrgagatgagaaggagttggtcccaa

SEQ ID NO: 17714 - DNA, 50 bp, homo sapien
gtttgaaagaggcatatttatgagaragttccctgttaaaccactatttc

SEQ ID NO: 17715 - DNA, 50 bp, homo sapien
tacaatatatagaagggtacattgartaatatgacatgctatataaatat

SEQ ID NO: 17716 - DNA, 50 bp, homo sapien
agattgtagcctttatgaaataagakgcataaaacttcattaataggtta

SEQ ID NO: 17717 - DNA, 50 bp, homo sapien
ctctctgtgtgtcggcatttatgcamgtattatgtatctttggtttgtgc

SEQ ID NO: 17718 - DNA, 50 bp, homo sapien
tattcctgggaggcttctcttccaaygctgggtcatacattgttgccttt

SEQ ID NO: 17719 - DNA, 50 bp, homo sapien
tccctgtggcgggaatgtaagcacaygtttggtggaattagaaaaggtta

SEQ ID NO: 17720 - DNA, 50 bp, homo sapien
cacataatagtgagtctctgctcctkaaaaatagatgacgatccaaattt

SEQ ID NO: 17721 - DNA, 50 bp, homo sapien
agggttgcctcaggttttgtgttaaytgataataagcgaacagctcatac

SEQ ID NO: 17722 - DNA, 50 bp, homo sapien
ttcctgacagcctgacttgcaatccrcaaatggaaaaatcagacacataa

SEQ ID NO: 17723 - DNA, 50 bp, homo sapien
ttaccatcccaagtatgtttggaacyacaaagtgctagtcctaatgactt

SEQ ID NO: 17724 - DNA, 50 bp, homo sapien
agagacatagatctgtttttgatctraccgctaatttgagcaactaattt

SEQ ID NO: 17725 - DNA, 50 bp, homo sapien
ggaggaaaaaatatcctgcttcttcragtctcttgtaattgctctccttt

SEQ ID NO: 17726 - DNA, 50 bp, homo sapien
aacctaggagtgttctgaagtgtcaygtgtacctatgaagtgggatggag

SEQ ID NO: 17727 - DNA, 50 bp, homo sapien
gttaagtttgatatgtcagctaggayctcaacatggaggtattcagaaag

SEQ ID NO: 17728 - DNA, 50 bp, homo sapien
attatttttcccacattaataatcawctagtgctccttcagcttgaaatg

SEQ ID NO: 17729 - DNA, 50 bp, homo sapien
tgttttatccctttgtcaagactaaygaccccatgattgacatgctggtt

SEQ ID NO: 17730 - DNA, 50 bp, homo sapien
caagtgctgtgcctagcaggaaccasaataataacaaactgggaacatga

SEQ ID NO: 17731 - DNA, 50 bp, homo sapien
ctctgcatataaaatattaatagatsagaaaacctaataaaacaaaaaat

SEQ ID NO: 17732 - DNA, 50 bp, homo sapien
ctctttacgtcagctttaccgtgtaraatataaagccaaatatgtggtta

SEQ ID NO: 17733 - DNA, 50 bp, homo sapien
aaggtcagatccagatcctgaaaaaygaccttgtaagccatagtagaaag

SEQ ID NO: 17734 - DNA, 50 bp, homo sapien
attattcaattgaatgttctaggagragtttttactattggggaaaaagt

SEQ ID NO: 17735 - DNA, 50 bp, homo sapien
ctttctttctgagtccttagttaacmgcattagtgtgacaaatatgtctt

SEQ ID NO: 17736 - DNA, 50 bp, homo sapien
gaaaaatataactactcgagtccacyattgatgatgggaagagaaattaa

SEQ ID NO: 17737 - DNA, 50 bp, homo sapien
tgcttactgtgtgctaaatataatgycaggtatgaatttttctttgggta

SEQ ID NO: 17738 - DNA, 50 bp, homo sapien
tatctttatcaccacagcagaatcaraagtgcacattcctggaagaagcg

SEQ ID NO: 17739 - DNA, 50 bp, homo sapien
tttctttctttgcgtttgcactttarcatttttactattggtgcattgat

SEQ ID NO: 17740 - DNA, 50 bp, homo sapien
gttgggttggcctgggagacttttamgtgcctctggatgagtctgctctc

SEQ ID NO: 17741 - DNA, 50 bp, homo sapien
atcatgctgatggatacaaagaactraagacttggagtaaagcaagacat

SEQ ID NO: 17742 - DNA, 50 bp, homo sapien
cacgttgaaaaattattctttgttayaatctcctacttaaaagatttttg

SEQ ID NO: 17743 - DNA, 50 bp, homo sapien
ctccttcatagctctttggaccactkagggagtagaggcttttggtgtgg

SEQ ID NO: 17744 - DNA, 50 bp, homo sapien
ggacattggacatgcctcattatacygcttcccttttggacttcagtcat

SEQ ID NO: 17745 - DNA, 50 bp, homo sapien
atatattttggctatgtacatatgaygataattaatgatagtgttctaat

SEQ ID NO: 17746 - DNA, 50 bp, homo sapien
atgacctcttacgtagcacttttcarcaaataatgtatacatttacttta

SEQ ID NO: 17747 - DNA, 50 bp, homo sapien
tgaaatttgctaaatatcacacttamcttgagaaaagttcttcttacaag

SEQ ID NO: 17748 - DNA, 50 bp, homo sapien
ctccatagtaataatgtaagagttaygtagcgcaagagttatttctgtac

SEQ ID NO: 17749 - DNA, 50 bp, homo sapien
agagcctctggatagcttacaagtayaaaggtcagccatagagtaaaggc

SEQ ID NO: 17750 - DNA, 50 bp, homo sapien
atgccaagacctggttgagtttatakatacagacggcaaccatcacctca

SEQ ID NO: 17751 - DNA, 50 bp, homo sapien
aagcttatcttttcactaaagactayagagatccttcagaactggatgta

SEQ ID NO: 17752 - DNA, 50 bp, homo sapien
tatccccattttacagatgttgaaastgagcatgaaatcttatttctctt

SEQ ID NO: 17753 - DNA, 50 bp, homo sapien
cctaggttcccctaagaaacccacaratgatttataggatcatcatgacc

SEQ ID NO: 17754 - DNA, 50 bp, homo sapien
gaagaatcatatccgaaaatattagrcatctcttcttgctccaaggccct

SEQ ID NO: 17755 - DNA, 50 bp, homo sapien
atgacctttgaagttatctactgatyaaatatggaacacatgcatcttaa

SEQ ID NO: 17756 - DNA, 50 bp, homo sapien
ggaggagagtggacagggtaagttasagaagtttgagaaactgccaagac

SEQ ID NO: 17757 - DNA, 50 bp, homo sapien
tttcagtgctgatttgctcatctaartaatcatcctataaaactgattga

SEQ ID NO: 17758 - DNA, 50 bp, homo sapien
ggaaactttagccattttaatgtggraagtctaagatttactgcttgggg

SEQ ID NO: 17759 - DNA, 50 bp, homo sapien
aataaaggaaggtagcaagttaggckatggattatattttcttgcttgtt

SEQ ID NO: 17760 - DNA, 50 bp, homo sapien
aaatgctgctgagagaattcacataygaagctgactaaaagatacacaat

SEQ ID NO: 17761 - DNA, 50 bp, homo sapien
aaaagaatattttcatgtagactgcwctaaaataacaagataaacctgaa

SEQ ID NO: 17762 - DNA, 50 bp, homo sapien
taaaagaaacactcaaaaatcagaayaggaacatatagagtcaatgaaaa

SEQ ID NO: 17763 - DNA, 50 bp, homo sapien
actaaaaataaggataaaatatgaaytcgaatacaaagagctctaaaaca

SEQ ID NO: 17764 - DNA, 50 bp, homo sapien
aaaacaaactagtggggaaaatttgmacaagaaatcccaagtccaggaaa

SEQ ID NO: 17765 - DNA, 50 bp, homo sapien
ttataggatgcagaatagaccaaaaktggatcatgacgtgtctattcaaa

SEQ ID NO: 17766 - DNA, 50 bp, homo sapien
acatcagtgcactgggattgctacamtgaattttgtgtgcatgtttcaaa

SEQ ID NO: 17767 - DNA, 50 bp, homo sapien
aaggaaagtaaggtatggccaaatasgtgtaataaaaaggaagtctcata

SEQ ID NO: 17768 - DNA, 50 bp, homo sapien
gagaaattttgactaaatgacttccraggtctcttgcatctctcagattc

SEQ ID NO: 17769 - DNA, 50 bp, homo sapien
tatctgagaaacaaaatgccataaawtgataaaagaaaaactcgggaaaa

SEQ ID NO: 17770 - DNA, 50 bp, homo sapien
accactatttgaaggcttctgtttamcctacccacgtggcccattagaat

SEQ ID NO: 17771 - DNA, 50 bp, homo sapien
gaggcttagttcacctgattgatccragataagcaggttcactgttagag

SEQ ID NO: 17772 - DNA, 50 bp, homo sapien
tcagactagcaatttatggccataawtcaaagtgattctggtagtaattt

SEQ ID NO: 17773 - DNA, 50 bp, homo sapien
tttcatttccaacctaattagcccaygatcaaggttcaaagcactgtatt

SEQ ID NO: 17774 - DNA, 50 bp, homo sapien
ggaaacctatgctttttatatgaaarcaaatggatattgtggaataagat

SEQ ID NO: 17775 - DNA, 50 bp, homo sapien
gcaacacagccacatgaaataatggwacttcctcatatcctgcttatttt

SEQ ID NO: 17776 - DNA, 50 bp, homo sapien
agggagttgatctgccttgcccagasaaaacactatgacaagcatgagaa

SEQ ID NO: 17777 - DNA, 50 bp, homo sapien
tctaccgtgtgatacatgaaaagtcraatttgaaatcctctctgtaactc

SEQ ID NO: 17778 - DNA, 50 bp, homo sapien
catttttgagcaaagagggatcaacraactagttgcttgaaagctttcct

SEQ ID NO: 17779 - DNA, 50 bp, homo sapien
cagggagcccctcctaaaagggaagrctacgttcagatattccttctcca

SEQ ID NO: 17780 - DNA, 50 bp, homo sapien
tggcacttctccagaacaggctccaraatactatatccagcatgttcctc

SEQ ID NO: 17781 - DNA, 50 bp, homo sapien
tgatgttttattcagtctgttacatraaactcaaaaaccgaccaggaaaa

SEQ ID NO: 17782 - DNA, 50 bp, homo sapien
gggttagttctgagaagccagtcccrcaggaagaggttatcacagagaac

SEQ ID NO: 17783 - DNA, 50 bp, homo sapien
aatcatggctggcatgggccagactraacccggtctctggcctgtatctg

SEQ ID NO: 17784 - DNA, 50 bp, homo sapien
taatagtttagagtcatataagagcrctatctttaaatgacttggtgaaa

SEQ ID NO: 17785 - DNA, 50 bp, homo sapien
tactaatgcatcatacactgtcttaygagatttcttctttggtcttggat

SEQ ID NO: 17786 - DNA, 50 bp, homo sapien
agtgtatgatgcattagtaaatcaaycagacaaatcatttactactgtgg

SEQ ID NO: 17787 - DNA, 50 bp, homo sapien
aattttcaaagttttccttctctgaygatataaaaatatatcatcataag

SEQ ID NO: 17788 - DNA, 50 bp, homo sapien
catttcaaacagaattccattattcragatactctggtacaccaaaaagc

SEQ ID NO: 17789 - DNA, 50 bp, homo sapien
agtgttctaatcataggaatcttccraaactgccagggatgttctgataa

SEQ ID NO: 17790 - DNA, 50 bp, homo sapien
gccaaatggagaatgaaagcaattayggtaggcaatttttttaatttgct

SEQ ID NO: 17791 - DNA, 50 bp, homo sapien
ggctttgctattttaggttacatgaytactgactaatgcaacaaatttaa

SEQ ID NO: 17792 - DNA, 50 bp, homo sapien
gcacttggaacattgtcagtatacaratgttcctcaataaaggatgagag

SEQ ID NO: 17793 - DNA, 50 bp, homo sapien
atttcaatccctagaccttggctcawattattgcctgtacttggaatgat

SEQ ID NO: 17794 - DNA, 50 bp, homo sapien
tccttgcctgccccagtctcaacaaytctccattgcccattttgagttca

SEQ ID NO: 17795 - DNA, 50 bp, homo sapien
ttaagttgaaaatggccaagcatagraactgaagacatttctcagcattt

SEQ ID NO: 17796 - DNA, 50 bp, homo sapien
actgagcagagaggaaagggcaaaayatgtggcaaccaagtttaggactg

SEQ ID NO: 17797 - DNA, 50 bp, homo sapien
ctctggacatgcaaggctattataaraccagatcttggctgggcatggtg

SEQ ID NO: 17798 - DNA, 50 bp, homo sapien
ttggtaatgatgctgagatttctaakaggtaactggatggattggggtcc

SEQ ID NO: 17799 - DNA, 50 bp, homo sapien
accacatcaaatgtaaagcactaaargtaatatgatctttctcagtgcag

SEQ ID NO: 17800 - DNA, 50 bp, homo sapien
gaggaaacagaaagtgttgacaaccragagtcttccgaggtataagtagt

SEQ ID NO: 17801 - DNA, 50 bp, homo sapien
atttacctagcacatgtaaccaggcraaagtgtaaaccagggtttctcaa

SEQ ID NO: 17802 - DNA, 50 bp, homo sapien
ccacagaaatctatttaacctataaygtggctggaccaaactgtactcaa

SEQ ID NO: 17803 - DNA, 50 bp, homo sapien
aacaataaaaataaggacttgctaayaaaagaattttagtttttatgtat

SEQ ID NO: 17804 - DNA, 50 bp, homo sapien
cttctgttctccttcaagccaataayaagattgagctgggaagctccttc

SEQ ID NO: 17805 - DNA, 50 bp, homo sapien
ataaacaagggcaggtgtctctctcsactacggagctaacacttgagcaa

SEQ ID NO: 17806 - DNA, 50 bp, homo sapien
taggagggtctctgaggctctaagarggacaaaaagagtatagagggact

SEQ ID NO: 17807 - DNA, 50 bp, homo sapien
tgacctagatctgagcactttaacartagaaacaaatctgagaacggagc

SEQ ID NO: 17808 - DNA, 50 bp, homo sapien
tgcaatgataaatcacagtacgggcrccaatgtggttctgacctggaagc

SEQ ID NO: 17809 - DNA, 50 bp, homo sapien
ataaaatctttaccagacaaaccagsattgagggaattcattaccactag

SEQ ID NO: 17810 - DNA, 50 bp, homo sapien
tggagagtggtctagtggctttaaaytgtaaggagaggcagagggagggc

SEQ ID NO: 17811 - DNA, 50 bp, homo sapien
caccctatcatttgatataactacartattacctttgatctatttgagca

SEQ ID NO: 17812 - DNA, 50 bp, homo sapien
actgaaggaggccaataaatgcttcrcgtatggttttctgattgtgtatt

SEQ ID NO: 17813 - DNA, 50 bp, homo sapien
ggggagtgatgtccccaaggcaataygggaagtctgcagcagagccaggc

SEQ ID NO: 17814 - DNA, 50 bp, homo sapien
ctgggggccttaggtaaatctgtccrataatcagtgtccttatctgctcc

SEQ ID NO: 17815 - DNA, 50 bp, homo sapien
ctagttatgtgctgtgctagcaaaakgtctacagatgagtcagaaatgcc

SEQ ID NO: 17816 - DNA, 50 bp, homo sapien
tgtacaaatttaatctttttctaagwatgccatagtctagttcatgaaga

SEQ ID NO: 17817 - DNA, 50 bp, homo sapien
tctcttggttgttgacattaaggacrattagaatagcaaactcttctaca

SEQ ID NO: 17818 - DNA, 50 bp, homo sapien
ttacattaacttgacaaatcaacacmgatagcaggaattttttcacacat

SEQ ID NO: 17819 - DNA, 50 bp, homo sapien
ctgttatctaaaaacatatggataawaccaacatgactagaaaccaaacg

SEQ ID NO: 17820 - DNA, 50 bp, homo sapien
agagggaaaatgatatagtcaatcartacagatgaaacagaaacccagga

SEQ ID NO: 17821 - DNA, 50 bp, homo sapien
ttttgaaatcctagggtttaattgasaccagtatagtaattcaaaaataa

SEQ ID NO: 17822 - DNA, 50 bp, homo sapien
gcaagaggacaaaaagtacagctcartgactaatcacaatgcaaacttac

SEQ ID NO: 17823 - DNA, 50 bp, homo sapien
agagctactataagtaagcacgtatyagtttttgtgaaaacatgttccat

SEQ ID NO: 17824 - DNA, 50 bp, homo sapien
aacggcttaaggaactccataggacmagaaaatttaacatgaccacaact

SEQ ID NO: 17825 - DNA, 50 bp, homo sapien
cagccagtcaacggccaagtgttacrgaactactatggtaataacacttg

SEQ ID NO: 17826 - DNA, 50 bp, homo sapien
ggttttatttgtgtgtgtgtgtacargtatatgatgaatatatacacatt

SEQ ID NO: 17827 - DNA, 50 bp, homo sapien
cagagttaacctctcttgagtaaaargaatccttcagaaccagaggggat

SEQ ID NO: 17828 - DNA, 50 bp, homo sapien
aggaggaatttcttcaccatgaaacwcctttttcacagtatgaataaaca

SEQ ID NO: 17829 - DNA, 50 bp, homo sapien
ctcatagcttgagagtgtttaaaacrggaatctcatttaggtgtggtagg

SEQ ID NO: 17830 - DNA, 50 bp, homo sapien
actataagaagtgtgtctttgctackcttccatttcctttcatcagcccc

SEQ ID NO: 17831 - DNA, 50 bp, homo sapien
tctacttgaagtcaatcttccaaaaytacttatgattaaaatcaggtttc

SEQ ID NO: 17832 - DNA, 50 bp, homo sapien
agctttgtgaactcagtaagtgccayataaaagtgttagctgtcatttta

SEQ ID NO: 17833 - DNA, 50 bp, homo sapien
agtgagtgcttaataattgcttgccraatgaacaaatataagatctcaag

SEQ ID NO: 17834 - DNA, 50 bp, homo sapien
gttccaagatatacatttttggatckctgaagtcaggaggcatctcccag

SEQ ID NO: 17835 - DNA, 50 bp, homo sapien
tacttgccttactttggaaaacgaaragagctcactaaagtggtccctct

SEQ ID NO: 17836 - DNA, 50 bp, homo sapien
caaatagattggcaaagatgctctayatgaaaattcccaaattaaaaaat

SEQ ID NO: 17837 - DNA, 50 bp, homo sapien
cctacctgggaaaggtgacatttatraactattaaaccttatttgtcttc

SEQ ID NO: 17838 - DNA, 50 bp, homo sapien
ctgctcctgtgcaccatccgtgtacycgacagcagctgattaagcctcct

SEQ ID NO: 17839 - DNA, 50 bp, homo sapien
gaaaaggtattatgtgtttgacaaaytgtatctacaaatttcttgtacat

SEQ ID NO: 17840 - DNA, 50 bp, homo sapien
ttttactaggaactagaccaaactgrcagtactagaaatctttttatttg

SEQ ID NO: 17841 - DNA, 50 bp, homo sapien
tctttcagtagtaaggtaacatgagratagcactatatagttcttagata

SEQ ID NO: 17842 - DNA, 50 bp, homo sapien
ggtttcagttatctgtggccaactayagtctgaaagtacatgagtacagt

SEQ ID NO: 17843 - DNA, 50 bp, homo sapien
aaagaccttctccgtgtccctagtayatgccaactgattcccactcgagg

SEQ ID NO: 17844 - DNA, 50 bp, homo sapien
aactagtgacttactattctcaaggyatagccatcaaatgaatatttcta

SEQ ID NO: 17845 - DNA, 50 bp, homo sapien
aagaatgagatggacaataagtgctmagagagagatttgaaaacactgat

SEQ ID NO: 17846 - DNA, 50 bp, homo sapien
taattgtcccagagtcttgaatacgycatcaggtatgggcattttatttc

SEQ ID NO: 17847 - DNA, 50 bp, homo sapien
gatgtctctgcctcctctgggtaaasgatgtttcttgagctatagggcag

SEQ ID NO: 17848 - DNA, 50 bp, homo sapien
ttaccccttcattcacctttgcatawgtgagaaatgcttgcaaaacttct

SEQ ID NO: 17849 - DNA, 50 bp, homo sapien
ttgcagagtgacagggacactgatasaagtaaagtcagaatgtcatggaa

SEQ ID NO: 17850 - DNA, 50 bp, homo sapien
ttgtcaccctttagctcgcaactgaraagatagttctgggccttaggagg

SEQ ID NO: 17851 - DNA, 50 bp, homo sapien
actaagcctaagctgaacttcttcaractaaaaagatgacaactcaaggg

SEQ ID NO: 17852 - DNA, 50 bp, homo sapien
attaaccagttttgtatctaacctascaattttatttcaatgtttttttc

SEQ ID NO: 17853 - DNA, 50 bp, homo sapien
caagcttccacagaaaaaagtaaaamgtgctgctgacaaaggatggtgat

SEQ ID NO: 17854 - DNA, 50 bp, homo sapien
agcagatcagaatgggcatgtgtatmaaatggatcttccagttcatcagc

SEQ ID NO: 17855 - DNA, 50 bp, homo sapien
cacctttttctttgtcttttaggtamatgtcggatactcagtcctgctta

SEQ ID NO: 17856 - DNA, 50 bp, homo sapien
acaattttcatttaatatttcacaawtgtatgtcttatcacattctcatg

SEQ ID NO: 17857 - DNA, 50 bp, homo sapien
cacattcttggcaatggagtccagayatttctcaaacatggtagggaaag

SEQ ID NO: 17858 - DNA, 50 bp, homo sapien
gtccccgaatatggcattagtacccratacccggctgagctcagacttcc

SEQ ID NO: 17859 - DNA, 50 bp, homo sapien
cgtcatgcacaaccgtgagcactcartgaagatacagaaaggtgttccct

SEQ ID NO: 17860 - DNA, 50 bp, homo sapien
acaaatttctaaatttgccgtaatayatacagggactcaatagggtagga

SEQ ID NO: 17861 - DNA, 50 bp, homo sapien
ctctttcacctatactgtgcaaacckgaaaactgtaaatgccaaaatact

SEQ ID NO: 17862 - DNA, 50 bp, homo sapien
gctgcctgagttacaacactgttcamgattttgccattaacaagaaattc

SEQ ID NO: 17863 - DNA, 50 bp, homo sapien
gaaggggagtagaggcacgagatcasaggataaaatagggaaggctccct

SEQ ID NO: 17864 - DNA, 50 bp, homo sapien
cctaagcctatgatgggccttatagragaactagtcacaggtggctctac

SEQ ID NO: 17865 - DNA, 50 bp, homo sapien
ttttgtatttttaagtttgattttcyagagatcgtaaatgcgtcattcag

SEQ ID NO: 17866 - DNA, 50 bp, homo sapien
aaatgacacaaaataaacaaaacgcygagccaaagtctgacacaaagtag

SEQ ID NO: 17867 - DNA, 50 bp, homo sapien
gcttaatctgcaacacaaaacaccartaataaagatgctagaattacttt

SEQ ID NO: 17868 - DNA, 50 bp, homo sapien
aagtatggtacattatgactaagtgmagcaattacaaagtgttggctaag

SEQ ID NO: 17869 - DNA, 50 bp, homo sapien
gcatcccacatgtattggttgttgayaaatcaaagaggttgcagattctg

SEQ ID NO: 17870 - DNA, 50 bp, homo sapien
tactatccactgttggttatctaagrcccttcctataaacagcagcctgc

SEQ ID NO: 17871 - DNA, 50 bp, homo sapien
ctacagtagagaaattgtgtctgtcrcgaaatctctccaggtgaccaagt

SEQ ID NO: 17872 - DNA, 50 bp, homo sapien
cggatacccactttattcagacaatrataatatcgttgagctatggtaag

SEQ ID NO: 17873 - DNA, 50 bp, homo sapien
gaatttgacaggtatgttacgtttakacttcattctgcatcattcattca

SEQ ID NO: 17874 - DNA, 50 bp, homo sapien
atgagtaggaaaagatgagtgtgaakgatattttaaaggaaaagttggca

SEQ ID NO: 17875 - DNA, 50 bp, homo sapien
gccgtttaaagggtgagagaaataaytacatgcccattcgtggttaaaaa

SEQ ID NO: 17876 - DNA, 50 bp, homo sapien
aatcaagttttgaactaagagctacrgaatgtatgccatttctctctggg

SEQ ID NO: 17877 - DNA, 50 bp, homo sapien
gttgatataactatgtccaattaaasaaaaaacaacatccaaaggttctg

SEQ ID NO: 17878 - DNA, 50 bp, homo sapien
taacacataaggaatgttaaatttaygtcaatgtgtcagggtagttttct

SEQ ID NO: 17879 - DNA, 50 bp, homo sapien
attgaactaatctacagtaatagaargcagaatcagtagggctatggaga

SEQ ID NO: 17880 - DNA, 50 bp, homo sapien
actgagctgtatttggttgaattatraaagcctgtttgtttatgtctctt

SEQ ID NO: 17881 - DNA, 50 bp, homo sapien
ttggagaattaagactattaaaaaartaagtattcactagtcatacagat

SEQ ID NO: 17882 - DNA, 50 bp, homo sapien
aaaactcaaaggtttctggaagccartgaaaatcctcacctctgactgaa

SEQ ID NO: 17883 - DNA, 50 bp, homo sapien
atatatattctatcacatccttccawtaaggtagatgctctcataaagtc

SEQ ID NO: 17884 - DNA, 50 bp, homo sapien
gaactttataaaattcggagcctcaygcatcagaaggtaaaaaacaaaag

SEQ ID NO: 17885 - DNA, 50 bp, homo sapien
aaaaaacaaaagtggacagttttaasaacgatggatgagttgctagggaa

SEQ ID NO: 17886 - DNA, 50 bp, homo sapien
ttgcctttatgcacataatttgccaygcctacattctttcagggcctaca

SEQ ID NO: 17887 - DNA, 50 bp, homo sapien
agaagcttgagctggcaaaaactgartaggaagcgcttccatgggtactg

SEQ ID NO: 17888 - DNA, 50 bp, homo sapien
gagcctgcagaccaggtcctggagamgttatgttctgtgattaaaccatc

SEQ ID NO: 17889 - DNA, 50 bp, homo sapien
tcattgtgtttcctgctgcataaaamtggctggaaatgaagattccttca

SEQ ID NO: 17890 - DNA, 50 bp, homo sapien
tctgcaagcaaatcatgccgctttasggtttaaactccgcaaagtgagca

SEQ ID NO: 17891 - DNA, 50 bp, homo sapien
taggagtgctctgtatgtgtttgaaygataaatggactcagatttcctta

SEQ ID NO: 17892 - DNA, 50 bp, homo sapien
ctagatgacacttcggataaagtaaraagtaggctgactagtttctaaat

SEQ ID NO: 17893 - DNA, 50 bp, homo sapien
acagagaatttttaagctggcaatamagaaaataataacatctattttgt

SEQ ID NO: 17894 - DNA, 50 bp, homo sapien
ccactctcttcttgaaaaagatccaratcatctttcagctatgtagacat

SEQ ID NO: 17895 - DNA, 50 bp, homo sapien
atggctaagtcatgtggacccttgaraagttgactttctgcagcaagccc

SEQ ID NO: 17896 - DNA, 50 bp, homo sapien
taaagctaagactaattatttgagastactacttttggttaaacttcaca

SEQ ID NO: 17897 - DNA, 50 bp, homo sapien
gtgctggggatggatatggggagaaygtgaattgttgaggtgtgtataaa

SEQ ID NO: 17898 - DNA, 50 bp, homo sapien
ttttgattaagctaccaataaaggtkaagagcattcagacttataaaatc

SEQ ID NO: 17899 - DNA, 50 bp, homo sapien
gacatcaggctacattgaatctagaraaccacagaaattgaggggactca

SEQ ID NO: 17900 - DNA, 50 bp, homo sapien
acattgatacaagagtccacaatgayaggtttcaaagatgaaagtaatgg

SEQ ID NO: 17901 - DNA, 50 bp, homo sapien
caaaaagccttttaacagatagttayattgatacaagagtccacaatgac

SEQ ID NO: 17902 - DNA, 50 bp, homo sapien
gtttggtacactcaagaagacaggaygtttagtacacccaggaagacagg

SEQ ID NO: 17903 - DNA, 50 bp, homo sapien
caccattgattttagtcagtgataaytaattggctttgtaatcagcaagc

SEQ ID NO: 17904 - DNA, 50 bp, homo sapien
gtcctgtatgtaatatcagggaatartaaatgatagaaaaataaggaaga

SEQ ID NO: 17905 - DNA, 50 bp, homo sapien
aatctatgaaactcaagaaacacagyattaaccagatggatcccattaaa

SEQ ID NO: 17906 - DNA, 50 bp, homo sapien
ccctcattgtgttgtgattagtataygtagggagtaaagatctgtaatta

SEQ ID NO: 17907 - DNA, 50 bp, homo sapien
tcatccactcatttaatttttctgcmctaattctttacgttaataagctt

SEQ ID NO: 17908 - DNA, 50 bp, homo sapien
tcctcgacataaatcttgtccactamaaagtacagatgtttggattttca

SEQ ID NO: 17909 - DNA, 50 bp, homo sapien
atgctgcactgcttgtgaacttataycagagcacactggataaagcatgt

SEQ ID NO: 17910 - DNA, 50 bp, homo sapien
aacgacaagaaaggcacagtcatacraagatccaggcaagagtcggctga

SEQ ID NO: 17911 - DNA, 50 bp, homo sapien
gcttcagggctgcctgagggcccacrctgaatgctaacgcctgtctgggg

SEQ ID NO: 17912 - DNA, 50 bp, homo sapien
cagagattccttatagtacctgttamgccttataaaagaagacttttgtg

SEQ ID NO: 17913 - DNA, 50 bp, homo sapien
cattttatgctccattacaatacccrcactgattataatgacaggcattt

SEQ ID NO: 17914 - DNA, 50 bp, homo sapien
tgcataactggagatgatttatcaayggtgcattttacaagatcaccact

SEQ ID NO: 17915 - DNA, 50 bp, homo sapien
tctcagtttggtttgcataatttaaraggagcagaagagcacgtgtactt

SEQ ID NO: 17916 - DNA, 50 bp, homo sapien
aaataataaaatagtcatagcagaartaatactgataatatttagagtta

SEQ ID NO: 17917 - DNA, 50 bp, homo sapien
catgcaggaggcctttgagacagccrattgctacaaccaggcctgaatca

SEQ ID NO: 17918 - DNA, 50 bp, homo sapien
cccaacaatttggaagattaattaasaacatgctattgagtaaaacctaa

SEQ ID NO: 17919 - DNA, 50 bp, homo sapien
ccttctcaatgttctatgacctagcwcctttttctcttaaatattcacta

SEQ ID NO: 17920 - DNA, 50 bp, homo sapien
ttcattgaggttgatgattgtgatayggactagtctggtgcttgcgtttt

SEQ ID NO: 17921 - DNA, 50 bp, homo sapien
tgtggctgaatcccattttcagagckaccaattacggtccagaggggctg

SEQ ID NO: 17922 - DNA, 50 bp, homo sapien
gaactcattcttttctgaccttctayagtacttgaagtgtgaaccacatt

SEQ ID NO: 17923 - DNA, 50 bp, homo sapien
acagaatactctccatctttcaggckgacaaccacacttatgtatcatac

SEQ ID NO: 17924 - DNA, 50 bp, homo sapien
tttaagtcactggtagttggttactraaatcatttcatcagttcgattat

SEQ ID NO: 17925 - DNA, 50 bp, homo sapien
aactccatgattttgataactgaackgtggttatggaagagaatgccctt

SEQ ID NO: 17926 - DNA, 50 bp, homo sapien
tgacttcagaacttaggaagataaamgataaccaggatttgacattcaga

SEQ ID NO: 17927 - DNA, 50 bp, homo sapien
gggagaaagaaaggaaggagcatcaragacttcacaaccaggctttcttt

SEQ ID NO: 17928 - DNA, 50 bp, homo sapien
ctaatcaatagctcgatccaggttaygaaggtgtttcccaagcttggtgc

SEQ ID NO: 17929 - DNA, 50 bp, homo sapien
tagacagcacccacgatattgtgatraccaaccagcttgagatgaaggca

SEQ ID NO: 17930 - DNA, 50 bp, homo sapien
tgaacagtatggtgttgcagattcayggagggcttaatttaataaacatg

SEQ ID NO: 17931 - DNA, 50 bp, homo sapien
attacttcttctttagcatttgttgratttttcttgaaaactgaactgtc

SEQ ID NO: 17932 - DNA, 50 bp, homo sapien
tcctggcaaccaaaatgacagggaartattcggtgataactacatttttc

SEQ ID NO: 17933 - DNA, 50 bp, homo sapien
tcctgggaggacatctgatactgaargtgactaaggtacgttgggccctg

SEQ ID NO: 17934 - DNA, 50 bp, homo sapien
tctcagttggcgtaaggtccctctamgattctagaattaactacatttta

SEQ ID NO: 17935 - DNA, 50 bp, homo sapien
ggggttatgtgatatcaagggctaasataaaggtaattggctatttaacc

SEQ ID NO: 17936 - DNA, 50 bp, homo sapien
agcaccttgaggaatgtttggtatayagtaggcagtcaggaagcaaatgc

SEQ ID NO: 17937 - DNA, 50 bp, homo sapien
ttttaagatcaaacaagacttaatamggtgggatttgttttcctattgac

SEQ ID NO: 17938 - DNA, 50 bp, homo sapien
cccatttttggttcccttttcctcarcaaggtctctctagcttcagccat

SEQ ID NO: 17939 - DNA, 50 bp, homo sapien
ccatttccatgatgccccgacaagascgtacaagccctagataaagctag

SEQ ID NO: 17940 - DNA, 50 bp, homo sapien
gccttcatgcttgtgcttactgccasagacaatctccagtctgtatggag

SEQ ID NO: 17941 - DNA, 50 bp, homo sapien
ctgttcctggctctgactttctctgsagctaatattgttcctctcatgtc

SEQ ID NO: 17942 - DNA, 50 bp, homo sapien
ttaagggaaatcataggaattagtayggagagtaagcctcttgattactg

SEQ ID NO: 17943 - DNA, 50 bp, homo sapien
atttggccttttagtcattgggatasgtaggcctttcacctttactagtg

SEQ ID NO: 17944 - DNA, 50 bp, homo sapien
aactgtttataaaagcaattaactgwaatggtacatatccatagacttat

SEQ ID NO: 17945 - DNA, 50 bp, homo sapien
ctggttcttggacacggatagtttgmaaaacagtctagaacccaacagaa

SEQ ID NO: 17946 - DNA, 50 bp, homo sapien
aacccaaacaagatacgcctctgaaycttcggaaatattttcagttaacg

SEQ ID NO: 17947 - DNA, 50 bp, homo sapien
gcatttgtgttttcagattgttttaygtgattatgcacttctatcccacc

SEQ ID NO: 17948 - DNA, 50 bp, homo sapien
cacacaaaacaattttcttttcaaaygccaagagaagtaatgtaatgatc

SEQ ID NO: 17949 - DNA, 50 bp, homo sapien
ggcagcggcaaagtcttgttaagcaraaagtttggaggataagcgagggt

SEQ ID NO: 17950 - DNA, 50 bp, homo sapien
accttaaaattaagaaaccataatamcggaggcagttgacatgcagacaa

SEQ ID NO: 17951 - DNA, 50 bp, homo sapien
tctgaaaagcttgtttgttttaatayaattgaacatttcatctttccccc

SEQ ID NO: 17952 - DNA, 50 bp, homo sapien
aataccaagtgaaccattttggaatsagaatagctagttacatctcttgc

SEQ ID NO: 17953 - DNA, 50 bp, homo sapien
agtttcattgttattcacttgataayagagagtcgttgaaggtttcgtgc

SEQ ID NO: 17954 - DNA, 50 bp, homo sapien
cagctctgagactctggttgtcagaragttccagtgagacccttaacatc

SEQ ID NO: 17955 - DNA, 50 bp, homo sapien
gatgaagcacaattcatataagtgaycaggtaatggtgccaacaatatca

SEQ ID NO: 17956 - DNA, 50 bp, homo sapien
agagcgttgttagaataagtaccaaytggagcatctagcatcttacattt

SEQ ID NO: 17957 - DNA, 50 bp, homo sapien
gactgtactttagagagttttacaaygttccaagtacacagacttctaaa

SEQ ID NO: 17958 - DNA, 50 bp, homo sapien
tactgtgccctcaccactaacatgakgtagccttagcaagagtctgagca

SEQ ID NO: 17959 - DNA, 50 bp, homo sapien
tttagtaggaaacaatgtgtgaaaargttatgttaaaaagcaaaggtaaa

SEQ ID NO: 17960 - DNA, 50 bp, homo sapien
aatgagctggctagggagttttacasgagctttacatttgctcgcctggg

SEQ ID NO: 17961 - DNA, 50 bp, homo sapien
gtcaagctaacttcttggagtcccaygtatctttctccaactccaatgag

SEQ ID NO: 17962 - DNA, 50 bp, homo sapien
tgaccacatagaaattcattcattckcaattaccttcttcatcaacctat

SEQ ID NO: 17963 - DNA, 50 bp, homo sapien
aaagaagacttttgtgtagccacaaygagaagcaagaaacaaccatatgc

SEQ ID NO: 17964 - DNA, 50 bp, homo sapien
ggcacaaagaaggcccacgggtttgraatgacggagagaagaggaaaaaa

SEQ ID NO: 17965 - DNA, 50 bp, homo sapien
ctcttgttctagaaatggattatcaratgctcctgagcagccagtggcct

SEQ ID NO: 17966 - DNA, 50 bp, homo sapien
ttgcttcatttttaaagtgggtatarcacctgatctttctactggttagg

SEQ ID NO: 17967 - DNA, 50 bp, homo sapien
ctcaaccaaaaaacagagctaataaygtccttttaagtacttcgtgggta

SEQ ID NO: 17968 - DNA, 50 bp, homo sapien
tctctttctaaaccattgtgttgtakgttattcagtattggtccatgtcc

SEQ ID NO: 17969 - DNA, 50 bp, homo sapien
cagacaagagagtgcaatgttttcasagacagatcagatcctgttaaaac

SEQ ID NO: 17970 - DNA, 50 bp, homo sapien
atttgaacctattaaaagcagtgaamcttttgaattcagccatttttaaa

SEQ ID NO: 17971 - DNA, 50 bp, homo sapien
gaactaggtaaaatagtaatacatgragttgctcttgctattcctttttc

SEQ ID NO: 17972 - DNA, 50 bp, homo sapien
tatgcctttaattgacatgtatggcrcttggtttttatttcttttcaatg

SEQ ID NO: 17973 - DNA, 50 bp, homo sapien
attaggcttctctaagagatccgggmagaaaataaaaatggtgccactgc

SEQ ID NO: 17974 - DNA, 50 bp, homo sapien
cgaggcacgggatccaccttgggaasaacactggacaccactgtgtaggt

SEQ ID NO: 17975 - DNA, 50 bp, homo sapien
tctcttagagaagcctaatctgtacracagatgaaggcagagtggctgtg

SEQ ID NO: 17976 - DNA, 50 bp, homo sapien
atctttacaactctatgcaaatctaraagtattccaaagtaaacagttta

SEQ ID NO: 17977 - DNA, 50 bp, homo sapien
actgagaagaaccaggactcaggtayattctggcaactggccacctgcaa

SEQ ID NO: 17978 - DNA, 50 bp, homo sapien
cattataccactccatagaatcatayaccaatgtctcttacatagtgcaa

SEQ ID NO: 17979 - DNA, 50 bp, homo sapien
tgtaaacattttggttattcagtgcyctatgatcattgttgtatcccctg

SEQ ID NO: 17980 - DNA, 50 bp, homo sapien
gaaagaaggaagccattaacaagatmagaagaggtagtgtcagcatgtgc

SEQ ID NO: 17981 - DNA, 50 bp, homo sapien
tccaacagagcagccaaaacatagaracatttaaaggcttttgttaatat

SEQ ID NO: 17982 - DNA, 50 bp, homo sapien
gaaaagtcacttgacaatcttgaaasgagcccatttccttgtaaggaaaa

SEQ ID NO: 17983 - DNA, 50 bp, homo sapien
ttttgagccttactatgttgttagcyctaaaactgacaaataattgtaag

SEQ ID NO: 17984 - DNA, 50 bp, homo sapien
tttaatacaattaaactatgcaacaycttacatggttcagtgcttataac

SEQ ID NO: 17985 - DNA, 50 bp, homo sapien
gtaagtttcacatcagctgattctaraaggaaaattagatcaattctacc

SEQ ID NO: 17986 - DNA, 50 bp, homo sapien
caccatatctacctacaggtattcargtggtcctctgctggagaatgctt

SEQ ID NO: 17987 - DNA, 50 bp, homo sapien
tcggcactgtttgctttattagcccrcatataacttcttgggagacacag

SEQ ID NO: 17988 - DNA, 50 bp, homo sapien
ttcaaaatattaattacatgtttaaygcaagtacctgtcacatagaaagt

SEQ ID NO: 17989 - DNA, 50 bp, homo sapien
gatattggtccctccaagtgttctcyagctcaaggcaattggcatttttc

SEQ ID NO: 17990 - DNA, 50 bp, homo sapien
gtggacatataacacaatccacaaargtatataaacacgtcactgcccta

SEQ ID NO: 17991 - DNA, 50 bp, homo sapien
agaaagtaggtactgatttccctaaygtttcctttgtgtggctgctgttg

SEQ ID NO: 17992 - DNA, 50 bp, homo sapien
aggcatcacattacctgacttaacastataattgatttgcatttctctaa

SEQ ID NO: 17993 - DNA, 50 bp, homo sapien
tacctcaacaaatcggaagccaaacrggatacctttaccaaagctaccgc

SEQ ID NO: 17994 - DNA, 50 bp, homo sapien
ccatgctaaacctattgttaaatcarcctctttgttcccaacactcctga

SEQ ID NO: 17995 - DNA, 50 bp, homo sapien
ctggaagaaacagcctgaactctaarctgcaggaatctgagaaaggacca

SEQ ID NO: 17996 - DNA, 50 bp, homo sapien
taaataaaagcttttgtttaatagawgtctggtattagaacagattattc

SEQ ID NO: 17997 - DNA, 50 bp, homo sapien
ttttgggtaaaaaagaaaaagaagcrcttgtatgaattttcatgttattt

SEQ ID NO: 17998 - DNA, 50 bp, homo sapien
aaagcactttgaaaactgccttatcratgtaagtggttgggtctacaaac

SEQ ID NO: 17999 - DNA, 50 bp, homo sapien
aaatgacagcatagtccttgctgtakaagtttacaatttaaattctaagt

SEQ ID NO: 18000 - DNA, 50 bp, homo sapien
ggcaggagcttagtttcattaaggcraatctgccatccacctttccctgg

SEQ ID NO: 18001 - DNA, 50 bp, homo sapien
gcaaataaatacaaggaaaatacaaygcaggtgaagatgtacaggtgtct

SEQ ID NO: 18002 - DNA, 50 bp, homo sapien
ccacctgctaagcatctctctagaaygttcacacacatacaagcaaattc

SEQ ID NO: 18003 - DNA, 50 bp, homo sapien
ggtcaatgaagaagaatgagtaacascatgccattcaacgacagattaat

SEQ ID NO: 18004 - DNA, 50 bp, homo sapien
atgtttgtaataacttcaacctagasagctaacttctaaaaagtagacca

SEQ ID NO: 18005 - DNA, 50 bp, homo sapien
aatgtgttctatgaagaaaaataaaygtagtaagaggaatagcaagtgcc

SEQ ID NO: 18006 - DNA, 50 bp, homo sapien
gccaaaagcattcctgtttttgttcrctgacctgtagacactgatacttt

SEQ ID NO: 18007 - DNA, 50 bp, homo sapien
ttagaacacattgagtccacttggaraagccgattaagtcttgggctgct

SEQ ID NO: 18008 - DNA, 50 bp, homo sapien
ttcagttattaaaaaataagtctacmatcgaataactgttcatgtctgaa

SEQ ID NO: 18009 - DNA, 50 bp, homo sapien
cctgtagacactgatactttgaagcrgagcaggattcttcagggaagctt

SEQ ID NO: 18010 - DNA, 50 bp, homo sapien
tcccttcttttttaaggttgattaayattccattgtttgtacagttgtcc

SEQ ID NO: 18011 - DNA, 50 bp, homo sapien
gtttactattactacaatcttcaagycctaaagatttttgcttcctgttg

SEQ ID NO: 18012 - DNA, 50 bp, homo sapien
accaatttacacagtcctagagaaaragtttaaatcatctgaaactatgc

SEQ ID NO: 18013 - DNA, 50 bp, homo sapien
ttaaagatgggataataaatgtaacraaagcatcaaactgtgtacaccct

SEQ ID NO: 18014 - DNA, 50 bp, homo sapien
tgtgggccaacccacacctattccaktgagttctgaacctcttccaagtt

SEQ ID NO: 18015 - DNA, 50 bp, homo sapien
aggcaaggccttagcatcaactgcaracattttggaaacaaacatgataa

SEQ ID NO: 18016 - DNA, 50 bp, homo sapien
agtcagtagcaaaataggtgattaaygagttcatggtaatagacaaaatc

SEQ ID NO: 18017 - DNA, 50 bp, homo sapien
ccttctgtcatacaagaagaggtgargacacagcatttgtcccctttgga

SEQ ID NO: 18018 - DNA, 50 bp, homo sapien
ctcaactgagggatgtatatatctaygtaaaaaggatgaaagaaattaca

SEQ ID NO: 18019 - DNA, 50 bp, homo sapien
cttagactcaacacccaaagtataayccataagaagaaaattgataaatt

SEQ ID NO: 18020 - DNA, 50 bp, homo sapien
ggaaatcctgttttctagcaagcaastcagcaggtacaaatcaggagacc

SEQ ID NO: 18021 - DNA, 50 bp, homo sapien
atatacttaatttctgatattaccayctttaggctcctatgttttcttaa

SEQ ID NO: 18022 - DNA, 50 bp, homo sapien
accatggagaaccctggtttgcttayagaatcacttgtgtaaacagaaaa

SEQ ID NO: 18023 - DNA, 50 bp, homo sapien
caatggaatttgtaagaagaaattayaacagaaagtatggatatgacttt

SEQ ID NO: 18024 - DNA, 50 bp, homo sapien
atcattagatacataacccttataaytccagagacataagtgggtcagtc

SEQ ID NO: 18025 - DNA, 50 bp, homo sapien
caggagaaggcatccagatcaaaagkcttagcatcatccttttcctgttg

SEQ ID NO: 18026 - DNA, 50 bp, homo sapien
aaccctgtcccagaggattatgagaygaagatagtttatataagcactga

SEQ ID NO: 18027 - DNA, 50 bp, homo sapien
ggtgaagcactgggacccttggaaargaaataaatcgtgtttatgccctt

SEQ ID NO: 18028 - DNA, 50 bp, homo sapien
tcaggggagagtgtgtgcatgcaccractattattccaggagcattagga

SEQ ID NO: 18029 - DNA, 50 bp, homo sapien
gagcacagaggatttttaggatagcraaaatacctggtatgatagtataa

SEQ ID NO: 18030 - DNA, 50 bp, homo sapien
taggtttgaagtttgggttttctctyaacagcatgaaaatgacaatggca

SEQ ID NO: 18031 - DNA, 50 bp, homo sapien
acttgaagacacaaaagcagtcaacygagctataaaggaaaactaaagaa

SEQ ID NO: 18032 - DNA, 50 bp, homo sapien
tagcaggtgacaaatgcatcagccaraagttaaatgtcctagttaattaa

SEQ ID NO: 18033 - DNA, 50 bp, homo sapien
tttggggcaattccttactcagaaayttagatgcttgtcagagggagaag

SEQ ID NO: 18034 - DNA, 50 bp, homo sapien
cagtcgacccaccacaccctctccaktacagtttagttggatagactaca

SEQ ID NO: 18035 - DNA, 50 bp, homo sapien
agtgatataaaagctctaaagccaasataaaacatatggctaggacttat

SEQ ID NO: 18036 - DNA, 50 bp, homo sapien
catcaccctgtaagaactttattcaracttgctggggaagaagttaccaa

SEQ ID NO: 18037 - DNA, 50 bp, homo sapien
tcaggctgtaaatataagaaccaggratgtatttaataaaaaaaaaagag

SEQ ID NO: 18038 - DNA, 50 bp, homo sapien
tggtgtagaaatgccaatctattcaractctcttagaactcctggaaact

SEQ ID NO: 18039 - DNA, 50 bp, homo sapien
ttctcttatcctgttaccctgaagayaatcactgctaattatctcagtcc

SEQ ID NO: 18040 - DNA, 50 bp, homo sapien
aagagtattctatggattatagttayggacatgatttagacaggtgctag

SEQ ID NO: 18041 - DNA, 50 bp, homo sapien
cagccctgccccagacatgtgacacmatttgacgagttttatgcagaaac

SEQ ID NO: 18042 - DNA, 50 bp, homo sapien
tcttcctgttttaatatctatgctaygcctatttttttgtaggatgttca

SEQ ID NO: 18043 - DNA, 50 bp, homo sapien
aaattagtggtatgtgtgaaaataastagcaggcttgggggacctgacaa

SEQ ID NO: 18044 - DNA, 50 bp, homo sapien
caatctaagcaactagagagctatcygaccttagtgaggttgctataaaa

SEQ ID NO: 18045 - DNA, 50 bp, homo sapien
cccgaataaatatttctccaaagggracataaaaatggataataggtata

SEQ ID NO: 18046 - DNA, 50 bp, homo sapien
ctgcttcagctctgcccggtaattgycaaggcttgcaaaatttgagagtc

SEQ ID NO: 18047 - DNA, 50 bp, homo sapien
acactgaatagctgtcatccccttcraggaattttcatagtatgagttag

SEQ ID NO: 18048 - DNA, 50 bp, homo sapien
attataggaagaacataatatctgaygtcacgtaaattcagatttgaagg

SEQ ID NO: 18049 - DNA, 50 bp, homo sapien
attactcttgttaagtcaccaacgayctcgaccttgccagatccaaagtt

SEQ ID NO: 18050 - DNA, 50 bp, homo sapien
gttcttggcacatagtacatgctcartatattcatcgttattttcactcc

SEQ ID NO: 18051 - DNA, 50 bp, homo sapien
gtttaatgatatgggtccatacaacraaggagtatgttctaatgcctgga

SEQ ID NO: 18052 - DNA, 50 bp, homo sapien
cttgaaggaatccgtggaggcttacyggtctgtatgaagccagtctaggg

SEQ ID NO: 18053 - DNA, 50 bp, homo sapien
agacccagccagggcttgtcagggayggagagttcaaaggaaggaatctt

SEQ ID NO: 18054 - DNA, 50 bp, homo sapien
ttctcttctgtaaaagaggcacaacratagtaaagagttgcctagagtaa

SEQ ID NO: 18055 - DNA, 50 bp, homo sapien
cctgctgaggagaggaccttgataamagagtacatattcaggaatgacag

SEQ ID NO: 18056 - DNA, 50 bp, homo sapien
gttggccgattggtagtggtcagtcyctgattaggaatagaagtgatcag

SEQ ID NO: 18057 - DNA, 50 bp, homo sapien
tgaaattaatatctgtgacctcatawcatatttgacttgagacctaaaca

SEQ ID NO: 18058 - DNA, 50 bp, homo sapien
atctttctctgatccaccagagaaayggtcacgtgatctattcatgctag

SEQ ID NO: 18059 - DNA, 50 bp, homo sapien
aatacctctgagatcaaggaaactayagtcattctgatctcttgatcaag

SEQ ID NO: 18060 - DNA, 50 bp, homo sapien
tgatcatttacctcctaaatttttaygtccaagctgttctttagatatct

SEQ ID NO: 18061 - DNA, 50 bp, homo sapien
ggctgataatttttggccttagttcyaggtagattaaaaagctgctagct

SEQ ID NO: 18062 - DNA, 50 bp, homo sapien
acccgaagaggaagatggtaaactartaagggccagagacaaaagatccc

SEQ ID NO: 18063 - DNA, 50 bp, homo sapien
atccagcatatcctacagttggttcmaagagcagagaaaaggagaagcta

SEQ ID NO: 18064 - DNA, 50 bp, homo sapien
gaggaagcatgaatacacaggtagaygaagcaaactgcaactgcacattc

SEQ ID NO: 18065 - DNA, 50 bp, homo sapien
gattgttccttcagaaagaaaaagartcttcaggcttagaaagctgtgtc

SEQ ID NO: 18066 - DNA, 50 bp, homo sapien
tgagctcgtcaccacatctgtaacaygggacaaataacagtacctggcta

SEQ ID NO: 18067 - DNA, 50 bp, homo sapien
tacatggttttcattttaacctacamtatatgtctggctatagcagtttt

SEQ ID NO: 18068 - DNA, 50 bp, homo sapien
cgagagtcttcaagatgaccatggayagaaaatgtacagtccatagcatg

SEQ ID NO: 18069 - DNA, 50 bp, homo sapien
agttatgtgcatatcctgaagtagayaaattcatatgaaaaaggaaatgt

SEQ ID NO: 18070 - DNA, 50 bp, homo sapien
gaatggtaaataccgagaattgtgcyaactgtaaacctgagtaaatgatt

SEQ ID NO: 18071 - DNA, 50 bp, homo sapien
tgtatacagaataacttgatactcakggattatttcaactgtttcttgtt

SEQ ID NO: 18072 - DNA, 50 bp, homo sapien
ttacgacctcatttttaaaataagargagctgtccttgcagggcacctcc

SEQ ID NO: 18073 - DNA, 50 bp, homo sapien
gaaattcagggttcagacccttcagratgggaggattgttcttttgacaa

SEQ ID NO: 18074 - DNA, 50 bp, homo sapien
ataaagagaaccctggttagtctccragagtgaagattggtggggaacca

SEQ ID NO: 18075 - DNA, 50 bp, homo sapien
ctatgatgaatgaaaattttactgaygatatggaggatgaattagagaga

SEQ ID NO: 18076 - DNA, 50 bp, homo sapien
agctaattagtaataataatcctgawcctacgcataagactgaattacta

SEQ ID NO: 18077 - DNA, 50 bp, homo sapien
gcctggcacacagaaggtacctaatyaatgcttattggatcactgggtag

SEQ ID NO: 18078 - DNA, 50 bp, homo sapien
agttgatactacacatttttgagtcyaataaaagagagaaactagaaagc

SEQ ID NO: 18079 - DNA, 50 bp, homo sapien
ggcttccatatacatatgagtagaarttcctgtagccagactttggagtt

SEQ ID NO: 18080 - DNA, 50 bp, homo sapien
acactgactgaacacaaccacatgcratgtttccaaacacattggtactg

SEQ ID NO: 18081 - DNA, 50 bp, homo sapien
ccttaagagattgcttcacatactgsaaagaaaaactttatttttaattt

SEQ ID NO: 18082 - DNA, 50 bp, homo sapien
ggttctttgtgtatctgtcacacaasggataaccaatatgactatttggt

SEQ ID NO: 18083 - DNA, 50 bp, homo sapien
gacatcaaggatcttagaaacacaaygaaatctcaagacattaaaattga

SEQ ID NO: 18084 - DNA, 50 bp, homo sapien
cagaggagtagattcaggtgtcagayatttgcataaaataccaattgctc

SEQ ID NO: 18085 - DNA, 50 bp, homo sapien
atcttttagtgtagtttatctgaaayagagagtatgttgaaaggagtaat

SEQ ID NO: 18086 - DNA, 50 bp, homo sapien
tgtgcttcttagaatcagtgagatayggtatttctgtacatccctgaggg

SEQ ID NO: 18087 - DNA, 50 bp, homo sapien
gtcaatgtgagaaacgacaaatcaayggaaagtcctgaaatggctgactg

SEQ ID NO: 18088 - DNA, 50 bp, homo sapien
cacccagtgcactttgtaggtggccyatctatatttacagggcatgttgc

SEQ ID NO: 18089 - DNA, 50 bp, homo sapien
tggagaagttgaaagaataatagaayagcatgataaatacccatataccc

SEQ ID NO: 18090 - DNA, 50 bp, homo sapien
gagtccaattctgctacacctttccrcccttccacggagcaaacctcatc

SEQ ID NO: 18091 - DNA, 50 bp, homo sapien
agataccaacccttcggtgaaagccragatgttaggcatttttttttttt

SEQ ID NO: 18092 - DNA, 50 bp, homo sapien
ttttttaaaaactaggttgttaagakattttacatactggaacctaaccc

SEQ ID NO: 18093 - DNA, 50 bp, homo sapien
tctgaccttgcactgtgtccagttayctactaatacccatactggtcatt

SEQ ID NO: 18094 - DNA, 50 bp, homo sapien
catatatccaccttggatgtatatcyctgttgaagaagttggtatcttta

SEQ ID NO: 18095 - DNA, 50 bp, homo sapien
agtggtaacaatgacatttcaatcaygtggacctgtttacagctgagctc

SEQ ID NO: 18096 - DNA, 50 bp, homo sapien
gtcatgaggattgttttctggtctaygaagtgtatttggaatgaaagcac

SEQ ID NO: 18097 - DNA, 50 bp, homo sapien
aagtggagcagttgatcaaaaaacaygaggaagaagaagccaaagctgag

SEQ ID NO: 18098 - DNA, 50 bp, homo sapien
gcagaaaagtttggaagattaactartactatctaaatgtgcagatgaag

SEQ ID NO: 18099 - DNA, 50 bp, homo sapien
cttctatatacaaccaacatgctatsaagttagaaaccaatggtggtttt

SEQ ID NO: 18100 - DNA, 50 bp, homo sapien
gaggaaactcacatactgtttgataraagtaggggatatgagtatttcct

SEQ ID NO: 18101 - DNA, 50 bp, homo sapien
aaacccagtatgacacggacagagargaatttatgtgagagggaaaagag

SEQ ID NO: 18102 - DNA, 50 bp, homo sapien
gacactaatacgcaagagctaagaargataactcaatcttctttttctga

SEQ ID NO: 18103 - DNA, 50 bp, homo sapien
tctggattattatgagagattttcaraaatggtctaatggtgttggcttg

SEQ ID NO: 18104 - DNA, 50 bp, homo sapien
gctcattggttccaggactttgtcarggattaagaacaagattatcgatc

SEQ ID NO: 18105 - DNA, 50 bp, homo sapien
gaaatgtctctcgtagaaatttatgwcaagccatgatgagagtgtagctt

SEQ ID NO: 18106 - DNA, 50 bp, homo sapien
gccctggactcctaaataccctgcasagtggtctaacccttgtgatgctt

SEQ ID NO: 18107 - DNA, 50 bp, homo sapien
caagtattcatgtcaggcaaaaaacrgctatattctgttgaaaaggggag

SEQ ID NO: 18108 - DNA, 50 bp, homo sapien
ctgcctattcctgaaccataatcaarttattgtagctttgaatcagtatt

SEQ ID NO: 18109 - DNA, 50 bp, homo sapien
gatgcatctctgtcaatggtaacaarcattctagaaacctctttcaatcc

SEQ ID NO: 18110 - DNA, 50 bp, homo sapien
agcccgtctccttctcccagtaatgyattcaatgtcaaagcagaaaagtt

SEQ ID NO: 18111 - DNA, 50 bp, homo sapien
ttaataaccacaataaccacaattayagcttccatgtatgaactacttcc

SEQ ID NO: 18112 - DNA, 50 bp, homo sapien
tattaaatttgcttattttcaaaaaygtcttggagaccagctctcaggtt

SEQ ID NO: 18113 - DNA, 50 bp, homo sapien
caactttccctcatgaaatggacttyaaggcattcccaaaagatagaggg

SEQ ID NO: 18114 - DNA, 32 bp, homo sapien
atcctgaaagtgcaagrcctgggtggattctg

SEQ ID NO: 18115 - DNA, 50 bp, homo sapien
tcattacttttctataatgttagcayatgaagacttaacattacaaataa

SEQ ID NO: 18116 - DNA, 50 bp, homo sapien
aagaacaggcttaatctcactttacyggattcttctacataaaaatataa

SEQ ID NO: 18117 - DNA, 50 bp, homo sapien
tgaaacaactgaaggctattgttacygaacctaaaactgagaagccagag

SEQ ID NO: 18118 - DNA, 50 bp, homo sapien
gactacagactcagatacctggaatraaccctggtcgcccgcccttcctc

SEQ ID NO: 18119 - DNA, 50 bp, homo sapien
tcttccccagataaatcacgcccacraggtagcaccaacaatatgtagtc

SEQ ID NO: 18120 - DNA, 50 bp, homo sapien
cggcgggttttcgatgcttgtcttcyactgaggtcaccaggtctgagctc

SEQ ID NO: 18121 - DNA, 50 bp, homo sapien
ttcctgttctaaaattaactggcaartcattctagcatctcccttcagat

SEQ ID NO: 18122 - DNA, 50 bp, homo sapien
aaaaatgtgctctagagggaactccyatgtggtgatcagtcattctatgc

SEQ ID NO: 18123 - DNA, 50 bp, homo sapien
attctgatgatcagagaatgttaagraaaatacaacttctattgccaggg

SEQ ID NO: 18124 - DNA, 50 bp, homo sapien
tcttaaaaaagtctgtgtataaaaawatatagaacagggacacctcagaa

SEQ ID NO: 18125 - DNA, 50 bp, homo sapien
aaatggtttttaagtggttgaagaaragaaatctatagaagaatgatatt

SEQ ID NO: 18126 - DNA, 50 bp, homo sapien
attgtttttcttggtaatggactcgsccagttgaatgttgcaaacatatt

SEQ ID NO: 18127 - DNA, 50 bp, homo sapien
taccagctttacaatcaattgtggaytcactaagacatgaaatgaaaact

SEQ ID NO: 18128 - DNA, 50 bp, homo sapien
gcaatttatcatataccttgattaaytgagagaacaaccaaccatactat

SEQ ID NO: 18129 - DNA, 50 bp, homo sapien
tctctggggaaggcagttctggatasatttcctttgcctcctcagaagcc

SEQ ID NO: 18130 - DNA, 50 bp, homo sapien
atgaaggctaaaattatatggataaraggacaaaattcctcaagactttg

SEQ ID NO: 18131 - DNA, 50 bp, homo sapien
ttggtgcaatagtgaaatttgaaggrcacaaactccttgcctagcttggc

SEQ ID NO: 18132 - DNA, 50 bp, homo sapien
caccaacctgctgccacccatgtcartctcaaaacctgcagctccaacgc

SEQ ID NO: 18133 - DNA, 50 bp, homo sapien
caccagatttccttggagatgattcrgaaatgctacatagagaaatggat

SEQ ID NO: 18134 - DNA, 50 bp, homo sapien
tgccgtgtattagttcacatagtacwcagaataatatataatcatcctat

SEQ ID NO: 18135 - DNA, 50 bp, homo sapien
aaattgcagataattctaatatgcasctgagagttgagaaccactgggag

SEQ ID NO: 18136 - DNA, 50 bp, homo sapien
tcagtagcccttgataaaagtcgacrgagaagtaataccctttagggaca

SEQ ID NO: 18137 - DNA, 50 bp, homo sapien
tattaatactttgcttatttcaaaaygctttagacttactaaaacttact

SEQ ID NO: 18138 - DNA, 50 bp, homo sapien
tgatttcaagtatatggcaggaagartataggttatatgcaaatactatc

SEQ ID NO: 18139 - DNA, 50 bp, homo sapien
ttcaactgagagaaaaagcgtttccrcccacaagtaacctaagatgtggt

SEQ ID NO: 18140 - DNA, 50 bp, homo sapien
aaccagtcctgttgtagcccttgtarcatctgctgtagtgatctggtttg

SEQ ID NO: 18141 - DNA, 50 bp, homo sapien
aggaaaatagtctcttgacacattawcccttttcattatttctccattac

SEQ ID NO: 18142 - DNA, 50 bp, homo sapien
tatttagaaattttaccttatcaacmatatttcttctttctacatttata

SEQ ID NO: 18143 - DNA, 50 bp, homo sapien
aaaattgtctaagaatgatcttctawgggttgttgtgagagctgagtgtg

SEQ ID NO: 18144 - DNA, 50 bp, homo sapien
atcctgataacattactttgccacaycacagaaccaagggtttcttctgg

SEQ ID NO: 18145 - DNA, 50 bp, homo sapien
acacaccgagtggagaacaagagaawccttttaggaacaaatagcttatt

SEQ ID NO: 18146 - DNA, 50 bp, homo sapien
gaatgcaccaagaatggaccaggatwacaactctgatgatgcagagaggt

SEQ ID NO: 18147 - DNA, 50 bp, homo sapien
gccaggatgaaggcaggtggattaasgaactaaccacagtgaaacagatg

SEQ ID NO: 18148 - DNA, 50 bp, homo sapien
ttttgtgtcccacctcttggctgaartagcctcctttattttctgtactt

SEQ ID NO: 18149 - DNA, 50 bp, homo sapien
tcattaatgttttacatcatttacartctagtcatcaatttgttcagtgt

SEQ ID NO: 18150 - DNA, 50 bp, homo sapien
caaaataaaatttacttatgtctaartctttgttacagcaccaaactgga

SEQ ID NO: 18151 - DNA, 50 bp, homo sapien
aaattcacctaaaaatggtcagaaarttggaactgaccttcagtaaaaac

SEQ ID NO: 18152 - DNA, 50 bp, homo sapien
aagcaaaaccttaccgagttgtgaayctggaacagccattgtgcaagcca

SEQ ID NO: 18153 - DNA, 50 bp, homo sapien
ggaaaataatcatagtgattcataargaaacatactgtaacaacatcaag

SEQ ID NO: 18154 - DNA, 50 bp, homo sapien
caataaataaacgtaggaaccaagaraggtaaatagaatgtagaaactga

SEQ ID NO: 18155 - DNA, 50 bp, homo sapien
gacatgagccaccatgtctggcccamagtttaatttgtgtgtgcgacata

SEQ ID NO: 18156 - DNA, 50 bp, homo sapien
cccgcattccgtgcatactcctcaayggtccaagaaggttggccccgctt

SEQ ID NO: 18157 - DNA, 50 bp, homo sapien
aggaaaaaccagagtaaaatcaatcracagaagcaatgttggttaagggt

SEQ ID NO: 18158 - DNA, 50 bp, homo sapien
ggtagcaaagtgcagttacttccagscaaatcaaaagtatgaaagcataa

SEQ ID NO: 18159 - DNA, 50 bp, homo sapien
atgaacacaattgaattatagtcatyaggttggaagggacgcgagagctc

SEQ ID NO: 18160 - DNA, 50 bp, homo sapien
tgataggagtgaagatggcttagaaycagagtatggcagccctttgatgc

SEQ ID NO: 18161 - DNA, 50 bp, homo sapien
aaccttgaatcattggtgttggcccyatattgttatttatttgaattaaa

SEQ ID NO: 18162 - DNA, 50 bp, homo sapien
gaaccatttttcttcaaaagttgaaytaggattgaaccagagtaggaagc

SEQ ID NO: 18163 - DNA, 50 bp, homo sapien
ttctttccaaactctagctggtactraaagatgttcttgggtttgtttgt

SEQ ID NO: 18164 - DNA, 50 bp, homo sapien
caacatcataggcatcttagatctayctaggtcaataattatagctcaag

SEQ ID NO: 18165 - DNA, 50 bp, homo sapien
gatagaatcaaaatagcgtttgaaayagagagatgagaggagtgctgcat

SEQ ID NO: 18166 - DNA, 50 bp, homo sapien
ctcgaacaggcatccacactaagaargtacactacacctctaaaaggaat

SEQ ID NO: 18167 - DNA, 50 bp, homo sapien
tcaccatgtatatgcaggcagcaaarttgtaaggaaaatagaggaatgga

SEQ ID NO: 18168 - DNA, 50 bp, homo sapien
attttattatgcttttatcacctaartgtgtatctccagcactgtgcctc

SEQ ID NO: 18169 - DNA, 50 bp, homo sapien
tcctaatccctggaatttatgaataygataacttacatgccaaaagtgtc

SEQ ID NO: 18170 - DNA, 50 bp, homo sapien
cagctggtcctgcctcttgcacttaygattgcacacactattgtctgcca

SEQ ID NO: 18171 - DNA, 50 bp, homo sapien
attaaattagtgaagatggtgattakatttgacacggagagaaagtggaa

SEQ ID NO: 18172 - DNA, 50 bp, homo sapien
gcctggtgaggaggtaccacccagcygcgagagttaattttctggcacag

SEQ ID NO: 18173 - DNA, 50 bp, homo sapien
tatcggccctggtgatcttacccgarcatgcaataactatttccatgcat

SEQ ID NO: 18174 - DNA, 50 bp, homo sapien
aatttcttcgtgactccattatataratcttcaagagttacagataactg

SEQ ID NO: 18175 - DNA, 50 bp, homo sapien
acagtaaacataagatttgtgtatcygaggcagactgattatttacctgc

SEQ ID NO: 18176 - DNA, 50 bp, homo sapien
tgattcgtgcataggaatgtcctaaycctttggctgtttctcaaattttg

SEQ ID NO: 18177 - DNA, 50 bp, homo sapien
gagaaaagaggaaggggatggagagwcagaaacggagacttgttgtcaat

SEQ ID NO: 18178 - DNA, 50 bp, homo sapien
gctttataatcctttattggggcctkaatcattttggattggtttgcagt

SEQ ID NO: 18179 - DNA, 50 bp, homo sapien
atctttagatccttagcacctaatgyagtagtgcctgatgctgtgtattt

SEQ ID NO: 18180 - DNA, 50 bp, homo sapien
ttcattttttaacgaacttattttawccagtcttcttgtatactataaaa

SEQ ID NO: 18181 - DNA, 50 bp, homo sapien
gtgaaagtgttttctgtccgtggaayatcctttgatgctgcagcaacaag

SEQ ID NO: 18182 - DNA, 50 bp, homo sapien
cagcagttctactcctagatatgccyaatatagctgcatatcacatgtgc

SEQ ID NO: 18183 - DNA, 50 bp, homo sapien
tatcttttttctccacatcctctaaygactaataaaatgtggctttcatt

SEQ ID NO: 18184 - DNA, 50 bp, homo sapien
ctctgggcttagactagacagaaccmatttatgtgatatgacagaagaga

SEQ ID NO: 18185 - DNA, 50 bp, homo sapien
tttcaattttttcttttacgactaaygctttttgtgtcttgtttaagaaa

SEQ ID NO: 18186 - DNA, 50 bp, homo sapien
cacgtaaactactcgtgcacagctgragataccatttatgctctgtggcg

SEQ ID NO: 18187 - DNA, 50 bp, homo sapien
caatgcaatttcaatattctttgctyaaaatgatctagaatctttaaaaa

SEQ ID NO: 18188 - DNA, 50 bp, homo sapien
acaagcttctttaaatctggggtagrataaatattccatggattgccttt

SEQ ID NO: 18189 - DNA, 50 bp, homo sapien
caaagctagaaatgaggtcaagccayaaaaaccatgcttttcccattaaa

SEQ ID NO: 18190 - DNA, 50 bp, homo sapien
gggaaccagagaggctgttgttgacyggaggagcactggaactggaactc

SEQ ID NO: 18191 - DNA, 50 bp, homo sapien
caaaaatttgaatgaccagagagcckgaaacattggacgattttagccaa

SEQ ID NO: 18192 - DNA, 50 bp, homo sapien
tgtcctccaactgtttttagctctaygtggaaaatccaccaaatgatctc

SEQ ID NO: 18193 - DNA, 50 bp, homo sapien
ctggcccaaaaccagtcagattttayagttggatggtaggtttctttact

SEQ ID NO: 18194 - DNA, 50 bp, homo sapien
tcccaccaaaaaattgtttaagtgakgttaattgagtcctgggaaagttt

SEQ ID NO: 18195 - DNA, 50 bp, homo sapien
ctggaataacatctgctgtgtacaaygtagaccgtaatttatttatctag

SEQ ID NO: 18196 - DNA, 50 bp, homo sapien
tgtgggagagacactaggtagtgtaygtcagagcaaatagggaacagttg

SEQ ID NO: 18197 - DNA, 50 bp, homo sapien
ttattgcaaaactagaaaattactaytaaatgttctaacatcaactggag

SEQ ID NO: 18198 - DNA, 50 bp, homo sapien
atagtgataaaccaactaacataaamtccaatctgagatttcttaccctc

SEQ ID NO: 18199 - DNA, 50 bp, homo sapien
atggaggctgaaggattgaaggagaygctttgcttatccaaccaaacccc

SEQ ID NO: 18200 - DNA, 50 bp, homo sapien
gcaacacagcacagctgctttaccaraacgtagccaggctgctttacgca

SEQ ID NO: 18201 - DNA, 50 bp, homo sapien
tgatctatttggccaccaaggttcaygctgtttaaatgatttcagattta

SEQ ID NO: 18202 - DNA, 50 bp, homo sapien
tctggtgttccctgcctcgtttaccrctctttccccatactttggtctga

SEQ ID NO: 18203 - DNA, 50 bp, homo sapien
aatcatttcttagttgtaacttggawcatcttcttttcctggtaattaac

SEQ ID NO: 18204 - DNA, 50 bp, homo sapien
aatatttatacacctcggaatgggaytaagggaagctggtagcccactga

SEQ ID NO: 18205 - DNA, 50 bp, homo sapien
aaagactttgcagggaagacctatgraaagggtgagaaagggcacaagtt

SEQ ID NO: 18206 - DNA, 50 bp, homo sapien
tttggacattgccgtatgaagacacmattttgggtcctcggtgactggta

SEQ ID NO: 18207 - DNA, 50 bp, homo sapien
aggcagagtttcaggtggtataaatsaagcccagttgatagtagttggag

SEQ ID NO: 18208 - DNA, 50 bp, homo sapien
caataagaaacttgcatctgtgtgamcccttttctgaaaaaggtcatttt

SEQ ID NO: 18209 - DNA, 50 bp, homo sapien
gcccagggcagtgtggaatacttaawagataccaaatcacctccaatctt

SEQ ID NO: 18210 - DNA, 50 bp, homo sapien
acacttgtgtacaactcaaaggaatwattaatcaccttggcaattacttc

SEQ ID NO: 18211 - DNA, 50 bp, homo sapien
acaaaacacccagtctgactttcagragaaataaaatgaacctggataaa

SEQ ID NO: 18212 - DNA, 50 bp, homo sapien
atgacaggctagtaaaccactaaatracctctaacagttgtttaaataac

SEQ ID NO: 18213 - DNA, 50 bp, homo sapien
cagaagcagattgttcagcctgacarcattaatagatggattggaggtaa

SEQ ID NO: 18214 - DNA, 50 bp, homo sapien
cctgatattgttactagtcgagatayagaagatgaagacataatgtgaat

SEQ ID NO: 18215 - DNA, 50 bp, homo sapien
cttagagaattaatatctaccctgaraaaacagaagtggtttcaactaga

SEQ ID NO: 18216 - DNA, 50 bp, homo sapien
aaaaacagactacattctatctttaycttgttctagaccgtgaataccct

SEQ ID NO: 18217 - DNA, 50 bp, homo sapien
aatgtgggaaacttgtgacattatamaactggtgaaacacacatcataaa

SEQ ID NO: 18218 - DNA, 50 bp, homo sapien
caataagatcttgtagaaacaaggtraaattcgatctaacacattccagg

SEQ ID NO: 18219 - DNA, 50 bp, homo sapien
tggctctgtgatacaaagagccttaraattaattgagtggaccagatggt

SEQ ID NO: 18220 - DNA, 50 bp, homo sapien
acatttctattcaatgggcatttacrctggatacttactctcaaggttcc

SEQ ID NO: 18221 - DNA, 50 bp, homo sapien
tttgcctgactttgaaatactgagamctaccctcaggcttgagtgctgaa

SEQ ID NO: 18222 - DNA, 50 bp, homo sapien
ctccgtctcaaaatatatatatatgycaaatcaaatagaattcaacaggt

SEQ ID NO: 18223 - DNA, 50 bp, homo sapien
atgacataaatacatacaagacacasaactaaaatgtcatgttattaaca

SEQ ID NO: 18224 - DNA, 50 bp, homo sapien
catttttatgcagtggcattgcccasaaatggtttcattcaacactaccc

SEQ ID NO: 18225 - DNA, 50 bp, homo sapien
actcaaggagaaggaattacacaacrgtatgaatatcaggaagcagggat

SEQ ID NO: 18226 - DNA, 50 bp, homo sapien
taatgttaaaatcaaggtagctaagyaatcgagttatttggtgtttgcgc

SEQ ID NO: 18227 - DNA, 50 bp, homo sapien
gatgacagactttcagttaaactaayaagtaagtcaactcatggtcaaca

SEQ ID NO: 18228 - DNA, 50 bp, homo sapien
taggaacaagtaggggattgaataaygcctaagagatatcaggcctttag

SEQ ID NO: 18229 - DNA, 50 bp, homo sapien
catatgtcttcagggcttactatggmcacctgtgtagaatccagactcta

SEQ ID NO: 18230 - DNA, 50 bp, homo sapien
tcctcccaagcttaaatcacaggaaytggaatcagaagacagaagaatgg

SEQ ID NO: 18231 - DNA, 50 bp, homo sapien
cagcatttatgtgctttagtatcctyacctcttgacatgaggatgtgaaa

SEQ ID NO: 18232 - DNA, 50 bp, homo sapien
tttattaacttatttaattatcacarctattctgtatggagcactctgtt

SEQ ID NO: 18233 - DNA, 50 bp, homo sapien
acaatttttctctctgtcattattcycttgagcatattgggttgggtagc

SEQ ID NO: 18234 - DNA, 50 bp, homo sapien
ctttctcttatagatctttaacctgrattttcatcatgctgttttaggag

SEQ ID NO: 18235 - DNA, 50 bp, homo sapien
taacaggtgctttagagacctaatayagaaagagtttagattgattatag

SEQ ID NO: 18236 - DNA, 50 bp, homo sapien
attgtgggaaaactaattactgtaamtccaaataaagtgtgaagttttag

SEQ ID NO: 18237 - DNA, 50 bp, homo sapien
tttagatcctgaatgcttgacttaayattactagttagatcctgaatgct

SEQ ID NO: 18238 - DNA, 50 bp, homo sapien
tatcatgtcctgctcagaaccttaayctagagctgccaatcattagcttc

SEQ ID NO: 18239 - DNA, 50 bp, homo sapien
tatccggttggataatggaaccctgsattaggtagataaccctgggtggg

SEQ ID NO: 18240 - DNA, 50 bp, homo sapien
agctctggtttccccagctgtaaaaytgcaatgataacagcttacctctg

SEQ ID NO: 18241 - DNA, 50 bp, homo sapien
atgtttactcttcttgttgtaaccaraagtaaagaataactgaggacaaa

SEQ ID NO: 18242 - DNA, 50 bp, homo sapien
tataccattcattccacggtagtcartctgttacattgtttctatcagag

SEQ ID NO: 18243 - DNA, 50 bp, homo sapien
tgaagaggagtcttgctgtccaagaragattaaaatatatcactctgtac

SEQ ID NO: 18244 - DNA, 50 bp, homo sapien
gcttcatgaaagtgtactaccttcaraatcctagtgggatatatttcata

SEQ ID NO: 18245 - DNA, 50 bp, homo sapien
cttatcctatctccattgcaaaccastatcacaaagaaagatcatccagt

SEQ ID NO: 18246 - DNA, 50 bp, homo sapien
ctcatacttgctggcttcttacaaayacaaacaggacaaaagtaagtgtg

SEQ ID NO: 18247 - DNA, 50 bp, homo sapien
atagtctcaggagagattcttctgaragtgaaatccctgacattcaggct

SEQ ID NO: 18248 - DNA, 50 bp, homo sapien
tgaactctgaaaagactcagtatgcyaatcaccaccacattccagccgct

SEQ ID NO: 18249 - DNA, 50 bp, homo sapien
actggtgtggaatgagaaaggtagaragcctggaacaagaattaaagtgt

SEQ ID NO: 18250 - DNA, 50 bp, homo sapien
tttaaaaatctgtgcttaccaggaawttaaacctgtgtggcataaaatta

SEQ ID NO: 18251 - DNA, 50 bp, homo sapien
cttttttaaaggtaacacaagccaawcttacacaatttgacaagcaatag

SEQ ID NO: 18252 - DNA, 50 bp, homo sapien
agcttaataagctgatatgtacttcraatttatatgcttaaatgtacact

SEQ ID NO: 18253 - DNA, 50 bp, homo sapien
tccacgacaaagacagctcaacccaytggaacaaacagactcccaatgtg

SEQ ID NO: 18254 - DNA, 50 bp, homo sapien
ggccaggtctctaccaaatttatacrattccaggaacttattctcttccc

SEQ ID NO: 18255 - DNA, 50 bp, homo sapien
cactgtactatgctgactttgcaaaygaagcaaatgagctccaagtggtg

SEQ ID NO: 18256 - DNA, 50 bp, homo sapien
tcagatatctcatttccaagaataargtaagtacccctttgctctcatgg

SEQ ID NO: 18257 - DNA, 50 bp, homo sapien
ggctatcgtaaagttgttgcaaaaamtcaaaggagaatacagacatttaa

SEQ ID NO: 18258 - DNA, 50 bp, homo sapien
ctcccttaaacagttctaccgacttyaagccatggtgcttgcctaaaccc

SEQ ID NO: 18259 - DNA, 50 bp, homo sapien
aaatcagaaaatcaaagactatggtraattctcatctctgcccataaagg

SEQ ID NO: 18260 - DNA, 50 bp, homo sapien
aaagaacctctggactagtggctgaygtaatcatgacctctgagatgttc

SEQ ID NO: 18261 - DNA, 50 bp, homo sapien
gcgaactgctttactctatcactgcrctaatgctaattagatacacttgc

SEQ ID NO: 18262 - DNA, 50 bp, homo sapien
cagaaggggagaggagagatttaacrcctacatttctgttgacattgcaa

SEQ ID NO: 18263 - DNA, 50 bp, homo sapien
cctacagcctgcaatataatatttaygtagcttccgaaagagacctgcaa

SEQ ID NO: 18264 - DNA, 50 bp, homo sapien
tccttggctattttgcaattcagtamgtttgttgtaggtgtggctcaaaa

SEQ ID NO: 18265 - DNA, 50 bp, homo sapien
ttccaatttaattacgtttatctgcyaatgggtgactctgtttcttgtgg

SEQ ID NO: 18266 - DNA, 50 bp, homo sapien
gctgccatggtggtctttcctttacyaacatttctttccatgcatcttcc

SEQ ID NO: 18267 - DNA, 50 bp, homo sapien
tctttgtagatttcacacttaatcaragagtactggttcaaagcctggta

SEQ ID NO: 18268 - DNA, 50 bp, homo sapien
tctttcctccaagacttctcatatarcttcaatatctatccatttatttg

SEQ ID NO: 18269 - DNA, 50 bp, homo sapien
tgactgagcttggtctacctcattcyatactgtttgccgtctcgtcattg

SEQ ID NO: 18270 - DNA, 50 bp, homo sapien
gctaagtgatggcgtctgaagaaaasaatgattattccagagtatggaag

SEQ ID NO: 18271 - DNA, 50 bp, homo sapien
atacccatttcataggtggaatcaargtacagggagtttaaatgatacaa

SEQ ID NO: 18272 - DNA, 50 bp, homo sapien
ctgataaccttgttagtaggaggacrctcatttgtgcatggaacaagaca

SEQ ID NO: 18273 - DNA, 50 bp, homo sapien
tcatatcagtccaaattctgcataaraaaaaatggttactttcataattg

SEQ ID NO: 18274 - DNA, 50 bp, homo sapien
aggcctgtgcatgaattggggaagcrgaaatgccaactttttaattttaa

SEQ ID NO: 18275 - DNA, 50 bp, homo sapien
tttgtgaatcccacgagtccttgatractataatttcccatagaaaagat

SEQ ID NO: 18276 - DNA, 50 bp, homo sapien
tgccactccttgtatttccaatctgratctttccatgaagcaataatttg

SEQ ID NO: 18277 - DNA, 50 bp, homo sapien
gatggagtctttctgctcttctctcyatccgtggtagcaagcacagcact

SEQ ID NO: 18278 - DNA, 50 bp, homo sapien
aatcctgaaaggagataatgtagcayctgtatggtatcaacaaagaaaca

SEQ ID NO: 18279 - DNA, 50 bp, homo sapien
tcttcacccaggtataaagaatctcygtgacattggctatctcttgaact

SEQ ID NO: 18280 - DNA, 50 bp, homo sapien
aagcttgaaataaaccagatggcaartacaagggaatggtctttttcctc

SEQ ID NO: 18281 - DNA, 50 bp, homo sapien
gacacgggtatcatccaggactttaycatttcgagggattcccacccctc

SEQ ID NO: 18282 - DNA, 50 bp, homo sapien
taagtcactgcatctttcaaggcacrgctaagactcctggaagttgtgct

SEQ ID NO: 18283 - DNA, 50 bp, homo sapien
atgtatttgattaacaaaagacttcrcatgaatcatagatctagcaatta

SEQ ID NO: 18284 - DNA, 50 bp, homo sapien
tgcaaggacacaattcagcccataasagattctcaaaagattgtctgcac

SEQ ID NO: 18285 - DNA, 50 bp, homo sapien
tccaggcaatataaatgacctcccayggaaaaattatatgacacttaaag

SEQ ID NO: 18286 - DNA, 50 bp, homo sapien
ttggtttcattttgatggattcataygggccaaagaaggttcttgatgga

SEQ ID NO: 18287 - DNA, 50 bp, homo sapien
gactcagggagagagcaatgttaaawtggatttattgtctaggacctgag

SEQ ID NO: 18288 - DNA, 50 bp, homo sapien
ctagtggaatgctaagactatacaargcatttaataatacttggctaatt

SEQ ID NO: 18289 - DNA, 50 bp, homo sapien
catttaataatacttggctaatttayattgctctgtccaaggggattttc

SEQ ID NO: 18290 - DNA, 50 bp, homo sapien
gatcatttaaattatattttgtatasatcccaattttaaaatatgataat

SEQ ID NO: 18291 - DNA, 50 bp, homo sapien
tccaagccggcagtggtaagtaaaawaggtaaggctctattttaagcctg

SEQ ID NO: 18292 - DNA, 50 bp, homo sapien
accaacattaaatacctggcttctgyagtttcaccagttccatttttgtg

SEQ ID NO: 18293 - DNA, 50 bp, homo sapien
ttaagcctggctgccaatatgtaaayacgtagaatactggtaaagcagta

SEQ ID NO: 18294 - DNA, 50 bp, homo sapien
ctggttttccctagcctttgtaggcrcttggaactaagcgaggatccaat

SEQ ID NO: 18295 - DNA, 50 bp, homo sapien
ttccatatgcaagttggtgctacacwcagatttgtcataaaaagtcaata

SEQ ID NO: 18296 - DNA, 50 bp, homo sapien
agtacagttttattgggggacaaacsaacaaattatcctatagttctacc

SEQ ID NO: 18297 - DNA, 50 bp, homo sapien
acatacacaactagctcatcttccaygcttgaaagtccaactcgacctct

SEQ ID NO: 18298 - DNA, 50 bp, homo sapien
ccttccctttctacattctccaagayaaagagtccatgttggttttgccc

SEQ ID NO: 18299 - DNA, 50 bp, homo sapien
aagagtttcatgagaatcttgtttayaatcccattgaaaataaagtgctc

SEQ ID NO: 18300 - DNA, 50 bp, homo sapien
ataaggtgggaaaagttatcccagamagagatggatgccatgtagttatg

SEQ ID NO: 18301 - DNA, 50 bp, homo sapien
gttggaaaggtactactctgggaaayatagagctagttatcatctggagc

SEQ ID NO: 18302 - DNA, 50 bp, homo sapien
aaaatgtgaataatcttatgaaggayacagaaaattatacaggacaacat

SEQ ID NO: 18303 - DNA, 50 bp, homo sapien
gcttgtagagaaatactcagtgtcayattttacaacccagtgtgctcctt

SEQ ID NO: 18304 - DNA, 50 bp, homo sapien
gtgcactttggttaattgtaaaaccratcagttccaataaatagctggca

SEQ ID NO: 18305 - DNA, 50 bp, homo sapien
agcggtaagacaataattttctataygcatgcaaggcttagaattgagga

SEQ ID NO: 18306 - DNA, 50 bp, homo sapien
tttagagtttctcttgctttcaaacygtgggctcttataactgctatatc

SEQ ID NO: 18307 - DNA, 50 bp, homo sapien
cacccggcccaatacatgttagcaaygatccacagctaatatcatctcta

SEQ ID NO: 18308 - DNA, 50 bp, homo sapien
tatggttgatccgctctgtgtagccraaataggtgtgatttcctgagtaa

SEQ ID NO: 18309 - DNA, 50 bp, homo sapien
cttgaacttctgattcacatggagaytattcttttaaaattagcctaaat

SEQ ID NO: 18310 - DNA, 50 bp, homo sapien
gtccagcctcctggtaatgccatcaygattatggttgatccgctctgtgt

SEQ ID NO: 18311 - DNA, 50 bp, homo sapien
aagctgtgaattatgaagatattccrctaagtattgtgaggattattgtt

SEQ ID NO: 18312 - DNA, 50 bp, homo sapien
aattaatccaatggtacttaattaaraatatgaatcagaatctcctgaaa

SEQ ID NO: 18313 - DNA, 50 bp, homo sapien
aatttctaggaggaaaggactagaamgggaaggaaatacatatttgtcat

SEQ ID NO: 18314 - DNA, 50 bp, homo sapien
tcagcaattaatttgatcattttaastacactgaagatcgagaaagcccc

SEQ ID NO: 18315 - DNA, 50 bp, homo sapien
gctgtcaatttgtatattggataaamcttaacatttaccaagaaacattc

SEQ ID NO: 18316 - DNA, 50 bp, homo sapien
ctacaacctgtgcaattcaacctaaytccatgtagtgtcaggactacttg

SEQ ID NO: 18317 - DNA, 50 bp, homo sapien
tcaagccctcacttcagtgggctgayggaaatatagccaaagtattttac

SEQ ID NO: 18318 - DNA, 50 bp, homo sapien
tgggaactctgccaaggcacgtaagsccacaaaaggtgatgggcacacct

SEQ ID NO: 18319 - DNA, 50 bp, homo sapien
atgactctggctgaatttgcattaakgatttcctaccagggttgccaagt

SEQ ID NO: 18320 - DNA, 50 bp, homo sapien
tgatttcagccttcaattctccacgkaagctgagcctccatggttttctc

SEQ ID NO: 18321 - DNA, 50 bp, homo sapien
gcattgtgttcctgatcaatagagtwaacaactgacataagactactttc

SEQ ID NO: 18322 - DNA, 50 bp, homo sapien
gtctttgtttgcataaaaataatgamcttggaccaccagaatcccacgta

SEQ ID NO: 18323 - DNA, 50 bp, homo sapien
cctctttcaccatccaaatcttagcratcccttaagtctcacctcctcca

SEQ ID NO: 18324 - DNA, 50 bp, homo sapien
tacaatttatatcaggatgctcaacygtaagctcaagagctaaggaaagt

SEQ ID NO: 18325 - DNA, 50 bp, homo sapien
ggagcatacttcatttaagggtttaycagcttgactgaacaacttgaaaa

SEQ ID NO: 18326 - DNA, 50 bp, homo sapien
taaatctactctacctttaaattagscagcgtactctctaacacatgaag

SEQ ID NO: 18327 - DNA, 50 bp, homo sapien
agtttacttctgcctcttttttctcrcctctaccaaggtaatgatgacca

SEQ ID NO: 18328 - DNA, 50 bp, homo sapien
tgctgctctattctctccaagtgtamgcatcgctgggcttgtcctagaac

SEQ ID NO: 18329 - DNA, 50 bp, homo sapien
agtcctagagagcacatgcacagaaygatcagaataatcactgctttccc

SEQ ID NO: 18330 - DNA, 50 bp, homo sapien
ggtgcacaatctttctactgcaactsacaaacaacagtcaaaagccctat

SEQ ID NO: 18331 - DNA, 50 bp, homo sapien
aaaataaagtctggcttgagaattcracaatattttcaggagattctgat

SEQ ID NO: 18332 - DNA, 50 bp, homo sapien
attgcactccagcctcggcaacggarcgagactgtgtcaaaacaaaacaa

SEQ ID NO: 18333 - DNA, 50 bp, homo sapien
agagataaaaagaagatgagaataarataatatacctgtctaagaataga

SEQ ID NO: 18334 - DNA, 50 bp, homo sapien
ataaaataatatacctgtctaagaayagaacatgcatttgcgacgggtgt

SEQ ID NO: 18335 - DNA, 50 bp, homo sapien
tcataagaaagtgctgttaaagctayggtctgagacaggaaaggtggctg

SEQ ID NO: 18336 - DNA, 50 bp, homo sapien
tactaatgaggcagacttgctttcawctaggcaaagtaagattttgtaac

SEQ ID NO: 18337 - DNA, 50 bp, homo sapien
aattcatttcaaatggagacaggtaygatggatgtgttaagaacctagct

SEQ ID NO: 18338 - DNA, 50 bp, homo sapien
tctcatatcacagcttatcaagttayctcaagttatctcatatcacagct

SEQ ID NO: 18339 - DNA, 50 bp, homo sapien
accagttataaaagtagaaaaacgasaagagctacagaaattatttcact

SEQ ID NO: 18340 - DNA, 50 bp, homo sapien
tttcagagcacctaagggtagaaaayaaccaatgctacttccatgacaaa

SEQ ID NO: 18341 - DNA, 50 bp, homo sapien
atgggcagaagataattggccctcasagaatggggaaggcacaggggtgg

SEQ ID NO: 18342 - DNA, 50 bp, homo sapien
taagctaacttaacctcactttctcyaaagcatatcacacccacggctag

SEQ ID NO: 18343 - DNA, 50 bp, homo sapien
gaggatgggcacagccatgtggaaayacaaagcaaacagaaacctcagga

SEQ ID NO: 18344 - DNA, 50 bp, homo sapien
ccaggattggaacttgggtctaacamcagggctactagaacataggaatt

SEQ ID NO: 18345 - DNA, 50 bp, homo sapien
cctgggggtctcctagttattctaaytgaatctgaagataagattgaaga

SEQ ID NO: 18346 - DNA, 50 bp, homo sapien
taattttaccaggtatggaatcttasgtttgtactaatcgaaaatagctt

SEQ ID NO: 18347 - DNA, 50 bp, homo sapien
ctgagaacacaagaaagatgtataaycaacagagcaagagcctggaggag

SEQ ID NO: 18348 - DNA, 50 bp, homo sapien
ttatttctgaagatcatgagaaactwaaacatgatagaaagattaagaac

SEQ ID NO: 18349 - DNA, 50 bp, homo sapien
tctctacattggtttctctgaaatcrcaaaaagacgatgactggatatat

SEQ ID NO: 18350 - DNA, 50 bp, homo sapien
ggcaacttacatagtttaattaagcrctctgattaaatcaatatgtatcc

SEQ ID NO: 18351 - DNA, 50 bp, homo sapien
tcttaatttcttttcaatcaataacratttctaattcacaaggaaaagga

SEQ ID NO: 18352 - DNA, 50 bp, homo sapien
attattgactgcgctccttccctgcraactctttctatatatatcgtaga

SEQ ID NO: 18353 - DNA, 50 bp, homo sapien
caaatcctgttatggtgaagatcaaytgtatttagcatatgacagctgga

SEQ ID NO: 18354 - DNA, 50 bp, homo sapien
ttccaaatcaccataagattaggtayaactcaaggagagatgcaaataac

SEQ ID NO: 18355 - DNA, 50 bp, homo sapien
cggctggcagtgaatggaatccgacygcttactctcaactccaaaaccca

SEQ ID NO: 18356 - DNA, 50 bp, homo sapien
tgtcgtcttccatctgtttgctgcaygatctgaatgttcctttctgtggt

SEQ ID NO: 18357 - DNA, 50 bp, homo sapien
ccctttccccagacaatgcccaagastaccagtggatcggcctgaacgac

SEQ ID NO: 18358 - DNA, 50 bp, homo sapien
aggatatttgtctgtgtttggcttarctttacaaaatgaaagaaccaaca

SEQ ID NO: 18359 - DNA, 50 bp, homo sapien
ctccacaaatgtttttgaagctcaayagatttgaatattactgaatcagc

SEQ ID NO: 18360 - DNA, 50 bp, homo sapien
tacctgggcttaaacaccttggcaaygggaggagatggatatgtttggtc

SEQ ID NO: 18361 - DNA, 50 bp, homo sapien
atgctatttctgtcatcattagatasctaaaaacctgtgataaacagacc

SEQ ID NO: 18362 - DNA, 50 bp, homo sapien
aacagagcaaaacctcggtctagaasaggtatcctgaagttggagagggt

SEQ ID NO: 18363 - DNA, 50 bp, homo sapien
tgatcttacctgcctggaatccactsagaagccattggcttgatctagaa

SEQ ID NO: 18364 - DNA, 50 bp, homo sapien
aatttatggactctttgtgtattaaraagtagacatgagctcagacttct

SEQ ID NO: 18365 - DNA, 50 bp, homo sapien
aaaatgatcattcttgattctttaamaactgaaattctaccaaattctac

SEQ ID NO: 18366 - DNA, 50 bp, homo sapien
aagctcggcaagtggactttttctcmagctgcgttcaggtcaaatagtgc

SEQ ID NO: 18367 - DNA, 50 bp, homo sapien
tcagagaggggatgcaatgccttgawgagttacagaaagagagagattga

SEQ ID NO: 18368 - DNA, 50 bp, homo sapien
agctgctgtagagtattccttcatcygagcgtggcattgccctgtccagg

SEQ ID NO: 18369 - DNA, 50 bp, homo sapien
atggatagatagatgagggagagaakacggatggatagatagatagatag

SEQ ID NO: 18370 - DNA, 50 bp, homo sapien
gtgggtcagattctacatagaaagaygttaacaagcattaacgagttcat

SEQ ID NO: 18371 - DNA, 50 bp, homo sapien
ataatccctgtatttaatgaactcakaatatgttgcataagaaaaaaaaa

SEQ ID NO: 18372 - DNA, 50 bp, homo sapien
attatccaagaaaaattttagtagcrcttacttatatattatttttaacc

SEQ ID NO: 18373 - DNA, 50 bp, homo sapien
acaggcatccacaaaagtgaactcaktgaggatttcttattgttatcctc

SEQ ID NO: 18374 - DNA, 50 bp, homo sapien
taaataaatattcatgtatacaaagratgttccccaaaagacattttcaa

SEQ ID NO: 18375 - DNA, 50 bp, homo sapien
gattatatgagtatgtctaaataaayattcatgtatacaaaggatgttcc

SEQ ID NO: 18376 - DNA, 50 bp, homo sapien
gcaatcagagatgaatgagacctackgagcaagttcgtgttttaatcagg

SEQ ID NO: 18377 - DNA, 50 bp, homo sapien
gtgtgaccttttacagaaatcttacmatgggctgatggtggtagttgatg

SEQ ID NO: 18378 - DNA, 50 bp, homo sapien
tctggtctatgcattttaaagataasaaaatgtttccatcaccatggtgc

SEQ ID NO: 18379 - DNA, 50 bp, homo sapien
cataagttttgttgtccataagttamagaggagtggcttcagactcagag

SEQ ID NO: 18380 - DNA, 50 bp, homo sapien
agtgcagggaaattccagacaagackgagatctaatttctcaatttctgg

SEQ ID NO: 18381 - DNA, 50 bp, homo sapien
gattgctgcaatgcttagtgactacrgctattcacgtatcccacatgtgt

SEQ ID NO: 18382 - DNA, 50 bp, homo sapien
tcataccttcaatgagtagtacacawactttaccttcctatctgacctac

SEQ ID NO: 18383 - DNA, 50 bp, homo sapien
gacttccctgaaatcataaagactcraactggtttctcgagtcatagttc

SEQ ID NO: 18384 - DNA, 50 bp, homo sapien
atactttaccttcctatctgacctayagtaaaacattttagaagcctttc

SEQ ID NO: 18385 - DNA, 50 bp, homo sapien
aattttattaacttgcattgaaaacmatttacaacctagtctcaaactct

SEQ ID NO: 18386 - DNA, 50 bp, homo sapien
ccctacacagccttgatttgctaagyagaagggaaggcaaggggaagacc

SEQ ID NO: 18387 - DNA, 50 bp, homo sapien
taacagctgctctcaggtgcacatawcgtcatcagagcttcctgaattgt

SEQ ID NO: 18388 - DNA, 50 bp, homo sapien
tcgagtgccctgagcactgagataartatctgagagtcattcacatggtt

SEQ ID NO: 18389 - DNA, 50 bp, homo sapien
gccaaagttactacgaatgtgagcawtactactgatctcggttttatttt

SEQ ID NO: 18390 - DNA, 50 bp, homo sapien
tggtgttattcaaactgaccattcaraagatggattattgcagtaattat

SEQ ID NO: 18391 - DNA, 50 bp, homo sapien
gcctgttttctgtttcttctcacacmgatggagttgcctttgtgtggaaa

SEQ ID NO: 18392 - DNA, 50 bp, homo sapien
agaccacaacattgtaaaaaagacarggcttaacactaggtgtaggttaa

SEQ ID NO: 18393 - DNA, 50 bp, homo sapien
agaataatgaagaatagtgccagcakatatgttagttattagtaatcctt

SEQ ID NO: 18394 - DNA, 50 bp, homo sapien
tatttatcaaacatttactgagaccrcaacattgtaaaaaagacagggct

SEQ ID NO: 18395 - DNA, 50 bp, homo sapien
agctatgaatggattaatctattcaygacccaatcacttcttaaaggccc

SEQ ID NO: 18396 - DNA, 50 bp, homo sapien
gggaagatgctgccatgagaacccaygtagtaatcacacaacagctgctg

SEQ ID NO: 18397 - DNA, 50 bp, homo sapien
tagtcttaaagataaacttttccaayttagtcatgtcctcagctccttat

SEQ ID NO: 18398 - DNA, 50 bp, homo sapien
tagctagtttaagataaagtttatakgcactaaatatgccagatctagga

SEQ ID NO: 18399 - DNA, 50 bp, homo sapien
tgattggctggcagatgaaaaagaayggctcttcacggatagataagagg

SEQ ID NO: 18400 - DNA, 50 bp, homo sapien
gaaagcagccaggatctggtcacaaygcctttatccctctaactaaaagc

SEQ ID NO: 18401 - DNA, 50 bp, homo sapien
aaccaccctaaaacacaaggagaaaygtgactcaggaatgtagcggagcc

SEQ ID NO: 18402 - DNA, 50 bp, homo sapien
tgttgtgtacattttatcactcaaaraacctcagccgtgggtcgggcgca

SEQ ID NO: 18403 - DNA, 50 bp, homo sapien
ggtcatgtggctggttaatcaatgaygaaaatagtatgggaatatatgtg

SEQ ID NO: 18404 - DNA, 50 bp, homo sapien
aacttttctaccttagtgaatttaaygatgtggtgattgtatttaaatga

SEQ ID NO: 18405 - DNA, 50 bp, homo sapien
tggactttccctacctgattcttctsaaggttatatcctcccaaagaacc

SEQ ID NO: 18406 - DNA, 50 bp, homo sapien
cctaaagaagataagagattgaaacwgtctaagaatctatgtatccttag

SEQ ID NO: 18407 - DNA, 50 bp, homo sapien
cttctggcatactaatttcatctaayacaatacagtcagatcctccggat

SEQ ID NO: 18408 - DNA, 50 bp, homo sapien
ctcaaacagccgcctacagagagccrgagagtggcaggagaatgtgttac

SEQ ID NO: 18409 - DNA, 50 bp, homo sapien
aatcatccttcataaatgtggagagsctcacatgtgctgctggtggtaac

SEQ ID NO: 18410 - DNA, 50 bp, homo sapien
gtcttccagaggctgctcctttcaartctcttcctaactggatgcacgtg

SEQ ID NO: 18411 - DNA, 50 bp, homo sapien
acagttatccgtctagaggtttccamgaaataaataaataaaacaacttg

SEQ ID NO: 18412 - DNA, 50 bp, homo sapien
ttattatgtgtttccaaagctaaaamgtttattatttgagatgattactc

SEQ ID NO: 18413 - DNA, 50 bp, homo sapien
gcctggcctgctctcttttcctttayaatctccctgcaaggaaatgctgt

SEQ ID NO: 18414 - DNA, 50 bp, homo sapien
ctcctgacaatgatagttctgttaaratcaaagtcgcaatgtgcccttgg

SEQ ID NO: 18415 - DNA, 50 bp, homo sapien
gtagactcctgtctgaatattcaacragaaatttatcttacattcattcc

SEQ ID NO: 18416 - DNA, 50 bp, homo sapien
caagttctcttttctgttatgcatcrctagtataaaatacaataaaataa

SEQ ID NO: 18417 - DNA, 50 bp, homo sapien
atctttacataaacactgagctctasaagaagaggcttaaatgggggaag

SEQ ID NO: 18418 - DNA, 50 bp, homo sapien
cctgggttttgactgaagcggttgcyaataaagaaatgtgaatgtatttt

SEQ ID NO: 18419 - DNA, 50 bp, homo sapien
ggtgattctcactttgtcctctccawctggttattgcaatcaagccaatt

SEQ ID NO: 18420 - DNA, 50 bp, homo sapien
agtgcaaaagcagcctttgacaataygtagataaatcagtacagcaaagt

SEQ ID NO: 18421 - DNA, 50 bp, homo sapien
agatgatgggtgtttttgactctaargctcattctaaggcagggaagaaa

SEQ ID NO: 18422 - DNA, 50 bp, homo sapien
cttacgctctttataatgtatatgasattcatccacatcagtgcatacat

SEQ ID NO: 18423 - DNA, 50 bp, homo sapien
gtatttttttctatatgtggatatargtataaagaaatttatattaaaat

SEQ ID NO: 18424 - DNA, 50 bp, homo sapien
aatgccctgcacagtagttcaagcakccttatatcactggcttgtaacct

SEQ ID NO: 18425 - DNA, 50 bp, homo sapien
aaggacaaaaaggaccgcattacaaraagatgttaactgttagtactaat

SEQ ID NO: 18426 - DNA, 50 bp, homo sapien
tttccctaggaaactgcatgtcttcmagtatatcattggttgaaaaaggc

SEQ ID NO: 18427 - DNA, 50 bp, homo sapien
gtccctctgcatacaactgaacaaarattacaggaggaccaggatgagat

SEQ ID NO: 18428 - DNA, 50 bp, homo sapien
agggacatattgagttcgaaacatgmagggtagcaaagctgagattctgg

SEQ ID NO: 18429 - DNA, 50 bp, homo sapien
ctgactcctcgtaccagactttctaycaggaaactaatgtgatatacaca

SEQ ID NO: 18430 - DNA, 50 bp, homo sapien
tgatccagaagcttctggaaacaacrgagagatggatatgttttctctta

SEQ ID NO: 18431 - DNA, 50 bp, homo sapien
agaaacatttaggctgttgcccaagraaagaccagaatttcctttagatg

SEQ ID NO: 18432 - DNA, 50 bp, homo sapien
tggcatggtatgctttatgtgacaaytccctggctgtagttaggaccagt

SEQ ID NO: 18433 - DNA, 50 bp, homo sapien
atggaaataaatccaacaagtaggargaatttgagaagcaatagcagtgg

SEQ ID NO: 18434 - DNA, 50 bp, homo sapien
aaatgcaatgtcatgtacaatgactsaaaaaatatacttaggtgaaattt

SEQ ID NO: 18435 - DNA, 50 bp, homo sapien
cagcatgaagcttatcataattaacraactctgctcttccagatttaaaa

SEQ ID NO: 18436 - DNA, 50 bp, homo sapien
agcatgtgtgcctccaggacccggawgtaacaagactgtatcccaaagcc

SEQ ID NO: 18437 - DNA, 50 bp, homo sapien
attcctgagctaattactagaatatsagtcagtaggttctaaatcaaaaa

SEQ ID NO: 18438 - DNA, 50 bp, homo sapien
ccgggtcctggaggcacacatgctakgtatatttgtaacagattcacaca

SEQ ID NO: 18439 - DNA, 50 bp, homo sapien
tgtgttgcagtgggaaggtattcaastgaagaggtggggaaaatattcat

SEQ ID NO: 18440 - DNA, 50 bp, homo sapien
gcagaaatgtgcagaaaagggtacaytcatacatcacttgtaaaaacctg

SEQ ID NO: 18441 - DNA, 50 bp, homo sapien
aaggatctgaaattcattcaacgatraaagtgcttaaaacattctatctt

SEQ ID NO: 18442 - DNA, 50 bp, homo sapien
ttggctgttactaccactatcttaaygactgcagaactgttcaaattata

SEQ ID NO: 18443 - DNA, 50 bp, homo sapien
caatcagctgcttcatccctgtgtcragatccatttctagttagagatca

SEQ ID NO: 18444 - DNA, 50 bp, homo sapien
ttccatccatcttctgcctagagccrggataatcttttccttctcacatg

SEQ ID NO: 18445 - DNA, 50 bp, homo sapien
cctggaaacatggtcacgtctttcaraggaatggaactgactctgctgag

SEQ ID NO: 18446 - DNA, 50 bp, homo sapien
cattttctggcaggcactgcgtgaarcacttggcataaatgacctccata

SEQ ID NO: 18447 - DNA, 50 bp, homo sapien
ttttaaaaacatagcttaaagcacamaacaaaatttcaccagcttataaa

SEQ ID NO: 18448 - DNA, 50 bp, homo sapien
atcagagccatgactactaatcctaygataaaacgattcaaggataaaag

SEQ ID NO: 18449 - DNA, 50 bp, homo sapien
tccctgacaaggacgaggtgcaacastgttagcggaatccatttcatcgc

SEQ ID NO: 18450 - DNA, 50 bp, homo sapien
cgcttttctgactttgtgaaaatgcyatccacttagtgatttggcatgca

SEQ ID NO: 18451 - DNA, 50 bp, homo sapien
ttgaacctctaaaggcccgaggttaratctggattaaatcacgagtgaaa

SEQ ID NO: 18452 - DNA, 50 bp, homo sapien
caagcaggtaacctgtatatcaaacsagatgcatgtcagccaccctgaat

SEQ ID NO: 18453 - DNA, 50 bp, homo sapien
tggagaccctcacaatgtcaaggacyggatttcaatagatttacatatta

SEQ ID NO: 18454 - DNA, 50 bp, homo sapien
caagaggggaacaatatatttgccaygagtcttttctgctgctctttgaa

SEQ ID NO: 18455 - DNA, 50 bp, homo sapien
cattaatttgctttatgtttgactasagaggcttcccataactattagaa

SEQ ID NO: 18456 - DNA, 50 bp, homo sapien
ctccccaacagttaagccaagaaatsaattataaaaatgtacttcagtca

SEQ ID NO: 18457 - DNA, 50 bp, homo sapien
atctcactgaatgatgattggcatayattactacctcacagattatatta

SEQ ID NO: 18458 - DNA, 50 bp, homo sapien
atcttcagaaactcacaataaggtayatttcatcttaactaaggtaagac

SEQ ID NO: 18459 - DNA, 50 bp, homo sapien
gctgccatgcctatcagagtgcctaygccatgataggacctaataaacat

SEQ ID NO: 18460 - DNA, 50 bp, homo sapien
tgaagaaagacagaaaatgagagaaytgaattgtaggtaacagggaaggc

SEQ ID NO: 18461 - DNA, 50 bp, homo sapien
aactccctgcatctgatgtctactaycatgactaatctaaaattgtattt

SEQ ID NO: 18462 - DNA, 50 bp, homo sapien
tgtggtccctctgcaaggaatgagaktcgccctaagatggagaaacattt

SEQ ID NO: 18463 - DNA, 50 bp, homo sapien
cattaatcaagtgtgggaggtgttayaatccctgtactctggagtccaga

SEQ ID NO: 18464 - DNA, 50 bp, homo sapien
aaatatggaaaaaaatggttttgaaytgaatatttgaatatatttacttt

SEQ ID NO: 18465 - DNA, 50 bp, homo sapien
aagaaccaaagcttttcttggcaaayggcctgtcagtcatttcagtttat

SEQ ID NO: 18466 - DNA, 50 bp, homo sapien
gctcattgtgaaatagtaacggaaartaaaatatggcaagctaaatgtta

SEQ ID NO: 18467 - DNA, 50 bp, homo sapien
gagagcccaaagaacctcctaggaarccttgtaaatatcctgcctcagga

SEQ ID NO: 18468 - DNA, 50 bp, homo sapien
cagaagagagctggcaatgttactamgtccaattaagatttataagtgaa

SEQ ID NO: 18469 - DNA, 50 bp, homo sapien
aacctccctttgtatttttttactcyaagaccaattggttaggaatctcc

SEQ ID NO: 18470 - DNA, 50 bp, homo sapien
cgtaaattctctttaatgattctcaygattttgataaaaacaatcactta

SEQ ID NO: 18471 - DNA, 50 bp, homo sapien
gtctgtatttatgtgaaataacaggracgttaaacatgctaccttccatt

SEQ ID NO: 18472 - DNA, 50 bp, homo sapien
atccttttatgagtaaaatgtcatawaaaaataaactccttaatacatgt

SEQ ID NO: 18473 - DNA, 50 bp, homo sapien
ttttttcttgttaagcattaatgtaraagctgaatagttagtgtacatta

SEQ ID NO: 18474 - DNA, 50 bp, homo sapien
tgcccatatttttctttgatgatgtwacaaatgccctgcacagtagttca

SEQ ID NO: 18475 - DNA, 50 bp, homo sapien
aattttggttaatatcttaataccastcttttggcattatactctttaaa

SEQ ID NO: 18476 - DNA, 50 bp, homo sapien
acagggccagcgctggatctcaatayggatgtgctttcaaacttcctatg

SEQ ID NO: 18477 - DNA, 50 bp, homo sapien
tttatgcagaaatccattcatttcayctgttcaaaacatagttatgttta

SEQ ID NO: 18478 - DNA, 50 bp, homo sapien
ttcttcatatttacattatcttggcmagtaatataatgatcatagctaaa

SEQ ID NO: 18479 - DNA, 50 bp, homo sapien
taactcctgtctgatttaggaaaaamtgatggaaagtaagaaaacagaag

SEQ ID NO: 18480 - DNA, 50 bp, homo sapien
acttgtaagtattgtaaacttaccaytaaccattttaggtaacatgtatc

SEQ ID NO: 18481 - DNA, 50 bp, homo sapien
aattaatatgctgtgtccatatgagwaaagtagagagaatgaagcaagaa

SEQ ID NO: 18482 - DNA, 50 bp, homo sapien
agacctccaataactttgacattatmagacgaaatacaatgatctcagtc

SEQ ID NO: 18483 - DNA, 50 bp, homo sapien
ctcactgcatgataacctatacagasaggcaatatccagtagcctcactt

SEQ ID NO: 18484 - DNA, 50 bp, homo sapien
gaacctttgttccctggttctttatragagttctgtcctacttgagttga

SEQ ID NO: 18485 - DNA, 50 bp, homo sapien
tccatcagactttattcacagaagastaagtaagaaggaataataagata

SEQ ID NO: 18486 - DNA, 50 bp, homo sapien
gctgttgtgacggggctgctccaaaraggaataccaatgcaagcaaggag

SEQ ID NO: 18487 - DNA, 50 bp, homo sapien
agtaaataagctctgtttacaagtarcctttagatgaggctgaacctggg

SEQ ID NO: 18488 - DNA, 50 bp, homo sapien
agacagctttgttatgaaaataatakcaagtgggttacgataatcacaca

SEQ ID NO: 18489 - DNA, 50 bp, homo sapien
atttgactgggttaggtcaatagacrgagatttttctgggaacatcagga

SEQ ID NO: 18490 - DNA, 50 bp, homo sapien
ggccactcagcattccactgggacaycaagcctctttttttgttccaggc

SEQ ID NO: 18491 - DNA, 50 bp, homo sapien
acatttccctggcactaccctagtasagtctctgcgtaggagatccacac

SEQ ID NO: 18492 - DNA, 50 bp, homo sapien
cattctttctccatttccagtaaaaygaacacctccactgaacacctact

SEQ ID NO: 18493 - DNA, 50 bp, homo sapien
ctacccacctcccacctacccgcaaytgaaccatgagcgttggaggtgca

SEQ ID NO: 18494 - DNA, 50 bp, homo sapien
ttcatgctttcaaatcctacaaaaaygccatgtgtttcctcatggtctgc

SEQ ID NO: 18495 - DNA, 50 bp, homo sapien
gcaatactgcaaaagataatgaaggractataaacagtgattatctttgt

SEQ ID NO: 18496 - DNA, 50 bp, homo sapien
gtgtaagtgaatatttcctaccatawattacccacagaacaatttcaccc

SEQ ID NO: 18497 - DNA, 50 bp, homo sapien
acacaggcacagcaaactgcatttckaaaggttttgtaagttaaacaagc

SEQ ID NO: 18498 - DNA, 50 bp, homo sapien
agggaagatgggtatatcaggcataragggagagagatttgaggatgcat

SEQ ID NO: 18499 - DNA, 50 bp, homo sapien
tcccactcccaccaactcaggacatsatcccttaccacgacctctttagc

SEQ ID NO: 18500 - DNA, 50 bp, homo sapien
aaaagagacattttagcctcttacartcttattcccgaagtctagctgaa

SEQ ID NO: 18501 - DNA, 50 bp, homo sapien
agtactagaatttaaagtgcatatarggatctgagtaaaatatagatttg

SEQ ID NO: 18502 - DNA, 50 bp, homo sapien
gaggaagttggaatttcacatatgaragaaagatcaagtacctgggagcg

SEQ ID NO: 18503 - DNA, 50 bp, homo sapien
caaaaatacacttgtgtgagtcaaayaaaacatgtctgcaggccaaaggc

SEQ ID NO: 18504 - DNA, 50 bp, homo sapien
tgtttattaattgcggccataagaartcattagggtttcagaaaaagctt

SEQ ID NO: 18505 - DNA, 50 bp, homo sapien
ttatgtaaactctcctgatcctccawcattgccaactaattctaaatatc

SEQ ID NO: 18506 - DNA, 50 bp, homo sapien
catcttttaggtgctgtgtagagtaygatccgagacacagtcatccttgt

SEQ ID NO: 18507 - DNA, 50 bp, homo sapien
atcatgaagaggttgaagtccatgasgtaatgagagactatgaaagccgt

SEQ ID NO: 18508 - DNA, 50 bp, homo sapien
tgctcagagaatttctttggtccctraaatatcctgaaccctgaattttc

SEQ ID NO: 18509 - DNA, 50 bp, homo sapien
agtgtatttttgaaaacttgagtaarcatttacaaatcacagtattttat

SEQ ID NO: 18510 - DNA, 32 bp, homo sapien
aataggtaatatttaayggaagaactattgtt

SEQ ID NO: 18511 - DNA, 50 bp, homo sapien
gttgtagagcagatctgcattatcartatttaatttgccagttacaagcg

SEQ ID NO: 18512 - DNA, 50 bp, homo sapien
ttgtagccttgtacatgttacttcartcctctctatgtcaaattcctcac

SEQ ID NO: 18513 - DNA, 50 bp, homo sapien
aaaaggtgtgacttgccttattgaamtgatactggcatatctgactgtaa

SEQ ID NO: 18514 - DNA, 50 bp, homo sapien
cctacataattagtcacactgctcastaagataagtataattattcgaga

SEQ ID NO: 18515 - DNA, 50 bp, homo sapien
aggacacctaccgcacgtcttactcrcagctttcaggcgaacactaactc

SEQ ID NO: 18516 - DNA, 50 bp, homo sapien
aactttaatggtgaagtctccataaygcagttcttaaaaaaaaaaaaaaa

SEQ ID NO: 18517 - DNA, 50 bp, homo sapien
cttggtttcataataccgtactgccratttataaactatattttagtcta

SEQ ID NO: 18518 - DNA, 50 bp, homo sapien
catgatacaatctctctcttctgcaygaaaccagagtcctttctactgtt

SEQ ID NO: 18519 - DNA, 50 bp, homo sapien
catggcgaaaccccatgtctactaamaattagccgggcatggtggcaggc

SEQ ID NO: 18520 - DNA, 50 bp, homo sapien
tgctaatgactgtgaccttgagttaycaagacatggtagaagtatgtgtc

SEQ ID NO: 18521 - DNA, 50 bp, homo sapien
accagatactcaatgagtatttgctraatgaacaaatcagtgaatgagtg

SEQ ID NO: 18522 - DNA, 50 bp, homo sapien
caaaatgtggctcctgaaagaagaaytgggcactgttaccaaaagcagaa

SEQ ID NO: 18523 - DNA, 50 bp, homo sapien
tgaaaaaaaaaattggctaaacagaragtccaaagataaagctcttaaag

SEQ ID NO: 18524 - DNA, 50 bp, homo sapien
caagctgggaggcaacattatttaaragggagcgtgttgcagagtataac

SEQ ID NO: 18525 - DNA, 50 bp, homo sapien
atggccctgcttgaaggtgctcaaaygggaaaatccactcccgatggccc

SEQ ID NO: 18526 - DNA, 50 bp, homo sapien
aggcgcattccacagatgataaaatmactcacaaacctgtcagaagtcac

SEQ ID NO: 18527 - DNA, 50 bp, homo sapien
gaaatcatcattactatctgagagcyatttacttctagacaaaatcttgt

SEQ ID NO: 18528 - DNA, 50 bp, homo sapien
attgcactatgtagcttttgcacacyaaaactcattttattatcaaaacc

SEQ ID NO: 18529 - DNA, 50 bp, homo sapien
atggcctccttgttctacttctcctmaacttctgaaattagattcacacc

SEQ ID NO: 18530 - DNA, 50 bp, homo sapien
ctacagattaaaacaggtaggccatragatatgatgatagccaagactac

SEQ ID NO: 18531 - DNA, 50 bp, homo sapien
gtttgaatgatgtgttttctttacaycttcgagttaagatcacctggatg

SEQ ID NO: 18532 - DNA, 50 bp, homo sapien
gcagcgctgaggagagagtgaataaktctttcagagaaagtcagggaaga

SEQ ID NO: 18533 - DNA, 50 bp, homo sapien
tattcactctctcctcagcgctgccraaacattttgttcatgcatttatt

SEQ ID NO: 18534 - DNA, 50 bp, homo sapien
tgcatttattagagcacactgtaatkagtgcaatatatatgtttgttttc

SEQ ID NO: 18535 - DNA, 50 bp, homo sapien
tttacccatgttgtttcaagttgcaygtataagttcatttgttttggggg

SEQ ID NO: 18536 - DNA, 50 bp, homo sapien
ctgattttaatttggactgataagcragttttctgaacaggtttataggg

SEQ ID NO: 18537 - DNA, 50 bp, homo sapien
cacagatttggttagtagtattttgraggcaggataaaggaagatcctaa

SEQ ID NO: 18538 - DNA, 50 bp, homo sapien
gccagtcctggccatagaaatgatayccttcatgacaaagaggctcagct

SEQ ID NO: 18539 - DNA, 50 bp, homo sapien
tgtgtgatgagacttacagggttccsaaagtttgtctgtagctcaaggca

SEQ ID NO: 18540 - DNA, 50 bp, homo sapien
agactcgtagaactaagatgtattcraagtcagtcgattttctggaaacg

SEQ ID NO: 18541 - DNA, 50 bp, homo sapien
gaagataatggagaatgcagattaaygaccttacaaaaataaacagtttt

SEQ ID NO: 18542 - DNA, 50 bp, homo sapien
aaagcttacccaggctggtagagaaygggcacggcaagcgtgaagttagg

SEQ ID NO: 18543 - DNA, 50 bp, homo sapien
aggataaaattaacgttgtttcacartaacacaaaactgtgcttcttatt

SEQ ID NO: 18544 - DNA, 50 bp, homo sapien
atcttcagcaacatgactcattaaakaagaccaagggtttcagtgttaaa

SEQ ID NO: 18545 - DNA, 50 bp, homo sapien
ctagactacttctcttgggtctcaarcaatgagaagctctgacaataaat

SEQ ID NO: 18546 - DNA, 50 bp, homo sapien
ggctgagttataaccaacaccctatsagttgaaatgatgtgttcttctag

SEQ ID NO: 18547 - DNA, 50 bp, homo sapien
tttcaccaaataaaggcttatagcargttacccagatatgttggcagaat

SEQ ID NO: 18548 - DNA, 50 bp, homo sapien
ttcctcctcctgccattatactggasgtgttagaattctatcccacattg

SEQ ID NO: 18549 - DNA, 50 bp, homo sapien
ggtggggaattcaatcttgtcattaycagcattcctttcccttctccatg

SEQ ID NO: 18550 - DNA, 50 bp, homo sapien
aagtcatggagagcaaggaagtaaaragggaattacacacatcacatttt

SEQ ID NO: 18551 - DNA, 50 bp, homo sapien
agcttggatcctactcaacaactcaygtcagagaaggaagatgacagcag

SEQ ID NO: 18552 - DNA, 50 bp, homo sapien
cctgctctcttggccatggagaccaytctgacatcacttctgcttggtga

SEQ ID NO: 18553 - DNA, 50 bp, homo sapien
ttaatttctctcaaaattctgtacartgaaggacttttttgatgtagaag

SEQ ID NO: 18554 - DNA, 50 bp, homo sapien
cattctttcatgcataagtaaagtarggttctaagagagaatatttttct

SEQ ID NO: 18555 - DNA, 50 bp, homo sapien
tgtcacttaaaagggtgaagtccaartacctttgcatggctccaacccaa

SEQ ID NO: 18556 - DNA, 50 bp, homo sapien
aaaaagcagctcgttattgttaatgycaacacctcagataatatgctttt

SEQ ID NO: 18557 - DNA, 50 bp, homo sapien
gtaagattagttcttttcctctagakattctgagtagaaagaactaacca

SEQ ID NO: 18558 - DNA, 50 bp, homo sapien
gtcctttccctgtagtttttcctacsactctgaccaatctcctacatttc

SEQ ID NO: 18559 - DNA, 50 bp, homo sapien
aggacagaagagacaaggagagaagragaacgtctggaattcctttgttc

SEQ ID NO: 18560 - DNA, 50 bp, homo sapien
tggtttcccattgcttataacgtggwatttcaactccttattggacccac

SEQ ID NO: 18561 - DNA, 50 bp, homo sapien
cacatttgaattagccatatcgaaarttcaaatattcttccatttggcat

SEQ ID NO: 18562 - DNA, 50 bp, homo sapien
ggaggtgatgtggcaaaagatgaacygggaggaattagcagggatttgac

SEQ ID NO: 18563 - DNA, 50 bp, homo sapien
gcagcttgtttttgcataatttaagyactacgtggttgtgtcgtttaagt

SEQ ID NO: 18564 - DNA, 50 bp, homo sapien
taacctcacagagattcaggacccasgtgtaaatctcaatctgtaatcct

SEQ ID NO: 18565 - DNA, 50 bp, homo sapien
atatcaagattgctttttgttttaarggcttctctgttgagaacatgtct

SEQ ID NO: 18566 - DNA, 50 bp, homo sapien
ctgtgagaatatccaggtatgggcaytctgaggaaccataactgacatcc

SEQ ID NO: 18567 - DNA, 50 bp, homo sapien
gtgatttaccttttgagtttatctasaagatcctagtccacttaaaagta

SEQ ID NO: 18568 - DNA, 50 bp, homo sapien
tctggcaagttcgccctttttaataygactgatgcttaattcagttgtcc

SEQ ID NO: 18569 - DNA, 50 bp, homo sapien
ggcgattcgacctctgaaagctctgyaaggctaggaatttatgctttaag

SEQ ID NO: 18570 - DNA, 50 bp, homo sapien
cagaagaaaaaaatacacaaatccarcgaagaattaatctaaagaacatc

SEQ ID NO: 18571 - DNA, 50 bp, homo sapien
ctgaaggattccaaagactatactcwaatttttatttaaaggatttggat

SEQ ID NO: 18572 - DNA, 50 bp, homo sapien
cttcttcatctctttctgattctaaktagtaccatgctttccacttagca

SEQ ID NO: 18573 - DNA, 50 bp, homo sapien
cgaatgctttagatctcatctactcmagaggttctcaaacctggccacat

SEQ ID NO: 18574 - DNA, 50 bp, homo sapien
tgggctgtattgattagaaagggaawcttcatttaagcagcagaaaaagg

SEQ ID NO: 18575 - DNA, 50 bp, homo sapien
aattttattttactactcatccacarataaaaagctagtttccctttaat

SEQ ID NO: 18576 - DNA, 50 bp, homo sapien
ccttatattagtcatttgaaagaaargcaactaatatatggttttggaac

SEQ ID NO: 18577 - DNA, 50 bp, homo sapien
tgagtgggatttcactgaaagacttsaaatgtttgttctcttcataggtg

SEQ ID NO: 18578 - DNA, 50 bp, homo sapien
gaccattagaagtctccctattcaaygtagatactgttttaaacatcttc

SEQ ID NO: 18579 - DNA, 50 bp, homo sapien
tccatatctactataacggcacttcmaaagaagatatactgtatttaaca

SEQ ID NO: 18580 - DNA, 50 bp, homo sapien
atgggttttctttgagctgagtaatwaaaagtaactttctgttttctttc

SEQ ID NO: 18581 - DNA, 50 bp, homo sapien
catttaaaaaaatgttgcagaggacyaccaggaaattgttattgacgata

SEQ ID NO: 18582 - DNA, 50 bp, homo sapien
aaatacttttaggaaatagctataawaataagttgtacattttaatgtat

SEQ ID NO: 18583 - DNA, 50 bp, homo sapien
gtttcaccggctttgagaaccgtcarcctaacagcaactgccacagaagc

SEQ ID NO: 18584 - DNA, 50 bp, homo sapien
aaacaactcaccctgaaggccaaatkatgtcatagtgcagaacgcaaatc

SEQ ID NO: 18585 - DNA, 50 bp, homo sapien
tgtaggttactcaaaagaagttggawgtggtttcctataaatagcttttg

SEQ ID NO: 18586 - DNA, 50 bp, homo sapien
gtcctatagactttagattagtagarattgagatgtggtggttgagctgt

SEQ ID NO: 18587 - DNA, 50 bp, homo sapien
gccatggctcaaataaaaaaactcasggaatatctcagttcttttcccca

SEQ ID NO: 18588 - DNA, 50 bp, homo sapien
aattgaagctgactactcctgagaartaaatgcattgtttaaaacttcag

SEQ ID NO: 18589 - DNA, 50 bp, homo sapien
aacatatttatatttcttaaacttayggtcatcaaagacctcttgttctg

SEQ ID NO: 18590 - DNA, 50 bp, homo sapien
tggcagaaaaagttcctgcaatatgmatttagagatttgattacccagca

SEQ ID NO: 18591 - DNA, 50 bp, homo sapien
tctcttatgtgaaatcccacaaggawaggcaacttccagaaatggccaag

SEQ ID NO: 18592 - DNA, 50 bp, homo sapien
agaaatggttttttaaaaaatccacsaaaatggaaactatctccagcaac

SEQ ID NO: 18593 - DNA, 50 bp, homo sapien
atcaaccatttccaacttaaaaccaygtgcacagaatttaccttacaatt

SEQ ID NO: 18594 - DNA, 50 bp, homo sapien
ttgagaaactttgtgtggatttgagrcgttgttgaatgcagctgaacatt

SEQ ID NO: 18595 - DNA, 50 bp, homo sapien
ggagtagagagaagaagaccacctaygtggcagtgttaaatatatttgct

SEQ ID NO: 18596 - DNA, 50 bp, homo sapien
cagccatcttgcaccatgataaggartaaggatcacggcagagtaaaaaa

SEQ ID NO: 18597 - DNA, 50 bp, homo sapien
cttgagaattgaatgaattcaataaktatgattcattggctactcatttt

SEQ ID NO: 18598 - DNA, 50 bp, homo sapien
actccaaactgatcaccgttgactgyactaacgttggttctccaggacac

SEQ ID NO: 18599 - DNA, 50 bp, homo sapien
ggtgcctttgttgccccatttcacasagaagaaggcagcagctcggtggg

SEQ ID NO: 18600 - DNA, 50 bp, homo sapien
cccgaccatccaaaagcaaaatctaygtcccactgtccaggaaaggactt

SEQ ID NO: 18601 - DNA, 50 bp, homo sapien
ggatggctggaggaagcgagttataygagaggacagcaagctcagccact

SEQ ID NO: 18602 - DNA, 50 bp, homo sapien
tgaggcttattacattatagaaacaraggcagctcaatggcaggtggttg

SEQ ID NO: 18603 - DNA, 50 bp, homo sapien
agttttttgtcttttactttgaataygatgccatgtgtcaagcatttgtt

SEQ ID NO: 18604 - DNA, 50 bp, homo sapien
tctgagcattcagcatttttggcaaygaatcttgtgattgccagaatgag

SEQ ID NO: 18605 - DNA, 50 bp, homo sapien
ttctggacttcctcccaattcctackgcaaaagatggaggtggccactcc

SEQ ID NO: 18606 - DNA, 50 bp, homo sapien
aactggacttagaagtcaagtcaaargcagagaatatggagaagatgctt

SEQ ID NO: 18607 - DNA, 50 bp, homo sapien
cagacaatgttttcaagcctcaatcyatttgtgttcttactgggagatag

SEQ ID NO: 18608 - DNA, 50 bp, homo sapien
tcctgattgattacagtgcaaattarctaaatgaattatttagctcaact

SEQ ID NO: 18609 - DNA, 50 bp, homo sapien
tcggaaacaaacacactgtctgaacrgcaggaaagcaggatcacagtcac

SEQ ID NO: 18610 - DNA, 50 bp, homo sapien
tatcataggttagtaaatttattggraacacttaactttagctaattaag

SEQ ID NO: 18611 - DNA, 50 bp, homo sapien
ttgcatgaaattctaatatttgccaytgcctaactatgataagggaggaa

SEQ ID NO: 18612 - DNA, 50 bp, homo sapien
aaacctcagtgatatttctgcaatcraagtgttttatctgtaaagatgtt

SEQ ID NO: 18613 - DNA, 50 bp, homo sapien
tttctagcttggagaataatgtgtaracaactgcaattttgtatcgccct

SEQ ID NO: 18614 - DNA, 50 bp, homo sapien
gtagggaatgtctgtcccatttgtamggaatagcagatataatacaaaat

SEQ ID NO: 18615 - DNA, 50 bp, homo sapien
ctcccagatctcacttgcttacttaraagtttccattcttactaacgaca

SEQ ID NO: 18616 - DNA, 50 bp, homo sapien
ttgaattacagtggatcaagattaaytccaggctctacttagaggaagct

SEQ ID NO: 18617 - DNA, 50 bp, homo sapien
tgaatggctctcctggcttatgtcartcctttttttgagaccagcaggta

SEQ ID NO: 18618 - DNA, 50 bp, homo sapien
gaagcccaggaatttgtgtttttaaycagtacaaggcttgatcttgccta

SEQ ID NO: 18619 - DNA, 50 bp, homo sapien
gaatttatttattggtttattaacasagttgatccttgaataatgcaggc

SEQ ID NO: 18620 - DNA, 50 bp, homo sapien
ggattaattattgatgtctgtctccragtagaattaggaagtgatgacac

SEQ ID NO: 18621 - DNA, 50 bp, homo sapien
ttcttcttcctttgcccttctgacayggaaagaaactatatcaacttttc

SEQ ID NO: 18622 - DNA, 50 bp, homo sapien
tgtgaatagcattagcatttcactayaccaatacttttgctgttaatcga

SEQ ID NO: 18623 - DNA, 50 bp, homo sapien
actctgaaacataatttgtaaaacastatgtgggccaaataaaatatact

SEQ ID NO: 18624 - DNA, 50 bp, homo sapien
tatcttctttcaggaattatgtctcrcaataaaaaatgagtttccttcca

SEQ ID NO: 18625 - DNA, 50 bp, homo sapien
aacacttcctggaaaacttcatacakcttctattggagaatggtaccatg

SEQ ID NO: 18626 - DNA, 50 bp, homo sapien
cagaactggattttataggatagaasaagatgagatgataggaaatctgc

SEQ ID NO: 18627 - DNA, 50 bp, homo sapien
gctgagcaactgacaaagcaaacgcmcatattaatcctacttaaggttca

SEQ ID NO: 18628 - DNA, 50 bp, homo sapien
agttcatgcatactttctcggtagayaagaagttgcgggcttctattgtt

SEQ ID NO: 18629 - DNA, 50 bp, homo sapien
tacagcgtcttggggaaatctttgaygttctacaggttcaatttttgcta

SEQ ID NO: 18630 - DNA, 50 bp, homo sapien
ccttctccagagtgcactgtaatgayaataaaaggtcaaacaaggcacaa

SEQ ID NO: 18631 - DNA, 50 bp, homo sapien
aggtttgatctgtgccatgccaggayattggagaattctcatgggggcca

SEQ ID NO: 18632 - DNA, 50 bp, homo sapien
gctacagccacagggaagtttcacaygattacttgcccaagatcctcata

SEQ ID NO: 18633 - DNA, 50 bp, homo sapien
ctagagagaagaaaagtgtggctcaraagcaaatgggactttgcccagaa

SEQ ID NO: 18634 - DNA, 50 bp, homo sapien
aggactcctattggtgaccactgaaktatcttaaatatcctattcaagta

SEQ ID NO: 18635 - DNA, 50 bp, homo sapien
ggtcatagcaacattgttatcactcrcacaattaggaatcttaatgccct

SEQ ID NO: 18636 - DNA, 50 bp, homo sapien
attttagctaatgcacctcttcaaaractattccaatcttaaaaaatatc

SEQ ID NO: 18637 - DNA, 50 bp, homo sapien
cagcaaattaaaatgtttctcttacwatgataaccactgttagaatgaca

SEQ ID NO: 18638 - DNA, 50 bp, homo sapien
ttggccaagaatttacatgaggttawgaatgcctaacacacaaaaaataa

SEQ ID NO: 18639 - DNA, 50 bp, homo sapien
acaggtcccccatagaacagagtccrcttaattcagcctgctcaggcaat

SEQ ID NO: 18640 - DNA, 50 bp, homo sapien
tgtaagtttctgattgaacatggaartatccagccatgtagataaaagct

SEQ ID NO: 18641 - DNA, 50 bp, homo sapien
ggaatggtgaatgtttcttagcaacygtaacttactgcctgcactcctct

SEQ ID NO: 18642 - DNA, 50 bp, homo sapien
cttattgtcacagaaatcaaaataaygatactgcttcaatttacatagca

SEQ ID NO: 18643 - DNA, 50 bp, homo sapien
aataaactaggcaataaatataaacragatatttcgcatactcacggatc

SEQ ID NO: 18644 - DNA, 50 bp, homo sapien
gtaaatcctcaatgtggcctttacartctgcctcttttaatccttctctg

SEQ ID NO: 18645 - DNA, 50 bp, homo sapien
gtgtctccctgatggcataattataraagttccactccaaatgggaaaat

SEQ ID NO: 18646 - DNA, 50 bp, homo sapien
gggctgtacaaacctagtcattttgyatccaatgcatgtactttccctcc

SEQ ID NO: 18647 - DNA, 50 bp, homo sapien
gggtccagctgaattatctgccttgkaatcctcccatccacttttgctga

SEQ ID NO: 18648 - DNA, 50 bp, homo sapien
gatcaataatctcttaatactgaaartcacaaaataggataaaacgttct

SEQ ID NO: 18649 - DNA, 50 bp, homo sapien
aggatgcacacacttctcataaagtkactcttcagacaaatttatttttt

SEQ ID NO: 18650 - DNA, 50 bp, homo sapien
ctaactcccacgccatgagaatttaygcttggcttagtgttcccatagcg

SEQ ID NO: 18651 - DNA, 50 bp, homo sapien
ttaactgtagtggtttaacctgtgawattagtgactcttgagaaagcaga

SEQ ID NO: 18652 - DNA, 50 bp, homo sapien
tgatactaaaaaggttaatattatcyctagaagcagagaaacagaaaata

SEQ ID NO: 18653 - DNA, 50 bp, homo sapien
gtgctatatagccaacgctatgtccrcttaaccctactggtcatgtctag

SEQ ID NO: 18654 - DNA, 50 bp, homo sapien
gcaagaaaaaaaattaaatttagtcyaattccatgcaacaattcaaacta

SEQ ID NO: 18655 - DNA, 50 bp, homo sapien
aaatggggaaataaccaaaaacaacygaagtatgaatgatttacacctgc

SEQ ID NO: 18656 - DNA, 50 bp, homo sapien
aatgggcaaaagaaatcagcaaaggkcattttacagaaaaggaaacccca

SEQ ID NO: 18657 - DNA, 50 bp, homo sapien
tcctttaggttccacttaataaaacyacccacaccagatggtctgaaggg

SEQ ID NO: 18658 - DNA, 50 bp, homo sapien
cttcctcccccactttataaagaacrgagacagatctcattttttcagat

SEQ ID NO: 18659 - DNA, 50 bp, homo sapien
taaacctctttttctttataaattaycctgtcttaagtatttcttcgtag

SEQ ID NO: 18660 - DNA, 50 bp, homo sapien
aacaaccctatgaagtagtatttacrcccattttatggacagggaaactg

SEQ ID NO: 18661 - DNA, 50 bp, homo sapien
caagaatactacactatctataccaygctacccaggagggaagagtaaca

SEQ ID NO: 18662 - DNA, 50 bp, homo sapien
actaaaccagtgttcatcttccataygctgattgatgtctcatgtctccc

SEQ ID NO: 18663 - DNA, 50 bp, homo sapien
tcctctctctactttcccatcaaaayctatggctaaagtacacttgcata

SEQ ID NO: 18664 - DNA, 50 bp, homo sapien
ttattacttttacagtccatggaaayattgttggccctcacgtgaagcag

SEQ ID NO: 18665 - DNA, 50 bp, homo sapien
ctgttctttgaatttcatctgaaccrggtgcacagatatggattcatcaa

SEQ ID NO: 18666 - DNA, 50 bp, homo sapien
tcatttgggttgtgctttcaccaaaygattgcagcaatgcaagaggggga

SEQ ID NO: 18667 - DNA, 50 bp, homo sapien
tgaaaagtatatagcacctctccccraattcctcttgcattggccatgta

SEQ ID NO: 18668 - DNA, 50 bp, homo sapien
ggatcctcttgcagctatgacccaamatttgatgacgttttcccaaggag

SEQ ID NO: 18669 - DNA, 50 bp, homo sapien
tcaaatggaggttaacttctgcatcyacgtctttaccacgtggcaggtat

SEQ ID NO: 18670 - DNA, 50 bp, homo sapien
tctgaaacaaactagagggattttasattcgaagggataataataataat

SEQ ID NO: 18671 - DNA, 50 bp, homo sapien
ttaaaaaagtatagtttgggataatmaagttcttttgaatccaaaatcaa

SEQ ID NO: 18672 - DNA, 50 bp, homo sapien
cggaattttaaaacctaatatgaagraaataatgtaaaatatctcatgaa

SEQ ID NO: 18673 - DNA, 50 bp, homo sapien
gaacaggaagtgatatgcatatgacratatatgacgtgatatagaaggta

SEQ ID NO: 18674 - DNA, 50 bp, homo sapien
aatttgcaagtcttagtcttgtatamgcatggtgtatgaactgtctttta

SEQ ID NO: 18675 - DNA, 50 bp, homo sapien
agatgatctctaacacactagtccgratttaatgttttcaaaaaaaagaa

SEQ ID NO: 18676 - DNA, 50 bp, homo sapien
ctgttgacaaactcctcttccttacygctacttaattcctaattcctgtt

SEQ ID NO: 18677 - DNA, 50 bp, homo sapien
ttgctattctgcttgcaaattaacasgactgaattcttaggatcactgaa

SEQ ID NO: 18678 - DNA, 50 bp, homo sapien
ggagatcttttgtacaaggcaaagcrgacttggaaacagaatttaccctc

SEQ ID NO: 18679 - DNA, 50 bp, homo sapien
tgtggttgatcattccttctcatagratcaaccaagtggtgttccaagaa

SEQ ID NO: 18680 - DNA, 50 bp, homo sapien
taacctctctcccattgcaaaagacmgtcaattccatttatggtgttcta

SEQ ID NO: 18681 - DNA, 50 bp, homo sapien
aaaggtttgttggatggatctaatargctctgtcacataagggattcaca

SEQ ID NO: 18682 - DNA, 50 bp, homo sapien
ggttcatagttctaataataattgaygtttcccccaactctactgttcac

SEQ ID NO: 18683 - DNA, 50 bp, homo sapien
aaatatagatctttctcaaacccaawgctaatcatccccagaatcctgga

SEQ ID NO: 18684 - DNA, 50 bp, homo sapien
cttctaagcttccttcctggaggaaytgctgtttcttgtacatcattttg

SEQ ID NO: 18685 - DNA, 50 bp, homo sapien
ctttatggatcaaagtggtcacttaycagcaaattgacatgattcaccca

SEQ ID NO: 18686 - DNA, 50 bp, homo sapien
ctaatacagatgaaaatacgttataygtcaagtgctgataaagtcccgta

SEQ ID NO: 18687 - DNA, 50 bp, homo sapien
ccctggacttgcgttcttggaatcayagatagagtgagttagaagggcac

SEQ ID NO: 18688 - DNA, 50 bp, homo sapien
tctcaacagacatcgaaagaatgaayggactcagcacccagggcctgcag

SEQ ID NO: 18689 - DNA, 50 bp, homo sapien
acccctctctggagttctctgatacratcagcttggagtgcagattttca

SEQ ID NO: 18690 - DNA, 50 bp, homo sapien
atgcctccacacttccttttggaaakaaatcataaagcaatcatgtacat

SEQ ID NO: 18691 - DNA, 50 bp, homo sapien
tgattaatactttcaaaatgttataycatggcatgttattttccacactc

SEQ ID NO: 18692 - DNA, 50 bp, homo sapien
cacagttatcctgcctacaagacaamggactggagtgcttatccacaaat

SEQ ID NO: 18693 - DNA, 50 bp, homo sapien
tagatgtatagtagtagttgatgtakagtagtgccactggtttgtgaaca

SEQ ID NO: 18694 - DNA, 50 bp, homo sapien
cattgctattatgcgattccttctaygcacgtccgtcttagaagtaggaa

SEQ ID NO: 18695 - DNA, 50 bp, homo sapien
tgaggtggggacgcacatctggacgsaaagtgtttgccgagagcacttgg

SEQ ID NO: 18696 - DNA, 50 bp, homo sapien
ggtagctcacaaaattaagaagaagkctggagaactgggctcaaatagaa

SEQ ID NO: 18697 - DNA, 50 bp, homo sapien
atgcaaagtcacttaatgagaacccrattctttctaagtccaaagccact

SEQ ID NO: 18698 - DNA, 50 bp, homo sapien
ctaaccctctgacagcgttagcataraagatttacatttatgttacgagg

SEQ ID NO: 18699 - DNA, 50 bp, homo sapien
cccagcaagctttaatttaaggataragtcattcagaaagctaatctgat

SEQ ID NO: 18700 - DNA, 50 bp, homo sapien
ttttacagatgaggaagtgaatcacsaagtcactgagcagattcagctgt

SEQ ID NO: 18701 - DNA, 50 bp, homo sapien
tgagccagcaagccatgtactcgcaygtcggtctgtctagagctgctgtc

SEQ ID NO: 18702 - DNA, 50 bp, homo sapien
aaatataaagcccttttgtagcctawcacactattaaacttgctttcacc

SEQ ID NO: 18703 - DNA, 50 bp, homo sapien
tctcctgatttctacatgtgagtgargtaatgattttacaggcctgaaca

SEQ ID NO: 18704 - DNA, 50 bp, homo sapien
aaggcacagagtggatgaatggaacraacgatacatgaaaaaaacacttt

SEQ ID NO: 18705 - DNA, 50 bp, homo sapien
gatggtgtctgatggagtgcttttarctggaagcattgaagcttgcagaa

SEQ ID NO: 18706 - DNA, 50 bp, homo sapien
gcttgccattgccacaagtagctatmaattaatctaataatgccccactg

SEQ ID NO: 18707 - DNA, 50 bp, homo sapien
tattaggcccagagaggcaatagaaygagatagcaatcatgtcctacata

SEQ ID NO: 18708 - DNA, 50 bp, homo sapien
atacaatgattcaacctggagaaaayaacatcaaacgaacagaaatgagg

SEQ ID NO: 18709 - DNA, 50 bp, homo sapien
tactttgcacctgtagaatgacagargaacattgggatggtgggacagag

SEQ ID NO: 18710 - DNA, 50 bp, homo sapien
ttaaataaatgggcatatgtactgaygctcgtgttatctgttgttttaaa

SEQ ID NO: 18711 - DNA, 50 bp, homo sapien
cactgcttctctgtaggatagaagckctctgcaacttggtcattgcctcc

SEQ ID NO: 18712 - DNA, 50 bp, homo sapien
gtacaacatttaaaagatgaaggaawgtctagggaaacacgaataaatgt

SEQ ID NO: 18713 - DNA, 50 bp, homo sapien
atttgttaatttaattttttttaagkcacgcgagctccgggagagtccag

SEQ ID NO: 18714 - DNA, 50 bp, homo sapien
ctgtttcacccttgtctaagtggtcsaggtggttcctgtctatattcttg

SEQ ID NO: 18715 - DNA, 50 bp, homo sapien
aaaaggaactgagattaacttttcarctgatgattggcactttcaggatg

SEQ ID NO: 18716 - DNA, 50 bp, homo sapien
cagcctaaatgtgcctctgctctagwcctgataaatgcattgcatactca

SEQ ID NO: 18717 - DNA, 50 bp, homo sapien
gatatcgcagcccgagactagattaratgttctcaacctaaggtgatgtt

SEQ ID NO: 18718 - DNA, 50 bp, homo sapien
cactgcagactagcttcctttactayctacacatacaagaaaaatactga

SEQ ID NO: 18719 - DNA, 50 bp, homo sapien
ctgagcttactgaagccaattatccmaagagtatgtgatccagaagcaag

SEQ ID NO: 18720 - DNA, 50 bp, homo sapien
ctgaaatgacagacccaggactatayattcagacaagattctcctgactc

SEQ ID NO: 18721 - DNA, 50 bp, homo sapien
cctctcaactctgggctctcagtgargaagttaattagcctgactaaatc

SEQ ID NO: 18722 - DNA, 50 bp, homo sapien
tcaccaattcatgatttcctaaaaaygtgtgagtctctaggacagattcc

SEQ ID NO: 18723 - DNA, 50 bp, homo sapien
gaagggaaatgtttaggaaataataytaaatgacaaaggcagaatgcaaa

SEQ ID NO: 18724 - DNA, 50 bp, homo sapien
atcgggaagaaatgaaggcatgaacraatagactaattgagagaagatag

SEQ ID NO: 18725 - DNA, 50 bp, homo sapien
ctcagcaggatgaaaacagtgctagyaggcatgacagatgcatctttact

SEQ ID NO: 18726 - DNA, 50 bp, homo sapien
ctggtgttcagtgctggataattctyaatttggagatgtctaatgaacat

SEQ ID NO: 18727 - DNA, 50 bp, homo sapien
tcttctctcttcagagagcttgaagkccacgtgtttcagatgccccaaca

SEQ ID NO: 18728 - DNA, 50 bp, homo sapien
gggatcatccagtggagttgtaaacragggaaccatcttgcaagatctag

SEQ ID NO: 18729 - DNA, 50 bp, homo sapien
tgagaggagatgcagacaccgaaaartgaaatgaatgacattatgcacaa

SEQ ID NO: 18730 - DNA, 50 bp, homo sapien
aagtggttctttgcttactaatgagrccctaagatgtccttttctaagct

SEQ ID NO: 18731 - DNA, 50 bp, homo sapien
aaaatagggcagcatatcctgaatgsaataagtaaaagatacattgtcga

SEQ ID NO: 18732 - DNA, 50 bp, homo sapien
taagaacactgaaactcacagagatsaattagcttgcccttggccacgtt

SEQ ID NO: 18733 - DNA, 50 bp, homo sapien
actacatggcctcaaccaccaagcgyagtcatctagaagagacagcagtt

SEQ ID NO: 18734 - DNA, 50 bp, homo sapien
caaatctaagcctctgaaaaaggaascgtacaaagatagacaccgcagca

SEQ ID NO: 18735 - DNA, 50 bp, homo sapien
gagaggcagtaactccagtgacagcratgagtttctctctgtgaaaaatt

SEQ ID NO: 18736 - DNA, 50 bp, homo sapien
acaactcaagcttcgtaaaagacacragattctgattcttacagctttga

SEQ ID NO: 18737 - DNA, 50 bp, homo sapien
caaagcagagagatactaccaggaaytatgatgatgatacagctgcattt

SEQ ID NO: 18738 - DNA, 50 bp, homo sapien
tggtcttgtaatgctgactgttgaayagaaaacagaagaagatcacattt

SEQ ID NO: 18739 - DNA, 50 bp, homo sapien
gctatctccctcacctaaaatataarctctttcaaagcagggaatctatc

SEQ ID NO: 18740 - DNA, 50 bp, homo sapien
cagtaaagcattgtttactcttggaygggttcctcgatttttgttctttg

SEQ ID NO: 18741 - DNA, 50 bp, homo sapien
ggaaaaatctcactacagaatcaccragcccagtaaagcattgtttactc

SEQ ID NO: 18742 - DNA, 50 bp, homo sapien
attttggggcaacctatacaaaaagwacccatgcagttttccttcggcat

SEQ ID NO: 18743 - DNA, 50 bp, homo sapien
cgttttaaaggactctgtggtcaagraagtttgggaaacactgttccaaa

SEQ ID NO: 18744 - DNA, 50 bp, homo sapien
gcctaaatgctccacttaaaagacaygaatttgcagaatggatacgaatt

SEQ ID NO: 18745 - DNA, 50 bp, homo sapien
gctgatacaggacctgaataaatgartatcacacacagtcagcttctttc

SEQ ID NO: 18746 - DNA, 50 bp, homo sapien
gcgatagtggcagaagttacatctayagtgaaatgaacaaatagactgag

SEQ ID NO: 18747 - DNA, 50 bp, homo sapien
actcgaaatggctgaagatgccacaratgagtctgggaagagtattacac

SEQ ID NO: 18748 - DNA, 50 bp, homo sapien
aaactatgggaataagaatgatactyaaagcaacaggctccttttaccaa

SEQ ID NO: 18749 - DNA, 50 bp, homo sapien
atcactttcacagagactatggaatsacctaggaagtgcaaagaaagaga

SEQ ID NO: 18750 - DNA, 50 bp, homo sapien
gaaatcgcagggaatgttgatcagasagcacggtgatatcagggtttggg

SEQ ID NO: 18751 - DNA, 50 bp, homo sapien
actgatatcagaagtgtgagtagaamtgaaggaatcagaagcaagggaaa

SEQ ID NO: 18752 - DNA, 50 bp, homo sapien
gtgtaggattctgtgctaaaaggaasatttgatctggtgggagaggttca

SEQ ID NO: 18753 - DNA, 50 bp, homo sapien
gctgccaactggtaatgataaacacsaggctaagaattgaacagagtcac

SEQ ID NO: 18754 - DNA, 50 bp, homo sapien
gcatgtttcaaacagatagaagttcmatgtgaggagtgcttagtgaatca

SEQ ID NO: 18755 - DNA, 50 bp, homo sapien
gatttgattagacagctgtcagagaragtaagaggaaacccatgaacgca

SEQ ID NO: 18756 - DNA, 50 bp, homo sapien
atatgttttaatataattgggatgayaccatatatgcttattagaaatgt

SEQ ID NO: 18757 - DNA, 50 bp, homo sapien
gtcctccaataaccccatgtttggasacttaggttttggagccaggcaga

SEQ ID NO: 18758 - DNA, 50 bp, homo sapien
ttacaacataatattttaatgactgyacaataccccttcaaatagatgta

SEQ ID NO: 18759 - DNA, 50 bp, homo sapien
cattatcttcccacttaaaatcgtcraatgatgctaaaaagaaaacccaa

SEQ ID NO: 18760 - DNA, 50 bp, homo sapien
acgagtttttacacagttgcaagcasacaaggtccaccatgctgtatcct

SEQ ID NO: 18761 - DNA, 50 bp, homo sapien
aaaaaaaaaaaagtacaataataacmgtcaaatctattaagtgtttacct

SEQ ID NO: 18762 - DNA, 50 bp, homo sapien
aatgggctcacgtggcatgccatgaycagttattccaaacgacttgggct

SEQ ID NO: 18763 - DNA, 50 bp, homo sapien
atctgatgaactaacacactcaaatraaactgatttgtgggcaagtacga

SEQ ID NO: 18764 - DNA, 50 bp, homo sapien
taatactacctttattagtatacaartcaaagcactttcatagaaaccac

SEQ ID NO: 18765 - DNA, 50 bp, homo sapien
taaaaacacttgccaatcgaaaatakgtagaatagaaaatgtgttgaaat

SEQ ID NO: 18766 - DNA, 50 bp, homo sapien
ttaatgtgtaggtgaatgcaaactcyatcgttgagcctggggtgtaagac

SEQ ID NO: 18767 - DNA, 50 bp, homo sapien
gacactgagtctcaaaggaattagaygttctcaagctccaagaggcttca

SEQ ID NO: 18768 - DNA, 50 bp, homo sapien
gtggcatctgctgaaaccgcatatgsaagagaactacttcactcatatgc

SEQ ID NO: 18769 - DNA, 50 bp, homo sapien
ggtgtggtgtacagtagattgttgakgtatctcatgcccatttctggaga

SEQ ID NO: 18770 - DNA, 50 bp, homo sapien
accagagtgtgaaagggcagacacawggtaatacaaaccattacataccg

SEQ ID NO: 18771 - DNA, 50 bp, homo sapien
tttaacaaagagctaggtgacaacayggatatttttcttaaattcatggt

SEQ ID NO: 18772 - DNA, 50 bp, homo sapien
gctccagcaaagggtaactacagagragcgaataggagagggacacatgg

SEQ ID NO: 18773 - DNA, 50 bp, homo sapien
ccagaaatagtgaatcccggagaacsagcttgaacaagtccaagcttctg

SEQ ID NO: 18774 - DNA, 50 bp, homo sapien
gtgattttgccaaatgtacccattarcagagaagcacattgcttggatga

SEQ ID NO: 18775 - DNA, 50 bp, homo sapien
gcgatcagcagcagtaaacacactargaacgcactattaaaatgaagagt

SEQ ID NO: 18776 - DNA, 50 bp, homo sapien
gtaaaatgcgcacactactagtactkacttctcaaagttggacttggtaa

SEQ ID NO: 18777 - DNA, 50 bp, homo sapien
tgggacagatgtgatattaatacagratccatttcttggagtgttttcca

SEQ ID NO: 18778 - DNA, 50 bp, homo sapien
accatgcatattccagcagtttacayacttaggctggttattctggtgct

SEQ ID NO: 18779 - DNA, 50 bp, homo sapien
aatcaataacttaaacatattatcartaactcaagggaaggagaaaaagt

SEQ ID NO: 18780 - DNA, 50 bp, homo sapien
atcattaggaagtgatgtttattagwcagtgaattaagaggaaaatatca

SEQ ID NO: 18781 - DNA, 50 bp, homo sapien
aaggcagctctccatcagccaagaawacctttctcaataggatgtcagct

SEQ ID NO: 18782 - DNA, 50 bp, homo sapien
aaaaatggaaaagttatagcaagcamatactaacaaaacattggtgtacc

SEQ ID NO: 18783 - DNA, 50 bp, homo sapien
atttcattctattctaaatgcgggaycatataaaatgaacatataaataa

SEQ ID NO: 18784 - DNA, 50 bp, homo sapien
gctttcctgggagactctaatggcaragactgttgaaatagaaatgcctc

SEQ ID NO: 18785 - DNA, 50 bp, homo sapien
caccatatgctggacacttgaaataygaaagacaatcagaaacagaagca

SEQ ID NO: 18786 - DNA, 50 bp, homo sapien
ttaatctgtttgcatttcatttctayatgatggacagtattggggccagt

SEQ ID NO: 18787 - DNA, 50 bp, homo sapien
agcaacaatttacgattatttgtcayggttcctgggctgactgggctctg

SEQ ID NO: 18788 - DNA, 50 bp, homo sapien
agggcatgggaaggtatacacagtamctttgcacgttatcatcacacagg

SEQ ID NO: 18789 - DNA, 50 bp, homo sapien
aggtaataaagatttccagccactaygtcttcatcacaagtaggtaatac

SEQ ID NO: 18790 - DNA, 50 bp, homo sapien
gaacgctaatggacatagcagcaaastgaaggtggacataaatccagcca

SEQ ID NO: 18791 - DNA, 50 bp, homo sapien
aatgacattctttcttatttcaaaamtcccaacttgagaacagatgtcct

SEQ ID NO: 18792 - DNA, 50 bp, homo sapien
tggtccaagctcaccataatgccagracatattcaaggcatggggaaata

SEQ ID NO: 18793 - DNA, 50 bp, homo sapien
tcagtgcctacactgtgcttctctargagaccacctgagtcctagggtgg

SEQ ID NO: 18794 - DNA, 50 bp, homo sapien
catcaccatgccatgtgagcgaggaraaaatgtagaccaagagtggttaa

SEQ ID NO: 18795 - DNA, 50 bp, homo sapien
atcctccaaagagatattttcaagaytatttcaacaacaaggaggtggtt

SEQ ID NO: 18796 - DNA, 50 bp, homo sapien
tctcaaccctccaaattcaactgtcmctggaagtctttgtggagttggaa

SEQ ID NO: 18797 - DNA, 50 bp, homo sapien
ttttaaaaaataattagtttgaccartattaaaacatagatgaattttag

SEQ ID NO: 18798 - DNA, 50 bp, homo sapien
tcttccccttaactcctaaggaataraggcatcagccataccaagggaat

SEQ ID NO: 18799 - DNA, 50 bp, homo sapien
tccccagtctcttgatgccattccawtaccttgtctgctctttagcctaa

SEQ ID NO: 18800 - DNA, 50 bp, homo sapien
ctatagtacccatattattttcttcrcactaaataggacaacttattggt

SEQ ID NO: 18801 - DNA, 50 bp, homo sapien
catccctacaggtatagctaaggaarttaaagttgagagagatgcaacct

SEQ ID NO: 18802 - DNA, 50 bp, homo sapien
aagaataataattaaattgtctctayactttactttgttataaatttaca

SEQ ID NO: 18803 - DNA, 50 bp, homo sapien
tatccaattccttcaactaggtaccygctgaatacctgagaacaagcttc

SEQ ID NO: 18804 - DNA, 50 bp, homo sapien
attattattcttacagctctcataayaaaggatactctcattatccttgt

SEQ ID NO: 18805 - DNA, 50 bp, homo sapien
ttatcaataagcacaataatagcaartagtcaatgatataataggtacat

SEQ ID NO: 18806 - DNA, 50 bp, homo sapien
tcttagcttgagtttttccaacgcasatgatgatacagcctcatgggggt

SEQ ID NO: 18807 - DNA, 50 bp, homo sapien
cagacacaagcacctctagaaaagasagaaggagctcccgtgggccaggg

SEQ ID NO: 18808 - DNA, 50 bp, homo sapien
gaaacaaaactcaaacctgaatccamatttttgatgccacaagataatgt

SEQ ID NO: 18809 - DNA, 50 bp, homo sapien
atccctatccttagagtaaattccayaagtcatgaccttctccctattaa

SEQ ID NO: 18810 - DNA, 50 bp, homo sapien
ttggagagacatgtgtcagcatatargtcgaagatggtcccttccagcag

SEQ ID NO: 18811 - DNA, 50 bp, homo sapien
cctcatatgctttacttctcttagamccaattggaaatgacaagtaattc

SEQ ID NO: 18812 - DNA, 50 bp, homo sapien
ctaggatatgctgcaataagaaatawctcccaagtatcactgtgttaatt

SEQ ID NO: 18813 - DNA, 50 bp, homo sapien
aataaagaagcaaatggccagcatayggaatgcataatctgtcttctctc

SEQ ID NO: 18814 - DNA, 50 bp, homo sapien
taatgtttcttcattgaatcagtcartacttactctggtgcctactgttt

SEQ ID NO: 18815 - DNA, 50 bp, homo sapien
tttttccccattgcattttgtttgargcacacacagaaagggtaactaat

SEQ ID NO: 18816 - DNA, 50 bp, homo sapien
ttaaaatttcaaatttgtcctttctsacttaggcactgtggtaggtccat

SEQ ID NO: 18817 - DNA, 50 bp, homo sapien
tttgtgagccccatgtacggttgcaytgctgactaagtatatctctatct

SEQ ID NO: 18818 - DNA, 50 bp, homo sapien
cctttctaaatgtatttaccagaatsatgaacctcttttattgaaccttg

SEQ ID NO: 18819 - DNA, 50 bp, homo sapien
tcattctggtaaatacatttagaaargcaaaaattaaatgaacaagaggc

SEQ ID NO: 18820 - DNA, 50 bp, homo sapien
ttgttgggaaaacactggtttatctyagaaaatccaagggatcaccaaaa

SEQ ID NO: 18821 - DNA, 50 bp, homo sapien
tcttgcacttccaccacctgcaaaartaagagcatgtcctagaatggaag

SEQ ID NO: 18822 - DNA, 50 bp, homo sapien
aagaggacttgaattcagacccaaakaatgagaaaagcaatctcttgagg

SEQ ID NO: 18823 - DNA, 50 bp, homo sapien
cctgtctataaagcacaagggttgarctacataaattcaagcaattaaaa

SEQ ID NO: 18824 - DNA, 50 bp, homo sapien
ttgactggtggatcacagagactcasaggctaaaggaatgagataattcc

SEQ ID NO: 18825 - DNA, 50 bp, homo sapien
ctccctccaagaaattcactctaaayacaaattacacaaatagttggcta

SEQ ID NO: 18826 - DNA, 50 bp, homo sapien
gtgggcaccagccctgagaggaacgratgaacttgattgacctacccgga

SEQ ID NO: 18827 - DNA, 50 bp, homo sapien
gatgcagtggattaacaagggatgaygtatgactcttctgtgtttgtcag

SEQ ID NO: 18828 - DNA, 50 bp, homo sapien
tacaatttttaactgccatttaaaaygagattcaaactcgaaattatgga

SEQ ID NO: 18829 - DNA, 50 bp, homo sapien
ataccctctgtttctcaacaagtcaygtgtacctgggcctcccagatttc

SEQ ID NO: 18830 - DNA, 50 bp, homo sapien
taaaaactcttgtaaactccattgcraaacttctgtgcttgacttccagc

SEQ ID NO: 18831 - DNA, 50 bp, homo sapien
cggatgctcccttctctctggaaackagccgatgcataaaatattcctac

SEQ ID NO: 18832 - DNA, 50 bp, homo sapien
aaggcaattgacttttcccaagaagmaggccacgctcaagtgcaggtgct

SEQ ID NO: 18833 - DNA, 50 bp, homo sapien
aagtttgttcccacctgaatgttacrccggacgggagtatggtaccccga

SEQ ID NO: 18834 - DNA, 50 bp, homo sapien
ccttgctgtgacaagtggaagacaaratgttatgcagtaaactactggcc

SEQ ID NO: 18835 - DNA, 50 bp, homo sapien
gacagttgtctttatggatgtttaaygaggggattcacaggaagcaccaa

SEQ ID NO: 18836 - DNA, 50 bp, homo sapien
atggtgtcactcaaggatgtagtaaytgcatttgtactatggtagtgtca

SEQ ID NO: 18837 - DNA, 50 bp, homo sapien
taattgtaaagctcctgcattactaygagccacttgaaactagaaaacct

SEQ ID NO: 18838 - DNA, 50 bp, homo sapien
ggatcaggtacattttatcttaaggrccaattccaatccattggtagtgg

SEQ ID NO: 18839 - DNA, 50 bp, homo sapien
ctctccaaggcttattcggtgttaayagacattagtgtgaccctcagagc

SEQ ID NO: 18840 - DNA, 50 bp, homo sapien
cttcacaaaataatattaagcatccraaggcttttgcgtgaatgaaatgg

SEQ ID NO: 18841 - DNA, 50 bp, homo sapien
tggatttaagaagtctcagctggcgyattaaggcatccgtgctgagcagc

SEQ ID NO: 18842 - DNA, 50 bp, homo sapien
aggaaaatgcctttgaacaatagaargtcatggatctatcccaactctaa

SEQ ID NO: 18843 - DNA, 50 bp, homo sapien
aatgggaaagcagaaattactccaaygaggactgcaaatgttctcaatat

SEQ ID NO: 18844 - DNA, 50 bp, homo sapien
aatgggaaaaattcgattctgatatraggctcagataaaagttcaagaca

SEQ ID NO: 18845 - DNA, 50 bp, homo sapien
cttctgactcaaaagcctgacctatraacatctttgtggagacaggactc

SEQ ID NO: 18846 - DNA, 50 bp, homo sapien
ccataaatctttctgctgttatacayctgttttatttcatgttccttttt

SEQ ID NO: 18847 - DNA, 50 bp, homo sapien
atgctaaatatatggtcttttttcawtctacactctgataaccaaaaatc

SEQ ID NO: 18848 - DNA, 50 bp, homo sapien
gaaatcaatatcagggaacagttacygcatctcaatattatttgccgaga

SEQ ID NO: 18849 - DNA, 50 bp, homo sapien
gaattgggagaaacaggtagtatgaragtatttgggaaaacgaagtgcct

SEQ ID NO: 18850 - DNA, 50 bp, homo sapien
cagctggaaggctaacttggaataaytcagtttgcgtttatttctactca

SEQ ID NO: 18851 - DNA, 50 bp, homo sapien
catgcctgctccccagaggcctctayattaacttccagtcttgtctccac

SEQ ID NO: 18852 - DNA, 50 bp, homo sapien
tccagttggaagatattagaagacaygctgtatccacctttcctatttcc

SEQ ID NO: 18853 - DNA, 50 bp, homo sapien
ccaaatgtttttgcccacaagattcyatttccacaaatggttcatttatt

SEQ ID NO: 18854 - DNA, 50 bp, homo sapien
ggtaactcgatgccacttatgtagaytaaatattcatgcaaacaaaaaat

SEQ ID NO: 18855 - DNA, 50 bp, homo sapien
ggggaaggcttccaagcaggctccaytaatcacatgtggtacaatgcagg

SEQ ID NO: 18856 - DNA, 50 bp, homo sapien
agattcattgtttgtccaattattgsaatgagagaatcaacagggggcaa

SEQ ID NO: 18857 - DNA, 50 bp, homo sapien
gagagcccgtgctccctgttaataaygaaaacagactgacatttgtccag

SEQ ID NO: 18858 - DNA, 50 bp, homo sapien
agattgaagggaaaggtttaaccagracttcagatgggctacagattttt

SEQ ID NO: 18859 - DNA, 50 bp, homo sapien
attaggaaaatagccagactcctacyggaattaggtagcccagatatgag

SEQ ID NO: 18860 - DNA, 50 bp, homo sapien
ggagaaaggtaacccaaaatccgatyagatcatttgagctcctagatcat

SEQ ID NO: 18861 - DNA, 50 bp, homo sapien
gtactaataaaaacagacaaattcarcagatacaaccgactttctcggtg

SEQ ID NO: 18862 - DNA, 50 bp, homo sapien
aggttttgatgacattatgacttgaytattaaacttgtatgtgagatttc

SEQ ID NO: 18863 - DNA, 50 bp, homo sapien
agtccctacatattaaactgtagaayaggagtgagatgaattatccatgc

SEQ ID NO: 18864 - DNA, 50 bp, homo sapien
tgggcctcaaactggattaactctcrcatactgcagtcaagattttgcca

SEQ ID NO: 18865 - DNA, 50 bp, homo sapien
gagatatggggacttgttcaaaacasaaagagaccctgtagctgttattg

SEQ ID NO: 18866 - DNA, 50 bp, homo sapien
ggctataacgtgaattttgagtatasgaggaatgcataaaaataagatct

SEQ ID NO: 18867 - DNA, 50 bp, homo sapien
ccttccgcatcctgacccgggtctcyactgctgtgcacacacagccacca

SEQ ID NO: 18868 - DNA, 50 bp, homo sapien
cctattcatattggaaaccagaaaaygaggacatgcataggttaaaaaac

SEQ ID NO: 18869 - DNA, 50 bp, homo sapien
gtgtggagtttacagaaacactcagraataaccaccagaaaaaagtaatg

SEQ ID NO: 18870 - DNA, 50 bp, homo sapien
ctgttagtgttcacagctagggatcwcaagcaatgtgcaggagagaggta

SEQ ID NO: 18871 - DNA, 50 bp, homo sapien
cattccaccccttttcacataaaaartccgagggtcaaacacaccgtgta

SEQ ID NO: 18872 - DNA, 50 bp, homo sapien
ttaccctgaattaccctgcataacaraagagagggaaattccaagggtgt

SEQ ID NO: 18873 - DNA, 50 bp, homo sapien
tctttacagcaacaggagagaaaagkccaggagatccaagagtggttatt

SEQ ID NO: 18874 - DNA, 50 bp, homo sapien
cacacttgcgccctgaggagtagttraaattcagcttgaggggcacttag

SEQ ID NO: 18875 - DNA, 50 bp, homo sapien
ctccggcacacacatccgtgggagayggctcaacttctttataaagtggt

SEQ ID NO: 18876 - DNA, 50 bp, homo sapien
ggaaataaacttctgttgttgttacyaatcattgtcatcatcacttttgt

SEQ ID NO: 18877 - DNA, 50 bp, homo sapien
gaaaacttaatgttatcaagatgacrcctcaaattgatctacagattcaa

SEQ ID NO: 18878 - DNA, 50 bp, homo sapien
tgagatagccaaacttcaccctccasagattttgatttaattttcctggg

SEQ ID NO: 18879 - DNA, 50 bp, homo sapien
gatccactatgcctggccttctttcraggttctggttgcaatttaggatt

SEQ ID NO: 18880 - DNA, 50 bp, homo sapien
ctaaatccctaacaagtgctcaatcratatttttgaatgaatgaatgaat

SEQ ID NO: 18881 - DNA, 50 bp, homo sapien
tgatgttcacaagagccctgaaaggkaaggattactgtccctgttttgtc

SEQ ID NO: 18882 - DNA, 50 bp, homo sapien
ttaagcatttgaaatgcagttatagyaaccgctaattctgtgttaatttg

SEQ ID NO: 18883 - DNA, 50 bp, homo sapien
tccaaatcagtgctagcttgatggayaggaaaatgaagggagaataatgt

SEQ ID NO: 18884 - DNA, 50 bp, homo sapien
actaagttatctcaaagtgataacasaagacaaatatataaatcttcagc

SEQ ID NO: 18885 - DNA, 50 bp, homo sapien
attatcctataataataatctgtaamattagtttagaaacaagaaggctg

SEQ ID NO: 18886 - DNA, 50 bp, homo sapien
cattgtccagagacacggggatttcrcaaaggtcaaacagcaaagcaagt

SEQ ID NO: 18887 - DNA, 50 bp, homo sapien
atttttagacataaacttttctgtayctatgaaagtattatcctataata

SEQ ID NO: 18888 - DNA, 50 bp, homo sapien
ggtacagaaaagtttatgtctaaaartgatattatattgggtcatctaaa

SEQ ID NO: 18889 - DNA, 50 bp, homo sapien
aatgattaaattatcagaaagctaaraaccaggctgcctgaatattcccc

SEQ ID NO: 18890 - DNA, 50 bp, homo sapien
tttcaggaccacgtggtattatttcwaacagacacttagagtgatgcagg

SEQ ID NO: 18891 - DNA, 50 bp, homo sapien
ttaaaaaccttctccatcttctcacrcttctcaagaatagaaggaatgac

SEQ ID NO: 18892 - DNA, 50 bp, homo sapien
gctaatgtctaccatgattacctccraacagctcttaggcatatagcaat

SEQ ID NO: 18893 - DNA, 50 bp, homo sapien
ttacaggcctaagccactgtaccacrctaaagattaaaaagttataaaaa

SEQ ID NO: 18894 - DNA, 50 bp, homo sapien
atttaccatctaaaattgtgttccaytatgggtctgtgtctgtggtagag

SEQ ID NO: 18895 - DNA, 50 bp, homo sapien
acaagttaatcaaaataaatcgaaayggcgcatgcctgggtaacactctt

SEQ ID NO: 18896 - DNA, 50 bp, homo sapien
tttcttgctgaagatgagttcatttkaaaactttatagtgtatgtgttta

SEQ ID NO: 18897 - DNA, 50 bp, homo sapien
aatgcattttgtttctttggaggagkacctaattctcttaaccttcagac

SEQ ID NO: 18898 - DNA, 50 bp, homo sapien
tacaggggatattacattcaaatacyggtagtgtgaactccagaactgtg

SEQ ID NO: 18899 - DNA, 50 bp, homo sapien
agctacggcctctctgtgcctccacragtgtgattccggtgcatggaagc

SEQ ID NO: 18900 - DNA, 50 bp, homo sapien
caaaactgtttttcaaaagcaatgcmctagtgatgtaaaatctttttacc

SEQ ID NO: 18901 - DNA, 50 bp, homo sapien
tcttggcatttaaagaattcttatakgtcatccgttcatccatccataca

SEQ ID NO: 18902 - DNA, 50 bp, homo sapien
tctcagggtatagatattgggctgayggaagattctgatgattaaatgag

SEQ ID NO: 18903 - DNA, 50 bp, homo sapien
gacagataaagatgtcgctgctacckgaacacctttgtatggaagtctgc

SEQ ID NO: 18904 - DNA, 50 bp, homo sapien
tttatttttttaaatagcccactgayacaaatttcagatgtctgcaagcc

SEQ ID NO: 18905 - DNA, 50 bp, homo sapien
agggatccccatcagtctccaaaggwaggaaaattaccaaaattgtgcaa

SEQ ID NO: 18906 - DNA, 50 bp, homo sapien
atctgagccagacttttcattggtakgattttgaatctttacaataactc

SEQ ID NO: 18907 - DNA, 50 bp, homo sapien
tgatttgagctgtggctttctctacwcccatttacccataaatgtgattt

SEQ ID NO: 18908 - DNA, 50 bp, homo sapien
atcaggatatgcaagttataaaacaygatgcagaatcactacgcacacac

SEQ ID NO: 18909 - DNA, 50 bp, homo sapien
aagtacagtattgtacccaagtagartaatcttttgacagatgaaatgac

SEQ ID NO: 18910 - DNA, 50 bp, homo sapien
gaaaatgtagcttttctagactgtawatagtggcagtagcaagagagagg

SEQ ID NO: 18911 - DNA, 50 bp, homo sapien
gaattatcacattgtaacattcaaartgccaagtttccaacaaaaaccta

SEQ ID NO: 18912 - DNA, 50 bp, homo sapien
gtaggcaggtggatctgaaatctcayatagtaccaagacacgtgactagg

SEQ ID NO: 18913 - DNA, 50 bp, homo sapien
agatcccagaggggcccaagccatasgcaagatgacctcttggtggggat

SEQ ID NO: 18914 - DNA, 50 bp, homo sapien
aaacagtagcaaacatttagaatgcwgactgttatgtttggaagaactcc

SEQ ID NO: 18915 - DNA, 50 bp, homo sapien
gaggtttcccagcatgactttgagamgagtggcagtatgcatattttaca

SEQ ID NO: 18916 - DNA, 50 bp, homo sapien
tgaagatgaatattcaagtggtggaracagaagcagggtaatatgtaggg

SEQ ID NO: 18917 - DNA, 50 bp, homo sapien
agaagctccccattactgagaggaaraagacgacccaagataattctcac

SEQ ID NO: 18918 - DNA, 50 bp, homo sapien
ctcatggagcataatgatctatcagkaataatccgtgctcatctcctaca

SEQ ID NO: 18919 - DNA, 50 bp, homo sapien
tctagaaggaatgagaaaacaaatasgtttcaatagcaaagactctgctc

SEQ ID NO: 18920 - DNA, 50 bp, homo sapien
ttctgagaactgctttaaatacaacracctgtgcttgcatgcagatgtcc

SEQ ID NO: 18921 - DNA, 50 bp, homo sapien
actagtccctgggctttgttctttaraagtaataagacagaaaattacat

SEQ ID NO: 18922 - DNA, 50 bp, homo sapien
catgttgcctggataacttctattcrctctctggatctcagctcagacat

SEQ ID NO: 18923 - DNA, 50 bp, homo sapien
aacagaaacccaactcccaccacagrattttaaagtagaaaagaaacacg

SEQ ID NO: 18924 - DNA, 50 bp, homo sapien
tcacacaaaggaatctattaagtcakcagatattgcccgtgaaatacaac

SEQ ID NO: 18925 - DNA, 50 bp, homo sapien
cctctttggtttgctgggtctcaaarcaattataaagtaaaagtaacatc

SEQ ID NO: 18926 - DNA, 50 bp, homo sapien
taagaggtgttcgatatgtgtttgakgagtctccaggatggtgtagaaat

SEQ ID NO: 18927 - DNA, 50 bp, homo sapien
taataagtataatcctgctagtcacrataataacaaaaacaaccccttgg

SEQ ID NO: 18928 - DNA, 50 bp, homo sapien
ggaatgggacagattatgattcctgmaaagaagttgcactggtaatgact

SEQ ID NO: 18929 - DNA, 50 bp, homo sapien
gcttttgaagcataagtgattacaayttggcaatggtgtcaggcagaact

SEQ ID NO: 18930 - DNA, 50 bp, homo sapien
tttaaaactggatgaaaaaattaaaygtacaagcaggatagggaataaag

SEQ ID NO: 18931 - DNA, 50 bp, homo sapien
cgttttatagataatggtaataagayaaacaataagaagagccaacgttt

SEQ ID NO: 18932 - DNA, 50 bp, homo sapien
taaggtaactaaccactgagccacaytattactagattttctgagtccac

SEQ ID NO: 18933 - DNA, 50 bp, homo sapien
gttgggaccaaagatttatgtgcaakggagtttttatttatctgccctgt

SEQ ID NO: 18934 - DNA, 50 bp, homo sapien
gtttagagaaaccaagtcttcaagayagcactggttataatttgtttttc

SEQ ID NO: 18935 - DNA, 50 bp, homo sapien
tcctttagaataacagaaggtcacargacttaaaatagacccataaaagc

SEQ ID NO: 18936 - DNA, 50 bp, homo sapien
aaaagattaatccaacaaagagaaaktccatctagcaggataagtactat

SEQ ID NO: 18937 - DNA, 50 bp, homo sapien
ggtagagctgacggtcggagtagacrgcgcgggccaggctaatcctctgc

SEQ ID NO: 18938 - DNA, 50 bp, homo sapien
ccctgtcttgaagatgtcaaagtagkagcccagagtgtttagtaaaaggg

SEQ ID NO: 18939 - DNA, 50 bp, homo sapien
gccctgctatcatccctctgtagaakaaggcaccaaggctcagagacacc

SEQ ID NO: 18940 - DNA, 50 bp, homo sapien
atgggagcttttatttttttcatctmactgatattagcagacccacagta

SEQ ID NO: 18941 - DNA, 50 bp, homo sapien
cagcaagactgaaggaacaaggaagkagctaaaatgttaacaaatagcaa

SEQ ID NO: 18942 - DNA, 50 bp, homo sapien
agagttaaacctttctattctttcarcagttggaacactatttttaaaaa

SEQ ID NO: 18943 - DNA, 50 bp, homo sapien
gtgggtgttccctgcaaagactgccratgtttgaagaattaaatgattat

SEQ ID NO: 18944 - DNA, 50 bp, homo sapien
aaatagaatcatggcctagacaatcmagaaagggagccatggtgttgctg

SEQ ID NO: 18945 - DNA, 50 bp, homo sapien
tagacagtcatatatagctaattacratctgaagcgagtgtgaattatga

SEQ ID NO: 18946 - DNA, 50 bp, homo sapien
agaggcagatcacctaatccaatcasggataatgtttaatcaaagctaga

SEQ ID NO: 18947 - DNA, 50 bp, homo sapien
ctaaagcttcatttctcaaaatgccragttgagtcaggacggaaggagaa

SEQ ID NO: 18948 - DNA, 50 bp, homo sapien
cctgcttattcaattaatcacttaaytgatcatgctgtcatctttttctg

SEQ ID NO: 18949 - DNA, 50 bp, homo sapien
aactctatattcaacttgcatcaaarcacgtgtcatagagaagcaggagt

SEQ ID NO: 18950 - DNA, 50 bp, homo sapien
gttggacttcaagaagttatcccaawctcttcattcattcacttattcat

SEQ ID NO: 18951 - DNA, 50 bp, homo sapien
taggtagtacgttcatatatcagaamtcgtattacacacaggagatcctg

SEQ ID NO: 18952 - DNA, 50 bp, homo sapien
agaaggagtagttcagtgacataaargacatggaaccttaaaacagaaaa

SEQ ID NO: 18953 - DNA, 50 bp, homo sapien
tttggtaaattgatcgttgagcaaargtaatacaatgtaggaaaggcatt

SEQ ID NO: 18954 - DNA, 50 bp, homo sapien
cctcccagaagtgttagctaattgaraagtattcagggccaccacactat

SEQ ID NO: 18955 - DNA, 50 bp, homo sapien
tgggtatatcaggagggccaacaaaraatgtgtcaagagagtaaagaagt

SEQ ID NO: 18956 - DNA, 50 bp, homo sapien
ttgtctgctcagactggcatctgcaygataacccaagagctagaatactc

SEQ ID NO: 18957 - DNA, 50 bp, homo sapien
cttgagtatatggctacttaagtgckcccttctacgtctttcctaatcta

SEQ ID NO: 18958 - DNA, 50 bp, homo sapien
gagaaaagtagtggtggtctagagayatttaggaaggctgcgatgggtcc

SEQ ID NO: 18959 - DNA, 50 bp, homo sapien
ttcattctctctctgccacacagcartatgatcgttccactggtaaagct

SEQ ID NO: 18960 - DNA, 50 bp, homo sapien
attttatagagttgctgaaagaatcmatgtgaaaatgtacataaagtgtt

SEQ ID NO: 18961 - DNA, 50 bp, homo sapien
aagaggagggagaatggcaagttgcraacccgggacaacaaagctgagct

SEQ ID NO: 18962 - DNA, 50 bp, homo sapien
agcttgctatccatgctttgctttayagcttgacctttcatggaactaca

SEQ ID NO: 18963 - DNA, 50 bp, homo sapien
cttttccatgcatctttgtcaatgayggtttacattctgggattgaacta

SEQ ID NO: 18964 - DNA, 50 bp, homo sapien
tccagcttcttccaaagcacattgawaagaacaatatttgtatatcactt

SEQ ID NO: 18965 - DNA, 50 bp, homo sapien
aggcactttataaactgacaagaacratatttgtaccgcactttatagtt

SEQ ID NO: 18966 - DNA, 50 bp, homo sapien
atgtgacacttgtcaaataacatgcrcggcccttcagtatctcccagtga

SEQ ID NO: 18967 - DNA, 50 bp, homo sapien
cttaaattattttcttgactggttcwcatggaggtataaagagtcctgtt

SEQ ID NO: 18968 - DNA, 50 bp, homo sapien
gaagtggaaagggacaatctcaagakgctgtactttataaaactggagtc

SEQ ID NO: 18969 - DNA, 50 bp, homo sapien
aagaaataagagatccttcccaaaaygatgcctggcgatttgcttttttt

SEQ ID NO: 18970 - DNA, 50 bp, homo sapien
attttccttctctcataatcttggarccactttattaaatgacagaaaga

SEQ ID NO: 18971 - DNA, 50 bp, homo sapien
ggtggctttggcatgtgtccatgggsatgttcgcctcaaagtgatgcagg

SEQ ID NO: 18972 - DNA, 50 bp, homo sapien
aagtcctacacagcagccttctttcmaaacacagacaggtagagccatcc

SEQ ID NO: 18973 - DNA, 50 bp, homo sapien
gcaatgtgcccaagttacttcactgsaggatcaggaattaggtctaattt

SEQ ID NO: 18974 - DNA, 50 bp, homo sapien
atccattaaaatgtaattactgatawgataggattttcaggtgccatttt

SEQ ID NO: 18975 - DNA, 50 bp, homo sapien
tataattataattactaacacacaayttatcaaaataacataatcacatt

SEQ ID NO: 18976 - DNA, 50 bp, homo sapien
acagctcaaagttagaatgttgttckcaaaaaggaaaactaatacacacc

SEQ ID NO: 18977 - DNA, 50 bp, homo sapien
cttcgtgtcttcttctggaaattggractaataatccaccagaagctgtt

SEQ ID NO: 18978 - DNA, 50 bp, homo sapien
gcataaatctaaactgagaaggcaaytgaaaaagtaattcaggaacaatc

SEQ ID NO: 18979 - DNA, 50 bp, homo sapien
ataagcacgtctttaaggaattatcratgtcagagtctatccatttaaag

SEQ ID NO: 18980 - DNA, 50 bp, homo sapien
aaaagctccttgttccacgtggagarctattggctttgcttatatcacaa

SEQ ID NO: 18981 - DNA, 50 bp, homo sapien
ttcaggtgtggagaaacttagcagcsagagatgggtttttgagaaaaaga

SEQ ID NO: 18982 - DNA, 50 bp, homo sapien
gcagcatgagaacagactaatacacyaggcgattaatcaaagtctatatg

SEQ ID NO: 18983 - DNA, 50 bp, homo sapien
tgagagaaatgtcagctatgccttaytaagcacatggtaaagtgataaga

SEQ ID NO: 18984 - DNA, 50 bp, homo sapien
ccaactccttccattacctttgatamgtctagacctgatccagtgagtat

SEQ ID NO: 18985 - DNA, 50 bp, homo sapien
agttggaacctacatttatggagaayctattaagtgctaggtgtttctta

SEQ ID NO: 18986 - DNA, 50 bp, homo sapien
acccatggctagagctagaaccctamgagctgcttcctaccaaaaatgag

SEQ ID NO: 18987 - DNA, 50 bp, homo sapien
cagataagtaaaggaagcaaataccraggttcatgtctcaagtgttgctg

SEQ ID NO: 18988 - DNA, 50 bp, homo sapien
gaaacgggctaataatttgagaggargccatagctgaaattctcaactgt

SEQ ID NO: 18989 - DNA, 50 bp, homo sapien
tgtaaattatttatttgcatacctaygaagtctaaagaacattataattg

SEQ ID NO: 18990 - DNA, 50 bp, homo sapien
gtttcccttagataagttcgatcaayaaagaatccatttcttctgcaaag

SEQ ID NO: 18991 - DNA, 50 bp, homo sapien
tcatagatcatcaactttgagatggrcactttaaaaaaatattttaacag

SEQ ID NO: 18992 - DNA, 50 bp, homo sapien
taaaacttcgctttatccttctagarattttgggcacataaacgcaatat

SEQ ID NO: 18993 - DNA, 50 bp, homo sapien
gaataatttgcttaaaataaatggaygagaatggtaagttgcaatgtaag

SEQ ID NO: 18994 - DNA, 50 bp, homo sapien
tcagaaagtaatgtagattgctttcmcttcaagaactaacagctctaaag

SEQ ID NO: 18995 - DNA, 50 bp, homo sapien
taatcttgccaatatagatagctaaytgaattcttaactaactttgcaat

SEQ ID NO: 18996 - DNA, 50 bp, homo sapien
aatactctacaagccaaataaaacaytgtctccaggctattggccaccag

SEQ ID NO: 18997 - DNA, 50 bp, homo sapien
cctcaccatctccagttagtcgcaayggaaattagaagagcttgcatatt

SEQ ID NO: 18998 - DNA, 50 bp, homo sapien
gtaaaggtggttgctttattttaaawtactctacaagccaaataaaacat

SEQ ID NO: 18999 - DNA, 50 bp, homo sapien
aaagaaggaaagaaacatctccaaargcatgcatatacccatggctagag

SEQ ID NO: 19000 - DNA, 50 bp, homo sapien
aaacagtgacctctcaggattcatayggtggtgaggttctttgactgact

SEQ ID NO: 19001 - DNA, 50 bp, homo sapien
ttccttccttacgcaacaatctaagmaacaccaggagtagaatttggttt

SEQ ID NO: 19002 - DNA, 50 bp, homo sapien
gtaattggtttgtaacaatctaacartcttgctttatcttcctttcattt

SEQ ID NO: 19003 - DNA, 50 bp, homo sapien
tcaataggtatatgctaaatgaatgwacaagtttccacaattaatgacat

SEQ ID NO: 19004 - DNA, 50 bp, homo sapien
gttgataaaggttgcagttggaaaayagttttatggatttatttaaaaat

SEQ ID NO: 19005 - DNA, 50 bp, homo sapien
ttaaaggcagtaggctattgctggawcttggatggagattgatgtggttg

SEQ ID NO: 19006 - DNA, 50 bp, homo sapien
agcatttttgatagaggaaatagcaygttcaaggctatatgcagagctga

SEQ ID NO: 19007 - DNA, 50 bp, homo sapien
tccttgggcaatgaggtgaaaacggracgaaggatgatgagcacagcatc

SEQ ID NO: 19008 - DNA, 50 bp, homo sapien
aaaggcacactctctacaataaataycacatttctgaaagagaattcaca

SEQ ID NO: 19009 - DNA, 50 bp, homo sapien
tgaactggctactcaaaagagaatayaaatgcctaagtctcagggataga

SEQ ID NO: 19010 - DNA, 50 bp, homo sapien
aggaaaaaagaccaggatcttcaacmaagttttactgtaaaaatttcaaa

SEQ ID NO: 19011 - DNA, 50 bp, homo sapien
aattttcaaaggcattggccactaaytcattgattgtcatcacccagtca

SEQ ID NO: 19012 - DNA, 50 bp, homo sapien
tgaagttctcttgattcctcttttakctctctgtccttaatcatatcctg

SEQ ID NO: 19013 - DNA, 50 bp, homo sapien
aaacatttatatattatgtagtatayggaaaaaatgaacggggaaagaaa

SEQ ID NO: 19014 - DNA, 50 bp, homo sapien
tttttatagtgtgttacttgttttcraccatatcagaagagctttgattt

SEQ ID NO: 19015 - DNA, 50 bp, homo sapien
tacttgttcagtgagtttcatgtcartcatatgcatccccagcacttgtg

SEQ ID NO: 19016 - DNA, 50 bp, homo sapien
gagttctaaagatgaattaagaacartaactttcatcaagatatgtaata

SEQ ID NO: 19017 - DNA, 50 bp, homo sapien
tcagaggtactcagtaaatgttgaaytcattggctcatttgacaaatgca

SEQ ID NO: 19018 - DNA, 50 bp, homo sapien
tagccaaactccttaccacaattgaygtgattttgtgtgatttgcttatt

SEQ ID NO: 19019 - DNA, 50 bp, homo sapien
ctgcacacaaaaaaatcaataaatayccattatgactacctctgtaccag

SEQ ID NO: 19020 - DNA, 50 bp, homo sapien
gaaaccaaggaacacctcataatacrgagttaaggcttgcaacacactgc

SEQ ID NO: 19021 - DNA, 50 bp, homo sapien
tgacggaagtagaaaggtgagttaartgcatccttagagaaatgttcgtt

SEQ ID NO: 19022 - DNA, 50 bp, homo sapien
gttcctcatgtacaaaagttaatcaktaatgtatcctctgaaaagcttta

SEQ ID NO: 19023 - DNA, 50 bp, homo sapien
atcatcacaccagccaactctgagcrcaggcacgtagtaggcatttttgc

SEQ ID NO: 19024 - DNA, 50 bp, homo sapien
gaagcatgggaaattttgatatgtayatttgacctgtctcgagcatcatt

SEQ ID NO: 19025 - DNA, 50 bp, homo sapien
atcaacctcagggcagcgcagggaaygaaatgcacaggccagtacatggt

SEQ ID NO: 19026 - DNA, 50 bp, homo sapien
ctcctcataccactattaatttctayggttctttgagagaaatagcatcc

SEQ ID NO: 19027 - DNA, 50 bp, homo sapien
tcttggtttataccaatatcctagckcatctctccaatgtttttttttct

SEQ ID NO: 19028 - DNA, 50 bp, homo sapien
cctggctcctgtttccattttaacawgagaagtggttgtgttaaaggaat

SEQ ID NO: 19029 - DNA, 50 bp, homo sapien
attagggggtggttcactataactgmaaatgaatttaaacttgagaattt

SEQ ID NO: 19030 - DNA, 50 bp, homo sapien
tttgtattattgcaatggataatacmatactgaatacaaattttaagagt

SEQ ID NO: 19031 - DNA, 50 bp, homo sapien
tatcaacattcagatcatatcaccartcatttgtatatttattttgccaa

SEQ ID NO: 19032 - DNA, 50 bp, homo sapien
agtactgtatgatgcacttaacagayattttcttggttcataccacagtc

SEQ ID NO: 19033 - DNA, 50 bp, homo sapien
ttttggtgtgttccttatgatatackattcagacaattatgttttgcttt

SEQ ID NO: 19034 - DNA, 50 bp, homo sapien
gaagagaagtttgttgaaggtgtagkaaaggaaggaaactgacatagagt

SEQ ID NO: 19035 - DNA, 50 bp, homo sapien
aggtgcaaaatgtaatagttctgatyacctactacctatcatctgggaca

SEQ ID NO: 19036 - DNA, 50 bp, homo sapien
taaactagatgttgtctttttgtaartattttagcaacatgtatgtatgt

SEQ ID NO: 19037 - DNA, 50 bp, homo sapien
ctctcatggaaaacaaataaattaamaagtcaagaagatattaactgaaa

SEQ ID NO: 19038 - DNA, 50 bp, homo sapien
ctaactccgaagtctgctctgtatcraaagattctagggcatgctggcct

SEQ ID NO: 19039 - DNA, 50 bp, homo sapien
tggtttattcaccaaaaagagcccamtctggcatgtagcatagctttctc

SEQ ID NO: 19040 - DNA, 50 bp, homo sapien
attagatagctgaggaacaagttagratgtaattaaccaacggacaccaa

SEQ ID NO: 19041 - DNA, 50 bp, homo sapien
ctctacagtttgcaaagccttacacrcccaggaattcatatgctggtagc

SEQ ID NO: 19042 - DNA, 50 bp, homo sapien
atttcacaaataccctacaatgtacrattccctttctagaatttattatt

SEQ ID NO: 19043 - DNA, 50 bp, homo sapien
acaatgtggactactacagagtggaygggagtgtaggataaaaaactatt

SEQ ID NO: 19044 - DNA, 50 bp, homo sapien
attttgacacgtgttaagtacttgakgaatagatgtgtgaataattaatc

SEQ ID NO: 19045 - DNA, 50 bp, homo sapien
agatgattccaagataccaagaaagraaactcaggcagggcccagatgga

SEQ ID NO: 19046 - DNA, 50 bp, homo sapien
agaaacaagatcgtcataactggaaygggaatcaaaattgcatttgacga

SEQ ID NO: 19047 - DNA, 50 bp, homo sapien
tgtctgcttttcttcatatctctcartctagtgtataattcaacactgtt

SEQ ID NO: 19048 - DNA, 50 bp, homo sapien
ccacctggtttgattttgagacacaytattatgaactgaataggtctcta

SEQ ID NO: 19049 - DNA, 50 bp, homo sapien
ttggaaagatgtacatttccagaaamagtcattgaggtattgatagggtt

SEQ ID NO: 19050 - DNA, 50 bp, homo sapien
attcaaggcaagggacgttaaaggcraaacatcggttaggaggtaagtat

SEQ ID NO: 19051 - DNA, 50 bp, homo sapien
tgccttattttatttctatagttaayaggttaatcctaaaattctgtagg

SEQ ID NO: 19052 - DNA, 50 bp, homo sapien
atctgcttgttgagccaaagataaarttcacaccaagaagcctaaataaa

SEQ ID NO: 19053 - DNA, 50 bp, homo sapien
cacaggcatcaatatacctccaatawgtagactgttctcaaacaatactg

SEQ ID NO: 19054 - DNA, 50 bp, homo sapien
gagtaaagaataagacacataaaaartaaaagtaggccgggagccatggc

SEQ ID NO: 19055 - DNA, 50 bp, homo sapien
ccatcctccaccaacaaaaaatagakaatttctactaacatagtgcagga

SEQ ID NO: 19056 - DNA, 50 bp, homo sapien
gaggtgtcttaaaatatcaaatatcrattaaagtattcagatattctgat

SEQ ID NO: 19057 - DNA, 50 bp, homo sapien
ggtgtgctcagtacaaccattgccaracaaaatattttgatcaaaatccc

SEQ ID NO: 19058 - DNA, 50 bp, homo sapien
gtgctgtgtcacaaatttctttgtaygcctcttgggctaccgtggttttc

SEQ ID NO: 19059 - DNA, 50 bp, homo sapien
agagccaggactccccgactatctcygaaccattgtcaattcttaattcc

SEQ ID NO: 19060 - DNA, 50 bp, homo sapien
tttggaagcattcatggctaagaaaygttaggcttatcatagattcagca

SEQ ID NO: 19061 - DNA, 50 bp, homo sapien
tatgttaatatacaaatgaatagccrataaatgaagttgggacaactggc

SEQ ID NO: 19062 - DNA, 50 bp, homo sapien
atagattaatgggttaaaatgtgaamtaaataagtgaacaaattaaggtg

SEQ ID NO: 19063 - DNA, 50 bp, homo sapien
ccttacttagaccactcgatttaaaytgaagagttcatgtgtgtctaata

SEQ ID NO: 19064 - DNA, 50 bp, homo sapien
cagatttctttttagcaacaatacasacccttttaagtaattgataccct

SEQ ID NO: 19065 - DNA, 50 bp, homo sapien
tgcaccatttttcttttcactaatayacttgatcttcattattcatggga

SEQ ID NO: 19066 - DNA, 50 bp, homo sapien
ctattttgttcatattattaaggaaktattccagccttgaagagaccttg

SEQ ID NO: 19067 - DNA, 50 bp, homo sapien
tcacatcccagaccagaaggtataaraataaataagtagattaaagtgat

SEQ ID NO: 19068 - DNA, 50 bp, homo sapien
ttaacaggcatccatgctccacagaygatcttttttactcattttacaaa

SEQ ID NO: 19069 - DNA, 50 bp, homo sapien
taatgtttccctcttcctctcctcartctcttatatgatccgtgatcttt

SEQ ID NO: 19070 - DNA, 50 bp, homo sapien
aacattttagcatcaaagacttctaygttcactgttttgttattcagatg

SEQ ID NO: 19071 - DNA, 50 bp, homo sapien
tctttacattttgcccacagtcgtgwaagctaatggcatcattttcatgc

SEQ ID NO: 19072 - DNA, 50 bp, homo sapien
aattcccatagcttgagagacatgayatttttatgtatagacttttcaaa

SEQ ID NO: 19073 - DNA, 50 bp, homo sapien
tgccaaagtccatgcaacttgttaakgcaagagctaaaataggagtcatt

SEQ ID NO: 19074 - DNA, 50 bp, homo sapien
gtgttcttttaagacatagtctccastacctgaagttgtattttaatgtg

SEQ ID NO: 19075 - DNA, 50 bp, homo sapien
tagcctcatgttcaattcaactcaaycacttggagctctctgggcatctg

SEQ ID NO: 19076 - DNA, 50 bp, homo sapien
agtttattttattggcatgaagtacsgcttaaggcagaaattcaaacctt

SEQ ID NO: 19077 - DNA, 50 bp, homo sapien
ctctagctagtcctcagaattcaacyagcattccctgaaagccctcattt

SEQ ID NO: 19078 - DNA, 50 bp, homo sapien
ctgcacaatttatcagaatgagtgaytatttttcctaagctgaagagaga

SEQ ID NO: 19079 - DNA, 50 bp, homo sapien
catctagaaattctgtgtcctagtaygttgccgcaatgactttttggata

SEQ ID NO: 19080 - DNA, 50 bp, homo sapien
tttagagggaatttagatttgacaaygactctaaaaattgcacaccacct

SEQ ID NO: 19081 - DNA, 50 bp, homo sapien
caaacaggctaagacagtcagacaarcaaagacttttgcctcattaatag

SEQ ID NO: 19082 - DNA, 50 bp, homo sapien
aacaatctatttgaataatgagctartaagtatggatgaaagaatggata

SEQ ID NO: 19083 - DNA, 50 bp, homo sapien
agaactctaaaaactcatgataaaartaactaaaatataaataaaagatt

SEQ ID NO: 19084 - DNA, 50 bp, homo sapien
gtgagggcccactgcctggtgcataracagagactcccagctgcattctc

SEQ ID NO: 19085 - DNA, 50 bp, homo sapien
aaagtatttatttctgctttacgtayagagttatggttttgcagaaggtg

SEQ ID NO: 19086 - DNA, 50 bp, homo sapien
gagacaaccctgtgcaagacacaaakcaacaatcttaaacatagtggaaa

SEQ ID NO: 19087 - DNA, 50 bp, homo sapien
aacataagctccactaggtgtaagamacttttataagccacaataatagc

SEQ ID NO: 19088 - DNA, 50 bp, homo sapien
ttgcagcttttctgattgtggcaacmacttttggctcttgaccaaggact

SEQ ID NO: 19089 - DNA, 50 bp, homo sapien
atctactttttttaatagaatgaccwacattatttgttctgtcaaatcta

SEQ ID NO: 19090 - DNA, 50 bp, homo sapien
gggttttaaatctctaaaaaacagtraattctaaagcaaaggagacatgg

SEQ ID NO: 19091 - DNA, 50 bp, homo sapien
cattgtcagaatatatttttcttctmacttagatcatagatttctaaaaa

SEQ ID NO: 19092 - DNA, 50 bp, homo sapien
tgttataaagtaacccccaaataaaygcatagtgcaacacgtgttttgtt

SEQ ID NO: 19093 - DNA, 50 bp, homo sapien
gaccttgcgttttcttctaaagcagratagcaattacagtaataatagct

SEQ ID NO: 19094 - DNA, 50 bp, homo sapien
atatatattaaggttgatgatgatayaaggtgacagaaacacacagaaga

SEQ ID NO: 19095 - DNA, 50 bp, homo sapien
gcatagtgcaacacgtgttttgttaygctcatgaatttgttttgatcaag

SEQ ID NO: 19096 - DNA, 50 bp, homo sapien
gggagaagtgctaaaagaagtctctsaaaaccatatcccaggaggaaagt

SEQ ID NO: 19097 - DNA, 50 bp, homo sapien
catcatggtccatgatgggatgccasctttcataaaaatatgcaaaaact

SEQ ID NO: 19098 - DNA, 50 bp, homo sapien
ttcttccatccttggatttacagtasagatttcttctgaatgggtagaat

SEQ ID NO: 19099 - DNA, 50 bp, homo sapien
tacattgaaaactattcttagacgaygcataaagcgactgcaaatgattt

SEQ ID NO: 19100 - DNA, 50 bp, homo sapien
agttattctttttgaaatatctaacygtaattttctccaaaattttcgga

SEQ ID NO: 19101 - DNA, 50 bp, homo sapien
atgttatttctgttaaaaattctcaygctgaaaatcttctggcttagaaa

SEQ ID NO: 19102 - DNA, 50 bp, homo sapien
ttcctcagagggtgaaataacttgckagggtacaacagtgacttagtaat

SEQ ID NO: 19103 - DNA, 50 bp, homo sapien
aacctgatgccaggccttctggtcaygagtccagcactctttctcctgtg

SEQ ID NO: 19104 - DNA, 50 bp, homo sapien
tttttcctatcaggtacattactacrggcattaaacatttttcctggggt

SEQ ID NO: 19105 - DNA, 50 bp, homo sapien
tacaaatgcagtgtgacagtaaaagrcattggttttctcttctatgcagc

SEQ ID NO: 19106 - DNA, 50 bp, homo sapien
cctgcctatcccctggcttaattccrgctccatgcatgtgacgagcagaa

SEQ ID NO: 19107 - DNA, 50 bp, homo sapien
gagaaaatacattgatgattagcaakaatttttaaaagcatgtgattttg

SEQ ID NO: 19108 - DNA, 50 bp, homo sapien
tgtgacgagcagaaaaaagaaagtcrcatctggacctccggcggcaaggg

SEQ ID NO: 19109 - DNA, 50 bp, homo sapien
gctctaagaactgggaatggccaagracaaaagaaagaaatcctgggcta

SEQ ID NO: 19110 - DNA, 50 bp, homo sapien
agcttcaggtattggttgatgaaaakcacttagctatttcaagatgctca

SEQ ID NO: 19111 - DNA, 50 bp, homo sapien
ttttatggagaggttccaatggtgayatttgtaaagtttctcaggtgatt

SEQ ID NO: 19112 - DNA, 50 bp, homo sapien
gtgttggccaatgcagcttaaaaacygctcaataattatacatccaacta

SEQ ID NO: 19113 - DNA, 50 bp, homo sapien
agagtttgccaaacatctctcatgaytagatttaccgggagtctccttag

SEQ ID NO: 19114 - DNA, 50 bp, homo sapien
acaagaattgcttaggaatcttgtcraatatgataatccctggattttta

SEQ ID NO: 19115 - DNA, 50 bp, homo sapien
atctccatatgtgattttactttaaygacatgtaattcaactgaataata

SEQ ID NO: 19116 - DNA, 50 bp, homo sapien
catccatgtcctattatccctgtaartaaaatgtgacacgatttgatatt

SEQ ID NO: 19117 - DNA, 50 bp, homo sapien
attaagtgattttctttttgctgtaygaaagcagtataatttttatagat

SEQ ID NO: 19118 - DNA, 50 bp, homo sapien
tccatgtcgttttatctaaatcagcycaaaaccaaggacgctggtgttcc

SEQ ID NO: 19119 - DNA, 50 bp, homo sapien
caagtggttaaacaaaccagcaaatsagaattgggtcaaattcagcaaca

SEQ ID NO: 19120 - DNA, 50 bp, homo sapien
gtagaatgactctctaaacatcaaarttccttgaaaagcaagtcaacaag

SEQ ID NO: 19121 - DNA, 50 bp, homo sapien
taaaataatatttatgcctctatgcwccatttaatttcctccacaagctt

SEQ ID NO: 19122 - DNA, 50 bp, homo sapien
cctcttgccgaggagctcatcattgyaggtagagttgacattcagaacag

SEQ ID NO: 19123 - DNA, 50 bp, homo sapien
cacagtagagtggctgaattatctgyataaatttgcaaatcagaacacca

SEQ ID NO: 19124 - DNA, 50 bp, homo sapien
gattcaaagtgtcaactcttaggctsagaaatcaaatttggcagttttat

SEQ ID NO: 19125 - DNA, 50 bp, homo sapien
gttttggattttgactgacttactckcaatattttgtcagcatcattcaa

SEQ ID NO: 19126 - DNA, 50 bp, homo sapien
agtcaaaggtgttaaacagaaagacrattcttcacacattggatatgcca

SEQ ID NO: 19127 - DNA, 50 bp, homo sapien
aataagaccaagttctactagcacamtgaagtattgaatgccaaattatc

SEQ ID NO: 19128 - DNA, 50 bp, homo sapien
acagagttagatattactgaatcaastgaatccaattggatatcttccca

SEQ ID NO: 19129 - DNA, 50 bp, homo sapien
ttgtagggtaagtcaaataaagatamgcagataggaaagtacagaaattg

SEQ ID NO: 19130 - DNA, 50 bp, homo sapien
aataagaaacacaagggagagagccragaatctgccttttagggtgcgga

SEQ ID NO: 19131 - DNA, 50 bp, homo sapien
tgttaaataacttgcccaactgcaamgagcaaatagaagccagaattcaa

SEQ ID NO: 19132 - DNA, 50 bp, homo sapien
aaaccatctctgtataatgatgttaygcacggttagaagagagatcacaa

SEQ ID NO: 19133 - DNA, 50 bp, homo sapien
agcattaataaccttgcagtgttgargaagaaaaacaactgaagcctagg

SEQ ID NO: 19134 - DNA, 50 bp, homo sapien
acatctcttagccacaaagaaaggcracttcagatctaacctagatgtga

SEQ ID NO: 19135 - DNA, 50 bp, homo sapien
gccaagcttactttgtacattacacrctggaactcagagccaagctaact

SEQ ID NO: 19136 - DNA, 50 bp, homo sapien
cattgcactgaataaggaattccaaygtggcaaagttatttctataaaag

SEQ ID NO: 19137 - DNA, 50 bp, homo sapien
agctcatcgttgccactgatattacrgatgagagtaaatggcagagatag

SEQ ID NO: 19138 - DNA, 50 bp, homo sapien
cactttttctgttgttttgattttaygtttctgaacatgtggatttatca

SEQ ID NO: 19139 - DNA, 50 bp, homo sapien
tacccagaatctgtaagctactcagmaattaaaaatcaaagccagaaaaa

SEQ ID NO: 19140 - DNA, 50 bp, homo sapien
atttctttttattccggcttgtactsaattactagaacaacttcatttct

SEQ ID NO: 19141 - DNA, 50 bp, homo sapien
ttttctaaaccacctgctgattgccractttttatttattcagttgactt

SEQ ID NO: 19142 - DNA, 50 bp, homo sapien
tacattgaggcatattttaaattgaragcagccaccttgttttttactca

SEQ ID NO: 19143 - DNA, 50 bp, homo sapien
ttattattcaacagtagattaatcayggctgaataaatatggaacagaac

SEQ ID NO: 19144 - DNA, 50 bp, homo sapien
tataaaagaatgactgctcatatgasatgcattgtggtgtagtatgcaat

SEQ ID NO: 19145 - DNA, 50 bp, homo sapien
aaacagatgcaatttaggtgaaacasggttactctgaaggtcaatgccac

SEQ ID NO: 19146 - DNA, 50 bp, homo sapien
atttctattggagagggctattctasactgtaagcccatagagcagaaac

SEQ ID NO: 19147 - DNA, 50 bp, homo sapien
gatagagtggtcattctactctgacrcaaaacctaactgctcacatgaat

SEQ ID NO: 19148 - DNA, 50 bp, homo sapien
ggttggtggctgtgtggcccaatcasagccaattactgtgactaggtagg

SEQ ID NO: 19149 - DNA, 50 bp, homo sapien
cagatagtctttccatctggacttgwacctgagagaatgtgaagctgagt

SEQ ID NO: 19150 - DNA, 50 bp, homo sapien
ggaaaatagaattatcatatgttaartgtttatgagagaataatcatgcc

SEQ ID NO: 19151 - DNA, 50 bp, homo sapien
ttatacccactgctccatttgcatcraagtcataaacctccacctgctac

SEQ ID NO: 19152 - DNA, 50 bp, homo sapien
cacaaacctgtctgaaaggctaatayggaataaatgaagtgcttattccg

SEQ ID NO: 19153 - DNA, 50 bp, homo sapien
tatactaaccctggccctgcattacrcgagctgcttagctcacctgctga

SEQ ID NO: 19154 - DNA, 50 bp, homo sapien
tgttagtgaggaagaatgggtacaaragtgaggagagtcattctggacag

SEQ ID NO: 19155 - DNA, 50 bp, homo sapien
gcgtggtgagaagcgagaatgaaaaygtctctgagaacccatgtgaacag

SEQ ID NO: 19156 - DNA, 50 bp, homo sapien
atcccttcttgtggtggcctgtccartgaatagtagatatgggagtataa

SEQ ID NO: 19157 - DNA, 50 bp, homo sapien
tcttgatgaatgaggaagaattcagmaaatgaacaataagaatcatatgt

SEQ ID NO: 19158 - DNA, 50 bp, homo sapien
gtttgtgaactgaagccagctaggartaaagggcctgcttgacttaccca

SEQ ID NO: 19159 - DNA, 50 bp, homo sapien
atgctggtgatcagaagttccaaatwacaggccactctaatctctgatca

SEQ ID NO: 19160 - DNA, 50 bp, homo sapien
ggcctctgcagtccctgttccctgaygattttatgggctgtaactctttg

SEQ ID NO: 19161 - DNA, 50 bp, homo sapien
acaaaagcctgagtgtggagccataygtgtcataaaaacagccacaacaa

SEQ ID NO: 19162 - DNA, 50 bp, homo sapien
gaagttccctattttgctctcaccartagcccatcatcaagaactaatgt

SEQ ID NO: 19163 - DNA, 50 bp, homo sapien
tatgagttagttataagtctagatayctcacataatgagagcctaaactt

SEQ ID NO: 19164 - DNA, 50 bp, homo sapien
gcacaatgtggaagatccagagtgamtaactggacaacaaaacttaaaat

SEQ ID NO: 19165 - DNA, 50 bp, homo sapien
taaactttacattgatctgtgaaatkaccacctccaaaatcccaaataag

SEQ ID NO: 19166 - DNA, 50 bp, homo sapien
tttcttttaattttcttcatataacycttcacatgtactcttgagattgc

SEQ ID NO: 19167 - DNA, 50 bp, homo sapien
caggttcggggtgaaaagtgaggagragcgccagacttatgttgtttctt

SEQ ID NO: 19168 - DNA, 50 bp, homo sapien
cagcttatggttggctataatgctcmgaaatagaagcaatgattagacaa

SEQ ID NO: 19169 - DNA, 50 bp, homo sapien
aaaatatgaattggtgggtaaaaccrgagagctgcagtcaagatctgttt

SEQ ID NO: 19170 - DNA, 50 bp, homo sapien
aatgaactgacggtgttgaaaatgckagagatgaaaatatttactgaaaa

SEQ ID NO: 19171 - DNA, 50 bp, homo sapien
tcaagtaatacgtgttgagcaccacrcttatcccttataatgaagcacaa

SEQ ID NO: 19172 - DNA, 50 bp, homo sapien
ggtggtgctgattggagaaactttaygtaaacttgaatgttatgtaaatc

SEQ ID NO: 19173 - DNA, 50 bp, homo sapien
ggaaatttatcttgaaaccttgtagratcaatttatatttagaagaacaa

SEQ ID NO: 19174 - DNA, 50 bp, homo sapien
cgcaggtgatatgctgtctgtgaccrcgacaattttcctaaaagaggggt

SEQ ID NO: 19175 - DNA, 50 bp, homo sapien
aactttgcaattcttatgataaaackgataaacaaaaaactcaggaccaa

SEQ ID NO: 19176 - DNA, 50 bp, homo sapien
atattcatgtgtttcaatatgtaccraaatttacattacatttaaaatac

SEQ ID NO: 19177 - DNA, 50 bp, homo sapien
aagataaagataattaaaaatttgaygcatttcttcccagtgtttttact

SEQ ID NO: 19178 - DNA, 50 bp, homo sapien
gaaggattaaatttagagatgataaygataatggaattataaatcagcac

SEQ ID NO: 19179 - DNA, 50 bp, homo sapien
gtacctctccaaagccaaaaagttcmatctctatgttcaagctctcataa

SEQ ID NO: 19180 - DNA, 50 bp, homo sapien
aagtgattcgttttaacattcccaascaataactagttctacacaaaacg

SEQ ID NO: 19181 - DNA, 50 bp, homo sapien
cagtctagggaatgggaatgatgccyaaatacttgtgttgcttttgttac

SEQ ID NO: 19182 - DNA, 50 bp, homo sapien
ggcagattctggacttggaacatggraacaatataatttaatgctcaata

SEQ ID NO: 19183 - DNA, 50 bp, homo sapien
tgttccgagataaagcaaagggcagsagtatattggtccaattaatttga

SEQ ID NO: 19184 - DNA, 50 bp, homo sapien
catttgcatctcatccatgttgtaawtggtatcatcaacacagtgctcaa

SEQ ID NO: 19185 - DNA, 50 bp, homo sapien
agtaaaattattctcaggttgcatastagaattaaaagtgccagattctt

SEQ ID NO: 19186 - DNA, 50 bp, homo sapien
tgcattcatagttattcataaacackaattatgtctctttctataatctt

SEQ ID NO: 19187 - DNA, 50 bp, homo sapien
acaatgtaaaatttctcttcataaaratggaatggatgcttctgtgatag

SEQ ID NO: 19188 - DNA, 50 bp, homo sapien
ggcagaaatccaactgaaaatctcaycgcagggctcccaaaacacatctt

SEQ ID NO: 19189 - DNA, 50 bp, homo sapien
agaaactattttatcagtcaatcgawcttagcaaataatgcccaatcttt

SEQ ID NO: 19190 - DNA, 50 bp, homo sapien
agaacccaggaatactggacttaacraatgcttaccttctttttctttcc

SEQ ID NO: 19191 - DNA, 50 bp, homo sapien
cttcatttcacaattatattaagatyacacttcagagatccttataggct

SEQ ID NO: 19192 - DNA, 50 bp, homo sapien
atatttgaatcaaataacattcctgyatgacagtccttccagtgcactct

SEQ ID NO: 19193 - DNA, 50 bp, homo sapien
ttatttctgcctgatagaactcatgwatgaacgaaggtgatttttaaaaa

SEQ ID NO: 19194 - DNA, 50 bp, homo sapien
ttttcctcaaacaaaaggtctgacargtttttatacattcagaacagaaa

SEQ ID NO: 19195 - DNA, 50 bp, homo sapien
taaaagcatttagtatcataactagwatcctgtaagtgctcaatcattgg

SEQ ID NO: 19196 - DNA, 50 bp, homo sapien
taattctaagtttcaaacctggataygtgaattaataaatgtgagcacag

SEQ ID NO: 19197 - DNA, 50 bp, homo sapien
tagttttatgaaagtatgcagggcartaaatgcatcaagtatagcatctt

SEQ ID NO: 19198 - DNA, 50 bp, homo sapien
aaatgcccaactccaagtttactgakgttgatagtttgttcaaagttgcc

SEQ ID NO: 19199 - DNA, 50 bp, homo sapien
agatatggcataacactttaatcgcyattggctatgggcctaataaaatc

SEQ ID NO: 19200 - DNA, 50 bp, homo sapien
gctttgataggggctcttctcaaackgctgtcctgtccttctgagtgcct

SEQ ID NO: 19201 - DNA, 50 bp, homo sapien
ttaacagaaatgttctgactttttcragacatgataaaacagagagctat

SEQ ID NO: 19202 - DNA, 50 bp, homo sapien
atgcatttagcatcagttgcagatayggatagccttttcaaaaaatgcat

SEQ ID NO: 19203 - DNA, 50 bp, homo sapien
tagcatctctacgtggtttctccaartgaactctccagcagaatatattg

SEQ ID NO: 19204 - DNA, 50 bp, homo sapien
gttcactgatctcgtcagtgtcttayggcaagaacaggtctgaagcttgg

SEQ ID NO: 19205 - DNA, 50 bp, homo sapien
tctgggcctctttttgaactgggaawtctgatccaggaggtctggcatag

SEQ ID NO: 19206 - DNA, 50 bp, homo sapien
atgaggatttacaagacaggtgttawgtttactgattgctaactgcacat

SEQ ID NO: 19207 - DNA, 50 bp, homo sapien
aatatctctgtgacagactcaacagratgaagtttattgtttagttacaa

SEQ ID NO: 19208 - DNA, 50 bp, homo sapien
ctccctcaataaatcacctcaagaascacactctcgggctctcctaggga

SEQ ID NO: 19209 - DNA, 50 bp, homo sapien
aaatactataacccaaactcctataycatactcctgtacaactcgtgagc

SEQ ID NO: 19210 - DNA, 50 bp, homo sapien
aaagtgatgaaaaagaggatctcacrgaaaagaggtcttaaaattcactt

SEQ ID NO: 19211 - DNA, 50 bp, homo sapien
tgatgctatgagcactgggacctccrggaaagagtaaagaattcctcctc

SEQ ID NO: 19212 - DNA, 50 bp, homo sapien
gggtagcaggaaaaagaagttaaaayacagtgatgggattactgggcagg

SEQ ID NO: 19213 - DNA, 50 bp, homo sapien
attacagacacttaaaaagaataacrcctacattttctaatctgctatgg

SEQ ID NO: 19214 - DNA, 50 bp, homo sapien
aatgtttgagaaactgtgcagtgagratgaatcaacaagtaaatatcatg

SEQ ID NO: 19215 - DNA, 50 bp, homo sapien
caaggtagtcaaagatgtgaacaagrattcttacaactgagaagcagagt

SEQ ID NO: 19216 - DNA, 50 bp, homo sapien
gcgctctcctgaactgtccattggakctaaggtttgccttgcatctaaca

SEQ ID NO: 19217 - DNA, 50 bp, homo sapien
ccaagctcagctgcaattttaacacrgccatcagggatatctgtctctct

SEQ ID NO: 19218 - DNA, 50 bp, homo sapien
cttggagagaactagtatcaaaacaytaaaatgctcggttactttggaaa

SEQ ID NO: 19219 - DNA, 50 bp, homo sapien
ttttcctagctttgatgcagacttaygctggtaaaaatgggtttaaattt

SEQ ID NO: 19220 - DNA, 50 bp, homo sapien
tcgcaaaacaagccttatttcataayccactaataattactaaccttttt

SEQ ID NO: 19221 - DNA, 50 bp, homo sapien
cttcggctcagatattggctacaaaygtgctactcaccttctgagggttc

SEQ ID NO: 19222 - DNA, 50 bp, homo sapien
tttctgccaccatttctttatgatamctgaccaataaggagagggtaatc

SEQ ID NO: 19223 - DNA, 50 bp, homo sapien
tgtggttggagatgaggaaaagaaakatccccatgaagcagcttgtgaac

SEQ ID NO: 19224 - DNA, 50 bp, homo sapien
tttctctctacaatgaacagggcccratatgcttcatgttacaagctgca

SEQ ID NO: 19225 - DNA, 50 bp, homo sapien
cattttttacagctgagggtattaargactgctgacattgacttacttag

SEQ ID NO: 19226 - DNA, 50 bp, homo sapien
cacagaaataggaagagatcaataargcccagaagagaaatcttgccaaa

SEQ ID NO: 19227 - DNA, 50 bp, homo sapien
ggactccaccaccattgcaaagccasacaagtttaagttttttggggtat

SEQ ID NO: 19228 - DNA, 50 bp, homo sapien
ctaagggacattttgaaaattaaatkatagcacatgaggcaagcaatcaa

SEQ ID NO: 19229 - DNA, 50 bp, homo sapien
aaccttaatagggctttgcaagacaygatgatctttcatacaattataaa

SEQ ID NO: 19230 - DNA, 50 bp, homo sapien
tgaattagcgagaacctaatttaaaraaaagcagcaaagatgcttcacaa

SEQ ID NO: 19231 - DNA, 50 bp, homo sapien
tgaatcatgcttgcatgtatcatgayggaaaactatagaagcaggtcatg

SEQ ID NO: 19232 - DNA, 50 bp, homo sapien
tttggtaaaagaaaagaccacgatckcataaacatgcctactaagataca

SEQ ID NO: 19233 - DNA, 50 bp, homo sapien
tttttatttgtcttgtagtacctaayatggaagtcacagaatccagagtg

SEQ ID NO: 19234 - DNA, 50 bp, homo sapien
tacaccagggagatacaaggtgataygagtattgagaacagagacctgac

SEQ ID NO: 19235 - DNA, 50 bp, homo sapien
tgtgactgtgtttttttaatatatgratctgtctcatcttctccactggg

SEQ ID NO: 19236 - DNA, 50 bp, homo sapien
atggaagtcacagaatccagagtgtsaacatggaagctacaaagttgctt

SEQ ID NO: 19237 - DNA, 50 bp, homo sapien
atccatgtgactatttgatttatacrcccatcaatgtctagggcttctca

SEQ ID NO: 19238 - DNA, 50 bp, homo sapien
caatcttttcgctttctctttagatsacgaatacaggtacaaaaaaatga

SEQ ID NO: 19239 - DNA, 50 bp, homo sapien
cagaccttcactcaagccaaccatamaaaattatcaatgcaaccaacaag

SEQ ID NO: 19240 - DNA, 50 bp, homo sapien
catttctgaaataaacagcttaaaaytgcaggtcacatgaatttttattt

SEQ ID NO: 19241 - DNA, 50 bp, homo sapien
ttcttcatacttctgtcactttttcyattggaagatttgcttaggaaaat

SEQ ID NO: 19242 - DNA, 50 bp, homo sapien
aatcttatgttcctcaatgacagaarcccatttttaccaaggactgggat

SEQ ID NO: 19243 - DNA, 50 bp, homo sapien
gtgtttgatcccaatccctggggaarctacggaaatgcaactcaaaactg

SEQ ID NO: 19244 - DNA, 50 bp, homo sapien
tcctatagtcatagtcattttgacayattaatgaggaatgaaaatcccag

SEQ ID NO: 19245 - DNA, 50 bp, homo sapien
ctttggtcaggaatggtgctttagaygctcagctggctctgtacaaagtt

SEQ ID NO: 19246 - DNA, 50 bp, homo sapien
atgactgtcatttgccaatccctggyacgaatccttatcatcttattatt

SEQ ID NO: 19247 - DNA, 50 bp, homo sapien
cagtaaaggtgaactaattcttaggragagttttggcacttgtttgaagc

SEQ ID NO: 19248 - DNA, 50 bp, homo sapien
gctatgttagatactccagttcattsaaagtgatatcaccctaacattct

SEQ ID NO: 19249 - DNA, 50 bp, homo sapien
gatatcaccaccaatccatgcaaatyaattgaccagaattgtgttagtat

SEQ ID NO: 19250 - DNA, 50 bp, homo sapien
gcttgaagcagctaggtaagaagaamatttcaaatcaattttgggccaca

SEQ ID NO: 19251 - DNA, 50 bp, homo sapien
gcttaagtggacgacaaataaatgaygactgaattcaagcacagtgctta

SEQ ID NO: 19252 - DNA, 50 bp, homo sapien
caaagcaagaatatgcaaaatggcasataccgcatgaccttgatagttag

SEQ ID NO: 19253 - DNA, 50 bp, homo sapien
gggacaacttcaagtagttttgtgayggaagtaaattaaatgctgaggtg

SEQ ID NO: 19254 - DNA, 50 bp, homo sapien
aactgtgtgaagccaccctgggtacsaactttgagaaagaagcaggcttg

SEQ ID NO: 19255 - DNA, 50 bp, homo sapien
attccatcttttcttacctacttacycagtggcgtagacaggatgttgaa

SEQ ID NO: 19256 - DNA, 50 bp, homo sapien
agatttagtgcttgtagacgtcaacsaagattgaacaaacaggtctgggt

SEQ ID NO: 19257 - DNA, 50 bp, homo sapien
aaactgaactagactgtatgtcaaaraagagtctcaatgtcaacttaatc

SEQ ID NO: 19258 - DNA, 50 bp, homo sapien
tgttaaaaggaaactgaagataattmaatggcaccttgctgtagaaataa

SEQ ID NO: 19259 - DNA, 50 bp, homo sapien
agccacttaagctttgggaccgcggscatttgctcagtctgtttcttagg

SEQ ID NO: 19260 - DNA, 50 bp, homo sapien
gcaaacatgagatacagttgattaawctaagtacctccacattgacattc

SEQ ID NO: 19261 - DNA, 50 bp, homo sapien
accatttttggtattatcatgtgcartagtattttactgtagtattaatt

SEQ ID NO: 19262 - DNA, 50 bp, homo sapien
aacaggactttcataattgatctaartgacaaagcaatcaaaatggggaa

SEQ ID NO: 19263 - DNA, 50 bp, homo sapien
ggactcttggttcaggtatcacctaygacataaagccttcccttatgtcc

SEQ ID NO: 19264 - DNA, 50 bp, homo sapien
aaaaagagaaagtctaaaaactccaragaggaagtaatcctgagacccca

SEQ ID NO: 19265 - DNA, 50 bp, homo sapien
agagctccatggtgcagatagctcaragaggattaaattatactttgtag

SEQ ID NO: 19266 - DNA, 50 bp, homo sapien
cttcaatgaaatagaaacacatttaratagacctgaacttctaaatgtgt

SEQ ID NO: 19267 - DNA, 50 bp, homo sapien
gtttccccaggttgaatgctcttacyactggcgcacatacattaaagagc

SEQ ID NO: 19268 - DNA, 50 bp, homo sapien
aaccaaacttttctattcagaagtaygttttcctctcaggcttccctgtg

SEQ ID NO: 19269 - DNA, 50 bp, homo sapien
gagagagcttgtaaattgtgacctargatagatcataaaaatatatatat

SEQ ID NO: 19270 - DNA, 50 bp, homo sapien
gccctggggtcctgatcagaaaccawtagtagggtcagagtattgagggg

SEQ ID NO: 19271 - DNA, 50 bp, homo sapien
gccagggtgtagtcctctgagaaagragtgatacatttacatgtgaaagc

SEQ ID NO: 19272 - DNA, 50 bp, homo sapien
tcaagaagacaatgtaagactactcygaatgattggaacacgttcttgag

SEQ ID NO: 19273 - DNA, 50 bp, homo sapien
tgaaggatcaagttgtcagccaagakaaccaagagccagacacagggaac

SEQ ID NO: 19274 - DNA, 50 bp, homo sapien
gagaccaggagctgagcaccgagaaycatctgtgagctgccgctgtgatg

SEQ ID NO: 19275 - DNA, 50 bp, homo sapien
agtgtgattcaccacttcttgcatayaacagtgcaaatcaaagatttttt

SEQ ID NO: 19276 - DNA, 50 bp, homo sapien
aactgttgcgtggagttcacagttcsactaaccctgtgaacacccaagcc

SEQ ID NO: 19277 - DNA, 50 bp, homo sapien
cccaagacatgaacagtgtggaagartcttaccagcatcacgctataaaa

SEQ ID NO: 19278 - DNA, 50 bp, homo sapien
gtctctctctgcctttgttttatagyaagaggctacatttggaccaggtg

SEQ ID NO: 19279 - DNA, 50 bp, homo sapien
aacaaatccaggtcatagcatagaartgggacctctctgtgtggagctct

SEQ ID NO: 19280 - DNA, 50 bp, homo sapien
ccattcatcattacacttttgtctckcagagtgtcatacaatgagtaaca

SEQ ID NO: 19281 - DNA, 50 bp, homo sapien
gcaggcaaggctgcaatgtggatccraaagtctcctgaggctggagtttc

SEQ ID NO: 19282 - DNA, 50 bp, homo sapien
atgagctttactgcattacaaaccaycaaatgtagcagcttataacagca

SEQ ID NO: 19283 - DNA, 50 bp, homo sapien
tagagaaagagactctaggtcttaaytggagaaactgtcatgtcctattg

SEQ ID NO: 19284 - DNA, 50 bp, homo sapien
agccatccacatgcctttcacctcargtaacactgggaggggacagcctt

SEQ ID NO: 19285 - DNA, 50 bp, homo sapien
tagaaatatagtctctaataaaaaaktccaaactgaacaatgaacaaaat

SEQ ID NO: 19286 - DNA, 50 bp, homo sapien
tatagattgagaatgacctaaagcartataacttaagagggaaagacatc

SEQ ID NO: 19287 - DNA, 50 bp, homo sapien
ctaatgtgttttaaatggagagttaygttaggaaaatgttcctaaacata

SEQ ID NO: 19288 - DNA, 50 bp, homo sapien
tttctactaacagaaacgtctggagyagtcgcaagagaatcctgtctcgg

SEQ ID NO: 19289 - DNA, 50 bp, homo sapien
ctcttcatggttggtagaggaagcgyagaataggtcgggcacacggtagc

SEQ ID NO: 19290 - DNA, 50 bp, homo sapien
gtcccacatcagttatgaaattgagsagagactcttttaacaaaaaaaca

SEQ ID NO: 19291 - DNA, 50 bp, homo sapien
caccacagggggcctcctaaaaatakaccgactgctatgtgatagcttag

SEQ ID NO: 19292 - DNA, 50 bp, homo sapien
atggttactcaattaaatatgactcwgaatttaagaattttctacttccc

SEQ ID NO: 19293 - DNA, 50 bp, homo sapien
ttgttgacttgtttgtggtttgtgayaataaaggatgtagggtctttaat

SEQ ID NO: 19294 - DNA, 50 bp, homo sapien
cacagaaggcttaaaatgccgcaggwattgttgtgtaacaaaacatttct

SEQ ID NO: 19295 - DNA, 50 bp, homo sapien
ggcaggtgttcattgattctctatayatacgttgttgcattttacatgtg

SEQ ID NO: 19296 - DNA, 50 bp, homo sapien
caatctttagttcttctgctagaaarccaatgtctccaaaagtatttcct

SEQ ID NO: 19297 - DNA, 50 bp, homo sapien
caggtataggtgatgtggcagcaaaygatataaacaggagctaaatttgg

SEQ ID NO: 19298 - DNA, 50 bp, homo sapien
gacccaaagctggaagggaatcttaycatcatcttgttcactcctggatc

SEQ ID NO: 19299 - DNA, 50 bp, homo sapien
ttgttggtgtcttactcccattttayctcaatgcctaacacattgcttag

SEQ ID NO: 19300 - DNA, 50 bp, homo sapien
tttcatgattacagaattgtaaagasagtctccgtcatttaaaatatcta

SEQ ID NO: 19301 - DNA, 50 bp, homo sapien
tgtgcttccactgcagactggatagmaaccctaactctgcaataccacta

SEQ ID NO: 19302 - DNA, 50 bp, homo sapien
acatgaccttaccactcacaaatgayaggtagacacagagccacaaataa

SEQ ID NO: 19303 - DNA, 50 bp, homo sapien
gcaccatagatctggaagggatcacrgagaaaacgggaagaaagggattt

SEQ ID NO: 19304 - DNA, 50 bp, homo sapien
tatttctatgctgactgaaatgagayattgtaatacatgctcctcaaaga

SEQ ID NO: 19305 - DNA, 50 bp, homo sapien
catgaccccccagtgctctaaggacraggccctgttgtgcccatgtgcca

SEQ ID NO: 19306 - DNA, 50 bp, homo sapien
gcaattttgattataaattcaaaccygaaaaatacagagaaaatataaaa

SEQ ID NO: 19307 - DNA, 50 bp, homo sapien
aactaattactcccagttggactcayctgttcacccgacagtcttcaagc

SEQ ID NO: 19308 - DNA, 50 bp, homo sapien
gtccctcctaaggcagtccctgtgaratgacatagcatagcaatggttca

SEQ ID NO: 19309 - DNA, 50 bp, homo sapien
ggaaagtgagaatcagctgtacttaycacatagctcttgctgctctaaat

SEQ ID NO: 19310 - DNA, 50 bp, homo sapien
aatctagactagaaccaccaccgcarcaataagtacaaagaataaacaca

SEQ ID NO: 19311 - DNA, 50 bp, homo sapien
aaataaaacaacagagctataaatayggataattaactgtagtaaaataa

SEQ ID NO: 19312 - DNA, 50 bp, homo sapien
tgtaatattaagatgagaaagatccyaactggacaaggaatgccattcgt

SEQ ID NO: 19313 - DNA, 50 bp, homo sapien
tgatttacttatgtcaaatttacacraatggcattccttgtccagttagg

SEQ ID NO: 19314 - DNA, 50 bp, homo sapien
ggtgctgaaccaaagaacacaaatgkagaatcagttcatctgggacctga

SEQ ID NO: 19315 - DNA, 50 bp, homo sapien
atagttttcatcattattatggatargtagtcctaaaggagagaggttta

SEQ ID NO: 19316 - DNA, 50 bp, homo sapien
agtgttgagtatatggtgatgatatwaaagataacgtaaacatattctaa

SEQ ID NO: 19317 - DNA, 50 bp, homo sapien
gactttaactcatacatatcacacartggactcagtgacctaaatatgac

SEQ ID NO: 19318 - DNA, 50 bp, homo sapien
ccaggaatggccactgtttgtattargaaggtcatgtttactagaaagtc

SEQ ID NO: 19319 - DNA, 50 bp, homo sapien
cacaggtggaacctaagtgctcagaycaaggagcggggactaaattaaga

SEQ ID NO: 19320 - DNA, 50 bp, homo sapien
gcagatgacttcccactttagagacsaaacttggagactcattgaactgc

SEQ ID NO: 19321 - DNA, 50 bp, homo sapien
aaatgtatattgaaatgcaaagaaastagaatagcaaaaatgttttgaaa

SEQ ID NO: 19322 - DNA, 50 bp, homo sapien
cattactctaggaaagaatcctacayattaatactgagtaagtgcccagg

SEQ ID NO: 19323 - DNA, 50 bp, homo sapien
cagaaaagcacatggtaatagtgccractcaaatgcttcccgggcaatag

SEQ ID NO: 19324 - DNA, 50 bp, homo sapien
tggctctgtgctgccataatcatgcmagaccaatccacctcaacttttat

SEQ ID NO: 19325 - DNA, 50 bp, homo sapien
gtaaacagatactcatattgttagcraaggtgctttcaagaaggtctctc

SEQ ID NO: 19326 - DNA, 50 bp, homo sapien
gtgtcttgacattgggcctgcaggaytatcttcagagtgacaccatgggg

SEQ ID NO: 19327 - DNA, 50 bp, homo sapien
gaggacaagtttgccattattaaaartagagttcccttcatgctgttatt

SEQ ID NO: 19328 - DNA, 50 bp, homo sapien
agcttcccacacatccgatggattcmaatgtaccataatacactgtacag

SEQ ID NO: 19329 - DNA, 50 bp, homo sapien
ctctaacaattttagcaacctgtatwaccttggaaaaatgattaagtctt

SEQ ID NO: 19330 - DNA, 50 bp, homo sapien
tttcaagtaaagccaataacgtaagraaagcgctacccacttccatcaat

SEQ ID NO: 19331 - DNA, 50 bp, homo sapien
agagacacacacttattaactcacaygtatggatcagaatgactaaacat

SEQ ID NO: 19332 - DNA, 50 bp, homo sapien
ggaagggtagagtgtgtctcaattcygaaattcaaaaagggccacatagg

SEQ ID NO: 19333 - DNA, 50 bp, homo sapien
acaggcagtggtcattagtttcaaaygctacaatgatttaaagattagca

SEQ ID NO: 19334 - DNA, 50 bp, homo sapien
ttttgtctttccttgtttcccttaayatttcatgaattgtctagcaaaaa

SEQ ID NO: 19335 - DNA, 50 bp, homo sapien
ttcagttttcaccaggtcctatggaragttgtatatattataattgattc

SEQ ID NO: 19336 - DNA, 50 bp, homo sapien
ggtttgctgaagattttctagaagcrctatttacacaaatatgcaaatgt

SEQ ID NO: 19337 - DNA, 50 bp, homo sapien
tcacatgtgtttttcagtatctctgyaatccagtatgcattccaaatgaa

SEQ ID NO: 19338 - DNA, 50 bp, homo sapien
gtaaatagggacagaaagtctgaacratcaacttgaagtaataatgctat

SEQ ID NO: 19339 - DNA, 50 bp, homo sapien
acatcattaatttttgcagtcatccyatgtactatcactcttagtttggt

SEQ ID NO: 19340 - DNA, 50 bp, homo sapien
gcaccaccgcacctgactgaaaacaytgattttttttcacttttctctcc

SEQ ID NO: 19341 - DNA, 50 bp, homo sapien
gtacaactgggtatggctatttacarctggatatattctgatatgtattc

SEQ ID NO: 19342 - DNA, 50 bp, homo sapien
gggttacgcccgggaaccataactaraagtggctgtttggtggttatatg

SEQ ID NO: 19343 - DNA, 50 bp, homo sapien
taccaaattctctttttacacatccratgataaatacataagccctaaat

SEQ ID NO: 19344 - DNA, 50 bp, homo sapien
gatcatatgggaattgtctgcttgarccttttagggaacctagatgatga

SEQ ID NO: 19345 - DNA, 50 bp, homo sapien
caaagcagggctacttttgtttggayggaagtgagaggtgagtaattggc

SEQ ID NO: 19346 - DNA, 50 bp, homo sapien
ctttgaggagggaagtgccattatargaaacaagatttggttttaaatgc

SEQ ID NO: 19347 - DNA, 50 bp, homo sapien
aaaaatgaattgaaatacatgcgacrctgactatggttcctaacagaaag

SEQ ID NO: 19348 - DNA, 50 bp, homo sapien
acaagcaactatcaaccagcatatgyatttctaaagtattataatgactc

SEQ ID NO: 19349 - DNA, 50 bp, homo sapien
gccaaaatattcttttcaaagtgatwagaagtaggagaagcttgctctct

SEQ ID NO: 19350 - DNA, 50 bp, homo sapien
gaggcagtttggaccttgagtggacmaggatttctggggtgctgcctttc

SEQ ID NO: 19351 - DNA, 50 bp, homo sapien
ttaattgtgcactcatcctaacactraatttgtcagttacatctggaggc

SEQ ID NO: 19352 - DNA, 50 bp, homo sapien
ctccttcccctctgggattcattcayaggtatttgatagaggcagcccag

SEQ ID NO: 19353 - DNA, 50 bp, homo sapien
taaccatgttctgggtgttcttgatyagcagtagtacccaatccttgctg

SEQ ID NO: 19354 - DNA, 50 bp, homo sapien
gacatctgacatcttgatagccacamtggaagtcaaaagacagtagaatt

SEQ ID NO: 19355 - DNA, 50 bp, homo sapien
gacatcaaagtcttggggcacagaartcacgtggtttcatctatgctgta

SEQ ID NO: 19356 - DNA, 50 bp, homo sapien
agtttagcaaataatactattagtcragatctgcttaggtgtttcccctt

SEQ ID NO: 19357 - DNA, 50 bp, homo sapien
tcacatcgcctttgttatgtccagasgagaggcataaaaaggcactctcc

SEQ ID NO: 19358 - DNA, 50 bp, homo sapien
cctaagcttatgatgatgagttatgwatgccaaatacttatctgaagagt

SEQ ID NO: 19359 - DNA, 50 bp, homo sapien
tcacacggtaatataaaggtcaaatmaacttctatgaaaacactatgtta

SEQ ID NO: 19360 - DNA, 50 bp, homo sapien
cctttttacacggatatgcttattaycattcatagcataagccaagtgct

SEQ ID NO: 19361 - DNA, 50 bp, homo sapien
tagtagaagaatggtttacatacccratcatatcacctttttactgtggc

SEQ ID NO: 19362 - DNA, 50 bp, homo sapien
ttatttttcctttccttgagggataygtagctaagagtagactttaacat

SEQ ID NO: 19363 - DNA, 50 bp, homo sapien
gacattatttatgatatatgtgttayagatagatagatacagaatatgta

SEQ ID NO: 19364 - DNA, 50 bp, homo sapien
tttagcggcccttgagatttaaagaygtaagattagaataggatctcaga

SEQ ID NO: 19365 - DNA, 50 bp, homo sapien
gactcattttcaagaaaatcagtgamgtggagcctccccgaaaggatgca

SEQ ID NO: 19366 - DNA, 50 bp, homo sapien
cctttcgatcagtaacacggaggaaytgctgtttgtttgaattctagtgg

SEQ ID NO: 19367 - DNA, 50 bp, homo sapien
cccagaaagcagtgtcgcatccccasaatacaaaagcaaaacctccccct

SEQ ID NO: 19368 - DNA, 50 bp, homo sapien
ggagtcacatttatgttttccaacastgagatatgtagaagagagaattt

SEQ ID NO: 19369 - DNA, 50 bp, homo sapien
ccttattatgtggtttgatgatatamctgcacatgatttcagaaaaccac

SEQ ID NO: 19370 - DNA, 50 bp, homo sapien
agggattcatagagatcactctatcrcctaaaattctctcttctacatat

SEQ ID NO: 19371 - DNA, 50 bp, homo sapien
ggcaataatctgtttgattcactccwaatgctgcttctgatctccatcta

SEQ ID NO: 19372 - DNA, 50 bp, homo sapien
tacaaaaaaacaaaattcaaaaatgyatctagccaaagtaccattaagag

SEQ ID NO: 19373 - DNA, 50 bp, homo sapien
ccttccctatgcctctttaaaattcrcacaatagtggttcatgctccgag

SEQ ID NO: 19374 - DNA, 50 bp, homo sapien
ttctcagtatgtgaaatgggaacatsacttaccatctactcacctcctgt

SEQ ID NO: 19375 - DNA, 50 bp, homo sapien
ccggtgatgttatctcaagaatgcastacaccaagcgcattggagcctgc

SEQ ID NO: 19376 - DNA, 50 bp, homo sapien
aaatggcagttgaattagagtaaacrcctggtaggtttcaaggacttttt

SEQ ID NO: 19377 - DNA, 50 bp, homo sapien
gtcaaaatttcagtcttggtaagagyattatcagcttgtattattcatta

SEQ ID NO: 19378 - DNA, 50 bp, homo sapien
tgtagtgcattcttgagataacatcrccggtaggaatgaggaccatggct

SEQ ID NO: 19379 - DNA, 50 bp, homo sapien
aaacattttgctcagctggaaaaaaytcagtagcaagaccagccatggtc

SEQ ID NO: 19380 - DNA, 50 bp, homo sapien
ctgttagtgctgcaggttttagagawcttatgtctgatggtttatcaggc

SEQ ID NO: 19381 - DNA, 50 bp, homo sapien
acaaagagatgcagtgccttccccarattaacagagattcagtgcctctt

SEQ ID NO: 19382 - DNA, 50 bp, homo sapien
agggtcaccaggcaggtgaatgtgasagtgccctaaagttatgaagaaat

SEQ ID NO: 19383 - DNA, 50 bp, homo sapien
taatgcatgatactaagatattttayaaggtggcatgtagttaagtgtgc

SEQ ID NO: 19384 - DNA, 50 bp, homo sapien
atcaaggaagggattattagctaaaygattcgggtggcctctaggagctg

SEQ ID NO: 19385 - DNA, 50 bp, homo sapien
ctatgatatcaaggtctatgctggasaaaaaataccctaagtgagcaata

SEQ ID NO: 19386 - DNA, 50 bp, homo sapien
aggcccatgccctttctcctaattcrctttaaagaggcaacagcatgcag

SEQ ID NO: 19387 - DNA, 50 bp, homo sapien
tttatgcagctgcaaatctagttagraaggttccctccagggctgtacat

SEQ ID NO: 19388 - DNA, 50 bp, homo sapien
tcttttggtgaagagatatatacacrcctgaagaaaaagggctggactgt

SEQ ID NO: 19389 - DNA, 50 bp, homo sapien
gttgggaaaatcctctggtgataaasggaaagcaaaaattgtttaaaaac

SEQ ID NO: 19390 - DNA, 50 bp, homo sapien
ccacccctagactctttaatgggtckaactcaatggtgccctggaatgtc

SEQ ID NO: 19391 - DNA, 50 bp, homo sapien
ttcaggggctgagaacttgataatgratttctttctgaagcttgagaagt

SEQ ID NO: 19392 - DNA, 50 bp, homo sapien
cccccattcccaaattaaagcagcaygaataattttagaggtcttattta

SEQ ID NO: 19393 - DNA, 50 bp, homo sapien
agggttctcatttcatggctactgasgtatttattcctatactatttaaa

SEQ ID NO: 19394 - DNA, 50 bp, homo sapien
gaatgactctgaattcctttccaaasctaaaattctattctgtgaaacag

SEQ ID NO: 19395 - DNA, 50 bp, homo sapien
atatttgacaatgaccaaaatgagayaagttggagaaaagcttcattgga

SEQ ID NO: 19396 - DNA, 50 bp, homo sapien
aatgatctcatatgacagatggactyaggtgtgtattatatccagccctg

SEQ ID NO: 19397 - DNA, 50 bp, homo sapien
ccactgaaattactgacctaaacagwaaataagctgatgactatctttcc

SEQ ID NO: 19398 - DNA, 50 bp, homo sapien
aatgctcagaaaaaatatcatttgcyctctctaggctataaagttggcta

SEQ ID NO: 19399 - DNA, 50 bp, homo sapien
ccctatcagtgtgaggagtgtgggcragcctttaatgataatgcaaatct

SEQ ID NO: 19400 - DNA, 50 bp, homo sapien
gtacagagtgtgggaatagtttcacsagtagttccgagtttgttatacat

SEQ ID NO: 19401 - DNA, 50 bp, homo sapien
tgtggtgtctttgcagctaggatcastccgtcccacatccccagaagctg

SEQ ID NO: 19402 - DNA, 50 bp, homo sapien
tcaaagccatgctgaacacattgccrcatatggagtaacagctcaataaa

SEQ ID NO: 19403 - DNA, 50 bp, homo sapien
tactttgatgagactttgtggttgawgaagatgtctctgtcttgcttttt

SEQ ID NO: 19404 - DNA, 50 bp, homo sapien
ggaatctttgattagagctcatcaawggttcagagggacctttggtgctc

SEQ ID NO: 19405 - DNA, 50 bp, homo sapien
caaaacaagctgtgagaggctctgasaacagtgcattgtgggagaagtct

SEQ ID NO: 19406 - DNA, 50 bp, homo sapien
tcccttcagagactgcgttccttgayggtatggcccatgatctgctgcag

SEQ ID NO: 19407 - DNA, 50 bp, homo sapien
tatgtctgtttcttctagcgcttcayagctgtattgacacatgtttgttg

SEQ ID NO: 19408 - DNA, 50 bp, homo sapien
tcacatttactgagcttttataataygctattcagactgctacgaacaag

SEQ ID NO: 19409 - DNA, 50 bp, homo sapien
gacacaattataatgtgtaatattgraaaaactcacacaggcaaattcgt

SEQ ID NO: 19410 - DNA, 50 bp, homo sapien
gaacaagagtgcaagtaagaaaatarggtccttgtgcttttttaagaaag

SEQ ID NO: 19411 - DNA, 50 bp, homo sapien
catagatatatctcatttaatcctamagcagtcctacaataaaaatgtta

SEQ ID NO: 19412 - DNA, 50 bp, homo sapien
gaatacagctgtgtaagaaggaacgsaatttcattaactcatgttgcagg

SEQ ID NO: 19413 - DNA, 50 bp, homo sapien
ggtctgtaaagaataactttattaartgatagtcagcatgtattgggcac

SEQ ID NO: 19414 - DNA, 50 bp, homo sapien
aaaaccaacaaagacaaattcaaaarcgcaccactgttgacttgggcaac

SEQ ID NO: 19415 - DNA, 50 bp, homo sapien
tgtacccattactgtctccttaaacygtgtactcttcaagggccagccat

SEQ ID NO: 19416 - DNA, 50 bp, homo sapien
caatcacagtcattttacaaataacwcagcagtaaagggttcactgattt

SEQ ID NO: 19417 - DNA, 50 bp, homo sapien
aagacaatttcatatgaagatctaaytgacaaagcagtggcaaaatttct

SEQ ID NO: 19418 - DNA, 50 bp, homo sapien
aatcggggaaacctatgttttagaartgaagtcaatatatagaaagatat

SEQ ID NO: 19419 - DNA, 50 bp, homo sapien
aatgaagtcaatatatagaaagatayagcacttgaagtggtgagcttcag

SEQ ID NO: 19420 - DNA, 50 bp, homo sapien
ccaagaataagttatctcacttagawgagttttctgtgaaactgaagctc

SEQ ID NO: 19421 - DNA, 50 bp, homo sapien
gaataagaggccaattaaactagagwaagggatcttggtaggaaaatttt

SEQ ID NO: 19422 - DNA, 50 bp, homo sapien
acagtgtgatttcactcatgctgaarctattttcctgaaattggagcctt

SEQ ID NO: 19423 - DNA, 50 bp, homo sapien
gatatcaaggaacttgagtctaacarcgctcactaataacttaagtctga

SEQ ID NO: 19424 - DNA, 50 bp, homo sapien
agatgcaatgatgtaccagattctgyacccagttatgcccttagcactaa

SEQ ID NO: 19425 - DNA, 50 bp, homo sapien
cacccagttatgcccttagcactaayacaagcaacacaaaactgagagtt

SEQ ID NO: 19426 - DNA, 50 bp, homo sapien
tcgggacacattgtgttctcagatcrcattcggaaaggcaaaaagtgtga

SEQ ID NO: 19427 - DNA, 50 bp, homo sapien
tttgcagttacacagcttggaaatasaatggcaaagcaaattgggaaaat

SEQ ID NO: 19428 - DNA, 50 bp, homo sapien
tgacatgtcaatatgtacataacacyggttaccactgactatgaatctcc

SEQ ID NO: 19429 - DNA, 50 bp, homo sapien
ggtgacttttattatgctcttttcartattggtaataaagtggcactatg

SEQ ID NO: 19430 - DNA, 50 bp, homo sapien
tgaaatgattgaaaacaatccaaaayggactactaaaacagtgacctggt

SEQ ID NO: 19431 - DNA, 50 bp, homo sapien
gagttcatgtcactgaatattctcastataaggacagcattaattgtatc

SEQ ID NO: 19432 - DNA, 50 bp, homo sapien
gagaacgtccctaccatgatgtccastaaagaatgggctacgtgtcccgc

SEQ ID NO: 19433 - DNA, 50 bp, homo sapien
gtgcttgcattagaaaattaggaacrcctgcagaaaatggctttcccaca

SEQ ID NO: 19434 - DNA, 50 bp, homo sapien
gaaggcacaagtacttaatcatgcayccaaatatcaatgaggcagaaata

SEQ ID NO: 19435 - DNA, 50 bp, homo sapien
tcgaaataaacttctcattgaaggakaaaatacatctagaaaagggtaca

SEQ ID NO: 19436 - DNA, 50 bp, homo sapien
tacaggcaaatgattccatgcacaaktagttgttcccacaagtagccaat

SEQ ID NO: 19437 - DNA, 50 bp, homo sapien
gaaggctttcaacaattttctatcakagcttaaattcaattctaaggata

SEQ ID NO: 19438 - DNA, 50 bp, homo sapien
tggcagaggtgtagtcttaggtacartagttcctcaaggaaggagactag

SEQ ID NO: 19439 - DNA, 50 bp, homo sapien
agggtgagagatgcacgaatgatacratgaacttggtgagggaagtgagg

SEQ ID NO: 19440 - DNA, 50 bp, homo sapien
cttccagtcagtaaaacctgcgaaamctcacattgaaacagctcaccatg

SEQ ID NO: 19441 - DNA, 50 bp, homo sapien
ccaggcaccttggctagtgatcaacygggatgatgttcccagatacacag

SEQ ID NO: 19442 - DNA, 50 bp, homo sapien
tcttgcagacagggtctccttgaatsaaacttggccttggggaagagcat

SEQ ID NO: 19443 - DNA, 50 bp, homo sapien
tcttcagatattcctccatcgtatayagtatccatagggtcctccagcac

SEQ ID NO: 19444 - DNA, 50 bp, homo sapien
cgtggataagccataagggaggcaastgtatttttttgttgtgtggaaaa

SEQ ID NO: 19445 - DNA, 50 bp, homo sapien
atggtatcctctctgaatatataccrctttagccagaaatcctgaaggca

SEQ ID NO: 19446 - DNA, 50 bp, homo sapien
atgggaataaaaggaaggagaaacaycttgctttgaggctattgtgtaaa

SEQ ID NO: 19447 - DNA, 50 bp, homo sapien
cttttagaagcttataaaagcaatarccaagataatatcacgtggttact

SEQ ID NO: 19448 - DNA, 50 bp, homo sapien
gctggttaagagctcattagcgatgwaaaagcatgaagagtgacaggttt

SEQ ID NO: 19449 - DNA, 50 bp, homo sapien
cttccttataattcgtcaactaaaasgtcattatttgtcacagcaaagaa

SEQ ID NO: 19450 - DNA, 50 bp, homo sapien
aagactctgtctctattcgcttaacrcagtggaaaaaaaggccacccttc

SEQ ID NO: 19451 - DNA, 50 bp, homo sapien
acaaaaactgcaggtaaggcaagagrcccgtaattgattcataagatccc

SEQ ID NO: 19452 - DNA, 50 bp, homo sapien
aggaagaggagcatggtatcacataygagtagaggtatttacaaaacccc

SEQ ID NO: 19453 - DNA, 50 bp, homo sapien
gggaatcctgactttgttctactgayaactgttcatctttaacaagcctg

SEQ ID NO: 19454 - DNA, 50 bp, homo sapien
taaacccattgtaacctcttgacgamcttcaatcttaatcatttactgtt

SEQ ID NO: 19455 - DNA, 50 bp, homo sapien
tgctctgggaacaataacctcagaaytgctaaatggtgtcccatgaaaaa

SEQ ID NO: 19456 - DNA, 50 bp, homo sapien
tggataaactgaggcacagaatactsaggctcaaacctttagtaataaag

SEQ ID NO: 19457 - DNA, 50 bp, homo sapien
taactaatggtcatcaacggtatcaygctagaacactttcttgtagaatt

SEQ ID NO: 19458 - DNA, 50 bp, homo sapien
aatatgagagcccacagaaatgttasaaatcctccagggcagtctttcta

SEQ ID NO: 19459 - DNA, 50 bp, homo sapien
tgtttgcgaaataaactgaactaaaygagtgtcttatctttggctatttt

SEQ ID NO: 19460 - DNA, 50 bp, homo sapien
taacctgtattctaggtctatacaakcatccaaatttatacacacacaca

SEQ ID NO: 19461 - DNA, 50 bp, homo sapien
acaagaaaggagttgtgaatggcatkaagaatgagaacacagggaaagct

SEQ ID NO: 19462 - DNA, 50 bp, homo sapien
tttgtgtcttaaagtgttttggtcargagaaactaaattggttagaaagt

SEQ ID NO: 19463 - DNA, 50 bp, homo sapien
aaaactagtgataaaggagtgtagcragtttcataaaacatcatgtcatc

SEQ ID NO: 19464 - DNA, 50 bp, homo sapien
gctacctttgctggcagagaaacacygaggaataaacgccttcggaagga

SEQ ID NO: 19465 - DNA, 50 bp, homo sapien
caggatgttgcactctccttttaccrcacagcaattatgatgccaggtgt

SEQ ID NO: 19466 - DNA, 50 bp, homo sapien
ttttagtattatgctaagtttcagcsagcagctgtgagtgtttagaattt

SEQ ID NO: 19467 - DNA, 50 bp, homo sapien
attttccagtttgatttcgagcctawcatcagttaatttctctttgttct

SEQ ID NO: 19468 - DNA, 50 bp, homo sapien
cctcatcagtgtttcaaataaggtaraagtacactaattcagtgtcatca

SEQ ID NO: 19469 - DNA, 50 bp, homo sapien
gggtcaaacatgaaactattaaaccrctcttttatgttatttatcagcta

SEQ ID NO: 19470 - DNA, 50 bp, homo sapien
tggtttaaatcctctctacaaactcrccagctctgcaaaataatcatctt

SEQ ID NO: 19471 - DNA, 50 bp, homo sapien
tattgacctttccacttacgagttargccttttaagctacaatcctcctg

SEQ ID NO: 19472 - DNA, 50 bp, homo sapien
taaaaatgaagcaattaattgagacrcattgtataaaagaaatcagtgta

SEQ ID NO: 19473 - DNA, 50 bp, homo sapien
aatttttattgctatagcatttctcrgaatacaaaccctgtctgctgtat

SEQ ID NO: 19474 - DNA, 50 bp, homo sapien
ccagggaagacttgggcacgagcaamaacgaggactatgaagctagggtc

SEQ ID NO: 19475 - DNA, 50 bp, homo sapien
ggcagtttcattattacactcccaargtttcagaaatctcgaaattggaa

SEQ ID NO: 19476 - DNA, 50 bp, homo sapien
ctttttgtcttaaggtattcagtagsaaagatcacattaaacaaaaggaa

SEQ ID NO: 19477 - DNA, 50 bp, homo sapien
aggcataagaggaatgggagccaagrctggaatattgccaatggaagtga

SEQ ID NO: 19478 - DNA, 50 bp, homo sapien
agagtggtcaatagttggatttgacrctttcctggatcccaaccccactc

SEQ ID NO: 19479 - DNA, 50 bp, homo sapien
aacatctccacaaaaggcatttacasaccacttatatcttctctcttcct

SEQ ID NO: 19480 - DNA, 50 bp, homo sapien
caccccaaggttaccaatgactcacyggttattaactccaaaggacatta

SEQ ID NO: 19481 - DNA, 50 bp, homo sapien
ctggctgcaaacattggattcctcaygaatgcgggacttaattatcaaaa

SEQ ID NO: 19482 - DNA, 50 bp, homo sapien
ggtagggttttttggtaaggcttaamtgttcaggcaagaaattttcactg

SEQ ID NO: 19483 - DNA, 50 bp, homo sapien
actttgcagcctcacaggtggagaawtgcctgtttcctgagttcaagctg

SEQ ID NO: 19484 - DNA, 32 bp, homo sapien
aaccaacttcttgttayggtatatatttaact

SEQ ID NO: 19485 - DNA, 50 bp, homo sapien
ggaggaaatacactgtcagtgaattwaatgtcacaacaaaggctcttttg

SEQ ID NO: 19486 - DNA, 50 bp, homo sapien
tcggcttgttcaaaatgacataacaktcaaacacaggtctatggaaatcc

SEQ ID NO: 19487 - DNA, 50 bp, homo sapien
gcatgtttacaaaacccccaggcgayacatgtgcacattaaagctgagac

SEQ ID NO: 19488 - DNA, 50 bp, homo sapien
tgaaggtagacgtgcatccaggaaayagtagtggctgccctgtgtttgtg

SEQ ID NO: 19489 - DNA, 50 bp, homo sapien
acagttggttctaccatgagattgaraaggtatgggaactagtcacagtt

SEQ ID NO: 19490 - DNA, 50 bp, homo sapien
acagactgtgtttacaattgtcttaygttgtcccacaacatctctacaat

SEQ ID NO: 19491 - DNA, 50 bp, homo sapien
agctcttctttgcagatggcgtcctyaatgagaaagaactggaggatctc

SEQ ID NO: 19492 - DNA, 50 bp, homo sapien
agctaaacaaaaatctctctataatraaattctctgggcaattacctggt

SEQ ID NO: 19493 - DNA, 50 bp, homo sapien
tgcaggtgtctttgctaattagcacraactcactctctgtctccatgacc

SEQ ID NO: 19494 - DNA, 50 bp, homo sapien
gtctatgaacacagtccctctggaasaagatgaattaaaatccttaccaa

SEQ ID NO: 19495 - DNA, 50 bp, homo sapien
attcttttttgtaaaatgtatagtawgtcagaaagtgatcagtgctacag

SEQ ID NO: 19496 - DNA, 50 bp, homo sapien
ccaacatcaaaaaaactaagagacastaggccacagaactatggatgaaa

SEQ ID NO: 19497 - DNA, 50 bp, homo sapien
gataactgacagttactgtgtgctcyctagtgtgttgagggccacctcga

SEQ ID NO: 19498 - DNA, 50 bp, homo sapien
gagaagaggaagaatgccaggccaaygataggattaagagctagtgaatc

SEQ ID NO: 19499 - DNA, 50 bp, homo sapien
cacagagcgcagtgcctagaggacascgcatgcttaacccagtgttcatc

SEQ ID NO: 19500 - DNA, 50 bp, homo sapien
tcagcaaagactaggctctggaaaasaaaagcagaacatccatcagagcc

SEQ ID NO: 19501 - DNA, 50 bp, homo sapien
atttgtatatccagttgtttcagaarggcatataaaaggtactcataccc

SEQ ID NO: 19502 - DNA, 50 bp, homo sapien
ctgagatatagtaagttgatcagcawatgttatttatcctcttcttccct

SEQ ID NO: 19503 - DNA, 50 bp, homo sapien
aatttttaaagctccctcttggaaawgttagtggaaatcaacttttggtt

SEQ ID NO: 19504 - DNA, 50 bp, homo sapien
ttagcaatacacttttcattagtgarcttttttagtaagatgacattgaa

SEQ ID NO: 19505 - DNA, 50 bp, homo sapien
aaacaaagaaacatttcaaaccataraattatatgtaaccatcaaaaatt

SEQ ID NO: 19506 - DNA, 50 bp, homo sapien
ctcatggcctatgcctgtgtctatayaatacctgatacatggatgaaaga

SEQ ID NO: 19507 - DNA, 50 bp, homo sapien
taagtgaaatcaaatgagagaagtcyaaccttgcaaaactgagccaactg

SEQ ID NO: 19508 - DNA, 50 bp, homo sapien
cttgcagatgggacttagtatagaasagggagtttatcatcctgcggtat

SEQ ID NO: 19509 - DNA, 50 bp, homo sapien
aagaaaaggaaaatagccagaggtargtgaaatcaaatgagagaagtcta

SEQ ID NO: 19510 - DNA, 50 bp, homo sapien
tttctgcaccatcggtagtttctacraggatggaagaacaataacaataa

SEQ ID NO: 19511 - DNA, 50 bp, homo sapien
ggtcagtggtgttctgctaaatcgcyacttaataccagcaatttctagca

SEQ ID NO: 19512 - DNA, 50 bp, homo sapien
ccttcctgtccaatataaggcagaasaaaggtgtgactgggtgtcagtgt

SEQ ID NO: 19513 - DNA, 50 bp, homo sapien
ctgatgcaacaaacgtgtcttgagcrccttgaagataagacagctcctat

SEQ ID NO: 19514 - DNA, 50 bp, homo sapien
agattgcctgtctgattttgcagaaktagctccaacatggttttggtaac

SEQ ID NO: 19515 - DNA, 50 bp, homo sapien
ttccacgttagacttttgtgtttcastcttatgtcctgttggattgtagg

SEQ ID NO: 19516 - DNA, 50 bp, homo sapien
tctttagtttcttggccatgtctaaytccaaggtgcctgcagccctttgt

SEQ ID NO: 19517 - DNA, 50 bp, homo sapien
tttttccagagttgctcagcacctamgaagagtttctaaactgtttccaa

SEQ ID NO: 19518 - DNA, 50 bp, homo sapien
gcttatgtgtccttcactgtggtgastaagcaagtggcgcgctgtccctg

SEQ ID NO: 19519 - DNA, 50 bp, homo sapien
gtctgcctgtacatttccaggctagyagtttttaatcaaatgtatgatca

SEQ ID NO: 19520 - DNA, 50 bp, homo sapien
gaccaacaagcttttcagagtgttcraggatcagggagcatgtgtggtgg

SEQ ID NO: 19521 - DNA, 50 bp, homo sapien
taccgtcttcatccataattcttgarctctatatcagaaactgacaagct

SEQ ID NO: 19522 - DNA, 50 bp, homo sapien
agaaaatccataatgagcaaaatatsaacatgttttaaaaagagggcatc

SEQ ID NO: 19523 - DNA, 50 bp, homo sapien
ttaggtcacctatatgcttttctgawgactgaaagaaagggaatgacaaa

SEQ ID NO: 19524 - DNA, 50 bp, homo sapien
ccttgttgggtttcagtgtgtatgayggacacagctatagctcaaggcca

SEQ ID NO: 19525 - DNA, 50 bp, homo sapien
ttcaggtccttcaccagatattttaraagctcatcaaggaaaggacgttt

SEQ ID NO: 19526 - DNA, 50 bp, homo sapien
atagtcttgaaaatcattgcacaaaygtagtgaggttcacacttattacg

SEQ ID NO: 19527 - DNA, 50 bp, homo sapien
atgtcacttggataccccggagagcrgcaggaaagcatcaaccaggtaag

SEQ ID NO: 19528 - DNA, 50 bp, homo sapien
ttgaaagtcatagaacaggatatgayggatcaaagatcttaagctttatc

SEQ ID NO: 19529 - DNA, 50 bp, homo sapien
ttctataggtgattgtgatttaaatrattgtttacatgtaactctcttag

SEQ ID NO: 19530 - DNA, 50 bp, homo sapien
cctaaaatggtataaatgttcaatartagccagtgaatataaaactaaat

SEQ ID NO: 19531 - DNA, 50 bp, homo sapien
agagtttgtgtgtgcaatggttttcyactgactaatcaggctgataaaac

SEQ ID NO: 19532 - DNA, 50 bp, homo sapien
ggccatgagggttttgtggcaccgasatcatcttatccattcattggttt

SEQ ID NO: 19533 - DNA, 50 bp, homo sapien
tcactgtgactgactcaaacaacaaygcaggaagacctggccatcatgaa

SEQ ID NO: 19534 - DNA, 50 bp, homo sapien
actcatcctgaactcatagatgtagyccaagaaaaaagctagggaaagga

SEQ ID NO: 19535 - DNA, 50 bp, homo sapien
cagtctcccagctcatgatggttacygctattccggccactcttcatgtt

SEQ ID NO: 19536 - DNA, 50 bp, homo sapien
ctaagttgaattataactgtttacaygtgaatcttatctcttgctctctt

SEQ ID NO: 19537 - DNA, 50 bp, homo sapien
tcaggatatggcaacatgctagaaaygatatgataggcaaaaacatccaa

SEQ ID NO: 19538 - DNA, 50 bp, homo sapien
ccctccttcaactctagacctaacaytctcagatgaatagaagaaagact

SEQ ID NO: 19539 - DNA, 50 bp, homo sapien
ctcaccttgggtgtttcctgattcartccatcttccacactgcccccaga

SEQ ID NO: 19540 - DNA, 50 bp, homo sapien
aatgccttaaagcctacggatgccartcttctgaaaagtggatgttacgt

SEQ ID NO: 19541 - DNA, 50 bp, homo sapien
gggaaaaaacaactctgaatcccaaygcatgaacaaaattgcagttagga

SEQ ID NO: 19542 - DNA, 50 bp, homo sapien
gcaaactgtgttaagtcctagaagasagatgggtaaatatcccaggaaaa

SEQ ID NO: 19543 - DNA, 50 bp, homo sapien
ttgtgtgcagagaaatatgttggagractctgggaacttgaagataagta

SEQ ID NO: 19544 - DNA, 50 bp, homo sapien
ggaagcttccaatcatgcacgaagaraaaggaggaatgaggtatctcaca

SEQ ID NO: 19545 - DNA, 50 bp, homo sapien
tattcaccaccagaaggtggtactayatgaatacttctcttttcctctag

SEQ ID NO: 19546 - DNA, 50 bp, homo sapien
catatcagctgggagggtgggaatayaccgaatgctctgacttgcacaga

SEQ ID NO: 19547 - DNA, 50 bp, homo sapien
taaacagcaaaaataaggacttagcraaagtaggtaggtaaataacatac

SEQ ID NO: 19548 - DNA, 50 bp, homo sapien
tttgcacttcaaatctgtatatatakgctgcccacatttggatgtggtag

SEQ ID NO: 19549 - DNA, 50 bp, homo sapien
atcaattaacatgattgacaattacrcaatatagacaatcatccaggata

SEQ ID NO: 19550 - DNA, 50 bp, homo sapien
atggaatctattcaataaggaattgscaaggacaaactttaaatgaatga

SEQ ID NO: 19551 - DNA, 50 bp, homo sapien
cttcttcagagactataaccactcayggactttcatactctagaatggcc

SEQ ID NO: 19552 - DNA, 50 bp, homo sapien
aaccagttgagtaattttttgcacartaagctacctcacgtctttcagca

SEQ ID NO: 19553 - DNA, 50 bp, homo sapien
aaactgtgcacaaaaccagaagttayccaacaagaccattgaatcattga

SEQ ID NO: 19554 - DNA, 50 bp, homo sapien
agtgtgtgggtgcagctgcctgtgayggagactaactgatttgtgcttgc

SEQ ID NO: 19555 - DNA, 50 bp, homo sapien
ttaaggctaaggtagaccaggaaatragtcctttgtgtgcccagaaagag

SEQ ID NO: 19556 - DNA, 50 bp, homo sapien
agtcatgcactttggggaagtaatayacatctgagaagttaaacagaggt

SEQ ID NO: 19557 - DNA, 50 bp, homo sapien
accagcgccatgttgtcatcaaaacraccggaaatgccttttgtgtctcc

SEQ ID NO: 19558 - DNA, 50 bp, homo sapien
aatggacaaaatattacgctattaartcacatacattccactcctatagt

SEQ ID NO: 19559 - DNA, 50 bp, homo sapien
aaacagaactaatttgaaaatttaaytgaatcacatcttcaggtgttgct

SEQ ID NO: 19560 - DNA, 50 bp, homo sapien
tactagtgaattctcaggacttagayagagggttccttggctcactcaag

SEQ ID NO: 19561 - DNA, 50 bp, homo sapien
acttagacttgccaaggcctccgggwacactgctctaatattcagcacct

SEQ ID NO: 19562 - DNA, 50 bp, homo sapien
atgaagaaataaacctgttaacggayagatttatagtattcaaatcacta

SEQ ID NO: 19563 - DNA, 50 bp, homo sapien
acttacaaggtatcattaaacgatastaatttttgcaatgaacaaggcaa

SEQ ID NO: 19564 - DNA, 50 bp, homo sapien
ccagacaacaggtaacgacaggtaaygacaggtaacgacaggtaacgcgg

SEQ ID NO: 19565 - DNA, 50 bp, homo sapien
cactacgctgtcaacatatgtttccyagacgtcgtttgaaatggctcaat

SEQ ID NO: 19566 - DNA, 50 bp, homo sapien
atggattacaacagtgaacttcagasacagggaagtagaaggggaatgac

SEQ ID NO: 19567 - DNA, 50 bp, homo sapien
gtagtgtcagatccacataacagtaycagagataggaaggccccgctatt

SEQ ID NO: 19568 - DNA, 50 bp, homo sapien
ctcatctcaagtcttcaactaaccckggaaccatctatgcttatgaccga

SEQ ID NO: 19569 - DNA, 50 bp, homo sapien
tctttcagcttctcagcttaactccrctcacacaggcaacaccctcaagg

SEQ ID NO: 19570 - DNA, 50 bp, homo sapien
cagaacctcagtttcctttcctatayaacgcaagccataaggttaacccc

SEQ ID NO: 19571 - DNA, 50 bp, homo sapien
tgatgtctctaggatgtcatgaagarcttttgagaaattgctactgatga

SEQ ID NO: 19572 - DNA, 50 bp, homo sapien
aatcacacttttttcttcttgattawaagtgaatttttgtttcagctaaa

SEQ ID NO: 19573 - DNA, 50 bp, homo sapien
attctttgctgagaaatttctccacmgatacagatacttctacatactac

SEQ ID NO: 19574 - DNA, 50 bp, homo sapien
aaagaaaagactgcttctccatgccyaataaaacagcaggagggtacagt

SEQ ID NO: 19575 - DNA, 50 bp, homo sapien
gagagtcatcatttttattgacgaawtccataatgatgacagtgtgtgga

SEQ ID NO: 19576 - DNA, 50 bp, homo sapien
gaggatagaatcaagctcttcttaaygatatggaagactggaggaaaaaa

SEQ ID NO: 19577 - DNA, 50 bp, homo sapien
tgatttgagttacaaaatgttcctcraatccctttgcaacatgtatgtgg

SEQ ID NO: 19578 - DNA, 50 bp, homo sapien
acagctcatgctcagtttcagtgacragaaatgtgttgagctaaaaatat

SEQ ID NO: 19579 - DNA, 50 bp, homo sapien
attaggcaacagatcagagaatgaargaattactgaaatggagctcaaat

SEQ ID NO: 19580 - DNA, 50 bp, homo sapien
atgtcgatcttttcacattataatckcatcaaccaggaagaaaccctcag

SEQ ID NO: 19581 - DNA, 50 bp, homo sapien
cattttattttcatgctcagcgtaayaagaagagaaaagtcgtgttttgc

SEQ ID NO: 19582 - DNA, 50 bp, homo sapien
catacaaggaataatagtaagtagasaagctggtaaacatatcaataaaa

SEQ ID NO: 19583 - DNA, 50 bp, homo sapien
atcctatcaagtacttgatgaaccaratggacacatgagatataaatctt

SEQ ID NO: 19584 - DNA, 50 bp, homo sapien
gagatatctactttccaagtaaaaasgttgtctcataatatgggagtcag

SEQ ID NO: 19585 - DNA, 50 bp, homo sapien
ccctggggacgtaccaagtggaaacrcgggtgcccagagattagaactcc

SEQ ID NO: 19586 - DNA, 50 bp, homo sapien
cctatgtctagggagatgtgtgcaawataccttctagtcctcagaaatgg

SEQ ID NO: 19587 - DNA, 50 bp, homo sapien
agttgatattatcacgctaagtaagmcactaataaccctgcttcctatgt

SEQ ID NO: 19588 - DNA, 50 bp, homo sapien
ataggaaagcctgttgccctgtagaygggatttacttattggaaatgcag

SEQ ID NO: 19589 - DNA, 50 bp, homo sapien
atagagatgaatttgcatatttgaasaacactagatatcatgggcaagct

SEQ ID NO: 19590 - DNA, 50 bp, homo sapien
gggagttcacataaggaaattcttcycttcataatgcagatggcaggatc

SEQ ID NO: 19591 - DNA, 50 bp, homo sapien
cccgtctcccaagagccttgtgtaaktcatctaaaaaacaaatgtttcgg

SEQ ID NO: 19592 - DNA, 50 bp, homo sapien
tactttcacaaacttccctacagaawtggttctaacagaactgttcaagg

SEQ ID NO: 19593 - DNA, 50 bp, homo sapien
aagagaaccaacaaccaaatcaatayccaaaaaataacaataacgtccag

SEQ ID NO: 19594 - DNA, 50 bp, homo sapien
gtgatattttccaccatggatacaawgtttgttgtgataagacaggaaat

SEQ ID NO: 19595 - DNA, 50 bp, homo sapien
gatgaaagcagagaaacttgataccracctagctaaggataaatgtatgg

SEQ ID NO: 19596 - DNA, 50 bp, homo sapien
taaaatttagtgccttaaacaaagasatactgataaatcttttcatgaag

SEQ ID NO: 19597 - DNA, 50 bp, homo sapien
caaatgccactgtgtatgcaaatcayctggaatcttgtgaaaatgtagat

SEQ ID NO: 19598 - DNA, 50 bp, homo sapien
taacgctactgttataatgttggtayaaacaaagtgtggtgggaaaccaa

SEQ ID NO: 19599 - DNA, 50 bp, homo sapien
ttatttttataagtatttagtcataygtgattaaaatatacttcatgctt

SEQ ID NO: 19600 - DNA, 50 bp, homo sapien
ataaaaataatacaggatgatataamgtaaaaaatgaattactcttagtc

SEQ ID NO: 19601 - DNA, 50 bp, homo sapien
agtcgttttggagttgttttcagcaragtcacaatgatagcaccattata

SEQ ID NO: 19602 - DNA, 50 bp, homo sapien
tccctttgccaactctcgacattackgaacattttgatttcttaccatcc

SEQ ID NO: 19603 - DNA, 50 bp, homo sapien
gttgatgcagtgttaaattaaagccyattaattcattgtgaaaacaagcc

SEQ ID NO: 19604 - DNA, 50 bp, homo sapien
gtggtagaaccaaagtgtgaacccaygtactgatagaagtccccaggaaa

SEQ ID NO: 19605 - DNA, 50 bp, homo sapien
atgctgacttatcccgaagcctccaygctatcatcatctccatttcacag

SEQ ID NO: 19606 - DNA, 50 bp, homo sapien
gctttcatgtattcttactttggacyctgacatatacctcaattatgaga

SEQ ID NO: 19607 - DNA, 50 bp, homo sapien
catgtctgaaccagggccttctaaarctcataaggataatatcataggga

SEQ ID NO: 19608 - DNA, 50 bp, homo sapien
ttttgctgaagagtaatttaggaaaratggctggtacagacccttaatgt

SEQ ID NO: 19609 - DNA, 50 bp, homo sapien
agggggctaagactcactggacagayaaagagtggtccctagtgatggcc

SEQ ID NO: 19610 - DNA, 50 bp, homo sapien
tgtccaggccttgctaagagtctcakggaagttatggcccatccctccag

SEQ ID NO: 19611 - DNA, 50 bp, homo sapien
ggctcatgaatcagatatgattcatsaaagtaccacatcctcctaccaac

SEQ ID NO: 19612 - DNA, 50 bp, homo sapien
caagacttgctgatagaagggatacrctttttctggcatgagtaaccaag

SEQ ID NO: 19613 - DNA, 50 bp, homo sapien
caatatattcaaacttccaaggaaamctattttgaatatagaattctata

SEQ ID NO: 19614 - DNA, 50 bp, homo sapien
ttttgtctcttaccaacatgacaaartggatgtagtatggaggcataatc

SEQ ID NO: 19615 - DNA, 50 bp, homo sapien
atttgtacctcagcaaagttataatsactacatatcacataccccaagtc

SEQ ID NO: 19616 - DNA, 50 bp, homo sapien
agccagtgtgacttcctggggcataygtcaagatggaatcaaggtcccca

SEQ ID NO: 19617 - DNA, 50 bp, homo sapien
aaaccctgactgtctacagattccarctttaatagcaagcctgtggagtt

SEQ ID NO: 19618 - DNA, 50 bp, homo sapien
ccagcccatgaagtactttttaaggwcctctttgcttacttcattttatc

SEQ ID NO: 19619 - DNA, 50 bp, homo sapien
cctgatctggagccataggcagaaasaaaatggtaacattgagaatttta

SEQ ID NO: 19620 - DNA, 50 bp, homo sapien
cctaattgccctagtcataagtgaartatcctcggagccatatcccgggc

SEQ ID NO: 19621 - DNA, 50 bp, homo sapien
aattagaagggccaggtttaaccaargctcaacaccagccatgtcccccg

SEQ ID NO: 19622 - DNA, 50 bp, homo sapien
tagcttgctgatatggtcagttacartggttggtatcaaatattacaatg

SEQ ID NO: 19623 - DNA, 50 bp, homo sapien
tcacccttgtcctcaccctgcgaatwatctcacatttctgaaccttagtt

SEQ ID NO: 19624 - DNA, 50 bp, homo sapien
tcatgtctgacctgaggcggactaaygctcatctcaaaaaacatcttttt

SEQ ID NO: 19625 - DNA, 50 bp, homo sapien
ttgggattttctgtgtggacaattaygttatctgtgattttctcctttcc

SEQ ID NO: 19626 - DNA, 50 bp, homo sapien
atatcttgaagggtttgtggtgatayactttttcattcctgacattggtc

SEQ ID NO: 19627 - DNA, 50 bp, homo sapien
agaagcaagagtttaagtagcaacaragtcagctgaggatttatctggat

SEQ ID NO: 19628 - DNA, 50 bp, homo sapien
gccaggccaagttgattttcgtcaarcaaacactggtctagatggcgctg

SEQ ID NO: 19629 - DNA, 50 bp, homo sapien
aataaatcttaggagtgcattatgasgatggtgattttgagattataaag

SEQ ID NO: 19630 - DNA, 50 bp, homo sapien
atagcttctctcatttttaggagaaycttccttagcctcagtgtggactg

SEQ ID NO: 19631 - DNA, 50 bp, homo sapien
ggccacacagatatggatgcagtcarggaaaccagttgtgaaaatagttc

SEQ ID NO: 19632 - DNA, 50 bp, homo sapien
cccaaacatttagatcttgtgctctsaacagcaggttaaaggacaaagga

SEQ ID NO: 19633 - DNA, 50 bp, homo sapien
attcagtgctgctagcagagacttaratggtaggtccagggcaagcaatc

SEQ ID NO: 19634 - DNA, 50 bp, homo sapien
ttcaatctgtcatctttatttccaaygttactctgtcattatattatagg

SEQ ID NO: 19635 - DNA, 50 bp, homo sapien
tattaaggaatgctactagaaataartaaccaaaacataataataaagta

SEQ ID NO: 19636 - DNA, 50 bp, homo sapien
aggaccaaatactccccttttcagasgctcaaggaataatccccaggctc

SEQ ID NO: 19637 - DNA, 50 bp, homo sapien
ctttcccagtctgtaaataatacaartgcctaccttttagggatttttct

SEQ ID NO: 19638 - DNA, 50 bp, homo sapien
ttgaaccacaggactctttgtcattsaaaactattttggaaaagctggtc

SEQ ID NO: 19639 - DNA, 50 bp, homo sapien
catgaaaatgttagattaaatatgaracctgaatctagaagaaacaagct

SEQ ID NO: 19640 - DNA, 50 bp, homo sapien
gacattaggatatatgggttaataartcacgtcaatgctggaaaatatga

SEQ ID NO: 19641 - DNA, 50 bp, homo sapien
ataaagacggtaagctcgggaaccasaggtggcccaaccggcaggtccca

SEQ ID NO: 19642 - DNA, 50 bp, homo sapien
gtgtgttcctaacacagatatgggaygattttccaaatgtatgtggagga

SEQ ID NO: 19643 - DNA, 50 bp, homo sapien
cactcactttcttggttctaaaatgrcagtgctatgcatgaatatgtttg

SEQ ID NO: 19644 - DNA, 50 bp, homo sapien
tgttctcttcctcaaagctcgaacamaaaactaactcgcaccccccgtca

SEQ ID NO: 19645 - DNA, 50 bp, homo sapien
aacaagtaaaaacagttcatcaaacygactggtgaatcctagtagtgaca

SEQ ID NO: 19646 - DNA, 50 bp, homo sapien
cagccagggacaaatgtttgcattamatctcccctgttcagcttactggt

SEQ ID NO: 19647 - DNA, 50 bp, homo sapien
taaggataatagagtcacagaatgaygaagaagaaccaaaccatgatctc

SEQ ID NO: 19648 - DNA, 50 bp, homo sapien
atagcgtgttatccagtgtgttatcyattgaggtaggataaaaaacgaag

SEQ ID NO: 19649 - DNA, 50 bp, homo sapien
acaaaataagtgattataagggacaytggatttctaaaatgacattactg

SEQ ID NO: 19650 - DNA, 50 bp, homo sapien
aaaattcagtattatactttcccttraaaatagagatgatacgatactgg

SEQ ID NO: 19651 - DNA, 50 bp, homo sapien
caaactcctggaggcaaataggaacmagacttaagaaaggtctagtcaag

SEQ ID NO: 19652 - DNA, 50 bp, homo sapien
aggtttggccagtccagaacgtgacygctgatttcaggctgagccagtcc

SEQ ID NO: 19653 - DNA, 50 bp, homo sapien
gccaccatgcctggctgatataagayattttcaccatcacaaaaagttcc

SEQ ID NO: 19654 - DNA, 50 bp, homo sapien
aaaagatgtgtccacctagaatgccrgaatgtgagattttccatccaagt

SEQ ID NO: 19655 - DNA, 50 bp, homo sapien
aagctaatgtctgcattggccatcaracaaagaaagggactcaccagcta

SEQ ID NO: 19656 - DNA, 50 bp, homo sapien
acatgtgtgctatattaaggaggcamtctatttgaagttccaagtttttt

SEQ ID NO: 19657 - DNA, 50 bp, homo sapien
taaaagctaccattttgatgactgakgcttagaaaattattttagaggag

SEQ ID NO: 19658 - DNA, 50 bp, homo sapien
gttgagaaagactcagatcataccasgtctctgtgggcagaatcgattct

SEQ ID NO: 19659 - DNA, 50 bp, homo sapien
ttgtgagtcttgtgtaaaccagaatsaccatctccatcacacagccaaca

SEQ ID NO: 19660 - DNA, 50 bp, homo sapien
aagtcaatgatttctgtgattgatakaattctaaggtgtctgagagcagg

SEQ ID NO: 19661 - DNA, 50 bp, homo sapien
catttctataaaatgctcaaaaatasgcactgatttacagtgacagagag

SEQ ID NO: 19662 - DNA, 50 bp, homo sapien
attgcaagggactcctgattgtgaayggaggagagaaagataggatgaaa

SEQ ID NO: 19663 - DNA, 50 bp, homo sapien
acctttgtcatgatctcattcacaayattggtggtccctgagagtggagc

SEQ ID NO: 19664 - DNA, 50 bp, homo sapien
ctcctagctttgctcatgtcacactracttttcaaaggatgctgcccaat

SEQ ID NO: 19665 - DNA, 50 bp, homo sapien
agggagctcctttattctgagccagyaaatatacaatcggctgaagattc

SEQ ID NO: 19666 - DNA, 50 bp, homo sapien
ctgggagacagagccaggtattagawgagagaagactgagagcctctagg

SEQ ID NO: 19667 - DNA, 50 bp, homo sapien
tcacgaagtttgtggtagttggttayaaatagcaacaggaaaccaatacg

SEQ ID NO: 19668 - DNA, 50 bp, homo sapien
tagaacagagggaaaaatgaaacacrgtagataacaacaaaggaaggata

SEQ ID NO: 19669 - DNA, 50 bp, homo sapien
ctaaggttttgagttacacataagcragtcaaatagcatataaataacag

SEQ ID NO: 19670 - DNA, 50 bp, homo sapien
gaaacagaaatggtttttaaatggcygatacggaatattgaattttttta

SEQ ID NO: 19671 - DNA, 50 bp, homo sapien
ccccaatcagtgtttacatttctaaygacaatgactagccaaagagcatc

SEQ ID NO: 19672 - DNA, 50 bp, homo sapien
gtctacagtgactagactgcaaaccraagagattgtgaaacatcgttaaa

SEQ ID NO: 19673 - DNA, 50 bp, homo sapien
cttaagtggtaacctgattataaaarcaacacacgtgacaacagaatatt

SEQ ID NO: 19674 - DNA, 50 bp, homo sapien
cttgtggtcccgcattggtctgacaycacttccagtttcgtacctccttt

SEQ ID NO: 19675 - DNA, 50 bp, homo sapien
acacagtgtgccagaaaatccggcakgtagataaaagtttgattagtcag

SEQ ID NO: 19676 - DNA, 50 bp, homo sapien
gagttaagcactattctgacttttawcacgatgggttagttttccctgtt

SEQ ID NO: 19677 - DNA, 50 bp, homo sapien
ttcttcttagattcgtggcctaccaytatgaaagctgggaccttgttgta

SEQ ID NO: 19678 - DNA, 50 bp, homo sapien
agcagttaagctaaaatgttcaaccrctcattattcccatagattacacc

SEQ ID NO: 19679 - DNA, 50 bp, homo sapien
agcattgcactaggcacgaagagaaratctaggaaggaagatctgagcgg

SEQ ID NO: 19680 - DNA, 50 bp, homo sapien
agaagctgaaaggaaagtgccattaraagttttccaaccaagtccccaag

SEQ ID NO: 19681 - DNA, 50 bp, homo sapien
cacgggggaaagacatgcatctctasgctgtcctgcatcatggttattgg

SEQ ID NO: 19682 - DNA, 50 bp, homo sapien
aggcaataaatcctagctgataggayatcgtgatgtttccaaatgcaccg

SEQ ID NO: 19683 - DNA, 50 bp, homo sapien
ggtctctatgtatgacaagaggcaayggagaggaggagacagagcagagg

SEQ ID NO: 19684 - DNA, 50 bp, homo sapien
tattattgggagtcagagttctcacyatagaagaagagggatacaaataa

SEQ ID NO: 19685 - DNA, 50 bp, homo sapien
tattaggacttatcatggtatcctamaagttacttgattgtttattcttt

SEQ ID NO: 19686 - DNA, 50 bp, homo sapien
cttgggcgcccagcttcatttgccakgttgcgtccaatatccccaaggtc

SEQ ID NO: 19687 - DNA, 50 bp, homo sapien
tgagggaaagccttgacatcagccaraaagaaagggttataggtgtgagc

SEQ ID NO: 19688 - DNA, 50 bp, homo sapien
gtacatttgtgtgcatgtgttttaaytgaaaacttgtcaagtcttatctt

SEQ ID NO: 19689 - DNA, 50 bp, homo sapien
tatcatatcacgctcagatcaggtartacaaagtgtatggaggagaaggt

SEQ ID NO: 19690 - DNA, 50 bp, homo sapien
attcagaactcaaggcaattatggargcatttgggtctcctgaacttttc

SEQ ID NO: 19691 - DNA, 50 bp, homo sapien
agctttattgttcatgaatgaaaacsatttgcttctctgaacttatttta

SEQ ID NO: 19692 - DNA, 50 bp, homo sapien
gagaaagtgggagcgcttcaatgaartgttaagaagagtgctggcctggg

SEQ ID NO: 19693 - DNA, 50 bp, homo sapien
aggtgggtttggtggataccaagtarcgctgtttcattgaatatacaggt

SEQ ID NO: 19694 - DNA, 50 bp, homo sapien
ccttcttcaatctcaatctgctttgractaagtattttggtagcagcatt

SEQ ID NO: 19695 - DNA, 50 bp, homo sapien
aggtttaaggcttaggttagggatayccaatctttcagtttccctgggcc

SEQ ID NO: 19696 - DNA, 50 bp, homo sapien
aaaactaggactaggaagagagacaraaaccatgcggatggcagaggaga

SEQ ID NO: 19697 - DNA, 50 bp, homo sapien
tccagaagcacttctgtatacattaygccaaactgtctctagctgacctg

SEQ ID NO: 19698 - DNA, 50 bp, homo sapien
tatttccacccaagtcgctaatacaktcctgtcgttcagtttgatgagat

SEQ ID NO: 19699 - DNA, 50 bp, homo sapien
tatttttctgtgcctgacttatttawcaaaatatccttcaggctcatcca

SEQ ID NO: 19700 - DNA, 50 bp, homo sapien
cacacttaggcaacatgcagttcagmaacatgtaagtgcctactgtgtgt

SEQ ID NO: 19701 - DNA, 50 bp, homo sapien
tcctattattctttacagcctgtaasagatgtaaaatccacaagttctcg

SEQ ID NO: 19702 - DNA, 50 bp, homo sapien
gacttaggtattttggtttaaagaayttcatgattccaagtagagaccta

SEQ ID NO: 19703 - DNA, 50 bp, homo sapien
gatgcacacaagggtcaagcctgcasatgtcttaacagtggcctatgcag

SEQ ID NO: 19704 - DNA, 50 bp, homo sapien
tgcttttcactttgctgctctgagtyaatctttgtctagaaaccacccat

SEQ ID NO: 19705 - DNA, 50 bp, homo sapien
tttcatgaacactgaaatgagacagraaatgaagagttgagttatcttgc

SEQ ID NO: 19706 - DNA, 50 bp, homo sapien
gaaaaagccatagccaaggaggagartcaaatctttaaagatcccaaacc

SEQ ID NO: 19707 - DNA, 50 bp, homo sapien
tattatatggtattatgttcaagcayatgtggtacataatatgtggtaca

SEQ ID NO: 19708 - DNA, 50 bp, homo sapien
ctttctgcttctttctggttctcaastgagattttcccatggctatgagg

SEQ ID NO: 19709 - DNA, 50 bp, homo sapien
cgcaggacaagcctggcactgagaayagaatggtgatttggccataagtt

SEQ ID NO: 19710 - DNA, 50 bp, homo sapien
gttggccaagggctgccagacatgayagagcagggaaagaggcagagatg

SEQ ID NO: 19711 - DNA, 50 bp, homo sapien
aaggtttgcgacattccagtatttcrctatatatgaagttctttatgaag

SEQ ID NO: 19712 - DNA, 50 bp, homo sapien
tggaggtttgtaacagctcttctccyggaaatttttcagatctcccctct

SEQ ID NO: 19713 - DNA, 50 bp, homo sapien
atcaagttacacccctggcacataayaaacattcgacaaacagtatcttt

SEQ ID NO: 19714 - DNA, 50 bp, homo sapien
aaaatatgcaagacagtattgcaaarttaaaaatcagtaaaatcccacaa

SEQ ID NO: 19715 - DNA, 50 bp, homo sapien
ccagtgctgcaactatattcaataartgggccttgttcaaatcctgagta

SEQ ID NO: 19716 - DNA, 50 bp, homo sapien
actgcctacacgaggactatgataaygaaggctcctagcccagggcgtgg

SEQ ID NO: 19717 - DNA, 50 bp, homo sapien
tctccagccttttctccaggattcamattataatactgtgctgtcattgg

SEQ ID NO: 19718 - DNA, 50 bp, homo sapien
gccagtgacctgtatttttgaaatgsacaaagttgtttgggaggatgaca

SEQ ID NO: 19719 - DNA, 50 bp, homo sapien
aagacctcctcaggtgattctaaaaygctgccatgtagatgaccactggt

SEQ ID NO: 19720 - DNA, 50 bp, homo sapien
ttatttaaagctgccagtgcaatgayggcttctggcttaaaccattggtg

SEQ ID NO: 19721 - DNA, 50 bp, homo sapien
tcaacagttttcagaggatgggcaaygtgatctgaactaaacctgcaata

SEQ ID NO: 19722 - DNA, 50 bp, homo sapien
ttaaatgtaagaagactatgcaaagrattgatagacagccatggatatgg

SEQ ID NO: 19723 - DNA, 50 bp, homo sapien
aaaacacaaattcacagttggaaaawcgtaataggatagagtaggacttg

SEQ ID NO: 19724 - DNA, 50 bp, homo sapien
caacagtcatgtggcttacatctgcsacgacacttgatatttttctaaga

SEQ ID NO: 19725 - DNA, 50 bp, homo sapien
taacctctctttctacttattttggragacatcttagaaaaatatcaagt

SEQ ID NO: 19726 - DNA, 50 bp, homo sapien
tacttctactcaacttctttttcaarcgtaatatattgaggaacgctctt

SEQ ID NO: 19727 - DNA, 50 bp, homo sapien
tgaaaagggatgaagtctctgctatraaagaatccctgggtaaaaatttt

SEQ ID NO: 19728 - DNA, 50 bp, homo sapien
tagaaaggggtgagctctccatcacygaaagtattcagataggcttccag

SEQ ID NO: 19729 - DNA, 50 bp, homo sapien
tcgatgccttgcttcccaaatcttcragcctcattcaagaatggtgggtc

SEQ ID NO: 19730 - DNA, 50 bp, homo sapien
cttctttgataattcgatgtgtccasctagggcctcacacagggatttgt

SEQ ID NO: 19731 - DNA, 50 bp, homo sapien
agcgacttgtcactttgatgctgtcraggatattgtctttccattgtgag

SEQ ID NO: 19732 - DNA, 50 bp, homo sapien
tcacacagggatttgtgtaggcagaygagatacggatgtactgctgactg

SEQ ID NO: 19733 - DNA, 50 bp, homo sapien
cttgttctttcatcttagcaagtcartctgagcagtaatgtagccctcta

SEQ ID NO: 19734 - DNA, 50 bp, homo sapien
ctttggagtggcctgagtataccatsactgtgacccatggctaccttggg

SEQ ID NO: 19735 - DNA, 50 bp, homo sapien
acgagaagcttctggcaggtctgaawtgagagaagaaaatgggtgaggga

SEQ ID NO: 19736 - DNA, 50 bp, homo sapien
tcttcgtcatgtcacattgcagggcyatctggtccagtggccactcattc

SEQ ID NO: 19737 - DNA, 50 bp, homo sapien
atgtatagaagcttgtaatagtaaayaatttggtaaacagcaaagagtaa

SEQ ID NO: 19738 - DNA, 50 bp, homo sapien
ttagtgcagagggccctacacaatastaacaaaacactgggaaatgtcat

SEQ ID NO: 19739 - DNA, 50 bp, homo sapien
aaaatttgaagatatattcaggaccragattaggataagacaaatgcggt

SEQ ID NO: 19740 - DNA, 50 bp, homo sapien
ccattatatccaccatgtgtcttaayatcttagatagtgttcagattaac

SEQ ID NO: 19741 - DNA, 50 bp, homo sapien
aaatatactaaccaagtctaaattckcactttcacactctcatggtttcc

SEQ ID NO: 19742 - DNA, 50 bp, homo sapien
taatgcaactacaatgtacacttcaraatggttaaggccaggcacagtga

SEQ ID NO: 19743 - DNA, 50 bp, homo sapien
gttatcatcatttacttttagagtaygcctacattagaagtgattgctcc

SEQ ID NO: 19744 - DNA, 50 bp, homo sapien
actctcttctatagcaaagcagagastcctttctaaccaggtctcccaat

SEQ ID NO: 19745 - DNA, 50 bp, homo sapien
gttacataaattagatttaaacacastctacacttcagagacatctgcaa

SEQ ID NO: 19746 - DNA, 50 bp, homo sapien
gcatgctggagagaaacttgaagaaygtgagaaaaccttcagcaaggatg

SEQ ID NO: 19747 - DNA, 50 bp, homo sapien
ctggaaggacagataatggagactaytaaaaggaaaacaagtctataaaa

SEQ ID NO: 19748 - DNA, 50 bp, homo sapien
tgcatacttgacattaaaaaagaaartcaggccaatcaaaatctccagac

SEQ ID NO: 19749 - DNA, 32 bp, homo sapien
cgatgttgctctttaaygcaagtcctacacca

SEQ ID NO: 19750 - DNA, 50 bp, homo sapien
atcaattcagttgacattaaagttgraagtgtactcctcttatccaacaa

SEQ ID NO: 19751 - DNA, 50 bp, homo sapien
cgtaagattcctagttaaatgtctawacttttgcaccagatttttttttt

SEQ ID NO: 19752 - DNA, 50 bp, homo sapien
atattgaagatcagaaacattccaarcctgtcaaacatctttcatggtgt

SEQ ID NO: 19753 - DNA, 50 bp, homo sapien
gggaagcagagagctggttgggctaygcaataatatgaataactaaaagc

SEQ ID NO: 19754 - DNA, 50 bp, homo sapien
actggtgtgagccatggcagtaccaytgatgtaagcaaaagttgctgctg

SEQ ID NO: 19755 - DNA, 50 bp, homo sapien
gacttaaacatttactacctaaagayatgctttgaattcttacttattcc

SEQ ID NO: 19756 - DNA, 50 bp, homo sapien
ttccagagctgtttaaccctgttaayaagcgtgaaagaaaaatggattct

SEQ ID NO: 19757 - DNA, 50 bp, homo sapien
ctgagacatcttacatgcttgtaaaytgaaaccatcattttgtggttcca

SEQ ID NO: 19758 - DNA, 50 bp, homo sapien
atatatttttatggtattgcatttargaaggagaaacttattgttttaca

SEQ ID NO: 19759 - DNA, 50 bp, homo sapien
taagtaggttggtagatgattttcasatttctagagagaaggaatgtgat

SEQ ID NO: 19760 - DNA, 50 bp, homo sapien
tttccataactgcatttaaaaggcaytaagtgttgtgaccatggggtggt

SEQ ID NO: 19761 - DNA, 50 bp, homo sapien
gccatacaaaagaatgccttgcatayggtagataataaacgttgaataaa

SEQ ID NO: 19762 - DNA, 50 bp, homo sapien
tgtaacattttttctctaaaatctayggtgtgaagaaagtataacaagca

SEQ ID NO: 19763 - DNA, 50 bp, homo sapien
tttatttgtagtgcagactcaaataycatcaaaactataatttttatgta

SEQ ID NO: 19764 - DNA, 50 bp, homo sapien
aaatttagtgtggcttttgatgcatwaggaagggaaccctgagaaatgta

SEQ ID NO: 19765 - DNA, 50 bp, homo sapien
attttactcaattctatcaaaaccartcactgaaccctaaccccaccaat

SEQ ID NO: 19766 - DNA, 50 bp, homo sapien
agttacattgagaactttcaacagcrgaaagctacagcaatttgagaaat

SEQ ID NO: 19767 - DNA, 50 bp, homo sapien
tcacctcctgacagatttcaacccastatgtcagtgactcctaagtcaga

SEQ ID NO: 19768 - DNA, 50 bp, homo sapien
aatgcacgaatgtatcgtttaataartgacaaacacacagaggaaagaac

SEQ ID NO: 19769 - DNA, 50 bp, homo sapien
gagtaccttttatgtcttatgctagwaccaaaaagatgaataaaatgcag

SEQ ID NO: 19770 - DNA, 50 bp, homo sapien
tggcttgtttgttttgacaaaaataygattttactaaatgtatgccctgc

SEQ ID NO: 19771 - DNA, 50 bp, homo sapien
cctctattatcttctatcacaaaacscagcttgttacctttattactttt

SEQ ID NO: 19772 - DNA, 50 bp, homo sapien
tttccatgccagtcaatactatgacrgctttaaatcaactgcatctaatc

SEQ ID NO: 19773 - DNA, 50 bp, homo sapien
ggctaggatggatgattgcaaaccasagtgccaccattgcaggcctgggc

SEQ ID NO: 19774 - DNA, 50 bp, homo sapien
cgtcaacactgtggtctctataaacrctatgactgctatcaccctgccat

SEQ ID NO: 19775 - DNA, 50 bp, homo sapien
acgccaattcacggagaaataagaawccaagctcttgggaaatcctcaga

SEQ ID NO: 19776 - DNA, 50 bp, homo sapien
ttgagttgcaaatgataggaaatacrgaatctgaaacagaacaaaggatc

SEQ ID NO: 19777 - DNA, 50 bp, homo sapien
aattttcagggagagctttagtatawatcccaggcacatgttgtgcaact

SEQ ID NO: 19778 - DNA, 50 bp, homo sapien
ggcagtcctatgtccttgacacaaaygcttcttgctgaaatcctccctag

SEQ ID NO: 19779 - DNA, 50 bp, homo sapien
acatttaaagagaagcatctaccackgctttaaaacaaaacaactctgag

SEQ ID NO: 19780 - DNA, 50 bp, homo sapien
agggttcaaacgtccaactttaccaygaaggagcaaactgagacctcctg

SEQ ID NO: 19781 - DNA, 50 bp, homo sapien
ggttggctttaaaaattttatctgaragactcaacatatttggagaaagc

SEQ ID NO: 19782 - DNA, 50 bp, homo sapien
tgagaacctctgtaattcttcattcrcctccagtcttaggataggtacct

SEQ ID NO: 19783 - DNA, 50 bp, homo sapien
aaatgtctcctctttcccatcaatarctaattgtccatcaaccatcgatc

SEQ ID NO: 19784 - DNA, 50 bp, homo sapien
aagggcccttattccattcatgaggrcataaccttcccgaggccttatct

SEQ ID NO: 19785 - DNA, 50 bp, homo sapien
gccaggaactgtattcagtgctggamgagatacaaggatgaataaggcac

SEQ ID NO: 19786 - DNA, 50 bp, homo sapien
catggctgtgaagtgttcaagtctayagagatttggaaggttttggtttt

SEQ ID NO: 19787 - DNA, 50 bp, homo sapien
cttttccagtaaggtagctgtgttaygggttcagttgtatgtgtggtttt

SEQ ID NO: 19788 - DNA, 50 bp, homo sapien
ccaaattatactgcctggtactgcaragtaagttcccacttcttggaagg

SEQ ID NO: 19789 - DNA, 50 bp, homo sapien
tgataacacctgccaggttttgagastccggtgaattgaaccacaaagat

SEQ ID NO: 19790 - DNA, 50 bp, homo sapien
gacatgctttttagtacagaactgaygcttcccagattatttgtcagtgt

SEQ ID NO: 19791 - DNA, 50 bp, homo sapien
gaatacagttcctggcataaactaaygatgcaataaattgtgtttgaatt

SEQ ID NO: 19792 - DNA, 50 bp, homo sapien
gctgacaggattaatgttcctcttaycaaagcacacagggtcataaccct

SEQ ID NO: 19793 - DNA, 50 bp, homo sapien
gcatctttgccatgagtcacactaaygtccgcacgctgcaagtaggaatt

SEQ ID NO: 19794 - DNA, 50 bp, homo sapien
tcacactgctcattgaaaccctgacraattaaagctcatgttattgaagg

SEQ ID NO: 19795 - DNA, 50 bp, homo sapien
tttggttcatacacccggagcgtgargtccaagggaagaggcctcaaggc

SEQ ID NO: 19796 - DNA, 50 bp, homo sapien
attataattaagtaactaacaaggamataatctcctaaaaggcagaagcc

SEQ ID NO: 19797 - DNA, 50 bp, homo sapien
caacattgtattataaaatatttcamacatacagaaaaattacacaaata

SEQ ID NO: 19798 - DNA, 50 bp, homo sapien
ctttcacagtcttgaaacataagaamgctcaagagcatagagagcataga

SEQ ID NO: 19799 - DNA, 50 bp, homo sapien
gattttacctcgtttacatgatagcractaaataatgtctacaactcata

SEQ ID NO: 19800 - DNA, 50 bp, homo sapien
ttctgtgccaagagtctcattcataygccttgagccacccaggcagagca

SEQ ID NO: 19801 - DNA, 50 bp, homo sapien
tactgtttgatggagaaaatgttgtsaaaatacggttcccattccatagt

SEQ ID NO: 19802 - DNA, 50 bp, homo sapien
aatgtttcacccattccaccaaaaaygaggtattgtcgtggagtcagatt

SEQ ID NO: 19803 - DNA, 50 bp, homo sapien
caaacagtaaatctttggcattaaamcaagagattgtcccacgaagagga

SEQ ID NO: 19804 - DNA, 50 bp, homo sapien
gtgttgacaatagtgtttataatcayactttggacttccaagcaaatggg

SEQ ID NO: 19805 - DNA, 50 bp, homo sapien
aatcccattttacattctgtattccragcgattaagcctgtttttttttt

SEQ ID NO: 19806 - DNA, 50 bp, homo sapien
ttgacatgtaatatgataattcacaraagtgatgtggtcttcatgtttat

SEQ ID NO: 19807 - DNA, 50 bp, homo sapien
accctggtagggacctttcgaagcarcaaggccccacgcaggtacttccc

SEQ ID NO: 19808 - DNA, 50 bp, homo sapien
cagattgttctgaggagttctgctargacattcgatggcatgggtctgca

SEQ ID NO: 19809 - DNA, 50 bp, homo sapien
gagaaattagaacaaagtgaaagacrctagcaaaggctaatagtggttct

SEQ ID NO: 19810 - DNA, 50 bp, homo sapien
ctcaatgtctactacctaggatccaractaaagaagggaagtcaggggaa

SEQ ID NO: 19811 - DNA, 50 bp, homo sapien
gtgggaaagtgctttagactttaaascatgagccctaatcaaataaacaa

SEQ ID NO: 19812 - DNA, 50 bp, homo sapien
cccatgccgtggcataattgatcacrcccatttctcatcagggtcaataa

SEQ ID NO: 19813 - DNA, 50 bp, homo sapien
ttgtctattttacatgcgtgaaaacsaggaaaatgaaagtgctggttggg

SEQ ID NO: 19814 - DNA, 50 bp, homo sapien
ccaaggagatttaaatagttgccgaygggccaaggaagaacccatctaag

SEQ ID NO: 19815 - DNA, 50 bp, homo sapien
agacgcagaacgtggctacactgtayaacagtaatggtaacacccctgga

SEQ ID NO: 19816 - DNA, 50 bp, homo sapien
tcataaaattaaaaaatttcccatcratccttatggtgtgtttttgtcat

SEQ ID NO: 19817 - DNA, 50 bp, homo sapien
tagagcagttatggactccttctcayggactgagtttctctatggggtag

SEQ ID NO: 19818 - DNA, 50 bp, homo sapien
aagcgtatgtaaaaatataggttaargagagtaataatggctatggtagt

SEQ ID NO: 19819 - DNA, 50 bp, homo sapien
ggctattttaacaagattgagagtgragcctggaaaatgcttaatttaaa

SEQ ID NO: 19820 - DNA, 50 bp, homo sapien
tgcttgagtgttgatgacataaagcwattgaacttacctggtagaggagc

SEQ ID NO: 19821 - DNA, 50 bp, homo sapien
gaatccttttttcctctctccaggcwgaatattactgaagaatgatcctg

SEQ ID NO: 19822 - DNA, 50 bp, homo sapien
agaagactaatttccttaatgcataraatactggtgtaactcaataaaat

SEQ ID NO: 19823 - DNA, 50 bp, homo sapien
ggccctgacaccttctcaccttggaygcattgcttaattgtttgagcatg

SEQ ID NO: 19824 - DNA, 50 bp, homo sapien
ttctgcgagccttcacctagaataayatggtgaccaaaaagtgtgaggaa

SEQ ID NO: 19825 - DNA, 50 bp, homo sapien
tgtaagttatctttccactcgtgggwatcttcttgtcctaggtcaaaatt

SEQ ID NO: 19826 - DNA, 50 bp, homo sapien
gcaaaggattattttagaatccataygtagagtgcccaaaaggaaaagct

SEQ ID NO: 19827 - DNA, 50 bp, homo sapien
agtgtttagtggtttaattgaggtasaaaattttgagggtctgtgttcgt

SEQ ID NO: 19828 - DNA, 50 bp, homo sapien
tcttgctctgaacaaatcttcaagarcccttctgatgcccttggcatatc

SEQ ID NO: 19829 - DNA, 50 bp, homo sapien
tccaaccagcccatggtggacacacrgaatcatcccatttgacatatgtg

SEQ ID NO: 19830 - DNA, 50 bp, homo sapien
cccacgagtggaaagataacttacarcctaaagcaggacaggtaaatgct

SEQ ID NO: 19831 - DNA, 50 bp, homo sapien
taagagcatgagaggcctttgtaaargtgtcagtggggtgatcagatggc

SEQ ID NO: 19832 - DNA, 50 bp, homo sapien
gttcctctgagttctggcttcttcartagattcatgtccaggcccctgga

SEQ ID NO: 19833 - DNA, 50 bp, homo sapien
tgggcctcataggacccaaaggaaayttgtggttggaacaatgtgcagtt

SEQ ID NO: 19834 - DNA, 50 bp, homo sapien
aggctgtaccatctgggtttgtgtamgcatttttctgaacaaattcctgt

SEQ ID NO: 19835 - DNA, 50 bp, homo sapien
tgctgtgcagattaaatgaattcccrgatgtaaaacacttagaacctgct

SEQ ID NO: 19836 - DNA, 50 bp, homo sapien
tgtgggaaaggagtgaaacattccaygcaggtacacctagaacaattaaa

SEQ ID NO: 19837 - DNA, 50 bp, homo sapien
aaaaaagtcagtacattgaaatcacrgaggtgttgttccacaaaaactta

SEQ ID NO: 19838 - DNA, 50 bp, homo sapien
aattttaaatttctggtttgaccgartccatgtttgttttaagtgctcag

SEQ ID NO: 19839 - DNA, 50 bp, homo sapien
attcagattaacaattctgtaaacartaagggaaaattctttaagaagtt

SEQ ID NO: 19840 - DNA, 50 bp, homo sapien
aatcagaatttttttgcatttatgamcggctgtttttctactttgtaatt

SEQ ID NO: 19841 - DNA, 50 bp, homo sapien
cctggcccagctgccttaacttagcrcaaatgcaaacttgccctgtatct

SEQ ID NO: 19842 - DNA, 50 bp, homo sapien
gattccattctaagtgcggtgaagarctatctaagtgctcaggcagcgac

SEQ ID NO: 19843 - DNA, 50 bp, homo sapien
aagttggcgatattgtgatgtgttayagaagttggaatatgtaggtacat

SEQ ID NO: 19844 - DNA, 50 bp, homo sapien
ttctctgaacttaagaatggtgcccraatgaacctttacaaaccatgcaa

SEQ ID NO: 19845 - DNA, 50 bp, homo sapien
ctattaaccatggtatgaagagttcrcaaaaactttttgtacatattgtc

SEQ ID NO: 19846 - DNA, 50 bp, homo sapien
aaacaagctttaatatctcttagcayaactataagtattagattaaaatg

SEQ ID NO: 19847 - DNA, 50 bp, homo sapien
ttctttcccttcccatctcgattaamccttgttggcaggagtgctgattc

SEQ ID NO: 19848 - DNA, 50 bp, homo sapien
ccccagttctggcagaaagctgtaasgttgacaaaatggcagtgctgtgg

SEQ ID NO: 19849 - DNA, 50 bp, homo sapien
aagaccaaaagcattatttaaccacratgattcttttgtcctggtttgcc

SEQ ID NO: 19850 - DNA, 50 bp, homo sapien
aagtctttggaaataataattgataygagttgtgtgtttggtcacagtgc

SEQ ID NO: 19851 - DNA, 50 bp, homo sapien
atactaattgccatgaccagtaactraaccagtgagctattaaatcttac

SEQ ID NO: 19852 - DNA, 50 bp, homo sapien
ttttatatgaatatccaaggtcatakaattgattcaaaagctaaggaatc

SEQ ID NO: 19853 - DNA, 50 bp, homo sapien
gctgtattttggaagaaagaaagcaracattttattgaacatacgctatt

SEQ ID NO: 19854 - DNA, 50 bp, homo sapien
tgataacacaaccactttttttagcrcaatgttctatattttattacatg

SEQ ID NO: 19855 - DNA, 50 bp, homo sapien
gctgtagtcatatcaatttcttcaartcaagagcaaagatggttttactg

SEQ ID NO: 19856 - DNA, 50 bp, homo sapien
ggagagaaatgcttcagaaacaatargacttatggcaatgatgatagtga

SEQ ID NO: 19857 - DNA, 50 bp, homo sapien
tttacagcaggtgtaaaaacactaamgacaaggaaataagcaggataaac

SEQ ID NO: 19858 - DNA, 50 bp, homo sapien
gcacctacaatgcagcaggtactaargatataaatatgaacagatatagt

SEQ ID NO: 19859 - DNA, 50 bp, homo sapien
atcttcaaagctagctgaaagtacaygcttacccaccacgttattgtcta

SEQ ID NO: 19860 - DNA, 50 bp, homo sapien
ttccagtgactgggaatgcatttcasaaattaattgctatttttgtgggt

SEQ ID NO: 19861 - DNA, 50 bp, homo sapien
gcttcacccagtactcacagctctgraatctggatggtttataattagta

SEQ ID NO: 19862 - DNA, 50 bp, homo sapien
cgatccaactacataaaaatttgaaragcacaaagaacattacatcttgg

SEQ ID NO: 19863 - DNA, 50 bp, homo sapien
tgaccctgtgataaaaactgtccatsacctgagtgccgagtaattggtga

SEQ ID NO: 19864 - DNA, 50 bp, homo sapien
tcaaaatgatagttttattaccacaraagactacttatccttaatgtttg

SEQ ID NO: 19865 - DNA, 50 bp, homo sapien
gacataactccaagtgttatattaawtgttctattttatattagctctaa

SEQ ID NO: 19866 - DNA, 50 bp, homo sapien
ctggtcactttcagatgatgaaaaaractttcaagttatctctgatcaca

SEQ ID NO: 19867 - DNA, 50 bp, homo sapien
cttataggcttggctgtctttaacartattctggtagctgtgcttgaaca

SEQ ID NO: 19868 - DNA, 50 bp, homo sapien
tcaaattgtattctatatccattaaygtatcagttatcccaaagccttca

SEQ ID NO: 19869 - DNA, 50 bp, homo sapien
agtgtttaacatgctgccggtcacayattaagcaatacacatgagctact

SEQ ID NO: 19870 - DNA, 50 bp, homo sapien
cataaggtaaagacactagccgttckcataaccaagatcccttcagcttc

SEQ ID NO: 19871 - DNA, 50 bp, homo sapien
caagtcaaaagtagtggccagtttayggatagatgtctttcaggtcagcc

SEQ ID NO: 19872 - DNA, 50 bp, homo sapien
gagagaggcaccgccttccctctacyatgattctgaacctggggcacgat

SEQ ID NO: 19873 - DNA, 50 bp, homo sapien
aaaggccttctccaaccctagttaamgccatatctccaccttgtcccacc

SEQ ID NO: 19874 - DNA, 50 bp, homo sapien
acacattttattgtactattatgtgsagtagacacattccttgtcatttg

SEQ ID NO: 19875 - DNA, 50 bp, homo sapien
acagcaactcccttctctaggcgaaytccacctcaacacacaatcagctt

SEQ ID NO: 19876 - DNA, 50 bp, homo sapien
ccacaagagttttaattctattacasaggagtagtcctacaaactaatgt

SEQ ID NO: 19877 - DNA, 50 bp, homo sapien
tttgtgacaattgtaggtgctgtcckggaatttgagacaccatctcttat

SEQ ID NO: 19878 - DNA, 50 bp, homo sapien
attttgacagctcaggaaaatgataygaaaatttgtaatagtaatcaaag

SEQ ID NO: 19879 - DNA, 50 bp, homo sapien
attctatttgagaaaacagttctaaygttcatgcctctatcagaaacatt

SEQ ID NO: 19880 - DNA, 50 bp, homo sapien
gtcattttacccagttgaccactgartatgacgattatgtcatgaatgta

SEQ ID NO: 19881 - DNA, 50 bp, homo sapien
cttgaaatagagagttgatgagttaygtttttgaatacccttcacagggt

SEQ ID NO: 19882 - DNA, 50 bp, homo sapien
aggaccatgacttgcttaggcccgaytaacatttgcactcaccattttgt

SEQ ID NO: 19883 - DNA, 50 bp, homo sapien
tgatgccagcagacctgctcctaggratggctttactactctactgtgtg

SEQ ID NO: 19884 - DNA, 50 bp, homo sapien
tgttctgcatggtcaagtttctccayaatagcatttgtgaaagggaaggg

SEQ ID NO: 19885 - DNA, 50 bp, homo sapien
gacagctggttcctgcaagaatgaaygtacagcattttctaatcagtctc

SEQ ID NO: 19886 - DNA, 50 bp, homo sapien
gcttttatcctctgtgatctgtaaaytgttaaactttccaaaaactaaaa

SEQ ID NO: 19887 - DNA, 50 bp, homo sapien
tcacacgctgggatccagattctcaracctttcagggcctcttgtttatc

SEQ ID NO: 19888 - DNA, 50 bp, homo sapien
tccctggaccactctagacctctgayagttagtaggggtccagtttcccc

SEQ ID NO: 19889 - DNA, 50 bp, homo sapien
aagaaaagccatgcctcaggagaacrgaagaaaacatgccgttcccagcc

SEQ ID NO: 19890 - DNA, 50 bp, homo sapien
cacatttagccctgctgggtgattckagtaaggctcccaaaggaacaagc

SEQ ID NO: 19891 - DNA, 50 bp, homo sapien
tcattgaggaagctcttccataacamatcatatcacatttaactcccagc

SEQ ID NO: 19892 - DNA, 50 bp, homo sapien
agaggtgttaggaaatagacatcaascatttgagcacgttggaatgaagc

SEQ ID NO: 19893 - DNA, 50 bp, homo sapien
ggcctgaaaaactcccttgtctgtargataaaagccctctctttaatgtg

SEQ ID NO: 19894 - DNA, 50 bp, homo sapien
agatgtagacacccatttgatctaaratacagcatacatctgttgagttg

SEQ ID NO: 19895 - DNA, 50 bp, homo sapien
caaataattttcaacaagttagtgaygtagaataaatacaattccagaag

SEQ ID NO: 19896 - DNA, 50 bp, homo sapien
tttcttagtcatccacacctcaaatkagtaaacagactctgcaggaaaat

SEQ ID NO: 19897 - DNA, 50 bp, homo sapien
ggactcaaagtgtaagacaataacaytctcatgatttctcccaaacagaa

SEQ ID NO: 19898 - DNA, 50 bp, homo sapien
tgatctcgccttgaaaagtgtgtgasaggctcagtcagagcattctgtct

SEQ ID NO: 19899 - DNA, 50 bp, homo sapien
tttcaggactgagctcctgcacttaygggtgagaaacacagaaagtgctg

SEQ ID NO: 19900 - DNA, 50 bp, homo sapien
atcagagcctacctctgctctgaagraactcactgtttagagagaaaggc

SEQ ID NO: 19901 - DNA, 50 bp, homo sapien
ctaagactgagcatctggccagatayaacagcaatcatttagggggaaaa

SEQ ID NO: 19902 - DNA, 50 bp, homo sapien
aaacaatttcttccacttaggaaaaygtatagtcttacgtaggtaacacc

SEQ ID NO: 19903 - DNA, 50 bp, homo sapien
gtcattattaactagcacttattgastattgattatgtgccaggaatcat

SEQ ID NO: 19904 - DNA, 50 bp, homo sapien
gactggcgtgtggataaaaaggaagsagtttcaagtcaaataaaacactt

SEQ ID NO: 19905 - DNA, 50 bp, homo sapien
aataacattttggtagatggtaaagkataattacgagtcatttcaagttg

SEQ ID NO: 19906 - DNA, 50 bp, homo sapien
caccacctaggaaaggagaatctacragagagaaatgacctggtggggag

SEQ ID NO: 19907 - DNA, 50 bp, homo sapien
ttttctgcactcccttagtatttagrcaacttccctgcataccacagcca

SEQ ID NO: 19908 - DNA, 50 bp, homo sapien
gctaccctactgctttacacaaattyaacacatctccaagcttctgaggg

SEQ ID NO: 19909 - DNA, 50 bp, homo sapien
agggaagtcactcttggcacctatcwcttgggaaaaaggagcgtctcaga

SEQ ID NO: 19910 - DNA, 50 bp, homo sapien
aaaagtgtggactctcatccacttcratactgtcccacgttggatggagg

SEQ ID NO: 19911 - DNA, 50 bp, homo sapien
gacctagtgtacgctaggtgcttagraatgcttgttaaatgattgaacaa

SEQ ID NO: 19912 - DNA, 50 bp, homo sapien
aatattagctgtcattaattaagcamctactacatcagactctgtggtag

SEQ ID NO: 19913 - DNA, 50 bp, homo sapien
gctgaactcaggaataaatactgagratgcagatctctaatgaaaggaaa

SEQ ID NO: 19914 - DNA, 50 bp, homo sapien
gcagatcacttcaaaaatagatgcaygtcttagttcagtgattgacgttt

SEQ ID NO: 19915 - DNA, 50 bp, homo sapien
acacatatacacacacactcatactyacaacctttactatgtatgctttt

SEQ ID NO: 19916 - DNA, 50 bp, homo sapien
aggaggtttacccactttcccaagaygtaaaaagactcagttaacacagg

SEQ ID NO: 19917 - DNA, 50 bp, homo sapien
atgggtattattaccattagtttatwacttgcctctggtcaggtttagca

SEQ ID NO: 19918 - DNA, 50 bp, homo sapien
ttctctccctttacctcctcatctcrctagtcctttagtttctctcatcc

SEQ ID NO: 19919 - DNA, 50 bp, homo sapien
aatcatgttctgtaaaataggcttargaaaggagaaagacatgttctagg

SEQ ID NO: 19920 - DNA, 50 bp, homo sapien
tatttacaaaggagttattaaatatsagaagcctgttaaccaatagcttt

SEQ ID NO: 19921 - DNA, 50 bp, homo sapien
tcagattccctggctcccaacactckgaagcaaaatataaccatgggcag

SEQ ID NO: 19922 - DNA, 50 bp, homo sapien
gtctctgtgtttcgtttggaatttcrcgttctctccgactccctgccata

SEQ ID NO: 19923 - DNA, 50 bp, homo sapien
aagctttggttaggacctgagtataygcaaagaacacaacgtgcttccaa

SEQ ID NO: 19924 - DNA, 50 bp, homo sapien
aggtcacccctgatttctctcaaacrgagtaacttctcttctttatgtcc

SEQ ID NO: 19925 - DNA, 50 bp, homo sapien
aggctcagagcagttaaatctgccayctagagaagcacagatagacagta

SEQ ID NO: 19926 - DNA, 50 bp, homo sapien
gaatatacttcgagcatttaggtacygaatctagaacacattgctgtgca

SEQ ID NO: 19927 - DNA, 50 bp, homo sapien
ggtttagctagagttaagcaaggtargagtgaccagctagggggaagaga

SEQ ID NO: 19928 - DNA, 50 bp, homo sapien
tgatcaatcaattatgtctgttacaratctagaaaggagagtggcatcat

SEQ ID NO: 19929 - DNA, 50 bp, homo sapien
tgcagacctattacatccctatgacygacatctctcaccactaccccact

SEQ ID NO: 19930 - DNA, 50 bp, homo sapien
aagttctgttgctgaccacgtcttakgaaggtactcttagagaatactag

SEQ ID NO: 19931 - DNA, 50 bp, homo sapien
agtcttgcccagcctatgagaagaargtagaatcccctagaacatggccc

SEQ ID NO: 19932 - DNA, 50 bp, homo sapien
tgttcagtcttctgtttctatcaccraagctaattatttgccttcctgaa

SEQ ID NO: 19933 - DNA, 50 bp, homo sapien
cagagaaaagggagcatcgttatgaygaaaagggagattctcatttcaga

SEQ ID NO: 19934 - DNA, 50 bp, homo sapien
aaaaggaagacgtagctgtggttacrgagaaatgatgtatctgtcctgtg

SEQ ID NO: 19935 - DNA, 50 bp, homo sapien
acctatcactaaaacagctagaaagwctaggcatactgaaagatatttta

SEQ ID NO: 19936 - DNA, 50 bp, homo sapien
taggatcctgtttgtcctaaggaaayggaatctgtcctaggtctaatgtg

SEQ ID NO: 19937 - DNA, 50 bp, homo sapien
tctctaaagagccctaagctcagaakttagctgcttaaacacatggtctt

SEQ ID NO: 19938 - DNA, 50 bp, homo sapien
taggcttagcaaaatgggaataataraacctatctcatagggctgtggag

SEQ ID NO: 19939 - DNA, 50 bp, homo sapien
ttgaatctatagtcatggagataaaracaataagaaaaagagaggattag

SEQ ID NO: 19940 - DNA, 50 bp, homo sapien
tagggccaccaaggaccacatatcgwactgtatagtgagaagggtgggct

SEQ ID NO: 19941 - DNA, 50 bp, homo sapien
aaaagcaatatagagtaagtggttaygttttaaagctcttgattatactg

SEQ ID NO: 19942 - DNA, 50 bp, homo sapien
agacaggagggcagcagaagggcagwaaaactttgcttctgaggccttcc

SEQ ID NO: 19943 - DNA, 50 bp, homo sapien
aattcctctaaacataacttcaaaawtgacttagaataacacacaagact

SEQ ID NO: 19944 - DNA, 50 bp, homo sapien
caagaaggaatggaattgagtgagcraagtacagttaaataaatcttaaa

SEQ ID NO: 19945 - DNA, 50 bp, homo sapien
tccagagactatgtatcttctataamtggcgaggaaagtagttgattcag

SEQ ID NO: 19946 - DNA, 50 bp, homo sapien
agtggagtaaacaaacatgaacaacmaacaatatcacaatgaaataagtg

SEQ ID NO: 19947 - DNA, 50 bp, homo sapien
ctatggaaccactataacttctaacratgcggcatgaatatgtctaagtt

SEQ ID NO: 19948 - DNA, 50 bp, homo sapien
agaagggtctccctttttcatttccrcagttagagcactcacagtatttg

SEQ ID NO: 19949 - DNA, 50 bp, homo sapien
ttttttttttctttttataagcaacwctgaaagatacgggttattaactt

SEQ ID NO: 19950 - DNA, 50 bp, homo sapien
atgtgctagatgctctcacatggaawgtccttttttttttctttttataa

SEQ ID NO: 19951 - DNA, 50 bp, homo sapien
cctgaggacttaacaagcattgagcrgatgaaccaacaaggcattgactt

SEQ ID NO: 19952 - DNA, 50 bp, homo sapien
gtaacagaagggaccagcaggatcayggttttcccagtgtctcctgtggt

SEQ ID NO: 19953 - DNA, 50 bp, homo sapien
atgagcagcaggcacagaagcactgmagagactttcatgttgaaggttaa

SEQ ID NO: 19954 - DNA, 50 bp, homo sapien
gttctgggtactgagcaggtgatagratttagaagtgtattctgtatggc

SEQ ID NO: 19955 - DNA, 50 bp, homo sapien
agtaacataaacaaatcatttaaaartatggtggtacatccagaggcagc

SEQ ID NO: 19956 - DNA, 50 bp, homo sapien
tcttggttgttctgcagatgctatcrctgttgttaaaacacacaacttct

SEQ ID NO: 19957 - DNA, 50 bp, homo sapien
ttgaatttcatgaacttaatccataygctgtgttgaaatacttaacggag

SEQ ID NO: 19958 - DNA, 50 bp, homo sapien
gggctgccagcagcagagctgtagcraaaatctaacatggaggcagcgag

SEQ ID NO: 19959 - DNA, 50 bp, homo sapien
gagcaaatggagaatggacactaackggactttgctcctggatttccttg

SEQ ID NO: 19960 - DNA, 50 bp, homo sapien
gaatttactggtttactcctgagaaraccagtcagagttaatttctcaat

SEQ ID NO: 19961 - DNA, 50 bp, homo sapien
tcaactgtctgcctccactagttgaycataaagtccataaggagctttgt

SEQ ID NO: 19962 - DNA, 50 bp, homo sapien
taggtttgcacacattgaagtatgckatttaacaccatcctgtaactcga

SEQ ID NO: 19963 - DNA, 50 bp, homo sapien
gtaaaattaatagccgaaaagaagamgttctcacccaaagccattgaaac

SEQ ID NO: 19964 - DNA, 50 bp, homo sapien
aaaagagataattaaacacacttaayatctgtgcctaattaatgctgttg

SEQ ID NO: 19965 - DNA, 50 bp, homo sapien
ttttagaagtaggcagagtatattcrcaagtacctttttaattacctaga

SEQ ID NO: 19966 - DNA, 50 bp, homo sapien
aacttcaatttctttatccgtaaaastggaatatatgggtgtctccacat

SEQ ID NO: 19967 - DNA, 50 bp, homo sapien
cccccaatactctgtcctgcttcccrctgaattttatcactttccttgat

SEQ ID NO: 19968 - DNA, 50 bp, homo sapien
atggaagactgagtttcactgtacayctaggacttaacgacagcattgac

SEQ ID NO: 19969 - DNA, 50 bp, homo sapien
tgctgaaatcaaaaggctatgaagargcagaagtcttgtgaaggtgttgt

SEQ ID NO: 19970 - DNA, 50 bp, homo sapien
gtgttaacacttctgaaacaggaatsagatcactgagttaaatctccaac

SEQ ID NO: 19971 - DNA, 50 bp, homo sapien
catggattgccaggaagctcaacaargtgcaagtcaaggttaaaaattag

SEQ ID NO: 19972 - DNA, 50 bp, homo sapien
cagtagtcatggtggaattgtagacygattggagaactttttaggagagt

SEQ ID NO: 19973 - DNA, 50 bp, homo sapien
tccacccctaggctgtgttcaaaacygcagcgtaactgagaaaacggtgg

SEQ ID NO: 19974 - DNA, 50 bp, homo sapien
gaaatagcaccaatagccaacttacmatatgatgagcccttctgcgtact

SEQ ID NO: 19975 - DNA, 50 bp, homo sapien
agcaaactgtgtgtgcttatttatakcttgctttttccttttaaacttaa

SEQ ID NO: 19976 - DNA, 50 bp, homo sapien
acacaggagtcagccctgctccacayagaattaaagcatctgaagtcagc

SEQ ID NO: 19977 - DNA, 50 bp, homo sapien
aacctcagaagttaccatgattatcsaaaactactggtaccctgcccagg

SEQ ID NO: 19978 - DNA, 50 bp, homo sapien
ccagttaccccaaaacaattaagaamtatcgatgagcatctaatgtgtca

SEQ ID NO: 19979 - DNA, 50 bp, homo sapien
ctcatcatagctctattactaataarctctccaatccttctttcctgagt

SEQ ID NO: 19980 - DNA, 50 bp, homo sapien
caacccatgccaggcagtttaggcaygtgaaggattaatgaaggatagag

SEQ ID NO: 19981 - DNA, 50 bp, homo sapien
tggtattcctggaagctagagaccasaaagtaagcaacgctgaaagtcgc

SEQ ID NO: 19982 - DNA, 50 bp, homo sapien
gtttactcgaaaccatactgtactasacacttttgcattccatgctaact

SEQ ID NO: 19983 - DNA, 50 bp, homo sapien
ttgctaggtccccattctttccacaygtttgagaaggtaaaatccttgta

SEQ ID NO: 19984 - DNA, 50 bp, homo sapien
ctgccaaataaatcctaacgtctaayatcagcaatctcttcaacataaac

SEQ ID NO: 19985 - DNA, 50 bp, homo sapien
tgggaagcatgaacccacatagaacyaatctggagactccagtgtttttt

SEQ ID NO: 19986 - DNA, 50 bp, homo sapien
atgatctcctaactactcagtaatasagacaaagtaaatattcccatttg

SEQ ID NO: 19987 - DNA, 50 bp, homo sapien
gcctatcccagtgttgccactccaamgtagtgatacagaatggctgggct

SEQ ID NO: 19988 - DNA, 50 bp, homo sapien
tctggggacacaactggagagggaaygtacttagaggcatgcagtaagat

SEQ ID NO: 19989 - DNA, 50 bp, homo sapien
ctcagagttgctctgcaaattgcacygagaagaactgcagtaatgtttta

SEQ ID NO: 19990 - DNA, 50 bp, homo sapien
ggcaggagtaaaagtcagatttcaaygagtagaagtacaagaaaaaagtg

SEQ ID NO: 19991 - DNA, 50 bp, homo sapien
ctaagaggtgactaactgaagacaargacaaaaaactaccatttgtttca

SEQ ID NO: 19992 - DNA, 50 bp, homo sapien
gaggtgagtcagggctagcattcacrctgaaatctgcaaggattatagac

SEQ ID NO: 19993 - DNA, 50 bp, homo sapien
gaaacaaatgctcagaatatgcagaraaaataagtacatcctatccagga

SEQ ID NO: 19994 - DNA, 50 bp, homo sapien
agagccacagtcagggctaaggccaratcccatcaagagcacctgaatca

SEQ ID NO: 19995 - DNA, 50 bp, homo sapien
cctagaacttggtgttctaaattccragatcaatattctaaacccacttg

SEQ ID NO: 19996 - DNA, 50 bp, homo sapien
agatgggctcagtccacagaagctaygtgaattctcccagtaacagatga

SEQ ID NO: 19997 - DNA, 50 bp, homo sapien
aatttcttgactcatctccaacataygtgtttactgtggaaaacacacat

SEQ ID NO: 19998 - DNA, 50 bp, homo sapien
aatctattccacctcaaaagatcacragttgaaagggaaccagatcacag

SEQ ID NO: 19999 - DNA, 50 bp, homo sapien
cttcttgttgtactcccttctctaakttaatgtgcctgataacttttgaa

SEQ ID NO: 20000 - DNA, 50 bp, homo sapien
tagagaagtgggcactgtttaaggcyaaccattgacttctgataatataa

SEQ ID NO: 20001 - DNA, 50 bp, homo sapien
taaatgatcacttcatattccataarctcctcaacaccttcccactgcag

SEQ ID NO: 20002 - DNA, 50 bp, homo sapien
cctttaaaaatgaaattctaagcaayaaattatacacttcaatgacaaag

SEQ ID NO: 20003 - DNA, 50 bp, homo sapien
agtgaaaaggaatgatctaagtacaygaacaaatctttaaagcaaaatgt

SEQ ID NO: 20004 - DNA, 50 bp, homo sapien
aattctctgtacagccaatgactackatgtgcatgagaatattttactag

SEQ ID NO: 20005 - DNA, 50 bp, homo sapien
agggacagacagggacagatagagayaagcagggacttgcagggactcgt

SEQ ID NO: 20006 - DNA, 50 bp, homo sapien
caggtattaaacattctatggatccraaaccatctttcaacataagcaag

SEQ ID NO: 20007 - DNA, 50 bp, homo sapien
catattacagcttcattgattgacarcaaaagtactgagctatttggtct

SEQ ID NO: 20008 - DNA, 50 bp, homo sapien
ggagattctcctctctaaacttccawggctctattcatgagtaaggatgg

SEQ ID NO: 20009 - DNA, 50 bp, homo sapien
tctagagtaagacatgtttccgaackcattctaagaactatactgttggc

SEQ ID NO: 20010 - DNA, 50 bp, homo sapien
tgtaagcatcctgcactcatgatacragtcaccaaatcctgaaagcccat

SEQ ID NO: 20011 - DNA, 50 bp, homo sapien
atcttggcagacatagacagtgttgraatgtagataattagatttatact

SEQ ID NO: 20012 - DNA, 50 bp, homo sapien
ttatgccacttattgttttctatacyataagacagtgatttatggacata

SEQ ID NO: 20013 - DNA, 50 bp, homo sapien
ctgtctcgtctgctactaaaagttcraatcagtccatccatctcagctag

SEQ ID NO: 20014 - DNA, 50 bp, homo sapien
ggttccatttaggccaagacttaaargatgcactagaactggccaggtga

SEQ ID NO: 20015 - DNA, 50 bp, homo sapien
ggaaaacacattgaatagggtatctraacgaatctggagaccatggttcc

SEQ ID NO: 20016 - DNA, 50 bp, homo sapien
caagtattctactagtgtcatgggcraatatcataattgaatgtacacaa

SEQ ID NO: 20017 - DNA, 50 bp, homo sapien
ctacatgtggacctccgtgagaaaasgcatatgcataggacggtgagcag

SEQ ID NO: 20018 - DNA, 50 bp, homo sapien
ctacaaaaaagcaggaagacctaatrattacaagttcactagttctaacc

SEQ ID NO: 20019 - DNA, 50 bp, homo sapien
attcccctggattagatgaggttacrgagtaagaaatacttatatggatt

SEQ ID NO: 20020 - DNA, 50 bp, homo sapien
gtgcagtctaaggctctccctatgaygtctgtaaattcccaggaggattc

SEQ ID NO: 20021 - DNA, 50 bp, homo sapien
tcaaagcaagttcaaatttggaatasagaccactgggctagtagacactt

SEQ ID NO: 20022 - DNA, 50 bp, homo sapien
tcatagggagagccttagactgcacmaatcgtagaatgggtttagctagt

SEQ ID NO: 20023 - DNA, 50 bp, homo sapien
gaatttttagatgcttttagtatagmacttttagtataggactgtgcaag

SEQ ID NO: 20024 - DNA, 50 bp, homo sapien
gccggtacctgtgagacatcaattasagcctcagtaagggttgaatcaag

SEQ ID NO: 20025 - DNA, 50 bp, homo sapien
cattttaatagtttccttttatgtaygcagtaagcattcaataaaggtct

SEQ ID NO: 20026 - DNA, 50 bp, homo sapien
aatttacgttactggaaggagagtcmatacacaaatttgtgagatagttt

SEQ ID NO: 20027 - DNA, 50 bp, homo sapien
gaaactgtacacttaagatacatgcmctttattttaagtttaaaaataca

SEQ ID NO: 20028 - DNA, 50 bp, homo sapien
atagttctttgcttgaattgcagtgraaaaaaactctctttaagttataa

SEQ ID NO: 20029 - DNA, 50 bp, homo sapien
tattcagattttcctgggaaggacasatactattggtttcacctcagaga

SEQ ID NO: 20030 - DNA, 50 bp, homo sapien
acaacaacatttatttccaggtactractgccagtttttacatcaggaga

SEQ ID NO: 20031 - DNA, 50 bp, homo sapien
gaaggcagaactattctgtgtttgakccctatactaagaacattacatac

SEQ ID NO: 20032 - DNA, 50 bp, homo sapien
gagctacaagaaaactactaaggcayaacccctggaagcattcattcttt

SEQ ID NO: 20033 - DNA, 50 bp, homo sapien
tataagagagagggccatatgtccgkatttgccagaaaactaattgattt

SEQ ID NO: 20034 - DNA, 50 bp, homo sapien
tttctgacagggccaaaataacctastagccttccaaacatttcgccagt

SEQ ID NO: 20035 - DNA, 50 bp, homo sapien
cctaggatttcagcatctgttcttaygtgacgagaagaaacagctccctt

SEQ ID NO: 20036 - DNA, 50 bp, homo sapien
ggagtctataaagttcaggccagacraaagcagagagaaccggagaacag

SEQ ID NO: 20037 - DNA, 50 bp, homo sapien
cgtctcaatcaatcaatcaacaatcrataatcaattagactcctcttggg

SEQ ID NO: 20038 - DNA, 50 bp, homo sapien
gaaatgccatctttttaactacctartaatcattttcttctctccatgaa

SEQ ID NO: 20039 - DNA, 50 bp, homo sapien
tctgtgtatgtattcattgttcacaytggatttattttatgtaaatcaag

SEQ ID NO: 20040 - DNA, 50 bp, homo sapien
cacacatacacatgcatattcctgcraacacacacacacacacacacaca

SEQ ID NO: 20041 - DNA, 50 bp, homo sapien
cctctttaacagtcaacaatgattamggaagtgtgatattggagcaaggt

SEQ ID NO: 20042 - DNA, 50 bp, homo sapien
aagatttaatgtatcatcagtttagrattatgtagcacaaggtcatgttt

SEQ ID NO: 20043 - DNA, 50 bp, homo sapien
ttacagataactgtataattgggtcyaatcacctttgagataggttatca

SEQ ID NO: 20044 - DNA, 50 bp, homo sapien
tgataccagatgttctactactaatsatcttattctattataacccaaga

SEQ ID NO: 20045 - DNA, 50 bp, homo sapien
aaaagaggggaaaaaagaccattaarctgataaaggccaagaacctacac

SEQ ID NO: 20046 - DNA, 50 bp, homo sapien
tcttatgccagtaggttaaagttccraggataaagatgacttttaaaatg

SEQ ID NO: 20047 - DNA, 50 bp, homo sapien
caaaattctgaaattcaaggtaataygttgttcagttcaacttaatttta

SEQ ID NO: 20048 - DNA, 50 bp, homo sapien
gggaagcttcctgcagaaaagagaamattctggaaaggaccaaggaagct

SEQ ID NO: 20049 - DNA, 50 bp, homo sapien
tctttttttatcagattcaatttcasatcagcctgagtcccagaaaggtt

SEQ ID NO: 20050 - DNA, 50 bp, homo sapien
ttcttaaagtggaatgcgttcggtasctttctttttagcaagtgttttac

SEQ ID NO: 20051 - DNA, 50 bp, homo sapien
tactgcctgcataagtcaactcccawtgctcataaacaactgttttctta

SEQ ID NO: 20052 - DNA, 50 bp, homo sapien
tctctttaagattgatgactttcagwatcataaatcggtagagccagaga

SEQ ID NO: 20053 - DNA, 50 bp, homo sapien
tccttgcagaagtgacttgtttacawgttagtacagctagttcctgcctg

SEQ ID NO: 20054 - DNA, 50 bp, homo sapien
gaggacatcagagaaaacaaggtgcratgaactggcggtaggcatttgtt

SEQ ID NO: 20055 - DNA, 50 bp, homo sapien
ccttttaaaggtttgtatgcttaacyggatttcaaaatagttgcaatagt

SEQ ID NO: 20056 - DNA, 50 bp, homo sapien
acataacagatagtgataaaaattcyactggatttgtcaaaagttttaaa

SEQ ID NO: 20057 - DNA, 50 bp, homo sapien
ggaaggttttcactggaccagcctcraagggtgcagtgtggggctggcta

SEQ ID NO: 20058 - DNA, 50 bp, homo sapien
agtgaacaaatgtaaacagtgaaaayccattctttaaacagactcaagac

SEQ ID NO: 20059 - DNA, 50 bp, homo sapien
actaagtttataaaatgtaaactccygaagttcctgtttctccttaagtt

SEQ ID NO: 20060 - DNA, 50 bp, homo sapien
actcaaacaatctgaagagagaccayggatttcacacatctgtcaggtgg

SEQ ID NO: 20061 - DNA, 50 bp, homo sapien
ctcttctttaaaaaaaggaattaacrctatgaagattggatcctaaagaa

SEQ ID NO: 20062 - DNA, 50 bp, homo sapien
agagaaagtgagaagaaactgaagayggactctattacgtgaagtagtaa

SEQ ID NO: 20063 - DNA, 50 bp, homo sapien
aatggggaagcatttagagaactcayaatataaatgatcattttaaatgt

SEQ ID NO: 20064 - DNA, 50 bp, homo sapien
ttggaggggacgtaggacgccggcasagaaggagccgggtggagctgtgg

SEQ ID NO: 20065 - DNA, 50 bp, homo sapien
aagagagccagagcaagagcttgaartatatcatgcaatagtgtatcatg

SEQ ID NO: 20066 - DNA, 50 bp, homo sapien
attaggtcaagaccatttttggcaawccacgatgataaaataatactact

SEQ ID NO: 20067 - DNA, 50 bp, homo sapien
atagatttgataagagtggcttggaratacaatagccaatgtggaaatca

SEQ ID NO: 20068 - DNA, 50 bp, homo sapien
attattcatagcatttcgctctatayactctgtgccatagaacaaattgc

SEQ ID NO: 20069 - DNA, 50 bp, homo sapien
tgtcagagcagcacttcagaaaatakccaggtgtcatgagaagctgctgg

SEQ ID NO: 20070 - DNA, 50 bp, homo sapien
aacaaaaaacttaatttagctttggyaggcagcaagtcactcttgctgta

SEQ ID NO: 20071 - DNA, 50 bp, homo sapien
atgactagattaagtgctgttgcccraaagaataaaggaattaagtttta

SEQ ID NO: 20072 - DNA, 50 bp, homo sapien
cctactagactcactttgggtgaccyacactttgctttctgccgttgata

SEQ ID NO: 20073 - DNA, 50 bp, homo sapien
attggtcttaggtgcctcatatacaragagaaccttgtttttcagcttgt

SEQ ID NO: 20074 - DNA, 50 bp, homo sapien
cactatgccaggctgcctttactgaygttgggcatggtcggaagagctca

SEQ ID NO: 20075 - DNA, 50 bp, homo sapien
atgaatgaatagagggacaaatggawaggtaaagtcctaggaagcaggca

SEQ ID NO: 20076 - DNA, 50 bp, homo sapien
gtatacaacccagttcccttcgtccrctcgccaatgtgcacttagccaag

SEQ ID NO: 20077 - DNA, 50 bp, homo sapien
aaaagttcagttaccttgagcctaayatcgttaatgaacaagtggccccc

SEQ ID NO: 20078 - DNA, 50 bp, homo sapien
tttttccccacagagtcacatacaaratttacatgtaaatagtagtgaca

SEQ ID NO: 20079 - DNA, 50 bp, homo sapien
gaggatacaagtcacaaaggaaaagkctccacatgctgttagttggcaag

SEQ ID NO: 20080 - DNA, 50 bp, homo sapien
acctgacattttctcaagattaggtwaaacccaaacttctgaatactctg

SEQ ID NO: 20081 - DNA, 50 bp, homo sapien
atagaaaccaatctggctgccattcrcttgagagattttgtcatcttcat

SEQ ID NO: 20082 - DNA, 50 bp, homo sapien
cctatccccttcctgaattaagtccraatatagtcagtctttgagtgtgg

SEQ ID NO: 20083 - DNA, 50 bp, homo sapien
agcaggaagaatgggcaagagaatakccagactagctaggacatgtggga

SEQ ID NO: 20084 - DNA, 50 bp, homo sapien
aggccaaggctgtatataacctccaygaaaaccactgtctgcagtgccca

SEQ ID NO: 20085 - DNA, 50 bp, homo sapien
tccctttgatagtgactttttaaaasagagtggccacactgcattccact

SEQ ID NO: 20086 - DNA, 50 bp, homo sapien
tttctagttatttagttgccacctayaaaaaactacatacaaaacctctg

SEQ ID NO: 20087 - DNA, 50 bp, homo sapien
ccctatgagctaggggattgagcaaygataccttttaatctttacttcca

SEQ ID NO: 20088 - DNA, 50 bp, homo sapien
tctcccataccctgaattgcaaagayctaagtgtagattccccagggact

SEQ ID NO: 20089 - DNA, 50 bp, homo sapien
tgagactaagaaaaacctaatgtggracaatccaaagtgattataactag

SEQ ID NO: 20090 - DNA, 50 bp, homo sapien
cacatatgcacgtctgatccctataraggtgtatgttcagcttttgttca

SEQ ID NO: 20091 - DNA, 50 bp, homo sapien
atctgattctaggagactctgcctcrttgaggatattttgaggcctaact

SEQ ID NO: 20092 - DNA, 50 bp, homo sapien
gaatgatggtttccagcttctggaawtacggtgaaatttacggcagactg

SEQ ID NO: 20093 - DNA, 50 bp, homo sapien
aggttagaaaagaaaggtgagtaaawttatcaatcttagaaaatctggag

SEQ ID NO: 20094 - DNA, 50 bp, homo sapien
gtcttgggcctcagaatttagctaaygtatgtgttttcttttctttcttt

SEQ ID NO: 20095 - DNA, 50 bp, homo sapien
caaaaagccccagatcactcacttayatgacagaaacattagtctctgcc

SEQ ID NO: 20096 - DNA, 50 bp, homo sapien
gcacagactcatggcttctcaatcargcaagtacatgttttacttttcat

SEQ ID NO: 20097 - DNA, 50 bp, homo sapien
tcctccagcctggtgctctctgttgyactattagaatcagctaatcagac

SEQ ID NO: 20098 - DNA, 50 bp, homo sapien
agaaaatgaagctggagtggaagctsaatttccaaaaagcacctggcttg

SEQ ID NO: 20099 - DNA, 50 bp, homo sapien
ggatagtgatgtggaaatattaacarcagagtcaaagcgggtattttggg

SEQ ID NO: 20100 - DNA, 50 bp, homo sapien
tttctcattgctcttttggacagaastcataccgctccttgaagccaaag

SEQ ID NO: 20101 - DNA, 50 bp, homo sapien
taatctgagctccagttactacttarggtgtttcctgaacgtactactgc

SEQ ID NO: 20102 - DNA, 50 bp, homo sapien
tcctcatctacaaaggtaaggtaacwgtatctattttacaggattgatgt

SEQ ID NO: 20103 - DNA, 50 bp, homo sapien
gggaaaggtaaggactgcatttaaarggtctatctggaggacaacatgtc

SEQ ID NO: 20104 - DNA, 50 bp, homo sapien
atgagggataagtggtgctcctctasaattaggtactaactcagaaggca

SEQ ID NO: 20105 - DNA, 50 bp, homo sapien
gactagatagtctatagacagagaarcagattcattaaaccagggccatt

SEQ ID NO: 20106 - DNA, 50 bp, homo sapien
cattaagtgtatagttaatgaataartatagctcaaaatatattaaatat

SEQ ID NO: 20107 - DNA, 50 bp, homo sapien
gagacatcctgggtaataaaccgatragaagctctgctgcattcctctcg

SEQ ID NO: 20108 - DNA, 50 bp, homo sapien
gggtatttattaaatacattcgggcyacaatgtctaggaatggcacagaa

SEQ ID NO: 20109 - DNA, 50 bp, homo sapien
aacaccaagtagaagttacactacamggaccatgcaggtcagccaggtgt

SEQ ID NO: 20110 - DNA, 50 bp, homo sapien
cactttcttgagcttgcctttatgayagagacattttgctagagtaaatg

SEQ ID NO: 20111 - DNA, 50 bp, homo sapien
agtttccagtgggatacagacagaayatgacttgagagattgataggatt

SEQ ID NO: 20112 - DNA, 50 bp, homo sapien
tggaaattctgcattgtagttgaaawtaatttatctattttaatgcagat

SEQ ID NO: 20113 - DNA, 50 bp, homo sapien
cctaaaatttttattctggtttacayggattagcataaagatagagcaaa

SEQ ID NO: 20114 - DNA, 50 bp, homo sapien
catataaagtctgaattttgaataayttagatgggccctaagctatacct

SEQ ID NO: 20115 - DNA, 50 bp, homo sapien
gtgtttctagtcaaggatatttcaaytaaatttcatcagtacattatagt

SEQ ID NO: 20116 - DNA, 50 bp, homo sapien
cggaatacaaagatatatttagctgyagtttgttttgtagttgagttcaa

SEQ ID NO: 20117 - DNA, 50 bp, homo sapien
ttagatggtggtagtgtagtgttaargaaggcctccaaaaaatgtgagac

SEQ ID NO: 20118 - DNA, 50 bp, homo sapien
ttaagagataattacaaaatggctaygtcccaaattctactgataatggt

SEQ ID NO: 20119 - DNA, 50 bp, homo sapien
gaaaaaacagggcttgaggcatatcracaaagagaacaccagcagtcatt

SEQ ID NO: 20120 - DNA, 50 bp, homo sapien
taatctgtaaaatgagaaagttggtyaatacctacgttctccaaactgtg

SEQ ID NO: 20121 - DNA, 50 bp, homo sapien
cgctttttccacttacaatattatargcactttccaagctattgttgtat

SEQ ID NO: 20122 - DNA, 50 bp, homo sapien
gcagtatttaccagactgagttccaygaacactggttccaagggacttga

SEQ ID NO: 20123 - DNA, 50 bp, homo sapien
agggaggtctccaatggtacccaaakgtgcaaataattaagaagattcat

SEQ ID NO: 20124 - DNA, 50 bp, homo sapien
taccttttttctttgaaccatttcarcaatcctctaaggtggatattatt

SEQ ID NO: 20125 - DNA, 50 bp, homo sapien
aatcgtcctctccactgaccttcaayacccaaaaaagtaaaattctctga

SEQ ID NO: 20126 - DNA, 50 bp, homo sapien
caaaacaaaaatccctggaatactcratcgagggttatgaactccacctg

SEQ ID NO: 20127 - DNA, 50 bp, homo sapien
aagagcaatagagcaaagactgctargttattagaactaaagaaaacttc

SEQ ID NO: 20128 - DNA, 50 bp, homo sapien
tgagctccccagggatgccaagcaartcagatacagagccaggactggtc

SEQ ID NO: 20129 - DNA, 50 bp, homo sapien
ctggtgacagtgaaggcagtgataayaccacaatcagggacatctctaat

SEQ ID NO: 20130 - DNA, 50 bp, homo sapien
tagagaaacctgggtctgtgagatcyactgatggctccagaccccaactt

SEQ ID NO: 20131 - DNA, 50 bp, homo sapien
cttcctccaaattttaccaatcccaractctgctcctgccaatataattt

SEQ ID NO: 20132 - DNA, 50 bp, homo sapien
tcttttagtccccagatgtgtcagcratgtaagctatgcctttcaaccag

SEQ ID NO: 20133 - DNA, 50 bp, homo sapien
aagggcgagacatgcaaattagaaayggcgcttcagccacggggcaaaaa

SEQ ID NO: 20134 - DNA, 50 bp, homo sapien
tagctctgtgaccttagacaagttastaaagctctcctggtcacagtttt

SEQ ID NO: 20135 - DNA, 50 bp, homo sapien
ggcccagatcattttaattatgtcamtctcttgctcaaaaatatgtaaaa

SEQ ID NO: 20136 - DNA, 50 bp, homo sapien
cagcctatggaggcctcaatgagaartcttttgtagatggcttgaatttt

SEQ ID NO: 20137 - DNA, 50 bp, homo sapien
tctgtgctgagtatggtggcaaataraggtatgtccctggtgccttgtta

SEQ ID NO: 20138 - DNA, 50 bp, homo sapien
atcaatattaatgcatcacatggacrcagaatttgtaatgagtcattcta

SEQ ID NO: 20139 - DNA, 50 bp, homo sapien
aaattaagtaacgaattaaagcataygtaatcagagttttagctctcaac

SEQ ID NO: 20140 - DNA, 50 bp, homo sapien
gaatggactagatctcttgttgacartatcctctgtagtgtcccatagac

SEQ ID NO: 20141 - DNA, 50 bp, homo sapien
catttgacaagcttcctaacgaaggkattcatcattacacaatcatcaag

SEQ ID NO: 20142 - DNA, 50 bp, homo sapien
gtttcttatttctcttgtcccttgaygattgtgtaatgatgaatcccttc

SEQ ID NO: 20143 - DNA, 50 bp, homo sapien
gttgacttcaatcgggcaagatcacrgtcaagttcagcactgctttctga

SEQ ID NO: 20144 - DNA, 50 bp, homo sapien
aacttcctgagggcgaagactctaaytccttatcccattgggatccagat

SEQ ID NO: 20145 - DNA, 50 bp, homo sapien
acaaacaaaaaacagccagtatttcrcttcagagcagcaactgtcccatg

SEQ ID NO: 20146 - DNA, 50 bp, homo sapien
ctgtataccaggcacttggatacaaygaaacaattggatagaatacacac

SEQ ID NO: 20147 - DNA, 50 bp, homo sapien
gcctgatcaggtactaataggagctyaccatttcctgagcatatagtatg

SEQ ID NO: 20148 - DNA, 50 bp, homo sapien
tgttcttggagggttggataccgacrcgggttgggttgctgtgctctctc

SEQ ID NO: 20149 - DNA, 50 bp, homo sapien
tttaaaaatatttttgtaaaaacaaytatgtagctcaagctggagtgatc

SEQ ID NO: 20150 - DNA, 50 bp, homo sapien
ggagggagccaggtgagaaagtgaaytgacccacatgacttccgaggctc

SEQ ID NO: 20151 - DNA, 50 bp, homo sapien
ggttaaaaacatcataagaccgatgraacagtctcttcgtggcaataaga

SEQ ID NO: 20152 - DNA, 50 bp, homo sapien
tgtcctgcatccaaatcactgtgtgmacatgagaaagtcactggtccttt

SEQ ID NO: 20153 - DNA, 50 bp, homo sapien
actccactttttacaaactactttcragcccatgacttccctctgctctt

SEQ ID NO: 20154 - DNA, 50 bp, homo sapien
aaaattctttatacgatgttaaaaayttaaggatcaaaaatatcacgcta

SEQ ID NO: 20155 - DNA, 50 bp, homo sapien
cttctccattagctaaatgaccagakagaaactcacctgcatcctggtta

SEQ ID NO: 20156 - DNA, 50 bp, homo sapien
ataaagattgtaaattggcattttcratagctctaggaagtttagacaac

SEQ ID NO: 20157 - DNA, 50 bp, homo sapien
actgtcagagtctaaatagattctargtctcttgtctcgtctatcttcca

SEQ ID NO: 20158 - DNA, 50 bp, homo sapien
gtaaaatcacatctaacacctttacrcagaggaaataattcagtgtcaat

SEQ ID NO: 20159 - DNA, 50 bp, homo sapien
aaaaataaacatttattaggtatagrcaaatgcaaatatattcaatgctt

SEQ ID NO: 20160 - DNA, 50 bp, homo sapien
ctggagagagagagcacgcaaagacracagagagaagtcaaataggaaat

SEQ ID NO: 20161 - DNA, 50 bp, homo sapien
cacccctgttacaaaggattgacacraatttctctttactcccattgtct

SEQ ID NO: 20162 - DNA, 50 bp, homo sapien
aaaatttaaaactgttgattacttayaccctgatgttgggtaaaacatac

SEQ ID NO: 20163 - DNA, 50 bp, homo sapien
aataaaatgcttagtatctctgacayatagtttaaacttccatttctaac

SEQ ID NO: 20164 - DNA, 50 bp, homo sapien
ttcattttaagatgtcttccacagaygctaagaataacttgtctggagga

SEQ ID NO: 20165 - DNA, 50 bp, homo sapien
tcatataggctggactaaatttcgcraagttcattaattttcaaatgtaa

SEQ ID NO: 20166 - DNA, 50 bp, homo sapien
atacttctatttccataaataattcygaatgcttggagaaaacactagtt

SEQ ID NO: 20167 - DNA, 50 bp, homo sapien
caggagggaatgaagttagacaagasagaacacttcctcaatgaaggatt

SEQ ID NO: 20168 - DNA, 50 bp, homo sapien
ggaggttctaaaaggctattggactyaacatatgcaatgtggaatttatt

SEQ ID NO: 20169 - DNA, 50 bp, homo sapien
attctaaggtttcaaacaaccaatawggaaaagaaagctgatcaggcatg

SEQ ID NO: 20170 - DNA, 50 bp, homo sapien
ataaataatcctaaaaactgaatgtwaagtagacatggagctttcatggg

SEQ ID NO: 20171 - DNA, 50 bp, homo sapien
ttcagtgtcatgcgatgaattaaaayagggctgtgttaaaatagtgactg

SEQ ID NO: 20172 - DNA, 50 bp, homo sapien
gttgcctgtcacccagtgggtcccawtcaatacagataggttaaggaact

SEQ ID NO: 20173 - DNA, 50 bp, homo sapien
tacaaatacatttttttaagttgtartaacaggaaaaattatggctcaga

SEQ ID NO: 20174 - DNA, 50 bp, homo sapien
tctgattttaaattctctaagatgcsctcgtagctctcaaataaatgctt

SEQ ID NO: 20175 - DNA, 50 bp, homo sapien
tcattaagttgtattatcggttcaayttaattgatttgactcgtggacat

SEQ ID NO: 20176 - DNA, 50 bp, homo sapien
ggaatttgatgtggacaagaaactcygaggctagcagcatgaaatacata

SEQ ID NO: 20177 - DNA, 50 bp, homo sapien
actcttcctcctttcattgaaatgcrgagattcccttgaagttggatact

SEQ ID NO: 20178 - DNA, 50 bp, homo sapien
tacaggcagaaactatggtttctgcracaataagaagaaaacttacaatg

SEQ ID NO: 20179 - DNA, 50 bp, homo sapien
cagtattttccattaggaaatcttgyagcattcagctgggtgcttataca

SEQ ID NO: 20180 - DNA, 50 bp, homo sapien
acatctgtaaaagatactaagatccraggaaagaataatccaaacaacca

SEQ ID NO: 20181 - DNA, 50 bp, homo sapien
ggaaggttctaaacagattgccctargatctcagtgaggcgtgaagctta

SEQ ID NO: 20182 - DNA, 50 bp, homo sapien
gcttctaaattgcgtatttgttccaycattttgaagaagagttgcatttc

SEQ ID NO: 20183 - DNA, 50 bp, homo sapien
atgggaaggctgaaagccaagcaagraaatagtttcagaaaatgagttca

SEQ ID NO: 20184 - DNA, 50 bp, homo sapien
gattgaactctattttcaggcttaartattccctctgcactgctgcaact

SEQ ID NO: 20185 - DNA, 50 bp, homo sapien
tcaatcattcaagccgttgggtaaargcaaataattagcaaaaataatac

SEQ ID NO: 20186 - DNA, 50 bp, homo sapien
attatagaatattccctaaagacaaygtgatgttctatgcaaaaaaaaaa

SEQ ID NO: 20187 - DNA, 50 bp, homo sapien
tcattgctaaatctgaactgattacscttgctatttgtcactggaacaca

SEQ ID NO: 20188 - DNA, 50 bp, homo sapien
agggtaatcagttcagatttagcaaygaactcaaataaaagttaattagg

SEQ ID NO: 20189 - DNA, 50 bp, homo sapien
ggaccaactcccagtggagagggtayataagagccccagagaaaggagag

SEQ ID NO: 20190 - DNA, 50 bp, homo sapien
tcaaacccataaataccacagactcyaatagccatggattgctgtgcctc

SEQ ID NO: 20191 - DNA, 50 bp, homo sapien
tgggaaggagacatataacagaatayaccattaattttgggagatttcca

SEQ ID NO: 20192 - DNA, 50 bp, homo sapien
ccccagcccacctcagttcaaacacratgtgcatccattcacacaggcac

SEQ ID NO: 20193 - DNA, 50 bp, homo sapien
gaggaacctctctgtaattggagaamggtaatcaacagtgctgcggactt

SEQ ID NO: 20194 - DNA, 50 bp, homo sapien
acagactaatacactatgccatgttraaaaactacaaggctcaaagtgat

SEQ ID NO: 20195 - DNA, 50 bp, homo sapien
agaaaaaaacattaagttggaggackaacagtgaatatcagctactcagg

SEQ ID NO: 20196 - DNA, 50 bp, homo sapien
gtttaagtgtctgagacaccatttaytaaactgttaaaagaagaaataga

SEQ ID NO: 20197 - DNA, 50 bp, homo sapien
tccagagtagttgcctttctcacagraattaagtgtttatgctgcttcct

SEQ ID NO: 20198 - DNA, 50 bp, homo sapien
ctgatagatcccagctacccatacarcttctacctctttaatccaatgac

SEQ ID NO: 20199 - DNA, 50 bp, homo sapien
attacattttttagaagtggtttagragctacttaaatgatgaaaggaga

SEQ ID NO: 20200 - DNA, 50 bp, homo sapien
gaaccgttattgtgtctgttcacatyaaatgaaaaaatctcacattgctc

SEQ ID NO: 20201 - DNA, 50 bp, homo sapien
tgtgttttatacttcatttgtcttamgtgtgtatttttggcttttctatc

SEQ ID NO: 20202 - DNA, 50 bp, homo sapien
atacagactgagtttaataataggayattcaccatttcttcattccaagc

SEQ ID NO: 20203 - DNA, 50 bp, homo sapien
cgttattgaactacgatacaaccaartggacccagcagtatattcatcct

SEQ ID NO: 20204 - DNA, 50 bp, homo sapien
aagcaatagatttttaggcagataaraggatgtaataaaagcaatatttg

SEQ ID NO: 20205 - DNA, 50 bp, homo sapien
gaaggaaaaaggactgaataattcaygaggaagaaaactagttctaggtt

SEQ ID NO: 20206 - DNA, 50 bp, homo sapien
aagggaaaaaataggcaaggattatraaaatacaactttctgtcatagat

SEQ ID NO: 20207 - DNA, 50 bp, homo sapien
tttataagagagttgaacattgtaarataaatctaataactaaacaatat

SEQ ID NO: 20208 - DNA, 50 bp, homo sapien
cagaggcctgaccggacacataataygacaaccacatttttcctcatcat

SEQ ID NO: 20209 - DNA, 50 bp, homo sapien
gggttggttatggtcgtatctttaaragtgaaattttcaactcctaagac

SEQ ID NO: 20210 - DNA, 50 bp, homo sapien
tgaagagcaggcagcttgtagccaaygtacccagagacctggccgtagag

SEQ ID NO: 20211 - DNA, 50 bp, homo sapien
ccatatctgatggtatcctatagaamttcgctctctatcaaaatcacaat

SEQ ID NO: 20212 - DNA, 50 bp, homo sapien
gacaggtctaatggatttgtgtctakgtctagttccttgtaggaatatct

SEQ ID NO: 20213 - DNA, 50 bp, homo sapien
aaaagttttgaccatataaagcaacragagaggaatattgaatatacata

SEQ ID NO: 20214 - DNA, 50 bp, homo sapien
tttctaataggacttattggccacckgaaattatgtcttctcactagaat

SEQ ID NO: 20215 - DNA, 50 bp, homo sapien
agactgagtacacttaggattcaaarctattttcagggtactattagtca

SEQ ID NO: 20216 - DNA, 50 bp, homo sapien
gaaaatatcatagatcaagtccgaasggtgatgagaggataggcataaga

SEQ ID NO: 20217 - DNA, 50 bp, homo sapien
atgtaagaacacccaagtcagtcacrgtcatgagggtaaagcatgactta

SEQ ID NO: 20218 - DNA, 50 bp, homo sapien
tgcttgactagtgtacccatactackgattcacttccttctttgagtatc

SEQ ID NO: 20219 - DNA, 50 bp, homo sapien
tgatatgcgattaagataaagtgcawgatatgttttttttttttcttttt

SEQ ID NO: 20220 - DNA, 50 bp, homo sapien
tatagctttaaaatgtcttggccatsatgaatattctgggtaacctagct

SEQ ID NO: 20221 - DNA, 50 bp, homo sapien
ctcatcttattacttatctatggaartgaccaaaaccacatctagaagtc

SEQ ID NO: 20222 - DNA, 50 bp, homo sapien
ttgcaagtggtgcaatttaggatgawctgtttttattcattactgcataa

SEQ ID NO: 20223 - DNA, 50 bp, homo sapien
acgtgatacatcacattaccagactraaagataaaaacgcgttattatct

SEQ ID NO: 20224 - DNA, 50 bp, homo sapien
gctgttttttcccacagctgacaacrgagtcaacctcttcgaggcaggag

SEQ ID NO: 20225 - DNA, 50 bp, homo sapien
aaatgcatcagcaaaagtgaatttckaagcatctctctagtgttacaaac

SEQ ID NO: 20226 - DNA, 50 bp, homo sapien
gtctcaagaaagaaaaaagtgtacartcaatcggttttgtcatgcatata

SEQ ID NO: 20227 - DNA, 50 bp, homo sapien
gcttacctctatagaagaacatccaracaatcaaataaaagaaggaactt

SEQ ID NO: 20228 - DNA, 50 bp, homo sapien
gacaataataatttaatacctaccayagcgagaaagtaaaattaaattaa

SEQ ID NO: 20229 - DNA, 50 bp, homo sapien
agcagtgtcaagggtttcgagcagcsaggctcattggcagtcggcttttg

SEQ ID NO: 20230 - DNA, 50 bp, homo sapien
agcctggaaggaagcagcagtttgartacatgtaaacaatgctccacaga

SEQ ID NO: 20231 - DNA, 50 bp, homo sapien
aacctattgataggcagcaacaatarcatataagtcaaaaggagggtaga

SEQ ID NO: 20232 - DNA, 50 bp, homo sapien
aaaacaaaacaccagtatctgtgtargtacaactagtatagtctttcaca

SEQ ID NO: 20233 - DNA, 50 bp, homo sapien
ccaggccaaaacatgcttgaaaaatkaggaaaatgaaaagatgacttata

SEQ ID NO: 20234 - DNA, 50 bp, homo sapien
ggttttacaacttggccttctgatartaataataacagcagtaacaacac

SEQ ID NO: 20235 - DNA, 50 bp, homo sapien
tggtttctctcatctgtacaattaaraagctccattgagagagggaacta

SEQ ID NO: 20236 - DNA, 50 bp, homo sapien
gatcatcattatcatcatgaacaaargcatcctaaaatgagggagagcaa

SEQ ID NO: 20237 - DNA, 50 bp, homo sapien
tacctactagcgtcagtataattacrcatttggcttctgctagcatgtta

SEQ ID NO: 20238 - DNA, 50 bp, homo sapien
gtcataaatactgttacctgtaagawtatgtgaactttattatggatctt

SEQ ID NO: 20239 - DNA, 50 bp, homo sapien
agaatgtacatcatccgagaacaaamtagagcgaagggctgatccactgg

SEQ ID NO: 20240 - DNA, 50 bp, homo sapien
gatatgtacataattaaacaatcacrccctctttagtatcttttggtaga

SEQ ID NO: 20241 - DNA, 50 bp, homo sapien
gatcctgacagtgattaaagaaatayaggaaagctctcaacatatgtgta

SEQ ID NO: 20242 - DNA, 50 bp, homo sapien
tttctggctttgctcttcaaataaaycactctgagaagttgataaagtaa

SEQ ID NO: 20243 - DNA, 50 bp, homo sapien
tcattgtattctcaaaatttttgacwacttgatcaagtctattacgattc

SEQ ID NO: 20244 - DNA, 50 bp, homo sapien
agataagaagacatctataaacatgmaaacaaatgaagaaatgagagcat

SEQ ID NO: 20245 - DNA, 50 bp, homo sapien
ttggagggctttcttcagtattcacratgtctcttgaaagggacttttga

SEQ ID NO: 20246 - DNA, 50 bp, homo sapien
gttttgccagtccaagaatatagccractggatcaagttttcctaagaga

SEQ ID NO: 20247 - DNA, 50 bp, homo sapien
gatcatgtagattctggaatttgacrgtactttggctcccagccctccag

SEQ ID NO: 20248 - DNA, 50 bp, homo sapien
cattttggtcaataaacagcaagaaygtttgaagaagagagaaaagtagc

SEQ ID NO: 20249 - DNA, 50 bp, homo sapien
aacagccacgtgagtgccaataaackctggaaactcatgtttcctaatct

SEQ ID NO: 20250 - DNA, 50 bp, homo sapien
tctaagtattgtcttaatgagtagasctagattacccccagcttcaccaa

SEQ ID NO: 20251 - DNA, 50 bp, homo sapien
gaatgtatgatgtattcttagcaaayggcccatgggaagacactaatatc

SEQ ID NO: 20252 - DNA, 50 bp, homo sapien
caccgagcagagtgggagctatgtaygagtgacacccactctcttacctg

SEQ ID NO: 20253 - DNA, 50 bp, homo sapien
taaaaaggtttcattacatttagcaraataaagtcttattaaaggttatg

SEQ ID NO: 20254 - DNA, 50 bp, homo sapien
gaagtaggtgttcactttaaacttayggcttgatctttttctaccctctg

SEQ ID NO: 20255 - DNA, 50 bp, homo sapien
ttaacgcacatttggttcctctaaaygttttctactaaaagagctctaca

SEQ ID NO: 20256 - DNA, 50 bp, homo sapien
atgtgtttaccttacatttaatgaayggtttagtgttttctctgagattt

SEQ ID NO: 20257 - DNA, 50 bp, homo sapien
tgactacactaaaacatctctgctayatttttcatgtgtaatacattgat

SEQ ID NO: 20258 - DNA, 50 bp, homo sapien
tgaaaacgtagaggactcaaatcggwagatctgtgttctagaatgtactt

SEQ ID NO: 20259 - DNA, 50 bp, homo sapien
tctagaatgtacttcacaaggcatcrgagggttgttaccttattagccct

SEQ ID NO: 20260 - DNA, 50 bp, homo sapien
atccctcaccctagaaaggagcaacrgtgctaatcaacccacgagctgct

SEQ ID NO: 20261 - DNA, 50 bp, homo sapien
taggcagataaagagtttggggccartaaaaaatatcacagttctgagga

SEQ ID NO: 20262 - DNA, 50 bp, homo sapien
atcccatgctcatgagagtaatcccyagttgaatattatgcagctactaa

SEQ ID NO: 20263 - DNA, 50 bp, homo sapien
taaacaggcaatttatcatgtggccraaggttgtacgtaatgcattatct

SEQ ID NO: 20264 - DNA, 50 bp, homo sapien
acagagtttcacagaagttggaacaygatcaagtctaccaaaatatgcat

SEQ ID NO: 20265 - DNA, 50 bp, homo sapien
aagagccatgacagatccactacacrgccaattcctctgcaggtaatcag

SEQ ID NO: 20266 - DNA, 50 bp, homo sapien
ttcttgtagaatcaagaaggaagtgraactagagtaactttctgtaaagt

SEQ ID NO: 20267 - DNA, 50 bp, homo sapien
gggtctgctctggtttgggatcctgsagttcctgcttctttcaggctacc

SEQ ID NO: 20268 - DNA, 50 bp, homo sapien
gtcaaaatatcactccctgagcaatkaaactaaatcttagagctgcctac

SEQ ID NO: 20269 - DNA, 50 bp, homo sapien
gctagatgctttctcagcactgttcyagtttgtaggtgaaacatgaagct

SEQ ID NO: 20270 - DNA, 50 bp, homo sapien
cagctcaggtggcacttagctgacayctattggaacagtcatgaaactat

SEQ ID NO: 20271 - DNA, 50 bp, homo sapien
caaactgctccataggccataaaggyatgaatagtttcatgactgttcca

SEQ ID NO: 20272 - DNA, 50 bp, homo sapien
ctgatctacatgcttattaagcaaaygatagaatgaatgaatgaatgaat

SEQ ID NO: 20273 - DNA, 50 bp, homo sapien
ccattttccatattgcaagcacatcsatcttttaaaattcaaatctaatc

SEQ ID NO: 20274 - DNA, 50 bp, homo sapien
ttctattgttctatcgtttttctcaytctggcaaatcttaccaatctatt

SEQ ID NO: 20275 - DNA, 50 bp, homo sapien
tcaactcttcccatggattaatagawctgtaattaaaatccaacagagag

SEQ ID NO: 20276 - DNA, 50 bp, homo sapien
gttgctcaaccttttgcagagaaaakattacagttctagttggtagagga

SEQ ID NO: 20277 - DNA, 50 bp, homo sapien
aacctgcagaggcatctgttgcaaasggtgtcttacagtgccactcaatt

SEQ ID NO: 20278 - DNA, 50 bp, homo sapien
cttacactccaccccctaggccaaasgagacatatgccttggacacacag

SEQ ID NO: 20279 - DNA, 50 bp, homo sapien
ctttaactacattgtccaactgaagratctcttgtcatcaaagcttggac

SEQ ID NO: 20280 - DNA, 50 bp, homo sapien
tcaagagggttagtctgtctttgagraccagcattttctgaaaaatgtgt

SEQ ID NO: 20281 - DNA, 50 bp, homo sapien
tcaaagtacacacacaatagggtccraatggaatcacaaacacatagcca

SEQ ID NO: 20282 - DNA, 50 bp, homo sapien
ccacacaaatcaaagcacatttccartgccactccatctgaagttttgac

SEQ ID NO: 20283 - DNA, 50 bp, homo sapien
agatacatccctggcaagtgaaatayctggacaggaaaataacaagccat

SEQ ID NO: 20284 - DNA, 50 bp, homo sapien
tgttcaaatcagctaagtgtaagaarattagaaatgattgggggcctgtc

SEQ ID NO: 20285 - DNA, 50 bp, homo sapien
ttgcctaagggtcacaaagcacctawgtgtagaagctagggttcaaggca

SEQ ID NO: 20286 - DNA, 50 bp, homo sapien
atatttatttatgatcttcttaaaaycattccatgaaataggaactgtaa

SEQ ID NO: 20287 - DNA, 50 bp, homo sapien
ctaccttagtggatgagcactctcargttagatatctgcatagttgccta

SEQ ID NO: 20288 - DNA, 50 bp, homo sapien
aagcccaatatgtatttgttgtccaygactctttgaaacattctcttact

SEQ ID NO: 20289 - DNA, 50 bp, homo sapien
gggaagggggactgctcatggaatcrgaagacttaggagtgagtctcggt

SEQ ID NO: 20290 - DNA, 50 bp, homo sapien
gtttctccatattgtaaattcatgayggctatttattgggcatctactgt

SEQ ID NO: 20291 - DNA, 50 bp, homo sapien
taggcactgcactaggtactggagaygactcctgaaactcccacttaaac

SEQ ID NO: 20292 - DNA, 50 bp, homo sapien
acattacaagcacggacagtatgtayccttaggcttaacataaagtataa

SEQ ID NO: 20293 - DNA, 32 bp, homo sapien
aaaaagcataattaccrgagccaagttgaggt

SEQ ID NO: 20294 - DNA, 50 bp, homo sapien
gataattgcacaattcgccatttaakaacagtggaaatcagtttataagg

SEQ ID NO: 20295 - DNA, 50 bp, homo sapien
ccctaattaagctttgataccttacrgcagagtttgtctgcaattatatt

SEQ ID NO: 20296 - DNA, 50 bp, homo sapien
attaagcaggatgacaaaattcataygtttttcccagcgtcaaggcatct

SEQ ID NO: 20297 - DNA, 50 bp, homo sapien
aagaaagcagccaacaggatttgcarggacataccctattccttccagct

SEQ ID NO: 20298 - DNA, 50 bp, homo sapien
caatgtcctgagctcacactgatggrcatgcttaacctgcactgtccttc

SEQ ID NO: 20299 - DNA, 50 bp, homo sapien
caggcctggggctttaggtaatcaaraggtcattgctttttttttttttt

SEQ ID NO: 20300 - DNA, 50 bp, homo sapien
tgaaatgtagataatcctttgccaastaagatagttctccagggtaccca

SEQ ID NO: 20301 - DNA, 50 bp, homo sapien
tcagaagcctcgaaatatgtattaayggtcacaagggaaatcgtgggcaa

SEQ ID NO: 20302 - DNA, 50 bp, homo sapien
atttctgcagttctgttcttgcccaygatttcccttgtgaccattaatac

SEQ ID NO: 20303 - DNA, 50 bp, homo sapien
ctcctgcatttgcctaagccagttcracttgggtttatgacataggaaag

SEQ ID NO: 20304 - DNA, 50 bp, homo sapien
tacatttttagatcccaactctaccrctgtaattctttttgtgcccattt

SEQ ID NO: 20305 - DNA, 50 bp, homo sapien
tgggttgcttgggatcagcttgtcasgtaggacttgagaatggggagctc

SEQ ID NO: 20306 - DNA, 50 bp, homo sapien
ataaataaataaatacatgtgtgaaytattcccaagacacaagaagctag

SEQ ID NO: 20307 - DNA, 50 bp, homo sapien
tttgagtgaaactaattcactagtcrcaaaggtaattggttttcctgtcc

SEQ ID NO: 20308 - DNA, 50 bp, homo sapien
agtaagcttaatgtattttaactgarcttagtgatttgagggagaatgca

SEQ ID NO: 20309 - DNA, 50 bp, homo sapien
gtacatagctaaagtcatgtagtacraaaagatgaaaagcctaagtatca

SEQ ID NO: 20310 - DNA, 50 bp, homo sapien
gcaaacaaaacaatttaaaagcccargtaggactgagaaagattttccta

SEQ ID NO: 20311 - DNA, 50 bp, homo sapien
cataaacaactcttatttatgctcgyaacacggatgctcaattacaaaac

SEQ ID NO: 20312 - DNA, 50 bp, homo sapien
acatcatttaagatcaaggcaacaamtcattctatgtaacagaaccatta

SEQ ID NO: 20313 - DNA, 50 bp, homo sapien
ttcatctcagtcttctaggacctccratgttctgacatgacctgaacctc

SEQ ID NO: 20314 - DNA, 50 bp, homo sapien
tgggttccacattcctgtgaggttcragtaacagatgcctggctgttctc

SEQ ID NO: 20315 - DNA, 50 bp, homo sapien
atatgttatgcaaatatctgaaggaraggtgtgaccaagggaatgttaag

SEQ ID NO: 20316 - DNA, 50 bp, homo sapien
ttcaaaaaaagagagaacttgacccrgataggtggttctcagtgtttaga

SEQ ID NO: 20317 - DNA, 50 bp, homo sapien
aagcttggatggatttgaagaactgyactttatacttctagtttctgtga

SEQ ID NO: 20318 - DNA, 50 bp, homo sapien
aattgctgctctctgcttctttatcrcatacctaactttggattcaagct

SEQ ID NO: 20319 - DNA, 50 bp, homo sapien
aatgactgatcaaagtcagggtatamatatctcagtttcctcacactgtg

SEQ ID NO: 20320 - DNA, 50 bp, homo sapien
tacccttgttcaacttcgcttttcaytctccatgagttccatatttcctg

SEQ ID NO: 20321 - DNA, 50 bp, homo sapien
aatatcctattctgaatctaagaaaygcaatactgttgcaatatgacatt

SEQ ID NO: 20322 - DNA, 50 bp, homo sapien
ttattcagcttggtttctacgatgayctgattcacagcttttattattgc

SEQ ID NO: 20323 - DNA, 50 bp, homo sapien
gtggttggttcggttactaaggagcraggagagaatggacattggaatac

SEQ ID NO: 20324 - DNA, 50 bp, homo sapien
atagcaaaatctaatcttaactaacrcaaagggactaattggatgtccta

SEQ ID NO: 20325 - DNA, 50 bp, homo sapien
gctgcctataccaggctcaatcctayactgctctgttcctcctgaaaaaa

SEQ ID NO: 20326 - DNA, 50 bp, homo sapien
ttctcagggagaggagagagagggcraaaggtgatcctctggccttcctt

SEQ ID NO: 20327 - DNA, 50 bp, homo sapien
tttttaaagtctattttaaagtctcragtgaagtagtttggagcaactgg

SEQ ID NO: 20328 - DNA, 50 bp, homo sapien
gagaaataaacatctaatctgacatyatcactgtgtcccaatcaactgaa

SEQ ID NO: 20329 - DNA, 50 bp, homo sapien
ctcagtttatcaaaatagagacttgsattcaagggaataaaataaaaggt

SEQ ID NO: 20330 - DNA, 50 bp, homo sapien
cttgtacatttggcaaaataatttayaactattaagagcccacagaaagg

SEQ ID NO: 20331 - DNA, 50 bp, homo sapien
gcccccaaagttcatgtattgaaaayttgatcctctattcagtggtattg

SEQ ID NO: 20332 - DNA, 50 bp, homo sapien
tctgttaatgaaatctgactctaagrctacactccctattgagagactac

SEQ ID NO: 20333 - DNA, 50 bp, homo sapien
taaataataacagtcacaaagctggraaaacgtgtcttttgagaagtgta

SEQ ID NO: 20334 - DNA, 50 bp, homo sapien
tcagagatttcaaagcctgttttcaygctattgcatatttcaattttgag

SEQ ID NO: 20335 - DNA, 50 bp, homo sapien
ggacaaagggctttacaaatgtaatyagggtaaggattttgagatgagga

SEQ ID NO: 20336 - DNA, 50 bp, homo sapien
gggagaaggctgcctaactgcctaamagtgcatacaactttttttttttt

SEQ ID NO: 20337 - DNA, 50 bp, homo sapien
cttggtgaatgttccatgtgtgctasaaaaaaatgtgtgttctaatgtta

SEQ ID NO: 20338 - DNA, 50 bp, homo sapien
tctcttacaggaatgaatgtgatacrccaaaagcaggagacccttgagaa

SEQ ID NO: 20339 - DNA, 50 bp, homo sapien
ccattgaagtagagcattaaaaatayagagttcttctgaagatacctaca

SEQ ID NO: 20340 - DNA, 50 bp, homo sapien
atagcaaggctgcaaaggaaaggtarctggtgcaaatggttgcacgggaa

SEQ ID NO: 20341 - DNA, 50 bp, homo sapien
attttggctcttttttggttccatayaaactatagaattcctttattcta

SEQ ID NO: 20342 - DNA, 50 bp, homo sapien
ggcaagagctattcaaagactaagaycattattttacccataatctgaca

SEQ ID NO: 20343 - DNA, 50 bp, homo sapien
atatgaacacaacaatgttatgcacsattaaaatccaagagtatgttaaa

SEQ ID NO: 20344 - DNA, 50 bp, homo sapien
gttatgaaatccctttgcaacaacamcttatctatctcaaccagcaattc

SEQ ID NO: 20345 - DNA, 50 bp, homo sapien
cctaaaattgttggagagtgctattmaaaatgattataaaaatatgtgtg

SEQ ID NO: 20346 - DNA, 50 bp, homo sapien
ataaggtaggtaagtattccagccaycttacttacataattgctaccttc

SEQ ID NO: 20347 - DNA, 50 bp, homo sapien
acacacaagtaaaaagcatcaacacrgtgttatttttacataagctcagt

SEQ ID NO: 20348 - DNA, 50 bp, homo sapien
ttgccttagtttaacatcttatatcrgaattgaatgaggttaattgaggt

SEQ ID NO: 20349 - DNA, 50 bp, homo sapien
cacatttccttcaattcagcactcartccattttaaacactcatgctcta

SEQ ID NO: 20350 - DNA, 50 bp, homo sapien
gccgctcaatgttgcctagagcacaktaagtgtgacattttcttaattta

SEQ ID NO: 20351 - DNA, 50 bp, homo sapien
ctagtcacttgcaggattttaaaagwatgagactctcaagaattagtata

SEQ ID NO: 20352 - DNA, 50 bp, homo sapien
agttttttcctagtgtagaaaataayagtcctgtcttccaagtgggtgag

SEQ ID NO: 20353 - DNA, 50 bp, homo sapien
aacaaaatgacataatgtccttaaaytgacgtaccttccataatcaattt

SEQ ID NO: 20354 - DNA, 50 bp, homo sapien
tataaaaaagcatagaaaggaaatamctatccgagatgaaagaacattca

SEQ ID NO: 20355 - DNA, 50 bp, homo sapien
tcttctctaaaagaggttgaactcasaaaaacaaaatctaccaatcaatg

SEQ ID NO: 20356 - DNA, 50 bp, homo sapien
agcaggggagccgttagggtatgacyggagccatgacacttttctagatg

SEQ ID NO: 20357 - DNA, 50 bp, homo sapien
ttctagtatttataggatgttagaaraccaaagtcaagttaacaatgagg

SEQ ID NO: 20358 - DNA, 50 bp, homo sapien
tgtattttaccaaaaggcagaacagycactttattcctttgaatagattt

SEQ ID NO: 20359 - DNA, 50 bp, homo sapien
aatgtgaattactgactagaccatamatttttaatgttatggactttgtc

SEQ ID NO: 20360 - DNA, 50 bp, homo sapien
ggaaatacaatggaatctaaaggaaytgtaaagtcattaaaaccctggta

SEQ ID NO: 20361 - DNA, 50 bp, homo sapien
ctggttaacaaaatgaataaagatcractttcatgagatttatattcttg

SEQ ID NO: 20362 - DNA, 50 bp, homo sapien
actggttctgaaacatgcttcaaaarctcagttattccagggtattgttt

SEQ ID NO: 20363 - DNA, 50 bp, homo sapien
cattcaagaggaaacagagaatttcratgacaaatactacgaatctcaag

SEQ ID NO: 20364 - DNA, 50 bp, homo sapien
gacaaagctgtattctgtgcactgayatgaaagaatttaccaaataatta

SEQ ID NO: 20365 - DNA, 50 bp, homo sapien
aggtaagaaagctgcaagaatgcgaycatgtttaaccaaccgagattttt

SEQ ID NO: 20366 - DNA, 50 bp, homo sapien
atacaatgatgtattttagtaccaaycgcagaacctgacacattacaagt

SEQ ID NO: 20367 - DNA, 50 bp, homo sapien
aaagccatacctcaaaatggtcacasagtatattaacagacctaaattag

SEQ ID NO: 20368 - DNA, 50 bp, homo sapien
tgtacacatcaatcaaaggaagtaaytgaggatgaagtggagtagaggtt

SEQ ID NO: 20369 - DNA, 50 bp, homo sapien
attggttagctgagcgtttgcgttayctgaacatggtttgaacagttggc

SEQ ID NO: 20370 - DNA, 50 bp, homo sapien
aggcaagactcacctaactggaaaaygaggcagagattacaagaggatac

SEQ ID NO: 20371 - DNA, 50 bp, homo sapien
gtttgcaagaggttaagcactactarcaacaaaaaaggcaaacatcattg

SEQ ID NO: 20372 - DNA, 50 bp, homo sapien
cctcaaaccccttcttcccattcaayttcctcattactccttaaaagtga

SEQ ID NO: 20373 - DNA, 50 bp, homo sapien
tcagcataattcctcttttagaaaaygacacatactgttggggtatatcc

SEQ ID NO: 20374 - DNA, 50 bp, homo sapien
ttccatttaaggaaaaggaaacctaygagagagcaaatcatcccatgttt

SEQ ID NO: 20375 - DNA, 50 bp, homo sapien
gttccttctataaccaatttattgarggatttcatcatgaagtcatgttg

SEQ ID NO: 20376 - DNA, 50 bp, homo sapien
ctctgtgctatgttctcctcccggtyacagtttgcccatctcaaagttct

SEQ ID NO: 20377 - DNA, 50 bp, homo sapien
gctgtacaaaagttatgatccacgayggggttttcaaaacagatagggct

SEQ ID NO: 20378 - DNA, 50 bp, homo sapien
aaagggtaaggtgaccaatgaaataytaacgaaagaggaactccagtaga

SEQ ID NO: 20379 - DNA, 50 bp, homo sapien
ccaaaacacaaagtattctatttgakccaaaaggttacataaggaatggt

SEQ ID NO: 20380 - DNA, 50 bp, homo sapien
ttactggggatggatccacagttagmaaatgtccttgttggttcagaccc

SEQ ID NO: 20381 - DNA, 50 bp, homo sapien
gattctcctacagagctgggtatccrgatttgacctgtgtttgctcttct

SEQ ID NO: 20382 - DNA, 50 bp, homo sapien
tgcatgcttttacttattccacagawatgtattgagcatctgaaattgtt

SEQ ID NO: 20383 - DNA, 50 bp, homo sapien
agtctttggcttgcaagtttagatgsagactaggcactctggtttgagta

SEQ ID NO: 20384 - DNA, 50 bp, homo sapien
tgttaccaaaaacgtgacatcccgaygaaactggaggcgccacacagcag

SEQ ID NO: 20385 - DNA, 50 bp, homo sapien
accatagatgtggatgccagaggaaycataaaacatcacagaaggctggg

SEQ ID NO: 20386 - DNA, 50 bp, homo sapien
actttctagatccctgtgtttacacmaaaataaagtgttgacactcacag

SEQ ID NO: 20387 - DNA, 50 bp, homo sapien
tccactttggacgttgagcttagaastgagagtacgccaatgcccacatt

SEQ ID NO: 20388 - DNA, 50 bp, homo sapien
gaattataactaaagacaagaaacamgattaatgccacaaattgggctca

SEQ ID NO: 20389 - DNA, 50 bp, homo sapien
gactcaagttgctctagagtcttaamcctgaaaatgctgaaagttgactt

SEQ ID NO: 20390 - DNA, 50 bp, homo sapien
agagtagaaaaggagatgttcaagasaatgtgggttaataatacttaggg

SEQ ID NO: 20391 - DNA, 50 bp, homo sapien
tagcttgaagcataagatttggctcrccacagggtactttctgagtattc

SEQ ID NO: 20392 - DNA, 50 bp, homo sapien
agtcttaatatattttttttaatatsagtctcagttaaattcttcactaa

SEQ ID NO: 20393 - DNA, 50 bp, homo sapien
ctccatcctccctcctacttggctcyaaaccctaagtattattaacccac

SEQ ID NO: 20394 - DNA, 50 bp, homo sapien
tggcaacatgctctttccttcctcartaggatggcaacttgaagtcacat

SEQ ID NO: 20395 - DNA, 50 bp, homo sapien
tagttagtcactagacaacccagtgyatcttaaactcccacttctggaga

SEQ ID NO: 20396 - DNA, 32 bp, homo sapien
ggagaagaaatacatgraaacctagttctaat

SEQ ID NO: 20397 - DNA, 50 bp, homo sapien
attgcttacttgaccaagcagtgaartgaattaattaagtggggtaggaa

SEQ ID NO: 20398 - DNA, 50 bp, homo sapien
ttgtaaggtctcaatctgagagaacrcttttattttatatttgataatca

SEQ ID NO: 20399 - DNA, 50 bp, homo sapien
atgaaggatacctttagaagaaatargtagtctttggtttgccacaattc

SEQ ID NO: 20400 - DNA, 50 bp, homo sapien
taccaaaaagcttctgtttaactgawcttctctcatgatgatttactatt

SEQ ID NO: 20401 - DNA, 50 bp, homo sapien
tcatccttttccgtagagttagaatsaaatgcaatcagctggctggatat

SEQ ID NO: 20402 - DNA, 50 bp, homo sapien
gaatagtccctgaggcttcagtaaaygcttcatgagttcagaaaaaatga

SEQ ID NO: 20403 - DNA, 50 bp, homo sapien
agcatataaaaatagattaacagacrcataaaaatacaatgcataggtaa

SEQ ID NO: 20404 - DNA, 50 bp, homo sapien
ctgtttattttatgctgtagccatayctttcaaaactcctcatccttccc

SEQ ID NO: 20405 - DNA, 50 bp, homo sapien
ttccttccagacagcagcgagatgargagacaccagtggacttcttctac

SEQ ID NO: 20406 - DNA, 50 bp, homo sapien
aatttactctggattcctcagatcartagatgaatggttttgttgttgtt

SEQ ID NO: 20407 - DNA, 50 bp, homo sapien
tttaggaatgtgctttcacctaataycataacagtgagactccttggata

SEQ ID NO: 20408 - DNA, 50 bp, homo sapien
ttcagagcttggtcataaaagcataygtttctctaaagcaaagggtgata

SEQ ID NO: 20409 - DNA, 50 bp, homo sapien
taatgaaatttgatgttgcctttacsagaataagcctctcatgtggaaaa

SEQ ID NO: 20410 - DNA, 50 bp, homo sapien
tcagaagctggtactgtcttaaaggsacactggcactcctaaaatccttc

SEQ ID NO: 20411 - DNA, 50 bp, homo sapien
ggtcctggttttatattctaaaagaytattaggttattagagttccaacc

SEQ ID NO: 20412 - DNA, 50 bp, homo sapien
aatttgaagcttttttgaataaggawgacacaacttaaagtccgcggttg

SEQ ID NO: 20413 - DNA, 50 bp, homo sapien
tcaagcttttcttcatggttataaamgaatattgtgatgagtgatttatc

SEQ ID NO: 20414 - DNA, 50 bp, homo sapien
tgtcagagaacgtggtttttatgcartcattgatggaaagctcatgacgc

SEQ ID NO: 20415 - DNA, 50 bp, homo sapien
ggatttgaatctggtcaccactaacrattatatatgtaaccttgtgcaac

SEQ ID NO: 20416 - DNA, 50 bp, homo sapien
tgctctggtaaatggtgacatctacrcaggttatgagaaactgggctctc

SEQ ID NO: 20417 - DNA, 50 bp, homo sapien
actagactatatggttctatgggaaygtactgaacattggctgacacatg

SEQ ID NO: 20418 - DNA, 50 bp, homo sapien
ctgagtttccagcaccttttgttcaytacgttcttaacaaccacatgctg

SEQ ID NO: 20419 - DNA, 50 bp, homo sapien
acactgaatactgagggctaatatgwcaagaactgtattttttagcttaa

SEQ ID NO: 20420 - DNA, 50 bp, homo sapien
tcagtagagagagactgaattgtaaytgaagagaccaattcatcggaagt

SEQ ID NO: 20421 - DNA, 50 bp, homo sapien
tttggcaatttttcgtaaggttgaaygtttatctattctatgactcagca

SEQ ID NO: 20422 - DNA, 50 bp, homo sapien
tcagccatcatgatatattacttaargaatacgaacattttagtataaaa

SEQ ID NO: 20423 - DNA, 50 bp, homo sapien
cataggactgaagtctgcgaaaataytacatgtcttttttatttgcttgg

SEQ ID NO: 20424 - DNA, 32 bp, homo sapien
tataccacctagctaaktaatgactagaatat

SEQ ID NO: 20425 - DNA, 50 bp, homo sapien
cgtgattcccaatccttgtcctttgyaaatattctagtcattaattagct

SEQ ID NO: 20426 - DNA, 50 bp, homo sapien
tcgtcctgcgtcctgactctgagcarggttgtacctcatgcaaaagttgt

SEQ ID NO: 20427 - DNA, 50 bp, homo sapien
gccaaagaaatctctatagtccaggragtcctagcatgcctggttggttg

SEQ ID NO: 20428 - DNA, 50 bp, homo sapien
tgtacaagtctccgatgaggtcataygccgtaagtctgttccatgggctc

SEQ ID NO: 20429 - DNA, 50 bp, homo sapien
gtttaagtaacttgcctatgatcacsagtgtagcccagcttcagaatgca

SEQ ID NO: 20430 - DNA, 50 bp, homo sapien
aatatttattgatctaagttccaggmattttaattgtacatagattttat

SEQ ID NO: 20431 - DNA, 50 bp, homo sapien
cagtgcagcgccatctttatgactgraccagttgaggtacctcctgggta

SEQ ID NO: 20432 - DNA, 50 bp, homo sapien
aggtcacctgatagtagatgaggtayataatttacgagattgttttcctt

SEQ ID NO: 20433 - DNA, 50 bp, homo sapien
gctgtctaaaagtacaaaaaagtgaratcagaaggtatgggtgtcaactc

SEQ ID NO: 20434 - DNA, 50 bp, homo sapien
ttaattttagaatcaggatgctaaamaaattagaagtctgaaaaccactg

SEQ ID NO: 20435 - DNA, 50 bp, homo sapien
ccccagcagaaacattaacttgaaaygactatctacactcaaaaatacct

SEQ ID NO: 20436 - DNA, 50 bp, homo sapien
tgaggataatggccctgttatgaaamggagagaaagaaggtctttgtggt

SEQ ID NO: 20437 - DNA, 50 bp, homo sapien
ggagtttgttttcccactctctgcargaaagttaatcaattttagaacca

SEQ ID NO: 20438 - DNA, 50 bp, homo sapien
atatgaataattgaaaactgaactcsaacagtagcagaggaaatcaacaa

SEQ ID NO: 20439 - DNA, 50 bp, homo sapien
ggcactgcagcttctaaaggaagaayacttgagaatgtgtaagatcagaa

SEQ ID NO: 20440 - DNA, 50 bp, homo sapien
atttggaatatcttaattctttcaamtggaggaagatgaactcatgtcac

SEQ ID NO: 20441 - DNA, 50 bp, homo sapien
ggtgcctgcttttcttaatctcccaygtttagtgaaatacttaaaaatgc

SEQ ID NO: 20442 - DNA, 50 bp, homo sapien
ctgaaaagattaccttccactaaagycttgatttcaaactacttcattag

SEQ ID NO: 20443 - DNA, 50 bp, homo sapien
gaaaagccactaattaaatttggaaktgataggcatttgctgatgtcaag

SEQ ID NO: 20444 - DNA, 50 bp, homo sapien
caactgaagttacaaaagattgccaytcctgaaagagaagaaaaagcaaa

SEQ ID NO: 20445 - DNA, 50 bp, homo sapien
attcaccaccataaaaacacatttargtataaaactcacaggtcttacaa

SEQ ID NO: 20446 - DNA, 50 bp, homo sapien
gaagcttgtcctctgactaggtttckaatttctatgtggaatttcctatc

SEQ ID NO: 20447 - DNA, 50 bp, homo sapien
tcacagatgtgtgtcatttggcccaygaagtatccaaaacattttgaatt

SEQ ID NO: 20448 - DNA, 50 bp, homo sapien
gggtggatggaatattgagactatcrctttctgatactttcagtgactgt

SEQ ID NO: 20449 - DNA, 50 bp, homo sapien
aactctggcaggcctgaagggtaagyacgctagagtaggccgcagaatat

SEQ ID NO: 20450 - DNA, 50 bp, homo sapien
gtttctcatttacatcttattgtgaragtatggaaataaaacataaatgt

SEQ ID NO: 20451 - DNA, 50 bp, homo sapien
acagtcactcataaaagagttcctgraatttagcatataaaatcctactt

SEQ ID NO: 20452 - DNA, 50 bp, homo sapien
aggacgttatgtacaagtaactgaakagtagtaggcaacaaagtgggaaa

SEQ ID NO: 20453 - DNA, 50 bp, homo sapien
tatggataacctgtcctctctttaamtgctccaaatatgcttatcatttt

SEQ ID NO: 20454 - DNA, 50 bp, homo sapien
atataatggagaaattggcaggaccrctattattactctcgatttttcta

SEQ ID NO: 20455 - DNA, 50 bp, homo sapien
cattggtctttacatatactcagtgraagaacgagtttattaataatatc

SEQ ID NO: 20456 - DNA, 50 bp, homo sapien
taattaaggagtaaatatctacacaratgaggctggaatatgaaatgttt

SEQ ID NO: 20457 - DNA, 50 bp, homo sapien
taaatgataaagaagggatttgaccrgaggaataaaatgttaacatgtgc

SEQ ID NO: 20458 - DNA, 50 bp, homo sapien
gtttctttagtgttgatacccaaaartgaatgcagtcctctaatttatac

SEQ ID NO: 20459 - DNA, 50 bp, homo sapien
aaatgggccaaagtgagaattttaayggatgtacaaggcacaggtcaaaa

SEQ ID NO: 20460 - DNA, 50 bp, homo sapien
ccactgccaccaccatcaccaacaawgaaagaattctccagacaaaaatg

SEQ ID NO: 20461 - DNA, 50 bp, homo sapien
taaaactctgaaataaggcaaccacrataacattaaaactcaaacttagc

SEQ ID NO: 20462 - DNA, 50 bp, homo sapien
taattgtaacacaataggcatagaayggtagaacataatagtatatattg

SEQ ID NO: 20463 - DNA, 50 bp, homo sapien
tatcaataaaccaactcttccaatayggtgatgtgatgataatttaggtc

SEQ ID NO: 20464 - DNA, 50 bp, homo sapien
atagacaaatggaaaacagcacttcrctatgttacaagggttggcatggt

SEQ ID NO: 20465 - DNA, 50 bp, homo sapien
atttccccctttctggaagctctaasgatagcattctacaatttcatgct

SEQ ID NO: 20466 - DNA, 50 bp, homo sapien
tacaagtacatatcatattatgtgamccagagacctatctaaatgtatag

SEQ ID NO: 20467 - DNA, 50 bp, homo sapien
aacatgagggaaatggacaagtgaamcttcttaaggactcatggtaattt

SEQ ID NO: 20468 - DNA, 50 bp, homo sapien
atattttttggactcacacagcttaygatgattttatccaaagttcatgc

SEQ ID NO: 20469 - DNA, 50 bp, homo sapien
tctacattatcatcaataattaaccragagaaaatgcttctatttatatt

SEQ ID NO: 20470 - DNA, 50 bp, homo sapien
atgaatggatgaataagtgaatgaaragttatcttagaatccatttcagg

SEQ ID NO: 20471 - DNA, 50 bp, homo sapien
cgttataaatgtgaccttaatttccraaccaaaaatgaagacaaatggtc

SEQ ID NO: 20472 - DNA, 50 bp, homo sapien
cacaagggatgagaataaaaacagcygccatttactaactgctggagatc

SEQ ID NO: 20473 - DNA, 50 bp, homo sapien
ctaagagcagaattctgttttgctayggtactcattccaacctatgaagg

SEQ ID NO: 20474 - DNA, 50 bp, homo sapien
tgggtaatatctggtataataaagayaatgtcccccactaaagtaaaagg

SEQ ID NO: 20475 - DNA, 50 bp, homo sapien
cgtgcacttaccatgtgccaggctaragtctctattttaagcttgttaca

SEQ ID NO: 20476 - DNA, 50 bp, homo sapien
tcttcgtttttgtctaaaagaaataraactcctatgaatattcctgtaca

SEQ ID NO: 20477 - DNA, 50 bp, homo sapien
tatggatcacatgggtgtatcactaygtcaaagctcattgaacttaagat

SEQ ID NO: 20478 - DNA, 50 bp, homo sapien
catggaaaagaaaatcccagtgcaaktatatttacaaacacaggtgtggg

SEQ ID NO: 20479 - DNA, 50 bp, homo sapien
actttagatccataaattaatttcaygtaaaaagatgctattatcaagcc

SEQ ID NO: 20480 - DNA, 50 bp, homo sapien
agtctgtacttctccttttatcttckgaactgtgatgaaaagaacagtcc

SEQ ID NO: 20481 - DNA, 50 bp, homo sapien
cctcagttttcttctctgcaaaatgragtaacaaaactcatgttgcaaag

SEQ ID NO: 20482 - DNA, 32 bp, homo sapien
actccaggacaaggaakttaagaactggggct

SEQ ID NO: 20483 - DNA, 50 bp, homo sapien
aaatgaaagctggaactgaattctcrattcgggaaacataatctagtaaa

SEQ ID NO: 20484 - DNA, 50 bp, homo sapien
ctagccaccttatacaactaaattasaagtacaattaaagtcaatttcac

SEQ ID NO: 20485 - DNA, 50 bp, homo sapien
tgaggtaagtatctaattatttcccrggctgctgaacatcaatgaataga

SEQ ID NO: 20486 - DNA, 50 bp, homo sapien
tttgcaagtataactgtttctgtaamtgtctgcacaatgaatcatgtttc

SEQ ID NO: 20487 - DNA, 50 bp, homo sapien
gatttagtgtctgtggtcaaaagaasttcatgtcattcaacaccaggcca

SEQ ID NO: 20488 - DNA, 50 bp, homo sapien
tttacggtgctgtaataaggaagcawtcactagcttttcaagaggaaaaa

SEQ ID NO: 20489 - DNA, 50 bp, homo sapien
acatctttcttaggcaagtgttctcrgacatgcaagaaagaccaaatttg

SEQ ID NO: 20490 - DNA, 50 bp, homo sapien
ctactccacaccaggcatgagcaaaratgttctctgacactgcagaaaaa

SEQ ID NO: 20491 - DNA, 50 bp, homo sapien
catatgtctccttttccgtaatcaayaaatctcggtttaagttccatcca

SEQ ID NO: 20492 - DNA, 50 bp, homo sapien
gtatttttgcatgtatgttggtaaarcctaagtcaaaactcagttatata

SEQ ID NO: 20493 - DNA, 50 bp, homo sapien
tgagatgatagcataagctgcttaawatttccaggtttaaagaaaaatca

SEQ ID NO: 20494 - DNA, 50 bp, homo sapien
agtaccatagtttaaaaacggttccyaagagtataatctcccattcagta

SEQ ID NO: 20495 - DNA, 50 bp, homo sapien
atgcctggcacgtagtgagctatatmaacacttagaaatgagtaatagtt

SEQ ID NO: 20496 - DNA, 50 bp, homo sapien
ggccagagtaatcaaattcaatagastaataactatggcagagtcaaggt

SEQ ID NO: 20497 - DNA, 50 bp, homo sapien
agaactttaacatgaaagaaacttaraatatcatgtacagttaaaaaaag

SEQ ID NO: 20498 - DNA, 50 bp, homo sapien
tgctcatatttgcttcaaatcatackgcatgttcttctttagcaaaagtc

SEQ ID NO: 20499 - DNA, 50 bp, homo sapien
tgttcggcttcaaaacagtctgaacrcaagagaataagttatttgtgacc

SEQ ID NO: 20500 - DNA, 50 bp, homo sapien
tcctgttttgttaaagtaacatccaygataaaatacaaatttcaagacat

SEQ ID NO: 20501 - DNA, 50 bp, homo sapien
caggagtcagtttcttaatatacagsctaagacagtaaaataatatgcca

SEQ ID NO: 20502 - DNA, 50 bp, homo sapien
gattcatatacttagtgttgccttaygacatatttcctggaaaactttta

SEQ ID NO: 20503 - DNA, 50 bp, homo sapien
atgtgattaattgcatggaaccagawtagaattaaggaaattaaaattca

SEQ ID NO: 20504 - DNA, 50 bp, homo sapien
atgtaggttcagaaaaacaagccacsaacaatcacacaaattctctcatc

SEQ ID NO: 20505 - DNA, 50 bp, homo sapien
acagggtacaaatcttatatacacarcttcaagaaatagagggttgctct

SEQ ID NO: 20506 - DNA, 50 bp, homo sapien
ggttttaaatccgttcaattaatcartgacgactggctttggtgaacaca

SEQ ID NO: 20507 - DNA, 50 bp, homo sapien
tgacacctcttggttgattacgaaartgtgttcaccaaagccagtcgtca

SEQ ID NO: 20508 - DNA, 50 bp, homo sapien
ttgaccttggagcatctgctgacgaygtatgttggggatggtcttcttgt

SEQ ID NO: 20509 - DNA, 50 bp, homo sapien
ggaccctttcagctatatagtttccrcctaaggtatgaagaaatgagatg

SEQ ID NO: 20510 - DNA, 50 bp, homo sapien
aaattcttagggtgggtcctaggcakccttattttatttatttatttact

SEQ ID NO: 20511 - DNA, 50 bp, homo sapien
cacaatacccagcgcctagttagaaytcaaagttaactattgttaaatgg

SEQ ID NO: 20512 - DNA, 50 bp, homo sapien
gtttggtttctgtcaacttcaccctsaattttggtgtcctaaacagccta

SEQ ID NO: 20513 - DNA, 50 bp, homo sapien
tcctcctgttcaaactcctttcttcrctgcgttactactgtttggtttct

SEQ ID NO: 20514 - DNA, 50 bp, homo sapien
tgtcctgtttctggtacatggtaaakgataaaaaatatttgataaagttt

SEQ ID NO: 20515 - DNA, 50 bp, homo sapien
ggatgattaatcataaaattcacaayggaggacactctgtgggtaaggaa

SEQ ID NO: 20516 - DNA, 50 bp, homo sapien
gcagccacctctaacctaagcattgycaacattataattgtaagtcgtct

SEQ ID NO: 20517 - DNA, 50 bp, homo sapien
ggcagtgagtctttttgagcatggaragcgaagaagagaaagaagaggct

SEQ ID NO: 20518 - DNA, 50 bp, homo sapien
caatataatttaacctaaattttatsacagtgtttcttgctgagggagaa

SEQ ID NO: 20519 - DNA, 50 bp, homo sapien
tcctgagctggagttctacgaatcayggtctggagatgaaaactgggaag

SEQ ID NO: 20520 - DNA, 50 bp, homo sapien
tgcagatgtatgttctagataacacrgtaaaggcaggcattgggaatgga

SEQ ID NO: 20521 - DNA, 50 bp, homo sapien
gaagtctgtctgttagccaatatatkaaaggttgattgatttaattataa

SEQ ID NO: 20522 - DNA, 50 bp, homo sapien
aattagaaatttgagaaattgtaaargttgaaagaacttgaactgctaac

SEQ ID NO: 20523 - DNA, 50 bp, homo sapien
cagaggggtatcctggttttatcaaygtggagattttgctgtaatttgtt

SEQ ID NO: 20524 - DNA, 50 bp, homo sapien
acttgggtaatttttctaattccaaytccttgtttctaacagctttgttg

SEQ ID NO: 20525 - DNA, 50 bp, homo sapien
ataatgctgtgtaacaaactatacgraaatataacagctcaacataatca

SEQ ID NO: 20526 - DNA, 50 bp, homo sapien
tgcatgtgtatatgtaaaaatattaygtatcagtcaggttaagttgcatt

SEQ ID NO: 20527 - DNA, 50 bp, homo sapien
agtcagattgcaaaggagtgaataasggcaacgaaatcaggaggcgaagg

SEQ ID NO: 20528 - DNA, 50 bp, homo sapien
aagtgcacatgaaacacaggcactamtaatacaggttacattaataattc

SEQ ID NO: 20529 - DNA, 50 bp, homo sapien
tttaagaaaatgtttgggaatcaatragcaagatcattttgttcaggttt

SEQ ID NO: 20530 - DNA, 50 bp, homo sapien
tttagtataaagtgtaacagtgtcaragacttagaaaaatattacagaag

SEQ ID NO: 20531 - DNA, 50 bp, homo sapien
tgagaaaggaacagttgttcgcagawgtcctggtacctgcatcaactaac

SEQ ID NO: 20532 - DNA, 50 bp, homo sapien
ctgcatcaactaaccttggaacacaytgggatcacaaaacaataagaaag

SEQ ID NO: 20533 - DNA, 50 bp, homo sapien
gtttattctcaaaattacataaaacrgaaaggcacatacttaaacaagtc

SEQ ID NO: 20534 - DNA, 50 bp, homo sapien
cattgatgcataagaaatattgtaayggtttcatgacacacatgtctaaa

SEQ ID NO: 20535 - DNA, 50 bp, homo sapien
tgagcatagatggacaattacctcayggttcctacatacaacacttacat

SEQ ID NO: 20536 - DNA, 50 bp, homo sapien
gggcagcgtaaggtatttaccaaacrctagaggccagttctcactccatc

SEQ ID NO: 20537 - DNA, 50 bp, homo sapien
tcatcaaattataccaatgactcagyattatgaatgacctcaacaatctg

SEQ ID NO: 20538 - DNA, 50 bp, homo sapien
cacaagtttgggagatttctggacarcaaaagggacaggccatgcttcat

SEQ ID NO: 20539 - DNA, 50 bp, homo sapien
gaaactattcaggatttccaagtaaygaagaatcaagctaggtaagtcct

SEQ ID NO: 20540 - DNA, 50 bp, homo sapien
aaaggtcaagagcctcttatttttayggaatgcacctctcttgcttttta

SEQ ID NO: 20541 - DNA, 50 bp, homo sapien
ttctaagcttttaacttacatatgasataaatggaagaaatatatatagt

SEQ ID NO: 20542 - DNA, 50 bp, homo sapien
agttatatcctccttcttcaaaactsaggtccaatcttacctctcagcaa

SEQ ID NO: 20543 - DNA, 50 bp, homo sapien
taatagcaaaagagaagtcaaacgaytataaatttcaggaggattctatt

SEQ ID NO: 20544 - DNA, 50 bp, homo sapien
atttgttcatggagtgtatagtaaarccttagccatcacttttagactga

SEQ ID NO: 20545 - DNA, 50 bp, homo sapien
acctttctctgtctcctgctttctarattgatggaaaggcccttaatttg

SEQ ID NO: 20546 - DNA, 50 bp, homo sapien
aggaaaatgttgcagaacttttcacmggagtaaaatatagttgcaccaca

SEQ ID NO: 20547 - DNA, 50 bp, homo sapien
attctctttacagttgcataatggayaagtttaggataagtcagcatcat

SEQ ID NO: 20548 - DNA, 50 bp, homo sapien
gagtccaacttgttaaagatgagtaygttcaagaaggaaattgtatcact

SEQ ID NO: 20549 - DNA, 50 bp, homo sapien
ttggggtttgcttttgacattcctcraataatgggatgtatacagttatg

SEQ ID NO: 20550 - DNA, 50 bp, homo sapien
ctagtgggcaacagaacaatattggratggtggtaatgcgatgtaatggc

SEQ ID NO: 20551 - DNA, 50 bp, homo sapien
ccatgctctaaaccaactgagttgayggggatatttcaaagaaataggaa

SEQ ID NO: 20552 - DNA, 50 bp, homo sapien
gtacataaaatatgcttcctaccacyaagaatataaattaatgtttcaca

SEQ ID NO: 20553 - DNA, 50 bp, homo sapien
tgtgtgggaagggacagggtatgagwcagaagcatcaactcacacaggag

SEQ ID NO: 20554 - DNA, 50 bp, homo sapien
aagaacggatttcctggaatacagckatataattttggttgtcaaattcc

SEQ ID NO: 20555 - DNA, 50 bp, homo sapien
ggcctcttaaaattgccttgacttaygcagtctaaagactactcacttgc

SEQ ID NO: 20556 - DNA, 50 bp, homo sapien
atgtgagaattgaaatcaagacacastatgttacagatggaagacttcaa

SEQ ID NO: 20557 - DNA, 50 bp, homo sapien
gtaccttatctccactttctggaaaygacccctgaccctcatagtggagg

SEQ ID NO: 20558 - DNA, 50 bp, homo sapien
cactactccgacaataagatattgtsaagcgatctgtaaaacagaagaaa

SEQ ID NO: 20559 - DNA, 50 bp, homo sapien
tcttctattcatcaaaactcaaacgraatggctgggcttttcattacgtt

SEQ ID NO: 20560 - DNA, 50 bp, homo sapien
gatttttctatgcagcatatactgckgaaaattaagtcaaaatatttatg

SEQ ID NO: 20561 - DNA, 50 bp, homo sapien
aaaataacttcaggatggagagtcaraataacccagatgaggtttacagc

SEQ ID NO: 20562 - DNA, 50 bp, homo sapien
gagagaaagtgttgctactaaattargagtaaagactgtgtgaactgttt

SEQ ID NO: 20563 - DNA, 50 bp, homo sapien
cttctaaaaaaactaagatgacttcsatgcatagatgatgttgatgaaca

SEQ ID NO: 20564 - DNA, 50 bp, homo sapien
atttcagttgcaaattgaaataaaayggaaacagttcacacagtctttac

SEQ ID NO: 20565 - DNA, 50 bp, homo sapien
atgttcaattaattaaaataatacaytgtaaagctcaacatcattcttgg

SEQ ID NO: 20566 - DNA, 50 bp, homo sapien
cattgcaaacacattctcaagcatgragatcagtaatgtgtagtaaatta

SEQ ID NO: 20567 - DNA, 50 bp, homo sapien
atatataatattaaaaatttagttayagtgattaaagtctgtatatgtgg

SEQ ID NO: 20568 - DNA, 50 bp, homo sapien
cattaaaattaatgactaatcaggargcaacgtaaccaaaagcacagtga

SEQ ID NO: 20569 - DNA, 50 bp, homo sapien
tttgaagttttctaggacgggagaaygttataaagcaaacaaataatctc

SEQ ID NO: 20570 - DNA, 50 bp, homo sapien
gtgaaaaacaacagaaagaacaagaygaaaagtagacaaaaagatctgta

SEQ ID NO: 20571 - DNA, 50 bp, homo sapien
gtgcctgtagcccctcagcacctaayaacaccacactgtaagcgcccagg

SEQ ID NO: 20572 - DNA, 50 bp, homo sapien
taacttttccagcacctagagtggargcaagtaaggaagaaagggattgg

SEQ ID NO: 20573 - DNA, 50 bp, homo sapien
ttcaaatttttcattctgttgattaygtgatctcagttacttaaaatctc

SEQ ID NO: 20574 - DNA, 50 bp, homo sapien
ctgaaaataattggtgtaaattaaasaataagcaatatacaggtgtattg

SEQ ID NO: 20575 - DNA, 50 bp, homo sapien
ttcactccttcttgaattttgttccrgaggaggagttagtttacgtgccc

SEQ ID NO: 20576 - DNA, 50 bp, homo sapien
attgttaataacaccattccaaaacyattctgtcatctttacattttgtt

SEQ ID NO: 20577 - DNA, 50 bp, homo sapien
ggtggctagtgactgatttggatgakgacattcccactgagctgggcata

SEQ ID NO: 20578 - DNA, 50 bp, homo sapien
gtcagcaaaataaacactggcccatragcccattgaaaaggagtaaagga

SEQ ID NO: 20579 - DNA, 50 bp, homo sapien
tgtctacaatcttcatcagcttgcayataatttttctgcaaaacaaaaat

SEQ ID NO: 20580 - DNA, 50 bp, homo sapien
agagatagatctgaatggtttccagkagcttctaagagcctgaacatgaa

SEQ ID NO: 20581 - DNA, 50 bp, homo sapien
aatgtaaaaggtactgctgatatatraggtactgcttacctaagcctgag

SEQ ID NO: 20582 - DNA, 50 bp, homo sapien
ctaacttttaaaacactctgtaaaayaggcatccaaattcccattctaca

SEQ ID NO: 20583 - DNA, 50 bp, homo sapien
aattagtaggtatacattaatagaawctcgtaaagaaccaatcatataac

SEQ ID NO: 20584 - DNA, 50 bp, homo sapien
actatgcatttaaacctgcatctaawtcaatggacatctgtgacagtcaa

SEQ ID NO: 20585 - DNA, 50 bp, homo sapien
aaaaaaaaaaagcctcactactctawgatcaagggctgtgaatttgttga

SEQ ID NO: 20586 - DNA, 50 bp, homo sapien
acatctcttagcatccagcgaaaatrataatgcttaaaaaaaaaagaaaa

SEQ ID NO: 20587 - DNA, 50 bp, homo sapien
actatcaaatttctcttgttgttagycctcattctgccagggttctgaac

SEQ ID NO: 20588 - DNA, 50 bp, homo sapien
ctaataagtgttggctttggttgaamactatattccctgcaaagcatgtg

SEQ ID NO: 20589 - DNA, 50 bp, homo sapien
ttctaagcttgctaatgattgtgaartgattacagttatgaaactttaat

SEQ ID NO: 20590 - DNA, 50 bp, homo sapien
gaaaaagcagtgattagagctgagaygttaacagattggataaaatgtac

SEQ ID NO: 20591 - DNA, 50 bp, homo sapien
agtcgtgacagtaagagaatggagayaggtgttactgaaactttaaatgg

SEQ ID NO: 20592 - DNA, 50 bp, homo sapien
ccaagctttcgaatgggtattgttawccctggctgctttaccctgttttg

SEQ ID NO: 20593 - DNA, 50 bp, homo sapien
taaagaacctgacaaataaatacaartgtgtaaaaatatgcttttacttc

SEQ ID NO: 20594 - DNA, 50 bp, homo sapien
tctaaacaaagtcatcaaaacagatrataccacatagacaattctaaaat

SEQ ID NO: 20595 - DNA, 50 bp, homo sapien
gctgtgaacaccttattacagatacmcagaaataactggaagaacccctg

SEQ ID NO: 20596 - DNA, 50 bp, homo sapien
aatcaataacactgttgcttagaaayggatatataaaatagacaccaaga

SEQ ID NO: 20597 - DNA, 50 bp, homo sapien
aatgttgtcagtttttctaataatamgtggtgtatcagatgcaatcttat

SEQ ID NO: 20598 - DNA, 50 bp, homo sapien
gaaagtgttaatgaaattaagactaygtgagattagagtatgcaaacgag

SEQ ID NO: 20599 - DNA, 50 bp, homo sapien
gaagcttcagccactgagaatgattkaaccacatcgagcctgtctttccc

SEQ ID NO: 20600 - DNA, 50 bp, homo sapien
atgtatgttcagttttattcaattaygttattgttcattagaagcataca

SEQ ID NO: 20601 - DNA, 50 bp, homo sapien
ctcctctgttggtaccctacatgtcratgccgagactgaggctcagagag

SEQ ID NO: 20602 - DNA, 50 bp, homo sapien
ataaatttggtttttaaagtgtacaratgatttacgtgtactgggtcaag

SEQ ID NO: 20603 - DNA, 50 bp, homo sapien
aggtagctagataggtaagtaggtcratagatacatagcataatgtatgt

SEQ ID NO: 20604 - DNA, 50 bp, homo sapien
ataaacttattcttctattgaaatgyatgttgcacacaataaaatttatc

SEQ ID NO: 20605 - DNA, 50 bp, homo sapien
aaatactttatattacaaatttaaartcaggactgcaaatctagaggtat

SEQ ID NO: 20606 - DNA, 50 bp, homo sapien
tacttacctatctagctacctgggaygcacttacctatctagctacctag

SEQ ID NO: 20607 - DNA, 50 bp, homo sapien
tgtactgaatttgccagtataaacartatgttcattttaccctgggttca

SEQ ID NO: 20608 - DNA, 50 bp, homo sapien
tgcacacaagatatttaggaaattayggccttggtattcccagtagaact

SEQ ID NO: 20609 - DNA, 50 bp, homo sapien
gcttaaaaacaatacctgatgagacrgatcatgctaaaagcctcaattta

SEQ ID NO: 20610 - DNA, 50 bp, homo sapien
aattaaaaaaactcttgcaatactcyagaaatttttttatatttgtttta

SEQ ID NO: 20611 - DNA, 50 bp, homo sapien
tgacaaatgtgcgtcctgtgcatgarctgcgaagattttccatgatcagc

SEQ ID NO: 20612 - DNA, 50 bp, homo sapien
aaaagaatgtatggttaatatatcartgaaaaagtaaattactgcatcat

SEQ ID NO: 20613 - DNA, 50 bp, homo sapien
attcacagtgcaatgacagcaatacscttctataactacagcttcagact

SEQ ID NO: 20614 - DNA, 50 bp, homo sapien
atggcagtagtgcctgctttgctagratacttggtaaactaatttaatga

SEQ ID NO: 20615 - DNA, 50 bp, homo sapien
agaaatgcccaacttgctataaccasagtggaattagtttgctttgaagg

SEQ ID NO: 20616 - DNA, 50 bp, homo sapien
aagcctaatctttcttatacctaaamtgaactcaagaattgcttctagac

SEQ ID NO: 20617 - DNA, 50 bp, homo sapien
cccgtgtggtttctttcgcaatgctmaacactggctttggcagcactcaa

SEQ ID NO: 20618 - DNA, 50 bp, homo sapien
atataactcctaaaaagaaatgtagwcactgagatcataattcacggctt

SEQ ID NO: 20619 - DNA, 50 bp, homo sapien
ttcataaatggtgtatattcaaagargaagtgaaagtccggcgttttgaa

SEQ ID NO: 20620 - DNA, 50 bp, homo sapien
ttggcaatatcattgctctgggtcasgttgcaaaatagtcaaagaaacac

SEQ ID NO: 20621 - DNA, 50 bp, homo sapien
cagtgcaactcaaccattttattgargcccatctaagaatcttgcacagg

SEQ ID NO: 20622 - DNA, 50 bp, homo sapien
tcaaggtaatattttccatgtgttaygtgctattatggtgattccagctg

SEQ ID NO: 20623 - DNA, 50 bp, homo sapien
tttgcagctgcactgagggagaaacmaaattaagacagatctagaatata

SEQ ID NO: 20624 - DNA, 50 bp, homo sapien
ctctagtgggatgaacaatatttagratcatttacaactttataccagtc

SEQ ID NO: 20625 - DNA, 50 bp, homo sapien
taatggaagctcagggaaacaattaratcctgttataagaaaataaaaat

SEQ ID NO: 20626 - DNA, 50 bp, homo sapien
ccatataaaaagtgaaattttacacrctcacaagaaacaatactttctca

SEQ ID NO: 20627 - DNA, 50 bp, homo sapien
attacttttaattagagctaataaasatatggatttacatgctggctgag

SEQ ID NO: 20628 - DNA, 50 bp, homo sapien
gttccctccagcccttttatgaaacrcgatcgcctcctgaaggccccatc

SEQ ID NO: 20629 - DNA, 50 bp, homo sapien
taaatattatatgtgtgcctaaataygtggtcagaggaattgcaacgctg

SEQ ID NO: 20630 - DNA, 50 bp, homo sapien
tcctggctctgccacttattaactakgagcctttaggtgagctccttacc

SEQ ID NO: 20631 - DNA, 50 bp, homo sapien
tctgttaacctccgccttaattttasaatttagaccacttacacttaatg

SEQ ID NO: 20632 - DNA, 50 bp, homo sapien
ggaatcatattttaagtctagagaaygcttagataatactagtttattcc

SEQ ID NO: 20633 - DNA, 50 bp, homo sapien
gccagtgatggttgtcacagatgaaycttggttatcactaggctcttgct

SEQ ID NO: 20634 - DNA, 50 bp, homo sapien
acacgattaactatctggggaggacractaactgctggctccaagggcca

SEQ ID NO: 20635 - DNA, 50 bp, homo sapien
ttgtgattgggtagctcatagcataraagcaagaagttagttgtggttct

SEQ ID NO: 20636 - DNA, 50 bp, homo sapien
tcaaagaatgttctgctctacaaaaygatttatgtctttcataagcaaag

SEQ ID NO: 20637 - DNA, 50 bp, homo sapien
tctttatcctctgaccagaacagaarggaatataatggtgtagtatcaca

SEQ ID NO: 20638 - DNA, 50 bp, homo sapien
ataaagccaccaattttccagaataygcacaatcattcctggttctgagc

SEQ ID NO: 20639 - DNA, 50 bp, homo sapien
aggacaggcagaaggccaatgacaamggattctgggagccaagcttaagc

SEQ ID NO: 20640 - DNA, 50 bp, homo sapien
ccccaggcctgtcatgttctttgctraaaaatcaaaacagaatgcagtag

SEQ ID NO: 20641 - DNA, 50 bp, homo sapien
acactgggattttagaaatgaattgractgtacctggccctaacagcagg

SEQ ID NO: 20642 - DNA, 50 bp, homo sapien
tgtgtgtgctttatatatgacaaacygaaatataatctgtttcttaaatt

SEQ ID NO: 20643 - DNA, 50 bp, homo sapien
atcacagacttctgagacaaaatcaygctaaggaaatcaaacacttgccc

SEQ ID NO: 20644 - DNA, 50 bp, homo sapien
caaatgcaaatagtgaccatcaataycttggagggtagaggaagatactt

SEQ ID NO: 20645 - DNA, 50 bp, homo sapien
atgccatggagatgagggtagactcraaaagggaatgactgctaatacga

SEQ ID NO: 20646 - DNA, 50 bp, homo sapien
ccatgagagttaactgccagagagayggttcttttctaaagtgttttaga

SEQ ID NO: 20647 - DNA, 50 bp, homo sapien
ctgaatcccctgtgcagggaaggagycgctcttgacaaatttcttgccta

SEQ ID NO: 20648 - DNA, 50 bp, homo sapien
cagttcagcatttccattctattaawctacagcccttggctccaacaata

SEQ ID NO: 20649 - DNA, 50 bp, homo sapien
gaaacctaaaacccacaaatggaaaktgttatcatttatcttatatttgg

SEQ ID NO: 20650 - DNA, 50 bp, homo sapien
catatttattagataagccaaaatcraatttaaaagctgaaatgtcacag

SEQ ID NO: 20651 - DNA, 50 bp, homo sapien
atagccaagacactcctgaagaagayaaataagacagaagaagactgttc

SEQ ID NO: 20652 - DNA, 50 bp, homo sapien
gttaatgacctcaagtctccaaataygctgccagaaattttattcttttg

SEQ ID NO: 20653 - DNA, 50 bp, homo sapien
atagccatattcacttgtgccttatyaattgcatttgttcacttcccccc

SEQ ID NO: 20654 - DNA, 50 bp, homo sapien
taaatgtttcgaccacagaataagasaacctaaaacaatttacattagtg

SEQ ID NO: 20655 - DNA, 50 bp, homo sapien
cctcattattcatcacctgattgtcrgaaattaactataacccttcatgt

SEQ ID NO: 20656 - DNA, 50 bp, homo sapien
attggcctatcttgactaacaatgarccttggatttgaaacatatcatca

SEQ ID NO: 20657 - DNA, 50 bp, homo sapien
tggcgcaaagaggcagcaagcccgayaaattgtgtaaccattttcagacg

SEQ ID NO: 20658 - DNA, 50 bp, homo sapien
gagaagtaggaggggtacaagaatayagccagatagaagtaataagttct

SEQ ID NO: 20659 - DNA, 50 bp, homo sapien
aatgattatattagatctgaggcatrataaacttccatcaacctttaaag

SEQ ID NO: 20660 - DNA, 50 bp, homo sapien
tacagtgttttacttgtgactattawataggactgaaatatggagaatta

SEQ ID NO: 20661 - DNA, 50 bp, homo sapien
aggtgtataataccttgagttctaaygctgatgcaaatctcaaaactcag

SEQ ID NO: 20662 - DNA, 50 bp, homo sapien
tgttacaggtagaaaggaatggccarcttggagaaatggccactgggatg

SEQ ID NO: 20663 - DNA, 50 bp, homo sapien
tgcagcctggggagagctgcaatcayaaaactccccaggcctcctagtct

SEQ ID NO: 20664 - DNA, 50 bp, homo sapien
gacatcttcggttatactttctgtamaaagatccagctgggagcttaagt

SEQ ID NO: 20665 - DNA, 50 bp, homo sapien
cagcactgctggaagaaataaaaccsagtggcgtgacagcaacgtttaag

SEQ ID NO: 20666 - DNA, 50 bp, homo sapien
gaaccaatttaaaaaggattaaaaamgtccactgccaaaaattcgattta

SEQ ID NO: 20667 - DNA, 50 bp, homo sapien
ccaaaccatttccctatgccttaagmctcatccaactgaaccccactctt

SEQ ID NO: 20668 - DNA, 50 bp, homo sapien
gttacaaaatctggtgattgtaaccrcattctcaactgaataataagaca

SEQ ID NO: 20669 - DNA, 50 bp, homo sapien
taacattgagatcgttattgttccaytgattgacttctgaattttcatac

SEQ ID NO: 20670 - DNA, 50 bp, homo sapien
acctaatttcacatatatgaagtgasagcaagtaaggcaatcttagagaa

SEQ ID NO: 20671 - DNA, 50 bp, homo sapien
cagttaacaacaaattgttcagaagyagagcattagagaggtaaactttc

SEQ ID NO: 20672 - DNA, 50 bp, homo sapien
agaactcaagctcagatccaatcccragaggtcctgatttaattggtctg

SEQ ID NO: 20673 - DNA, 50 bp, homo sapien
cctcctggattctaagtacacttaamattacagcagccgttcgtttctat

SEQ ID NO: 20674 - DNA, 50 bp, homo sapien
gccagtgctgggttcctatactccaratcaaaaagtgagatagcttaaag

SEQ ID NO: 20675 - DNA, 50 bp, homo sapien
aataaagaaaatctaagcacttagcrgaaacttaaccagtaaaatatcat

SEQ ID NO: 20676 - DNA, 50 bp, homo sapien
cacgacacagggctttatccatgtarccagcgagtggccttagagacctg

SEQ ID NO: 20677 - DNA, 50 bp, homo sapien
gtataagatctagaggttatctttgwacatttttcaacatttgggtaaaa

SEQ ID NO: 20678 - DNA, 50 bp, homo sapien
agtctcatgcagagttggtgactaayatccttcactctagcttgaaagcc

SEQ ID NO: 20679 - DNA, 50 bp, homo sapien
actcttgaatgacagctctaagaaaytggcttctcaggaaactgagacaa

SEQ ID NO: 20680 - DNA, 50 bp, homo sapien
tgtcaatgctataatataatcacacyggcaatctagaaatacctacttcc

SEQ ID NO: 20681 - DNA, 50 bp, homo sapien
cagtggtgaggcatccacaagtttamagcagggagagtaaatgatcaggg

SEQ ID NO: 20682 - DNA, 50 bp, homo sapien
gaagcgtgaacattatcttaaaatayagtttcggtgattctccaaagagt

SEQ ID NO: 20683 - DNA, 50 bp, homo sapien
atttaaaagtattaaaaacttacatsagaccgtgcagctcagtatgtggc

SEQ ID NO: 20684 - DNA, 50 bp, homo sapien
tggcttgataattattatgaaaatawccctatgctagtgcttgaggctgc

SEQ ID NO: 20685 - DNA, 50 bp, homo sapien
agcacagtttgctgaatattataagyctaggagtgaaacctactgctcag

SEQ ID NO: 20686 - DNA, 50 bp, homo sapien
ctctcctatcctttggtcaaaattarcaacataacaagaagatagtgcag

SEQ ID NO: 20687 - DNA, 50 bp, homo sapien
atgaactgaagctcggagagataaakaatgccagaaatggagaggaaatg

SEQ ID NO: 20688 - DNA, 50 bp, homo sapien
tgtgggaaccagagctccttggcccraagtgtgactgtgactctcctcca

SEQ ID NO: 20689 - DNA, 50 bp, homo sapien
tttacagtaccaacaatagcataaamattttcctaagtactagactggtg

SEQ ID NO: 20690 - DNA, 50 bp, homo sapien
ttgtctttaaatgcccttactcgtcrcagtttaaacacttaggatgtggc

SEQ ID NO: 20691 - DNA, 50 bp, homo sapien
gtcagcaatactgaaaggtagtcaaytatttttagggaaaaggaatgagc

SEQ ID NO: 20692 - DNA, 50 bp, homo sapien
ttccagataaactccagaaaacatasatatagtgagtttggggttgtgta

SEQ ID NO: 20693 - DNA, 50 bp, homo sapien
tatgttttctggagtttatctggaarattggttttgagtgtgaaccgtct

SEQ ID NO: 20694 - DNA, 50 bp, homo sapien
tttgaaaaatcattatcaagtcaackgctgggaaatacactagtaaagta

SEQ ID NO: 20695 - DNA, 50 bp, homo sapien
gtatacctttgttttgttcacaacayattttatcttttcatacgcatctg

SEQ ID NO: 20696 - DNA, 50 bp, homo sapien
ttcattattggaaaataaagtaacartgtgaactcttttatttcatggga

SEQ ID NO: 20697 - DNA, 50 bp, homo sapien
cgtccgttactttcccctgtgattasagtttgtgccctttgtcctaatac

SEQ ID NO: 20698 - DNA, 50 bp, homo sapien
ctttcctgattcttctttcaatccamagtgaaaattgtaaaatgaacatg

SEQ ID NO: 20699 - DNA, 50 bp, homo sapien
agaaaaagaagaatctattgcccatsataaggtggatatttaaaagcctc

SEQ ID NO: 20700 - DNA, 50 bp, homo sapien
ttttctccatagatattttagaaackgcgaattacagcaataatagtatg

SEQ ID NO: 20701 - DNA, 50 bp, homo sapien
caaaatgactcttaatttacaaggartagaggttggctgatccctgtgat

SEQ ID NO: 20702 - DNA, 50 bp, homo sapien
cccaccacctagagaccacagcaagmagacggatgtaaaattctgctacg

SEQ ID NO: 20703 - DNA, 50 bp, homo sapien
aaaaaaggaactactgactatgaaarccatcgatttcaatttccaaactt

SEQ ID NO: 20704 - DNA, 50 bp, homo sapien
caggtggtcttaaagttggtgagacraaagtgtggagcttccaccatgga

SEQ ID NO: 20705 - DNA, 50 bp, homo sapien
ctttaatatggtacaaagtgattaartgggccctagagaagcacaaagtt

SEQ ID NO: 20706 - DNA, 50 bp, homo sapien
agcagtgagacaatgaaacttgttckataattatttgagatcatagctag

SEQ ID NO: 20707 - DNA, 50 bp, homo sapien
gaagggcaaaattttaaaagaccatkatcagcttgaaagagaacatttgg

SEQ ID NO: 20708 - DNA, 50 bp, homo sapien
ccttagtccaacattaataactcaayaaactctgcaggctcaagggaaac

SEQ ID NO: 20709 - DNA, 50 bp, homo sapien
atgaatacactgaaacaacttcctcrctttggaattaacaagaatagacc

SEQ ID NO: 20710 - DNA, 50 bp, homo sapien
ataaatatgtgcaattatgtcaattkaaaggaactgtaaagatgagatta

SEQ ID NO: 20711 - DNA, 50 bp, homo sapien
tggcttggcggactccaacctatgcrctttacgtcattactgaggcaagg

SEQ ID NO: 20712 - DNA, 50 bp, homo sapien
cgtatatggatggataagggataaaytgcttcacaagactattattgatc

SEQ ID NO: 20713 - DNA, 50 bp, homo sapien
aaagcattgttttctaacaaacttgsatacattgtaagatttagacatgt

SEQ ID NO: 20714 - DNA, 50 bp, homo sapien
taagaaaacgaatgatccactgaaawttgaatgaatggtaagatcaataa

SEQ ID NO: 20715 - DNA, 50 bp, homo sapien
gaattttatgatattaagatggtaaytgaccagaagactcagagcttgtt

SEQ ID NO: 20716 - DNA, 50 bp, homo sapien
gatttgtttttttaacattcttccamtctccaaaactccaactattaaaa

SEQ ID NO: 20717 - DNA, 50 bp, homo sapien
cagtcgggcttaacgttcgtgaacayggtaattgatttctacgaattcct

SEQ ID NO: 20718 - DNA, 50 bp, homo sapien
gaaatgctggaaatatttgtaaccawcttataagctcatggaaatgcttt

SEQ ID NO: 20719 - DNA, 50 bp, homo sapien
aaaaagagtcaaaagagttttgaatragctaacaatgtttatgtagcata

SEQ ID NO: 20720 - DNA, 50 bp, homo sapien
acagaacttaaacactcttcaaagayggtggttccaatgactctgtgatt

SEQ ID NO: 20721 - DNA, 50 bp, homo sapien
cgacagccccaacacttcactctcayggatcttttacttccaaggccact

SEQ ID NO: 20722 - DNA, 50 bp, homo sapien
aatctatatgctgcctgagatcatcrgagagtatgtatatgaaaatgaga

SEQ ID NO: 20723 - DNA, 50 bp, homo sapien
tcctgcacctatttacagttcaatcraccacaaggcctttggccatacgc

SEQ ID NO: 20724 - DNA, 50 bp, homo sapien
aatgagagtgaaaataagagaggaawttagtgatctaaggactacattaa

SEQ ID NO: 20725 - DNA, 50 bp, homo sapien
tcaaaaagccaaatgcttgaaaacaygtaaggagtagtaggttgaacaat

SEQ ID NO: 20726 - DNA, 50 bp, homo sapien
tttgctacaaagagctgggaaaataraactgcttggtctggataattgtt

SEQ ID NO: 20727 - DNA, 50 bp, homo sapien
agtcagaaatactaagtagtcagatkaacctataaataagagacaaaaac

SEQ ID NO: 20728 - DNA, 50 bp, homo sapien
gtaattaccaatataaatagccttaraatgatagtgatttggtaagcatt

SEQ ID NO: 20729 - DNA, 50 bp, homo sapien
gcaggatagacagtacaccctgagasaaaggattcagggcaggctgcttt

SEQ ID NO: 20730 - DNA, 50 bp, homo sapien
atggaaaacactgtattgattctaaracatgagagaaatttaaggtaaca

SEQ ID NO: 20731 - DNA, 50 bp, homo sapien
ttgttaatccagtatttcacagtacratatgttgagaaacttgtatgcac

SEQ ID NO: 20732 - DNA, 50 bp, homo sapien
tatctgataagcagtgtatttgaacygtaccatggaaaacactgtattga

SEQ ID NO: 20733 - DNA, 50 bp, homo sapien
tgatgataatttaacaaaagtcttayatgcatctcaaggaattaatcacc

SEQ ID NO: 20734 - DNA, 50 bp, homo sapien
acataatacgttcattatcttgcccragccattattggaaataagactca

SEQ ID NO: 20735 - DNA, 50 bp, homo sapien
cttggggaagctttatagaaatagaratgtctgtattccatccctaaccc

SEQ ID NO: 20736 - DNA, 50 bp, homo sapien
cagctttacatatggagagaactgasgattttggatgatgtcaagcaaat

SEQ ID NO: 20737 - DNA, 50 bp, homo sapien
ttggcaagagcactcatgaataaccrcattaaaacagcgataaaagaccc

SEQ ID NO: 20738 - DNA, 50 bp, homo sapien
tacttatctatagcctttcacagaaygtcaaagaagtgtcataagtattc

SEQ ID NO: 20739 - DNA, 50 bp, homo sapien
tactaaattataagagagctagtacraagtattttattgaataaggttag

SEQ ID NO: 20740 - DNA, 50 bp, homo sapien
taagcttttaaaaaataatttgtcaytacaaaggaactatcaaagagcta

SEQ ID NO: 20741 - DNA, 50 bp, homo sapien
cacaaaggagagtagccaggagtaaygagaggacggtcaggtgggcactt

SEQ ID NO: 20742 - DNA, 50 bp, homo sapien
ctgattccacacaacttaagcctccratacaatcacttacaaaaaacaaa

SEQ ID NO: 20743 - DNA, 50 bp, homo sapien
acttttacaggtagtaacagctacaratactctcccagaagtggagggac

SEQ ID NO: 20744 - DNA, 50 bp, homo sapien
gttaatgcagtttctggatcttccawgagagtaacctgagttttttgttg

SEQ ID NO: 20745 - DNA, 50 bp, homo sapien
cctggggcagtggaaatggaattcarcttacaaaatcagggttcacgctc

SEQ ID NO: 20746 - DNA, 50 bp, homo sapien
ttaaatgagacaatgaatgtagaaamaaattttgtagattgtaaagtgct

SEQ ID NO: 20747 - DNA, 50 bp, homo sapien
ataacagagcctagaatagtcatagrataatatgatggattttcaggatg

SEQ ID NO: 20748 - DNA, 50 bp, homo sapien
gtgttacggaattcttctccatcgckatttacacatgcatgtgaatctgt

SEQ ID NO: 20749 - DNA, 50 bp, homo sapien
atccaggttgaagtacacattgatcsattcattggctgcaaaagcctttt

SEQ ID NO: 20750 - DNA, 50 bp, homo sapien
ggagacactaaatagcctggctgacmgggagcaaaagatgctgcataagg

SEQ ID NO: 20751 - DNA, 50 bp, homo sapien
ctggcctcttctagatatttaagaawgtagttcacataagaggattacag

SEQ ID NO: 20752 - DNA, 50 bp, homo sapien
taaacattctataacagtatacttcmaaatgatgctgtaatcctcttatg

SEQ ID NO: 20753 - DNA, 50 bp, homo sapien
ccttagaagcataaattttgtgcacygtatggtttatcacttcaagactc

SEQ ID NO: 20754 - DNA, 50 bp, homo sapien
aagcaactagagaattgaatacgccraaattcatgacaagctatgaagct

SEQ ID NO: 20755 - DNA, 32 bp, homo sapien
agaattgctcatggaayaattatttaactgta

SEQ ID NO: 20756 - DNA, 50 bp, homo sapien
gaaatgagcccattggatttaacaayacccaagtaaccatagtaagtagt

SEQ ID NO: 20757 - DNA, 50 bp, homo sapien
cacttggggtcacacaaacacatggkaacttactacttcttcctgagagg

SEQ ID NO: 20758 - DNA, 50 bp, homo sapien
aggcggcaatggtgagccaagcgtgsaacagcccaaactaaagtcggggt

SEQ ID NO: 20759 - DNA, 50 bp, homo sapien
attgggctataagtgaataattccakgttgaccaatcatattattcccag

SEQ ID NO: 20760 - DNA, 50 bp, homo sapien
gatggcgacccatttatcttagtacrccagtgacaaatatgatgtctagt

SEQ ID NO: 20761 - DNA, 50 bp, homo sapien
aagcagctattgtacctgtgctcaaygatgtgaaggaaaatatgattata

SEQ ID NO: 20762 - DNA, 50 bp, homo sapien
cagaatatgaaaatgaaagaagttayaatgctaggtttttctaatcccat

SEQ ID NO: 20763 - DNA, 50 bp, homo sapien
atgatcatgtcacatcgtttggacasaagtcacttggaagccaaagtttt

SEQ ID NO: 20764 - DNA, 50 bp, homo sapien
aatcaaactctgtcaagttttgtcawtcagaccaatgatttgtcatgctg

SEQ ID NO: 20765 - DNA, 50 bp, homo sapien
attcagaattctttgcaggctttaaraagtcacatcatacacatatctcc

SEQ ID NO: 20766 - DNA, 50 bp, homo sapien
tctttgagagtaataatgcaacccaratcaaagcaatcactgaggaacta

SEQ ID NO: 20767 - DNA, 50 bp, homo sapien
ctgggttgcattattactctcaaagwatgttttcctgcttgtttaattca

SEQ ID NO: 20768 - DNA, 50 bp, homo sapien
atacataatttaatagttcacaaagycaagaagcctcatcatactgctta

SEQ ID NO: 20769 - DNA, 50 bp, homo sapien
aagaattgtgtcctcattgttattaraaatcctgtcctctggatcctctc

SEQ ID NO: 20770 - DNA, 50 bp, homo sapien
cctgggatcttctacatgccttttascgtctatctgcatgtcactgccat

SEQ ID NO: 20771 - DNA, 50 bp, homo sapien
catcagatcccacattccagataagraaaacaatacccacagagcaagaa

SEQ ID NO: 20772 - DNA, 50 bp, homo sapien
cttggacaggaaaggtagagtggtcractaccctgtggcagttttgagca

SEQ ID NO: 20773 - DNA, 50 bp, homo sapien
gcaggatgatgactgtgttgttctgsattaatacaggcttaagaggtgtt

SEQ ID NO: 20774 - DNA, 50 bp, homo sapien
tgttgcaccaagtggaaaataactaratatagatttacaacttttaaaat

SEQ ID NO: 20775 - DNA, 50 bp, homo sapien
tcactgattccactgaattacactcwattatactgggtcagtaagcttaa

SEQ ID NO: 20776 - DNA, 50 bp, homo sapien
agaactgggctgacattaacacagartctatccttgaagaaaaaaacaac

SEQ ID NO: 20777 - DNA, 50 bp, homo sapien
aattaaaggtttatatgtccttccayggtggtttaaacagagatatttac

SEQ ID NO: 20778 - DNA, 50 bp, homo sapien
ctgccttttgtattgtgttaccttaygcagttgaagcaaattatttgaaa

SEQ ID NO: 20779 - DNA, 50 bp, homo sapien
ccacggaataatcgtttcagacttawatcctgtgtaagacttactattaa

SEQ ID NO: 20780 - DNA, 50 bp, homo sapien
cattgaggatatacacaaactccctmaatcagttgcaatttttgttgaag

SEQ ID NO: 20781 - DNA, 50 bp, homo sapien
ctctaatttctattatctaattctcycatgaaggtaagctgtccaaagta

SEQ ID NO: 20782 - DNA, 50 bp, homo sapien
ataccttcattacctcacgagtgcartgatgtgaagatgtctcaattctc

SEQ ID NO: 20783 - DNA, 50 bp, homo sapien
aataaaccttgcaattgaggtattcrcagtgtccacaggaacaaactcat

SEQ ID NO: 20784 - DNA, 50 bp, homo sapien
atcctggaatcacacccctcaatacyatattttacctgcatcatgtgtgc

SEQ ID NO: 20785 - DNA, 50 bp, homo sapien
tgcatttgtatagagcccaatcagasgagtcttcaccgagaatgatacaa

SEQ ID NO: 20786 - DNA, 50 bp, homo sapien
atatcatacatcttgattttagacaycttctccattaaggtgtgagctta

SEQ ID NO: 20787 - DNA, 50 bp, homo sapien
tatggctttcttttggcagctatgargtctgttgagaaacagcaaatggg

SEQ ID NO: 20788 - DNA, 50 bp, homo sapien
cttatcacatcaagggagttatagaygataatgttggctttgacctcaat

SEQ ID NO: 20789 - DNA, 50 bp, homo sapien
ccaaggcattattctccttgactaayccacattctccttgttgctatttg

SEQ ID NO: 20790 - DNA, 50 bp, homo sapien
attcactttatacatggaagctgaarctgatggaagttgaataatttgcc

SEQ ID NO: 20791 - DNA, 50 bp, homo sapien
tcacatgcatgtgaagctgtgcaagracctctgcaaaatgcctttgccca

SEQ ID NO: 20792 - DNA, 50 bp, homo sapien
attgaattaaatcaggcatgaaaaaratcaataaaactcaccaattcaaa

SEQ ID NO: 20793 - DNA, 50 bp, homo sapien
gaatctattttggtatgaagaccacygagaaaagaagataaagcatcttt

SEQ ID NO: 20794 - DNA, 50 bp, homo sapien
tataattgccattttaaggagcccarctatgattacccttatctgaaatg

SEQ ID NO: 20795 - DNA, 50 bp, homo sapien
atgtgtgtgaatatctattcattatraggacatgatacacacacacacac

SEQ ID NO: 20796 - DNA, 50 bp, homo sapien
tcttctaatgcataatgtcgggaaawtgtctttgtgattagacggctggc

SEQ ID NO: 20797 - DNA, 50 bp, homo sapien
acttctaaagttattgcagagtgaamcagtaagatcgctaatggattttt

SEQ ID NO: 20798 - DNA, 50 bp, homo sapien
cacatctggccactagccagcataakagctcctgaagtgtagtgccttct

SEQ ID NO: 20799 - DNA, 50 bp, homo sapien
tagaccagtcctagacagaggcaaayaatctatcccagtggtcagaatcc

SEQ ID NO: 20800 - DNA, 50 bp, homo sapien
tgaatagttttaagtcatgaaaggcrgcatcctaaaagttgattaaagaa

SEQ ID NO: 20801 - DNA, 50 bp, homo sapien
accttaaatgttgaagttaataaaaytggtaatgctcgacgtggggaaaa

SEQ ID NO: 20802 - DNA, 50 bp, homo sapien
acaaagatagccttcataaaagaggmaattgtagcagtgtccccatgacc

SEQ ID NO: 20803 - DNA, 50 bp, homo sapien
gccagggaatggggaggtcagatgaygagaggctttaggtttcacttgga

SEQ ID NO: 20804 - DNA, 50 bp, homo sapien
agaaacccagagtaaagaagatggaygaaataatagaactctaaatcatt

SEQ ID NO: 20805 - DNA, 50 bp, homo sapien
tgatttgttcattttccagattttakgtaacatggatatactatatttaa

SEQ ID NO: 20806 - DNA, 50 bp, homo sapien
agcaacaagcaattgacatactttaraacaaaatttcagagaactttgtg

SEQ ID NO: 20807 - DNA, 50 bp, homo sapien
ggttggctgctctttgaaccacttaygcacattagaaaaatatacttctg

SEQ ID NO: 20808 - DNA, 50 bp, homo sapien
cgtgggcatacagatgttttaaagayggccagagttaggaatgagacccc

SEQ ID NO: 20809 - DNA, 50 bp, homo sapien
actgtggctgataaaggcatatacaygaactaaaaatcttttctggagga

SEQ ID NO: 20810 - DNA, 50 bp, homo sapien
ggaatttcatttctgtgttacatagmattgcattttgaagtagtgtttat

SEQ ID NO: 20811 - DNA, 50 bp, homo sapien
tattctttaaatttggttagaactgwcaggaaaattttgttatgaagaca

SEQ ID NO: 20812 - DNA, 50 bp, homo sapien
aagttccacaaacaaccattcatctmaaataaaagtgaaaattcacacat

SEQ ID NO: 20813 - DNA, 50 bp, homo sapien
ttaaaatccagctgctatgaaatgartcaccctgtaagagcaggttggac

SEQ ID NO: 20814 - DNA, 50 bp, homo sapien
tgtacaaagacaggtacgacgagcaytagcgtcccttgggaattcgcaca

SEQ ID NO: 20815 - DNA, 50 bp, homo sapien
tatccccaggtagctagtgtcagaaytgggtttaattagaggacatccag

SEQ ID NO: 20816 - DNA, 50 bp, homo sapien
aaccatctattgcttaaaaatagaamgaggtaaactatgctgttttggtg

SEQ ID NO: 20817 - DNA, 50 bp, homo sapien
ttcacagattcttctggcttttctayggttgccattttattcttggcttc

SEQ ID NO: 20818 - DNA, 50 bp, homo sapien
ctgttgtcttctcctctttgtttaaygtcttctgattctttatccaaccc

SEQ ID NO: 20819 - DNA, 50 bp, homo sapien
atgcagcagcttgtccagttatataygaaaccaagaattctgtgctacgc

SEQ ID NO: 20820 - DNA, 50 bp, homo sapien
catgacacattgcaatgtgtctcgawcttttggcctcaagcgatcctcct

SEQ ID NO: 20821 - DNA, 50 bp, homo sapien
atttttcttagaggccatcacaatayctagaaaagaaatattactttggg

SEQ ID NO: 20822 - DNA, 50 bp, homo sapien
tctgtttacattttcatcaataatayacatttagcgagtttttgttgaat

SEQ ID NO: 20823 - DNA, 50 bp, homo sapien
agcagtcaaaacaggattataaaaasagtggaatattttatgtttagagg

SEQ ID NO: 20824 - DNA, 50 bp, homo sapien
tatcctcagttttaacaaaaatatcrcaatgtatcaatattttaaaggac

SEQ ID NO: 20825 - DNA, 50 bp, homo sapien
tctcctctcccctttcttctggctaytaaactttccgctccttaacccac

SEQ ID NO: 20826 - DNA, 50 bp, homo sapien
agtttaaaaattgggtaatttgataraagaattaagtcctcatgggaaaa

SEQ ID NO: 20827 - DNA, 50 bp, homo sapien
catccataaatctatttttaacccamcatttggcaatctactccttacac

SEQ ID NO: 20828 - DNA, 50 bp, homo sapien
ttttaatgagttagaagttcacgtcycagttccaaaacccaataatgcat

SEQ ID NO: 20829 - DNA, 50 bp, homo sapien
tgttttcagtaaaagttactccaaaygtgcctgcctcttctgtttcccct

SEQ ID NO: 20830 - DNA, 50 bp, homo sapien
tgctgtaccaggcatctttgccacaktgtaatagtccaacaacttgaatc

SEQ ID NO: 20831 - DNA, 50 bp, homo sapien
tattatattaagtttgagcaatcatraacaaattcataaggaataatgcg

SEQ ID NO: 20832 - DNA, 50 bp, homo sapien
agacatatacaccaactgaatagaayagagatgccagaaatgcaacttca

SEQ ID NO: 20833 - DNA, 50 bp, homo sapien
ataataatcttaataaaatcttgtgkacttttacctatttgagacaaact

SEQ ID NO: 20834 - DNA, 50 bp, homo sapien
cttcaatgacttccttcatgaaagasaatgaaagcgatctggcctgacat

SEQ ID NO: 20835 - DNA, 50 bp, homo sapien
gaagttgataaattggcttgataccratgaaaatggcgaccactgcttga

SEQ ID NO: 20836 - DNA, 50 bp, homo sapien
tcataccacttgctatttcttacccraatgaagtgtaagagagtgagtta

SEQ ID NO: 20837 - DNA, 50 bp, homo sapien
ccaaatctctgttttattgggttcaytcagatttagaattcagaaaactt

SEQ ID NO: 20838 - DNA, 50 bp, homo sapien
gcgatgcatcagagtcacaccgatayagtgaaaacctcgttgcagcgcat

SEQ ID NO: 20839 - DNA, 50 bp, homo sapien
gcactgactctttcagactcctagtraacgagataccttggcagtcaggc

SEQ ID NO: 20840 - DNA, 50 bp, homo sapien
tctcagtgagcctgactgcatggcaygaggcctgactgccaaggtatctc

SEQ ID NO: 20841 - DNA, 50 bp, homo sapien
tttatttcaattgaatgctataggaraagatgatcccaaaagtgcgttcc

SEQ ID NO: 20842 - DNA, 50 bp, homo sapien
aactagagttctatgcctcctttgayctagttaaataaggcgacaggata

SEQ ID NO: 20843 - DNA, 50 bp, homo sapien
aggaaatcctttaacaatgctatgasagtaataaagatttatttatatag

SEQ ID NO: 20844 - DNA, 50 bp, homo sapien
aaacacgtgaccgtagtcttgtccarccatgagattttatcattttcaga

SEQ ID NO: 20845 - DNA, 50 bp, homo sapien
gacaataagatggagctcagcattaygtgaatatattaaggagatttaat

SEQ ID NO: 20846 - DNA, 50 bp, homo sapien
agtgaaacagaatggaatccagaaaracccaaatacacacagaaatttag

SEQ ID NO: 20847 - DNA, 50 bp, homo sapien
tgcaaaacataaaaaaactattaaawctcatggacaaaagtcacccccag

SEQ ID NO: 20848 - DNA, 50 bp, homo sapien
ttaatagtttttttatgttttgcacrggacagatttttaccataaattaa

SEQ ID NO: 20849 - DNA, 50 bp, homo sapien
gatgaaggcaactacaaccttggacragatcacagccacatattcctctc

SEQ ID NO: 20850 - DNA, 50 bp, homo sapien
agaatctgaagaataacttgagatcmacaataactctacagttatccaca

SEQ ID NO: 20851 - DNA, 50 bp, homo sapien
tttctccctgaaagcaagataaggcsaggcaaaagggagccctataaata

SEQ ID NO: 20852 - DNA, 50 bp, homo sapien
ggcacactgccttgtacctaataaaygccaggctcatgataatttatttg

SEQ ID NO: 20853 - DNA, 50 bp, homo sapien
ggaaaaaattaattactagactaggraataaccatagtttggctaaaagt

SEQ ID NO: 20854 - DNA, 50 bp, homo sapien
tacaaacaaggacttgtcccaagccrcattttaggtgctgatagactgag

SEQ ID NO: 20855 - DNA, 50 bp, homo sapien
ttctgtaacaatcaggtttacagcaycagattagctacatggtgcttata

SEQ ID NO: 20856 - DNA, 50 bp, homo sapien
cagtgtgggcacctcagtgcaaccartgagaaaacgtggagaagaaggta

SEQ ID NO: 20857 - DNA, 50 bp, homo sapien
taggcctccctttgtgtcaaagagawcggaagtactttgcacctggatcc

SEQ ID NO: 20858 - DNA, 50 bp, homo sapien
agagattggtcaaactatagtaaacyatttcagattaaattcactttaaa

SEQ ID NO: 20859 - DNA, 50 bp, homo sapien
ttcagatccagtccaaatttaagcgyatagaaaaatcttttattaaaaag

SEQ ID NO: 20860 - DNA, 50 bp, homo sapien
gccctaaatactatgttggtggtatraaataattcctctgtacctcaagc

SEQ ID NO: 20861 - DNA, 50 bp, homo sapien
aatcaccccagttaggttcagactamatgtggtgccttgtttttggtgga

SEQ ID NO: 20862 - DNA, 50 bp, homo sapien
aaataacctcctgttgtatgttagaygtaccatatttttgtaaacattcc

SEQ ID NO: 20863 - DNA, 50 bp, homo sapien
agctgggagcacatcagactcgcaartagcagtaataaaaaagcaagatt

SEQ ID NO: 20864 - DNA, 50 bp, homo sapien
ctggctgatttatgagaaaggtaccragacaagagcatcgacagactggc

SEQ ID NO: 20865 - DNA, 50 bp, homo sapien
acagcctagctgcagttgttgggctwaaattattctgggcctatttgatg

SEQ ID NO: 20866 - DNA, 50 bp, homo sapien
tgtccatcttcagcccaggccataartctattcatcagattactaatctt

SEQ ID NO: 20867 - DNA, 50 bp, homo sapien
ctctaatttactttcatgaaacagcraactaattcttctaacacactatt

SEQ ID NO: 20868 - DNA, 50 bp, homo sapien
tacaaatgaaaaaataagactgcaaygtaatttagctgtaagaagtcata

SEQ ID NO: 20869 - DNA, 50 bp, homo sapien
tatttttttctgcttttctgttaaayctttggctttttggattgtaactg

SEQ ID NO: 20870 - DNA, 50 bp, homo sapien
catttttcctgctggagtgagaaatmaatggtctctttcaatagggtagt

SEQ ID NO: 20871 - DNA, 50 bp, homo sapien
aaaattttttaaagtttccattttckacaaatctaaacagcttcctctgt

SEQ ID NO: 20872 - DNA, 50 bp, homo sapien
tccttttagctcattttagcctcacratatcccagagaggtgtgtcatat

SEQ ID NO: 20873 - DNA, 50 bp, homo sapien
aggcacatttactgagggattaggaraactcataaaacattgcactctat

SEQ ID NO: 20874 - DNA, 50 bp, homo sapien
gtgacattttagcagacctcggacaygtataaaagacaaaagtagagctc

SEQ ID NO: 20875 - DNA, 50 bp, homo sapien
tgagaggctatttagcttgtgagtasagcaaaatctcagatccttcacag

SEQ ID NO: 20876 - DNA, 50 bp, homo sapien
gaagaagttggtcctccatggtatayagagcaagagaacccaggaggggc

SEQ ID NO: 20877 - DNA, 50 bp, homo sapien
agtttttttctttacatgaaactacygaaagcgaaagtatgtcatgctta

SEQ ID NO: 20878 - DNA, 50 bp, homo sapien
aatactctgttgacacagcaaaccayaaggagtgttgaaaaagtggcagt

SEQ ID NO: 20879 - DNA, 50 bp, homo sapien
gaaagggtaataaagaatgctaagtraaggaaaaccctgggacagagaag

SEQ ID NO: 20880 - DNA, 50 bp, homo sapien
tgacacacataacatcctttgatcamaaatcttcaggggatccccactcc

SEQ ID NO: 20881 - DNA, 50 bp, homo sapien
aaactgcttcttgcatctaagccaayatttcctggttgaatggctcttaa

SEQ ID NO: 20882 - DNA, 50 bp, homo sapien
atttatattttgtaatgtctgttaartacttgcagaagtgctggatgatt

SEQ ID NO: 20883 - DNA, 50 bp, homo sapien
tggcgtcctaatccaagcaggtcagscataggtcacgtgcacaacgccaa

SEQ ID NO: 20884 - DNA, 50 bp, homo sapien
ggtcacatgctaaagagggtcccacrcttcatagaattttgggcggctag

SEQ ID NO: 20885 - DNA, 50 bp, homo sapien
actaaagcaaactccttcaactagayaaagacagcatctcatttaaatgc

SEQ ID NO: 20886 - DNA, 50 bp, homo sapien
cagagcttctgggcacctggatgaayggttcacatgggagtcaacagtgg

SEQ ID NO: 20887 - DNA, 50 bp, homo sapien
gagaaatcccaatgagggaccgccaratgatgagaaggcagcctgacatg

SEQ ID NO: 20888 - DNA, 50 bp, homo sapien
tattccagtcttatatttatgtagamgacacaagattttcatggaaaaac

SEQ ID NO: 20889 - DNA, 50 bp, homo sapien
ttctcacactaaaccagagctgctcrccttttaactttcgttacctggct

SEQ ID NO: 20890 - DNA, 50 bp, homo sapien
gagaaaattcctccatgcaggatgaygttagataatgacagggcaaagga

SEQ ID NO: 20891 - DNA, 50 bp, homo sapien
tggtgccagaggagaatcgggcttaygtgaagactaaaaaatacacaggg

SEQ ID NO: 20892 - DNA, 50 bp, homo sapien
gttgttaagccatttttaagttgcaracatcaaggcacagcttatctaaa

SEQ ID NO: 20893 - DNA, 50 bp, homo sapien
agggtcgttcttgagttcacttacaragaatcgatccttacaggtgacct

SEQ ID NO: 20894 - DNA, 50 bp, homo sapien
tgaagtgtgcttatgcttaagagtargagaaagtccaaaagaatcctaaa

SEQ ID NO: 20895 - DNA, 50 bp, homo sapien
caaacacctgtgaggatagcctccamgagagcaggaatgctagtgatagc

SEQ ID NO: 20896 - DNA, 50 bp, homo sapien
atgggagcctgaatatggatttcaamcgaagaagaggaagctttgagaaa

SEQ ID NO: 20897 - DNA, 50 bp, homo sapien
tcaatgattcatcaagtcaattctaygtaggcttacttctaaatgtgaca

SEQ ID NO: 20898 - DNA, 50 bp, homo sapien
gcttcatctgctattaaatcctacayatacccaagagttgcactgatgta

SEQ ID NO: 20899 - DNA, 50 bp, homo sapien
attctgtgcagcaggtttgagaggcrcacttgacatccatcacccagcca

SEQ ID NO: 20900 - DNA, 50 bp, homo sapien
tacatttgctgtcatatttgctttarggatgttattgaggtcttgtccat

SEQ ID NO: 20901 - DNA, 50 bp, homo sapien
tgcagttagattttacatgcccaaakttaccaaaatgagagattattttt

SEQ ID NO: 20902 - DNA, 50 bp, homo sapien
ctggacttaactaaaaaagctaccaytcccttgataaattcacaatacag

SEQ ID NO: 20903 - DNA, 50 bp, homo sapien
ccaatctttgccatttcagtaaatcyacctagtgatccatgccatctccc

SEQ ID NO: 20904 - DNA, 50 bp, homo sapien
atgaaagggagtaacctgagagttayacaagaaagcccataatcatagtc

SEQ ID NO: 20905 - DNA, 50 bp, homo sapien
tgggttaaaaattaatatatctggayaatgggtatttggcttgaagtttt

SEQ ID NO: 20906 - DNA, 50 bp, homo sapien
caaaacttcctcttgagatgcaacartgggttttggaataggacatagga

SEQ ID NO: 20907 - DNA, 50 bp, homo sapien
ctatatgatatgaagcatttagttcsctttaccaacagctacagaaaatt

SEQ ID NO: 20908 - DNA, 50 bp, homo sapien
tgcaaatctgcacacaccctcggtaygacccttggcgcctgaccaccaga

SEQ ID NO: 20909 - DNA, 50 bp, homo sapien
agtttcccttattctggtatacttaygaattggtgatgaagccactacca

SEQ ID NO: 20910 - DNA, 50 bp, homo sapien
tgaaagccaacacttttaagagatayggtaagaattagataacaatggca

SEQ ID NO: 20911 - DNA, 50 bp, homo sapien
catgcagtcccgactgtccccatgaygcactcgtaggggtgaagatattc

SEQ ID NO: 20912 - DNA, 50 bp, homo sapien
taatattttataacaggtccaagagycaaatacagctaaatgtaaatttt

SEQ ID NO: 20913 - DNA, 50 bp, homo sapien
gtgctcacccagtatgaggatcataygaattggtggttggaaaagcattg

SEQ ID NO: 20914 - DNA, 50 bp, homo sapien
ggaaaatactgatgtggcatcaaagycatcttgaaaattttgaaagactg

SEQ ID NO: 20915 - DNA, 50 bp, homo sapien
atacgaattggtggttggaaaagcaytgaaatgtcactgactttgactgt

SEQ ID NO: 20916 - DNA, 50 bp, homo sapien
ctctagggatggagctagtgcagaayaaggtagttccttcagagccgaga

SEQ ID NO: 20917 - DNA, 50 bp, homo sapien
aaagctctacattaatccacaatacrgcaatttccaccgatgggaaggac

SEQ ID NO: 20918 - DNA, 50 bp, homo sapien
cagttcacttgtccactgtagctaartagatcatacaaaagggccaaatg

SEQ ID NO: 20919 - DNA, 50 bp, homo sapien
atttaaggaaggtgcctgtaaagaakcgatgtttgagtcaggatctaaag

SEQ ID NO: 20920 - DNA, 50 bp, homo sapien
aaaataatctggggagcttgctcacratgcaggtattcctggcctcaccc

SEQ ID NO: 20921 - DNA, 50 bp, homo sapien
gccaggaaagtgtggcaagaacagcrgctgaaaacaggaaggatttcgcc

SEQ ID NO: 20922 - DNA, 50 bp, homo sapien
acaggatagaagaattttttcccaarggttgagctcaatagcatgaactt

SEQ ID NO: 20923 - DNA, 50 bp, homo sapien
tcaaaaggacttcgccaaaaataackatacaagtgagaggatttctaaca

SEQ ID NO: 20924 - DNA, 50 bp, homo sapien
gaaaattacaagtcaatcttacttayaaacatacatactaaaatagatac

SEQ ID NO: 20925 - DNA, 32 bp, homo sapien
ctgactgcattttatarcattatgggataacc

SEQ ID NO: 20926 - DNA, 50 bp, homo sapien
atgactctatacaacctttctttgaygcacttgagcttttgtaataatcc

SEQ ID NO: 20927 - DNA, 50 bp, homo sapien
ccaaatgcagggccaaacgaatgaaygtgacaatgtggctctttaatagt

SEQ ID NO: 20928 - DNA, 50 bp, homo sapien
aagaaatcaaggcaatgagttaaatracatgctctataagtgacatctaa

SEQ ID NO: 20929 - DNA, 50 bp, homo sapien
ggcataggcaggacaatgttggaccrcagcccaagaaaggtctagagtcc

SEQ ID NO: 20930 - DNA, 50 bp, homo sapien
acaggcagacagaggtaggtttgaakacaggtctgatacttgttgtgtga

SEQ ID NO: 20931 - DNA, 50 bp, homo sapien
aacctacctctgtctgcctgtaaaaycattccttctctggatattcctcc

SEQ ID NO: 20932 - DNA, 50 bp, homo sapien
cagaatgtaaagaactccttcaatcycattttctccttttaagtgtccca

SEQ ID NO: 20933 - DNA, 50 bp, homo sapien
acttcaacattgacagccttggtaasgaagaacaaataacgtagtctgtg

SEQ ID NO: 20934 - DNA, 50 bp, homo sapien
accacgttttcactgggtccacaackgtcaatcctgaccctttcagtcta

SEQ ID NO: 20935 - DNA, 50 bp, homo sapien
gtcaggattgacagttgtggacccartgaaaacgtggtgacattaatcaa

SEQ ID NO: 20936 - DNA, 50 bp, homo sapien
agaggtcaaaatctacatttctgatmaggttcttagccagtgagtgagag

SEQ ID NO: 20937 - DNA, 50 bp, homo sapien
aggaatacttataagcctaaacataygaggaaaatagcaccagaaacaag

SEQ ID NO: 20938 - DNA, 50 bp, homo sapien
ggtaacagtttccctttaactgacaytgagaaagtatttccaaaaaacag

SEQ ID NO: 20939 - DNA, 50 bp, homo sapien
tttgcatagtttgacaaactataaaraagtagtcctatatattattaaat

SEQ ID NO: 20940 - DNA, 50 bp, homo sapien
aatactcctctttaccgctatatgaygggcccatgtgttgattatctatt

SEQ ID NO: 20941 - DNA, 50 bp, homo sapien
agtcaaacaaaactacaacaggtcartatctatgtgttaaagagtgattg

SEQ ID NO: 20942 - DNA, 50 bp, homo sapien
accttggtgatgttcttcttgtaaastatctcccaggtgttctctgcact

SEQ ID NO: 20943 - DNA, 50 bp, homo sapien
ctcggactcctcatcttgaccagagycattgtctttggttaaataaccaa

SEQ ID NO: 20944 - DNA, 50 bp, homo sapien
atcgaaagagactgatccaatccaayatctactttgttcaggactgcgat

SEQ ID NO: 20945 - DNA, 50 bp, homo sapien
attttctgtctgcagaatctcaaaastcccaggtaatttaggggcaatta

SEQ ID NO: 20946 - DNA, 50 bp, homo sapien
ggcaggggggataaaaattggccaascaagctgttcaactgcaatatcaa

SEQ ID NO: 20947 - DNA, 50 bp, homo sapien
ttaaagatcttctcattgtaggtaaytgctttatcagcacctgtcttctg

SEQ ID NO: 20948 - DNA, 50 bp, homo sapien
attttgccgctattcatatttaatawccatgtgccgctatacattctgtt

SEQ ID NO: 20949 - DNA, 50 bp, homo sapien
cctttttaataagagctctgccacartggaattcaaagcctgaagggcag

SEQ ID NO: 20950 - DNA, 50 bp, homo sapien
agaaaagaggaaagctctcaaataawcagactaactactgactctatgca

SEQ ID NO: 20951 - DNA, 50 bp, homo sapien
cactttggcaagctggctaggaagayatatgaactctgagaggcattttg

SEQ ID NO: 20952 - DNA, 50 bp, homo sapien
ttgggtaacacctatccaagggtatkaagcctcggaatctgggttattag

SEQ ID NO: 20953 - DNA, 50 bp, homo sapien
tttacttgcaatattctcttatcacyattttaatattcctggtgactatg

SEQ ID NO: 20954 - DNA, 50 bp, homo sapien
gcctctccaccctaattttgggtgaygcacttcctgcctataggaaagta

SEQ ID NO: 20955 - DNA, 50 bp, homo sapien
gaatccagtcctgctctactcatcamccttacaaaatgtagtactgtgcc

SEQ ID NO: 20956 - DNA, 50 bp, homo sapien
tgaagttaatagttttgtacctacartaatgaatctcaatgaataaatta

SEQ ID NO: 20957 - DNA, 50 bp, homo sapien
gtactcacgaagtagtgcagattagscatattgctcttcatatcatttgg

SEQ ID NO: 20958 - DNA, 50 bp, homo sapien
aaatttgtgtggatatttcataacartacagttttcctcctgtatgcttt

SEQ ID NO: 20959 - DNA, 50 bp, homo sapien
tgctttagagggatgttatgaatatyaaggaacaagtgattattaacctt

SEQ ID NO: 20960 - DNA, 50 bp, homo sapien
gagccagcagtctccccagtgctcaytcggatcgaaaggggtgtcagacc

SEQ ID NO: 20961 - DNA, 50 bp, homo sapien
aatagaaataaccaactctgaaatgyaatagcaaaaaaattacactcaaa

SEQ ID NO: 20962 - DNA, 50 bp, homo sapien
ggattttcacgtcttccttccactaytaatttctagttccattccatttt

SEQ ID NO: 20963 - DNA, 50 bp, homo sapien
acagctaatccaaatttgatgggaartaaggcataagctattccagaaac

SEQ ID NO: 20964 - DNA, 50 bp, homo sapien
gagacagcatgcaagaaagtctgctsaaatacgctaatgagtaggataga

SEQ ID NO: 20965 - DNA, 50 bp, homo sapien
tttatagctttgtcactaaattgaascactgaagtagaagattaagaaaa

SEQ ID NO: 20966 - DNA, 50 bp, homo sapien
aagttagtacaagagttaacatataygacaaagtacacatgaaatacaac

SEQ ID NO: 20967 - DNA, 50 bp, homo sapien
tcttgccaggaagttggagagattgragattattgttgttgtatttcatg

SEQ ID NO: 20968 - DNA, 50 bp, homo sapien
caccccagttccctgaattgatccasaatggtgagctatggcccttctag

SEQ ID NO: 20969 - DNA, 50 bp, homo sapien
actctgctctgcattttataccctgsatgtcactttgtttgctgagcttg

SEQ ID NO: 20970 - DNA, 50 bp, homo sapien
atgagaaaatatagttttcagttccwagaaaggtttgcttggtttatgtt

SEQ ID NO: 20971 - DNA, 50 bp, homo sapien
tgttctcacttcaaaacttttttcamggtatgtgcttttaggtgactccc

SEQ ID NO: 20972 - DNA, 50 bp, homo sapien
atttcccccaaattaacatagcaatraaacagtttgcagttattaatccc

SEQ ID NO: 20973 - DNA, 50 bp, homo sapien
agaggccaaggatgtatgcagggtayaggctggcaaaaaatgcttcctgg

SEQ ID NO: 20974 - DNA, 50 bp, homo sapien
tgcattcagctgcagagcaggtcccratgtctaccacgtgtgtccagggt

SEQ ID NO: 20975 - DNA, 50 bp, homo sapien
cggctgccctgtaggagctctgaaarccttgttcctcatcactccctccc

SEQ ID NO: 20976 - DNA, 50 bp, homo sapien
aagtttaatcttacattcctacaaartatataacagtgttttccaaagtt

SEQ ID NO: 20977 - DNA, 50 bp, homo sapien
aatgattcttcttgtttatcacttaycctgtctcattaagccacttacca

SEQ ID NO: 20978 - DNA, 50 bp, homo sapien
gtcaggatgcaatgataaatgctcartcttaagcaggacaaatcaagcct

SEQ ID NO: 20979 - DNA, 50 bp, homo sapien
aatttcatttgttttctttatttcaytcctctatggctgtggctacagct

SEQ ID NO: 20980 - DNA, 50 bp, homo sapien
aataactgtgacctgaattgagaatraaccaggctccaaaaaggcagttt

SEQ ID NO: 20981 - DNA, 50 bp, homo sapien
cagtgctcagttttgaaaaataggcraaaaagtgtaggagaaagctgaag

SEQ ID NO: 20982 - DNA, 50 bp, homo sapien
gatatgcaaatgtccaagtccctgartaaagccacctcgctcaactaaga

SEQ ID NO: 20983 - DNA, 50 bp, homo sapien
gctgtaaaatatttgagatgccatastacaattaaccatttccttttagt

SEQ ID NO: 20984 - DNA, 50 bp, homo sapien
ggcaagcaaagccatcactattttaygtgagaagaaacaaaacattaatc

SEQ ID NO: 20985 - DNA, 50 bp, homo sapien
gagagactggaattttatgttaaagrctgccccggtctacagaacagtag

SEQ ID NO: 20986 - DNA, 50 bp, homo sapien
cctctatagagacagttctgggagayaaaacacattcagggagaaaccca

SEQ ID NO: 20987 - DNA, 50 bp, homo sapien
tgtgacaatcatttaattatttaaargagaggagaatgctatttctaagt

SEQ ID NO: 20988 - DNA, 50 bp, homo sapien
aaattctttcacattttgtcatatawctaactgctgatcatcttctttct

SEQ ID NO: 20989 - DNA, 50 bp, homo sapien
taaagcaaattcattatcagcattaygtggttaaacatgcttattgtaat

SEQ ID NO: 20990 - DNA, 50 bp, homo sapien
ataaaatgaaatgagtggctataaayaaagatcatgaatgtattaattag

SEQ ID NO: 20991 - DNA, 50 bp, homo sapien
taggtgtcaataataataacgggaaratgtcacagtacctattggagaca

SEQ ID NO: 20992 - DNA, 50 bp, homo sapien
acccgacttgggtactgtcgcgatayggcagcactgaaaatatactacag

SEQ ID NO: 20993 - DNA, 50 bp, homo sapien
ataagtttctttatgccttatggcarccgccctgttttacaagtttctac

SEQ ID NO: 20994 - DNA, 50 bp, homo sapien
atttccaaattataatctcacaaaamaactgtggaaagtataaactttta

SEQ ID NO: 20995 - DNA, 50 bp, homo sapien
tttttcttttccctgttcctacttayattacatgtgctcctccctgagct

SEQ ID NO: 20996 - DNA, 50 bp, homo sapien
tgaatatttaacttgcatttatatayctaatgtaagttaaaatatatttt

SEQ ID NO: 20997 - DNA, 50 bp, homo sapien
ctacttctatttcatatcacaatacwcttttgaaagttgaatcatatagt

SEQ ID NO: 20998 - DNA, 50 bp, homo sapien
tcactcaccttaaactgagaaacacracctaagtctagaaaagctgcagg

SEQ ID NO: 20999 - DNA, 50 bp, homo sapien
tacttaaaggagatcctgagttttakctagaaatgttttcagttttatgt

SEQ ID NO: 21000 - DNA, 50 bp, homo sapien
acaaacctatatatagatccctgaayttaaaatgaaagttaaaaagaaat

SEQ ID NO: 21001 - DNA, 50 bp, homo sapien
ttcaatggtcattacagctagagaakagagagtatttgcaaccctgggaa

SEQ ID NO: 21002 - DNA, 50 bp, homo sapien
agatgccaaagttatggacaaacaaygaaaatatttagataatttgggtg

SEQ ID NO: 21003 - DNA, 50 bp, homo sapien
ttaacaaaaattaggttaattctgayacaggtcgtccatacactattttt

SEQ ID NO: 21004 - DNA, 50 bp, homo sapien
accaaaaccttgtctaagcataagcraaaacaggggaagattcagtaaat

SEQ ID NO: 21005 - DNA, 50 bp, homo sapien
gttgttaacttttcaacacagtgacmgaatgaaaagagcaggttgtatta

SEQ ID NO: 21006 - DNA, 50 bp, homo sapien
ttcagctagctgggaaacaggataasctcactgcaatttctcccttagct

SEQ ID NO: 21007 - DNA, 50 bp, homo sapien
ggatagaatagaaatattttcatgaygtaattttaatactatctagcatt

SEQ ID NO: 21008 - DNA, 50 bp, homo sapien
cttcctcctttgtgtctcaagattcyaaaccaaaagaccacaagggcacg

SEQ ID NO: 21009 - DNA, 50 bp, homo sapien
ccagactctcataaatctgaagataragttgaaatcatagaaaaactaag

SEQ ID NO: 21010 - DNA, 50 bp, homo sapien
aggttacagatggctctaggataaargacaaatgtacctctaaagccgag

SEQ ID NO: 21011 - DNA, 50 bp, homo sapien
ttttcagcttgtttatggtgaatccwattatgaaatgtcacacaagtgca

SEQ ID NO: 21012 - DNA, 50 bp, homo sapien
gactaagttctcaaaaggaaatacamcgagaacaaaaatagaaaaatgag

SEQ ID NO: 21013 - DNA, 50 bp, homo sapien
gtggctggctgttgtatgcaatatcyagttaacaatgtcaggaattaaag

SEQ ID NO: 21014 - DNA, 50 bp, homo sapien
tccatatttcctcaagagtactatasgtggtgtaaatatctgctgagtca

SEQ ID NO: 21015 - DNA, 50 bp, homo sapien
actttcttaaaataagtaattctccrgcatataactgcaaacaaaattct

SEQ ID NO: 21016 - DNA, 50 bp, homo sapien
ggaattcacagaatgaaacaacatayctacgtagctagcaagtggtaaag

SEQ ID NO: 21017 - DNA, 50 bp, homo sapien
gtgcaataaaacaatcgttcgtatayataattacctttggatacctgaaa

SEQ ID NO: 21018 - DNA, 50 bp, homo sapien
tagactcctcgtcgtctaagccatgyattccctgaagtctggggcttccc

SEQ ID NO: 21019 - DNA, 50 bp, homo sapien
ccaaaattacagttagttgatattcmcaaattctatagagctattatgtg

SEQ ID NO: 21020 - DNA, 50 bp, homo sapien
cagggtcttcaatatagcactcggtyaaaagaaagaaaatattgaatgaa

SEQ ID NO: 21021 - DNA, 50 bp, homo sapien
ttatgaattttttctagagttatccygatttcttttttgccatctgtttc

SEQ ID NO: 21022 - DNA, 50 bp, homo sapien
attgctactactcctatgaaggttaygttttgccatcactggggtctggg

SEQ ID NO: 21023 - DNA, 50 bp, homo sapien
ctgtgtggggagggagatcttgttgsattaagttctaagcaattcctatg

SEQ ID NO: 21024 - DNA, 50 bp, homo sapien
ccaacaaagtatctgagcttatgaartgactacaaatggaaacggcttag

SEQ ID NO: 21025 - DNA, 50 bp, homo sapien
cttatgaagtgactacaaatggaaayggcttagagaatgtgttcttttgt

SEQ ID NO: 21026 - DNA, 50 bp, homo sapien
atatttgatatgtgtaaataaaaccratttaagatcatgattaaactctg

SEQ ID NO: 21027 - DNA, 50 bp, homo sapien
tgcatggagtaggtgctttgggatargaacaaagaaatcaggctggattg

SEQ ID NO: 21028 - DNA, 50 bp, homo sapien
tatttgcctgaggatcttagtttagragtgaacgtctcaaacatttcatg

SEQ ID NO: 21029 - DNA, 50 bp, homo sapien
gaatgatagcaccactagcaccaacraaggctataggtttccctgatcat

SEQ ID NO: 21030 - DNA, 50 bp, homo sapien
ttttgccaaatctgactttgactacrggcttcccttttgtctccatctcc

SEQ ID NO: 21031 - DNA, 50 bp, homo sapien
caacaatacaccagatcaagcaaatkaaagaatttcagaactagaaaacc

SEQ ID NO: 21032 - DNA, 50 bp, homo sapien
ctctcatttatgaagaatgactttgsagcgtaccatatccttagctggta

SEQ ID NO: 21033 - DNA, 50 bp, homo sapien
aattataaccactcttcttggactcsagctatttcacttgaaatccatta

SEQ ID NO: 21034 - DNA, 50 bp, homo sapien
tgcatcattcgtaacttctgcatacrattataaatatgaaaaaaattaac

SEQ ID NO: 21035 - DNA, 50 bp, homo sapien
tgcttgtaaactgaaaagctgaaaaygcttttaaatatattacaaaagaa

SEQ ID NO: 21036 - DNA, 50 bp, homo sapien
actgctagcccaatattgattgaaayaagagttgattgcatggactaaca

SEQ ID NO: 21037 - DNA, 50 bp, homo sapien
agcttctaggactcttataaaaaackaatgtattcataatatattcatat

SEQ ID NO: 21038 - DNA, 50 bp, homo sapien
cttacctggtttcacaagctacaagmctagaaagaattcttaactatccc

SEQ ID NO: 21039 - DNA, 50 bp, homo sapien
aggaaaagcagacacccttacatatraacatttccttaaagaagtaagtt

SEQ ID NO: 21040 - DNA, 50 bp, homo sapien
ttagagagatgtaaggttctcactasgttgctataaatcagctttactaa

SEQ ID NO: 21041 - DNA, 50 bp, homo sapien
catgcatatttgttgaaccttctacyatcctctttgttattaattgaaga

SEQ ID NO: 21042 - DNA, 50 bp, homo sapien
atacttgtctccatgtttctaaatawgaatgacttgtatatcttatctac

SEQ ID NO: 21043 - DNA, 50 bp, homo sapien
tctagagactgtcccaggatcaatcsatatttagcccaatttcctgcaac

SEQ ID NO: 21044 - DNA, 50 bp, homo sapien
caatggtaagggctgtgtgccaagaygtaactttctaaagagagaaaaac

SEQ ID NO: 21045 - DNA, 50 bp, homo sapien
ttccttagtaattacagtatagtgarcataattgcatttttgatgattaa

SEQ ID NO: 21046 - DNA, 50 bp, homo sapien
gtcatttgtaatattactgagaacaktctctgcttaggccattgaccaca

SEQ ID NO: 21047 - DNA, 50 bp, homo sapien
aagtgtgattgaatactctatgccaytagacaggattgttcattgatgag

SEQ ID NO: 21048 - DNA, 50 bp, homo sapien
aaaaaaaaagttccagagatgagtaracagaattatttcattttgatatt

SEQ ID NO: 21049 - DNA, 50 bp, homo sapien
agttaaatccagtttgtataggggayctattttcagtcatctctcaggta

SEQ ID NO: 21050 - DNA, 50 bp, homo sapien
catagtcatttaaataaatggtagtsactaataattgagtatcttcctgt

SEQ ID NO: 21051 - DNA, 50 bp, homo sapien
tggttttgatgatttggatactatcygaacctagtcttggtattccactc

SEQ ID NO: 21052 - DNA, 50 bp, homo sapien
aacagcacattaactacagctactaygattaataagaagactgaaatcag

SEQ ID NO: 21053 - DNA, 50 bp, homo sapien
cttgaactgtcaatggctaatttagkcactacttttgtgagctaaatttc

SEQ ID NO: 21054 - DNA, 50 bp, homo sapien
ctgcaggcctagtaacttgcttaccyagtcggatacagcagaaatgatgt

SEQ ID NO: 21055 - DNA, 50 bp, homo sapien
tccatctccttgggagtgatgcttayagcttagggctccgttcaggcttc

SEQ ID NO: 21056 - DNA, 50 bp, homo sapien
ttagaggttgaagtcagactggcaayagtaaatacctaattattgccagg

SEQ ID NO: 21057 - DNA, 50 bp, homo sapien
cttatttagcattttcctgaaattaygaaaagctatagcaaatagtggaa

SEQ ID NO: 21058 - DNA, 50 bp, homo sapien
cccactgagatctacccgacaagcaygtaattaatgtgacaaacaacagc

SEQ ID NO: 21059 - DNA, 50 bp, homo sapien
tttgtaaattaaactgcaggctctcrattttagttttttaagttactagc

SEQ ID NO: 21060 - DNA, 50 bp, homo sapien
gctttgactctgtgttctagggaaayttatctaaatgagaaaaggaaaat

SEQ ID NO: 21061 - DNA, 50 bp, homo sapien
agcagtgagttagccctggctgaaamtttatgtagtcatattctttcctt

SEQ ID NO: 21062 - DNA, 50 bp, homo sapien
ggcagggaaacctttccaccgaagasagttggtcatgctagataatatac

SEQ ID NO: 21063 - DNA, 50 bp, homo sapien
ctgagcacttcctgtccttcctgacygtaagatgttctcaaccagtcctg

SEQ ID NO: 21064 - DNA, 50 bp, homo sapien
tggttgatggattcatagtctcacamggctgtaaacaataaggtctagga

SEQ ID NO: 21065 - DNA, 50 bp, homo sapien
aatgtcaaatgagtttatttcaaatwattcacaagtctaagacattactt

SEQ ID NO: 21066 - DNA, 50 bp, homo sapien
gcatgatgtacatagaataagaagaygtaaaaatatttcttttgtctatg

SEQ ID NO: 21067 - DNA, 50 bp, homo sapien
aattataatatagtcctcagtcttamagtgattagagcttactgaccagc

SEQ ID NO: 21068 - DNA, 50 bp, homo sapien
cacatgcttcttggaatgaaacaaartcttaaaattggatattttgtggt

SEQ ID NO: 21069 - DNA, 50 bp, homo sapien
tttgaagaacagagaatgttttcacsaattcacaactctggatagataga

SEQ ID NO: 21070 - DNA, 50 bp, homo sapien
attgagctttcaccagaatttacagwctgcagagtttaaagattatcatt

SEQ ID NO: 21071 - DNA, 50 bp, homo sapien
actgagaaagcaaaggaaggcgatawctgaaacaagaaatgatatgatta

SEQ ID NO: 21072 - DNA, 50 bp, homo sapien
aaaaccatatagcaagcacagatacmaatgacagcattgcaaagccttat

SEQ ID NO: 21073 - DNA, 50 bp, homo sapien
tgttgcctctctttttaactgggcgmaattatacttaatcactcaaatcc

SEQ ID NO: 21074 - DNA, 50 bp, homo sapien
acatttctcatctcactatcgaccayggtaggaattctgttgttccagct

SEQ ID NO: 21075 - DNA, 50 bp, homo sapien
gtagtatttataaactcagctgtaayagaagaaatgataagtatgatatt

SEQ ID NO: 21076 - DNA, 50 bp, homo sapien
tctaagtcagcggaagttccagaaayggtcaataatatttttgctggaag

SEQ ID NO: 21077 - DNA, 50 bp, homo sapien
cattctcaagcttcaagatgagatcraggagccatagtgtgcattttcct

SEQ ID NO: 21078 - DNA, 50 bp, homo sapien
gaagctcttctattagttacattgckatacagtctaattttttatgttgg

SEQ ID NO: 21079 - DNA, 50 bp, homo sapien
ccgaagatgccttgcaggtgagtaaygtaaaccaactgttgaaggagcac

SEQ ID NO: 21080 - DNA, 50 bp, homo sapien
tgaagacctggaaatgctcttttcartatgtgttgacattttctctctca

SEQ ID NO: 21081 - DNA, 50 bp, homo sapien
gctgaaatgatattagatttagtgargtgagccgtatatcacaagtactc

SEQ ID NO: 21082 - DNA, 50 bp, homo sapien
ttctttctctcctgacaatataacamctgatgaagaatgaaatccaaatc

SEQ ID NO: 21083 - DNA, 50 bp, homo sapien
aggaacttcctattattagtcttcgyataatttgacagaaccctcaatct

SEQ ID NO: 21084 - DNA, 50 bp, homo sapien
tgaaaattggcaccttgataatctayagaactaaggacatcagcatttat

SEQ ID NO: 21085 - DNA, 50 bp, homo sapien
cagcctctccttgggtgcccgctaastctacattggttcatagataccaa

SEQ ID NO: 21086 - DNA, 50 bp, homo sapien
acacattggccttgggaattaatcaygccagaataatcacttttccccat

SEQ ID NO: 21087 - DNA, 50 bp, homo sapien
ccaagtttcaaggaacctaccaaagwcaattttccaggtttttggatgag

SEQ ID NO: 21088 - DNA, 50 bp, homo sapien
aagctcaattttattacttcgtttarattaatgcaacatttgggggcaga

SEQ ID NO: 21089 - DNA, 50 bp, homo sapien
ctacccattaacactgctatcggtaygaggatcactgtctgctcaagtag

SEQ ID NO: 21090 - DNA, 50 bp, homo sapien
gagtaaatgacctatctgagcagtarcatcttcgattctttgatctgggg

SEQ ID NO: 21091 - DNA, 50 bp, homo sapien
ttattttcaaactaaacatattcaawttaaaggatatgaggaaagaaaaa

SEQ ID NO: 21092 - DNA, 50 bp, homo sapien
gagattttacttggaccaagtttgargattataactcagaagcacatatt

SEQ ID NO: 21093 - DNA, 50 bp, homo sapien
ccactctcatagtacctcagctgatyaaggggattctgcttgaaaacttc

SEQ ID NO: 21094 - DNA, 50 bp, homo sapien
cattgctacaaattttaaaagtacasgaaagtatcaaagataacacaagc

SEQ ID NO: 21095 - DNA, 50 bp, homo sapien
tttattcttgtcttctgtgtgattcragcatattcacgttaaagtcaacg

SEQ ID NO: 21096 - DNA, 50 bp, homo sapien
gccacagtatacatcttcttttaackctgtagaatatgtaaaattttgat

SEQ ID NO: 21097 - DNA, 50 bp, homo sapien
gtgttttctccatgatcatagaacaraggtggttaaaacactcaaccacc

SEQ ID NO: 21098 - DNA, 50 bp, homo sapien
ggtagcttgatttatgaccattacaytgaaatttcccagtattatttctc

SEQ ID NO: 21099 - DNA, 50 bp, homo sapien
tgatagagtggatgtggaaggatacraaaacagagataaaggatgactcc

SEQ ID NO: 21100 - DNA, 50 bp, homo sapien
tttaattctttttagagatttttaaytgggtaatactacatagcaaacac

SEQ ID NO: 21101 - DNA, 50 bp, homo sapien
ttcaccagcttgttctcagcttaaayctggagtcatcctttatctctgtt

SEQ ID NO: 21102 - DNA, 50 bp, homo sapien
caggaatcaaccaggaacctttagcmgaattgacaatatggtgttgataa

SEQ ID NO: 21103 - DNA, 50 bp, homo sapien
agcactgagtcattgcctcttctaarcaaccatttatctagaaacaactc

SEQ ID NO: 21104 - DNA, 50 bp, homo sapien
agcagggaagagaaagtattgcaaargatagccgttacagtcggaacaga

SEQ ID NO: 21105 - DNA, 50 bp, homo sapien
agcagcactgtagaccttaatttaaratcattagcaagcaggctgaacta

SEQ ID NO: 21106 - DNA, 50 bp, homo sapien
aacctcatagtgagaaatatctacaktagtgcaaaggattgtgtatgata

SEQ ID NO: 21107 - DNA, 50 bp, homo sapien
tgcagcagaggtggagagggaattasatacctgaatttacaaatggatgg

SEQ ID NO: 21108 - DNA, 50 bp, homo sapien
aaatgagtagcctgcagtcccagatwaggtcagagttaagtcaacctgag

SEQ ID NO: 21109 - DNA, 50 bp, homo sapien
ccttacaccacctaagtatgccaaartctccttattgattgtccacaatt

SEQ ID NO: 21110 - DNA, 50 bp, homo sapien
aaaaactgaatgcgattcaggagaargttttaaaatatgtctatgagcat

SEQ ID NO: 21111 - DNA, 50 bp, homo sapien
cagaatcatttgataaaatcttttamcaaacacagaatcctatactgttt

SEQ ID NO: 21112 - DNA, 50 bp, homo sapien
aggctaagatctatgcttatgaacaytataatcctgtagctatctcattt

SEQ ID NO: 21113 - DNA, 50 bp, homo sapien
agatctgtcccactgctgatgctaartacgtcaaaactaagtcttattct

SEQ ID NO: 21114 - DNA, 50 bp, homo sapien
taaatggcaagggtcagcagtttgaratctacctggaacacaagcagcac

SEQ ID NO: 21115 - DNA, 50 bp, homo sapien
taattggtaatatttggagataatasagttgacctacaataattgtttga

SEQ ID NO: 21116 - DNA, 50 bp, homo sapien
aagaggcttttgctgggaggcctctraaactacattcaacactgacataa

SEQ ID NO: 21117 - DNA, 50 bp, homo sapien
ttttggacatctgggaataaactctsaatgtaaacaaaaagaatgcagtt

SEQ ID NO: 21118 - DNA, 50 bp, homo sapien
agtgtgggactcaccctaaggaaaamatatgcagaatactcctcaaaagc

SEQ ID NO: 21119 - DNA, 50 bp, homo sapien
atgttggcctttgctctgtgcaagasaattataccagctccaaggtaaga

SEQ ID NO: 21120 - DNA, 50 bp, homo sapien
tcatcatgctcacctttagatcaacragtggcaatctatgttctatctgt

SEQ ID NO: 21121 - DNA, 50 bp, homo sapien
atagtatgttctctagtgaacaaaamttgggtagcagaagatggatagat

SEQ ID NO: 21122 - DNA, 50 bp, homo sapien
tcttctcctccactatatatgtcatratacacactaatattcagaccaca

SEQ ID NO: 21123 - DNA, 50 bp, homo sapien
tttctttattgaaaactgagggtackaatgctgactgtcttacgtgcctg

SEQ ID NO: 21124 - DNA, 50 bp, homo sapien
gatagacactatgctgtgcattagawcttgcataagtgacattttgtaca

SEQ ID NO: 21125 - DNA, 50 bp, homo sapien
agtttcattggaatgtattcccaccrgaagttgaggaccatctgtcatga

SEQ ID NO: 21126 - DNA, 50 bp, homo sapien
ttttgttaattgccgaaaagtgatcratgactaaggtacatgaatagtca

SEQ ID NO: 21127 - DNA, 50 bp, homo sapien
tttgtgatactggtgacaaggcagarcgtggagaataccattctagtagt

SEQ ID NO: 21128 - DNA, 50 bp, homo sapien
taataatatatagatcatctttgaawccttagaccttaattttaattgtg

SEQ ID NO: 21129 - DNA, 50 bp, homo sapien
cttttgggtttactctttcctttagratcaattctgataaattgtattcg

SEQ ID NO: 21130 - DNA, 50 bp, homo sapien
gagagtcatggggtaatgtttttacratgtttcctgccagcacacgttat

SEQ ID NO: 21131 - DNA, 50 bp, homo sapien
tattgaagaatggagaaaaatgaacyattgtggatgttggggggagtata

SEQ ID NO: 21132 - DNA, 50 bp, homo sapien
ttcaaatattgtattcaatgatcagrctatcaacctaattaatggtaagg

SEQ ID NO: 21133 - DNA, 50 bp, homo sapien
actttgtacatttgactaagtaacaytccttgtatgctatcctgtaatgt

SEQ ID NO: 21134 - DNA, 50 bp, homo sapien
tttattacattgatcacataaactaygcttcctaggcttctctcctttaa

SEQ ID NO: 21135 - DNA, 50 bp, homo sapien
aaataccaagatacagggctaaccaytaatactatatctgtgttaaatat

SEQ ID NO: 21136 - DNA, 50 bp, homo sapien
cagaggccaacattctgatggttgaracagatgactgataggtaattatc

SEQ ID NO: 21137 - DNA, 50 bp, homo sapien
aaaggtgcataagatttagagaaaasttaagatgagaaaaaaaagagaag

SEQ ID NO: 21138 - DNA, 50 bp, homo sapien
agcatcttcctcagaggccttcatgyatcgctcctaacatctacctccca

SEQ ID NO: 21139 - DNA, 50 bp, homo sapien
cttctttgtttctactacataaacawaatcgcttcctccacagctctatc

SEQ ID NO: 21140 - DNA, 50 bp, homo sapien
ttataggtggacttaaaataatcaakcaaatatataaacttcagaccaat

SEQ ID NO: 21141 - DNA, 50 bp, homo sapien
taagaaactagataggaggagaaaartgaatatgaatacatagcccctag

SEQ ID NO: 21142 - DNA, 50 bp, homo sapien
ccttattcttcagttacaggttacayagaggagtttgagaactgcctgac

SEQ ID NO: 21143 - DNA, 50 bp, homo sapien
ttgtaaactgtaaagcagaatctaamtaaatatgaagtctcaagagccat

SEQ ID NO: 21144 - DNA, 50 bp, homo sapien
aagtattatgaagatttttagttaayccaagatgtactttctagctctgt

SEQ ID NO: 21145 - DNA, 50 bp, homo sapien
atgatagagtttgaggaaaaatagaytaagtacgtacaagttataaggac

SEQ ID NO: 21146 - DNA, 50 bp, homo sapien
aaaattacataccaaacctttttcaraatttacaatctagagccaggcta

SEQ ID NO: 21147 - DNA, 50 bp, homo sapien
ctattcaatcagtgggctactcagasaaatatcatcatagttttcataca

SEQ ID NO: 21148 - DNA, 50 bp, homo sapien
tgtaatagtctaaaagaaggaagtcraagtgagaaaaaaacatagaccat

SEQ ID NO: 21149 - DNA, 50 bp, homo sapien
ttatgtctgccttagaatggattcastacacttttaagtgcgtttgtatg

SEQ ID NO: 21150 - DNA, 50 bp, homo sapien
aagcaacttttatctgagatgatgaytactcgaatacttcttttgcatat

SEQ ID NO: 21151 - DNA, 50 bp, homo sapien
ggaagcttggagtttcctcccggtcractatagctgttatgttaatatct

SEQ ID NO: 21152 - DNA, 50 bp, homo sapien
tagttgacctctctgaacctgtcggraaagttgtgaatctccttcacatt

SEQ ID NO: 21153 - DNA, 50 bp, homo sapien
gaaaggagaaaagtccccattagaasgtgaagacccagaaaaacctttca

SEQ ID NO: 21154 - DNA, 50 bp, homo sapien
agtgaatcccttgcaaaactggaaaygttaaaaatgtatcaggcccaaga

SEQ ID NO: 21155 - DNA, 50 bp, homo sapien
gcaggtgcatttctggtggtctttaygtgaagactattgttgaaacaagg

SEQ ID NO: 21156 - DNA, 50 bp, homo sapien
acaaggggaatcatgggttgtctcawgtaacaaggctttagaaaggactt

SEQ ID NO: 21157 - DNA, 50 bp, homo sapien
acattacggcaggaaggaaaagtgcmaaggaatgagggaacagcccctta

SEQ ID NO: 21158 - DNA, 50 bp, homo sapien
tgagtttactaagggctcttcttacyacatttatcgtgaagcctaaaaca

SEQ ID NO: 21159 - DNA, 50 bp, homo sapien
tgcaagatttgtctaggaaattaaaygtatgttagagacactgaccaaga

SEQ ID NO: 21160 - DNA, 50 bp, homo sapien
tggaactgctcagctggtctgtaaayatgtgcgaaataaagttttttaag

SEQ ID NO: 21161 - DNA, 50 bp, homo sapien
tacatttacatgtgcaataaactaarctatataacatgtaactctaaaac

SEQ ID NO: 21162 - DNA, 50 bp, homo sapien
ttccactcatgcattgttcactcaamaaatatttccataggcttgacact

SEQ ID NO: 21163 - DNA, 50 bp, homo sapien
aacctaatccaaagaaaagacctaastgtcctcaattttgtgaaggctga

SEQ ID NO: 21164 - DNA, 50 bp, homo sapien
catagataagaaatccggtggctackgaaaaacatcaaggatggcttgtg

SEQ ID NO: 21165 - DNA, 50 bp, homo sapien
ataaataaccaactataaagctatcractaacaaatgcttgtccttttat

SEQ ID NO: 21166 - DNA, 50 bp, homo sapien
cttttgatccataaggaaggtgacgkattatgttgcaaatgatacatttt

SEQ ID NO: 21167 - DNA, 50 bp, homo sapien
gttagaattggcttgtataaatgacrggtagaaccatcttatatagcttt

SEQ ID NO: 21168 - DNA, 50 bp, homo sapien
tagagtatgggaccagattgagaacraagttgaagatttccatccgatgt

SEQ ID NO: 21169 - DNA, 50 bp, homo sapien
agttgggtagaacatgaactgtagartaaaattggtgaaagggaatcaga

SEQ ID NO: 21170 - DNA, 50 bp, homo sapien
caaagatatcctatttaagaaacagraaacacttacattgcacattatca

SEQ ID NO: 21171 - DNA, 50 bp, homo sapien
cataagcatctcaaagtcacacatcsgatggaaatcttcaactttgttct

SEQ ID NO: 21172 - DNA, 50 bp, homo sapien
catccctccaggtatcgtatcatcayggccacatcaaagcaggtagggta

SEQ ID NO: 21173 - DNA, 50 bp, homo sapien
gaaagtggttttgcaagtgtaacaaytgatttaaaaagagcaagtatgca

SEQ ID NO: 21174 - DNA, 50 bp, homo sapien
agccaggacgaaaacattcgacaagmaacagccaaaaaatccagaggaag

SEQ ID NO: 21175 - DNA, 50 bp, homo sapien
accaataagctatgcaaagcaataaycttcctttccttttgtctaatctg

SEQ ID NO: 21176 - DNA, 50 bp, homo sapien
gaaatatataatccatgtgaagagayagccgtaaggaaaggtaatacatt

SEQ ID NO: 21177 - DNA, 50 bp, homo sapien
taagcatctgagataaactccagccrcgtttggcttctatttttaaattc

SEQ ID NO: 21178 - DNA, 50 bp, homo sapien
aggatctaaagagaatctaaaaatarcatcgatttgaagtaaatatcatc

SEQ ID NO: 21179 - DNA, 50 bp, homo sapien
ggaatctaccaaaaccagacttagaraaggaaggccagtttggaagttac

SEQ ID NO: 21180 - DNA, 50 bp, homo sapien
acttcatggagcatagagggcaccaytaaatgatcaattgctttaacagg

SEQ ID NO: 21181 - DNA, 50 bp, homo sapien
tgaacttaaaatacagtatttagtcyataagaaattgaagtatgcaagta

SEQ ID NO: 21182 - DNA, 50 bp, homo sapien
cactacattataatgaagttctcacygtattattacattaaagtcaaaga

SEQ ID NO: 21183 - DNA, 50 bp, homo sapien
caggggcctttagttatgatgacaasaggtccaagtattcccagtctcag

SEQ ID NO: 21184 - DNA, 50 bp, homo sapien
gtggcagataaatcctacttggggaygcactataagaaatggaagaaatc

SEQ ID NO: 21185 - DNA, 50 bp, homo sapien
gataaggtgaaataatatgaacaaaktgggtaatacagaaagtgaaatct

SEQ ID NO: 21186 - DNA, 50 bp, homo sapien
ttgggcacacctttggtaacatcaamcctttggaaaagttggtaaataaa

SEQ ID NO: 21187 - DNA, 50 bp, homo sapien
tagagtcaagaatagatacatcaccrataattccactgccataacccact

SEQ ID NO: 21188 - DNA, 50 bp, homo sapien
gtgcaattaatatcattattgagaawttccctagttgcttctctcttttg

SEQ ID NO: 21189 - DNA, 50 bp, homo sapien
tcagtaatctcctgttactattgaayctttatgggacctactttaaaatg

SEQ ID NO: 21190 - DNA, 50 bp, homo sapien
atgtgctctttatttgccatgatagwaataattattgttattatagcaaa

SEQ ID NO: 21191 - DNA, 50 bp, homo sapien
catgggttaattattttatctctaamacacgttaaaatataacaatacct

SEQ ID NO: 21192 - DNA, 50 bp, homo sapien
cttctggatgttacattggccagaayttagatacacacagtgaaggctga

SEQ ID NO: 21193 - DNA, 50 bp, homo sapien
aatttaataaatatgtgttaattgcygaccattttactaagcattatgga

SEQ ID NO: 21194 - DNA, 50 bp, homo sapien
aatgtgattgccagtattctgggcaygattatgaaagtcactgagaataa

SEQ ID NO: 21195 - DNA, 50 bp, homo sapien
tctaaaactgcatggttcacttagayatttctagacaaggtctccaaaac

SEQ ID NO: 21196 - DNA, 50 bp, homo sapien
attgcaaggcttctgcggaacacaartgtggattttagctcaaattgcac

SEQ ID NO: 21197 - DNA, 50 bp, homo sapien
agtttgaaaagccaagtgataaaagraacaattttaagattatcaaatga

SEQ ID NO: 21198 - DNA, 50 bp, homo sapien
tgggtgttcatttctagttttaacgmaattgaatgaaaattacttcctaa

SEQ ID NO: 21199 - DNA, 50 bp, homo sapien
gtaaatgtataattacctgaagtaayggaatatgtgcatttgtacataaa

SEQ ID NO: 21200 - DNA, 50 bp, homo sapien
ctttcaatgacgcatgacccttcgaygtgaaacctttgccttagtctata

SEQ ID NO: 21201 - DNA, 50 bp, homo sapien
ggtaaataggcccacattatttgtayatgaaagagaaaatctgggctgag

SEQ ID NO: 21202 - DNA, 50 bp, homo sapien
attttttaatgactaatcctcctgayatgagttcaagaagaaatagggta

SEQ ID NO: 21203 - DNA, 50 bp, homo sapien
attgaaagcttctgtgtagtacaatragctgtacatcacatctactcata

SEQ ID NO: 21204 - DNA, 50 bp, homo sapien
aagaaagtaaatggctttatgttcasaattatataaagaaaataaaatca

SEQ ID NO: 21205 - DNA, 50 bp, homo sapien
atgaggatatactccggataactgcsagtgtgttaggttgaaatgctttc

SEQ ID NO: 21206 - DNA, 50 bp, homo sapien
gtctacagaagttcaagattcctgtraacacagatttccacaaaaacata

SEQ ID NO: 21207 - DNA, 50 bp, homo sapien
attcctaatcagaattgctgttctayaaccaaatgaagctgcctcagttg

SEQ ID NO: 21208 - DNA, 50 bp, homo sapien
atatcattcatagtgacaaatatacwcaagaactatcagggacaaatttg

SEQ ID NO: 21209 - DNA, 50 bp, homo sapien
cagcaactgtaaatttttgcagaaaytatttgaagtgctgcattttgtgc

SEQ ID NO: 21210 - DNA, 50 bp, homo sapien
tccctgttgttcacattcgttcaaayaagaatactacaatgtataaagaa

SEQ ID NO: 21211 - DNA, 50 bp, homo sapien
caacaagtatttcctgtgtgccagaygttctgtaaaatacagagataaga

SEQ ID NO: 21212 - DNA, 50 bp, homo sapien
gggagctgtatctccttggtaaacaytaaagttccaactcactagtcaaa

SEQ ID NO: 21213 - DNA, 50 bp, homo sapien
attcagcacatacttttcattcatayactatcaggaccacactaggtact

SEQ ID NO: 21214 - DNA, 50 bp, homo sapien
acccaaagcccttgattaggatagasagtgaaaaccattaagcactaccg

SEQ ID NO: 21215 - DNA, 50 bp, homo sapien
ttgctttcaacttcataaactaacastgagaaggcaatgcaaacccttgg

SEQ ID NO: 21216 - DNA, 50 bp, homo sapien
ggggattttaaactttattattaccraaatactcacatactcaacttttt

SEQ ID NO: 21217 - DNA, 50 bp, homo sapien
caccacattttcaggggccaaaaaayttagcaggaacttacaacaaactt

SEQ ID NO: 21218 - DNA, 50 bp, homo sapien
atctggggagaattttgaaaataggkactcctcatcttcaccatcagttc

SEQ ID NO: 21219 - DNA, 50 bp, homo sapien
agtgaattttttatcttcgagaacartacttttcatatgctttcttagtt

SEQ ID NO: 21220 - DNA, 50 bp, homo sapien
aaagaccacttattattgtcatctawcattgttctggaaatgtcacattg

SEQ ID NO: 21221 - DNA, 50 bp, homo sapien
actacatttcgaagacaagtcaggckgatttctagattaaattcccctgt

SEQ ID NO: 21222 - DNA, 50 bp, homo sapien
agatttagatatagaaccatagtaargattgaaaattgcaaaatcaatat

SEQ ID NO: 21223 - DNA, 50 bp, homo sapien
ccatcctttacctatttataggatamctgtccatggattatcaataatct

SEQ ID NO: 21224 - DNA, 50 bp, homo sapien
ctttatccattcatccgcttatggamacttagctccaacctcagtttttt

SEQ ID NO: 21225 - DNA, 50 bp, homo sapien
tatttactactaccaggatgaaattmaaatcattcaatgtgtagccctaa

SEQ ID NO: 21226 - DNA, 50 bp, homo sapien
tctcaagtctgagaaccgggaaccaytgaattctgatataagttttccta

SEQ ID NO: 21227 - DNA, 50 bp, homo sapien
accgtgcaaaagttctgatattctaygcctagctgccctcttctatggat

SEQ ID NO: 21228 - DNA, 50 bp, homo sapien
taaataaaacatggagattacaacasagatcattgctttatgccacatga

SEQ ID NO: 21229 - DNA, 50 bp, homo sapien
acagggacatctcatctaatataacygcaaaatccgaaaaagatcaaact

SEQ ID NO: 21230 - DNA, 50 bp, homo sapien
gaaaacttcagatatttataattgasgcgaacaagtaaaaagggaaggag

SEQ ID NO: 21231 - DNA, 50 bp, homo sapien
attatgtcaaataacaaatacgctargcagttagtagaagggaagaaatc

SEQ ID NO: 21232 - DNA, 50 bp, homo sapien
atcaggggaaaaatctaaattcttarcatcacatgaagggacttaataat

SEQ ID NO: 21233 - DNA, 50 bp, homo sapien
ttggtgctatgttcccaatggctagrctacatggatctgggaactaaggg

SEQ ID NO: 21234 - DNA, 50 bp, homo sapien
ttggggcccatgatggacaaatctcratgaaagggaagcaaaatcaaaag

SEQ ID NO: 21235 - DNA, 50 bp, homo sapien
acatcatgttcataatttcacagatyagcagttctgttatcatttggggc

SEQ ID NO: 21236 - DNA, 50 bp, homo sapien
agaactttcccagtcaaaaacatgcygagaattatatactatgtcttaaa

SEQ ID NO: 21237 - DNA, 50 bp, homo sapien
attttgtgttccattgctcctttgakaaataatcactcaccacctcagcc

SEQ ID NO: 21238 - DNA, 50 bp, homo sapien
aacaacttcactttgtcttaaaaatkatcttcattacgttaatttttgtt

SEQ ID NO: 21239 - DNA, 50 bp, homo sapien
attaggttatattacatcaacatgasctcaataggacagtagtttggaag

SEQ ID NO: 21240 - DNA, 50 bp, homo sapien
taatacaaatagaagatttgtgcaayatgatctatgctctcaggtggttc

SEQ ID NO: 21241 - DNA, 50 bp, homo sapien
ctcccctagcttaacctctgctgaamtaataaagtaaactcaggaaactg

SEQ ID NO: 21242 - DNA, 50 bp, homo sapien
acaatgccaacataagagttaataamacaggatgaggtgaaaaagagtgc

SEQ ID NO: 21243 - DNA, 50 bp, homo sapien
gcacaagaagcatgcaagaagtccawcgctttgtgctggttatcagcagg

SEQ ID NO: 21244 - DNA, 50 bp, homo sapien
aagagttagctccatgaatataaaamgtctttggatgtgtaaaagtctta

SEQ ID NO: 21245 - DNA, 50 bp, homo sapien
tgcaagatgagatttgtcttatgaayagtattaaaattttgactcaaact

SEQ ID NO: 21246 - DNA, 50 bp, homo sapien
gtaagacaaggtaaacatatgggaaracaaaaatgtcagttcaatataaa

SEQ ID NO: 21247 - DNA, 50 bp, homo sapien
tcaataagaaaacataacatgtaaaraggagactaaactatacaatgttt

SEQ ID NO: 21248 - DNA, 50 bp, homo sapien
agtcacgaaggaatcgtaggtaacaygtaaaaggaaggagctgtaatcct

SEQ ID NO: 21249 - DNA, 50 bp, homo sapien
tagactttgtctagaacacattagastatcaataaatgtctgcttttctc

SEQ ID NO: 21250 - DNA, 50 bp, homo sapien
tagaagtgtctgagatggcctagtaragtaagagaaacaaagaaaaatcc

SEQ ID NO: 21251 - DNA, 50 bp, homo sapien
atcagtccaacactgacgttttgcasataagaatactgttggcttagcag

SEQ ID NO: 21252 - DNA, 50 bp, homo sapien
aactactggatagaaaatatggctawgttactgagtttgttaatgtcaag

SEQ ID NO: 21253 - DNA, 50 bp, homo sapien
acatcagttcaaggaatgatgagctraatgccaaaataaagctgggatga

SEQ ID NO: 21254 - DNA, 50 bp, homo sapien
tttgctttggtcttgacatcttttaycatgcatcctaaattgagcttcaa

SEQ ID NO: 21255 - DNA, 50 bp, homo sapien
taaattcaaaactgccttacatgaamgagacttgttaatttaggtatttg

SEQ ID NO: 21256 - DNA, 50 bp, homo sapien
catagagcacaagaaaactgttgagraatccttagtgtgctgatcagtcc

SEQ ID NO: 21257 - DNA, 50 bp, homo sapien
aaataacagattctttttcctagaastgagaaattatctataaagtatgc

SEQ ID NO: 21258 - DNA, 50 bp, homo sapien
taagagctttaagggtatgtagacaycatgtaagtacatcaacattttaa

SEQ ID NO: 21259 - DNA, 50 bp, homo sapien
gttggttatacttcacatgtgataamgaaatagtaacagagatacagtag

SEQ ID NO: 21260 - DNA, 50 bp, homo sapien
aggacacagttaaaatatcagtctaygaatcctcctaattacatataatg

SEQ ID NO: 21261 - DNA, 50 bp, homo sapien
atatatggcatcttgataggccaagracaatgtataatttctattgcttt

SEQ ID NO: 21262 - DNA, 50 bp, homo sapien
gaaacataactgaaggagcatctacmaaatcttctggaaaagaaacacag

SEQ ID NO: 21263 - DNA, 50 bp, homo sapien
tatagcattcctactagcttttaggsatttagcaaagaacatatacaaac

SEQ ID NO: 21264 - DNA, 50 bp, homo sapien
tcaccaaaatgataggctactaagayaacatgataaaaacagcattaggt

SEQ ID NO: 21265 - DNA, 50 bp, homo sapien
gaagacagtgatgcgctcctcatgcrctaggaaccagaatacctggatac

SEQ ID NO: 21266 - DNA, 50 bp, homo sapien
aggttttatttctattcactttctcmgaattttacattcccagtttcttt

SEQ ID NO: 21267 - DNA, 50 bp, homo sapien
tatatttaagaagcccagtacaaggrcagatatttataacagatattgaa

SEQ ID NO: 21268 - DNA, 50 bp, homo sapien
gatccagaaaaacctctggttctacmcatctgctatagtattacaacaat

SEQ ID NO: 21269 - DNA, 50 bp, homo sapien
atgatgttaatgatttgcctcaacayaggttcagtaacttctgtttgcaa

SEQ ID NO: 21270 - DNA, 50 bp, homo sapien
ctatggaaatcaatttcagaagcccrgatcacaattagcccatggccatt

SEQ ID NO: 21271 - DNA, 50 bp, homo sapien
cagctacatgtgcaccagtcttaaaytcagtcagcttcacatacccaaga

SEQ ID NO: 21272 - DNA, 50 bp, homo sapien
aataggctataattctggaaatttamaggtcagtttgatttattcaattt

SEQ ID NO: 21273 - DNA, 50 bp, homo sapien
gcatttccagcctgtaaggacaatamacgaacaagagatgaatctattgc

SEQ ID NO: 21274 - DNA, 50 bp, homo sapien
ttagctatagatatagatacaagaakatttgttatggcaattagctcaca

SEQ ID NO: 21275 - DNA, 50 bp, homo sapien
agttttcttgtacaaacggttgttcyactctttctagaccaaagatcatt

SEQ ID NO: 21276 - DNA, 50 bp, homo sapien
atgggaactagacacataatgtagaygccgtgacagcatatagcactttc

SEQ ID NO: 21277 - DNA, 50 bp, homo sapien
tgtctctcagatgataccattgaagwccagagaggttaattagcataaca

SEQ ID NO: 21278 - DNA, 50 bp, homo sapien
aaacaaaatctctgcttattaaaacyattgcttccaaataaattacttag

SEQ ID NO: 21279 - DNA, 50 bp, homo sapien
tctgtccttacatagtggaagtgacraacgagctttcttgggcctctttt

SEQ ID NO: 21280 - DNA, 50 bp, homo sapien
aggacagaactgctctaacttgagascagtgaataaatgaagactcaagg

SEQ ID NO: 21281 - DNA, 50 bp, homo sapien
aaatgtcctatggatctccatcatayattagaacacattagtgataccac

SEQ ID NO: 21282 - DNA, 50 bp, homo sapien
attaaaataatttccaaagatcacamcctttatgcaaaagaagaattata

SEQ ID NO: 21283 - DNA, 50 bp, homo sapien
ttgctgtctgcgtgggatgcatacartatgagtgatgcaatgggtcacct

SEQ ID NO: 21284 - DNA, 50 bp, homo sapien
aaaagacaagttccctccagtggtcrgaaaagagaaaagaaatatgtcct

SEQ ID NO: 21285 - DNA, 50 bp, homo sapien
tgtaataggaggaaacaataataaawtgacccttttgcaatcgcttctga

SEQ ID NO: 21286 - DNA, 50 bp, homo sapien
tagtctgattatcttttgcagtatawaacatggcaatatataattactta

SEQ ID NO: 21287 - DNA, 50 bp, homo sapien
aaaggcaaacttatatgttggaacgwatggaagaggagatcaaaagagta

SEQ ID NO: 21288 - DNA, 50 bp, homo sapien
ttgcatggttgtgtgtgtaaggtcaktctctcttatagattcctcagttc

SEQ ID NO: 21289 - DNA, 50 bp, homo sapien
tacatatatattatgcattaagatamctgactgaattttgatatgatgtc

SEQ ID NO: 21290 - DNA, 50 bp, homo sapien
tcagattttcttccattaattttggyaacacagcgttcatttttctttgt

SEQ ID NO: 21291 - DNA, 50 bp, homo sapien
caacaaacatgcctttaacttgttgratgaacccatcaaattcctgatag

SEQ ID NO: 21292 - DNA, 50 bp, homo sapien
ctgggccacacacacattcaccatamaaattaaattgaataggtatcaag

SEQ ID NO: 21293 - DNA, 50 bp, homo sapien
gattacatcatgcctagtctctaackctctgcaaagggtcctgctcaggg

SEQ ID NO: 21294 - DNA, 50 bp, homo sapien
gggccaatcctctctctcaaataacyaaacattctggataaacacatttt

SEQ ID NO: 21295 - DNA, 50 bp, homo sapien
aatttgattttatatggttgaattgratgagagtttatatggtttttatt

SEQ ID NO: 21296 - DNA, 50 bp, homo sapien
gagccaccacactcagtctgttcagratatttcatctgagtttagggtgc

SEQ ID NO: 21297 - DNA, 50 bp, homo sapien
aagtcctcttcctaaacctgaaccasaggaattatgcacagaaatacaca

SEQ ID NO: 21298 - DNA, 50 bp, homo sapien
atgaaggatgaagagtataaaggatkaagtattaaaggataaagatagat

SEQ ID NO: 21299 - DNA, 50 bp, homo sapien
tagaatccttttgataaagatctcayattcagttaggaggaaaagcaaac

SEQ ID NO: 21300 - DNA, 50 bp, homo sapien
attccttttttttttctcctcataayaaattccctcacaatgacctggcc

SEQ ID NO: 21301 - DNA, 50 bp, homo sapien
gtatactattgcagagactgaaaaaytgttggccaagtaattatctattc

SEQ ID NO: 21302 - DNA, 50 bp, homo sapien
ggtatatggaagttcaattgcagaamtaatacactcagtctatcagatat

SEQ ID NO: 21303 - DNA, 50 bp, homo sapien
gatagtaatcaccatgtgacttaacmaattctttcttcaaaataaccctt

SEQ ID NO: 21304 - DNA, 50 bp, homo sapien
catccaatcccaagtagctaaaccakaataatcttgaaatttatgtcaga

SEQ ID NO: 21305 - DNA, 50 bp, homo sapien
cagctatagatagtattaaagaaaartttcgatgaaaaatccaaacttta

SEQ ID NO: 21306 - DNA, 50 bp, homo sapien
agaaaaatttcgatgaaaaatccaawctttagggaaatggaaaattactt

SEQ ID NO: 21307 - DNA, 50 bp, homo sapien
taaatatccttgagaagcaaaaaaasagctgacatgaggaaaaagaatta

SEQ ID NO: 21308 - DNA, 50 bp, homo sapien
aattacttttatacaaaggtaaaggragactgagtggtcttaatttacat

SEQ ID NO: 21309 - DNA, 50 bp, homo sapien
tgattttcaaggcttaaaatgtcacraaaagatagacaaccagacaatat

SEQ ID NO: 21310 - DNA, 50 bp, homo sapien
cattttctccagagtacattgaagcygcctgtgtgttttgtgatgcgtcc

SEQ ID NO: 21311 - DNA, 50 bp, homo sapien
cataaactcctctgaaacttgcaacygagatgggcagaaggacttcacct

SEQ ID NO: 21312 - DNA, 50 bp, homo sapien
ggcagaaggacttcacctgattaagratacagagaatctgttttctgact

SEQ ID NO: 21313 - DNA, 50 bp, homo sapien
ggataatcttaaacatgtctttaagragaaagtcagaaaacagattctct

SEQ ID NO: 21314 - DNA, 50 bp, homo sapien
ttgttctggattccaagaggagtaaygccatcaatattggtctgacggtg

SEQ ID NO: 21315 - DNA, 50 bp, homo sapien
tttaatctgaatgtagtattggagamgatttttatagtagagaggatgct

SEQ ID NO: 21316 - DNA, 50 bp, homo sapien
tacataaactgtatttgtaaataacmaaaatatgagttagaaacaggtaa

SEQ ID NO: 21317 - DNA, 50 bp, homo sapien
aaatggtaaaaggtgattatttatasgcaatcatattcatactgatagac

SEQ ID NO: 21318 - DNA, 50 bp, homo sapien
agaaatctgataattttatagagaaycccatgtttgtaattaaccactat

SEQ ID NO: 21319 - DNA, 50 bp, homo sapien
ttagagatgaaatggacagtggtcaytaggtgttggatatagtaagagag

SEQ ID NO: 21320 - DNA, 50 bp, homo sapien
ttagatgaagagttttgaagaatcaygtataacatcaagtaaaatcttcc

SEQ ID NO: 21321 - DNA, 50 bp, homo sapien
ttctttgcttttgcacacagctaccrccttggtttaagtctttcttatac

SEQ ID NO: 21322 - DNA, 50 bp, homo sapien
aaacaggtcacagccacaggtggaaygaaccagaaatggactctgcagca

SEQ ID NO: 21323 - DNA, 50 bp, homo sapien
tgttctaccatatagaattaatttcrcaaaattgcataaatggtacatgt

SEQ ID NO: 21324 - DNA, 50 bp, homo sapien
cacttttctgcactggtggctttaargttggtcttcagtgtttggtgctc

SEQ ID NO: 21325 - DNA, 50 bp, homo sapien
tattggcactaatgagctgtgtgaayttatccattacattatatctgaaa

SEQ ID NO: 21326 - DNA, 50 bp, homo sapien
agaagaagcaatcaacatgttagaayagatcatctcagagacacaaaaca

SEQ ID NO: 21327 - DNA, 50 bp, homo sapien
aaggtatgatcacattacaatttccrgaatttttgagttggtcatgaagg

SEQ ID NO: 21328 - DNA, 50 bp, homo sapien
tttatatactaaactcagccatacaraatttctttcacatttcctcagtt

SEQ ID NO: 21329 - DNA, 50 bp, homo sapien
tatcaggtgactagagtaaataaacygttaaacattgagtgagggggatt

SEQ ID NO: 21330 - DNA, 50 bp, homo sapien
taacctctgacttccctgaaaagtaygcatttagaaagagactgtatgtt

SEQ ID NO: 21331 - DNA, 50 bp, homo sapien
ggttacatttagtatggctttctcawgggaaaacttagataagctttagc

SEQ ID NO: 21332 - DNA, 50 bp, homo sapien
tttgcacttagtgatattctccttgmagtgttgtgctagagaaatgagtt

SEQ ID NO: 21333 - DNA, 50 bp, homo sapien
tcatgtgttagtattgacttgtctcraccccaattagctgtggaatgtga

SEQ ID NO: 21334 - DNA, 50 bp, homo sapien
cagtgtctagcacacaatgtcactcratgtttgaaaaatgaggtggatgg

SEQ ID NO: 21335 - DNA, 50 bp, homo sapien
catagaacattgggacctatatatgratgtataattgtatatatgtatat

SEQ ID NO: 21336 - DNA, 50 bp, homo sapien
atcaattttagaattgtagaaactcmatgaattcaaaaaggaggtccagc

SEQ ID NO: 21337 - DNA, 50 bp, homo sapien
agtatgagaattaaggtatttttccyaagtcagctattctaagaagaaag

SEQ ID NO: 21338 - DNA, 50 bp, homo sapien
attcctgcatagggcaacaaatgtargtaaggatctgccatggtgacaag

SEQ ID NO: 21339 - DNA, 50 bp, homo sapien
ctcttaagccaggaaatttttgttasaggtacactgctttacaggcacac

SEQ ID NO: 21340 - DNA, 50 bp, homo sapien
gttaaacttccatgctcatgagagtyaagttacgcttcatggctctctgc

SEQ ID NO: 21341 - DNA, 50 bp, homo sapien
ggcagaactttttccagaattaaaarttaacttagatgtcaaaataaaac

SEQ ID NO: 21342 - DNA, 50 bp, homo sapien
aggatgactgtgtgtcagaattataygaaaaaaagattaataaggcactc

SEQ ID NO: 21343 - DNA, 50 bp, homo sapien
aaaaatttaattttacatcagagaamatttacaatccaggtggtcagaac

SEQ ID NO: 21344 - DNA, 50 bp, homo sapien
tacaggaaataactctgatgttaaayttcaccactgcaccttttcccttc

SEQ ID NO: 21345 - DNA, 50 bp, homo sapien
acaatagtaggtgactgatgatctcyaatccacttctgtcaaaagagacc

SEQ ID NO: 21346 - DNA, 50 bp, homo sapien
cagcaggctgcggacagtaaggtaayatctcccagccaaggccatccttc

SEQ ID NO: 21347 - DNA, 50 bp, homo sapien
aagtgatatttattgagttatgtggwaaagatggcttgtatttttcagat

SEQ ID NO: 21348 - DNA, 50 bp, homo sapien
gtatcaaaatattagggaaaggacasaaactgcaatgcatgttacttggg

SEQ ID NO: 21349 - DNA, 50 bp, homo sapien
actacaatcccctatcttagtgatawcttcatcatgtttaggatagattc

SEQ ID NO: 21350 - DNA, 50 bp, homo sapien
tggggttggaccagaggttgacataraaacattaggaaattatggagaac

SEQ ID NO: 21351 - DNA, 50 bp, homo sapien
accaatatgttgcttataatcacaamtgtaagtaagttttcactgaattg

SEQ ID NO: 21352 - DNA, 50 bp, homo sapien
cgatataaaagagagagttgttcaasagtatttaacagatacccatacag

SEQ ID NO: 21353 - DNA, 50 bp, homo sapien
ctattacttcactttctcaaggtaawatctgaatggtactttctgggtat

SEQ ID NO: 21354 - DNA, 50 bp, homo sapien
ctgaattcatcaaaatcactagttaraagtataacacaatgagccatccc

SEQ ID NO: 21355 - DNA, 50 bp, homo sapien
agagaagccataaataaatagaaaamgatggacttcagaggtaggcaggc

SEQ ID NO: 21356 - DNA, 50 bp, homo sapien
tgagaaggatagtgttaagtctgtcsaaaatagtattgatctcctttaac

SEQ ID NO: 21357 - DNA, 50 bp, homo sapien
tctggggctggagccaagtatgacaygtaggaaagaaatcagcaaacgtc

SEQ ID NO: 21358 - DNA, 50 bp, homo sapien
aagggggtttttctttctgacgcatraatatttgaatcttgggcttttgt

SEQ ID NO: 21359 - DNA, 50 bp, homo sapien
ttatcagattgggaagtgacctggcragtcctagagatgatttgaataac

SEQ ID NO: 21360 - DNA, 50 bp, homo sapien
ccagacagaggtattacatatgagamccttcgacaaatctatttatttaa

SEQ ID NO: 21361 - DNA, 50 bp, homo sapien
agggagaatgggatggaagcagggaytagatttgccgacagctgagaatg

SEQ ID NO: 21362 - DNA, 50 bp, homo sapien
gtttctgttctgattcctcatttcasgcatttggacttggacttgttgac

SEQ ID NO: 21363 - DNA, 50 bp, homo sapien
catacttccaccatgcccgagaaaakaagttttgaaagattgatctttta

SEQ ID NO: 21364 - DNA, 50 bp, homo sapien
acccttaatcacagaacgttgagacraatctatagataagttgtggtgtc

SEQ ID NO: 21365 - DNA, 50 bp, homo sapien
ggattactggcttcgactgtgaagcrgaaaatgtgggatgtggtcctcac

SEQ ID NO: 21366 - DNA, 50 bp, homo sapien
ccctctgatttcctctattagcctaygaattttctatgtggaagaactac

SEQ ID NO: 21367 - DNA, 50 bp, homo sapien
catgcttatcccagggccattacaartctactaattatagttggactcga

SEQ ID NO: 21368 - DNA, 50 bp, homo sapien
ccaagatgccctgtgcatgaaagcayctctttaaatggagggtgaggggc

SEQ ID NO: 21369 - DNA, 50 bp, homo sapien
cttttaatcccttttagctgtcctaygcagtcacttcaacaagatgcatt

SEQ ID NO: 21370 - DNA, 50 bp, homo sapien
ggaatgagtatgcatagagaagatcrgagaatgacctggtcagtggtgtg

SEQ ID NO: 21371 - DNA, 50 bp, homo sapien
cattcttagatgtcttttttcccaargcataaaatattgtggagcaattt

SEQ ID NO: 21372 - DNA, 50 bp, homo sapien
aaattattagtaaaaatgacgatgaygttcacattttgtgaagaaatact

SEQ ID NO: 21373 - DNA, 50 bp, homo sapien
gccctatttttgaagcatcattgagwcctgcttccgggatggagatcttg

SEQ ID NO: 21374 - DNA, 50 bp, homo sapien
tcttcagaattcacagctctcccgcraaaacaatgtcagcagggagagcc

SEQ ID NO: 21375 - DNA, 50 bp, homo sapien
cttctctaactaccaccttgtcttaygataaagagtcagtgggccatgtc

SEQ ID NO: 21376 - DNA, 50 bp, homo sapien
agtctcaaccactttcattgggtcaraagaaaatgcttgatattcaaact

SEQ ID NO: 21377 - DNA, 50 bp, homo sapien
ctctttctctgtctctatcacacccrctatgacaagaatcagagatattt

SEQ ID NO: 21378 - DNA, 50 bp, homo sapien
cttagttaaaaaatggtggagatacwatatgcctgtcaatttctaccacc

SEQ ID NO: 21379 - DNA, 50 bp, homo sapien
tggcattcagtgttatatttgaggamgtttattcatttggttagagcttg

SEQ ID NO: 21380 - DNA, 50 bp, homo sapien
cctgtcccctaatagattgttgccaygtttagggaagcaaaccatttatc

SEQ ID NO: 21381 - DNA, 50 bp, homo sapien
ttatgctctaggaaggatgccttgcygatctttttgtctctatagcatct

SEQ ID NO: 21382 - DNA, 50 bp, homo sapien
gcatgcctctgacctgcttattcagyaagtgagagaatgcagcgatgaat

SEQ ID NO: 21383 - DNA, 50 bp, homo sapien
tggcagctgaccttgatgagattatmaattagaagtggacacaggatata

SEQ ID NO: 21384 - DNA, 50 bp, homo sapien
tcacaaacctgcaagggcaattctaktaccttcatttggtgagccagaga

SEQ ID NO: 21385 - DNA, 50 bp, homo sapien
ttttgtcagagtgctttgagctatasaatctattaacccgtatcttttga

SEQ ID NO: 21386 - DNA, 50 bp, homo sapien
tggctcaagcttattggcataattayaggaagtgaaaatattgagaaggt

SEQ ID NO: 21387 - DNA, 50 bp, homo sapien
cataacaagtatttaactccctaccwagttcactgttaagaacccaaatg

SEQ ID NO: 21388 - DNA, 50 bp, homo sapien
gcaattgaaaattaagttccgagaasgtggtgtatctaactttggttaca

SEQ ID NO: 21389 - DNA, 50 bp, homo sapien
taaagaataacataacatctaaaaawctatggaactaatgaaagaatcca

SEQ ID NO: 21390 - DNA, 50 bp, homo sapien
agcttgaatagaaaagtgataagaaygttacatttggaacaaccaaacac

SEQ ID NO: 21391 - DNA, 50 bp, homo sapien
ttcaagctgcatttgaggatgtcctragaacataattagtagtggccctg

SEQ ID NO: 21392 - DNA, 50 bp, homo sapien
gaaagagatagcactcctggtcagartctagtatatgtggcagcggaggg

SEQ ID NO: 21393 - DNA, 50 bp, homo sapien
atactggtttcacataagatgtgacsactgctataatcaagatgacaaca

SEQ ID NO: 21394 - DNA, 50 bp, homo sapien
gattacactcatgtcctccaaagccragtttttatgaatataagactgac

SEQ ID NO: 21395 - DNA, 50 bp, homo sapien
agtgtcttttttcccttctcaaaacyattaacccagatttccttcttatt

SEQ ID NO: 21396 - DNA, 50 bp, homo sapien
atatatctgtaggtatatgagtggaygtatatatatttaaaatagtgttt

SEQ ID NO: 21397 - DNA, 50 bp, homo sapien
gttattgttctgaaactacggagatraattttgattgattttaataagag

SEQ ID NO: 21398 - DNA, 50 bp, homo sapien
ttattgtttaaaactcctgaaaaaayacttgactgtttaaagcaaaaata

SEQ ID NO: 21399 - DNA, 50 bp, homo sapien
aatttaagttatacctaaaactctayggaacgctatataaatattacaca

SEQ ID NO: 21400 - DNA, 50 bp, homo sapien
ttttaattacttgaaccaaatacacygactataaaccaaagcttattttt

SEQ ID NO: 21401 - DNA, 50 bp, homo sapien
cagttgcctgacactagaccgccaargcatgaatggtcccacccagcaga

SEQ ID NO: 21402 - DNA, 50 bp, homo sapien
cagttattgtgaccttagtctgttaygcagagaaggaaaagtaataattg

SEQ ID NO: 21403 - DNA, 50 bp, homo sapien
tctgttagagtttctgtttttaacgracatttgggtactgaatacagtga

SEQ ID NO: 21404 - DNA, 50 bp, homo sapien
ttgacttattttaaagaaataccaasaatcaatgattagaaaggaaagat

SEQ ID NO: 21405 - DNA, 50 bp, homo sapien
gatatatataatgtataaagaataayttaggccaccaccagctttagaaa

SEQ ID NO: 21406 - DNA, 50 bp, homo sapien
agagggaagcaacaagcctcaaaacrataggaggtgtaggtggcatacat

SEQ ID NO: 21407 - DNA, 50 bp, homo sapien
aaaaacctgtccttcaagggcataaytgaataaatcaaaaataaagagaa

SEQ ID NO: 21408 - DNA, 50 bp, homo sapien
atcctatacaggtgtaaaatatacarattgggtgaggaaaatggtagcat

SEQ ID NO: 21409 - DNA, 50 bp, homo sapien
agtgggctcagctgggttgctgtacyacccatatcatgtgcaattgctaa

SEQ ID NO: 21410 - DNA, 50 bp, homo sapien
acacaacatataatttctactgtgayatgaagtacataaggctctatgta

SEQ ID NO: 21411 - DNA, 50 bp, homo sapien
ttagcagagaattctgctagaaatayggaaagctctgactcggtgttaaa

SEQ ID NO: 21412 - DNA, 50 bp, homo sapien
aactggaagggtaaatcattgataawatatgtaattcttaatgtatttaa

SEQ ID NO: 21413 - DNA, 50 bp, homo sapien
aatattttgaatcataagtttctcargagattctgatagatttgagaatt

SEQ ID NO: 21414 - DNA, 50 bp, homo sapien
tgtgagcaggttcctgacactacaarttcattcctttagcataaggtgtt

SEQ ID NO: 21415 - DNA, 50 bp, homo sapien
acgtttcataaaagaacacaaaagaygctaataaaggcagagccagccct

SEQ ID NO: 21416 - DNA, 50 bp, homo sapien
attccggcaaactttccagcaaacartactttgaggcagctggaaaaggg

SEQ ID NO: 21417 - DNA, 50 bp, homo sapien
cttacattctcagttgaagatcacayaagctaagagtggcgccttccaca

SEQ ID NO: 21418 - DNA, 50 bp, homo sapien
caaatgcccatcaatcaacaagggaygaagaaaatatgttgtatatatac

SEQ ID NO: 21419 - DNA, 50 bp, homo sapien
gaaacagaagacagaggaaacagtamaaatgtctgaatgctaacatctat

SEQ ID NO: 21420 - DNA, 50 bp, homo sapien
aaactgggatcaaagacagtgtatcrgaagaaaagatgcacttggtaccc

SEQ ID NO: 21421 - DNA, 50 bp, homo sapien
gaaagtttatacagaagggtaattcycaatttcttacatttcttccccac

SEQ ID NO: 21422 - DNA, 50 bp, homo sapien
tgactcttatttcacttaatgattcmctgagttgaaataggtgattgcca

SEQ ID NO: 21423 - DNA, 50 bp, homo sapien
tggtaagctcccagggactgtgtatyacctagattggcactgagtaggcc

SEQ ID NO: 21424 - DNA, 50 bp, homo sapien
actagtaagtaaggtaacaaccaagyataagatctagtgatgtgttcaaa

SEQ ID NO: 21425 - DNA, 50 bp, homo sapien
aatcaactttgttcctgtttatcagragagtctcatgacagatgggattc

SEQ ID NO: 21426 - DNA, 50 bp, homo sapien
attaaatactatgatttttgaatgamtaatgatcctctttaaaaattaca

SEQ ID NO: 21427 - DNA, 50 bp, homo sapien
gcttttgtgtacactggcaccttcaygattttctcaaggttgctgtataa

SEQ ID NO: 21428 - DNA, 50 bp, homo sapien
gggtgcatgctattagtctctccaaytgacagtgaggaatcagaggcatg

SEQ ID NO: 21429 - DNA, 50 bp, homo sapien
aattagagttcattccaagcatccaygatattttcatcttcttctcagtc

SEQ ID NO: 21430 - DNA, 50 bp, homo sapien
agcatcttcccctttgcatgctatckctctcccgtcagtcatgtgaagat

SEQ ID NO: 21431 - DNA, 50 bp, homo sapien
ctattgattcattactgagtttatayctgcttcatgaaaaatcctgatga

SEQ ID NO: 21432 - DNA, 50 bp, homo sapien
gaggggctgctacctgctatctggcrcaaaggaagggggtcgatttaaaa

SEQ ID NO: 21433 - DNA, 50 bp, homo sapien
tgatatacaatcacttaaagttaatsagaatgtttgaacttatctggttc

SEQ ID NO: 21434 - DNA, 50 bp, homo sapien
tgggccttgtctgctttcctgtaaaytgaggaggccggatcagctgggtg

SEQ ID NO: 21435 - DNA, 50 bp, homo sapien
cagagaaatagccttgccaatagtakaacatgacaatgaccacagtatcc

SEQ ID NO: 21436 - DNA, 50 bp, homo sapien
ccctaacacatagtcatacaggtaartaatatctctcaatctctatctgt

SEQ ID NO: 21437 - DNA, 50 bp, homo sapien
attttacagatggaaacagaggcctkagaatattaactgacttgcccaag

SEQ ID NO: 21438 - DNA, 50 bp, homo sapien
tctcatgagtaaaatgaatggcttcyactaaatgatctatctatgagatc

SEQ ID NO: 21439 - DNA, 50 bp, homo sapien
tttcctcttaggaaattaaactatcraggagagctagggttgttcttatt

SEQ ID NO: 21440 - DNA, 50 bp, homo sapien
aactgcccaaatctggtatccaaagrccctctccaacttttagaaagact

SEQ ID NO: 21441 - DNA, 50 bp, homo sapien
ctagggaaaaaccattatggctgtaygctctattctgtctctcatcctga

SEQ ID NO: 21442 - DNA, 50 bp, homo sapien
gtttggtttaaaagtggagagaatgyattaagattaggtgaaggttatta

SEQ ID NO: 21443 - DNA, 50 bp, homo sapien
ggattctatttgaggtaagcattggmccaaaataggaaaatcctacaaga

SEQ ID NO: 21444 - DNA, 50 bp, homo sapien
taggagcaataggttgtaccatatarcttaggtatgtggtaggctatacc

SEQ ID NO: 21445 - DNA, 50 bp, homo sapien
aagaatgagaggaagaaccacaaggwataagaggaacaagaaatgagaaa

SEQ ID NO: 21446 - DNA, 50 bp, homo sapien
cccacttgcaagggctgataagacargccatctcattcacggcagggagg

SEQ ID NO: 21447 - DNA, 50 bp, homo sapien
cattttttccaaggatgatatcatgsaagttgtattaggccattcttaca

SEQ ID NO: 21448 - DNA, 50 bp, homo sapien
agttagaaagggtaggatctctacckgaaaattaacatgaatggcagaat

SEQ ID NO: 21449 - DNA, 50 bp, homo sapien
gttcttgccactctgaggtatcctargaggagctagtagaaccttttgaa

SEQ ID NO: 21450 - DNA, 50 bp, homo sapien
ttgttctctcttgctggaagaccatsaagctgtcatttttcttggtaatg

SEQ ID NO: 21451 - DNA, 50 bp, homo sapien
acactgccatacccagaaaattgccygatgcatactgaagagtcaagaga

SEQ ID NO: 21452 - DNA, 50 bp, homo sapien
ggaagtaacactgcaattgacctctraaggattagtacaaagtagttcgg

SEQ ID NO: 21453 - DNA, 50 bp, homo sapien
gtgcaaagtgagtgaagccaaacgartacatgtgttaaatttagtaaatg

SEQ ID NO: 21454 - DNA, 50 bp, homo sapien
atagggaaaggaagaaaggcaaaaamagtgtgcattatcaagtaagctac

SEQ ID NO: 21455 - DNA, 50 bp, homo sapien
aaggatgatacaatgctcagaaatakagtggtggacattctggataattc

SEQ ID NO: 21456 - DNA, 50 bp, homo sapien
aatacttttgtgatatgtcaaggatratatgttacagtaatttaaagatg

SEQ ID NO: 21457 - DNA, 50 bp, homo sapien
tttgaaaattcctaaaaatctgagamctcttttgagaaaacaaaattaag

SEQ ID NO: 21458 - DNA, 50 bp, homo sapien
cgcatgaagaaatgtggacctcaacrattaaaatcaataatatttgagaa

SEQ ID NO: 21459 - DNA, 50 bp, homo sapien
tgagcctcatgggaataggctttgaygttagagaactgaggtgccaccct

SEQ ID NO: 21460 - DNA, 50 bp, homo sapien
gaacaggacttacaatttcctagtaygcttaaaatacagttccacacaga

SEQ ID NO: 21461 - DNA, 50 bp, homo sapien
aatggtacaaccagtctccttaaagyatctggattctcttgtaaaattaa

SEQ ID NO: 21462 - DNA, 50 bp, homo sapien
taacaaaagtatgtttcactaaagcrccaccttaaaaatgttagaaagta

SEQ ID NO: 21463 - DNA, 50 bp, homo sapien
agataatgatgttccagattctaggwcagtcttgtggtatgtttcacctc

SEQ ID NO: 21464 - DNA, 50 bp, homo sapien
tgtgctcagggttatgcaattaaacyacattctatatttaaaattctccc

SEQ ID NO: 21465 - DNA, 50 bp, homo sapien
tgtggaatgttagtgaggcattcaasgtcctttgccacatagctcttacg

SEQ ID NO: 21466 - DNA, 50 bp, homo sapien
tccaaaagaagattccaagtcataaycagatactttcccttagtcatgga

SEQ ID NO: 21467 - DNA, 50 bp, homo sapien
taagacacagaaatacatgaaaagcrcaaagtattgacactcaagtttat

SEQ ID NO: 21468 - DNA, 50 bp, homo sapien
gttggtgcagcaactataataaaaawtgtatgacgagatgataaaggcaa

SEQ ID NO: 21469 - DNA, 50 bp, homo sapien
agtagctctcaagtttgtgttttatsaacttctgatgccatgactatact

SEQ ID NO: 21470 - DNA, 50 bp, homo sapien
atatattcctttgtgcccagtctaawcacttaaaatatttagtagaaaac

SEQ ID NO: 21471 - DNA, 50 bp, homo sapien
ggtggcatagggaggagccccaaggyacagggaaagagagtagatggaag

SEQ ID NO: 21472 - DNA, 50 bp, homo sapien
ctgctgagcatgggctgaattcagaraagtgtgggttttatggagccctg

SEQ ID NO: 21473 - DNA, 50 bp, homo sapien
tgtgacaacttatagggccagaaaaytctgttgtctcagtagaagtttgt

SEQ ID NO: 21474 - DNA, 50 bp, homo sapien
gtacatttgtaggccatcagtggaastgcttgaaaattacagggctccat

SEQ ID NO: 21475 - DNA, 50 bp, homo sapien
atactagctagcatttatcaagctaygttaagcactttccctatattatc

SEQ ID NO: 21476 - DNA, 50 bp, homo sapien
ctttgcagagaactctcaattttagrcagccttgctcaatgaattattta

SEQ ID NO: 21477 - DNA, 50 bp, homo sapien
tttcagttaggcaaatttttctagcraatctccttgaactcctccctgca

SEQ ID NO: 21478 - DNA, 50 bp, homo sapien
gatcaatagttcagactcttaacgaygtagcaaaatttcaataaatgttg

SEQ ID NO: 21479 - DNA, 50 bp, homo sapien
tgtttctattgcaaagtttagcacakaactatttacatattaaaaattca

SEQ ID NO: 21480 - DNA, 50 bp, homo sapien
acaacttacctagatgagaaaatgaraggtcatacacgaacaactaaacg

SEQ ID NO: 21481 - DNA, 50 bp, homo sapien
tttttttacttaggagagtacatgaytaaaaatgtctggagataaccagt

SEQ ID NO: 21482 - DNA, 50 bp, homo sapien
atggtggaaaaacaaaagagaatgcrcggcccaacctacagcttcattct

SEQ ID NO: 21483 - DNA, 50 bp, homo sapien
gaagtataatttatgtgtcaaaaccraaggaaacaaatctatcctgaatg

SEQ ID NO: 21484 - DNA, 50 bp, homo sapien
taaaaatcattccagtttggcactgkactaaaataaacggttttagtact

SEQ ID NO: 21485 - DNA, 50 bp, homo sapien
atgatgagaagatggagtcatctgarctgaggtctaggtagtgagaagta

SEQ ID NO: 21486 - DNA, 50 bp, homo sapien
cagctgaaagtgaccattttcacaawtcagagcgttaaaagcttcagact

SEQ ID NO: 21487 - DNA, 50 bp, homo sapien
aagtcaacgtaaagagactgcttacrgattctataaagaggtatttctta

SEQ ID NO: 21488 - DNA, 50 bp, homo sapien
agttatatgaaaattccagaattggkaagtctacaagaacagaaagtaga

SEQ ID NO: 21489 - DNA, 50 bp, homo sapien
gctttatatgaaactgcaattaaacrctcaattaaataaatgcattgtga

SEQ ID NO: 21490 - DNA, 50 bp, homo sapien
tctggtttcactgaaatacaatccaygcagagtaaatacatgatattttc

SEQ ID NO: 21491 - DNA, 50 bp, homo sapien
agagcaacacacatccagagtgaaartaaaaggaagaattaaaaacaaac

SEQ ID NO: 21492 - DNA, 50 bp, homo sapien
aatttcctgggaagtacgtccttccraggatcggcatgctcagaattatg

SEQ ID NO: 21493 - DNA, 50 bp, homo sapien
agattgtcactgaatatcctcagcargcaggaacacttctcagactgtaa

SEQ ID NO: 21494 - DNA, 50 bp, homo sapien
tagttttcttgctattttctccatayctacagttgtttccttcactggaa

SEQ ID NO: 21495 - DNA, 50 bp, homo sapien
tacacattatgtagtttcatcaatakggaattaagttagatgtaaataac

SEQ ID NO: 21496 - DNA, 50 bp, homo sapien
cccaataagagtttgaaatatacccrcagtgttttgaatgaagatcgtgt

SEQ ID NO: 21497 - DNA, 50 bp, homo sapien
ttcctaagctgagatagacagagacrctggcccagacagacagagtgtgg

SEQ ID NO: 21498 - DNA, 50 bp, homo sapien
tctcttcaatggtaaacagagttacmaagaaaattccaaatgggtacccc

SEQ ID NO: 21499 - DNA, 50 bp, homo sapien
gccaagagaaaagagaaacctaaacmacagatggattaatccctactcta

SEQ ID NO: 21500 - DNA, 50 bp, homo sapien
taaagcaagactaaatccatggtcawatccatcccagagccaacttggac

SEQ ID NO: 21501 - DNA, 50 bp, homo sapien
agagaccttgagtgcttttcacttcrcaagatattacactgctccattac

SEQ ID NO: 21502 - DNA, 50 bp, homo sapien
ccaccaacagcagtaaacggaaattkaagatgaaaatccaggaaaggaga

SEQ ID NO: 21503 - DNA, 50 bp, homo sapien
agcaaaatgtctttttcatagcaagraccatttacagtaaggacaaacaa

SEQ ID NO: 21504 - DNA, 50 bp, homo sapien
aactctctgccttgaacttctgtgcyattgatggatatttaacccaatgg

SEQ ID NO: 21505 - DNA, 50 bp, homo sapien
aaggtgatatgctttgttgttatcaygacacaattgctacaaattagttc

SEQ ID NO: 21506 - DNA, 50 bp, homo sapien
tatattataggcacagtctacctctkaaatgtcaggtgttccctgatatt

SEQ ID NO: 21507 - DNA, 50 bp, homo sapien
gtaccttcaagggttgttttaaagcrgaatgtacaattcacctcttccca

SEQ ID NO: 21508 - DNA, 50 bp, homo sapien
gataactctttatataaaacataaawtggctccagaaaaatgattttata

SEQ ID NO: 21509 - DNA, 50 bp, homo sapien
gtctggtgagaccaattgctgataayggttagtgtgttgtttgtttcagt

SEQ ID NO: 21510 - DNA, 50 bp, homo sapien
ctctacgtcagtttgcattcaatgaygggtcgagactaggttgaaaggct

SEQ ID NO: 21511 - DNA, 50 bp, homo sapien
gctctctctgaaagggaacagtcacraaagttctttctctgctgaaaagt

SEQ ID NO: 21512 - DNA, 50 bp, homo sapien
agagtcacatgtcaacagacacccgratgaaacttcctcaagacttttca

SEQ ID NO: 21513 - DNA, 50 bp, homo sapien
atttccgagtcctgggagataatagrataaactcatggaggacctgtcct

SEQ ID NO: 21514 - DNA, 50 bp, homo sapien
cagtcacttgttgatagcaatatgaycattcaaggagaaaacaattaggg

SEQ ID NO: 21515 - DNA, 50 bp, homo sapien
atcatggcatactcttttctccttcyaatcaattctccagagcaagaatt

SEQ ID NO: 21516 - DNA, 50 bp, homo sapien
taagcatgtaaacataagaaatggascaagtaaattaaattatgaaatca

SEQ ID NO: 21517 - DNA, 50 bp, homo sapien
attacttaaatggaaaggtctttacygagtgatcctggccactccaacta

SEQ ID NO: 21518 - DNA, 50 bp, homo sapien
agttggcagaaatgctcagcttgcartaccctacattccatttggatcaa

SEQ ID NO: 21519 - DNA, 50 bp, homo sapien
tgcttcaatcatagataggtttatamtaagtgctttttggtgataatctg

SEQ ID NO: 21520 - DNA, 50 bp, homo sapien
gggactaggaaagcagggtatgcaayagtgagtctaaatgaggttataaa

SEQ ID NO: 21521 - DNA, 50 bp, homo sapien
ctgggactcacacagggactcagcargaagtagattgtagggaaaaatag

SEQ ID NO: 21522 - DNA, 50 bp, homo sapien
ccaaagtttaatcttcttaatccagsaagtctgttgaatgggcagcatat

SEQ ID NO: 21523 - DNA, 50 bp, homo sapien
ttggacatggacaggactgcatagargcatatatattgaaggttacctca

SEQ ID NO: 21524 - DNA, 50 bp, homo sapien
cctaaagtatttgttagttgtcaagmctgaataaagacaggtgtagacta

SEQ ID NO: 21525 - DNA, 50 bp, homo sapien
tttactttccagtactgagggttaaygtgtttcctcttagaaaaagaagc

SEQ ID NO: 21526 - DNA, 50 bp, homo sapien
ttgggtcagagcctccttaaaaataygcttcacctcaaatcatgtgagtc

SEQ ID NO: 21527 - DNA, 50 bp, homo sapien
gatacaatagcgtgtctatactaaamctgtacatggtaataaaaactaac

SEQ ID NO: 21528 - DNA, 50 bp, homo sapien
cttgatcctgagagccagggatccaytgaaaggccttcagcagaaagatg

SEQ ID NO: 21529 - DNA, 50 bp, homo sapien
aaatgcctctttttataaacacacastgtgagacagatgtttacccagga

SEQ ID NO: 21530 - DNA, 50 bp, homo sapien
gagtaaaatgtaaatcctgttaaccyagtgccttatggtagtaatacttc

SEQ ID NO: 21531 - DNA, 50 bp, homo sapien
cctgctttggagttcactttctccasgagcccctttctgacatctcccaa

SEQ ID NO: 21532 - DNA, 50 bp, homo sapien
ggaaattggatgttaatagctaaaakaatgacaggtgcataacaatttga

SEQ ID NO: 21533 - DNA, 50 bp, homo sapien
tgtttgctactaattttgattaaaaygttggagctgtcaaattctattaa

SEQ ID NO: 21534 - DNA, 50 bp, homo sapien
tggtggcatttgtctgtgtcctggargaagtccttatgtgtatgatctta

SEQ ID NO: 21535 - DNA, 50 bp, homo sapien
atagaccaaacatgttacaacccaawggtgaggtcattcatgaagcattc

SEQ ID NO: 21536 - DNA, 50 bp, homo sapien
agtgagtggcagctattgttatctaygcagaatgacactagccttaggca

SEQ ID NO: 21537 - DNA, 50 bp, homo sapien
acatgctttagtcaccaggaactgcyaattttacttctcaaatctctcaa

SEQ ID NO: 21538 - DNA, 50 bp, homo sapien
ttcctctaaaccatgctttatgaacyacacctttttgtgccccttgcctt

SEQ ID NO: 21539 - DNA, 50 bp, homo sapien
ttctgtttctcaagtttatggttaaraggagaacttattataaaggttaa

SEQ ID NO: 21540 - DNA, 50 bp, homo sapien
tctccagccccctttttttaacttcrattcttgccttgtaaacttcactt

SEQ ID NO: 21541 - DNA, 50 bp, homo sapien
tccttctacttagtatccttaggtaycaatttctgcctgctcgctagctt

SEQ ID NO: 21542 - DNA, 50 bp, homo sapien
tgtagcttgagggcaatagccttgawgtagcatcctttttgatgagtctc

SEQ ID NO: 21543 - DNA, 50 bp, homo sapien
ccaaaatacaaggataatgaaacacmagtgaatttttttaaagtgcatta

SEQ ID NO: 21544 - DNA, 50 bp, homo sapien
tgaggagatataattataaagtaaarccaacggatttgttgttagacagt

SEQ ID NO: 21545 - DNA, 50 bp, homo sapien
ttaaacattttctccaagatagatayaggatcctgcccaatttcagttac

SEQ ID NO: 21546 - DNA, 50 bp, homo sapien
tgcatcagctgttatatgactacagraataaacacttcatctcccccgca

SEQ ID NO: 21547 - DNA, 50 bp, homo sapien
aaaatataaaaaaagtcataataaartacattaggcaggtttcttaggcc

SEQ ID NO: 21548 - DNA, 50 bp, homo sapien
gagccataggatcaagaccaggacaygcagttaggaaagatacaacctag

SEQ ID NO: 21549 - DNA, 50 bp, homo sapien
tgggggattaatgtcagttcctaaasaagcacatgcattatagatttaaa

SEQ ID NO: 21550 - DNA, 50 bp, homo sapien
gcttttaggtctaagttttgtttgayggctggatttgcactgacacttgt

SEQ ID NO: 21551 - DNA, 50 bp, homo sapien
ccacctagtaaaatactgtttacacraattttgatcagctacatctcaat

SEQ ID NO: 21552 - DNA, 50 bp, homo sapien
acaggaatgcacacaacagctctaaygtcagcgtgaactaaagcctgcag

SEQ ID NO: 21553 - DNA, 50 bp, homo sapien
tcagccccaaatcctccaaagaaaargacagtaattctcctatttgaaaa

SEQ ID NO: 21554 - DNA, 50 bp, homo sapien
tgctctccacaaataactaacttagrcctggtactcttatcctccactta

SEQ ID NO: 21555 - DNA, 50 bp, homo sapien
ttttattatttaccaacataattacygaagaactaatttatttaataaaa

SEQ ID NO: 21556 - DNA, 50 bp, homo sapien
gattagagaaaaatatgtattcacayggctgtaagctagggcttagtaca

SEQ ID NO: 21557 - DNA, 50 bp, homo sapien
ttttaacatgatttaacaagtaagcrcaccgagagaaaatactttgtata

SEQ ID NO: 21558 - DNA, 50 bp, homo sapien
aaataaataactgaggcacagaaackcataagtaaatcctctcatgattt

SEQ ID NO: 21559 - DNA, 50 bp, homo sapien
ccagtaaattggcatccagaagacaygctatccagttccatctccataac

SEQ ID NO: 21560 - DNA, 50 bp, homo sapien
tatgtttcatcaattatatgggcaawgataaaaattttgataataaagca

SEQ ID NO: 21561 - DNA, 50 bp, homo sapien
taaactgcatatgatcagcatgaaawaagtatagaatgtgaaagtacatt

SEQ ID NO: 21562 - DNA, 50 bp, homo sapien
gtttgacttttctgcatttcattaawcaaattccctggttgcctttccaa

SEQ ID NO: 21563 - DNA, 50 bp, homo sapien
ttcctggatttttcattcactattakgttttggagattattttgcatatc

SEQ ID NO: 21564 - DNA, 50 bp, homo sapien
  misc_feature (16)..(16): n is a, c, g, or t
agtcatattggattanggaccatcayaagagtctcatttcaattaaatca

SEQ ID NO: 21565 - DNA, 50 bp, homo sapien
ggaatccctgctcagttgtcatcctyacccatcaacactattgcccactt

SEQ ID NO: 21566 - DNA, 50 bp, homo sapien
taaagaatatatggattaaatcagayagtatgtgtgaaaacacttaacgg

SEQ ID NO: 21567 - DNA, 50 bp, homo sapien
tacatttagggacacctattgagtamataacatgaaacattccacagatc

SEQ ID NO: 21568 - DNA, 50 bp, homo sapien
caccctgatttcggctttgtgagtasactttgatatgttcatgattcctg

SEQ ID NO: 21569 - DNA, 50 bp, homo sapien
taattaattggataatgttcatgtasgtttgaaattacttccatcaaaag

SEQ ID NO: 21570 - DNA, 50 bp, homo sapien
ggaatcctcctttattggctttttayggactttggaaacagcccacagat

SEQ ID NO: 21571 - DNA, 50 bp, homo sapien
cctgccaaggacacagtgtgtgagayggccttaagggaaaaaagtactca

SEQ ID NO: 21572 - DNA, 50 bp, homo sapien
cagcacctaaaagattcagaaagggkaatcgcactctgtttgttatttat

SEQ ID NO: 21573 - DNA, 50 bp, homo sapien
ttctcaggaccaaggtatgcactagrcagagggtaccagcctcctacttt

SEQ ID NO: 21574 - DNA, 50 bp, homo sapien
ataaggaaaatgtgttgtcatcaatragaaaaaatctaatgagtcaattt

SEQ ID NO: 21575 - DNA, 50 bp, homo sapien
gtctatataaaacctgtttaatgtamatatttctctcactgaaaccattt

SEQ ID NO: 21576 - DNA, 50 bp, homo sapien
gaagaaagtacagagaggaatctaaygtgaattaccccccaagggctaca

SEQ ID NO: 21577 - DNA, 50 bp, homo sapien
tagctttgtccctttgctaacagtaygaccacaagcccattatgtaaaaa

SEQ ID NO: 21578 - DNA, 50 bp, homo sapien
ctgagattcatttttttgcagaaagratatagtaacagctaaattgggtc

SEQ ID NO: 21579 - DNA, 50 bp, homo sapien
atgtcattgaaaaatatgcagagtarattttgttaagcaaattagaatgt

SEQ ID NO: 21580 - DNA, 50 bp, homo sapien
gtcactctctgagcctcagtctgcayatcaaacagaacaggttagcaatt

SEQ ID NO: 21581 - DNA, 50 bp, homo sapien
gcatctcatgctactttatgcatcastaaatgttttagtttttctccagg

SEQ ID NO: 21582 - DNA, 50 bp, homo sapien
aagcgaaataggaataacgatctaamctttatgcgcaatatagttttctt

SEQ ID NO: 21583 - DNA, 50 bp, homo sapien
tgtcttttgtgcatgtgtgtctactyagcgccctgaaaacttgtggcatt

SEQ ID NO: 21584 - DNA, 50 bp, homo sapien
ttgatagtgaagatgtatatgttgcratgaagaaatgagtgaatgagcta

SEQ ID NO: 21585 - DNA, 50 bp, homo sapien
ttcagatagaattagaattagtggamgtgaattagaaaagatgagattta

SEQ ID NO: 21586 - DNA, 50 bp, homo sapien
ctggactctaattgctgcatgtaaasaaacatcatctggaacagagccac

SEQ ID NO: 21587 - DNA, 50 bp, homo sapien
atgccatttttctttgatgcaatcaygaagaaaagtggaaatgcaggacg

SEQ ID NO: 21588 - DNA, 50 bp, homo sapien
tctggagtcagggttctggggatccrcctctcgtgcgtgttatcacaatc

SEQ ID NO: 21589 - DNA, 50 bp, homo sapien
tattctgaaagtataatatttaagargtttggctaagaaactggaaaata

SEQ ID NO: 21590 - DNA, 50 bp, homo sapien
gagaatgggcaaaggaactatgctaygtcatgtcggaggatggataggtt

SEQ ID NO: 21591 - DNA, 50 bp, homo sapien
cttgcctaaacaattttggaggtagrcccatgttcctgatctttcatgaa

SEQ ID NO: 21592 - DNA, 50 bp, homo sapien
agattagagacagtaaaattccagayaggtaagacgtaactgacctctgt

SEQ ID NO: 21593 - DNA, 50 bp, homo sapien
cttggtaacaaaatggattgcacaartatttatatgaaagtttgagcact

SEQ ID NO: 21594 - DNA, 50 bp, homo sapien
cactgcctgaggtactagatagcaaytggaacagataaaaagctaaccaa

SEQ ID NO: 21595 - DNA, 50 bp, homo sapien
gtactgcaaacttcatagttttccaygtaatatgtgctgtctcccatgag

SEQ ID NO: 21596 - DNA, 50 bp, homo sapien
tatagcaccacctgaatgatctatakcctgttctcgtcaatggcaatttc

SEQ ID NO: 21597 - DNA, 50 bp, homo sapien
gaaacggtaccaaattgtcatgttaygcatgtctactatccccatagcta

SEQ ID NO: 21598 - DNA, 50 bp, homo sapien
aatgattaactcatggccttggtccsgaaagtaagtgtcaactgtcacag

SEQ ID NO: 21599 - DNA, 50 bp, homo sapien
agaggaaaaggaatagaattaagaamacccaaagagaaatgttggtggag

SEQ ID NO: 21600 - DNA, 50 bp, homo sapien
atgcccgtcagagccttggccctcaycttcatagcactgatcctatttgt

SEQ ID NO: 21601 - DNA, 50 bp, homo sapien
tgaaaaatgcactgggcttgcaaacrcttttgtcatgtcaacacaactga

SEQ ID NO: 21602 - DNA, 50 bp, homo sapien
ttgctatgtttgatttaatcacatayctaaaccttccaaaatgagtttgg

SEQ ID NO: 21603 - DNA, 50 bp, homo sapien
tccagctatacataataaggttggayaaaagttacaatgggaagccaata

SEQ ID NO: 21604 - DNA, 50 bp, homo sapien
gaagggagttgcatgcattaagtcayagaggcctgaacaaagaatgtggt

SEQ ID NO: 21605 - DNA, 50 bp, homo sapien
attatgtttctcccaatttcagcaasttcctttttttaccctgctatata

SEQ ID NO: 21606 - DNA, 50 bp, homo sapien
aaatattattcttatttaaaccatgwacatcattaacatatttattcaaa

SEQ ID NO: 21607 - DNA, 50 bp, homo sapien
acacacacatcaacagctacacttasaaggaatgaccaataattatcaat

SEQ ID NO: 21608 - DNA, 50 bp, homo sapien
ctttttatacaattggaggttttgakctgatctttcaaagtatcatttcc

SEQ ID NO: 21609 - DNA, 50 bp, homo sapien
aagttacacttagaatggttctacaratattggtgttactgagaatgcag

SEQ ID NO: 21610 - DNA, 50 bp, homo sapien
aaggttctctggttcaactactttarctctctctacttctagacttggct

SEQ ID NO: 21611 - DNA, 50 bp, homo sapien
ctctcttagccatatagtagaagccsgatcatagactctcacccttacac

SEQ ID NO: 21612 - DNA, 50 bp, homo sapien
gttggcattcccaatatttttattakgtccagatctgaacaaagtggtat

SEQ ID NO: 21613 - DNA, 50 bp, homo sapien
attcgaatgtgttttctttatgtaaytctgctgttcaaggactaagagcc

SEQ ID NO: 21614 - DNA, 50 bp, homo sapien
tttttaacttctatttgaataacacmaaaaactgtggaagccttcctcca

SEQ ID NO: 21615 - DNA, 50 bp, homo sapien
cctcaaacttagttagactggaaagragcaatagtgacttaagtacaatg

SEQ ID NO: 21616 - DNA, 50 bp, homo sapien
cctagcaaatattgacaaggaaatayaggttctgacataaattatggcca

SEQ ID NO: 21617 - DNA, 50 bp, homo sapien
actagggttggttgctagcaaaacgsataaaagtaattctccttttgtgt

SEQ ID NO: 21618 - DNA, 50 bp, homo sapien
aagaaaggcagatttattcgagaaastacaaagatctgttgcaagggtgc

SEQ ID NO: 21619 - DNA, 50 bp, homo sapien
tttctatctctccatcctgattgcasgctttctttatctctgctccagtg

SEQ ID NO: 21620 - DNA, 50 bp, homo sapien
aataaatgcctaaatggcaagtacaragaacatttttcagatcttaactc

SEQ ID NO: 21621 - DNA, 50 bp, homo sapien
agtaatgtgatttgtgaactctaagrcattcctcaagtataagtcattaa

SEQ ID NO: 21622 - DNA, 50 bp, homo sapien
ctgtgtgggtaaattccaggactctyaaaaataatctggtctatataagt

SEQ ID NO: 21623 - DNA, 50 bp, homo sapien
tgcccctcacagataccggtcaaacmagaagtgtctcacattagcaataa

SEQ ID NO: 21624 - DNA, 50 bp, homo sapien
tggcaaaatgaataatagccttgcartataataagatcagaatctctctg

SEQ ID NO: 21625 - DNA, 50 bp, homo sapien
tgaggtcaccacagtttagaaatcawccttcatgccccattatacgtttt

SEQ ID NO: 21626 - DNA, 50 bp, homo sapien
acctccatatctgttcacatgttacmagtagtatttttcaagacgacagg

SEQ ID NO: 21627 - DNA, 50 bp, homo sapien
agctttgggggctacacaagatgacragactgcagcaaaccaaacaaatc

SEQ ID NO: 21628 - DNA, 50 bp, homo sapien
ggcctatgtttcatatctctggctayacaataagtcacttgggaagcttt

SEQ ID NO: 21629 - DNA, 50 bp, homo sapien
cacaggcaaggcttcaaatgacacastaggaagaccagcttagaagaaaa

SEQ ID NO: 21630 - DNA, 50 bp, homo sapien
gggagtaagataacaggagattagaygtttacaaaggcaggtaagcaaga

SEQ ID NO: 21631 - DNA, 50 bp, homo sapien
aagctgaaaaattgattcccggacaratgacctagctgaacggaatattg

SEQ ID NO: 21632 - DNA, 50 bp, homo sapien
tcaaagaatattttacaagccacaartgttattcaagctattgttagtaa

SEQ ID NO: 21633 - DNA, 50 bp, homo sapien
ttaacctctccgtgagtggatgaaartacactggactcagaaaaactggg

SEQ ID NO: 21634 - DNA, 50 bp, homo sapien
ttaatctctaattcattttaatgacygactcctttattctttctgatgct

SEQ ID NO: 21635 - DNA, 50 bp, homo sapien
gcactgatctagaatgcagaaaccawtagatttaaggccagccttttcta

SEQ ID NO: 21636 - DNA, 50 bp, homo sapien
ggaaatacatagtgaacattgaacaytctggaaaccagccagtgagtatt

SEQ ID NO: 21637 - DNA, 50 bp, homo sapien
tacctatcaaagaacctaatattgaycattgtctgtagtaagctcttagt

SEQ ID NO: 21638 - DNA, 50 bp, homo sapien
taggatgaataaaacatgatgaaacrcaattggaaacaattgcactaatg

SEQ ID NO: 21639 - DNA, 50 bp, homo sapien
cttagattcaaactggtacatagaaygcttgctctactttcaataataca

SEQ ID NO: 21640 - DNA, 50 bp, homo sapien
ataaaacttaaaaatagaaatgctcrctcaagtgtatgactcattttaaa

SEQ ID NO: 21641 - DNA, 50 bp, homo sapien
cccacaggtgaatcatacagagtttwaaaaatgttggtatgtttaaacca

SEQ ID NO: 21642 - DNA, 50 bp, homo sapien
acatatatttaaagatgtacttctamatgtttatatatttaaagatgtat

SEQ ID NO: 21643 - DNA, 50 bp, homo sapien
agttcagcagctatttggtcccctamgacactggttcaattggcacttta

SEQ ID NO: 21644 - DNA, 50 bp, homo sapien
aatggatttttaatagtaagatccaytgaacgtataaatctaagtaaaga

SEQ ID NO: 21645 - DNA, 50 bp, homo sapien
ctcagcttaagaggttatctatttcrattttcacctggtgagttttgaat

SEQ ID NO: 21646 - DNA, 50 bp, homo sapien
catcactcataaatccataatcatcwctccacctcggaaaaatctcactc

SEQ ID NO: 21647 - DNA, 50 bp, homo sapien
aaccaaacaaccctgtttttgtatawgctatgaacagttaaacttgggtc

SEQ ID NO: 21648 - DNA, 50 bp, homo sapien
aataccaaaatatctaagaaaaataygaagaaactataatgatgaaagca

SEQ ID NO: 21649 - DNA, 50 bp, homo sapien
aatgattgtctgagttctgagagtcrataaaccataatttaaccatttac

SEQ ID NO: 21650 - DNA, 50 bp, homo sapien
aaccatttacgctgctatagcttgaratagatgacaaatattcaaaccat

SEQ ID NO: 21651 - DNA, 50 bp, homo sapien
actaggatcaattagcatcaactackaaaattcctaggtggaaataagag

SEQ ID NO: 21652 - DNA, 50 bp, homo sapien
atacaaagtttgcctgagtcagttayacttaagtcttaaccacattaacc

SEQ ID NO: 21653 - DNA, 50 bp, homo sapien
agaaaagtacattctctatttctaakctagcagttttttctgtgtacagc

SEQ ID NO: 21654 - DNA, 50 bp, homo sapien
ctgagttgttgttgacaacttcagakgacttacaagtaatagtctcaaaa

SEQ ID NO: 21655 - DNA, 50 bp, homo sapien
cctggtatatgtagtgtttcccaaaragtaattcacaattcaaaatctac

SEQ ID NO: 21656 - DNA, 50 bp, homo sapien
ataggtaacctaggtcttggcacaaygtatcagtcaggattggctagtct

SEQ ID NO: 21657 - DNA, 50 bp, homo sapien
tgtcctcaaaggaccagtttaaatargaagagcctctggatggttaaaga

SEQ ID NO: 21658 - DNA, 50 bp, homo sapien
atggagatggtaagttggtaggtccragatagtgaggtgggtcccaggat

SEQ ID NO: 21659 - DNA, 50 bp, homo sapien
cagatcttcatgtcttaccacgtcckcaggtgaatctgataggaggcagg

SEQ ID NO: 21660 - DNA, 50 bp, homo sapien
tgcgtttacctgagatataatgagaragttcctgtcacaacaaattcaaa

SEQ ID NO: 21661 - DNA, 50 bp, homo sapien
atcagtttgatgtgtgatcttgagaragttgctaacagacctaaatatcc

SEQ ID NO: 21662 - DNA, 50 bp, homo sapien
aatggctggatccagggatgcaagaratggcaatagattgggcaaccaca

SEQ ID NO: 21663 - DNA, 50 bp, homo sapien
gatgcacttgtcaaaatccactagcrgaatgagaaaaagatgcataatct

SEQ ID NO: 21664 - DNA, 50 bp, homo sapien
tagtgagggaagttaaggaactacasaacatgagattacctaaggtcgag

SEQ ID NO: 21665 - DNA, 50 bp, homo sapien
atttggcaaataaacagcaccttcaygaaaaggagaatagtcttgcgctt

SEQ ID NO: 21666 - DNA, 50 bp, homo sapien
aacagaaaagtatttgaaggacctasaatggagcagttcaaaacttcttc

SEQ ID NO: 21667 - DNA, 50 bp, homo sapien
tggcatcataggtactatatagacarcctgtgtgagataaaagccatcac

SEQ ID NO: 21668 - DNA, 32 bp, homo sapien
gtgtctgatttacatargacctaaagattggt

SEQ ID NO: 21669 - DNA, 50 bp, homo sapien
ggatggggtggaggaaaaatcaaacmattatagaaataaatgtgccatga

SEQ ID NO: 21670 - DNA, 50 bp, homo sapien
aaagctgcttccatcctccttcttgyagcagctgaccgattttgatgggc

SEQ ID NO: 21671 - DNA, 50 bp, homo sapien
cgtggaggtgggactcattaatataraacaggaaatggtagaaaatacct

SEQ ID NO: 21672 - DNA, 50 bp, homo sapien
ctaaaatattttttggatatactaakgaaaagtaaaacactttataataa

SEQ ID NO: 21673 - DNA, 50 bp, homo sapien
cagcttagtaccattttgaggatgaragaaagagactatatactggaagc

SEQ ID NO: 21674 - DNA, 50 bp, homo sapien
tggggtacatttgatcatcatgctaraacaatttgtaagcaattaaaaga

SEQ ID NO: 21675 - DNA, 50 bp, homo sapien
tagatgataatagatgattgatagayaatagatgatacatagagatagat

SEQ ID NO: 21676 - DNA, 50 bp, homo sapien
atttgaagaggacaatgggctcagaygcaggttttgaaatagacaagtga

SEQ ID NO: 21677 - DNA, 50 bp, homo sapien
ctgggtgcagaaattaaacaagttcrcaacaatgaatgccagacatctgg

SEQ ID NO: 21678 - DNA, 50 bp, homo sapien
tggaaaacttatggtcattcacctcmaattttaaagcagaatgaagtctt

SEQ ID NO: 21679 - DNA, 50 bp, homo sapien
tacaaataccttgaatgtggaaaacrctttattttgaacatttctactcc

SEQ ID NO: 21680 - DNA, 50 bp, homo sapien
aaagttttctccatctctgaaaaagscgtaattcccactcctctgcccta

SEQ ID NO: 21681 - DNA, 50 bp, homo sapien
atgaatactatacatgataagacatkactgtagactgaattgatagtttt

SEQ ID NO: 21682 - DNA, 50 bp, homo sapien
tgggaagatatgaaggaaacatttcyataattgaaggatcttacagatta

SEQ ID NO: 21683 - DNA, 50 bp, homo sapien
tcacactcttgaataattaatgggtmaaagaaggaatcaaaagacaaaaa

SEQ ID NO: 21684 - DNA, 50 bp, homo sapien
agctttattgtacagataaaacaacrgtcaccattattcaaatacatata

SEQ ID NO: 21685 - DNA, 50 bp, homo sapien
tttagcactgtgatgaaatttctcayctaagtagttgccctgtgtttaaa

SEQ ID NO: 21686 - DNA, 50 bp, homo sapien
gcttaatataaatgagtaaaaaggcrcagtcctactaccttaatgaaata

SEQ ID NO: 21687 - DNA, 50 bp, homo sapien
tgcacctagtaattattgaactctgratattttaatggttccccaaaatg

SEQ ID NO: 21688 - DNA, 50 bp, homo sapien
gggagccaacaaaaacacaagattaygtaagactttctattgtcaagaag

SEQ ID NO: 21689 - DNA, 50 bp, homo sapien
tgatggaaccatgaaaggagcatcartgaagaaatcgtacaattcagaat

SEQ ID NO: 21690 - DNA, 50 bp, homo sapien
ttggctgccttaggcaagaacctccragtcacacttgactcttccttatc

SEQ ID NO: 21691 - DNA, 50 bp, homo sapien
gtgcttaaaagcattaccaattagcrcatgggactggatcaccgcgattt

SEQ ID NO: 21692 - DNA, 50 bp, homo sapien
caaaacaaataatttcctactatgcmatccaaatgttaccaatgatgccc

SEQ ID NO: 21693 - DNA, 50 bp, homo sapien
tgaagagtttccactgatttgtgacyatattactcaatattgctttgtag

SEQ ID NO: 21694 - DNA, 50 bp, homo sapien
aataggaaacaaaaaagatttgtatragaagatcctgattatgtttttgt

SEQ ID NO: 21695 - DNA, 50 bp, homo sapien
ataaatgatagataatgatgataggyacgtagatgataaatgattgatag

SEQ ID NO: 21696 - DNA, 50 bp, homo sapien
taggatatgcagatgatgcaacagayattctcagctccgatctgttatct

SEQ ID NO: 21697 - DNA, 50 bp, homo sapien
caataatattgaaaggtcaaggaaayaggtcaaacttgattagggtaaga

SEQ ID NO: 21698 - DNA, 50 bp, homo sapien
tctacatgaagtctttgaaataaaartctcggtctttcacctaaaaattc

SEQ ID NO: 21699 - DNA, 50 bp, homo sapien
atgtggctttttccatgtaatggcasgtagatcatgtaccttggccagca

SEQ ID NO: 21700 - DNA, 50 bp, homo sapien
ccagccatagtaatatttccagtgaygtaagataggatactgagaacata

SEQ ID NO: 21701 - DNA, 50 bp, homo sapien
ttttaattctattttgatatacatayggtagatgactgctaatcagctat

SEQ ID NO: 21702 - DNA, 50 bp, homo sapien
tgtaaaacatagaatggaatatgtcrcagtaactagatctaactaaacat

SEQ ID NO: 21703 - DNA, 50 bp, homo sapien
tagaaaatttctgtagtaattcagayggcccttaattgaaaaaaaaatag

SEQ ID NO: 21704 - DNA, 50 bp, homo sapien
ttgaataaataactgtgtctgaatgrattaatgaattaaaaagctaatca

SEQ ID NO: 21705 - DNA, 50 bp, homo sapien
gggcagctatacttatatcaactatrataggctttaaaaaaaaatataaa

SEQ ID NO: 21706 - DNA, 50 bp, homo sapien
attaatttaatgttatttattaagcrcattttatttaaataattcaaact

SEQ ID NO: 21707 - DNA, 50 bp, homo sapien
ttttgattccattagtttagtttaaygtgaaagctgctccctgcactact

SEQ ID NO: 21708 - DNA, 50 bp, homo sapien
atcgagacaattaatcctagttctgmaattattcatgagataaccgtaag

SEQ ID NO: 21709 - DNA, 50 bp, homo sapien
ctgtatttcttatggaacttcctctraaaaggaacacgctctctgctaac

SEQ ID NO: 21710 - DNA, 50 bp, homo sapien
agtgccaaaaagaagaaagattaccratgagatcatgataaataataatg

SEQ ID NO: 21711 - DNA, 50 bp, homo sapien
gagaaatgaaaacaaacagacgttargagtcaccaaccttcttggaaatc

SEQ ID NO: 21712 - DNA, 50 bp, homo sapien
atatgaaacactttttaaaaggagartcatctatctaataatcactttaa

SEQ ID NO: 21713 - DNA, 32 bp, homo sapien
tttgaactgctccagckaattactcaaaccac

SEQ ID NO: 21714 - DNA, 50 bp, homo sapien
acagtcccataatgtgcctatgacaygattgggttcatacatgaatactt

SEQ ID NO: 21715 - DNA, 50 bp, homo sapien
tgtgtaaggaatgctctgatttcaakatttcattccatgcatttgctcct

SEQ ID NO: 21716 - DNA, 50 bp, homo sapien
ttactccatcctccaaagggctataycgtcaatgtagaatttcagactcc

SEQ ID NO: 21717 - DNA, 50 bp, homo sapien
tttagattgcatatagaagagagacmaaactgcatagaaaagggcctttc

SEQ ID NO: 21718 - DNA, 50 bp, homo sapien
gtggtaatgctatttttaaattctamgtatggaatatttctatagcataa

SEQ ID NO: 21719 - DNA, 50 bp, homo sapien
atgtcttgtacatttgttcaacactsactacattttgaatgcataactgt

SEQ ID NO: 21720 - DNA, 50 bp, homo sapien
tcagagatccagtcagctaaccctcyagaatatcagcaatgttttcttca

SEQ ID NO: 21721 - DNA, 50 bp, homo sapien
gcacctcaagtcaggggagcaaggaygcgtgtaaaggattcatgaatggc

SEQ ID NO: 21722 - DNA, 50 bp, homo sapien
tccaatgcacatactctgtctttctsaaggcctttctgtctagaaaccat

SEQ ID NO: 21723 - DNA, 50 bp, homo sapien
aaagtaagttgttcagaaagaaccaytggagtcattatcagcttcattct

SEQ ID NO: 21724 - DNA, 50 bp, homo sapien
aagaaatatgtttcaatatatgaaargtaaggaggtcattccaagcagcc

SEQ ID NO: 21725 - DNA, 50 bp, homo sapien
aatagccccatgcctcagtacttctyaaaccatgtcattgttctaaagcc

SEQ ID NO: 21726 - DNA, 50 bp, homo sapien
gctgaaagtgaacctgtgacaattayaggttaagagtagcaggtaaaatt

SEQ ID NO: 21727 - DNA, 50 bp, homo sapien
cctttgtaagaatgacatgttggaaytcggcgttgagaaccaagatttca

SEQ ID NO: 21728 - DNA, 50 bp, homo sapien
cctattattaagaatacagacatcamaaaattgctaaaaatgagaagaca

SEQ ID NO: 21729 - DNA, 50 bp, homo sapien
gcacttatgtccttactctttaagcyacttccaatcaggtgctcagttac

SEQ ID NO: 21730 - DNA, 50 bp, homo sapien
aggtaaaatgctaaagcagtttgtaygcagaaacacataaggaatgtgaa

SEQ ID NO: 21731 - DNA, 50 bp, homo sapien
cagaatcttatgtcaattaaaagacygatagggaactagcaagaatgtaa

SEQ ID NO: 21732 - DNA, 50 bp, homo sapien
cgagcatgcgcattaacagacgatasggcagcacaagaccttctgggggc

SEQ ID NO: 21733 - DNA, 50 bp, homo sapien
ctgtcaatataattggctctttcgayggtgagaaaggatgaacacacaaa

SEQ ID NO: 21734 - DNA, 50 bp, homo sapien
ctacggtatttttatctgttgtgaastcaaatatgtctctggctcaatcc

SEQ ID NO: 21735 - DNA, 50 bp, homo sapien
ggaattgtcttcattccagtgcacargtgtcttccattagcctttttcct

SEQ ID NO: 21736 - DNA, 50 bp, homo sapien
tatgatttcatatatatgctcatgargctcacataacacaaaccgaacat

SEQ ID NO: 21737 - DNA, 50 bp, homo sapien
gaacactggtgtaatagtatgtaaaygcacactggaatcaccagggagct

SEQ ID NO: 21738 - DNA, 50 bp, homo sapien
tgagtagtctgtgcattcatgaaackggcaactgtgacatttggaaaaga

SEQ ID NO: 21739 - DNA, 50 bp, homo sapien
atgaatgatatatactgtctccacakataaataaacatattgacatctgc

SEQ ID NO: 21740 - DNA, 50 bp, homo sapien
atacaagggacgtgaagtaggtgaartgggaaaatgtggtatcagggctt

SEQ ID NO: 21741 - DNA, 50 bp, homo sapien
tatatttaatgtatcaaaatactcarggcaaacattttcctcaaaacaaa

SEQ ID NO: 21742 - DNA, 50 bp, homo sapien
gctcatctgaaatgccactttctcayggcgactttcttttatttcctagt

SEQ ID NO: 21743 - DNA, 50 bp, homo sapien
accttatttttagcctggaaactcayggaggacagattttgattttcatt

SEQ ID NO: 21744 - DNA, 50 bp, homo sapien
aatccttttgtttattttttgtatcrgataactgtcattcatcatggatt

SEQ ID NO: 21745 - DNA, 50 bp, homo sapien
ctgcattttactttcttcatgtctasagatagataatacttaagcaactt

SEQ ID NO: 21746 - DNA, 50 bp, homo sapien
aggagaaatttcttttactatctcayatcataaatcaaatagtagaaagc

SEQ ID NO: 21747 - DNA, 50 bp, homo sapien
aagagagtaggcaaatatggcaatakaaaatgctaacagcagcagatggc

SEQ ID NO: 21748 - DNA, 50 bp, homo sapien
taattttcatttcacaaatggaaatkacatcatcaagaaggagggcctgt

SEQ ID NO: 21749 - DNA, 50 bp, homo sapien
agaaaataaatgtgaatggaatacartgaatactgcataattttttcttg

SEQ ID NO: 21750 - DNA, 50 bp, homo sapien
cttattattttttgatacactattawgggtcaagtataaaaagtattggt

SEQ ID NO: 21751 - DNA, 50 bp, homo sapien
tcttccaaatctcatggtctattacrgcttaggtgtccagagattcgttt

SEQ ID NO: 21752 - DNA, 50 bp, homo sapien
ataagagatgtgtttgactggccaasaattgactgacacagttctttcgg

SEQ ID NO: 21753 - DNA, 50 bp, homo sapien
gaggaagagtactatccaaggaaccsgctatcatcacaaattctgcagac

SEQ ID NO: 21754 - DNA, 50 bp, homo sapien
ttatttgtcaagtatctatccacatyacttgacgatttagaggcaataca

SEQ ID NO: 21755 - DNA, 50 bp, homo sapien
ccatcgagagagcagtcaaggtttamataatattctggacattttcaatg

SEQ ID NO: 21756 - DNA, 50 bp, homo sapien
atggaaataaactcaaattgagactraagaggttagaggagggaacttag

SEQ ID NO: 21757 - DNA, 50 bp, homo sapien
ttatagcaaatgtaaattggagtcayattcagttgttcctggaccctctt

SEQ ID NO: 21758 - DNA, 50 bp, homo sapien
ttaaagttaatttggtaatagctaarattcacatcaaatataccaaaagg

SEQ ID NO: 21759 - DNA, 50 bp, homo sapien
ttttcaaccttctctactgagactcygaaaaaatcaaaacttgtttaaga

SEQ ID NO: 21760 - DNA, 50 bp, homo sapien
gagatataaagagtaaaggaaaatargacaggagcttgcctgggaagtct

SEQ ID NO: 21761 - DNA, 50 bp, homo sapien
aggcacaaatctttgtgcaccagaayttaaccaggcagacattcattata

SEQ ID NO: 21762 - DNA, 50 bp, homo sapien
ttctgtttgactaaaacagcactgaytcaggaacacagctacataaagta

SEQ ID NO: 21763 - DNA, 50 bp, homo sapien
aaagggaatattacctcagctatccraaagaactgtgtcagtcaattgtt

SEQ ID NO: 21764 - DNA, 50 bp, homo sapien
ttgacacaggtgatttaacagtatasagttgagacagttccacccaatta

SEQ ID NO: 21765 - DNA, 50 bp, homo sapien
tgtcactctaatgctttctttctccratagtgttgtgttaaattatttct

SEQ ID NO: 21766 - DNA, 50 bp, homo sapien
taaatctttgtgccgatagcatagamtattactgaaaagtcatagtgtta

SEQ ID NO: 21767 - DNA, 50 bp, homo sapien
catgtcctggtattctcggtgttacyggtacaggattaaagcttgtcatg

SEQ ID NO: 21768 - DNA, 50 bp, homo sapien
gttcagttctttgctgacttcctaamtggtgatgactctgcctggcaccc

SEQ ID NO: 21769 - DNA, 50 bp, homo sapien
tcagtttatgtccacttgatgtaaayagaacccaatgacgggggaaaata

SEQ ID NO: 21770 - DNA, 50 bp, homo sapien
tgctgacccctgtaccaggctcttaycgcttgatcacacacctgtgttta

SEQ ID NO: 21771 - DNA, 50 bp, homo sapien
atcagcagctatttattggtacagakaccatattttcatccaattaaatt

SEQ ID NO: 21772 - DNA, 50 bp, homo sapien
aatcttctgaaactgcaccttcaaayagttgtgtatatgtatgtattaca

SEQ ID NO: 21773 - DNA, 50 bp, homo sapien
taatcctatctttgtgtttatatgayggcattctactttttctgtgtgca

SEQ ID NO: 21774 - DNA, 50 bp, homo sapien
actatgcaagacagtgtgaatatccraagaaatatagagtactatatctg

SEQ ID NO: 21775 - DNA, 50 bp, homo sapien
ctgtcttgcatagtaaaaacaccaawtaacactctccttgttttaagtct

SEQ ID NO: 21776 - DNA, 50 bp, homo sapien
catttaggcaaaggaccatctattargataactctaaaatattctgcttc

SEQ ID NO: 21777 - DNA, 50 bp, homo sapien
tcccagtaaacctctcaatactgtcrctgcatagatattctttggggcac

SEQ ID NO: 21778 - DNA, 50 bp, homo sapien
ataaaagaggcctgatattcagcgarcaagcacttaccctacagaggcct

SEQ ID NO: 21779 - DNA, 50 bp, homo sapien
tgtggaagccttcaataccatgcaarataatttggtctttgttctgcaag

SEQ ID NO: 21780 - DNA, 50 bp, homo sapien
tcagaaaaagatatattgataagtakaaacatttctctgctttctttcca

SEQ ID NO: 21781 - DNA, 50 bp, homo sapien
attctcaccagcttgtttaggtgaasgacagaaacacctttcaaaaccac

SEQ ID NO: 21782 - DNA, 50 bp, homo sapien
aacaacaacaataacaaaaagtcatragagttatagatgttatgttagtc

SEQ ID NO: 21783 - DNA, 50 bp, homo sapien
tgggcagcacatgaactcactgaacratctaagcatcttgagaaatgaat

SEQ ID NO: 21784 - DNA, 50 bp, homo sapien
cccactctcaggaacttggaattaaragaagctctctgacaatctgacat

SEQ ID NO: 21785 - DNA, 50 bp, homo sapien
atttctatttacaatccagtagatcygaaaagacatcgccacataaaatg

SEQ ID NO: 21786 - DNA, 50 bp, homo sapien
tggtctaaaatataacatagctgggwcaacatcattcatgagagacctga

SEQ ID NO: 21787 - DNA, 50 bp, homo sapien
aaattattttatcaagttcatgaaastctcacctgaggagaaactgattt

SEQ ID NO: 21788 - DNA, 50 bp, homo sapien
cttctaagaatagagagtttcccaawtgagagattctgatattcaaatat

SEQ ID NO: 21789 - DNA, 50 bp, homo sapien
tctgccatccaaaatacattataccraaagcaaaatgagattaaatttcc

SEQ ID NO: 21790 - DNA, 50 bp, homo sapien
gattttttttaacacctctttgaccrcataaacatctgtttctgttattt

SEQ ID NO: 21791 - DNA, 50 bp, homo sapien
gaagattagatggtagtgataaacaytgctaggactaagaatggagaaag

SEQ ID NO: 21792 - DNA, 50 bp, homo sapien
aaataaaatgcgacatattagaaaasagaggatattagctcatttttgtt

SEQ ID NO: 21793 - DNA, 50 bp, homo sapien
aaacacatttcctctgatatgtcaaygttagtaatagtagtagctaatgt

SEQ ID NO: 21794 - DNA, 50 bp, homo sapien
aataaaccgtaaagtatgctagcaasttgccatgatatttgattccagtt

SEQ ID NO: 21795 - DNA, 50 bp, homo sapien
agttggttatgatttgctcatcttcmaaatttagataataataaaggcaa

SEQ ID NO: 21796 - DNA, 50 bp, homo sapien
gtctcaacctgaatgcctttttcacrgagacctgcagagatcattctacc

SEQ ID NO: 21797 - DNA, 50 bp, homo sapien
aggaaaaattgctacagcagctgtamtaaccaatattctacatttcaaca

SEQ ID NO: 21798 - DNA, 50 bp, homo sapien
gacctcattagaaggcaattttaacygtctaagtaatatatgggaaagac

SEQ ID NO: 21799 - DNA, 50 bp, homo sapien
atttaaaaccttaatgtttagtagcmatttaccacttactgtcatgccac

SEQ ID NO: 21800 - DNA, 50 bp, homo sapien
atggaaggagatagacaaaacctacyaaataataaggcaggatttattat

SEQ ID NO: 21801 - DNA, 50 bp, homo sapien
attaaaaatatctgcaaagcaattaygagaaacagtcattttcaccacat

SEQ ID NO: 21802 - DNA, 50 bp, homo sapien
atgcccatgatgacttacgtggtcasaatcacgctaaatgcattacattg

SEQ ID NO: 21803 - DNA, 50 bp, homo sapien
gaaataaaacttgaatgggtagaaasgtggtacatatgaattaggttttc

SEQ ID NO: 21804 - DNA, 50 bp, homo sapien
tacgccagtcagtaacataactgccrcacttgaacgacaaatttcactct

SEQ ID NO: 21805 - DNA, 50 bp, homo sapien
aagtttggggtgagggttatcctctyactttgattagactccccacttct

SEQ ID NO: 21806 - DNA, 50 bp, homo sapien
atattttattaataaggaagtctcartgagaaaggacaccttgattttgt

SEQ ID NO: 21807 - DNA, 50 bp, homo sapien
tgacttcacggcaggaggtaagacayggttggtttctcaatcacgatatc

SEQ ID NO: 21808 - DNA, 50 bp, homo sapien
attaaatggggctaaggtaacaaccrgaaggtactcattccaacaaggcc

SEQ ID NO: 21809 - DNA, 50 bp, homo sapien
aaatgttacttcattttctttgtacsaaacaggcagagagagcctgtatc

SEQ ID NO: 21810 - DNA, 50 bp, homo sapien
gcttgttaggcataacttgctaacaygtacaattactgatggtcaagatc

SEQ ID NO: 21811 - DNA, 50 bp, homo sapien
gtcatttgaaatggattaggtacacragcatcaacatggttaaagctcta

SEQ ID NO: 21812 - DNA, 50 bp, homo sapien
cttctgatgaaggcttctaaaggcamactagatggtggcttcctcgcact

SEQ ID NO: 21813 - DNA, 50 bp, homo sapien
aatagttttattatataggtctccayggtttcagtctcttctctgactca

SEQ ID NO: 21814 - DNA, 50 bp, homo sapien
tgctacacagtgaagtatccttaacygcagagtaggttctcacaggtgaa

SEQ ID NO: 21815 - DNA, 50 bp, homo sapien
atgaattccaatatttttgccctaasgtcattgccatgatttcataaaag

SEQ ID NO: 21816 - DNA, 50 bp, homo sapien
atgcaaaacgaatccaggcagcaatmataataagccattaaatgagccaa

SEQ ID NO: 21817 - DNA, 50 bp, homo sapien
tttgtcagtggattctgagggaaaayctgtaaattagagagggatgagcc

SEQ ID NO: 21818 - DNA, 50 bp, homo sapien
attaacctgttcattacaaggtggcyatctatgacactgttgctttattg

SEQ ID NO: 21819 - DNA, 50 bp, homo sapien
aagaacaaaattaagggaaaattaamacctgagagaatgatatttaccac

SEQ ID NO: 21820 - DNA, 50 bp, homo sapien
acttcattgccatgactacaaagaaytgatgtgatatgttttcagctcaa

SEQ ID NO: 21821 - DNA, 50 bp, homo sapien
cacctcccccgattcaaacttgaaaytaagtatgagctaaattccctgtt

SEQ ID NO: 21822 - DNA, 50 bp, homo sapien
gggttctcaaatgtgttgtacaaaawgtttcatgtaataaaattaagcaa

SEQ ID NO: 21823 - DNA, 50 bp, homo sapien
ttatcacgacattgttagttgaaagkcagaggagttaaaacctgaatcta

SEQ ID NO: 21824 - DNA, 50 bp, homo sapien
gaggtttcaaaccaaataaacatcaytgaaagataggttcaggtttaaac

SEQ ID NO: 21825 - DNA, 50 bp, homo sapien
ttgtctcagcttgttctctgattaamcttctgttcatcatcccagaccta

SEQ ID NO: 21826 - DNA, 50 bp, homo sapien
ttcattatttttgtcatggtttcackgaagatgagaagcatgaaaagtgg

SEQ ID NO: 21827 - DNA, 50 bp, homo sapien
tgtcaggactggcaagggcttacccracttcacggatcacaggttcacac

SEQ ID NO: 21828 - DNA, 50 bp, homo sapien
attaatgcattcatctattaaggtarctaaaacactatttgagataaatt

SEQ ID NO: 21829 - DNA, 50 bp, homo sapien
tgaactttgtaaagtaaaggtaaaayatgaaactgaattatctaatgaaa

SEQ ID NO: 21830 - DNA, 50 bp, homo sapien
gagaggaaattaagggtgttattctsaactacctaaaattaggaagttaa

SEQ ID NO: 21831 - DNA, 50 bp, homo sapien
tatggtaaagggattctaagcattarcaacataatttttttttttttttt

SEQ ID NO: 21832 - DNA, 50 bp, homo sapien
gggggtttagaggaatcaaatgatgmatggcaggcttagcttggttcatc

SEQ ID NO: 21833 - DNA, 50 bp, homo sapien
gtcaggagagagcatatcttaaatcrcatatactctcagactaagactca

SEQ ID NO: 21834 - DNA, 50 bp, homo sapien
tgttcataacaaagctaggcccttcrcagttggtaacaaacatagctacc

SEQ ID NO: 21835 - DNA, 50 bp, homo sapien
gtacaactatttgcatatatgagaartcaaaactacaaagaacagtgggt

SEQ ID NO: 21836 - DNA, 50 bp, homo sapien
catgtatggttttttatacatcttcrctatggtaaatactgctgcaataa

SEQ ID NO: 21837 - DNA, 50 bp, homo sapien
gtataaaaaaccatacatggataaaytgataaagaaaatgttgtatataa

SEQ ID NO: 21838 - DNA, 50 bp, homo sapien
ctatcagtgttccagtgtcttctgaycatctataccttgttgccgatccc

SEQ ID NO: 21839 - DNA, 50 bp, homo sapien
tgcctatttgaatctgtgttattagmataatcaaatcttaatgagtgctt

SEQ ID NO: 21840 - DNA, 50 bp, homo sapien
ggcggccttgactggtgcagtgccarcctctaaggtcaaggttctcctgg

SEQ ID NO: 21841 - DNA, 50 bp, homo sapien
tgagatttttgcaagcacggtctaaractatgtagatacaaagcttagca

SEQ ID NO: 21842 - DNA, 50 bp, homo sapien
aaaatctagcaatgatgatgaccgtyacactcctcgattgagtgttgaca

SEQ ID NO: 21843 - DNA, 50 bp, homo sapien
ctgggcctagacaaaagggccaagamagtctaaagaacaggaaacatgag

SEQ ID NO: 21844 - DNA, 50 bp, homo sapien
aagccacaggagacatgcaaaattcmatcagttattatattaatatccat

SEQ ID NO: 21845 - DNA, 50 bp, homo sapien
gaagcttccctctaatatgcctcgaygggtcatggtaatataatgcagcc

SEQ ID NO: 21846 - DNA, 50 bp, homo sapien
ctaagcttataaaagtcagagcctayacccttaacaaggtaacaacctaa

SEQ ID NO: 21847 - DNA, 50 bp, homo sapien
caatgccatttatcttcctaaaacawctctgttgagcaccttgagaaaca

SEQ ID NO: 21848 - DNA, 50 bp, homo sapien
aaatctttcaaataggggaaatgatraattcaagctggattaagaaatta

SEQ ID NO: 21849 - DNA, 50 bp, homo sapien
tctaattttcacccagttagaatcayccaaaggcatttcactttgctaga

SEQ ID NO: 21850 - DNA, 50 bp, homo sapien
aattatggaagtcattcaagtaggasaatgatgttttcaatttttttgtg

SEQ ID NO: 21851 - DNA, 50 bp, homo sapien
gggaagcaggaaagatgccaacttayggtgtttacactactctgtagcca

SEQ ID NO: 21852 - DNA, 50 bp, homo sapien
cttcaggttttcagagcaagggaacrccataatcagacccgtgctttgtc

SEQ ID NO: 21853 - DNA, 50 bp, homo sapien
gcaaggagtggaactattacatggcrgactcttttcactctcaagttgaa

SEQ ID NO: 21854 - DNA, 50 bp, homo sapien
taaagtgtttgggatgaatcagatgyactggtcttcatatacaaagagaa

SEQ ID NO: 21855 - DNA, 50 bp, homo sapien
ctgctctatgtctgtaacaggactcracggtgactgtacgtcaatgtata

SEQ ID NO: 21856 - DNA, 50 bp, homo sapien
taataatgaacaggtcttggtcttawatctcaaaggtgcctagaaagtta

SEQ ID NO: 21857 - DNA, 50 bp, homo sapien
acgtttccagccattcacagttgacyataaaggatcctaactagtcactg

SEQ ID NO: 21858 - DNA, 50 bp, homo sapien
ccatgatctctgccttgataggtgaygcaactgaaatgtgccaaggagaa

SEQ ID NO: 21859 - DNA, 50 bp, homo sapien
actacctgaatgaaatcttaccatayggaatccctcttgttcatggtttg

SEQ ID NO: 21860 - DNA, 50 bp, homo sapien
aaggtataaggaaggtgtgctactayattgtgtttgaatatctgcagttt

SEQ ID NO: 21861 - DNA, 50 bp, homo sapien
acagtcaggagggaatctggattaayatgttttcaaaaggattaaaacta

SEQ ID NO: 21862 - DNA, 50 bp, homo sapien
gtttttcaggctcagaaaggtatagraacccactacaaacatattctggt

SEQ ID NO: 21863 - DNA, 50 bp, homo sapien
gacaaattttgaatctacagactgtwaataatccaccttgacaatggtca

SEQ ID NO: 21864 - DNA, 50 bp, homo sapien
cgccaagttattcaagtcttctaacrcggaaatggcttttgaatctgtcc

SEQ ID NO: 21865 - DNA, 50 bp, homo sapien
cttatgtttttaaccagctcacaagwattagtactgctactagtgtagaa

SEQ ID NO: 21866 - DNA, 50 bp, homo sapien
gcctgcccagggcttctgcgtgagamctactccatgagccatcagaaacc

SEQ ID NO: 21867 - DNA, 50 bp, homo sapien
ataaccctaatcctatctgatcaaargatatgaataggcagttgaaagga

SEQ ID NO: 21868 - DNA, 50 bp, homo sapien
gtctaaaatgtttggagtgtaatgamgtcttccaggacgagacatcactg

SEQ ID NO: 21869 - DNA, 50 bp, homo sapien
ttaatgtacaaacggcagcaccttaygtatgacagtggaggccagaaagc

SEQ ID NO: 21870 - DNA, 50 bp, homo sapien
tttagcaaatcatgtttgacaagaamaaaggttacctgaaatcagagcta

SEQ ID NO: 21871 - DNA, 50 bp, homo sapien
tatatgagctggatgattgcctcatyacagaaccctaaacttactttgct

SEQ ID NO: 21872 - DNA, 50 bp, homo sapien
catataaatgtactgtcttaggaagraatggacaagttccacttccagat

SEQ ID NO: 21873 - DNA, 50 bp, homo sapien
tcttgtttatgccatgggtacgaaastaaattatatctaggcttgtacca

SEQ ID NO: 21874 - DNA, 50 bp, homo sapien
agaaaccaatcaattacctctcacartgtcatagtgcagacaatgattgt

SEQ ID NO: 21875 - DNA, 50 bp, homo sapien
ctgaaaatgtgcctctgttttacaargacacatccatttcgtcatttctt

SEQ ID NO: 21876 - DNA, 50 bp, homo sapien
cttaatatcttgacactgtaatacaytaggttgtccagggcctgaagctt

SEQ ID NO: 21877 - DNA, 50 bp, homo sapien
caaacttaacagacagcatcagagartaagttcagaatcccttgcagaaa

SEQ ID NO: 21878 - DNA, 50 bp, homo sapien
cctgggcacgttgatgtacctgtgcyaaacacctgcttattaagcgccta

SEQ ID NO: 21879 - DNA, 50 bp, homo sapien
ttgagcataaatataccagattccawaaatgtttacattgttcctaaatt

SEQ ID NO: 21880 - DNA, 50 bp, homo sapien
accaacacttaccctatttttctgcrattgtttacacctaaacttctcaa

SEQ ID NO: 21881 - DNA, 50 bp, homo sapien
cagaaatacactctatgagaagcaamattgtgtggtaattaagggcaaag

SEQ ID NO: 21882 - DNA, 50 bp, homo sapien
aaactttcctacttctgtgctttcarcctatagaaaacgcagtcatcatt

SEQ ID NO: 21883 - DNA, 50 bp, homo sapien
agagaggagaggaaagacaccttacyctgcatttggttaaaggtagctct

SEQ ID NO: 21884 - DNA, 50 bp, homo sapien
tgatgctttctgaatcagtgatgctmaaataatgcctgttcaaaaagatt

SEQ ID NO: 21885 - DNA, 50 bp, homo sapien
gactagatggagaactgtaactctcygaagatgtttctccacatgtgtca

SEQ ID NO: 21886 - DNA, 50 bp, homo sapien
gcaacagaggggtggattctttcctyaccagtgcaaccaaagtgggcagc

SEQ ID NO: 21887 - DNA, 50 bp, homo sapien
tctttacatgaagaattctttttgamgctaatcatagtgctgaaggtaat

SEQ ID NO: 21888 - DNA, 50 bp, homo sapien
ctgatggcattgatttatactactgracttgaaaactcttgggggcaaga

SEQ ID NO: 21889 - DNA, 50 bp, homo sapien
ctaggagcaggagatgactgtgatgraatagtgactaagttctatttgaa

SEQ ID NO: 21890 - DNA, 50 bp, homo sapien
attttgatctcctatgcatcacaaayggtgttaaggacatctagaatggt

SEQ ID NO: 21891 - DNA, 50 bp, homo sapien
agtagaccttttatcaatgctagagyaaatcatctcaaaagctgctgctg

SEQ ID NO: 21892 - DNA, 50 bp, homo sapien
tttagtacatattaaaatgcaaaggrattagtaaagaagtagaagagccg

SEQ ID NO: 21893 - DNA, 50 bp, homo sapien
caggagagggtgaacgcaattatgaraaaaggttaaaattgtcatactag

SEQ ID NO: 21894 - DNA, 50 bp, homo sapien
ttaatttttgtcaaattgatgggtakgaaatagtatccttttttgtgtta

SEQ ID NO: 21895 - DNA, 50 bp, homo sapien
ataaacttttttattctaagggaagycagtgattaaaaagcggtttatgg

SEQ ID NO: 21896 - DNA, 50 bp, homo sapien
agaacagtgcctggcagattgtaagyacccaacaagtattcgttgactaa

SEQ ID NO: 21897 - DNA, 50 bp, homo sapien
tgctcagtgtcccattttatagtagyataaccagataaatatgattctca

SEQ ID NO: 21898 - DNA, 50 bp, homo sapien
tagtattttgaaattttaagataatyatgaagtagatacattttaaagaa

SEQ ID NO: 21899 - DNA, 50 bp, homo sapien
atattcagcaacagaacacagggaaycgaatggtgagacacatttacaag

SEQ ID NO: 21900 - DNA, 50 bp, homo sapien
aaatttaaaattacctcaggatatasacatgcatggaactaatattttat

SEQ ID NO: 21901 - DNA, 50 bp, homo sapien
tgcaatcctcgcaaagttaggcggaycaaaccattccagaaagcagctgg

SEQ ID NO: 21902 - DNA, 50 bp, homo sapien
aattctctggaatcagaaatccacaracatttaaactgaaacaacatggc

SEQ ID NO: 21903 - DNA, 50 bp, homo sapien
ccatgagcagatcttcaggtatccamggaccttcctggactctcttatac

SEQ ID NO: 21904 - DNA, 50 bp, homo sapien
ctaagacactgttagatctgtaaaaygttacccattcaaatgggttattt

SEQ ID NO: 21905 - DNA, 50 bp, homo sapien
tatcctggtacattctgtccaacatsagaacctatgattcctccttgaaa

SEQ ID NO: 21906 - DNA, 50 bp, homo sapien
aaactaatgaggccggtagatttggracatcaaagttgttaagttaggcc

SEQ ID NO: 21907 - DNA, 50 bp, homo sapien
agcctgagaatgacagttcagcatcrcagcatcattctgctccactcccc

SEQ ID NO: 21908 - DNA, 50 bp, homo sapien
aatgagagtttaggatttctgacaaytcatagatataaaataggaattct

SEQ ID NO: 21909 - DNA, 50 bp, homo sapien
gtatattcactagtgaaacaactcaratatgtaagaacgttaggctgaca

SEQ ID NO: 21910 - DNA, 50 bp, homo sapien
cttccggggtgcctttcacatagtawctgagagccatttttaacaggctt

SEQ ID NO: 21911 - DNA, 50 bp, homo sapien
acaactcaatttttcagcagtgacaytaaagcagacataggaaatatgta

SEQ ID NO: 21912 - DNA, 50 bp, homo sapien
atttgtacccttacttaaacatacawccttttgtcatagcccattaaaat

SEQ ID NO: 21913 - DNA, 50 bp, homo sapien
tatgcttgaaggctaatacccttgtraaaacagactgaagttggcagcta

SEQ ID NO: 21914 - DNA, 50 bp, homo sapien
ccttgtgataatccagggatagatcrgagtgggaaactagaatctgagaa

SEQ ID NO: 21915 - DNA, 50 bp, homo sapien
cttgacagatctgtaactgaccttamaactttattgcaccagctaaatcc

SEQ ID NO: 21916 - DNA, 50 bp, homo sapien
ggaggaagacagactagatcatacaycagcacgtggcactgtaaggtctc

SEQ ID NO: 21917 - DNA, 50 bp, homo sapien
ttctgagagtctagtcccttttacaytagagggtgctgctagaggaggta

SEQ ID NO: 21918 - DNA, 50 bp, homo sapien
cttgaacattccatatatggtaatawgattatctgctgatcataaggtct

SEQ ID NO: 21919 - DNA, 50 bp, homo sapien
tattaattttggttgtgctcaaataygttcttattgaccttgtttatttt

SEQ ID NO: 21920 - DNA, 50 bp, homo sapien
gtgggatgttacccagcagatatacrggtgctccttcagagtctgttctg

SEQ ID NO: 21921 - DNA, 50 bp, homo sapien
aaccttccactgccaagtttcaggaygaagagaacactctgagtggtttt

SEQ ID NO: 21922 - DNA, 50 bp, homo sapien
ggtcatttgttttctactccaagggraccaaaaatgtagaaatttgagct

SEQ ID NO: 21923 - DNA, 50 bp, homo sapien
caaaactgcaacatccagctcagctkacaatagaacatctagcaagcttg

SEQ ID NO: 21924 - DNA, 50 bp, homo sapien
caccataagtgtaatttggaggccaygtattgaaaaaatatattagtaac

SEQ ID NO: 21925 - DNA, 50 bp, homo sapien
aagagcattaagttggtctcaaacaycttgacaaaaacagaagacagaat

SEQ ID NO: 21926 - DNA, 50 bp, homo sapien
ggggaatttgtcatttaagacagtcraacttgcatacacagtgatgactg

SEQ ID NO: 21927 - DNA, 50 bp, homo sapien
ttaaaaatgtagtttagaaggcccakgtaccagaggcccactaattgaat

SEQ ID NO: 21928 - DNA, 50 bp, homo sapien
ctctcagtctatttctacactgaaayctaatacagaaagtaaatattcca

SEQ ID NO: 21929 - DNA, 50 bp, homo sapien
ttttaaaaatatcagttctaagtagscctagcgtttctacatatttttag

SEQ ID NO: 21930 - DNA, 50 bp, homo sapien
cacagaacttggcctttggtctacaygatggagaaagaacagtcattgtt

SEQ ID NO: 21931 - DNA, 50 bp, homo sapien
ttcattcattcaacataaatgaaacyacatattcccttggcgtgaaattt

SEQ ID NO: 21932 - DNA, 50 bp, homo sapien
ctccaagcacagaaagcaggcatagrcccttgagagagcttgaaatattt

SEQ ID NO: 21933 - DNA, 50 bp, homo sapien
ggaaggaggcaggaacataactgtckacgggtgatgccctcagaaggcag

SEQ ID NO: 21934 - DNA, 50 bp, homo sapien
gtgtatgccttaggaaaagggaacaycaaacagagtggtccaagatcatg

SEQ ID NO: 21935 - DNA, 50 bp, homo sapien
atcggcaaatacacacatacgatatraggccgtctccctcctcaccatat

SEQ ID NO: 21936 - DNA, 50 bp, homo sapien
atacattgttacacattaactatcastcttctaatcccagttgagtttcc

SEQ ID NO: 21937 - DNA, 50 bp, homo sapien
cattgatttcaatcaacagtttcgartccatttcttctttctttttcacc

SEQ ID NO: 21938 - DNA, 50 bp, homo sapien
cagcttgggaggccatagtctgagaygaagatgttggcagggccctgctg

SEQ ID NO: 21939 - DNA, 50 bp, homo sapien
ataaacacaatctaaatgacctctaragattgctaatttatcatagtact

SEQ ID NO: 21940 - DNA, 50 bp, homo sapien
aaaggtgccaaatctacaaaatccayagaggaaagtcatcttattgaggg

SEQ ID NO: 21941 - DNA, 50 bp, homo sapien
cagcatctgctgagtaagttcaatcyctcaggtatgtcagaagggcaagt

SEQ ID NO: 21942 - DNA, 50 bp, homo sapien
gacaggcacattttgaaagggatgcygaatataaaaggcagggatgacac

SEQ ID NO: 21943 - DNA, 50 bp, homo sapien
acctgcatacatcatatgtgaaaaaytggatatataatgtatatctgcag

SEQ ID NO: 21944 - DNA, 50 bp, homo sapien
cggaaagagcaaacacagtgcgccaygggaagaaggaaggaacaaccaag

SEQ ID NO: 21945 - DNA, 50 bp, homo sapien
cagacatcacaagaactagcctcaayctttaaagctgaaagaaactttca

SEQ ID NO: 21946 - DNA, 50 bp, homo sapien
aactttgtattagtcactctttaacycagtgttgaaattttggagacttt

SEQ ID NO: 21947 - DNA, 50 bp, homo sapien
atcttgtctttgagtgcttatctagycctatctatttatgtattatttat

SEQ ID NO: 21948 - DNA, 50 bp, homo sapien
ctgtgagtgagctaaagttaagataygtttctactgggtcttagtttctt

SEQ ID NO: 21949 - DNA, 50 bp, homo sapien
gacatggaagcggggtgaaaagtccyagatcattccactcaagcacacag

SEQ ID NO: 21950 - DNA, 50 bp, homo sapien
aaatatccaggtgggtgtggcttaasagtattctctagtgaatgaaaatg

SEQ ID NO: 21951 - DNA, 50 bp, homo sapien
agaagattgacagaaacaatgacaamtgagtgtggtcatttaaaaaaatg

SEQ ID NO: 21952 - DNA, 50 bp, homo sapien
aaaagaaaaacactgagaacatgttwaaatctcctaattcttgataacct

SEQ ID NO: 21953 - DNA, 50 bp, homo sapien
taatcggtgatttaacacctcaaatyattcactcagatttccgaaggagt

SEQ ID NO: 21954 - DNA, 50 bp, homo sapien
ccgaaaatccggattgttctacctcwaagaccgatctgctcagatcttct

SEQ ID NO: 21955 - DNA, 50 bp, homo sapien
atgctatggggtactatgagaacggraattatgtaagtaaatacatttag

SEQ ID NO: 21956 - DNA, 50 bp, homo sapien
tccaagtgcggagtctatgggcataytatataagagtctgttatacagcc

SEQ ID NO: 21957 - DNA, 50 bp, homo sapien
aaatgcacagtgaatatccaatctaygaatgttagtcatcagaaccaaaa

SEQ ID NO: 21958 - DNA, 50 bp, homo sapien
agccactgtgcccagcctgaatttcragttaaagctagagttgcatttga

SEQ ID NO: 21959 - DNA, 50 bp, homo sapien
aatgaagaaaattgagaagaaacgaygcgaaggttctcacagtttgtcat

SEQ ID NO: 21960 - DNA, 50 bp, homo sapien
cttctgcataggcagaagagatgacygggaattgtgatttcaaaggctga

SEQ ID NO: 21961 - DNA, 50 bp, homo sapien
ggaatgagagggaattgcttctaaaytcctgtgttctctatgtctaggac

SEQ ID NO: 21962 - DNA, 50 bp, homo sapien
actatgtgagagcagcatggttcaartcactttgctgcaactcactccaa

SEQ ID NO: 21963 - DNA, 50 bp, homo sapien
catgctcctgaatggctactggtcaygaaaaaggaaattttaaaatttcc

SEQ ID NO: 21964 - DNA, 50 bp, homo sapien
cacttgcccagattacaaccaggaamttcacttggggtctctgtctgtta

SEQ ID NO: 21965 - DNA, 50 bp, homo sapien
aaataagaagccagccctttgtaaaytatgactttctacacacgtgtcag

SEQ ID NO: 21966 - DNA, 50 bp, homo sapien
ggcaaataagaaaagaagatgatccyatttatatagtccaaaacaggcaa

SEQ ID NO: 21967 - DNA, 50 bp, homo sapien
tagctataaaaatgaatcaaatagarctataagtatccccttaaaataga

SEQ ID NO: 21968 - DNA, 50 bp, homo sapien
gttccagcacattcagcaattcataygccatgctcagagatcttcaagag

SEQ ID NO: 21969 - DNA, 50 bp, homo sapien
ataacacaggccaggttatatgtccygaaagatgagaatgtgtgaagtcc

SEQ ID NO: 21970 - DNA, 50 bp, homo sapien
aggaaatggagtttcagagagaacargaagttgcccaaagattatgaccc

SEQ ID NO: 21971 - DNA, 50 bp, homo sapien
ttttcagactctctaaggatgggcawtatatggtgtacaatgtttacaac

SEQ ID NO: 21972 - DNA, 50 bp, homo sapien
ccacagagaccatccatctaaaaaaygatcctataaagaatgcaactcaa

SEQ ID NO: 21973 - DNA, 50 bp, homo sapien
acaggatggacacacaatcccaagamcatgggcacagttgggaagcttgt

SEQ ID NO: 21974 - DNA, 50 bp, homo sapien
cactgatggtgatgcaatgaaaaaamataacctggcagtcagcatgtttg

SEQ ID NO: 21975 - DNA, 50 bp, homo sapien
gtgcatttttcagtatccagataaakgtggaaaaggcagctgacatgggg

SEQ ID NO: 21976 - DNA, 50 bp, homo sapien
tttatcttgggattcccgggctccasagttgcaagaaaataaatctcttt

SEQ ID NO: 21977 - DNA, 50 bp, homo sapien
gccttcctggagcgagttaattccartatggtgtcaaccaagctcgggat

SEQ ID NO: 21978 - DNA, 50 bp, homo sapien
tccaggcaagcccagtttggatgcamgaaccctgcagatgcatgagaaat

SEQ ID NO: 21979 - DNA, 50 bp, homo sapien
tacatataaattttgtagttgagtaygtacaaagatagtaggagataagt

SEQ ID NO: 21980 - DNA, 50 bp, homo sapien
gaatctccacgggcctcaagttcaarcagtgctctcagatccaaccttag

SEQ ID NO: 21981 - DNA, 50 bp, homo sapien
aaattttttataagctgaatataccwatcttttcttctattgcttctaaa

SEQ ID NO: 21982 - DNA, 50 bp, homo sapien
ggagggaagggctgaaaaactaacayattggatactaaaatcactacaat

SEQ ID NO: 21983 - DNA, 50 bp, homo sapien
tcctccaatatttctacaatattttwaaaactcacagttgagcatgaaca

SEQ ID NO: 21984 - DNA, 50 bp, homo sapien
tttactggatgtttgcattttaatcratttactaactccaataaattgat

SEQ ID NO: 21985 - DNA, 50 bp, homo sapien
caaaattgtttttaattatctgaaaygtgtaaggtctgtctgtagtaatc

SEQ ID NO: 21986 - DNA, 50 bp, homo sapien
catcaactataagaatcatgtttaaktattttccaccagtcctctcccta

SEQ ID NO: 21987 - DNA, 50 bp, homo sapien
ctttgacaggtagagaagactggcaygatgcgtaaggggatttctgaggt

SEQ ID NO: 21988 - DNA, 50 bp, homo sapien
aacatctcattaagaaagagatcgtyaaatgtttagtgtaatttggaaga

SEQ ID NO: 21989 - DNA, 50 bp, homo sapien
gtataaagctaagaactaagctcacrcataaagccacgcatttttaaaga

SEQ ID NO: 21990 - DNA, 50 bp, homo sapien
tcagctgtaaacaattcgagagggtsaatatgaaagaggaactgcctcac

SEQ ID NO: 21991 - DNA, 50 bp, homo sapien
cgtgtggtctttacctaggcaatacrcatttaaactctatagtcttcaat

SEQ ID NO: 21992 - DNA, 50 bp, homo sapien
cagctttttcaagatttttcaaccayggactcctatttcatagcagcttc

SEQ ID NO: 21993 - DNA, 50 bp, homo sapien
aaatcaaaagctgtaagtaattaaasagtgaggaagacacagtgaaagcc

SEQ ID NO: 21994 - DNA, 50 bp, homo sapien
tcaggcctgaaagactcaaggcatayggttcaggcataaataatagattt

SEQ ID NO: 21995 - DNA, 50 bp, homo sapien
ctgcactgttctgctaatacaatgaygcctccagggaaactgggctgggc

SEQ ID NO: 21996 - DNA, 50 bp, homo sapien
aatttagtcccaactttattactggrccaatttagtgaaactctgcacct

SEQ ID NO: 21997 - DNA, 50 bp, homo sapien
taggtcacagaaatcatttaccttcrattgtgtttggcataatgttgaac

SEQ ID NO: 21998 - DNA, 50 bp, homo sapien
agtcctgcctagtactctctgaaaakaagtggtgcaactccaccctcacg

SEQ ID NO: 21999 - DNA, 50 bp, homo sapien
gaaagaaaagaatacataaaagatayaagctcctggatggcataggtctg

SEQ ID NO: 22000 - DNA, 50 bp, homo sapien
cacagtatctcttcactcaagatctractaaatcaatgtgcatcccacaa

SEQ ID NO: 22001 - DNA, 50 bp, homo sapien
atttttactgtcaaaacagggactakgcaattttttaagtaatcatccaa

SEQ ID NO: 22002 - DNA, 50 bp, homo sapien
agaaggagaaggaaatacatgatacmagtaatgagatgagaaagggtata

SEQ ID NO: 22003 - DNA, 50 bp, homo sapien
aagacactcttaatctaagacctaartcaataacaagtgtagtaaggcta

SEQ ID NO: 22004 - DNA, 50 bp, homo sapien
acaacatttggtctaatttcacaaayattttctaccagcagctcatgctt

SEQ ID NO: 22005 - DNA, 50 bp, homo sapien
tttttgagaacacaacagtggcctartaggaaattccctccttgcaaaca

SEQ ID NO: 22006 - DNA, 50 bp, homo sapien
cttggctcttctgctttgtaccaacygacattgctcctaaagcctactat

SEQ ID NO: 22007 - DNA, 50 bp, homo sapien
ttaccacagtgctgtataagtaacaygatgcataaaataataaaaaatta

SEQ ID NO: 22008 - DNA, 50 bp, homo sapien
ataaatgtttttattatatggtacakctagctattatatgtaatgtagtt

SEQ ID NO: 22009 - DNA, 50 bp, homo sapien
ccttgagcttttcaatatcggtaaaktattgcatcattaaaaataatatg

SEQ ID NO: 22010 - DNA, 50 bp, homo sapien
tcttatacattcaaagttctaagtcwattcttttcctttcaacttttatt

SEQ ID NO: 22011 - DNA, 50 bp, homo sapien
tctgttttgaaatgctgaattgtccygattatttctactctggagttaaa

SEQ ID NO: 22012 - DNA, 50 bp, homo sapien
ataatgtatatttcatagaggaaacmatccctcaggtgaatatttagtca

SEQ ID NO: 22013 - DNA, 50 bp, homo sapien
agagataaattgtataatattgtaayggttgtatagtttaatgatataat

SEQ ID NO: 22014 - DNA, 50 bp, homo sapien
tatatgccccttcatcatttcacackgacctaaagattcattcatttttt

SEQ ID NO: 22015 - DNA, 50 bp, homo sapien
tagataacaaatgagaatagctctayggttcagtttaaaactgaataaag

SEQ ID NO: 22016 - DNA, 50 bp, homo sapien
aactgtgaaatgaacatacagcataraaattagagatctagctagtgaca

SEQ ID NO: 22017 - DNA, 50 bp, homo sapien
taatagaatattaatttctcatcacraatgtaatttcttatgatggtctt

SEQ ID NO: 22018 - DNA, 50 bp, homo sapien
tcaattacaaactatgattaatcaakgcttgctatcagaagttgcctgta

SEQ ID NO: 22019 - DNA, 50 bp, homo sapien
ccactatgacaaggtataatcggtcyagtaatatgtctaaactttgttgt

SEQ ID NO: 22020 - DNA, 50 bp, homo sapien
aatagataatatattactgggtttcyatgaacacacctagtagcctcatc

SEQ ID NO: 22021 - DNA, 50 bp, homo sapien
aaacctatatccagccatctcattcyctagttaagaccatacaaagaagc

SEQ ID NO: 22022 - DNA, 50 bp, homo sapien
ggctgttactgacaggttgctgacasgtggccaaagcagacaccatatgt

SEQ ID NO: 22023 - DNA, 50 bp, homo sapien
tacacagatgacttgctgatagcaarctcgaactaagaccaatgtctgtc

SEQ ID NO: 22024 - DNA, 50 bp, homo sapien
tttgcaagcacatatatttcacaatwaaggcagaagtaatgttgttcaga

SEQ ID NO: 22025 - DNA, 50 bp, homo sapien
actcaaaatatctatttaatttggcmgcatccggattttttgcttataat

SEQ ID NO: 22026 - DNA, 50 bp, homo sapien
gaattttcatggtggttatgctaccmacttgtatcacttgggtctgtccc

SEQ ID NO: 22027 - DNA, 50 bp, homo sapien
acttactatagcatattgagaacaarttcagtattgcttacaaaaatcat

SEQ ID NO: 22028 - DNA, 50 bp, homo sapien
cctgagaaaagaaacgttacagcaamgacagaatgtttaaaaatgttttt

SEQ ID NO: 22029 - DNA, 50 bp, homo sapien
tagcttgtgtgtacgttttacctacrcaatatagaatgactgtattagct

SEQ ID NO: 22030 - DNA, 50 bp, homo sapien
gtcaccattatgatgagatacattcracaactaacaaagactaagagaag

SEQ ID NO: 22031 - DNA, 50 bp, homo sapien
ttctaacctttcaaaaataactgagraacataaagcaaatttcctcatgg

SEQ ID NO: 22032 - DNA, 50 bp, homo sapien
aattctattgagcatttttgtttagmaaagcagtttaacatgtgggtgtg

SEQ ID NO: 22033 - DNA, 50 bp, homo sapien
tgcttgacttttctgcaatgagaacyatcatgatttgattaaaagctttg

SEQ ID NO: 22034 - DNA, 50 bp, homo sapien
tttacaattccttccactttattgaygactgatacaggaaggcttctctc

SEQ ID NO: 22035 - DNA, 50 bp, homo sapien
ttattacttctattcaaatagcaaaktaacagaaagcgagtgagggtgat

SEQ ID NO: 22036 - DNA, 50 bp, homo sapien
aaattggacccttaagcaatacacaraaaaactcaaaatgtattaaagat

SEQ ID NO: 22037 - DNA, 50 bp, homo sapien
attatgtatgttaatagctgtaaaaytgttttgacatacctattgccttc

SEQ ID NO: 22038 - DNA, 50 bp, homo sapien
cctagtgttacttgcaccaagaatartaaccacggctcttgcagaacttg

SEQ ID NO: 22039 - DNA, 50 bp, homo sapien
aaagatctatttgatatttattcaayttcaccaggtatggtttggcatta

SEQ ID NO: 22040 - DNA, 50 bp, homo sapien
ttacatctggaggcacacattcagcsctagttagtatcacattctccatg

SEQ ID NO: 22041 - DNA, 50 bp, homo sapien
aagaatgaaaggatgaactgaggaartagacactaggatagctgaatgag

SEQ ID NO: 22042 - DNA, 50 bp, homo sapien
taagcttccgagaaaaacaaatgacrggttactaggcatgcaattttgtt

SEQ ID NO: 22043 - DNA, 50 bp, homo sapien
atatattttcaagttctgtgaaataygcaaaacgtttaacatttgaaaat

SEQ ID NO: 22044 - DNA, 50 bp, homo sapien
ctctatttaaactcttcaataggaartctggccaaatgcagcaaaaagaa

SEQ ID NO: 22045 - DNA, 50 bp, homo sapien
caaatcccattctaaggctgataaamtagagaaaacacagatttccaata

SEQ ID NO: 22046 - DNA, 50 bp, homo sapien
tattgtagggacagaagagggtcaaytactcaaaattccttgcaaactat

SEQ ID NO: 22047 - DNA, 50 bp, homo sapien
ccacacaagaaaaatatataagagamtctaagaccaacagagcctaataa

SEQ ID NO: 22048 - DNA, 50 bp, homo sapien
ggaggtgcggtgggcaggtgacatasaatgattccttactctgagtttct

SEQ ID NO: 22049 - DNA, 50 bp, homo sapien
gaagaaaacatcaacagccacttcaratacaaaatagtgtatttactttt

SEQ ID NO: 22050 - DNA, 50 bp, homo sapien
tctgaaaatcttggaaattgtttaastatagatacatttgattacaagga

SEQ ID NO: 22051 - DNA, 50 bp, homo sapien
caaaacagacatctaaataagtctarcaaataaattcaatgtaatttaag

SEQ ID NO: 22052 - DNA, 50 bp, homo sapien
caagttcagcagttcaactaattctraaaatcttggaaattgtttaacta

SEQ ID NO: 22053 - DNA, 50 bp, homo sapien
gaattcccttgtttaatgtgcacccratgtgaatgtgatggagatgttca

SEQ ID NO: 22054 - DNA, 50 bp, homo sapien
aaaaaaaatggataatcgaaacttaygtataccaaaaaatgaaatcccaa

SEQ ID NO: 22055 - DNA, 50 bp, homo sapien
tttgcacacctactacttgcttaacwctgtttatgaggttgggaataaga

SEQ ID NO: 22056 - DNA, 50 bp, homo sapien
gagtcctcatttgacagaaaattaaygcaatttaacacaaaaagaaacaa

SEQ ID NO: 22057 - DNA, 50 bp, homo sapien
tggaatctcaggataacaaggaaaasacatagacaagcctgctcaaaagg

SEQ ID NO: 22058 - DNA, 50 bp, homo sapien
aatgtccatcacaattgaagaaatakataacttgtggaatattcataaat

SEQ ID NO: 22059 - DNA, 50 bp, homo sapien
aaccaaaattaacaaccacacgccaycttgttacacgaatgactgaggaa

SEQ ID NO: 22060 - DNA, 50 bp, homo sapien
attttattttactcaccatttttatraccttcatccagatagtatctggt

SEQ ID NO: 22061 - DNA, 50 bp, homo sapien
aagggaaattacttttacttaactaygcagaaaacaaatattattggaag

SEQ ID NO: 22062 - DNA, 50 bp, homo sapien
tttcactacatagttatgcgttcctsagcaatatttattttaaattttac

SEQ ID NO: 22063 - DNA, 50 bp, homo sapien
tttcacttacctgttcctttctgaaygattttactctatatcttcctatg

SEQ ID NO: 22064 - DNA, 50 bp, homo sapien
gctgaactccgtgtacctttccaaayttcacaaggagcatctttcaaaat

SEQ ID NO: 22065 - DNA, 50 bp, homo sapien
agcttatcatgttaccttcgtatcaycttctctcagctctgtaaggagtg

SEQ ID NO: 22066 - DNA, 50 bp, homo sapien
aattatatgaccctctctctaattcmaggaactcaagagtatcacacaat

SEQ ID NO: 22067 - DNA, 50 bp, homo sapien
agaggcaatttgaatacaagaaatasagaatggcttatcttctattcagt

SEQ ID NO: 22068 - DNA, 50 bp, homo sapien
taaagaattgtaacagcaggtacaaygtgattttaccagtacaatccaga

SEQ ID NO: 22069 - DNA, 50 bp, homo sapien
aattgatgtattctcaccatctgtayaaaaaatcataggatagcatgttc

SEQ ID NO: 22070 - DNA, 50 bp, homo sapien
gtaagaatttgcttacagcttcttargatacaaagcacattatatacaga

SEQ ID NO: 22071 - DNA, 50 bp, homo sapien
tgtcttctattaactgtgggatgtaraggataacgaactacaagtaagtt

SEQ ID NO: 22072 - DNA, 50 bp, homo sapien
aaaagacattgagtaaattagagccwcatttgaccctaacatacttcaaa

SEQ ID NO: 22073 - DNA, 50 bp, homo sapien
cttactagcatagtgacacagtaaawaattaatcagtcagtgaaaactaa

SEQ ID NO: 22074 - DNA, 50 bp, homo sapien
gctactcatttaactgaagtgataaytaaaaatccttaaaggcaacacag

SEQ ID NO: 22075 - DNA, 50 bp, homo sapien
tttatagttatggaattccaaagcartaccgacatcaaatatgtggtaat

SEQ ID NO: 22076 - DNA, 50 bp, homo sapien
attttgacaaacataacaatggttcragagattgtatttactttaggagt

SEQ ID NO: 22077 - DNA, 50 bp, homo sapien
ttacttccatgtaatttgtgtaacawaaagtcatattgttattttatttg

SEQ ID NO: 22078 - DNA, 50 bp, homo sapien
taccccatgccaagcaaagaggataragttctgtagtagtcttccccgga

SEQ ID NO: 22079 - DNA, 50 bp, homo sapien
cattggagaaattcatcattaatcaytgaatcaggtaaaggaaaaattta

SEQ ID NO: 22080 - DNA, 50 bp, homo sapien
ccctaagtcactaaaaaggactacartgctcagaagaataatatataaca

SEQ ID NO: 22081 - DNA, 50 bp, homo sapien
aagcccacatccccactccctataaygagatccaggctccaggataggaa

SEQ ID NO: 22082 - DNA, 50 bp, homo sapien
cctgaccaattaacacctgctttatragttttttgataatcaagaagatg

SEQ ID NO: 22083 - DNA, 50 bp, homo sapien
ttctcaactctcctattggatgctasaggattataatttgctgcagaaaa

SEQ ID NO: 22084 - DNA, 50 bp, homo sapien
caataggagagttgagaattgtggayacagatctatataagaatgggacc

SEQ ID NO: 22085 - DNA, 50 bp, homo sapien
caatatgtttctactagtattgtaaycatcccaatagaaagtaagagatc

SEQ ID NO: 22086 - DNA, 50 bp, homo sapien
atgttatttagtggcattttggcaaytattttttcggttgctaattctga

SEQ ID NO: 22087 - DNA, 50 bp, homo sapien
ttcacctgctggtattgactagagayggccctggaaaaactcccttaggg

SEQ ID NO: 22088 - DNA, 50 bp, homo sapien
tctagaattcaagtgtgaacaattarccatcagggacactttctttctta

SEQ ID NO: 22089 - DNA, 50 bp, homo sapien
tgataaacttagcttgcatgtaccamctaaaaatgatagggtggagaagc

SEQ ID NO: 22090 - DNA, 50 bp, homo sapien
ttttctgggaagttagagacttacaygcccagctgacattgacagataca

SEQ ID NO: 22091 - DNA, 50 bp, homo sapien
ttgctattattttctttaggatctaygtgtcaaagttaatatacaacact

SEQ ID NO: 22092 - DNA, 50 bp, homo sapien
atgtaagtctcaaaggatctgctctsaactccactttttcaaaccaatat

SEQ ID NO: 22093 - DNA, 50 bp, homo sapien
atattgttttcagtcaggtttaggamaagtaggacaaacacaactttccc

SEQ ID NO: 22094 - DNA, 50 bp, homo sapien
gtggggaaaaggtctttaaaggatckcatctaagcctaaaaaaagaagaa

SEQ ID NO: 22095 - DNA, 50 bp, homo sapien
gggttgacttgagttgctgggtaaaraagtatgtgaggacagggaaaaca

SEQ ID NO: 22096 - DNA, 50 bp, homo sapien
aactagatgagaaaactcggttgaayccagatagttaaccacagaaagtt

SEQ ID NO: 22097 - DNA, 50 bp, homo sapien
tattttatcagatagtaggatggaayatacttaacacaccaacagactca

SEQ ID NO: 22098 - DNA, 50 bp, homo sapien
cactgaaacttagcagagtcttactraataatgggtaaatgtcagatcca

SEQ ID NO: 22099 - DNA, 50 bp, homo sapien
aaatttatttactattgggtaccaasagatgaaatagtcaagcaattggt

SEQ ID NO: 22100 - DNA, 50 bp, homo sapien
ttaatatatataattctgggtgaacyagtgtactatattacaagcttttc

SEQ ID NO: 22101 - DNA, 50 bp, homo sapien
caatataatctacttccctgttataygttagactttcttccctgggatta

SEQ ID NO: 22102 - DNA, 50 bp, homo sapien
ctcctatgaagtacagtccctaaacrgcatgtttttccacataaactcta

SEQ ID NO: 22103 - DNA, 50 bp, homo sapien
tcataatttatgctacattgttggcrgagtttctctattgactgtcttcc

SEQ ID NO: 22104 - DNA, 50 bp, homo sapien
agcttttcgtgtagcgctacgtaacyggacttggaggggttctagatttg

SEQ ID NO: 22105 - DNA, 50 bp, homo sapien
ggcgttagtcatttgtgtcactgaarccttgattcttttccttgaactga

SEQ ID NO: 22106 - DNA, 50 bp, homo sapien
taacagacagcgagaaaactgcctaygtgaagtgtatgtcttagatccct

SEQ ID NO: 22107 - DNA, 50 bp, homo sapien
gttcatctttatatccatttttgcascatgaacacaatataattcaattt

SEQ ID NO: 22108 - DNA, 50 bp, homo sapien
cacctgttattgagaaaaagatacamtgaagttaagaacagttggtgatc

SEQ ID NO: 22109 - DNA, 50 bp, homo sapien
ctgaaggctatatagcaggaacttcrctcaccaaatatgctttcagtgtt

SEQ ID NO: 22110 - DNA, 50 bp, homo sapien
cctctgtctcaaatgtctttctccartcgtgatcacctaattattgcctc

SEQ ID NO: 22111 - DNA, 50 bp, homo sapien
ttggcaaagaaagtaccagctcagawatattaactacctcaactccacgg

SEQ ID NO: 22112 - DNA, 50 bp, homo sapien
tctcatctcttatgatatatactacrctcattaaagtattctttattcac

SEQ ID NO: 22113 - DNA, 50 bp, homo sapien
gagaatggagtaaatatctgaaacamgattgaaagccctacaaaagagac

SEQ ID NO: 22114 - DNA, 50 bp, homo sapien
ggactaatacaatgatgagatgaaayggaaggtctaggagcttctaaaaa

SEQ ID NO: 22115 - DNA, 50 bp, homo sapien
atgcagtttatggagtcaaaattaarctacggcaattttagcacattttc

SEQ ID NO: 22116 - DNA, 50 bp, homo sapien
tcagtaccgttgatcatttcagataygtttcaactttatttagtgaaaga

SEQ ID NO: 22117 - DNA, 50 bp, homo sapien
taatagctgtcactagaaagctaaamaaagtcaccattcatcttactcat

SEQ ID NO: 22118 - DNA, 50 bp, homo sapien
gaatcaatggtattatgtaagcacawtcttatctatgaaatatttgagat

SEQ ID NO: 22119 - DNA, 50 bp, homo sapien
agagcttatcattgatagagaataakatattactgcagttaatgaatctg

SEQ ID NO: 22120 - DNA, 50 bp, homo sapien
gttcacatttagtattttctccaaastcatctacttcattgacaccatac

SEQ ID NO: 22121 - DNA, 50 bp, homo sapien
tttcatgtattttgtcgatttccaaygaacagcaatttggggaacttcta

SEQ ID NO: 22122 - DNA, 50 bp, homo sapien
catgtgtctttttaatacaggtgacratatccttaacattacctaattta

SEQ ID NO: 22123 - DNA, 50 bp, homo sapien
ccatgtattcctttttctatatttargaggtacttagaaggctagctgat

SEQ ID NO: 22124 - DNA, 50 bp, homo sapien
ttctagtgattcaataggtagaaaartagcttctagaattaactgcaatg

SEQ ID NO: 22125 - DNA, 50 bp, homo sapien
tgacatttttcagtgatattctaaayttaagcattgatcaatatggtcac

SEQ ID NO: 22126 - DNA, 50 bp, homo sapien
aacaaagaggcaattatcattttacraggcatttcgtattttcctcaaaa

SEQ ID NO: 22127 - DNA, 50 bp, homo sapien
gcttaagcttttctccatgtctacarattgattattagctgtgtctatta

SEQ ID NO: 22128 - DNA, 50 bp, homo sapien
cattttaatttttctgtcctgggcayatagcacactgcctagcacaggtt

SEQ ID NO: 22129 - DNA, 50 bp, homo sapien
aagagaagatgatggttagttaaagwcaaggaaaatgaaatgcttataaa

SEQ ID NO: 22130 - DNA, 50 bp, homo sapien
gcttgctgagtgagagataataatgsagaaacaaattcaactctattttt

SEQ ID NO: 22131 - DNA, 50 bp, homo sapien
cagttgcctggagagcttggtttaaygcagattctgatcagtccctagag

SEQ ID NO: 22132 - DNA, 50 bp, homo sapien
taggagagaacatcaaaaagcacacraaaacaagtgcattttatgaactg

SEQ ID NO: 22133 - DNA, 50 bp, homo sapien
atttattttttatatttgaacaatarcaataacaccttatgccagttgct

SEQ ID NO: 22134 - DNA, 50 bp, homo sapien
taaaaaaagtgcttgcaagcctgaargatgtaccctttgccacattcagt

SEQ ID NO: 22135 - DNA, 50 bp, homo sapien
tttcctatttctttcctgtcccaaarctaagcaagagtggaattatctcc

SEQ ID NO: 22136 - DNA, 50 bp, homo sapien
taatatttcactggatactcaaactkttcttaggaaattcacttttgttg

SEQ ID NO: 22137 - DNA, 50 bp, homo sapien
ctccatgaatgaatccttatttctcyacattttactggcagattacctta

SEQ ID NO: 22138 - DNA, 50 bp, homo sapien
taaaagcagtatcccaaagtccctaygatagaatttcagagaatattgag

SEQ ID NO: 22139 - DNA, 50 bp, homo sapien
agcttagcgatttaaggattcaacayggagatgaagtggaatgattcctg

SEQ ID NO: 22140 - DNA, 50 bp, homo sapien
ataagttgtatccctttagattaacsgctaattatttcacaaataaaatt

SEQ ID NO: 22141 - DNA, 50 bp, homo sapien
tcattagattgtggtaattatcattkaagactcataaagctcttgtttat

SEQ ID NO: 22142 - DNA, 50 bp, homo sapien
gtgttttatttctgataagactatamctggaaatgacttataaaataatt

SEQ ID NO: 22143 - DNA, 50 bp, homo sapien
ttcccaaacacacaatctaagttaastgaaattacctctgggtgctgcgt

SEQ ID NO: 22144 - DNA, 50 bp, homo sapien
gacccactaaatatgctgattaagayggataaaatgctcttattttaaac

SEQ ID NO: 22145 - DNA, 50 bp, homo sapien
tctattttgtccataagccaaaacartcactaagttacaaaacacagatt

SEQ ID NO: 22146 - DNA, 50 bp, homo sapien
acccacatgtgctaatgttggaattyaaaggtcaagaagctacaacattg

SEQ ID NO: 22147 - DNA, 50 bp, homo sapien
cataacaaggacatagcaactttaaytgaggacattactaagatgtattg

SEQ ID NO: 22148 - DNA, 50 bp, homo sapien
atttcaaaagtcaaaaatatgtttayggatatcagctaaaataacttatt

SEQ ID NO: 22149 - DNA, 50 bp, homo sapien
tccgttaaaagtcttggctaacacayagtagttacttgttaaatactttg

SEQ ID NO: 22150 - DNA, 50 bp, homo sapien
tatttcccctcaaatagatacgtagraagaaagtcgagctgcaactctaa

SEQ ID NO: 22151 - DNA, 50 bp, homo sapien
ctaatggcaggttttttatgaatgcyctaatatctgtcagctctgaggaa

SEQ ID NO: 22152 - DNA, 50 bp, homo sapien
gtaggggaggccaaaactaagtcaawctgaattcctctaaaacaaagggc

SEQ ID NO: 22153 - DNA, 50 bp, homo sapien
gtaaatagcacaacaatgtaaataartatgttggagaagtttggagattt

SEQ ID NO: 22154 - DNA, 50 bp, homo sapien
ttgactcaaacttgatctggtacaarttggaaaatactaaatacttcaac

SEQ ID NO: 22155 - DNA, 50 bp, homo sapien
tgcagttggtagtgtgcaccataaasttatcgtggtgttgtgaacatgtg

SEQ ID NO: 22156 - DNA, 50 bp, homo sapien
atgtaaattgtatttcttggcttgakaagatgtacattgtaaattaagtg

SEQ ID NO: 22157 - DNA, 50 bp, homo sapien
aatggcagaatcctcttcactagacrgtaacagagcctgtcacaaagcct

SEQ ID NO: 22158 - DNA, 50 bp, homo sapien
agccatactatgtgatgaagattaamaattaattattccaggctaattct

SEQ ID NO: 22159 - DNA, 50 bp, homo sapien
tcaaattgagctgtggactctcaaawttggttctcgcattagatttaaat

SEQ ID NO: 22160 - DNA, 50 bp, homo sapien
taattgaggaattccaaccacaagawtataggaacacaaggaggaatttc

SEQ ID NO: 22161 - DNA, 50 bp, homo sapien
acaataatcactttattaagttaaakacaagatgaaataaaagattactt

SEQ ID NO: 22162 - DNA, 50 bp, homo sapien
aaggcaataggaagaatattgatcarggaattaggagctctgagttctat

SEQ ID NO: 22163 - DNA, 50 bp, homo sapien
gactgaaggaaaagagtacttttaartcaatacatattgctttgatattt

SEQ ID NO: 22164 - DNA, 50 bp, homo sapien
tcaatggttttgttcttagtttgaastgtaaatattttgatacatggtta

SEQ ID NO: 22165 - DNA, 50 bp, homo sapien
aattttcacggtcacgtgagtttagraaatgcaatgtaacatgtctccct

SEQ ID NO: 22166 - DNA, 50 bp, homo sapien
ataaatctcttgcctttgggaacatragttgaacatgactgagactggga

SEQ ID NO: 22167 - DNA, 50 bp, homo sapien
taatttaagaaaatttaacaggtgtraaaatcaggcaatgataaaaatga

SEQ ID NO: 22168 - DNA, 50 bp, homo sapien
cattgaagttgacaattatacaaccyaacatctcaataaatttgtttcag

SEQ ID NO: 22169 - DNA, 50 bp, homo sapien
atttagtctcaatgctacttccttcratgtgtggtatataggaaagaata

SEQ ID NO: 22170 - DNA, 50 bp, homo sapien
gacaccaaactgtatgtaggccaacragtttgccagagaaaaacagaaaa

SEQ ID NO: 22171 - DNA, 50 bp, homo sapien
atctaataattatttaactaaatcartcattactttactaaactttggct

SEQ ID NO: 22172 - DNA, 50 bp, homo sapien
aagtttgatgacctgactaatcagayaggagttagttaagaaagctgaat

SEQ ID NO: 22173 - DNA, 50 bp, homo sapien
cagcatttgaaatttgtcttcactaratgagggctgtttctagctgtctc

SEQ ID NO: 22174 - DNA, 50 bp, homo sapien
caacaaattatcgttaagtatgtgayggagaaaagtatatctatattttc

SEQ ID NO: 22175 - DNA, 50 bp, homo sapien
aagttgcatttattagggtgacccaygcggccaagacaagcaggttgcca

SEQ ID NO: 22176 - DNA, 50 bp, homo sapien
cattgttcctttctctttatagctcrcttgctttcttatttctttaaatt

SEQ ID NO: 22177 - DNA, 50 bp, homo sapien
gattcaggaagagcaatttatataawcacatgtagagcatatgtaattta

SEQ ID NO: 22178 - DNA, 32 bp, homo sapien
tctggctttcaaatacrccttaagttgccaat

SEQ ID NO: 22179 - DNA, 50 bp, homo sapien
taagtagggtgattttccttcaaaasttcaataaattcatcctatttatc

SEQ ID NO: 22180 - DNA, 50 bp, homo sapien
aatatttcaaaaattaccaaaaatargggctaaagtgtacattgttttca

SEQ ID NO: 22181 - DNA, 50 bp, homo sapien
taccacaaaggaaactaggcatagayaataatttttttaaatgccaaata

SEQ ID NO: 22182 - DNA, 50 bp, homo sapien
attcatttcttaaatttatctttgasagttgctgaaaatctcacagcttg

SEQ ID NO: 22183 - DNA, 50 bp, homo sapien
tcctctcctgtttaactagtttgtamctctctctagattagattattccc

SEQ ID NO: 22184 - DNA, 50 bp, homo sapien
aattttacttatttgagtcctctccyatgtttttcacagtgtaggagaag

SEQ ID NO: 22185 - DNA, 50 bp, homo sapien
ttttagctgcttattttacactgaarcataatttagaaaccttctttagt

SEQ ID NO: 22186 - DNA, 50 bp, homo sapien
tccaaagaaatcagcagtttaatcaytgacaactcgttttaagaaagagg

SEQ ID NO: 22187 - DNA, 50 bp, homo sapien
acagcgagttttgcgatgtctgagascgatcccacggaggagaatatttt

SEQ ID NO: 22188 - DNA, 50 bp, homo sapien
aattgttttttgccactgcttataasatactcgcttctatatgaaaatgt

SEQ ID NO: 22189 - DNA, 50 bp, homo sapien
caacgcttaagttttatagacgaaakgatcatatagtttttcagaattaa

SEQ ID NO: 22190 - DNA, 50 bp, homo sapien
atacaaagaaaaaatgacattctagraattgagcatttgtagtaaattta

SEQ ID NO: 22191 - DNA, 50 bp, homo sapien
ctgctggtagagtgatgaaactaggragaatctacagtgtctgggaactt

SEQ ID NO: 22192 - DNA, 50 bp, homo sapien
ttactgtacctataataagaatcaamcttcgttcagaaaaatttaggcta

SEQ ID NO: 22193 - DNA, 50 bp, homo sapien
ccaaccctttatctaaacacatagartcatataaactgccttaaaatatg

SEQ ID NO: 22194 - DNA, 50 bp, homo sapien
gagccaccttgcctggccagaacagraatgtttaaccagagattaacctt

SEQ ID NO: 22195 - DNA, 50 bp, homo sapien
atccaagagattaatgcattctatawatcatgttaaagcattgatggctc

SEQ ID NO: 22196 - DNA, 50 bp, homo sapien
agaaacaaagccagatagagtagtayattttctagataaacacaggtgtc

SEQ ID NO: 22197 - DNA, 50 bp, homo sapien
tattcaatcttaaattaaccacaggraatatgagcataaatacatatatg

SEQ ID NO: 22198 - DNA, 50 bp, homo sapien
ccatgcaacatcacccaattatccayggcatcgtaagattgccataccaa

SEQ ID NO: 22199 - DNA, 50 bp, homo sapien
atagccaatttacattggaaactgartaatgcaggttaagggtgagttgt

SEQ ID NO: 22200 - DNA, 50 bp, homo sapien
ttccattatttaaatccttaccatarcatttcactttattacaaaagact

SEQ ID NO: 22201 - DNA, 50 bp, homo sapien
aggatcaagaaaggcagaatgtgaaygtgactgtcttttaaagggtcagc

SEQ ID NO: 22202 - DNA, 50 bp, homo sapien
taggaactctaaggttgattcgagaygaaactaaaccctggacatcagtg

SEQ ID NO: 22203 - DNA, 50 bp, homo sapien
tagcatcagcttcagctccttgaaaygggtggaattgatggacaatggaa

SEQ ID NO: 22204 - DNA, 50 bp, homo sapien
atctgtcactagcaagagtaccagcraagttttaaattttttccatgact

SEQ ID NO: 22205 - DNA, 50 bp, homo sapien
aagatagaactaaaatactgaaagcraaactatgagagaggaaagatggc

SEQ ID NO: 22206 - DNA, 50 bp, homo sapien
tgatttgcaaagagaagtgatcaaastcatagcacaaccaaatgaatgga

SEQ ID NO: 22207 - DNA, 50 bp, homo sapien
aaatctgttcatgcgtatctggtagwcaagaccatttgaaaagtaggtgt

SEQ ID NO: 22208 - DNA, 50 bp, homo sapien
agaatgttctgtttgcttttaaagaygtttcaagagacgtaacaatgaga

SEQ ID NO: 22209 - DNA, 50 bp, homo sapien
aacattatatgagtttgagctaatasgcttatctaagcaaattagaacac

SEQ ID NO: 22210 - DNA, 50 bp, homo sapien
gcagagggtagaggctgactgtccgraacctcccatgacccgtgacccgt

SEQ ID NO: 22211 - DNA, 50 bp, homo sapien
gctttgcttcatgaaacagagatgayctaaaccaaggtaagagggcagtt

SEQ ID NO: 22212 - DNA, 50 bp, homo sapien
tgtgaagtggtcttcaagtcagaaaytaccagagaactgtcatcccttct

SEQ ID NO: 22213 - DNA, 50 bp, homo sapien
gaagggaatgtctttaatctatcaamaacacatagcaaacatgtaagtag

SEQ ID NO: 22214 - DNA, 50 bp, homo sapien
gcttattgaccaagagctgtatggarcattacttttatcgcaactggctc

SEQ ID NO: 22215 - DNA, 50 bp, homo sapien
tggaccagaatttgtcatcgcttcarggattacattcttggggcttaacc

SEQ ID NO: 22216 - DNA, 50 bp, homo sapien
ttaccaagaccaccctgaggaacagraagctgcatttagatctgcacatt

SEQ ID NO: 22217 - DNA, 50 bp, homo sapien
ccatggtggcctgagcgagcctggaratacttcacagtggcaggggctga

SEQ ID NO: 22218 - DNA, 50 bp, homo sapien
gaagaagtccaggcaaatgtccaaaygagcattaggtgtacggaaaatca

SEQ ID NO: 22219 - DNA, 50 bp, homo sapien
tgtatcttgtaaaagtaatgtaagckcttaagaagtcaaaacatacagag

SEQ ID NO: 22220 - DNA, 50 bp, homo sapien
ataaaaggaatgtaacccggatacarcaattgattcagcagaaaggagcc

SEQ ID NO: 22221 - DNA, 50 bp, homo sapien
gtgtttgaatgaataagagcataaaygtgatccagaagatagattttaag

SEQ ID NO: 22222 - DNA, 50 bp, homo sapien
ttgtcagtcttcactcatggcaaccyatttagaggctacttatatgcatc

SEQ ID NO: 22223 - DNA, 50 bp, homo sapien
cctaaatggtcccaggaaggaagacraacagggagtctggactttggcct

SEQ ID NO: 22224 - DNA, 50 bp, homo sapien
ggttccagaacccggcttagtgtcasgactgaggtgctagaaacacactt

SEQ ID NO: 22225 - DNA, 50 bp, homo sapien
agtttgagagaatatgtacaaaacaraactatctcaatttgcaaagggaa

SEQ ID NO: 22226 - DNA, 50 bp, homo sapien
gtattgtaagcaatgaacactcaacrgccacttaggtctccattgtgaca

SEQ ID NO: 22227 - DNA, 50 bp, homo sapien
ttatctgagtctaggtgacacaggaytactatggcatttcatgaaagtgt

SEQ ID NO: 22228 - DNA, 50 bp, homo sapien
acactaaggagtgtctacaggagacragaatgaaaaatcaatggattgag

SEQ ID NO: 22229 - DNA, 50 bp, homo sapien
acaagtcaggtatttttctcagtaamgtgaatgtgaagagccattttctt

SEQ ID NO: 22230 - DNA, 50 bp, homo sapien
tgtaaatccttattaccaagctattraagtcttattaccaggctatttac

SEQ ID NO: 22231 - DNA, 50 bp, homo sapien
atccattttaggcatgtctgaattayaaagtttaagaaagtatgtagcaa

SEQ ID NO: 22232 - DNA, 50 bp, homo sapien
ctaagccaaagtcaaaaccgctggtraagatcatcatttctattgtctgg

SEQ ID NO: 22233 - DNA, 50 bp, homo sapien
agaggctataatttcatgttctaaawgatgtctttccaagctttctttcc

SEQ ID NO: 22234 - DNA, 50 bp, homo sapien
gttttaccccgtttcattgcagaaakaaaacgaatacaagcaaacatatt

SEQ ID NO: 22235 - DNA, 50 bp, homo sapien
gtggtaatcataattcataatgaaaygaagcagcaacaattccaacagaa

SEQ ID NO: 22236 - DNA, 50 bp, homo sapien
tatgttctttgcattatcttaaagartacatgttcaagccttaaactttg

SEQ ID NO: 22237 - DNA, 50 bp, homo sapien
tgggagctaaacacagccctaaagaygtacttacaccaatattaaattgc

SEQ ID NO: 22238 - DNA, 50 bp, homo sapien
acagttaacatatagcaagtctgtartaaaaggttatttttttaacctag

SEQ ID NO: 22239 - DNA, 50 bp, homo sapien
cgggcccgaggcagtgaggcatagcrgcaaatctcataaatttccaagag

SEQ ID NO: 22240 - DNA, 50 bp, homo sapien
gctagcaaagataatttttgatttargaacacagtgaatactccagaata

SEQ ID NO: 22241 - DNA, 50 bp, homo sapien
ccttcttggaatttccttactcttarcgctcacaacttgccgtggttttc

SEQ ID NO: 22242 - DNA, 50 bp, homo sapien
tgttaatataacaaatctaaatagamggttagacctatggaacgtgtata

SEQ ID NO: 22243 - DNA, 50 bp, homo sapien
aaaaggttttaaacactaattgaaasaatggtaaaataaacacatatata

SEQ ID NO: 22244 - DNA, 50 bp, homo sapien
agattcttatttgttgaaccggaaargaaaggaagtcagtatatcaacag

SEQ ID NO: 22245 - DNA, 50 bp, homo sapien
cctctggttcaacactgaggcacackggagtattcgttgagagctaaaca

SEQ ID NO: 22246 - DNA, 50 bp, homo sapien
tggtaataagaataaaggagatacaraaaagtatgctgaaggacacttag

SEQ ID NO: 22247 - DNA, 50 bp, homo sapien
tgaaataactatcacctctcactttwaaagccttgaaactcagtggcata

SEQ ID NO: 22248 - DNA, 50 bp, homo sapien
cacttagacaagagaaaaattagacragactgtgatgtggaactgtagga

SEQ ID NO: 22249 - DNA, 50 bp, homo sapien
attttagatatgatcagagaaaagasatttgggtacaaatacgtctgtag

SEQ ID NO: 22250 - DNA, 50 bp, homo sapien
aatatgctcacctttatggtccttaygagttactccttattgttctaagt

SEQ ID NO: 22251 - DNA, 50 bp, homo sapien
gcttgatgtgggcctgtgtgctacarcccggaacacaaaagaagacactc

SEQ ID NO: 22252 - DNA, 50 bp, homo sapien
gggaagaatacactaagctccaatawaattaggcaaatgagaggtatagt

SEQ ID NO: 22253 - DNA, 50 bp, homo sapien
tgccaactcattaaatgagcctaagmactaattccacttaacttcattgt

SEQ ID NO: 22254 - DNA, 50 bp, homo sapien
tttagttcctgtgctttagttgttamacctgagaaatccttgactgaccc

SEQ ID NO: 22255 - DNA, 50 bp, homo sapien
atattacagaatctcaggtttaagamcaaatgaccatgacttctttattc

SEQ ID NO: 22256 - DNA, 50 bp, homo sapien
ttactaaaaaataaattaggtaatcrgaaatgaaattaacatttataaat

SEQ ID NO: 22257 - DNA, 50 bp, homo sapien
tattttcttttttcttatcctcttayctcaatccatttctaagttagaaa

SEQ ID NO: 22258 - DNA, 50 bp, homo sapien
gcatgcagaagtcccagtgtgccctyaggctggctcttgtgctacttgtg

SEQ ID NO: 22259 - DNA, 50 bp, homo sapien
agcctggttttggctaccttgaagcracattcatttttacccttttcagt

SEQ ID NO: 22260 - DNA, 50 bp, homo sapien
taaataatttgactcctggtttatawacgcctgtgtatcaagaggactta

SEQ ID NO: 22261 - DNA, 50 bp, homo sapien
taaaataccaagatagattttagatraagtgacattatgcctctcagaaa

SEQ ID NO: 22262 - DNA, 50 bp, homo sapien
ccttgtcttttccaaaattatctcartacaatcagggcaagaaaataaac

SEQ ID NO: 22263 - DNA, 50 bp, homo sapien
catttaagttaaaaatcttctcgackgcaggatgtctaaggtcattgaaa

SEQ ID NO: 22264 - DNA, 50 bp, homo sapien
tctggagataaccttcttaaactccrctaaagagcaaccaaactcatcac

SEQ ID NO: 22265 - DNA, 50 bp, homo sapien
ctttggaatacacatctcagaagaayatagtgatacatttggagtactgg

SEQ ID NO: 22266 - DNA, 50 bp, homo sapien
gaaggcacttcagaatgttccatgcrcctgtccggaaagtccagaactac

SEQ ID NO: 22267 - DNA, 50 bp, homo sapien
tttatctgagcaccaactaaaaaagratgtggaaagcgttaatcctttta

SEQ ID NO: 22268 - DNA, 50 bp, homo sapien
tctggccacagtcggtacacaaccartgactgtagaaagcccagcaggca

SEQ ID NO: 22269 - DNA, 50 bp, homo sapien
gggtgctgcacctgcagtaggcgtgyagaaaatgaagtttattatcacta

SEQ ID NO: 22270 - DNA, 50 bp, homo sapien
cacaaccgactccagtacctcattckcaaccactaggtgattgtgcctca

SEQ ID NO: 22271 - DNA, 50 bp, homo sapien
aatattttcaaatgaagaagtaataygtgtgacactctaaattgtgaata

SEQ ID NO: 22272 - DNA, 50 bp, homo sapien
ctaaaacaaaagtctgtctggtatgmaaaggtgatttatagacccttttg

SEQ ID NO: 22273 - DNA, 50 bp, homo sapien
taaacaaggatatttaagaataaaaytagaacagaattataaatgagaaa

SEQ ID NO: 22274 - DNA, 50 bp, homo sapien
agggacgtgggaacataaaacatccrcttagccatcctaacagtgctggt

SEQ ID NO: 22275 - DNA, 50 bp, homo sapien
ttctagcctaggagcaatgggctacrccatacagcctaggggtgcctgga

SEQ ID NO: 22276 - DNA, 50 bp, homo sapien
caatagtagatgtatagacacacaaytcttcttatttcacatacaagaag

SEQ ID NO: 22277 - DNA, 50 bp, homo sapien
cgcacctcagaggtctatgcttgacmatcatctcttaaagtgagtgaaca

SEQ ID NO: 22278 - DNA, 50 bp, homo sapien
acgtcaccagcccgcgtctgtgttcrctgcgtccacttcacagggccaag

SEQ ID NO: 22279 - DNA, 50 bp, homo sapien
gcattctcttctgatagactacccargtttattccagatctctcacagaa

SEQ ID NO: 22280 - DNA, 50 bp, homo sapien
tatatgtttcttttcagagctggtaratgaatacttgaggttcactgggt

SEQ ID NO: 22281 - DNA, 50 bp, homo sapien
acaccctccctgtgcctcagcctaastgtcttcatgccgtggatgaacca

SEQ ID NO: 22282 - DNA, 50 bp, homo sapien
atgtgctaggattccaggcacgaggyaacgcaggcagcccagtctcctag

SEQ ID NO: 22283 - DNA, 50 bp, homo sapien
gccttgagcccccaaggccataggayagtaaatactcagcctgtgcctcc

SEQ ID NO: 22284 - DNA, 50 bp, homo sapien
ttcaatatttgagtggtaacagaaayggagccactgtggcaataaattgc

SEQ ID NO: 22285 - DNA, 50 bp, homo sapien
catctccatcttgcaggaactggcarcgatggtccaggccaacgcctctc

SEQ ID NO: 22286 - DNA, 50 bp, homo sapien
tttcattgtttactactatgacaacyatacagaaataagcataagcaatc

SEQ ID NO: 22287 - DNA, 50 bp, homo sapien
tgaaccacgatcatgttctagttatsagactatatacttaaaatgctaaa

SEQ ID NO: 22288 - DNA, 50 bp, homo sapien
ccgccagcgactgagtcacatttccyatgagggccatgctgtagctattc

SEQ ID NO: 22289 - DNA, 50 bp, homo sapien
aggtcctagaacagaaagaaatcatsaggatcacttaatgggagtgtctc

SEQ ID NO: 22290 - DNA, 50 bp, homo sapien
ggtgatctggagatcaccgtggtagyatagatcatgaagaacaagcgcta

SEQ ID NO: 22291 - DNA, 50 bp, homo sapien
ccagaagcttaaggattgtgctccayatagaaaagagctgcaggtgtgcg

SEQ ID NO: 22292 - DNA, 50 bp, homo sapien
attactcaggcttagttggcttccaygagtttgctttataagtgtctttg

SEQ ID NO: 22293 - DNA, 50 bp, homo sapien
atgacccatcctgtcctggattttarcagtcgatcagaggcctgagttat

SEQ ID NO: 22294 - DNA, 50 bp, homo sapien
ttgaagatgttggaagaaatttgaaygtgccttctgagccaaaccctctg

SEQ ID NO: 22295 - DNA, 50 bp, homo sapien
aaggagggcaacaattgggagcaaamaaagagatgccttaagaacttgga

SEQ ID NO: 22296 - DNA, 50 bp, homo sapien
aacttgggcaagggtatgattcaaamcttaattgtcttgtagaaataccg

SEQ ID NO: 22297 - DNA, 50 bp, homo sapien
ctttcctagagaaatagtgtaaccaktcatggctctccgggtgtgctgct

SEQ ID NO: 22298 - DNA, 50 bp, homo sapien
ctcagtgttcagttctcatcttaaaygcgcctcctgaagtaagtctttcc

SEQ ID NO: 22299 - DNA, 50 bp, homo sapien
ctgatttaaaaaataatagatatgawgttttgtgaaatagttaaatcaaa

SEQ ID NO: 22300 - DNA, 50 bp, homo sapien
tgttcagggctaaggtattcttccaytgagctttcaactcccttctgcca

SEQ ID NO: 22301 - DNA, 50 bp, homo sapien
ttcttgagttgagttacttccatcarggtgtacaggtacttacagaccta

SEQ ID NO: 22302 - DNA, 50 bp, homo sapien
ctgagtcctctgtaatggtattcaasctccaggaagattttttaaaagtt

SEQ ID NO: 22303 - DNA, 50 bp, homo sapien
acagcaggaaatattagcagattagwagacgtgatgtctaggacctgatt

SEQ ID NO: 22304 - DNA, 50 bp, homo sapien
accctgctctttccggaaggatatcrcattactggaccatcatctatttt

SEQ ID NO: 22305 - DNA, 50 bp, homo sapien
tgttgttgtaacgatttgtttcatayaagggacttgattcatgaggaaga

SEQ ID NO: 22306 - DNA, 50 bp, homo sapien
atagaatggagaagtcaaaatactcrcgtttgtacccatctgcttcactt

SEQ ID NO: 22307 - DNA, 50 bp, homo sapien
tgataacctattccaattgacagccrcttgagatgccctgtacatttgaa

SEQ ID NO: 22308 - DNA, 50 bp, homo sapien
attttgtttttggtggtaggagataygtactttgagggagtaagcttcat

SEQ ID NO: 22309 - DNA, 50 bp, homo sapien
cggtcagaatcctgaattttagatgragtcagatgtgagttctcatttga

SEQ ID NO: 22310 - DNA, 50 bp, homo sapien
ctacggataagagggttataaaagartacttccagagagcagaggctgaa

SEQ ID NO: 22311 - DNA, 50 bp, homo sapien
gtggtcgctgtctctctccaacccamggttccactctacctcgagccctc

SEQ ID NO: 22312 - DNA, 50 bp, homo sapien
tcctagagtcctttgcattagtaaartcatggacaaatatgggtacatcc

SEQ ID NO: 22313 - DNA, 50 bp, homo sapien
atttttatggaaagtccggaaaaacmgagtgtgttcagaggtgcatcatg

SEQ ID NO: 22314 - DNA, 50 bp, homo sapien
tactagagactttccatttctggtaygaagtaatgagattctgccaaaca

SEQ ID NO: 22315 - DNA, 50 bp, homo sapien
gttgatacttgatcagcttgttagaygtagaaggtctcactgaagtttga

SEQ ID NO: 22316 - DNA, 50 bp, homo sapien
tcaaaactttagaccacagtgtacaytcttcaacctggagatcggccgat

SEQ ID NO: 22317 - DNA, 50 bp, homo sapien
cacagatatcatgttattctagttaygtttataggaatctgtgaaaaata

SEQ ID NO: 22318 - DNA, 50 bp, homo sapien
tgtctttaaactgtgagttgatcagraggcgagccaattctgcagttgct

SEQ ID NO: 22319 - DNA, 50 bp, homo sapien
actctgggttccattgttaagacaarcacctcgggatgcctattctcagt

SEQ ID NO: 22320 - DNA, 50 bp, homo sapien
cagcttcttcaacccagctgtgagcrccacttcagctccactcaagggca

SEQ ID NO: 22321 - DNA, 50 bp, homo sapien
tctcagttcctggcacactctggackcacacagtaggtggttgatgatgg

SEQ ID NO: 22322 - DNA, 50 bp, homo sapien
taaagcttgttttccacaggattagraaatattttactctgagtttttct

SEQ ID NO: 22323 - DNA, 50 bp, homo sapien
cattcatataaatacccatatcttaygacatgtttatgcgtgtgcatgaa

SEQ ID NO: 22324 - DNA, 50 bp, homo sapien
atctgaaacgtttgatttcttcactraaaattaggcaaatagggtgaaat

SEQ ID NO: 22325 - DNA, 50 bp, homo sapien
tgatcaattaatttgtcttgggcacmgattttaatttattggtcacaatc

SEQ ID NO: 22326 - DNA, 50 bp, homo sapien
gttttggatactactatgggacctaygtacccaggacgctgagatgagct

SEQ ID NO: 22327 - DNA, 50 bp, homo sapien
aacagttctagtgctttttaaaagamcatcatagcaggccactgccccac

SEQ ID NO: 22328 - DNA, 50 bp, homo sapien
attaacattaacatattaaagaaatsactattttcagaataaatagtgag

SEQ ID NO: 22329 - DNA, 50 bp, homo sapien
tttgtctcaggtaaccgatcaatgargtgaataacctgtagggggcagca

SEQ ID NO: 22330 - DNA, 50 bp, homo sapien
ttgccttctttccaccaccctttcaraccaattcaccatcttcttgcccc

SEQ ID NO: 22331 - DNA, 50 bp, homo sapien
agaacacttttatcaaatgttttaakaattgaaagtgagccacaccatgt

SEQ ID NO: 22332 - DNA, 50 bp, homo sapien
acccatgggtgtacaacttgatttayggcaacctgaaagaagaaaccggt

SEQ ID NO: 22333 - DNA, 50 bp, homo sapien
ctttcttgtttctgtttgccgcttaygattttgctttgagataaccccag

SEQ ID NO: 22334 - DNA, 50 bp, homo sapien
acatgttctttagcatccctctcaaygactgccatgaggacacgggagcc

SEQ ID NO: 22335 - DNA, 50 bp, homo sapien
attttttcttaaagttggctttaaarttgttagtaagctgaaagataaat

SEQ ID NO: 22336 - DNA, 50 bp, homo sapien
tttttgatatcatggacaccaacagkatgtaaattcacacttcttatatc

SEQ ID NO: 22337 - DNA, 50 bp, homo sapien
gtaaatattgctttaataactgcaaygatatccaactacaatgaagagaa

SEQ ID NO: 22338 - DNA, 50 bp, homo sapien
tggaatatgtctgaaaacatgcacgratgtgttccttggcactctgggaa

SEQ ID NO: 22339 - DNA, 50 bp, homo sapien
gggatgagagaaatgacagtatgaasagagttgagtttacaacgatcagt

SEQ ID NO: 22340 - DNA, 50 bp, homo sapien
tggcatcaggaaaacactcaatggawgtatggtaataaaataaatatatg

SEQ ID NO: 22341 - DNA, 50 bp, homo sapien
ttttactttatgccgtgcaactgaawatagtttagaaaagcatgtttttc

SEQ ID NO: 22342 - DNA, 50 bp, homo sapien
caactttctgcttcagttttctgaayggtacagctagcgcttgggtaagt

SEQ ID NO: 22343 - DNA, 50 bp, homo sapien
attagtgacatttccttggcatatgmattacacacccatcaactctcagc

SEQ ID NO: 22344 - DNA, 50 bp, homo sapien
tggattaatgattcctatgcgtgtayatgatttttgtaaacatgctcagt

SEQ ID NO: 22345 - DNA, 50 bp, homo sapien
tggtatactttgaggttttgtgaaasgagtattggctcttttactctata

SEQ ID NO: 22346 - DNA, 50 bp, homo sapien
tggggggattttgggtaattcgccargtctaattcatgatttttggtagc

SEQ ID NO: 22347 - DNA, 50 bp, homo sapien
agtcctctctcctgcagttgtaaccraatactttaggacatcagcaggct

SEQ ID NO: 22348 - DNA, 50 bp, homo sapien
cacacagtggcagatgatgtcatcascgcgttggtaagatgggttcagat

SEQ ID NO: 22349 - DNA, 50 bp, homo sapien
tcagaactggtgacatctgaaaagasgcgagcttgaagggaaagaggaaa

SEQ ID NO: 22350 - DNA, 50 bp, homo sapien
ttaggggacaacttttcatggaatcrgagagtctttggacacaggtgtct

SEQ ID NO: 22351 - DNA, 50 bp, homo sapien
gcttagcagtcctcctgaggataggycataaaagccattttggcctctgt

SEQ ID NO: 22352 - DNA, 50 bp, homo sapien
ggaattcaagtgtccatgccggagcmgcaatttgctaagaatgtgagcaa

SEQ ID NO: 22353 - DNA, 50 bp, homo sapien
aataccaaccaactacagctagctayaaaacattcaacaaacatatccta

SEQ ID NO: 22354 - DNA, 50 bp, homo sapien
tagatttccattgtcttatgggaacygtgacattttgacaggcagctcca

SEQ ID NO: 22355 - DNA, 50 bp, homo sapien
aggaggatcatttaatcacttaaacraggtttctggggatgtcaaggatc

SEQ ID NO: 22356 - DNA, 50 bp, homo sapien
gggaccacagagcaatagtaggcagmaaagtaatgaaatgtggtaaatct

SEQ ID NO: 22357 - DNA, 50 bp, homo sapien
ggtgcatctatttcatctagaactamattttacgattcctaattcaaaaa

SEQ ID NO: 22358 - DNA, 50 bp, homo sapien
taaaaagcttttcccagtagatatcmatttgtactgtttctgaacattca

SEQ ID NO: 22359 - DNA, 50 bp, homo sapien
tctagtttgttgccaaggtaatacayaatgtagaatgctcagaaatagac

SEQ ID NO: 22360 - DNA, 50 bp, homo sapien
gtcattaatatgtgctgaattttgtmaagtgcgtgttgaattttgtcaag

SEQ ID NO: 22361 - DNA, 50 bp, homo sapien
atcatttggatctcatattctgaaaytgtaaattatgcctttcaactaga

SEQ ID NO: 22362 - DNA, 50 bp, homo sapien
gtgttggccactttgctgtaaaagckacttggttatctgtgattcttttt

SEQ ID NO: 22363 - DNA, 50 bp, homo sapien
gaagaggggaaagaagaggaagggasacttacaggtgccaattcaccaaa

SEQ ID NO: 22364 - DNA, 50 bp, homo sapien
tgcaatgaaggaagagaaaatatgawgttaacctataacattgtttgttc

SEQ ID NO: 22365 - DNA, 50 bp, homo sapien
tgtcccacattgaggtaatatttctyaatacacacatcaagtctccacac

SEQ ID NO: 22366 - DNA, 50 bp, homo sapien
cactgaagagacatgcctgaggttcyagggccagtaaataggacaactgg

SEQ ID NO: 22367 - DNA, 50 bp, homo sapien
atcaacatgtcttgtctttaagtaartatcttcaagtaactgttgactta

SEQ ID NO: 22368 - DNA, 50 bp, homo sapien
tccttaagccagatctgcctgactcrgaagttgggaagtgtcccagcggg

SEQ ID NO: 22369 - DNA, 50 bp, homo sapien
aaaacaagtgtgtccagctataaatracaaccacaggacactgtttctca

SEQ ID NO: 22370 - DNA, 50 bp, homo sapien
ctggattttactcacctctcattaayaactggatcctctaccaagaagca

SEQ ID NO: 22371 - DNA, 50 bp, homo sapien
ctctgacctgagttgacccagataamctttagacaaaactcacaggcagc

SEQ ID NO: 22372 - DNA, 50 bp, homo sapien
tggaaaacagtactaagaattcccaygtgaatattactgttccgatgata

SEQ ID NO: 22373 - DNA, 50 bp, homo sapien
catgctagcaaagaaattatagtcargtaaactcacagcagaatcctgat

SEQ ID NO: 22374 - DNA, 50 bp, homo sapien
caaatgaaaaactcctgacagagagkctataaaaatcacattactattgt

SEQ ID NO: 22375 - DNA, 50 bp, homo sapien
caagtttcaaaatagtcaatcattcragtatggctttatttctatcgcaa

SEQ ID NO: 22376 - DNA, 50 bp, homo sapien
gaaatacatgatagcttcatggaaartgtagtatgtgtgttgcacatatg

SEQ ID NO: 22377 - DNA, 50 bp, homo sapien
caagaattttatttgtcactgaaagragacattctcttattgcttaaaca

SEQ ID NO: 22378 - DNA, 50 bp, homo sapien
tggggatccctgctgcctttttgcaygtctcatctaagggcagataacca

SEQ ID NO: 22379 - DNA, 50 bp, homo sapien
gctctcgctgactgattcacttacaygtaaccgccgtattttaaagaccc

SEQ ID NO: 22380 - DNA, 50 bp, homo sapien
ctataaaatcaatgtgatcttaacamctttggacttatctatgtatggat

SEQ ID NO: 22381 - DNA, 50 bp, homo sapien
aggacccgtctctagaatcagacacrcccagcgcttcctccagcctctgc

SEQ ID NO: 22382 - DNA, 50 bp, homo sapien
tctgacgggtttttacagaaagaaaytgaagccctatgaaatgacagcgt

SEQ ID NO: 22383 - DNA, 50 bp, homo sapien
tcgccggcctggagcaagaagtaaaygtccactgtgccggagccgctacg

SEQ ID NO: 22384 - DNA, 50 bp, homo sapien
tagctttgctttgtagtaagtagccraggcatagctattttagtcaagat

SEQ ID NO: 22385 - DNA, 50 bp, homo sapien
tattttggatacagaaagtacacagratttggttttaccactaacatctc

SEQ ID NO: 22386 - DNA, 50 bp, homo sapien
atttttgtctggaatatacaggatamggcatattcttcattcacatactc

SEQ ID NO: 22387 - DNA, 50 bp, homo sapien
tatctgcacaaactacacatagcaawcctcaaatttgaacaggaaataaa

SEQ ID NO: 22388 - DNA, 50 bp, homo sapien
gatcctttctgactgtccaactatarccaactgtggatttgttttcacat

SEQ ID NO: 22389 - DNA, 50 bp, homo sapien
gaaaaggcaaggtaattgtgctacayggtatactaaagatcagcttttaa

SEQ ID NO: 22390 - DNA, 50 bp, homo sapien
tgcatcatcccaaagcattcgggatraacataggcacaaaacgaagacgc

SEQ ID NO: 22391 - DNA, 50 bp, homo sapien
agtcacataaacattcatcttcaaaytttaataaatatcgtaattgttat

SEQ ID NO: 22392 - DNA, 50 bp, homo sapien
ggacaacatcctccaaggagtaataygcagctaggttgtgtttgccttga

SEQ ID NO: 22393 - DNA, 50 bp, homo sapien
tcctgggcaggagatgggaactcttyaactatagataaatgcccgtctaa

SEQ ID NO: 22394 - DNA, 50 bp, homo sapien
agggtcatacaacatcgagtgccaaycagacaaggttcaccccgtggatg

SEQ ID NO: 22395 - DNA, 50 bp, homo sapien
tcagtgaaattgaaaacagaaaatasagtaaaatcaacaataccaaaagc

SEQ ID NO: 22396 - DNA, 50 bp, homo sapien
gtctattcttaaattagcataaatcwataaggaggtcaaagcacttttct

SEQ ID NO: 22397 - DNA, 50 bp, homo sapien
tttccacttcttgaaagtatatctayaagtttttagccaagaatttttgg

SEQ ID NO: 22398 - DNA, 50 bp, homo sapien
cccgttcctactgctacctacgatayacggtactgcgcctacctcacaga

SEQ ID NO: 22399 - DNA, 50 bp, homo sapien
cagtcttttaagaaagcatcttgacygataattggctgaaagaccataaa

SEQ ID NO: 22400 - DNA, 50 bp, homo sapien
atggatgtatccgtgccggtgttaargaaattgcagtgataaaatgagaa

SEQ ID NO: 22401 - DNA, 50 bp, homo sapien
gactcttggagctttctttgcagtcrcatttattgtgcattattcctgtt

SEQ ID NO: 22402 - DNA, 50 bp, homo sapien
acctgacaatctttattaaatgaaawtatttttgtatcatcaacaacaac

SEQ ID NO: 22403 - DNA, 50 bp, homo sapien
tacatttattcagctttattactaaygctttgttcatataattttcaccc

SEQ ID NO: 22404 - DNA, 50 bp, homo sapien
accgaggagtctccaaataagtgacrctgaataaatgcctgaaggaacaa

SEQ ID NO: 22405 - DNA, 50 bp, homo sapien
tgtgcaaagcttcattctcggttcartatctaacctccctactggggaca

SEQ ID NO: 22406 - DNA, 50 bp, homo sapien
tagggaaaaactataatgatcataayacaataccgttaatagcagcagcc

SEQ ID NO: 22407 - DNA, 50 bp, homo sapien
gtcacgtgcacattcttcgtttttgkattgtactgagattctttgctcag

SEQ ID NO: 22408 - DNA, 50 bp, homo sapien
tgtagggtttctctccagtatgaatkacctcatgtttagtaaggattgag

SEQ ID NO: 22409 - DNA, 50 bp, homo sapien
gataggagatgagatgagaattcagyaggtctctgagaaggaagaaggat

SEQ ID NO: 22410 - DNA, 50 bp, homo sapien
atgaactctaattgagtactatagayaatgttttagtaaaagcttttctg

SEQ ID NO: 22411 - DNA, 50 bp, homo sapien
ctttcagcgcctgtcgggatgactaycaaatcctggaaaatttgccgaac

SEQ ID NO: 22412 - DNA, 50 bp, homo sapien
gacaaatcctgtagaccatggagacmacaccgctgtcagccacgtgctct

SEQ ID NO: 22413 - DNA, 50 bp, homo sapien
aatccctcctcaatcctttctatacrcttggtcattaaaagttcggcaaa

SEQ ID NO: 22414 - DNA, 50 bp, homo sapien
gcgacagattatttgccactttccaygtgacctggttccaacagagggta

SEQ ID NO: 22415 - DNA, 50 bp, homo sapien
tggatcattgtcactgagggcatgamcttttgaaataattgaaaggaaac

SEQ ID NO: 22416 - DNA, 50 bp, homo sapien
tactctcctacctttacaactattayatgctcaaagttaagctaagtttc

SEQ ID NO: 22417 - DNA, 50 bp, homo sapien
catatgacttctgtaaaaaatgagamggacattactaaggatttgttaat

SEQ ID NO: 22418 - DNA, 50 bp, homo sapien
cattgaaacatgatgatacggcctckaagactcccttacttaaaggatcc

SEQ ID NO: 22419 - DNA, 50 bp, homo sapien
cttaatataacaggtgccagctgcaytagatttttctctgctgcctctgc

SEQ ID NO: 22420 - DNA, 50 bp, homo sapien
ctcaaaaaaaagccactttaagacartaccatctaagacttaatagcaat

SEQ ID NO: 22421 - DNA, 50 bp, homo sapien
ggagtcaaagttaaaagagaaaaaawctgtatccagctgggacaaccaga

SEQ ID NO: 22422 - DNA, 50 bp, homo sapien
atgacagaagataagttaggaagaaraatggctctacaacaaggtaaatt

SEQ ID NO: 22423 - DNA, 50 bp, homo sapien
tcatctctatagctaatttgtattayaactattcttattctaactatttt

SEQ ID NO: 22424 - DNA, 50 bp, homo sapien
cgctagataggggagctttctcaccyggcataagctcagctttcccccca

SEQ ID NO: 22425 - DNA, 50 bp, homo sapien
agtgccctccccgctgatttgtagastatctaatagaactagtgcactag

SEQ ID NO: 22426 - DNA, 50 bp, homo sapien
acactgtttttgtagaatctacacakggatatattgaagagcatggaggc

SEQ ID NO: 22427 - DNA, 50 bp, homo sapien
ttgctggtgagaagggagccagagayatgtgctgtgtgtgtcaggggtgg

SEQ ID NO: 22428 - DNA, 50 bp, homo sapien
gaaagtttcttcctagtattaatctraaaatatttccttgctcaccattg

SEQ ID NO: 22429 - DNA, 50 bp, homo sapien
aagcttgctgagaggaaattggaatyaggaatgaaagcagagggcatggt

SEQ ID NO: 22430 - DNA, 50 bp, homo sapien
ggccagagcaaaggctcaagcagacraactcacaaagacttcctgtgttg

SEQ ID NO: 22431 - DNA, 50 bp, homo sapien
tgaccaaaacttgagagaatattatragaatatcaaacacaatggagcta

SEQ ID NO: 22432 - DNA, 50 bp, homo sapien
agtgtgacaagagaatatagtttggragtgttgtgtagagttggcatgat

SEQ ID NO: 22433 - DNA, 50 bp, homo sapien
gaggaaggtcttttggtaaataagaygtgagagtttgtgtctgggctaca

SEQ ID NO: 22434 - DNA, 50 bp, homo sapien
atccaatattgtcaatggaaagaaamgtttacttctgagagatggatgca

SEQ ID NO: 22435 - DNA, 50 bp, homo sapien
aactttgtcaaatttaggtgtgaatmaaaaccatttggtaagattaaata

SEQ ID NO: 22436 - DNA, 50 bp, homo sapien
ctaacaggaatacttgactcagctastaagttacaaatttgcttcatttt

SEQ ID NO: 22437 - DNA, 50 bp, homo sapien
ctctccagtgtgagtcctaccatgcrattgaagatttggggcagatctga

SEQ ID NO: 22438 - DNA, 50 bp, homo sapien
aaaatctaaaaatattgcttttggaycgagaaatatgattgacaaatttt

SEQ ID NO: 22439 - DNA, 50 bp, homo sapien
gagtctttgctaccaacaacatggcsaaaagctgcctcacctctggggaa

SEQ ID NO: 22440 - DNA, 50 bp, homo sapien
gcctggggttcaactgggtgtagcayatctgttgcaggtgcaaatgtgtg

SEQ ID NO: 22441 - DNA, 50 bp, homo sapien
cgctggcacaacaacaacaaagcagratagcaatattagtagcagataaa

SEQ ID NO: 22442 - DNA, 50 bp, homo sapien
actccaattgttccccctttttatckctattggtcatgtctggacttgga

SEQ ID NO: 22443 - DNA, 50 bp, homo sapien
cgaccccagccggactcgagctcacycggttgcaggcgttaggctcccag

SEQ ID NO: 22444 - DNA, 50 bp, homo sapien
accaagatgaacaattgtaaagtaayctgaacttaggaattactccaaat

SEQ ID NO: 22445 - DNA, 50 bp, homo sapien
cactaaggccatgagagtcattcacrctaaatcaaggataacccttttta

SEQ ID NO: 22446 - DNA, 50 bp, homo sapien
atcagcaaattatcaaaatggtgacratggatacttcaaggcaggcccaa

SEQ ID NO: 22447 - DNA, 50 bp, homo sapien
ctgagatggggcacaggaccacctaygatctcgcctgagcgcctggctgc

SEQ ID NO: 22448 - DNA, 50 bp, homo sapien
tttaaacatatcgtctctatttacaragtgataatacatagcaattttta

SEQ ID NO: 22449 - DNA, 50 bp, homo sapien
ccttttcaacctcagggcttttgtaycagctgttctctgaagcattcttt

SEQ ID NO: 22450 - DNA, 50 bp, homo sapien
agaaaaaagttctccggagattttaygtgtaatacctgactgtttcccag

SEQ ID NO: 22451 - DNA, 50 bp, homo sapien
aatgttccttatttattttgatgtaycttcttggactaagttattttcac

SEQ ID NO: 22452 - DNA, 50 bp, homo sapien
caccctgcttttttgaaaccattcarcaaagattccatgtttatactcag

SEQ ID NO: 22453 - DNA, 50 bp, homo sapien
gcctggttggctctatgggcatctcsgacttccaacttgattcaaaatca

SEQ ID NO: 22454 - DNA, 50 bp, homo sapien
ctactgttcatcctattttcaactaygttcttttgcttatttgtccatcc

SEQ ID NO: 22455 - DNA, 50 bp, homo sapien
ctcctctggatggatcagggtcaaayggactcaacccaaaggcattttct

SEQ ID NO: 22456 - DNA, 50 bp, homo sapien
atgctgagtcataattcaaaccatamaaatcaaagaggtagaatgcttgg

SEQ ID NO: 22457 - DNA, 50 bp, homo sapien
agtaagaatccacatattctttacarcttctgaaaacttaattccccttc

SEQ ID NO: 22458 - DNA, 50 bp, homo sapien
atccaaatttcatttaatctatataygagttgggaagaactgacatcttg

SEQ ID NO: 22459 - DNA, 50 bp, homo sapien
gagaggctgtgtccttctcattttawgttcaatcattaaagaacgattca

SEQ ID NO: 22460 - DNA, 50 bp, homo sapien
aggaccatctagaatgctaagagaamccctcctcataccagtggggatct

SEQ ID NO: 22461 - DNA, 50 bp, homo sapien
tggggctgttttagaaaaaaatacarattgacatcacctagacatattta

SEQ ID NO: 22462 - DNA, 50 bp, homo sapien
ctatatttccaggctagcatttcagrctattgctttgtttctcactgtat

SEQ ID NO: 22463 - DNA, 50 bp, homo sapien
cttggctttctattgatgacttcagracaattagcatagttatgtgtagt

SEQ ID NO: 22464 - DNA, 50 bp, homo sapien
aaacacccagaagacaccttgagtamgaaagcatcttctctgagcccatt

SEQ ID NO: 22465 - DNA, 50 bp, homo sapien
ttgcctttagtcaaaacctcaaaccragcaaaaaggaaaagcttaatagt

SEQ ID NO: 22466 - DNA, 50 bp, homo sapien
ctcatacattctagtcagtcccaaaygagcaagaaccttcagcccaggtg

SEQ ID NO: 22467 - DNA, 50 bp, homo sapien
aacataagaatttgactagtgttaaycactccacttctccagtacactga

SEQ ID NO: 22468 - DNA, 50 bp, homo sapien
ctttataagatgttacctcatctaayggtcacagagtcaaactaaagtag

SEQ ID NO: 22469 - DNA, 50 bp, homo sapien
ggatggagattactttcattattacmagtacctacaggatgagggatttg

SEQ ID NO: 22470 - DNA, 50 bp, homo sapien
aagtagaggatcccgcaagtatgacygagggactggaatgcagagggccc

SEQ ID NO: 22471 - DNA, 50 bp, homo sapien
agaaatagcaggaagagcaaaaggaragtcaggaactgtgcatctcattt

SEQ ID NO: 22472 - DNA, 50 bp, homo sapien
ataacatggataccgtgtgactaatyaaagcagtgaggtgaaacttgaag

SEQ ID NO: 22473 - DNA, 50 bp, homo sapien
gagtaagcattagccatgggacgcasacaatccagccaatgctttcagaa

SEQ ID NO: 22474 - DNA, 50 bp, homo sapien
acaaaagggatgtgtaaagctgatcygaaaaaagtagtagcaaggccaac

SEQ ID NO: 22475 - DNA, 50 bp, homo sapien
ctcgatcaatagtttgtaccaataayaccagggatttgcccagtcatctg

SEQ ID NO: 22476 - DNA, 50 bp, homo sapien
gctgtcaaattggccaagatttaagwataactcacagttttgatttgcat

SEQ ID NO: 22477 - DNA, 50 bp, homo sapien
cactgtttccgtggcaccaccactayagggcttctgattttctgttctgt

SEQ ID NO: 22478 - DNA, 50 bp, homo sapien
tgtttattcttgcaaatggactttayaatgatcattttccaaaaaaaatt

SEQ ID NO: 22479 - DNA, 50 bp, homo sapien
ggaccaatggaacccacgtcacctaycggaaggacacacactataaggta

SEQ ID NO: 22480 - DNA, 50 bp, homo sapien
aggaaagaaggtaattagaaaaatargttaagtcagtggttctcaaactt

SEQ ID NO: 22481 - DNA, 50 bp, homo sapien
aatttatcctagaagtaatgttcgcrcaatcactgaggtagcactggttg

SEQ ID NO: 22482 - DNA, 50 bp, homo sapien
tggcaacacaccaagaggcaagaaaygtaagtccatggttcctggtaata

SEQ ID NO: 22483 - DNA, 50 bp, homo sapien
aacaaacaaacaaaaacaaaaaagargttcatacacagataaaatcaacc

SEQ ID NO: 22484 - DNA, 50 bp, homo sapien
gcagctgcttaagccaatagaaattkaacatgcctaagtgcagcctcctg

SEQ ID NO: 22485 - DNA, 50 bp, homo sapien
tgccaaagaattttacactttgtgcrgatccttaattttactaggcttaa

SEQ ID NO: 22486 - DNA, 50 bp, homo sapien
acctccgagtgcagaagccttggagratatgcatagggagtgctttgtcc

SEQ ID NO: 22487 - DNA, 50 bp, homo sapien
cagaagacctagctgaaataactgaygagggtgactgcattaaataacaa

SEQ ID NO: 22488 - DNA, 50 bp, homo sapien
caaagaaagaagcaccatgctaaccratttaatcctctctcctgtggaca

SEQ ID NO: 22489 - DNA, 50 bp, homo sapien
ttgtcaagaaactcatctaagatagsatcaggtcttgcccatggtcctcc

SEQ ID NO: 22490 - DNA, 50 bp, homo sapien
atagttttgaacccagtgtcgtaacrccaaggctgttttgttatacagcc

SEQ ID NO: 22491 - DNA, 50 bp, homo sapien
atctgttcaatggtcacacctttgasaagtgcagtaagaaggcaggtgat

SEQ ID NO: 22492 - DNA, 50 bp, homo sapien
tggggctagaatataaacttataaayagtcacagaaccaatctgtctgaa

SEQ ID NO: 22493 - DNA, 50 bp, homo sapien
gctacatagcaggtgtatatatttawgtggtaagtgagatatttcgatac

SEQ ID NO: 22494 - DNA, 50 bp, homo sapien
ttttatagaaaaaaatgccttcagasagattggttctgtgactgtttata

SEQ ID NO: 22495 - DNA, 50 bp, homo sapien
ttgtacccttcttaggaaatacacayggcaactctgaaagggggctgaag

SEQ ID NO: 22496 - DNA, 50 bp, homo sapien
taaccatgtgcttttgtatacacackaagaatgaaggcataacaagtgat

SEQ ID NO: 22497 - DNA, 50 bp, homo sapien
agaaacattttagatcttcaattcawgttgtttttccaattgcttattaa

SEQ ID NO: 22498 - DNA, 50 bp, homo sapien
gttagaaatcaatattcagatattcsgaaatagcaccgtgaggatggtgc

SEQ ID NO: 22499 - DNA, 50 bp, homo sapien
caccctggagtcttgcctcagataaytgatttaataagatcagagttttg

SEQ ID NO: 22500 - DNA, 50 bp, homo sapien
ctatgttgtctctctcaatgtctccraagagtattccaaggtttgtgaag

SEQ ID NO: 22501 - DNA, 50 bp, homo sapien
acactattatggaggcgataatgcamcaaatcacatctcaagagcaaggg

SEQ ID NO: 22502 - DNA, 50 bp, homo sapien
agctttccaaatgtctggagttctarataacttagatttaatccctactg

SEQ ID NO: 22503 - DNA, 50 bp, homo sapien
tcagtttctttccagtacagtcatcscttgatacctgctgggtattggtt

SEQ ID NO: 22504 - DNA, 50 bp, homo sapien
catagactctgcagaatgaagcaccrcagcttggtccagggcatctgcag

SEQ ID NO: 22505 - DNA, 50 bp, homo sapien
acatgctatacaaattctctctaaawcttctgcagtaaacactttctgtt

SEQ ID NO: 22506 - DNA, 50 bp, homo sapien
aatcatccataatttcaaaatgtcaraataatcactgtttatattttctt

SEQ ID NO: 22507 - DNA, 50 bp, homo sapien
aacattagagatgttctataggatcratttgagatttctggagtttactt

SEQ ID NO: 22508 - DNA, 50 bp, homo sapien
acatataacgagcagctaagtttccygagtttttggatatgacaacaagc

SEQ ID NO: 22509 - DNA, 50 bp, homo sapien
agagggccagactatgagtagcaagsaatgagtgtgctcagagatgggaa

SEQ ID NO: 22510 - DNA, 50 bp, homo sapien
taagagcatgggtgaccagggaataragctgaccttccagccctgaacac

SEQ ID NO: 22511 - DNA, 50 bp, homo sapien
atcatgtctgctgagtatgccaagcrctattcagaatgatcaattttgaa

SEQ ID NO: 22512 - DNA, 50 bp, homo sapien
tatccatgccattgcacaagcaatgrcaattaacacctgctcactcccct

SEQ ID NO: 22513 - DNA, 50 bp, homo sapien
tggcatgatgttgacaccaggtttayatgagtctataagattcataagag

SEQ ID NO: 22514 - DNA, 50 bp, homo sapien
aagccaatcagtttatgcctttatcygaccacaggaattcgtggcccaat

SEQ ID NO: 22515 - DNA, 50 bp, homo sapien
taaataaatgccttctttgcgagtaygagtttctacctagtttcagaaga

SEQ ID NO: 22516 - DNA, 50 bp, homo sapien
tctcattcacagatccgatatatcaytgaaatggtgagtcctgtacttgc

SEQ ID NO: 22517 - DNA, 50 bp, homo sapien
cctggtatgaaagtcacaggctcacsggcatgttgaattctttctcaaga

SEQ ID NO: 22518 - DNA, 50 bp, homo sapien
ggatggtaattaacttctgaacccarctgacaggtgtaatgatgactcta

SEQ ID NO: 22519 - DNA, 50 bp, homo sapien
tcagaacatattccttaatgatagarctttgagggaaaatggaatatgaa

SEQ ID NO: 22520 - DNA, 50 bp, homo sapien
tgctaggctttgggcaacaggtaaartcttcgtctgttacttgcatgaaa

SEQ ID NO: 22521 - DNA, 50 bp, homo sapien
tgtcttcgaagggaactagaaatacrgaaggctttaccacattctttaca

SEQ ID NO: 22522 - DNA, 50 bp, homo sapien
tggatattttgcatgacacactgtasaaactctagattcttttatacgtc

SEQ ID NO: 22523 - DNA, 50 bp, homo sapien
agagggaggaagttgtgcttactaasagcctgcagcttggaggagagatc

SEQ ID NO: 22524 - DNA, 50 bp, homo sapien
tgcataaccatgtacaatattctaartcataatgaacttgcttctggcta

SEQ ID NO: 22525 - DNA, 50 bp, homo sapien
ccctggggatgctgatctgtccttayctgcctaacgtgggtccctctccg

SEQ ID NO: 22526 - DNA, 50 bp, homo sapien
ctgacagactgatgctgatctgtcawtagtaacgcagccttccttctgtg

SEQ ID NO: 22527 - DNA, 50 bp, homo sapien
tggtctggtttcactgatagaggtayattgaaaggataagagagattcca

SEQ ID NO: 22528 - DNA, 50 bp, homo sapien
aggataagagagattccaggacatartaactggatgcaacataggggact

SEQ ID NO: 22529 - DNA, 50 bp, homo sapien
tttaaggcaatagagaacattttgaytacagtatgaatgaatgattacgt

SEQ ID NO: 22530 - DNA, 50 bp, homo sapien
tttaaagtttacagaggcaacaaaargtagcagtgcctgaataagcctgc

SEQ ID NO: 22531 - DNA, 50 bp, homo sapien
ggacaacctttagtcgtcttacagamcttagagtacatcagagaattcat

SEQ ID NO: 22532 - DNA, 50 bp, homo sapien
acctctccatgcctcagtttacacawccgctgatacgctgtcccctccag

SEQ ID NO: 22533 - DNA, 50 bp, homo sapien
acagcaagctgaggctaaaaggatcragactttataatggaatctaatat

SEQ ID NO: 22534 - DNA, 50 bp, homo sapien
acataaaaaaaaattatactagtgcraaactctagaaatataaagaacat

SEQ ID NO: 22535 - DNA, 50 bp, homo sapien
taataaagcataactcagattttccragaaaagatttctaccaattttag

SEQ ID NO: 22536 - DNA, 50 bp, homo sapien
cgaagcagaggaatttaggaaaggcwatttattctcttttaaagtaggta

SEQ ID NO: 22537 - DNA, 50 bp, homo sapien
gagcttagccaggtgaattcagagtsaagtaaaaagagaatctgcatttc

SEQ ID NO: 22538 - DNA, 50 bp, homo sapien
gagcagtttcccaatgaaagactaaygtgctaaatgagtatggaatgagc

SEQ ID NO: 22539 - DNA, 50 bp, homo sapien
catatttgtttgaatgcttgtttaayctctgtctgctacaatagagccaa

SEQ ID NO: 22540 - DNA, 50 bp, homo sapien
cgcaggagggggtcatgggtaaagaytactaccagacgttgggcctggcc

SEQ ID NO: 22541 - DNA, 50 bp, homo sapien
attttttgcaagtttctgattccacracattcaaatatactattacaaag

SEQ ID NO: 22542 - DNA, 50 bp, homo sapien
ctccagccatggtttgaaggacagawgtaaaagtatctggaatgattggg

SEQ ID NO: 22543 - DNA, 50 bp, homo sapien
caattggtaaggcctcagaaaagacrgaattcagtatactggaggaactc

SEQ ID NO: 22544 - DNA, 50 bp, homo sapien
tcatacctggagattcgtttttatcmagtgggtctcaataatctgttata

SEQ ID NO: 22545 - DNA, 50 bp, homo sapien
gtagattattagttgtattttaggaygtagtgaggagtaaagcgttgtgg

SEQ ID NO: 22546 - DNA, 50 bp, homo sapien
aaagaaaatgatattttgaaaactarggtaatgataggctatcatcatga

SEQ ID NO: 22547 - DNA, 50 bp, homo sapien
taagctaaattccctctgttggttamaataaaaataaacataatctgatc

SEQ ID NO: 22548 - DNA, 50 bp, homo sapien
caatttgtacaaggtctgatatttcwcaggttttgcatagaagcaaaggc

SEQ ID NO: 22549 - DNA, 50 bp, homo sapien
aaccttttaccaccctccaacgtaakgaagaagtttccagtgaggggtga

SEQ ID NO: 22550 - DNA, 50 bp, homo sapien
ggcctagacggttatgcacaatcgayccggttagatacagcagcgccccc

SEQ ID NO: 22551 - DNA, 50 bp, homo sapien
gagcccactcaagagcgtggataaayctcgggacaggattgtgacaggca

SEQ ID NO: 22552 - DNA, 50 bp, homo sapien
catgacatcttgtttaccttttctcraaattattctcttctagtgatttg

SEQ ID NO: 22553 - DNA, 50 bp, homo sapien
taacccataaaattctgaataaacayagtggagtactgatgaagaattct

SEQ ID NO: 22554 - DNA, 50 bp, homo sapien
ttcaaccactaaaacattaaaaaaaragtgataaatgtctccaaatcgta

SEQ ID NO: 22555 - DNA, 50 bp, homo sapien
ggataagaattgattcttcacagaamagttgtttcatgaccatagtcctc

SEQ ID NO: 22556 - DNA, 50 bp, homo sapien
aacacagttggtaactagttttggcygcacaaattctaagcagaatgttt

SEQ ID NO: 22557 - DNA, 50 bp, homo sapien
catagaagcaaaggcaaaaactgacyacagtactaaacagtcagaaacaa

SEQ ID NO: 22558 - DNA, 50 bp, homo sapien
aatacttacagctggttatggaaatsaagattcaactggtcccctatgtt

SEQ ID NO: 22559 - DNA, 50 bp, homo sapien
tttcaaaattttagcatgcatcaagwaacaacatttttcttcacagccga

SEQ ID NO: 22560 - DNA, 50 bp, homo sapien
cattggtgtgaaaatattagtagcamaaaacttcaaaagtctagttttca

SEQ ID NO: 22561 - DNA, 50 bp, homo sapien
agattaatggcgacagatttctataygttttgtagagtagatagcttaaa

SEQ ID NO: 22562 - DNA, 50 bp, homo sapien
tgcaggtaattgctggaggggctatragaacttccagggccagaaagagg

SEQ ID NO: 22563 - DNA, 50 bp, homo sapien
ctggcagctcacatcttagatgaacracaattgccacagcagcactttag

SEQ ID NO: 22564 - DNA, 50 bp, homo sapien
ttacatttccatatcaaaataacaarctgtagagcaaaaggctcatggca

SEQ ID NO: 22565 - DNA, 50 bp, homo sapien
aaaatatttattcaggactcagaaakgtatggattttattcatatttcta

SEQ ID NO: 22566 - DNA, 50 bp, homo sapien
tcactaccttaattgatcttcctgakaatgtagacttaaacatactaggg

SEQ ID NO: 22567 - DNA, 50 bp, homo sapien
gaaattcttctccaataaaattacayaaatggcctcagtgccaagcgtag

SEQ ID NO: 22568 - DNA, 50 bp, homo sapien
aagttggcacgtggcacaaaaaccartcttggcgttcagtgttttgttga

SEQ ID NO: 22569 - DNA, 50 bp, homo sapien
aagcaacatcatcttcctaggattgmatataggagagagcctaggcctcc

SEQ ID NO: 22570 - DNA, 50 bp, homo sapien
ttgtctgctgaccacatctagaatayaataacttgacatctcagggcagg

SEQ ID NO: 22571 - DNA, 50 bp, homo sapien
tctggcaatttagtgaagaagcaaartcttttccaacatctgctggaagc

SEQ ID NO: 22572 - DNA, 50 bp, homo sapien
taaaaatctattcttccttttgttargcacagatgaattacatttcttaa

SEQ ID NO: 22573 - DNA, 50 bp, homo sapien
acagagccactttgggctaacttaaygagacccagaaagaaaaacctccg

SEQ ID NO: 22574 - DNA, 50 bp, homo sapien
gaatctctggattgaactgtacctgmagccagtccatatttagaattttt

SEQ ID NO: 22575 - DNA, 50 bp, homo sapien
tggcatttaaagtttcctctcccaartaatctttgagacacttgcttatt

SEQ ID NO: 22576 - DNA, 50 bp, homo sapien
acatgcctgttaagggactcaaaaakgttcaccgctcttcggatgtccac

SEQ ID NO: 22577 - DNA, 50 bp, homo sapien
aacactcaagcttttgacattctcarccgtggccagaagaagtctctaaa

SEQ ID NO: 22578 - DNA, 50 bp, homo sapien
agcagagcgtacatgctcaaagacgraagtcccggtctgcagctttgcct

SEQ ID NO: 22579 - DNA, 50 bp, homo sapien
tacaggattatttgacttgtttacgyacatgggattgccaaaatgatgtt

SEQ ID NO: 22580 - DNA, 50 bp, homo sapien
tcaattagctagaagtttatacttcrccttctttaagcagttcatagcta

SEQ ID NO: 22581 - DNA, 50 bp, homo sapien
gtcgctctggggagctctaattcaaytatcaatatttgtttctgttttta

SEQ ID NO: 22582 - DNA, 50 bp, homo sapien
atggaaaagatgcacagcatacaaartcagatgggtaatttcagaagaaa

SEQ ID NO: 22583 - DNA, 50 bp, homo sapien
ctgaggaatattttgacttggaagakaatttaaacttttaatcaagagat

SEQ ID NO: 22584 - DNA, 50 bp, homo sapien
aaagagtcatcactttttgctgttaycttaaggccaagttgcttgtatac

SEQ ID NO: 22585 - DNA, 50 bp, homo sapien
aactgaggaattaagagaccaatacrgagtacaggaggattttttatttt

SEQ ID NO: 22586 - DNA, 50 bp, homo sapien
tattgagacctatgttgaaacacgamatatactgagataaaaaatagaaa

SEQ ID NO: 22587 - DNA, 50 bp, homo sapien
tgagcagatggagctctgtgcaagakgagtagatggagttccgagcaaga

SEQ ID NO: 22588 - DNA, 50 bp, homo sapien
attcctttcaccaatcaaatacaaargtgtcacttccaagcaaaaagtgg

SEQ ID NO: 22589 - DNA, 50 bp, homo sapien
tgacctcaatgtgctaccatatatcycttgctagtctctgaaaaagcaga

SEQ ID NO: 22590 - DNA, 50 bp, homo sapien
acaaaagtaaattctgcctttaaaaycagagaccagtgtcactggtgaac

SEQ ID NO: 22591 - DNA, 50 bp, homo sapien
agccaccaccaggccctggctttggsaaagaaacatgaacagacccctct

SEQ ID NO: 22592 - DNA, 50 bp, homo sapien
ctggaggtatttagttggcaacggawaagattgactccaccaaggcaggg

SEQ ID NO: 22593 - DNA, 50 bp, homo sapien
ccaaggtgttggtagaaattctaaaytcaagcctgaccttccagttgtta

SEQ ID NO: 22594 - DNA, 50 bp, homo sapien
gagtaagttttgaaaagaagagttaygtgcatcaaaaattcagttcagat

SEQ ID NO: 22595 - DNA, 50 bp, homo sapien
tggaagtatttgaagaaacacaagaragtacaagcagtttttctaatgtt

SEQ ID NO: 22596 - DNA, 50 bp, homo sapien
agctaaaaatatatttagaaagccawatctgaactgaatttttgatgcac

SEQ ID NO: 22597 - DNA, 50 bp, homo sapien
gcaaaggaatttctgtttatgttcawatttgtagacttttgtattattct

SEQ ID NO: 22598 - DNA, 50 bp, homo sapien
tctccatttcagctattgttgcttakaaccatcgtgggttaggcaggacc

SEQ ID NO: 22599 - DNA, 50 bp, homo sapien
aatatctcaagtagaaagggatttcrcgtagacaatgtaatgcttccaaa

SEQ ID NO: 22600 - DNA, 50 bp, homo sapien
catctgagtattcacagtggtaagaraccctttgaatgcaacaaatgcgg

SEQ ID NO: 22601 - DNA, 50 bp, homo sapien
tccattgttacgaggtataagaaaaygtaagtgcatgtggatataagcag

SEQ ID NO: 22602 - DNA, 50 bp, homo sapien
aaccaaaccccctacactagccagaygtcttccaacatttctctggtcac

SEQ ID NO: 22603 - DNA, 50 bp, homo sapien
caaagtctctgcgtgtggtgactaarcacaagacacggctgactcatgcg

SEQ ID NO: 22604 - DNA, 50 bp, homo sapien
ccacactgggaccaaaacgtaaaaargctgacataacttagggagggtgg

SEQ ID NO: 22605 - DNA, 50 bp, homo sapien
attatttatcagcatcaggtcaatayaggctgatgagtttaatgccatga

SEQ ID NO: 22606 - DNA, 50 bp, homo sapien
tttttaaaaaataataggaaggagargtaaaattttagacttagaaaaac

SEQ ID NO: 22607 - DNA, 50 bp, homo sapien
tttgtggacagagtgaattgctggaygtgttactccatgctcagaaggtc

SEQ ID NO: 22608 - DNA, 50 bp, homo sapien
ggctggcaggctccccaggtgagtayatgaaaacaaagaaactaaaagcc

SEQ ID NO: 22609 - DNA, 50 bp, homo sapien
ttaaacacttacaaattcatctaaamatcagaactcaaccacagttgtct

SEQ ID NO: 22610 - DNA, 50 bp, homo sapien
aatgactaagatgctttccaaatacragggaattatctttggtggtatga

SEQ ID NO: 22611 - DNA, 50 bp, homo sapien
gtgtttactgtagttaatgttcttayaatgtatcgcttttaatttaagtt

SEQ ID NO: 22612 - DNA, 50 bp, homo sapien
ttccaaaataaatgggatcacttcaycttcacctgcttaaaactcatcag

SEQ ID NO: 22613 - DNA, 50 bp, homo sapien
gctagaggtgttgaaaacatatggamagtatgactcgctgattcttaaga

SEQ ID NO: 22614 - DNA, 50 bp, homo sapien
accctaccttcccgcaaatggtaacrgtgagggctgacaagctttctcag

SEQ ID NO: 22615 - DNA, 50 bp, homo sapien
tctctaggaagcttctcttgagtgcsataggctcgcatccagacctcctc

SEQ ID NO: 22616 - DNA, 50 bp, homo sapien
taaccttgctttcacggtcctctagwaaaatccaaatatgtgttctgaag

SEQ ID NO: 22617 - DNA, 50 bp, homo sapien
ccacacatgcacaggctgatttatcrcagcatgacttgccgttgaaaaat

SEQ ID NO: 22618 - DNA, 50 bp, homo sapien
gaaaaagtttcaacctacaagaaaakaaagaattcatcacagaactttga

SEQ ID NO: 22619 - DNA, 50 bp, homo sapien
tttggcttccttgctaggggagatartaagagtcaatatgtttaaccagc

SEQ ID NO: 22620 - DNA, 50 bp, homo sapien
tgcataagcagtttctagcctcagargaatgctctcattttctttttctt

SEQ ID NO: 22621 - DNA, 50 bp, homo sapien
aaaaatgtcactgggactctggtacraattgcgttgaacctgcagctcac

SEQ ID NO: 22622 - DNA, 50 bp, homo sapien
aggctaagtgagtagccgagtgttasatgagccactcaaatccaggggtt

SEQ ID NO: 22623 - DNA, 50 bp, homo sapien
cacaaaagctggagataatggagaaygatgctgagaaatggaaaagcgag

SEQ ID NO: 22624 - DNA, 50 bp, homo sapien
ttcctgctgaagcaagattgtgataygtttgacttacatgaaaaaccttt

SEQ ID NO: 22625 - DNA, 50 bp, homo sapien
gaatggatgaatcatcctttgtttcrccagttccctctagatggacattt

SEQ ID NO: 22626 - DNA, 50 bp, homo sapien
aaggacaaggtatttggcctcaacartctcatattttagaaccatgcaat

SEQ ID NO: 22627 - DNA, 50 bp, homo sapien
tgaccaagtcacttccccatttagamtattcagaggcactccacagccca

SEQ ID NO: 22628 - DNA, 50 bp, homo sapien
taagatagaatcagagtcctttgcayggcatatgaagccccatggcctgg

SEQ ID NO: 22629 - DNA, 50 bp, homo sapien
ctagaggaaagtggaggaaaccgatrataaaatgataattatatattcag

SEQ ID NO: 22630 - DNA, 50 bp, homo sapien
acggatgaactacgttctctcttacygcaaagctcttgttccactaagtc

SEQ ID NO: 22631 - DNA, 50 bp, homo sapien
attgccaaaaaatgtgctctgaaaartcgtgttggcaattgtgtttgatc

SEQ ID NO: 22632 - DNA, 50 bp, homo sapien
ggaggaagttcccgctaagcgtttayagtctgaaaggtacacactgtatg

SEQ ID NO: 22633 - DNA, 50 bp, homo sapien
gagctgaggttagatgttcagaagcyctttcctatcataaggcatcattg

SEQ ID NO: 22634 - DNA, 50 bp, homo sapien
tctgccacatgtagggatctttagcyttgaaaactgagtagatgtatcca

SEQ ID NO: 22635 - DNA, 50 bp, homo sapien
gagcagaaacacagagcccttattayatgatgagcatttatctacatagc

SEQ ID NO: 22636 - DNA, 50 bp, homo sapien
ctgttttatcctactcatcctactasatctgggtgtctagaccacttgca

SEQ ID NO: 22637 - DNA, 50 bp, homo sapien
ggccatacaagattaagtcttgcaartgaaagtggaaatagcagaaggtc

SEQ ID NO: 22638 - DNA, 50 bp, homo sapien
ttgcaagtattgatgacacacctatracatataagacacattctctgctc

SEQ ID NO: 22639 - DNA, 50 bp, homo sapien
gctttgtgttacagttgattattaaragtgcaactgttggctttttatgc

SEQ ID NO: 22640 - DNA, 50 bp, homo sapien
acagatagggatcagggactgtaacyggaaaatagagaaaagagtctttt

SEQ ID NO: 22641 - DNA, 50 bp, homo sapien
ttattagttccaggagttttttgtarggattagctaagagttgaaaaaaa

SEQ ID NO: 22642 - DNA, 50 bp, homo sapien
gaggagatttccttcctcctcattgyagaacgcagtgggatatcaaagta

SEQ ID NO: 22643 - DNA, 50 bp, homo sapien
tctctaaatctcccgcatggatcaamtgacctcactgctctgtgacttct

SEQ ID NO: 22644 - DNA, 50 bp, homo sapien
aagggataaactctgaattaaaatcycctcaaattctttatactgtacta

SEQ ID NO: 22645 - DNA, 50 bp, homo sapien
tcagttgatccatgcgggagatttaragaccatttctacaggctggagaa

SEQ ID NO: 22646 - DNA, 50 bp, homo sapien
ctgtactagatcttatccagaatgamctatctgaaattcaaatggatgag

SEQ ID NO: 22647 - DNA, 50 bp, homo sapien
tctgtatactaattgtataatgctgmaatatattaatgtttcatatacta

SEQ ID NO: 22648 - DNA, 50 bp, homo sapien
attttttcataattttaaagcaagayggattgaaaatacacattagacaa

SEQ ID NO: 22649 - DNA, 50 bp, homo sapien
tattgtttctctcctgaatgggttamatgatgtcttcttaaatgtgagct

SEQ ID NO: 22650 - DNA, 50 bp, homo sapien
aaattcatggtaatttgccacagtarccattggaaattaataaaagcact

SEQ ID NO: 22651 - DNA, 50 bp, homo sapien
aagctttgtctagcattggattaaartatgacggagatccccagagatac

SEQ ID NO: 22652 - DNA, 50 bp, homo sapien
ttactaaccatcaagtaatccatacygcagagaaaccttacaaatgtact

SEQ ID NO: 22653 - DNA, 50 bp, homo sapien
ttagaacatatgttgaaatgaaaaargaatatactttgcaacaaactcag

SEQ ID NO: 22654 - DNA, 50 bp, homo sapien
taaaatccacataaccagactgaggwacagaatgtattgattactcaaaa

SEQ ID NO: 22655 - DNA, 50 bp, homo sapien
tacttgatggttagtaaggcttgcasggactctaaaaacttcaccatctt

SEQ ID NO: 22656 - DNA, 50 bp, homo sapien
aactgttaaatattaaatatggcaaygagcatagaaattactttaatagt

SEQ ID NO: 22657 - DNA, 50 bp, homo sapien
tgcaattgaaaatggtgctttgtccragagggcatgactctgtggtgtgt

SEQ ID NO: 22658 - DNA, 50 bp, homo sapien
catccctcctctgacttaccggatayactacaccactttataaaatagtt

SEQ ID NO: 22659 - DNA, 50 bp, homo sapien
actaaacacatgtaaataaagactarggatacatacaaatacatttccaa

SEQ ID NO: 22660 - DNA, 50 bp, homo sapien
tccttagggatatagccaaattacascatgccaagaaatgacagaaatgt

SEQ ID NO: 22661 - DNA, 50 bp, homo sapien
tacaggagatttctgtgtcttaacayggaataaggctgccgggtgaagaa

SEQ ID NO: 22662 - DNA, 50 bp, homo sapien
ttcaaagattctgctttacagattarataacttgtgccttttgttttcta

SEQ ID NO: 22663 - DNA, 50 bp, homo sapien
cctgagactcaggacacaacctaaaygtggctgagaatcttttcctgata

SEQ ID NO: 22664 - DNA, 50 bp, homo sapien
tgcctgcctctttgcctcaagatgawgttctgactctagtgagagttatt

SEQ ID NO: 22665 - DNA, 50 bp, homo sapien
aaaggaagaagttcttgtaaaagatracgatatttagtttgaggtggata

SEQ ID NO: 22666 - DNA, 50 bp, homo sapien
aagccaaaactttctaaaaagactaygagaacaaatgagaaaatatgcac

SEQ ID NO: 22667 - DNA, 50 bp, homo sapien
caccactatctgccaatcatatcaarcctaatcttaacagtcactgcaag

SEQ ID NO: 22668 - DNA, 50 bp, homo sapien
ccactgttctactaagattgaaataygtatgtttatgtaagctattaata

SEQ ID NO: 22669 - DNA, 50 bp, homo sapien
tgaattatttacttttctacatgaamcaatccattcttctgtgtgcatgt

SEQ ID NO: 22670 - DNA, 50 bp, homo sapien
cataataattaagaaaaagatattamcagagcattgcttaaaggcactac

SEQ ID NO: 22671 - DNA, 50 bp, homo sapien
aaaaatgaaaatatatgcaatcttcragaaataaagcaaataacctacct

SEQ ID NO: 22672 - DNA, 50 bp, homo sapien
ttgaggccagaggcatggcggtactsaccagtgtctcctgaaggctggag

SEQ ID NO: 22673 - DNA, 50 bp, homo sapien
ttaataattcataaatgccactaacratctacaagtgaaaagcattttca

SEQ ID NO: 22674 - DNA, 50 bp, homo sapien
ttatgccttctttttcttctcacacyggaactcagtctttgtctcttgaa

SEQ ID NO: 22675 - DNA, 50 bp, homo sapien
ctgaattccgccatggagatgtggaygactggaaatccctaactcagtcc

SEQ ID NO: 22676 - DNA, 50 bp, homo sapien
agatgtctatgagttcccaccttccrcttatttgtgacgacatcttatta

SEQ ID NO: 22677 - DNA, 50 bp, homo sapien
ctatagaccagtgtgggcttcttaamtatcttaattcttccagtcatgag

SEQ ID NO: 22678 - DNA, 50 bp, homo sapien
gtttattttgtagcttcttaaggaawctttactcaactggattgtgagag

SEQ ID NO: 22679 - DNA, 50 bp, homo sapien
aaggcaaaggggagctggtgcatcayatagtgagagagaaaacaagagag

SEQ ID NO: 22680 - DNA, 50 bp, homo sapien
gcctgtactcccagctacgcagtagrctaaggcaggactatcacttgaac

SEQ ID NO: 22681 - DNA, 50 bp, homo sapien
tgtatatgtacccatgtgtgcacttkaaatatcagtacaaactgataaac

SEQ ID NO: 22682 - DNA, 50 bp, homo sapien
agggcagcggccagtgaggctctaaygcactccgttcctgtagcaacacc

SEQ ID NO: 22683 - DNA, 50 bp, homo sapien
gatacaaatgagaacaatcgcttgaragtgaatatggtagcatctgacga

SEQ ID NO: 22684 - DNA, 50 bp, homo sapien
acagatgcgctttatcattgttggaycgggcatctctgaccctggagtgt

SEQ ID NO: 22685 - DNA, 50 bp, homo sapien
ccttcagccccttctgctttgacaargtttatcactagatgttctttagg

SEQ ID NO: 22686 - DNA, 50 bp, homo sapien
ctccttatgggaagaaaaacttctcrgaaaatctaacactttctacttta

SEQ ID NO: 22687 - DNA, 50 bp, homo sapien
ttttggtgtgtgatagggttaaaacmgattggatctgacattctaagcaa

SEQ ID NO: 22688 - DNA, 50 bp, homo sapien
atcaatcacattagatgacttcccaytacattttaatatcagataaatga

SEQ ID NO: 22689 - DNA, 50 bp, homo sapien
tctagtatgaatcaaaaatagatgaycttggggctttgtgtagagggcag

SEQ ID NO: 22690 - DNA, 50 bp, homo sapien
ttggcacgtgttgtaccagttatccragtcaattcttacttaggcgagtt

SEQ ID NO: 22691 - DNA, 50 bp, homo sapien
tagtctcctgggaacagctattatayagtgtcatggccaaagtcatagag

SEQ ID NO: 22692 - DNA, 50 bp, homo sapien
aagcttccctccttggcccgaatcasgttgcctgcctagttctgaccaat

SEQ ID NO: 22693 - DNA, 50 bp, homo sapien
aatgttatatgtaaatttatgtaaaygagtatgctaatgtccctgtgttc

SEQ ID NO: 22694 - DNA, 50 bp, homo sapien
gaatattttggctgaatatatggagmaacattgcatgggaggttcaaaaa

SEQ ID NO: 22695 - DNA, 50 bp, homo sapien
catcttaacattattaattttcccartccaagaacacaagacatctttcc

SEQ ID NO: 22696 - DNA, 50 bp, homo sapien
catgtagtttggacatgcgcctctargtgatgtggaactgagctccatga

SEQ ID NO: 22697 - DNA, 50 bp, homo sapien
ggtgccatcactgcatgttattgtcycttgccatatgctaccttttacaa

SEQ ID NO: 22698 - DNA, 50 bp, homo sapien
ttcttaaagctatctcttttcttgaratatgaggaatgattctctcctgg

SEQ ID NO: 22699 - DNA, 50 bp, homo sapien
actccacaactctggtgccaacgtaracaatattcttttatgcactcctt

SEQ ID NO: 22700 - DNA, 50 bp, homo sapien
ttgatgtttatgtttgatggaataargtacaacagtgtaaaagtaatatt

SEQ ID NO: 22701 - DNA, 50 bp, homo sapien
tggttgtatggttcacagctttacgyattgttgatttgttgccattgctt

SEQ ID NO: 22702 - DNA, 50 bp, homo sapien
aaaccgaactaaacttcttctatccrcccttgtgcacattacataacgct

SEQ ID NO: 22703 - DNA, 50 bp, homo sapien
ctcagtcacttcatcagttaaatgarggaattagaaatctttgaggagac

SEQ ID NO: 22704 - DNA, 50 bp, homo sapien
gcctttcccagctttcactcgccacraaataaatagcttctgtcaaggag

SEQ ID NO: 22705 - DNA, 50 bp, homo sapien
gtggaaagggctttagatacagttcrcagtttatataccatcagagaggc

SEQ ID NO: 22706 - DNA, 50 bp, homo sapien
aagccatcgcactctcttaggtaaaygcctagcagcctgtgggatattct

SEQ ID NO: 22707 - DNA, 50 bp, homo sapien
cacaaacattcaaaccagagcaggawtcaatttcttttactaacccatat

SEQ ID NO: 22708 - DNA, 50 bp, homo sapien
cttaagtgtattttgttctaacttayatttaatggattaattttagttaa

SEQ ID NO: 22709 - DNA, 50 bp, homo sapien
acttttaggcagcagagtggtatgaygcgatctgaatttatatcctgggg

SEQ ID NO: 22710 - DNA, 50 bp, homo sapien
aatggaaaattattgaaacatattaraaactacaaatggatcactgtggt

SEQ ID NO: 22711 - DNA, 50 bp, homo sapien
tatttattaagtgaatgaaatataaygcttatcagtaaataaaatgaggg

SEQ ID NO: 22712 - DNA, 50 bp, homo sapien
gactggaccgcaaaagtaatttaaargtttcattgtgggttcttttcctc

SEQ ID NO: 22713 - DNA, 50 bp, homo sapien
attaaatgaaaaggaaaattgtaacrgaaagaaagaaataaagtaaaata

SEQ ID NO: 22714 - DNA, 50 bp, homo sapien
catcaattgagatttcaagggagtcrccaagatcatcctcaggttcagtg

SEQ ID NO: 22715 - DNA, 50 bp, homo sapien
gcctgtggttgcacagtatgcaagartaaggaaacttggcagcttccagc

SEQ ID NO: 22716 - DNA, 50 bp, homo sapien
acattctttctgctgcgctgcaaagycatagcagatatgaggtgctgttg

SEQ ID NO: 22717 - DNA, 50 bp, homo sapien
ggaggctgaagtaggagaattgctcraatgtgggagaatcgcttgaactt

SEQ ID NO: 22718 - DNA, 50 bp, homo sapien
gccctggagcagctctgtggaaaaastggaatcagcttagaggttttgga

SEQ ID NO: 22719 - DNA, 50 bp, homo sapien
tgggggtgtctgacatctctgactcraataataaacacaagtatgttgga

SEQ ID NO: 22720 - DNA, 50 bp, homo sapien
ttctcttttagaatagggcgctttawagttggagaagttctgagagcttg

SEQ ID NO: 22721 - DNA, 50 bp, homo sapien
atgatcttctgatttgctagatatawggtggagaaaataaatattaaaaa

SEQ ID NO: 22722 - DNA, 50 bp, homo sapien
tctgatggcagagacagcaggaaacragaggcaatgtaacaacatatgag

SEQ ID NO: 22723 - DNA, 50 bp, homo sapien
ggtcagagtaggctgcggtaaagcaraaaaagagaggaggaaatgtttga

SEQ ID NO: 22724 - DNA, 50 bp, homo sapien
aaacaaagaaatggttttggcaccaygaggccctgtgtatttccaccctt

SEQ ID NO: 22725 - DNA, 50 bp, homo sapien
gcttgtgagtttttgtgaagtgaaasaacaatgatctgaaatcagacaga

SEQ ID NO: 22726 - DNA, 50 bp, homo sapien
agaaaaaaatactgcccatgatacckatgtatacagaaagttctaagggt

SEQ ID NO: 22727 - DNA, 50 bp, homo sapien
atgaagggacttaattgaagactaaycttttcaaatttgaatttacacaa

SEQ ID NO: 22728 - DNA, 50 bp, homo sapien
aaagaacatgtatgactttattaaawtgttgggtggatagatctctttcc

SEQ ID NO: 22729 - DNA, 50 bp, homo sapien
caggtacttcatgtggcaactgtaartattccaattagataagatgttta

SEQ ID NO: 22730 - DNA, 50 bp, homo sapien
taggccaccaggcacaggcacatgcrcttaaggtcaattttccccaagct

SEQ ID NO: 22731 - DNA, 50 bp, homo sapien
gggtctgtcttccatctgtagacctraaaatggcaccatcacatctggtt

SEQ ID NO: 22732 - DNA, 50 bp, homo sapien
tcatgtattttcttttttctgttacrcaactccatattataaagaatatc

SEQ ID NO: 22733 - DNA, 50 bp, homo sapien
gtgagtaacccaataaaccatttccraccgttatcattctaatgtcaatt

SEQ ID NO: 22734 - DNA, 50 bp, homo sapien
attttctggacatgactgtgataacsggggtgttgatgaaatattatgag

SEQ ID NO: 22735 - DNA, 50 bp, homo sapien
gcactccagcctcagcgatcaaaccrgactctgtctcaaaaaaaaaaaaa

SEQ ID NO: 22736 - DNA, 50 bp, homo sapien
actcacatcagcagagactcatctcrcatcttgctgtgcagttccagttg

SEQ ID NO: 22737 - DNA, 50 bp, homo sapien
gcagttgcagataagggatgaaacaygctctggcctcctgcagcaccccc

SEQ ID NO: 22738 - DNA, 50 bp, homo sapien
ccttcacccccccaatctgaataagsaaaatgttcatttgcattgatggg

SEQ ID NO: 22739 - DNA, 50 bp, homo sapien
gttagacagacactcagagaaatacrgaagataacaggcagagaggagtg

SEQ ID NO: 22740 - DNA, 50 bp, homo sapien
atgacatcttcatcccgcaacacaayttcatcttgcaaacgtctcaggtc

SEQ ID NO: 22741 - DNA, 50 bp, homo sapien
atagagcttcaactttctatttatcraacatttaaattgaaataatagca

SEQ ID NO: 22742 - DNA, 50 bp, homo sapien
gatgcctagtgagactttggcctgcrgaaaatctctatcacatataatta

SEQ ID NO: 22743 - DNA, 50 bp, homo sapien
taaggagtgaaaagtttaatagcaastaagaaggaagaaagaagagaaca

SEQ ID NO: 22744 - DNA, 50 bp, homo sapien
tttttgatgaaaccatacaaatgtawcgtgcatgcttaagcttttaccca

SEQ ID NO: 22745 - DNA, 50 bp, homo sapien
ggaatggccttagccctatccacaarctcagaataactaacgatttactt

SEQ ID NO: 22746 - DNA, 50 bp, homo sapien
agactacgatttagcaccagaagacrctcgcgccgggaaccccaaattcc

SEQ ID NO: 22747 - DNA, 50 bp, homo sapien
cctcagcgcagcatctgcagactacratttagcaccagaagacgctcgcg

SEQ ID NO: 22748 - DNA, 50 bp, homo sapien
ccagaaatttgtccattttctataartattcaaaacttttcatacagctt

SEQ ID NO: 22749 - DNA, 50 bp, homo sapien
tcttgaaaaaggcagaggaaattaaraatctgactgctcttgggtaatga

SEQ ID NO: 22750 - DNA, 50 bp, homo sapien
agggaaaaaatgatcttcggccttaygataattgtccctttttctttttt

SEQ ID NO: 22751 - DNA, 50 bp, homo sapien
gtggtaggtacttggtgatatttgckgaatgattcgtctactaaatagca

SEQ ID NO: 22752 - DNA, 50 bp, homo sapien
tgccccagtctaggcagagatgatayacctaggcaagagatgatggcaga

SEQ ID NO: 22753 - DNA, 50 bp, homo sapien
cccaaggaaacactgaaaacacatakcaggccaatgctgtgtggttttgt

SEQ ID NO: 22754 - DNA, 50 bp, homo sapien
atagaacacttccgcaacatggacamgagggccacgattgaggaccacaa

SEQ ID NO: 22755 - DNA, 50 bp, homo sapien
gtgatattggaaatagggttccgtasagatgatttgaagcacatgtaata

SEQ ID NO: 22756 - DNA, 50 bp, homo sapien
ttcgatgatgagctagggatgagcartcactaaaagccttcccacattca

SEQ ID NO: 22757 - DNA, 50 bp, homo sapien
tatagatcctgaatcctgtaagtgarcgattctcaaagtctgaaactccc

SEQ ID NO: 22758 - DNA, 50 bp, homo sapien
tgaaaggggtgctcgatgatctccargacaatgaggttcttactgagaat

SEQ ID NO: 22759 - DNA, 50 bp, homo sapien
gaggggataatctgtctataagaagyattgtattcaaatgaaaacttctc

SEQ ID NO: 22760 - DNA, 50 bp, homo sapien
ctttgccttcctgaccgttagatacrattaatttggggtttgttttttct

SEQ ID NO: 22761 - DNA, 50 bp, homo sapien
ttgagggaagagaccatgactacaayaactataagagaagttttcatttg

SEQ ID NO: 22762 - DNA, 50 bp, homo sapien
ataaaagataaatttaccttctttaygtctttcagacttgaaggctgtgt

SEQ ID NO: 22763 - DNA, 50 bp, homo sapien
tcttacaaggcatcagaaaaaacaaygtctgctcctcattatagaataat

SEQ ID NO: 22764 - DNA, 50 bp, homo sapien
aacctggtaagcttcattcactctcragcctaaaatccaaaaggtccatc

SEQ ID NO: 22765 - DNA, 50 bp, homo sapien
caaactaaaatatacaaagttttgaygatgttatggcttctccttaaagt

SEQ ID NO: 22766 - DNA, 50 bp, homo sapien
cataccttcaggtggcttcccttcaygtttaagataaagtcccgcctcct

SEQ ID NO: 22767 - DNA, 50 bp, homo sapien
tttcgccaagataggaatagacacayagaaagaaagcaatagagaaagac

SEQ ID NO: 22768 - DNA, 50 bp, homo sapien
gtcccttcatccaaattctcagtatkaaagtgcatgctacagcctgattc

SEQ ID NO: 22769 - DNA, 50 bp, homo sapien
ctctgagaaaactagaatctcttccrgctataaagaatgtacttaaatat

SEQ ID NO: 22770 - DNA, 50 bp, homo sapien
ttacttgctgaagataaacttatagyaggacctgtctgatgaaaacccag

SEQ ID NO: 22771 - DNA, 50 bp, homo sapien
cctgtctgatgaaaacccaggattayggtaatgaaggatcatcgtggcag

SEQ ID NO: 22772 - DNA, 50 bp, homo sapien
ttctttctgcagccatttcatctgcrccaacactttggaacctaatactg

SEQ ID NO: 22773 - DNA, 50 bp, homo sapien
ttacaagggctgaattttgagcaaasgtctttccatactcgtgaaatgtg

SEQ ID NO: 22774 - DNA, 50 bp, homo sapien
gaacagatgaagtagccaaaggaaayaggttcgctgatcaggcagctaag

SEQ ID NO: 22775 - DNA, 50 bp, homo sapien
tcccctgcttttgcaaatattgatgrcacacctatgacatataagacaca

SEQ ID NO: 22776 - DNA, 50 bp, homo sapien
agaaatacaaacggagagaaatttayggactctgcccagtgataacaatt

SEQ ID NO: 22777 - DNA, 50 bp, homo sapien
cagcattttggtcatcattgctctayggtcattcagcaccaaggccaggt

SEQ ID NO: 22778 - DNA, 50 bp, homo sapien
agtcacttgtggattagagaaagaastggctctgcttttgcaaagacaaa

SEQ ID NO: 22779 - DNA, 50 bp, homo sapien
tgttactgatgtacttttactgacaytaaggaaaatcaaagtgtggcatt

SEQ ID NO: 22780 - DNA, 50 bp, homo sapien
gttttagagttgttatattctaggaygattttctgcttatttgtccatct

SEQ ID NO: 22781 - DNA, 50 bp, homo sapien
ggtgctgacttctttagtaatctggratactgtctcctgtttttgagtaa

SEQ ID NO: 22782 - DNA, 50 bp, homo sapien
ggatccatggcctgtgacaaaaattraatgccgtcttcagcttccagatt

SEQ ID NO: 22783 - DNA, 50 bp, homo sapien
gggttcacacgccactgagatagacsgaccctgacaggccgtggggcctg

SEQ ID NO: 22784 - DNA, 50 bp, homo sapien
atgccacctgaagtcccgataacagsctgatttctcactaaacactccat

SEQ ID NO: 22785 - DNA, 50 bp, homo sapien
gaatggggaggaagtcaaagttccamattccaaggcagaagtcctgaaac

SEQ ID NO: 22786 - DNA, 50 bp, homo sapien
tttgaaatcctcatctacatgaaaamtatgacaattgtcacatatcctgc

SEQ ID NO: 22787 - DNA, 50 bp, homo sapien
ctttctgggagctgtatgaaaaccarctttacaccacaaagccaagacta

SEQ ID NO: 22788 - DNA, 50 bp, homo sapien
gaaattgcaagaaaaagctctttaayctggatgctcaccagtcagtgata

SEQ ID NO: 22789 - DNA, 50 bp, homo sapien
aaggaacaaaatttgaatagatgccrccacatggatgcactttgaaaata

SEQ ID NO: 22790 - DNA, 50 bp, homo sapien
gtccgtgagcaaatgagtaaataaasaaaatatggtagacacatacaatg

SEQ ID NO: 22791 - DNA, 50 bp, homo sapien
accacaatagcctactccaaccaaaytgactcacctgtctgactacgaat

SEQ ID NO: 22792 - DNA, 50 bp, homo sapien
tcaggattatattctattgttttgaygcaagatattcaaacagaaacgtg

SEQ ID NO: 22793 - DNA, 50 bp, homo sapien
tattggagattcacaggaagacagargattcgaaatcaccattgtagaaa

SEQ ID NO: 22794 - DNA, 50 bp, homo sapien
ctactaccaccctcatcagtaacaasaagaagatagttcagactttggag

SEQ ID NO: 22795 - DNA, 50 bp, homo sapien
ggggtctaacacagacatttctacaraggaccagatcatttcttgaagta

SEQ ID NO: 22796 - DNA, 50 bp, homo sapien
cctaataatctcctactatacaaaakaattttctaattagaggaaaaggg

SEQ ID NO: 22797 - DNA, 50 bp, homo sapien
gtgagggtgttattcttcttgcatawaatgtagtgactccacattgcacc

SEQ ID NO: 22798 - DNA, 50 bp, homo sapien
catagaaccctcctctgatcttatarggaattctagaaggggcacgaagc

SEQ ID NO: 22799 - DNA, 50 bp, homo sapien
ttctctcggggaaagggccttggtgsaattaacagcttttaagccagaga

SEQ ID NO: 22800 - DNA, 50 bp, homo sapien
aagctttcaaagcaaagcatactacsagggtaaagaaggtcatttaaaac

SEQ ID NO: 22801 - DNA, 50 bp, homo sapien
acaggcccttatagtgccatttccargttcgctttgggcagagatgcagg

SEQ ID NO: 22802 - DNA, 50 bp, homo sapien
ctagcgtatttgccaaccatccactsagtatttaacatgtgccagaccct

SEQ ID NO: 22803 - DNA, 50 bp, homo sapien
tcacagtgtaaatttcagattatccraatagcgatttagtctataaatat

SEQ ID NO: 22804 - DNA, 50 bp, homo sapien
tggtccttggcttctccttgtgtcartagggggtttaggctttagctgtg

SEQ ID NO: 22805 - DNA, 50 bp, homo sapien
tgggtgagtggtttagttacattgamgtcattttttcaggtagtcaccga

SEQ ID NO: 22806 - DNA, 50 bp, homo sapien
tcaaagagcatagaaaatgatgtaaratcctacaacggcatccccaaatc

SEQ ID NO: 22807 - DNA, 50 bp, homo sapien
aacctattttaccttaaaaatgaaaratgacatgtaacagctatagacag

SEQ ID NO: 22808 - DNA, 50 bp, homo sapien
caaggccaatagcttttattacatargatgatttatcgatcccagctatt

SEQ ID NO: 22809 - DNA, 50 bp, homo sapien
aaatactcagatgtctgcatgaaggkactctctcctcaagttcaaacatt

SEQ ID NO: 22810 - DNA, 50 bp, homo sapien
tgtttgaaaaattaaataaatatccrctatgtgcacaaaaaagcacccac

SEQ ID NO: 22811 - DNA, 50 bp, homo sapien
agctctacctcccacaatggagatcsaatttcaacacaagatttggaggg

SEQ ID NO: 22812 - DNA, 50 bp, homo sapien
tcaagtctattttatagttctaatcsaaagattgcttaactccagcaaat

SEQ ID NO: 22813 - DNA, 50 bp, homo sapien
agaggcaataggactgtattctaccrcttttggaaagactagaaccaata

SEQ ID NO: 22814 - DNA, 50 bp, homo sapien
gcagccagaagagagttaggctaaaygaacatgcgctatgcccagggctg

SEQ ID NO: 22815 - DNA, 50 bp, homo sapien
ttcccactctgggacaactctgacgscattggcctggtaccgagaggaat

SEQ ID NO: 22816 - DNA, 50 bp, homo sapien
ctccgtctgtctccctgtcttgaaaygagaaaacatctaagccaccagct

SEQ ID NO: 22817 - DNA, 50 bp, homo sapien
caaggcactagaaaaatagattatargtatgatatatcatccaattacca

SEQ ID NO: 22818 - DNA, 50 bp, homo sapien
acatttattttaaaagttgataaatratgctagaaaatattccaaattta

SEQ ID NO: 22819 - DNA, 50 bp, homo sapien
actagatattcattaatttgcctctyagacattaattgctttatatgtaa

SEQ ID NO: 22820 - DNA, 50 bp, homo sapien
aagttactttgagaatttaatgccawgagaaaatatcttttcccttgaag

SEQ ID NO: 22821 - DNA, 50 bp, homo sapien
agagttaactcactgtgtaataggayacattttaataaacaaatgatcag

SEQ ID NO: 22822 - DNA, 50 bp, homo sapien
agctaaaaatgttctctctcactaayaagggtgaatcacagcagccacct

SEQ ID NO: 22823 - DNA, 50 bp, homo sapien
ccctgggcttcctgctttcctaatgycatcatgctagtctagctgtttat

SEQ ID NO: 22824 - DNA, 50 bp, homo sapien
gtaaaagtgacacttaaaaggcaaascatatgagattatttcccatttta

SEQ ID NO: 22825 - DNA, 50 bp, homo sapien
acatcctaaagttgtaacaataaaaytcctgtgggatcatgcaagggaac

SEQ ID NO: 22826 - DNA, 50 bp, homo sapien
gacattacttcatgaataaaccaaaygtctcaacatgccctcaatgttta

SEQ ID NO: 22827 - DNA, 50 bp, homo sapien
ttacaacagagaaccactatgtgaaycacgaaagaagggttgtgcattga

SEQ ID NO: 22828 - DNA, 50 bp, homo sapien
tcgtgaaggatcgcctcgggggacgragcggaggatacagttctggaaaa

SEQ ID NO: 22829 - DNA, 50 bp, homo sapien
gcaatgtgaattttgaggtaggcaaygacaaaaatgaggcttgaaaggca

SEQ ID NO: 22830 - DNA, 50 bp, homo sapien
ttataaacataattgttattatgaartcattattatctgaaatttgtatt

SEQ ID NO: 22831 - DNA, 50 bp, homo sapien
ttattatgtattctgtatgtaagacrcttcataatgttcttttcattaga

SEQ ID NO: 22832 - DNA, 50 bp, homo sapien
attaaagttgactataatctggaaaraagagttgattccccttggactta

SEQ ID NO: 22833 - DNA, 50 bp, homo sapien
gccaatgtattttgtgatgtcctgawtaaagaacaaaatgagccaggtgt

SEQ ID NO: 22834 - DNA, 50 bp, homo sapien
ggcttcctctccagagccaatgtaakggagttgttttaaggattgaggat

SEQ ID NO: 22835 - DNA, 50 bp, homo sapien
gctacctacaaagatgtcacaaaacygttccagaacttgggtctcctcac

SEQ ID NO: 22836 - DNA, 50 bp, homo sapien
tggttgtaaaaaatcatgccaaatamgtttgaattactgtaaacatcatt

SEQ ID NO: 22837 - DNA, 50 bp, homo sapien
ggtggtgtcattgatacagatgacaragtgttcgctgagcacctaggcac

SEQ ID NO: 22838 - DNA, 50 bp, homo sapien
agaaaaagcacccatttgattaagaractatttttacactaccccgtggg

SEQ ID NO: 22839 - DNA, 50 bp, homo sapien
gttcgctgagcacctaggcactgaayagagatttatttccttcttcttaa

SEQ ID NO: 22840 - DNA, 50 bp, homo sapien
ttcttaaccctctcccactttattcrgaagttcatatgagccataacaag

SEQ ID NO: 22841 - DNA, 50 bp, homo sapien
taataggtggtctacatgtatcagcrctaatgcttacaacaaccctgcta

SEQ ID NO: 22842 - DNA, 50 bp, homo sapien
taagtttcgtgaattgttatcacgarcttctaaaattctgtttaaccgat

SEQ ID NO: 22843 - DNA, 50 bp, homo sapien
atagaagaaattcactgtggctaaaragcaagggtagaagctaagttaat

SEQ ID NO: 22844 - DNA, 50 bp, homo sapien
tgaaaatgtgaagtgtttagagtcayctgtactcctgttctcagtgattg

SEQ ID NO: 22845 - DNA, 50 bp, homo sapien
attgcattttataatattttcataaytgcaagatgtaaagagcaaagcaa

SEQ ID NO: 22846 - DNA, 50 bp, homo sapien
caggcagagttacttatgcgattcaygtaattttcacactataaattagg

SEQ ID NO: 22847 - DNA, 50 bp, homo sapien
accacatggatgctggcaaggcttayggcttgtgtcctaagtgttcaaga

SEQ ID NO: 22848 - DNA, 50 bp, homo sapien
aaaatggcaaatgatatttaaatcaygcagttttataagaagtatgttta

SEQ ID NO: 22849 - DNA, 50 bp, homo sapien
agacagaatgcagggagcaattacarcagaagacttcagaacatctctct

SEQ ID NO: 22850 - DNA, 50 bp, homo sapien
agtaaaatggtacacagcttggtaawtctttacagggtgacccaccaata

SEQ ID NO: 22851 - DNA, 50 bp, homo sapien
atacaagctgacggacagatctgaartaattaggaaaggttagatcataa

SEQ ID NO: 22852 - DNA, 50 bp, homo sapien
tccttaattcatgagtgatttctacratcttcactttacataagatgaaa

SEQ ID NO: 22853 - DNA, 50 bp, homo sapien
aagtgtgcattgttgaataatggccragcatacttatcttcctgaatcag

SEQ ID NO: 22854 - DNA, 50 bp, homo sapien
tctctcaggtgtccatgcacagttcrctttcactctgtgagtctaactgc

SEQ ID NO: 22855 - DNA, 50 bp, homo sapien
acctgagagattcttcttgcaaatayagagttatttatcatctactagtc

SEQ ID NO: 22856 - DNA, 50 bp, homo sapien
accagattggttgatataaaccacgmagctatatgtgttttaaaaaacct

SEQ ID NO: 22857 - DNA, 50 bp, homo sapien
ggaatgtggatagccaattaggaagracttacaaagtggatatcatgctt

SEQ ID NO: 22858 - DNA, 50 bp, homo sapien
ctataccaactcacacagctgatgcrattattaaaggaaataatgtttga

SEQ ID NO: 22859 - DNA, 50 bp, homo sapien
gagccaccttcacacttggttctaaygcagatgatatgattatgcacaga

SEQ ID NO: 22860 - DNA, 50 bp, homo sapien
ttgtcaatatttttcatggaatgaaytaatgagtaaatgtaaatgaacaa

SEQ ID NO: 22861 - DNA, 50 bp, homo sapien
aggttgctgcaccttctcagagaaaygagctttggctttgggttttattg

SEQ ID NO: 22862 - DNA, 50 bp, homo sapien
tctggctatgtatggaatggttaaartggtttattctaagagtttacaga

SEQ ID NO: 22863 - DNA, 50 bp, homo sapien
gaatcaacctcttgtttacgtagccmaataagcatggcatgttgaggtaa

SEQ ID NO: 22864 - DNA, 50 bp, homo sapien
tctgcaaagactctgatttttaaggkaaaagtcccaggatgtctacatat

SEQ ID NO: 22865 - DNA, 50 bp, homo sapien
tcttatgtcagtttaagtaactttaygtatttgaaattaataacataaaa

SEQ ID NO: 22866 - DNA, 50 bp, homo sapien
ccttcatgcctaggttcattgattayctggaatttacaaaacactgtctt

SEQ ID NO: 22867 - DNA, 50 bp, homo sapien
ctgccatatgtccgtcagttgagagmcactgctgtagagaaaaaggactc

SEQ ID NO: 22868 - DNA, 50 bp, homo sapien
atgtagttttgaatttaactagagcraagaagaaagcaaattcaggtaag

SEQ ID NO: 22869 - DNA, 50 bp, homo sapien
aaacactgcctcctcaccaggcatckataaaaccccttgcatttcaccat

SEQ ID NO: 22870 - DNA, 50 bp, homo sapien
agagtttctggatttgtggaactacrccgtcatgctattacaatgttgac

SEQ ID NO: 22871 - DNA, 50 bp, homo sapien
ttaaggctcaaattctagctataaaygattgccaaactaaacacttaaga

SEQ ID NO: 22872 - DNA, 50 bp, homo sapien
tcgttgtttctcagcaggcttctcaygttgaaatcattataagaatatgc

SEQ ID NO: 22873 - DNA, 50 bp, homo sapien
gaaagcacaaaataggatggtagaamtaaaagcacagtagatgtaaataa

SEQ ID NO: 22874 - DNA, 50 bp, homo sapien
tggccatttggagtttgatggcccamctgtttcttctgaactgtagtcac

SEQ ID NO: 22875 - DNA, 50 bp, homo sapien
ccagctgaaaggaacagtgagaatcygagggcttatggtccgagccctca

SEQ ID NO: 22876 - DNA, 50 bp, homo sapien
gcttttggccattgtgggggtgaacyaaccagtggtctgtgactacagtt

SEQ ID NO: 22877 - DNA, 50 bp, homo sapien
aaatggtcaatcaattagcacaagasgataatgttagaagagataggggc

SEQ ID NO: 22878 - DNA, 50 bp, homo sapien
catttttttctgagaagccaagtaargtaagtggctatttgatatatcaa

SEQ ID NO: 22879 - DNA, 50 bp, homo sapien
tccaggaagatcctaacatcctgaaraaaatgttctaggagatatgtatt

SEQ ID NO: 22880 - DNA, 50 bp, homo sapien
tgtgtatttcttcaaacacaccaaaytcttcttatctaaggcctgaaatt

SEQ ID NO: 22881 - DNA, 50 bp, homo sapien
cttatctgcacttagctcactgatayggaaaaaagtcttataatggtctg

SEQ ID NO: 22882 - DNA, 50 bp, homo sapien
gcagctgacacctactccgacatcaratctaagaacagctcacctctttc

SEQ ID NO: 22883 - DNA, 50 bp, homo sapien
aatccatggcaggatttcggtataayagcatggtttagcaagtctttcta

SEQ ID NO: 22884 - DNA, 50 bp, homo sapien
ttagtcttcatctatcaccacttcarggggcatgaaccatgtcctgtagg

SEQ ID NO: 22885 - DNA, 50 bp, homo sapien
atgaggaaagttgggtatgtttaaawctcttttgaaagtgtggagctgca

SEQ ID NO: 22886 - DNA, 50 bp, homo sapien
gccactatctgcaggtcagaggtggwatttcttggattttaagttgaaac

SEQ ID NO: 22887 - DNA, 50 bp, homo sapien
tatttctacgcattaggaaggaacamtctgaagatgaaattaagaaagaa

SEQ ID NO: 22888 - DNA, 50 bp, homo sapien
ggttaataaatattataataacagckagtagtcattgaacttttatgtaa

SEQ ID NO: 22889 - DNA, 50 bp, homo sapien
cctccagagaaaaggtcctgcagacrgtattaagcctaatccagaatagt

SEQ ID NO: 22890 - DNA, 50 bp, homo sapien
cagtaagaagaaatggtggtttaaakagactgtgtgagtatgattatgac

SEQ ID NO: 22891 - DNA, 50 bp, homo sapien
tcaaagtcttagcccatatatttcasagtaagaagaaatggtggtttaaa

SEQ ID NO: 22892 - DNA, 50 bp, homo sapien
gtctgcatacacggtaaaactgcaastagcttagaggataattttattaa

SEQ ID NO: 22893 - DNA, 50 bp, homo sapien
gccttcatctcctaattgtctatccwatcaggaactaattcatcaaagct

SEQ ID NO: 22894 - DNA, 50 bp, homo sapien
aagaagagaatagattgttactccawctaagacaatgttttttaagccac

SEQ ID NO: 22895 - DNA, 50 bp, homo sapien
gaactatgagtcactctgtttattawgtcaacttagtgtgtcataaccag

SEQ ID NO: 22896 - DNA, 50 bp, homo sapien
tgaactaaatcaatgatactttcgayctctaaatttcactcggtgagaac

SEQ ID NO: 22897 - DNA, 50 bp, homo sapien
gcaacttaaaatattaaatgcatacrcttaaaaaaatgaaaggtctcatg

SEQ ID NO: 22898 - DNA, 50 bp, homo sapien
caataacagatcttctgtagctaaartaatgagagagatgaatgtatcta

SEQ ID NO: 22899 - DNA, 50 bp, homo sapien
tcccaccagcttgtaaaggcagagaygaggttccttgcagatctttctga

SEQ ID NO: 22900 - DNA, 50 bp, homo sapien
tcccagctgttagatttttaaaatastatgttcagtgatatgcacaacac

SEQ ID NO: 22901 - DNA, 50 bp, homo sapien
gtctctataatgaaacctgcttaaakagttacctatattctctccaacct

SEQ ID NO: 22902 - DNA, 50 bp, homo sapien
ctcctcggctggcaacctcaagacaytcagaagacgcttagaaggtgaaa

SEQ ID NO: 22903 - DNA, 50 bp, homo sapien
ccaggcagagaggaattgatgggcaytcaagtaggaaattttttttaaat

SEQ ID NO: 22904 - DNA, 50 bp, homo sapien
aatatttcaccaatgcatctcctacraatctaacatggtgaattttacac

SEQ ID NO: 22905 - DNA, 50 bp, homo sapien
tgttagggggttaagagagtaagaawaggtaagaggaagacccaaggagt

SEQ ID NO: 22906 - DNA, 50 bp, homo sapien
attgattgtctttagtgtttttgaawactgagtatgagttgttgtggaca

SEQ ID NO: 22907 - DNA, 50 bp, homo sapien
aaaatgttacttgtcataaaattgasgtacacttaccactcgaaactgtc

SEQ ID NO: 22908 - DNA, 50 bp, homo sapien
ggctgagcaataaactcaagtcatcmgaaagatcctgagaaaggtcccaa

SEQ ID NO: 22909 - DNA, 50 bp, homo sapien
cctcttatttttgtaggtgcagttawtaaatctccaagaaaggtggaaca

SEQ ID NO: 22910 - DNA, 50 bp, homo sapien
ttctctcttgcttcaatattctcaaygttaccgagtgggtaaaggatatt

SEQ ID NO: 22911 - DNA, 50 bp, homo sapien
ttgttaagcaaatgaataaatggacragtcaatgaatgaatcaaagaatg

SEQ ID NO: 22912 - DNA, 50 bp, homo sapien
gaggcaaagctgacatgaaaggagaracatattacaatggaaatgggcaa

SEQ ID NO: 22913 - DNA, 50 bp, homo sapien
agttcatgcagaaaataatctttgcygataaaataaacatgaagcaaatc

SEQ ID NO: 22914 - DNA, 50 bp, homo sapien
taatgtagtgcctgtaaatttgagarctgttataaaatatttgtctacat

SEQ ID NO: 22915 - DNA, 50 bp, homo sapien
tttccttgaagacttgaaggacttayatagagagtcatggtagcactcca

SEQ ID NO: 22916 - DNA, 50 bp, homo sapien
aaagccaaagcaaaattaaccatgamgccttgagtttggccaaattgaat

SEQ ID NO: 22917 - DNA, 50 bp, homo sapien
atgggtttcagcatagttacctctcraacactggcaaagagggtatggga

SEQ ID NO: 22918 - DNA, 50 bp, homo sapien
aggcagttatattctaacattctaayagagattaagcagtccctagtaag

SEQ ID NO: 22919 - DNA, 50 bp, homo sapien
tttgagatatagagaatgcacgaacratggaagaaaatcctgggaaaatt

SEQ ID NO: 22920 - DNA, 50 bp, homo sapien
gtttttagttgacctataatttctaygatgaatggtcgctttttggcgtt

SEQ ID NO: 22921 - DNA, 50 bp, homo sapien
aatatttattacacaaatgaaccaakgaatactggatatggacacttttc

SEQ ID NO: 22922 - DNA, 50 bp, homo sapien
aaaatgaacttcactggcttgtaaayaaatgattgtccatgagaaaagaa

SEQ ID NO: 22923 - DNA, 50 bp, homo sapien
agatggaattctttttagaagggaayacagttgacccaggaacagtgcgg

SEQ ID NO: 22924 - DNA, 50 bp, homo sapien
ttaactttctgggcctaagtgacagrctcagagacgaagatgaaggttgg

SEQ ID NO: 22925 - DNA, 50 bp, homo sapien
agcattttaagtggctacagatttayacgactggactgattaatgtttaa

SEQ ID NO: 22926 - DNA, 50 bp, homo sapien
cagatcaaaaaagcatccaagaaccrctagggcaaccaggttctggagag

SEQ ID NO: 22927 - DNA, 50 bp, homo sapien
actcctcccctagtagccagactacrctgtttagcagaacagtgatatgt

SEQ ID NO: 22928 - DNA, 50 bp, homo sapien
accttgtttctgagagcgaccatacragagaaaactctgcaagacagcat

SEQ ID NO: 22929 - DNA, 50 bp, homo sapien
aaatacatcaaattaatgatgcggaygacacaataaactcgttaagaatc

SEQ ID NO: 22930 - DNA, 50 bp, homo sapien
gggtgataaatcacttctgcctaaawgtcccgggttccatcttggtctca

SEQ ID NO: 22931 - DNA, 50 bp, homo sapien
atgtttgaagtagaattttgtcctaygctctcaatctcatttgatgcctc

SEQ ID NO: 22932 - DNA, 50 bp, homo sapien
aatcattaaatttataatctctcctkaataatttttagtgatcctccttt

SEQ ID NO: 22933 - DNA, 50 bp, homo sapien
aaaaacctcctaaggccactccacamgattgaagttgaaactctctcact

SEQ ID NO: 22934 - DNA, 50 bp, homo sapien
gtttcttactctctgtgaaaactacsgcaatatggttcaagctatcacac

SEQ ID NO: 22935 - DNA, 50 bp, homo sapien
caggcggctcacagctttcaacagargattacttagaataacaagttaat

SEQ ID NO: 22936 - DNA, 50 bp, homo sapien
ggcatctcccagatttggaaagaaaygtctcctgtgccttccctgggtgg

SEQ ID NO: 22937 - DNA, 50 bp, homo sapien
atgtcaacagaattaagagaaaatgyatatgggcatctcaatagatgcaa

SEQ ID NO: 22938 - DNA, 50 bp, homo sapien
gagagatacagagatacggctttgaracagtttgagtcatctaattactg

SEQ ID NO: 22939 - DNA, 50 bp, homo sapien
agactaatgatacagttctaagacasggtgtttggctttaaaaacaacaa

SEQ ID NO: 22940 - DNA, 50 bp, homo sapien
taattcagcatacattgctaaagaamtatgcagcctggcacagtggttca

SEQ ID NO: 22941 - DNA, 50 bp, homo sapien
tcatttgtacttttaaaaatggttaygaatagtaataatgaaaaatagaa

SEQ ID NO: 22942 - DNA, 50 bp, homo sapien
gataatgctgattatgtgatgttaartaaagcaacaaccacaacaaagat

SEQ ID NO: 22943 - DNA, 50 bp, homo sapien
cagtatattaaatagaatcttcaaarttaacctaggatgcatgtttttct

SEQ ID NO: 22944 - DNA, 50 bp, homo sapien
aatagcgtagtggagatacaactatsaagaataatttcaatttactccaa

SEQ ID NO: 22945 - DNA, 50 bp, homo sapien
aaattatacaatggtgatagccacasaagaaaaaagaagtagaaagattc

SEQ ID NO: 22946 - DNA, 50 bp, homo sapien
atgtttatctcacctgtttctttgcrcttttgatactgctgtttttcccg

SEQ ID NO: 22947 - DNA, 50 bp, homo sapien
tctgagataagagccctttctatgcygagctttgttgtgagtgaaatttc

SEQ ID NO: 22948 - DNA, 50 bp, homo sapien
ttggagccacaaaagagacatcaaaktatctcagctatatttaactaact

SEQ ID NO: 22949 - DNA, 50 bp, homo sapien
cagaccactagactgtggattaggaycggaaacatcagaatgtatctccc

SEQ ID NO: 22950 - DNA, 50 bp, homo sapien
gcatttcctggttaattctaatagcraagaaagtgtgcagctctggagcc

SEQ ID NO: 22951 - DNA, 50 bp, homo sapien
aattatgcccaatacttttactagcmctatggatctggcccaacccagca

SEQ ID NO: 22952 - DNA, 50 bp, homo sapien
tgcgatgttcagccactccggcccasgaaatgtaagcacgggacgaacgg

SEQ ID NO: 22953 - DNA, 50 bp, homo sapien
ccaaattagtcataatttcagcttcraacaaattatgcccaatactttta

SEQ ID NO: 22954 - DNA, 50 bp, homo sapien
ctctggaaaggctttagctctcctayaaggcctggcagtaggacatacaa

SEQ ID NO: 22955 - DNA, 50 bp, homo sapien
gattacattaaactttacatgcaatraccttaaattgaaaaaaaaaatct

SEQ ID NO: 22956 - DNA, 50 bp, homo sapien
atttgcttaaggtcagtagttcaaayttcataatggttataagtgtgtaa

SEQ ID NO: 22957 - DNA, 50 bp, homo sapien
gaggggtccagggtaagcatgaatckacgcggatcaagccctcagcagga

SEQ ID NO: 22958 - DNA, 50 bp, homo sapien
aggggctgatatcaggagacaattgsatgctgaaagattctggagttttg

SEQ ID NO: 22959 - DNA, 50 bp, homo sapien
aaattaaaaatggtaagttatatgcrcctctgaatttagtgctgtcaact

SEQ ID NO: 22960 - DNA, 50 bp, homo sapien
taattttgcattaaagtgtctaaccyatagtggatgattaatgaatacta

SEQ ID NO: 22961 - DNA, 50 bp, homo sapien
tcatccttggagcttcatgtgtagaygaggataaaacaatgaccctgtgc

SEQ ID NO: 22962 - DNA, 50 bp, homo sapien
ctacctatcccaaactctaccaaacygctttgaattttaagattggaatc

SEQ ID NO: 22963 - DNA, 50 bp, homo sapien
atgctcttgaaatttctcagataacmaaggttttaaatcttagaaacaca

SEQ ID NO: 22964 - DNA, 50 bp, homo sapien
tggacttggtctgggtcactttcaayttagaggcacgtgaagggatggag

SEQ ID NO: 22965 - DNA, 50 bp, homo sapien
ggcttaaacaagataacttaatcacrgtattcaggtctgtggttgggcta

SEQ ID NO: 22966 - DNA, 50 bp, homo sapien
tacgggcattctcagaataagtggcwagtagttaattgcaccccaaatta

SEQ ID NO: 22967 - DNA, 50 bp, homo sapien
tcgttgcaatagagcaaatatcaaayatcggcatttcagatgttccccat

SEQ ID NO: 22968 - DNA, 50 bp, homo sapien
gaaaaaaaatcaaaggtgagttctaygaaatgtgataattgaaaccttaa

SEQ ID NO: 22969 - DNA, 50 bp, homo sapien
tctgtgtattcttctatactttttcmcttgcctaatattcttacaactcc

SEQ ID NO: 22970 - DNA, 50 bp, homo sapien
tattctattttgctaggatggggagmattaccagtttagatcaaattatt

SEQ ID NO: 22971 - DNA, 50 bp, homo sapien
cagctaattaaaggcattctctacaratttccaatcaaggaagttttctt

SEQ ID NO: 22972 - DNA, 50 bp, homo sapien
aacgtagaaaaatgttacggtttacrcaaagcacctggtaaattatagtc

SEQ ID NO: 22973 - DNA, 50 bp, homo sapien
ataaaactaattttacaagtgggtasgataatgtaattaagataccttgc

SEQ ID NO: 22974 - DNA, 50 bp, homo sapien
tctaagctttaatatcattccaacaycatctaaagtgacatttcctaatc

SEQ ID NO: 22975 - DNA, 50 bp, homo sapien
gtaatgaaagcggctgtattacacayggaaatctgggtccaaacagctca

SEQ ID NO: 22976 - DNA, 50 bp, homo sapien
gtccagactcacaaaatagaaacatsaagattcaaacttaaaccactcct

SEQ ID NO: 22977 - DNA, 50 bp, homo sapien
aagaggaatagggaagggggaagaayggtgtccaaactatccgtgacctt

SEQ ID NO: 22978 - DNA, 50 bp, homo sapien
attaaatgattcacctgaattcacamaactaaggaagtagtggaaccaag

SEQ ID NO: 22979 - DNA, 50 bp, homo sapien
caggaggagaattgttgatttccaartgggttattgtctttctgactcac

SEQ ID NO: 22980 - DNA, 50 bp, homo sapien
tcaggaatgtctactatagccaaaaraagtttactctgtcaaataagtac

SEQ ID NO: 22981 - DNA, 50 bp, homo sapien
taataaagattaattgagaagcatamtataacacactatacagagtaaag

SEQ ID NO: 22982 - DNA, 50 bp, homo sapien
ggtcaaaagttaaaggattagtgccyattagtgcctttctccttttctcc

SEQ ID NO: 22983 - DNA, 50 bp, homo sapien
catcccagagtatggaaaactcacargatttgaccccaaccgaaggagca

SEQ ID NO: 22984 - DNA, 50 bp, homo sapien
cgcacagctgtgctcccgctcgttgwaaaaaagatgccaaaagtgtagaa

SEQ ID NO: 22985 - DNA, 50 bp, homo sapien
attttctgacatttgatcctatagcyaaaatggcaaaaactgttaagtac

SEQ ID NO: 22986 - DNA, 50 bp, homo sapien
ataaacaaaaagacagaaggacttakcataattagggatacccaaagttg

SEQ ID NO: 22987 - DNA, 50 bp, homo sapien
aacagggcaattcaaatatcgtaaakaacttatgtacaggattataatgg

SEQ ID NO: 22988 - DNA, 50 bp, homo sapien
ttacttcattctgaatctctactcarcatatctcttcataaaggtcttcc

SEQ ID NO: 22989 - DNA, 50 bp, homo sapien
gccccaagatgatggtaagtagaagyaggtgctatttgcaaaacagccag

SEQ ID NO: 22990 - DNA, 50 bp, homo sapien
tttgctagggctgccaatagcaaagkactacacactggtaacaacagata

SEQ ID NO: 22991 - DNA, 50 bp, homo sapien
gagagtcactgaatgaaagaaacctkaattaccatcaagctcattgtatt

SEQ ID NO: 22992 - DNA, 50 bp, homo sapien
ttcttcagaatttttctacatagacrattatgttacctgtaaatgacaga

SEQ ID NO: 22993 - DNA, 50 bp, homo sapien
acaatgaagtggcggatgactcccakcttgaaaaggcaaatctcatagag

SEQ ID NO: 22994 - DNA, 50 bp, homo sapien
tcatgctctgtatatttttgttcagwcgtttgagcatgagttcctccgtc

SEQ ID NO: 22995 - DNA, 50 bp, homo sapien
ctgaaaatgcacacaggactgaagcraagagaaggaaatgaaaagcaatc

SEQ ID NO: 22996 - DNA, 50 bp, homo sapien
gggtatgaatgaaggacacaagagtraaaactcggatcatccaacctttg

SEQ ID NO: 22997 - DNA, 50 bp, homo sapien
gttaagaaaattgaagttatcaaatkagattaataaacagacataaactt

SEQ ID NO: 22998 - DNA, 50 bp, homo sapien
actctcaagactaatggaaattttasagataatgttgcaaacgaaaaaaa

SEQ ID NO: 22999 - DNA, 50 bp, homo sapien
tgattagagtctgccttatatagcarcctgccttacagtagaataaatga

SEQ ID NO: 23000 - DNA, 50 bp, homo sapien
gttcactcctctctgaagtggttaasaaaggactcataagatccctgggt

SEQ ID NO: 23001 - DNA, 50 bp, homo sapien
catcaagctatgtgaagagtgaacartatcaatcattgcaacttctaata

SEQ ID NO: 23002 - DNA, 50 bp, homo sapien
ccttagatgaggctgaacattgattyaaagttaccctgaggtgtaggggt

SEQ ID NO: 23003 - DNA, 50 bp, homo sapien
  misc_feature (46)..(46): n is a, c, g, or t
aattaaaactctaggtgtatacttayatggaactagtttatttccnattt

SEQ ID NO: 23004 - DNA, 50 bp, homo sapien
cagttaccaaatctgtgtacatttasgtctaggaatgtgtgtgggaagta

SEQ ID NO: 23005 - DNA, 50 bp, homo sapien
gagcgtgtctgtaaaatttaaaccaytgggcatttgttcaagactcctgg

SEQ ID NO: 23006 - DNA, 50 bp, homo sapien
gaaacctgttaacttacattttatgrattggcacattgtattacttactg

SEQ ID NO: 23007 - DNA, 50 bp, homo sapien
ggcctagaagtctttaatcatcagayaatgtcacagttagaacccctcaa

SEQ ID NO: 23008 - DNA, 50 bp, homo sapien
tttctttgaccctattaaccaataawtgtaatgaatctttcttatggaca

SEQ ID NO: 23009 - DNA, 50 bp, homo sapien
tcggaattactgaatcaaatctgaaygctcacctctcttaagactgattt

SEQ ID NO: 23010 - DNA, 50 bp, homo sapien
tgaattccttatagctaggttacagraaaattgatattctagttttgaga

SEQ ID NO: 23011 - DNA, 50 bp, homo sapien
ataatgcttgccatttggtaagtacmcggtaaatatttggtattatatta

SEQ ID NO: 23012 - DNA, 50 bp, homo sapien
cctcaagaggaacaattcgtgttcaytcaatgatgtctgtttagactttt

SEQ ID NO: 23013 - DNA, 50 bp, homo sapien
tttcatattgctgactttcttgacaytagggtgaaagattatgaatagtt

SEQ ID NO: 23014 - DNA, 50 bp, homo sapien
tcagaagaggataagccatcggtaawtatctgccagacatttcccccttc

SEQ ID NO: 23015 - DNA, 50 bp, homo sapien
ttcttccttttccttgtagcacttcrcattttggaaggactgagttgtcc

SEQ ID NO: 23016 - DNA, 50 bp, homo sapien
aagaactggagaggacaaactattcragagaaaagaattgtagaagcagc

SEQ ID NO: 23017 - DNA, 50 bp, homo sapien
tgatcaactgtgtttaagtttatcaygaagggaatgaaaattgagagacc

SEQ ID NO: 23018 - DNA, 50 bp, homo sapien
tattatgtgactattgtaaatgtaayggagctttatacaatgtctatatt

SEQ ID NO: 23019 - DNA, 50 bp, homo sapien
tagctctgaggaaccatattcattayctaacttagtgcaaacttaggcat

SEQ ID NO: 23020 - DNA, 50 bp, homo sapien
catgttttcagttttgtaggccataragtttctttaactactcaactctt

SEQ ID NO: 23021 - DNA, 50 bp, homo sapien
ttctttgagaaatagaaaataaaacragacactagtggtaaatttggtta

SEQ ID NO: 23022 - DNA, 50 bp, homo sapien
atactgaactaaaaatggtgattacwaagaaaaacctattcaaagttagg

SEQ ID NO: 23023 - DNA, 50 bp, homo sapien
attcagcagatccactctttatactyactctttctgttttgaacagcttt

SEQ ID NO: 23024 - DNA, 50 bp, homo sapien
tattctattctatattattctattcycttctatttattctgcaccatcaa

SEQ ID NO: 23025 - DNA, 50 bp, homo sapien
aggagacatgaactgcactatcaacyaacttcagcaaattgacatgtata

SEQ ID NO: 23026 - DNA, 50 bp, homo sapien
gtactttaatggcgtgatttagaaarccttgttgacaaagctacataagt

SEQ ID NO: 23027 - DNA, 50 bp, homo sapien
tgcatacactctttaacagcagttasaaaatgcagacatgttcatcagaa

SEQ ID NO: 23028 - DNA, 50 bp, homo sapien
atagataagtgaaaacaactgtgcamgtacctattcagtccctggcaata

SEQ ID NO: 23029 - DNA, 50 bp, homo sapien
ttgattcatcagcaccttgtcacacsggtccttaaaaagaaaccccagca

SEQ ID NO: 23030 - DNA, 50 bp, homo sapien
atcattagaatagcatttcatttgasaactcaggaccacccagaacttgg

SEQ ID NO: 23031 - DNA, 50 bp, homo sapien
caatttgtatcgctaatctccatgtsaacaagcagatccctggtccagct

SEQ ID NO: 23032 - DNA, 50 bp, homo sapien
tatctaatctgctccctttactcagrataaagacttgctggcagaggcta

SEQ ID NO: 23033 - DNA, 50 bp, homo sapien
tccgtaccatgtagacattctaacartagaccacgggcacgaaaaaatac

SEQ ID NO: 23034 - DNA, 50 bp, homo sapien
tccctgatagcatattattaaattaygttttaaagcactaaaaagcttac

SEQ ID NO: 23035 - DNA, 50 bp, homo sapien
cctatattttatttttgcgcataaarattcgactattaaccagatagtta

SEQ ID NO: 23036 - DNA, 50 bp, homo sapien
ccaagaatgagaaataatgctcctaycctgtgaatatctttctcctacat

SEQ ID NO: 23037 - DNA, 50 bp, homo sapien
gtggttctcttcacaatagtattcayggagaagtgagctatgtggtttgg

SEQ ID NO: 23038 - DNA, 50 bp, homo sapien
cacacacaacttatgagcattattgraatcctctttagaaaacaaacaac

SEQ ID NO: 23039 - DNA, 50 bp, homo sapien
gtacacagagttacacatcctcgtasactatttactttgctaactgcata

SEQ ID NO: 23040 - DNA, 50 bp, homo sapien
cccacataaatagtggtttcaatagscattgtttgaaatggcagtggcca

SEQ ID NO: 23041 - DNA, 50 bp, homo sapien
actgcaatatttacaactgcaattayagaaagcaactgtgaggaggatac

SEQ ID NO: 23042 - DNA, 50 bp, homo sapien
gctaattaatgtctaagagtcataawgcctttgatctaaatgaaagttca

SEQ ID NO: 23043 - DNA, 50 bp, homo sapien
agaggaaaaattttcaatgtacttcrcagctatcaaaatggaacccgatg

SEQ ID NO: 23044 - DNA, 50 bp, homo sapien
tttcacccatcatgcaatattacccratctaggtaaagggctgtgctatc

SEQ ID NO: 23045 - DNA, 50 bp, homo sapien
gccagtccttctcttaagttatatcracacaagcacccttcagcagttaa

SEQ ID NO: 23046 - DNA, 50 bp, homo sapien
ttccatagcttcatcatgcactatgractacatgctacttcaacaccttc

SEQ ID NO: 23047 - DNA, 50 bp, homo sapien
catgctaatatttcctgtttggtaaycacttatagttctttctcactgca

SEQ ID NO: 23048 - DNA, 50 bp, homo sapien
ttttcctgaccgtgggttatctgacmataaatttgtttggctttcagtct

SEQ ID NO: 23049 - DNA, 50 bp, homo sapien
cagagctgagcggatgacgactgcasaagagaaatcatgaatcttaactg

SEQ ID NO: 23050 - DNA, 50 bp, homo sapien
ataacccacggtcaggaaaatgttamactcttcttggctggtgctggctg

SEQ ID NO: 23051 - DNA, 50 bp, homo sapien
gaaacttttgatataaaaataatacyacagggcagttagagtaagcatac

SEQ ID NO: 23052 - DNA, 50 bp, homo sapien
ttattgattcttctgtatctatatcrattaactcttctctctctcctcta

SEQ ID NO: 23053 - DNA, 50 bp, homo sapien
acacgtgtaatttatttaattctggsatactatgcagttctgttgaagcc

SEQ ID NO: 23054 - DNA, 50 bp, homo sapien
gggaatggatgccaattcctactagscatataggttgtgataaggacaaa

SEQ ID NO: 23055 - DNA, 50 bp, homo sapien
gtttggactgcatacttgcggattcrcctcaaatgttgatgttgagccta

SEQ ID NO: 23056 - DNA, 50 bp, homo sapien
gcattcctagtggaagtaaatgaccyaattggaggaaaataaggagcagg

SEQ ID NO: 23057 - DNA, 50 bp, homo sapien
ggtttatcaagataaaattattatamcctaaaatgcacaaatcttaatgg

SEQ ID NO: 23058 - DNA, 50 bp, homo sapien
aaaattgatttgatgactccttgtakatataaatccatggctacatctgg

SEQ ID NO: 23059 - DNA, 50 bp, homo sapien
ccatcaaagtactcacagtctagcaratgtagataaacatacacatgcac

SEQ ID NO: 23060 - DNA, 50 bp, homo sapien
ttatttattttaataatttctgatarcatggcacaaagaattaaacttat

SEQ ID NO: 23061 - DNA, 50 bp, homo sapien
aagtaatacatattcagacctagaaratgtgaaaaatgtagaaaagtaca

SEQ ID NO: 23062 - DNA, 50 bp, homo sapien
atgattcagaatataataagcaccartctgaacggtagtatagattcaca

SEQ ID NO: 23063 - DNA, 50 bp, homo sapien
attcggagagagagcgtctaatatgratggtggtagggagtaggtgaaat

SEQ ID NO: 23064 - DNA, 50 bp, homo sapien
taaataaatgaaagtctatcagttayggtctgctgtactattgaaaataa

SEQ ID NO: 23065 - DNA, 50 bp, homo sapien
ttatggtctgctgtactattgaaaayaaagaagttactgtatctatactc

SEQ ID NO: 23066 - DNA, 50 bp, homo sapien
attgtacaactttcttccaggaacakcggaacagtaatttacagcatgga

SEQ ID NO: 23067 - DNA, 50 bp, homo sapien
ggtcagatacaagcaaaaaaggtaaytgtctcacatccccattataaaag

SEQ ID NO: 23068 - DNA, 50 bp, homo sapien
tacagaattccttgctctatgtgaaytcggacagcagggggttagtatct

SEQ ID NO: 23069 - DNA, 50 bp, homo sapien
taattatgaagcttgcttatataaaytgtacatgcaaagattctccaagc

SEQ ID NO: 23070 - DNA, 50 bp, homo sapien
cacttgatgtgttagaagcagtctayaatgcttttcattttgaagatggt

SEQ ID NO: 23071 - DNA, 50 bp, homo sapien
cggaggcccctcactcctatgaaaaygccaatgtatccaaggatgctgcc

SEQ ID NO: 23072 - DNA, 50 bp, homo sapien
aagatgtagttggtgcactgtactcrcccaaaaaaggtatgagtgtattt

SEQ ID NO: 23073 - DNA, 50 bp, homo sapien
aaaattgtttagatgctaggccctaraagaaatctcaactctaccaaaga

SEQ ID NO: 23074 - DNA, 50 bp, homo sapien
gtagattgataatgactgatgatcarcgctatgatggagggaacaccttg

SEQ ID NO: 23075 - DNA, 50 bp, homo sapien
cctagactccttctaacacgtcatcragttagaaggagtttgatgactcc

SEQ ID NO: 23076 - DNA, 50 bp, homo sapien
taaattgcccattactctctccagtracaaataattcataattgatatct

SEQ ID NO: 23077 - DNA, 50 bp, homo sapien
cttgtttttagtatgacaaaaggaargtgactttgattgggttatatagg

SEQ ID NO: 23078 - DNA, 50 bp, homo sapien
cacagaggaccttggatgcagaaagrataaaacaagcaagaattttaaag

SEQ ID NO: 23079 - DNA, 50 bp, homo sapien
ggtccattttagagagaacatttacycaagtactaaatcatcaaaaattt

SEQ ID NO: 23080 - DNA, 50 bp, homo sapien
tcggagcaagataaacctggattcayattcttactgtgactcttcctagc

SEQ ID NO: 23081 - DNA, 50 bp, homo sapien
tggtgaaagaaaactttaaagcaagkctgcacagttgcaacaaaacaacc

SEQ ID NO: 23082 - DNA, 50 bp, homo sapien
tatcaagaaatagtacttttttgacscaatttccagtgaaaataacatta

SEQ ID NO: 23083 - DNA, 50 bp, homo sapien
cctgtgatgtcccttcttgcccatcrgaaattgctatatagattaccttt

SEQ ID NO: 23084 - DNA, 50 bp, homo sapien
tagcaaaaatatatgctcaaggatakagtatagcaaaatcccaaatgaaa

SEQ ID NO: 23085 - DNA, 50 bp, homo sapien
attgcctttcattctctgggtctgartagcattaattgaggtgtgtggca

SEQ ID NO: 23086 - DNA, 50 bp, homo sapien
tctaaaaatatttcaatccagtttaygcacaaaggagacaagtgtttcgg

SEQ ID NO: 23087 - DNA, 50 bp, homo sapien
gagaaaatgagagacaagcaaaagargtttccccttataaacccaccaga

SEQ ID NO: 23088 - DNA, 50 bp, homo sapien
actcacatgggctacacaggttgtaygtggcatagccagaatgccaaact

SEQ ID NO: 23089 - DNA, 50 bp, homo sapien
tgactgttacagttcacaagaagtayggaggacacacatctgggtgggac

SEQ ID NO: 23090 - DNA, 50 bp, homo sapien
gctaatttaccgaactctatcaataygtttcaatcaggtaaagcaagagc

SEQ ID NO: 23091 - DNA, 50 bp, homo sapien
agtgagccacaaaaggttctgcccawgaaatgacatttaagaggaaaatt

SEQ ID NO: 23092 - DNA, 50 bp, homo sapien
tcctcagcctagttaaccttggccaygagaatgggatcttctatgtgact

SEQ ID NO: 23093 - DNA, 50 bp, homo sapien
gaacaaaaatgctatcaacattgtayagtctttgtgttagatacatgttt

SEQ ID NO: 23094 - DNA, 50 bp, homo sapien
cactatgttccatgatgactcatatyaaccctagaatcaggaaaaagcaa

SEQ ID NO: 23095 - DNA, 50 bp, homo sapien
acctcaattttctgaaaacgatgacragaataagaatagggcatattcta

SEQ ID NO: 23096 - DNA, 50 bp, homo sapien
aataacagaaattacagagaaaaaasagccaggcaagggatgaaaacagg

SEQ ID NO: 23097 - DNA, 50 bp, homo sapien
caagaggcagcacctaccgagactasgaatgatgagtgtacaaagccctt

SEQ ID NO: 23098 - DNA, 50 bp, homo sapien
tgaacctttctgagatgaaatattcraagcaagatcctaccgaggaagac

SEQ ID NO: 23099 - DNA, 50 bp, homo sapien
ctgaagcccatatttcagttataaamctcaaggagatggtactttcaaat

SEQ ID NO: 23100 - DNA, 50 bp, homo sapien
tgggctgtcattctagatttctttcraagatgacttccagttaaataagc

SEQ ID NO: 23101 - DNA, 50 bp, homo sapien
caaatacaaggtcccgaagattcaaygaagaaaaaggtactcaagaagga

SEQ ID NO: 23102 - DNA, 50 bp, homo sapien
ggtcagagcttagactttctcttcayggagcttagcatttgtctttggtg

SEQ ID NO: 23103 - DNA, 50 bp, homo sapien
ccgttcagtcatggatcaaacagccyatttcagcaattgatatggatata

SEQ ID NO: 23104 - DNA, 50 bp, homo sapien
tcatttgctgcttcatctgacctaastcggtgggtttcttgattttaatg

SEQ ID NO: 23105 - DNA, 50 bp, homo sapien
cagtgaaagattgtgtgctttaggartaaaaatagctctttcaggtctca

SEQ ID NO: 23106 - DNA, 50 bp, homo sapien
tctgtgagtactgcgatccctcatasgtttatatattttttgagtgtaag

SEQ ID NO: 23107 - DNA, 50 bp, homo sapien
caatttaaagagaaagattataagcraatggtaatttctctaattgagtt

SEQ ID NO: 23108 - DNA, 50 bp, homo sapien
cttaaaattataaagtgttgacaaaygtcataggcgaagactcgaagcac

SEQ ID NO: 23109 - DNA, 50 bp, homo sapien
agttatctttcttttgaaaatgttaycaaggcccatgactatgccagaaa

SEQ ID NO: 23110 - DNA, 50 bp, homo sapien
tctgggatttttttttaagtgcttcragtcttcgcctatgacatttgtca

SEQ ID NO: 23111 - DNA, 50 bp, homo sapien
gttctcattctgggttattctggcaktaatcctgactcaatcactttcca

SEQ ID NO: 23112 - DNA, 50 bp, homo sapien
atctggttacaaagcattaacaatgmaaagatccagatttcaattattta

SEQ ID NO: 23113 - DNA, 50 bp, homo sapien
tatgaattagtaagcaattgaattcsctttcacatgatatattaagcttt

SEQ ID NO: 23114 - DNA, 50 bp, homo sapien
tttcaatatttattttaaaaaacatsaagagtctgtcattgtcatgacct

SEQ ID NO: 23115 - DNA, 50 bp, homo sapien
tgtagttgacaatttttttccaagasaccttgctatttactatgaattag

SEQ ID NO: 23116 - DNA, 50 bp, homo sapien
tgcttactaatgattggcagagatayccttaaatgcctggaaagtctctc

SEQ ID NO: 23117 - DNA, 50 bp, homo sapien
ttagacaagcttgtggcaggtcctayctactacatgtctggtttaaggaa

SEQ ID NO: 23118 - DNA, 50 bp, homo sapien
taagttttaaaagtgaagctacttamcctttttgagtctcagtttccccg

SEQ ID NO: 23119 - DNA, 50 bp, homo sapien
ggcagaggagtcttggagagacctcratggcctaagggatgtcccaagag

SEQ ID NO: 23120 - DNA, 50 bp, homo sapien
tgcttctatacaacatattttagacratcttcaactaaaactaaaaccac

SEQ ID NO: 23121 - DNA, 50 bp, homo sapien
agcactagagctggcactggagaagscttcccaaggagcacactggcgct

SEQ ID NO: 23122 - DNA, 50 bp, homo sapien
acatgtttctaacccattagagaaargactcgtgccaggcttggggcggt

SEQ ID NO: 23123 - DNA, 50 bp, homo sapien
taactctgctactgattatctttgcratttttaggaagtgtaccattctt

SEQ ID NO: 23124 - DNA, 50 bp, homo sapien
taaaaaatgaatgatacttttacaamccttccaaaatataatgggttcat

SEQ ID NO: 23125 - DNA, 50 bp, homo sapien
gtgttgcccagctctgccaggaataygcttctggagagcctatcacaaat

SEQ ID NO: 23126 - DNA, 50 bp, homo sapien
tcattttgtgtctccattgtattcartctgacttttgcactctgaaactt

SEQ ID NO: 23127 - DNA, 50 bp, homo sapien
aaacattccacacactatgtctacamaatgggagaatctcttcctgaatt

SEQ ID NO: 23128 - DNA, 50 bp, homo sapien
tcatcattactatttgagttcaaacrccaacaagaaaacaaagaaaagta

SEQ ID NO: 23129 - DNA, 50 bp, homo sapien
aggtaataagaggtgataagatacaygaacattggatgtacttagggcaa

SEQ ID NO: 23130 - DNA, 50 bp, homo sapien
ccattgcagatatagactattcccarcgtcacttagtgttctattggaca

SEQ ID NO: 23131 - DNA, 50 bp, homo sapien
tgccaataataaactgccaaactagraacctcaacttatttgttgtatag

SEQ ID NO: 23132 - DNA, 50 bp, homo sapien
gccattattcttaatgagggccttcraacaccctagctctttgcacccta

SEQ ID NO: 23133 - DNA, 50 bp, homo sapien
tatgttgggacactgtcatcatccarccacgtgacttggccagcatgctg

SEQ ID NO: 23134 - DNA, 50 bp, homo sapien
cacagagtttgtttccttggaagagrctatgctaaggtaggtaaggtggt

SEQ ID NO: 23135 - DNA, 50 bp, homo sapien
tatgtatatcctagttacattcctamattctctgtctgcaaagtattatt

SEQ ID NO: 23136 - DNA, 50 bp, homo sapien
atgattacagtgtggccgataaggartactactttgatcggaatccctcc

SEQ ID NO: 23137 - DNA, 50 bp, homo sapien
aagtctaaaatctgtagtagtatggkcaggtagaacatgaacttaacttt

SEQ ID NO: 23138 - DNA, 50 bp, homo sapien
atagcttactattttctaggtactayacttatgcactttatatatattgt

SEQ ID NO: 23139 - DNA, 50 bp, homo sapien
tttcatcaagactgaatcttttgtcsatctaattggtaagaaaatatttt

SEQ ID NO: 23140 - DNA, 50 bp, homo sapien
cacacgaacacaaagtccaggcccargtaaacatctccatttttgactgc

SEQ ID NO: 23141 - DNA, 50 bp, homo sapien
tagaacagcttctctgatgtaggacyctggaatccagttctggagaaaca

SEQ ID NO: 23142 - DNA, 50 bp, homo sapien
gcagcaggaaaagagagaataagtaytacctgcttaagaatcacaatgtg

SEQ ID NO: 23143 - DNA, 50 bp, homo sapien
aatcaaaagcttggccagttctagcmaccacattgtgattcttaagcagg

SEQ ID NO: 23144 - DNA, 50 bp, homo sapien
attggaaatgtaaatgacaattgtasagatgagaagttttcaatatgagt

SEQ ID NO: 23145 - DNA, 50 bp, homo sapien
ttcattcatcaaacattcatcaaaasgctgctcttcatgtagagatgagc

SEQ ID NO: 23146 - DNA, 50 bp, homo sapien
aaggggaaaagctatgtagtgcttaygtggtgcagcctcatatgattgtg

SEQ ID NO: 23147 - DNA, 50 bp, homo sapien
ttgtgtcaggaaactgatagtgcaaktaccataaagaggttttcccaagt

SEQ ID NO: 23148 - DNA, 50 bp, homo sapien
ccttgtgttgttgggaattttaccaygtgaatcagttcagcattatatgg

SEQ ID NO: 23149 - DNA, 50 bp, homo sapien
tatggtgagaagtgttctggactcaygatatgttttgaagttagagccaa

SEQ ID NO: 23150 - DNA, 50 bp, homo sapien
tgctctttttattacattccattgcycgtaactattgcgtcactccacct

SEQ ID NO: 23151 - DNA, 50 bp, homo sapien
tgctaagattacagcagagaacaaaygttttttaaatgaagctttcattt

SEQ ID NO: 23152 - DNA, 50 bp, homo sapien
atacaaggaaaagactctagagtaarcatgatttatttgtagacatagag

SEQ ID NO: 23153 - DNA, 50 bp, homo sapien
tttcagtgaaaattgaaaaagctcaycacctctttcttagtgtactgagg

SEQ ID NO: 23154 - DNA, 50 bp, homo sapien
gaaacaaacaagtaatttcattatarcatgtgctcatattgaaatttcag

SEQ ID NO: 23155 - DNA, 50 bp, homo sapien
tgccatgtctagctaatgcattagaygaaacttttaagtcacagtgatga

SEQ ID NO: 23156 - DNA, 50 bp, homo sapien
aaagcttcaagttttatagagaaacmaagttgtaatatactctacagttg

SEQ ID NO: 23157 - DNA, 50 bp, homo sapien
aagtttaaatctgcagttactctcaytaagaagtatgttaacccagtaat

SEQ ID NO: 23158 - DNA, 50 bp, homo sapien
cgatatctcatcaatacaacttgaartgtttccaacgagaaatccagctt

SEQ ID NO: 23159 - DNA, 50 bp, homo sapien
acattctccatagttattcaaagcaragatagtttttttatatagaaata

SEQ ID NO: 23160 - DNA, 50 bp, homo sapien
gaggtgaagggagacaaatggagcamatcttacaaatatgtaattacaca

SEQ ID NO: 23161 - DNA, 50 bp, homo sapien
gagatatggcaagcacatcataggasaagaaggtagacaggagcttaggg

SEQ ID NO: 23162 - DNA, 50 bp, homo sapien
aaagcttttccatgaataatatatakaaatactcggtttcttttctcttt

SEQ ID NO: 23163 - DNA, 50 bp, homo sapien
cttatcttctaaatggacgtaatcaygatctagccacatgctataaccaa

SEQ ID NO: 23164 - DNA, 50 bp, homo sapien
aagaaatggccattagctgaaatgaragagtgtcagggctagaaacaagg

SEQ ID NO: 23165 - DNA, 50 bp, homo sapien
atagagcaccctgggaccctgcaaaytgtatggacctgtgtcattcatgt

SEQ ID NO: 23166 - DNA, 50 bp, homo sapien
ctatttaaataccaacaaaacttgasaggcagaattttatggctaagaat

SEQ ID NO: 23167 - DNA, 50 bp, homo sapien
cttcccctctgtgtgttacttctatyagctttgaatacctgatgtgtgtc

SEQ ID NO: 23168 - DNA, 50 bp, homo sapien
catacccaatatactccaggcatggraactacttcacattcccacaacac

SEQ ID NO: 23169 - DNA, 50 bp, homo sapien
ttacaagtggtaagctatgctaagaragattaaattgataatataggcaa

SEQ ID NO: 23170 - DNA, 50 bp, homo sapien
tgagaatctccatgtagactctgaayctcttgaaagtagaaactgtatct

SEQ ID NO: 23171 - DNA, 50 bp, homo sapien
gattagagtcacaaagaaacttcaawgtgaagacacaacgagaggccgtt

SEQ ID NO: 23172 - DNA, 50 bp, homo sapien
ctgagtgtttggaatggacgtttcartcacgattttagcttcctgtatgg

SEQ ID NO: 23173 - DNA, 50 bp, homo sapien
atgaactgaggtctctatccatatcygaattcacattgtattggagcagt

SEQ ID NO: 23174 - DNA, 50 bp, homo sapien
caaaagcctttaatgactctcattarctactgaattaatttctagttctt

SEQ ID NO: 23175 - DNA, 50 bp, homo sapien
ggggaaggaagtctccaagcagaaartggtactccacaaatggcattctg

SEQ ID NO: 23176 - DNA, 50 bp, homo sapien
aaatgaaatatctcttggctggaaamgatatccctgtggtctgatattat

SEQ ID NO: 23177 - DNA, 50 bp, homo sapien
tctgcctttgaagtttgaaaatatcrcttcatatgctttatggagcttaa

SEQ ID NO: 23178 - DNA, 50 bp, homo sapien
cactaagtgttagtaaacaaaatcayggacatactttgagttgcaatggt

SEQ ID NO: 23179 - DNA, 50 bp, homo sapien
tttttttaaaggttaaaatcagcacrcccttggttactgccggcaccgtt

SEQ ID NO: 23180 - DNA, 50 bp, homo sapien
agccccttatgctaagtgctgcccayaatctagtaaaagatacttgcttt

SEQ ID NO: 23181 - DNA, 50 bp, homo sapien
atttatcaaaggaggatgagaatgarcgttacagtgtagtgagaaagatg

SEQ ID NO: 23182 - DNA, 50 bp, homo sapien
gagcagcgccctccactgaacttgaygggctacgttagcacaacccatgg

SEQ ID NO: 23183 - DNA, 50 bp, homo sapien
gcttttttttgttttagctcttagayagatatgccaccaaacccagaatt

SEQ ID NO: 23184 - DNA, 50 bp, homo sapien
actctatctatgtcttaaattctccrcaagaagtggtaccatgttgtggt

SEQ ID NO: 23185 - DNA, 50 bp, homo sapien
gggaagctagttaactattcagttargttctggtagcaagcgtatgcagc

SEQ ID NO: 23186 - DNA, 50 bp, homo sapien
gcaaccttttccttttcccatctacygggcgaaccacagcagccttcccc

SEQ ID NO: 23187 - DNA, 50 bp, homo sapien
caaaggattgataatagttaaggcastcctaaaaaagaacaagttgggaa

SEQ ID NO: 23188 - DNA, 50 bp, homo sapien
ttctacacagaaaggtaccaattcarcctgtagggtctcaagtgcagatt

SEQ ID NO: 23189 - DNA, 50 bp, homo sapien
aacagccttctctcttatgcctaaakagccagtttaatcatcacaatgtc

SEQ ID NO: 23190 - DNA, 50 bp, homo sapien
gcagtgctctaagagtattggcagcyagaattataccctccgggcagaaa

SEQ ID NO: 23191 - DNA, 50 bp, homo sapien
acctgtcacagggcctgaggtgacawccttctttccaagatcataggctg

SEQ ID NO: 23192 - DNA, 50 bp, homo sapien
atttaggcaatggctgaacaaaccayattatgtgatagaaccattaaata

SEQ ID NO: 23193 - DNA, 50 bp, homo sapien
acctctggactcactgcaggaatgayggtaaatgcttctggcctgccttt

SEQ ID NO: 23194 - DNA, 50 bp, homo sapien
tggagacgtattaaggatgtggtaartggtattcatgtctgtttcatatg

SEQ ID NO: 23195 - DNA, 50 bp, homo sapien
caattttatttattgcccaacatcartataactacttctgaccatcccct

SEQ ID NO: 23196 - DNA, 50 bp, homo sapien
ataaaatttaagctcgttaccattayctacaagtgatagactttccacct

SEQ ID NO: 23197 - DNA, 50 bp, homo sapien
tataaagtgcaaagcagaatatgtcraaacctatatatttcttagaatat

SEQ ID NO: 23198 - DNA, 50 bp, homo sapien
ttcagagaacttgaagtatgaagtcwcaaggatctggcgaatactttgtg

SEQ ID NO: 23199 - DNA, 50 bp, homo sapien
atggggtatttcacacattcttgagyattttgaaaaagtcacatgacata

SEQ ID NO: 23200 - DNA, 50 bp, homo sapien
aaggcctttgagtagccatggtgaaygttacagactctgtgcataagagc

SEQ ID NO: 23201 - DNA, 50 bp, homo sapien
ttcccatccctccacctccacgtacyactatgttctcttgtctctaagct

SEQ ID NO: 23202 - DNA, 50 bp, homo sapien
tttctttttcagtgatctagtgtcckgatgagtaggaagtgacttttttt

SEQ ID NO: 23203 - DNA, 50 bp, homo sapien
tcttaggggcaagtaaaaagtagaargtcaagacagggattgctcttatt

SEQ ID NO: 23204 - DNA, 50 bp, homo sapien
taaagagaaaacatctcagtagcgayagactatggtaaataattgaatta

SEQ ID NO: 23205 - DNA, 50 bp, homo sapien
atctatcacgccactctgttgtgaaraataatgaatagcaccgttaacaa

SEQ ID NO: 23206 - DNA, 50 bp, homo sapien
tcgatgcctcgatgaagattgtttasgatgtttctatgcttgtcgtgcct

SEQ ID NO: 23207 - DNA, 50 bp, homo sapien
cctgatttttattgggatggacctcratgcctcgatgaagattgtttagg

SEQ ID NO: 23208 - DNA, 50 bp, homo sapien
aatcaggagaccctggctatcatagrccttagtcttcgctggtatcactc

SEQ ID NO: 23209 - DNA, 50 bp, homo sapien
atgatgcttaaggaaaagaatcacaygccatttactcttgtatcaagaaa

SEQ ID NO: 23210 - DNA, 50 bp, homo sapien
agcccagtagttagcttgagtaaaartcatctaccctaactagatcaact

SEQ ID NO: 23211 - DNA, 50 bp, homo sapien
aggcacggtgatttcaccaggcgaasttcaagtacaggacctatcatcgg

SEQ ID NO: 23212 - DNA, 50 bp, homo sapien
aggagaggctcaaaagggcttacaasgacatccaaggagaaactcgaggc

SEQ ID NO: 23213 - DNA, 50 bp, homo sapien
tagtctaccacaggtattagatctayatgtggttagcaggaaagtgtcca

SEQ ID NO: 23214 - DNA, 50 bp, homo sapien
ccaagctccttgtcagatatttccaygattcagtaatttttgatgaaata

SEQ ID NO: 23215 - DNA, 50 bp, homo sapien
tgccttgacattcataggtaaatgayccttgggcaagtcatttggctttt

SEQ ID NO: 23216 - DNA, 50 bp, homo sapien
ccattcagaagatgaagtccagccaraggaaagtagaagctcttccacca

SEQ ID NO: 23217 - DNA, 50 bp, homo sapien
tgaaaaagtctatatgtgttcaatascagatgcaattttttttaaatatt

SEQ ID NO: 23218 - DNA, 50 bp, homo sapien
ctcagataaccaaaaatgttacccgrattcttgctcaccatccattgtct

SEQ ID NO: 23219 - DNA, 50 bp, homo sapien
ttcataactgttgtagagcatgtaayggcaagtctagtattggaccactt

SEQ ID NO: 23220 - DNA, 50 bp, homo sapien
ttgtcattgtcctttgtaattccaayaagttctacagacactaattgcaa

SEQ ID NO: 23221 - DNA, 50 bp, homo sapien
aaatcgtaggtcaggtgcaatatccyatgttggttgagtgcctgtgtgct

SEQ ID NO: 23222 - DNA, 50 bp, homo sapien
ttgtctgggtttgcattctttagtgwaacaataaacttgaacttttcaaa

SEQ ID NO: 23223 - DNA, 50 bp, homo sapien
agacaatcgacttagctgattcagasagccatgaaataaacaaaaactat

SEQ ID NO: 23224 - DNA, 50 bp, homo sapien
atgaaaatgtgtgaattgatgaaaayagctctaatgattatgtaagaata

SEQ ID NO: 23225 - DNA, 50 bp, homo sapien
ctgaagacatcctgtgagaccaggcratcaactacacttgttcaccaagc

SEQ ID NO: 23226 - DNA, 50 bp, homo sapien
aaaatttgaagcttatcagcacaagycatgccttagggtctaaatctaaa

SEQ ID NO: 23227 - DNA, 50 bp, homo sapien
ggatttaagtatcttattattcagaycttgtgggtactccacaaattatt

SEQ ID NO: 23228 - DNA, 50 bp, homo sapien
aacccagccatttcatctacacggcratctacagattcacagatatgatg

SEQ ID NO: 23229 - DNA, 50 bp, homo sapien
aacagaatgctccatctccctggtcrcaactaaatagctccaatttccag

SEQ ID NO: 23230 - DNA, 50 bp, homo sapien
ttgcttgaattttgtcagcacaacawctaaataagggcataagaagagag

SEQ ID NO: 23231 - DNA, 50 bp, homo sapien
accaaatagaatgttagagaagagartatttctagaggttagcttatcaa

SEQ ID NO: 23232 - DNA, 50 bp, homo sapien
gtacatcaatttcacgcacaatttgyacttttgtcactgaaacatcaagt

SEQ ID NO: 23233 - DNA, 50 bp, homo sapien
aaggaggacacttgctctcatctcarctctgggtgaaagaaattgggagg

SEQ ID NO: 23234 - DNA, 50 bp, homo sapien
agtgtacttcccacagtcagggcagractttttaaagaggtaacacccga

SEQ ID NO: 23235 - DNA, 50 bp, homo sapien
cttaaataaaatatgtcacctaaaarttgaaagcataggagcaaatatat

SEQ ID NO: 23236 - DNA, 50 bp, homo sapien
aactatgcatattaaaaaattatgakcttcagtcttttcttcaaactctg

SEQ ID NO: 23237 - DNA, 50 bp, homo sapien
ggcggtgaaacgagaggtagaaggakatttgcactaatctctgagtttct

SEQ ID NO: 23238 - DNA, 50 bp, homo sapien
caaaattactgattcagaatcggcaygtagacaaattaaaatgtcagagg

SEQ ID NO: 23239 - DNA, 50 bp, homo sapien
atcagtgctgtcatcctctgtttcayaaggacatggagtgaatagtgtta

SEQ ID NO: 23240 - DNA, 50 bp, homo sapien
tggcttttcccattacttctgccacraaagtcttacctggcactcaacct

SEQ ID NO: 23241 - DNA, 50 bp, homo sapien
attttaactaaaaatcctaataagartactttccatagtggcagtatgtg

SEQ ID NO: 23242 - DNA, 50 bp, homo sapien
ctgggttagtgtgctgaaaaaccgakatccaagcccagcacctcacttct

SEQ ID NO: 23243 - DNA, 50 bp, homo sapien
gatagaacacgacagtgctgtaacaktatgacattctcagagaacatttc

SEQ ID NO: 23244 - DNA, 50 bp, homo sapien
tattatgaaatatctttgctataccracacggaagtgacatcatattcct

SEQ ID NO: 23245 - DNA, 50 bp, homo sapien
gatcataggagaggggtgttacgcaygagcacagagatatgagagagcaa

SEQ ID NO: 23246 - DNA, 50 bp, homo sapien
atttcagactactaacctgatattcrcttttatacagccttttttttttt

SEQ ID NO: 23247 - DNA, 50 bp, homo sapien
tgggccggaagtaatatgttgcaatwaacacattaagataattaaattaa

SEQ ID NO: 23248 - DNA, 50 bp, homo sapien
tcttctaatctttactaggcattaaycaagtggtagacaatgaaaggatc

SEQ ID NO: 23249 - DNA, 50 bp, homo sapien
gctggtacattgccaaatgcagaagratcaattaccactaccctcatacc

SEQ ID NO: 23250 - DNA, 50 bp, homo sapien
tctgggagacagatgcagaattgaastgtttacacatattttttcacttt

SEQ ID NO: 23251 - DNA, 50 bp, homo sapien
atagtataagtttaataaatcctgayagaacaaatgggtgaagaaaaaag

SEQ ID NO: 23252 - DNA, 50 bp, homo sapien
acctgttgcatccttgtcattgagartatagagattattttatgcatagt

SEQ ID NO: 23253 - DNA, 50 bp, homo sapien
caatcttagttgttttatcctggcarattttctctggacatcttatcctc

SEQ ID NO: 23254 - DNA, 50 bp, homo sapien
gaaatcataaagttctcccaaatgaragatatattccctaaaagcaaaaa

SEQ ID NO: 23255 - DNA, 50 bp, homo sapien
gaaaaataagccaaatagagctgtasacttcaaggaaattcattcattat

SEQ ID NO: 23256 - DNA, 50 bp, homo sapien
tatatttactttgtttatacagataycacctcattcttaagtttcataag

SEQ ID NO: 23257 - DNA, 50 bp, homo sapien
aatacctctaaattcctgaagaagaygctactccttggggttaaattgat

SEQ ID NO: 23258 - DNA, 50 bp, homo sapien
ttaaattttacatttccaataccacyaaattacaggaagccaaagttata

SEQ ID NO: 23259 - DNA, 50 bp, homo sapien
ataccactaaattacaggaagccaamgttatacaggtagccaatgtacaa

SEQ ID NO: 23260 - DNA, 50 bp, homo sapien
ttactttaaccaattaaaaactgctwaacttacacagtgggaaatagaac

SEQ ID NO: 23261 - DNA, 50 bp, homo sapien
taaatctaacaaaaactgtgtaagarataaatgtttaaaatcctaaaatg

SEQ ID NO: 23262 - DNA, 50 bp, homo sapien
acaatatgttcttgtagcaaaaggaygttcattaacatgacttgtgaagc

SEQ ID NO: 23263 - DNA, 50 bp, homo sapien
caaaaagaaacacagctaaatcataygtaatggtaagagattaaaagctt

SEQ ID NO: 23264 - DNA, 50 bp, homo sapien
aaatgtagaatgtaaaacttcagtamtaaataaagatttcaagtaacatt

SEQ ID NO: 23265 - DNA, 50 bp, homo sapien
taaataataaacatggtaaatcgtayaatatatgcatagttctttctagt

SEQ ID NO: 23266 - DNA, 50 bp, homo sapien
acaaagaaattctggacttacactcracatttgatcagttggctctaata

SEQ ID NO: 23267 - DNA, 50 bp, homo sapien
ttactctggacacaaacctagagtarcttaatgagaacgcaatctctaaa

SEQ ID NO: 23268 - DNA, 50 bp, homo sapien
atgctgaaataccgttgttggcatamaggaacataatttatttgtatata

SEQ ID NO: 23269 - DNA, 50 bp, homo sapien
agaaactatatttactattcattaastaaaagtgtgtcagcataaatgtc

SEQ ID NO: 23270 - DNA, 50 bp, homo sapien
cctctttatagagcaatttcttcggrcaataggtcaactgaatttttaat

SEQ ID NO: 23271 - DNA, 50 bp, homo sapien
aagggtacagaaatagatatttgaamattataaccacaaagatggtcaca

SEQ ID NO: 23272 - DNA, 50 bp, homo sapien
ttagcaaaattggtggattcactcaytaatttgtcccacgggggaaaaaa

SEQ ID NO: 23273 - DNA, 50 bp, homo sapien
ctctatccaagggagtaagttatcasaaggacctcattataacaggggct

SEQ ID NO: 23274 - DNA, 50 bp, homo sapien
gcatgatatgcaagtaaatgtataascaattcagtattactggagtgtgg

SEQ ID NO: 23275 - DNA, 50 bp, homo sapien
caaacaagaggcattcattttgcccracacccagagttgccccataaaca

SEQ ID NO: 23276 - DNA, 50 bp, homo sapien
tcaccagtgaacatcaaattagtcayagcaatgtaaccgtaatttttcaa

SEQ ID NO: 23277 - DNA, 50 bp, homo sapien
ttcagaagaataaaaagaaagtaaaygatgccaaaggccagacaaacaaa

SEQ ID NO: 23278 - DNA, 50 bp, homo sapien
agctattattagattcaaaattgccsgattctaatttatattttaagtgt

SEQ ID NO: 23279 - DNA, 50 bp, homo sapien
acgatgcagtgtagcctagtggttamgggcacaagctccccagccttgct

SEQ ID NO: 23280 - DNA, 50 bp, homo sapien
atagctagtttactgaggactctgaygtataatggtagtctatattttga

SEQ ID NO: 23281 - DNA, 50 bp, homo sapien
tccagtgggttgaggtatagaggtartaagattggcttgaggtggtaatt

SEQ ID NO: 23282 - DNA, 50 bp, homo sapien
tgaataaaattgtatctatgtgtctyaaaaggttctgaattattctaaca

SEQ ID NO: 23283 - DNA, 50 bp, homo sapien
agtgactcaacaaaatcataagccgsatgtagctttgtttcctctttcta

SEQ ID NO: 23284 - DNA, 50 bp, homo sapien
agcagagagtaactggaatgagtgaraacttggagagtgaaacctagaat

SEQ ID NO: 23285 - DNA, 50 bp, homo sapien
gataaaccatgttcactcctacagtmaaaattttgattatttggagcatc

SEQ ID NO: 23286 - DNA, 50 bp, homo sapien
aaataaaaataataattcttccttaytaacaggcatgaggcaagcttacg

SEQ ID NO: 23287 - DNA, 50 bp, homo sapien
aatgttacagtatatggtctttaaasaggtaattacattaaaataaggtc

SEQ ID NO: 23288 - DNA, 50 bp, homo sapien
tgttactggctgcccatcctgcaaaktctgtgtcctcagtaagcatcaat

SEQ ID NO: 23289 - DNA, 50 bp, homo sapien
gtttgtgagttagtcattagcagtakgagaaatccacattcagcccaaag

SEQ ID NO: 23290 - DNA, 50 bp, homo sapien
ttaggaggctcctgttagactcatayccatgaccagagtcagggctgcag

SEQ ID NO: 23291 - DNA, 50 bp, homo sapien
gctatggaacagctggctgatctgargaactaagaggctgtatgtgtgac

SEQ ID NO: 23292 - DNA, 50 bp, homo sapien
caggtacatcggcggtattgaaaacrctatttgattctccacttctgtgt

SEQ ID NO: 23293 - DNA, 50 bp, homo sapien
caggagggggtggcctgtgagaaagraaacctggactgaagtcagatttc

SEQ ID NO: 23294 - DNA, 50 bp, homo sapien
tggaatcttggaaatcttacagatgmatttattacatttccaaaatttta

SEQ ID NO: 23295 - DNA, 50 bp, homo sapien
tactcatcctgacacagcagtcccasagaagaggatctgtagtctaaaaa

SEQ ID NO: 23296 - DNA, 50 bp, homo sapien
acacttattttcaatttctacttgaygaaaatgttatgtttttcatatag

SEQ ID NO: 23297 - DNA, 50 bp, homo sapien
tccacttggtagaactaaatgctcargtagtatggaacttaagtataagg

SEQ ID NO: 23298 - DNA, 50 bp, homo sapien
actcaggtcaattaaattagaatgamgatggagtaagtgcacgtactatg

SEQ ID NO: 23299 - DNA, 50 bp, homo sapien
tctgtttttctcccagaaactgatcmcaggtatggttgactagcctgctt

SEQ ID NO: 23300 - DNA, 50 bp, homo sapien
cagtggaagtgaatgagtaaaggaaktatcagaacggcaccaaagaactg

SEQ ID NO: 23301 - DNA, 50 bp, homo sapien
acagcactgttccacctctcttccaytgaattttacatatgaacagacta

SEQ ID NO: 23302 - DNA, 50 bp, homo sapien
atttgtagcttggtgcattttctatyaggcgaaatgaggagggagagcca

SEQ ID NO: 23303 - DNA, 50 bp, homo sapien
gttcctttatctgacatccgacatayggttcttactaacaatccatatat

SEQ ID NO: 23304 - DNA, 50 bp, homo sapien
tgcagcactgcagatgacaatctacraagaacaagttacacagcaaaata

SEQ ID NO: 23305 - DNA, 50 bp, homo sapien
ctgtttccatgttaagagagcttgakaactcaggctgggagcatctagtc

SEQ ID NO: 23306 - DNA, 50 bp, homo sapien
cagcgagttgatccaagtattcttayggttctattatcttgatgtatttc

SEQ ID NO: 23307 - DNA, 50 bp, homo sapien
accataagaatacttggatcaactcrctggctaaagacgatttaaagagc

SEQ ID NO: 23308 - DNA, 50 bp, homo sapien
taagtgttagatatattttctaaaasatgcttactatcagtctgaccatg

SEQ ID NO: 23309 - DNA, 50 bp, homo sapien
tattatgaaaaatatttactgttacyatgaatctatttcaagaccaatga

SEQ ID NO: 23310 - DNA, 50 bp, homo sapien
tctgtctgatcagacttcttaatcarggtaagtatcagactaaccacaat

SEQ ID NO: 23311 - DNA, 50 bp, homo sapien
acctaccccggaaggctggaaatacrgaaacagcatggagttgcaagtcc

SEQ ID NO: 23312 - DNA, 50 bp, homo sapien
ataaacaacaacaaaagtagagtacyggttcaacttgtgtagtcactaat

SEQ ID NO: 23313 - DNA, 50 bp, homo sapien
atgagtctggattctatagaagctcrctatgatggaatattttcctttct

SEQ ID NO: 23314 - DNA, 50 bp, homo sapien
ggaaaggatggagaataaggtcacayaatttaggaagagtgatgtacaga

SEQ ID NO: 23315 - DNA, 50 bp, homo sapien
ctatcttccccgccctgtcagggtgyaacaattagaaaagaatgtgaggt

SEQ ID NO: 23316 - DNA, 50 bp, homo sapien
gagcctgagacataatagaacattayataacagttgctgatgatcgcttg

SEQ ID NO: 23317 - DNA, 50 bp, homo sapien
ttctgaagtggtagtttagatcttawattgccagtgggaaaaaatactag

SEQ ID NO: 23318 - DNA, 50 bp, homo sapien
tttgaccaggtcaatgtagtggttgsactgtaattaagtacaaaacaaag

SEQ ID NO: 23319 - DNA, 50 bp, homo sapien
tggcctacagtaaatgcgccatagcsaaaggcgttagcaattattatgaa

SEQ ID NO: 23320 - DNA, 50 bp, homo sapien
ttttgtctcccctttaccatgtcacrctttataactgtattgattttcaa

SEQ ID NO: 23321 - DNA, 50 bp, homo sapien
cccaatggaaaccctagaacacagayggtcactagaagagttccacattg

SEQ ID NO: 23322 - DNA, 50 bp, homo sapien
aagatatgttaatgcttggaatgaarttatcacaagatacttgttttgcc

SEQ ID NO: 23323 - DNA, 50 bp, homo sapien
agagtttccattcatagtttcaaagwcaggcccattagcagcgtgagtga

SEQ ID NO: 23324 - DNA, 50 bp, homo sapien
tgctataggacctcaatgccaagaargtatgatttggaattgtgtgataa

SEQ ID NO: 23325 - DNA, 50 bp, homo sapien
aattaggggattacaaattctttgayataactttgtctaggaggtggtgc

SEQ ID NO: 23326 - DNA, 50 bp, homo sapien
agctataccacacagacagcgaagayagaacaggagaagttcagatgcca

SEQ ID NO: 23327 - DNA, 50 bp, homo sapien
aactcaggtccatctgtatccaaagycaatactgtttcagctacttgaag

SEQ ID NO: 23328 - DNA, 50 bp, homo sapien
ttttgtaggtctgatgatcactgtcrccctgaaaattgaaaggaaaaaca

SEQ ID NO: 23329 - DNA, 50 bp, homo sapien
aagcctgggatattggcatcaaggtwaaaacaaagataaaatcatcttgt

SEQ ID NO: 23330 - DNA, 50 bp, homo sapien
gtcataatgagttttcattgatgcaygttgcctctcatcaccaattccac

SEQ ID NO: 23331 - DNA, 50 bp, homo sapien
attctctaatccatcaggaataaaaytgactggattagagctttcctagg

SEQ ID NO: 23332 - DNA, 50 bp, homo sapien
gagttcaggctcaaatatgacgcttsaaaaatcacttaaccttgtaacta

SEQ ID NO: 23333 - DNA, 50 bp, homo sapien
aatgaaattggattaaactgtctcamtcacgctgctaatgggcctgactt

SEQ ID NO: 23334 - DNA, 50 bp, homo sapien
tctgtcatacatctaatgaattgtcycttttagcataaatttgagggttt

SEQ ID NO: 23335 - DNA, 50 bp, homo sapien
taaggtatggggacaggtaattggcyatgtggaaaatcaggcaactgatg

SEQ ID NO: 23336 - DNA, 50 bp, homo sapien
aaaaattactgtccatatgtaaatargtgtatcatgatgacgtttcagag

SEQ ID NO: 23337 - DNA, 50 bp, homo sapien
ttccgactagtcacctggtaatagaycattcctgtcattcacaggctcag

SEQ ID NO: 23338 - DNA, 50 bp, homo sapien
ctatattaacataacaatcaaatcaygtagttttaactgagatggtatta

SEQ ID NO: 23339 - DNA, 50 bp, homo sapien
cattaattctctagcattccatctckaaaacaccctggacttccttgact

SEQ ID NO: 23340 - DNA, 50 bp, homo sapien
atttatttagaagaaaattcagaacmgttcatttcttcatcatccttgtc

SEQ ID NO: 23341 - DNA, 50 bp, homo sapien
gcattcatgctcttgagttatgtgcyatggagagtggaaaacaatggacg

SEQ ID NO: 23342 - DNA, 50 bp, homo sapien
gtttaagaatgtaagaccttgaaagmcaatattggagggaatgagttggc

SEQ ID NO: 23343 - DNA, 50 bp, homo sapien
cagaggtcgacttcctcagctattasgtctccacagctggattccatttg

SEQ ID NO: 23344 - DNA, 50 bp, homo sapien
tatccacacctattttacagatgaamagattgaggtcagaggagctaagc

SEQ ID NO: 23345 - DNA, 50 bp, homo sapien
ccttttccagggcaacgtaggctgartacatcccaaagtgctcagatgag

SEQ ID NO: 23346 - DNA, 50 bp, homo sapien
ttcttatcacagttgacaagacttasctttgtgtagtactttccagagct

SEQ ID NO: 23347 - DNA, 50 bp, homo sapien
ctgcactagaggaattcacaggagaracagtctgattttgatttagtatg

SEQ ID NO: 23348 - DNA, 50 bp, homo sapien
ttcagacaggtaatatgatatgccamggtgacatgattagagagggaagg

SEQ ID NO: 23349 - DNA, 50 bp, homo sapien
cacagtacatcagtaattaaagcaawtgaactaaatattccaattcaaag

SEQ ID NO: 23350 - DNA, 50 bp, homo sapien
ggatgaatgaaggaccctatctacakgtgcctgatgcatgtttcaagttc

SEQ ID NO: 23351 - DNA, 50 bp, homo sapien
aaggcttgtgaagatagccaggtgasgctgacgagctcttcattccatct

SEQ ID NO: 23352 - DNA, 50 bp, homo sapien
agaacaacgatgagtgggtaataaarcatttgaatcagatggaaggaata

SEQ ID NO: 23353 - DNA, 50 bp, homo sapien
gtaatacacacctcataggtttatcrcaagagttacagaaagcattgcaa

SEQ ID NO: 23354 - DNA, 50 bp, homo sapien
acacgttcattttataacgtttcacrcccatacatttggctttgaggtct

SEQ ID NO: 23355 - DNA, 50 bp, homo sapien
actacggcagagtaatcattctgcayagaaattatgtgtctctgaagcct

SEQ ID NO: 23356 - DNA, 50 bp, homo sapien
catctttcacaaattactaccttgaygtgagtggctaaaaaaaaaaaaaa

SEQ ID NO: 23357 - DNA, 50 bp, homo sapien
gttgacctgaaacactgtgctcggcrgagttttggaaaattaatcagctt

SEQ ID NO: 23358 - DNA, 50 bp, homo sapien
ttactgtaagtttacctatctggaakgttctagcagagtctttaattgat

SEQ ID NO: 23359 - DNA, 50 bp, homo sapien
cccagccgcaatccagcttagtacckgctgcatgtacacactcggtaaac

SEQ ID NO: 23360 - DNA, 50 bp, homo sapien
aatttttatgtcttcattaattctgraataaaattgtatgcagtaagtag

SEQ ID NO: 23361 - DNA, 50 bp, homo sapien
ccatgctcaggaatatatttgaaacrctttaataaccagctttaagcctg

SEQ ID NO: 23362 - DNA, 50 bp, homo sapien
tttgttagacattaaagcaggattcrcatgttatctctggctggtgctgt

SEQ ID NO: 23363 - DNA, 50 bp, homo sapien
gcagctataatcaaatccatccataracaaatccagccagcatttacccc

SEQ ID NO: 23364 - DNA, 50 bp, homo sapien
gaatagactgactaaatggatgaaaytccatgtttataagcatataggag

SEQ ID NO: 23365 - DNA, 50 bp, homo sapien
aaaagctttgcatttcttaattaaakagattggtttccaagatgagtatg

SEQ ID NO: 23366 - DNA, 50 bp, homo sapien
ttacctaaaattagctgtgctgttaraagagtgaataataatgctaataa

SEQ ID NO: 23367 - DNA, 50 bp, homo sapien
agagatctttttcttaacaccttcaraatcaaagttagaaataaagcaag

SEQ ID NO: 23368 - DNA, 50 bp, homo sapien
ggtagagaaagaaacggctaagtgarccaatcctcagttatcctcagaag

SEQ ID NO: 23369 - DNA, 50 bp, homo sapien
cttccaggatacaaatatctgaagakgtacttagatgacagaaaaacaca

SEQ ID NO: 23370 - DNA, 50 bp, homo sapien
aggcttaatgtcagcataaaccttasgattcccagttacctgccaataaa

SEQ ID NO: 23371 - DNA, 50 bp, homo sapien
tctgtcaagtcaggactaaacattaygcatctggaattggaactgccatg

SEQ ID NO: 23372 - DNA, 50 bp, homo sapien
agttcttctttccccagctgcaatayaaactagagggccagttttaggta

SEQ ID NO: 23373 - DNA, 50 bp, homo sapien
agaatggaaacagctatcagagaaawtgggatttggcctaactctcttac

SEQ ID NO: 23374 - DNA, 50 bp, homo sapien
tcctttactctcttattcactcctcratcttctactatctggctactggt

SEQ ID NO: 23375 - DNA, 50 bp, homo sapien
ggttagtctctcagaggctaagtaaygatcaaccaacaaaacctgcaaaa

SEQ ID NO: 23376 - DNA, 50 bp, homo sapien
atataaactgtccacataaagtgtcyagcaacttcttaaacaacagtaat

SEQ ID NO: 23377 - DNA, 50 bp, homo sapien
cacttatgttctatttacctttaccrctgttgcactttcagcattttcaa

SEQ ID NO: 23378 - DNA, 50 bp, homo sapien
ctcaggtgcttcaagaagtctaaagyccagggatgctgtaaacaggttta

SEQ ID NO: 23379 - DNA, 50 bp, homo sapien
ttctgctttcaccattagcataaaartgttcagagttgttatgattaaaa

SEQ ID NO: 23380 - DNA, 50 bp, homo sapien
tatgttgtgataaactgctgttggakgaattgacaagcagtctaaaagct

SEQ ID NO: 23381 - DNA, 50 bp, homo sapien
ccacagctagctcaattctaatgccraaaaagaaagtgagcactgcaaat

SEQ ID NO: 23382 - DNA, 50 bp, homo sapien
catagcattttggtgattgaaataaygcaagatacagacccaggtgaaag

SEQ ID NO: 23383 - DNA, 50 bp, homo sapien
acatagaacaacactccctagagtcmaagaatcatcatgctgcttttcag

SEQ ID NO: 23384 - DNA, 50 bp, homo sapien
caaactttgaactagaagaagataargaagtcttggcagttggtaatgag

SEQ ID NO: 23385 - DNA, 50 bp, homo sapien
cagctaattttaggtaaggtctaackgcttcaaaattcatagttggttgg

SEQ ID NO: 23386 - DNA, 50 bp, homo sapien
gaacatgctgtaagccactcaacctsaaaatctacaaaggtgagttcacc

SEQ ID NO: 23387 - DNA, 50 bp, homo sapien
actgttcaaatattctatgtgagggwaggttttcaagaattcattactaa

SEQ ID NO: 23388 - DNA, 50 bp, homo sapien
acagacagaatttagtcccttgagarattgaagttgaagagagtcacagt

SEQ ID NO: 23389 - DNA, 50 bp, homo sapien
atttttgaaggcaccttgaaacacasaaaaaatgatgttctccatctcct

SEQ ID NO: 23390 - DNA, 50 bp, homo sapien
tttgtgttagattttgcagttataamctatttcatcatttgaagttgcac

SEQ ID NO: 23391 - DNA, 50 bp, homo sapien
tttctctgactacatataggattgaygtgaaggtaatgcaatagacaaag

SEQ ID NO: 23392 - DNA, 50 bp, homo sapien
tatgtgtcatggaagatgctattcasgccttaataattgtgctttttttt

SEQ ID NO: 23393 - DNA, 50 bp, homo sapien
actctctcctgagtttctatcatggkcagtgtaggcattgaatcagagaa

SEQ ID NO: 23394 - DNA, 50 bp, homo sapien
actaggccttttctgtttagtcctaygtacttgagaaatcaaacgtcacc

SEQ ID NO: 23395 - DNA, 50 bp, homo sapien
cagctgcttgactctctgataaatcyctggacagtgaagaccctggcttt

SEQ ID NO: 23396 - DNA, 50 bp, homo sapien
aaaagcccaggtttgtaataggtacrgaagtctttgagcgtccgtggcta

SEQ ID NO: 23397 - DNA, 50 bp, homo sapien
atttgacacagttattctttaagccwgatttgaaagtaaaaccagataac

SEQ ID NO: 23398 - DNA, 50 bp, homo sapien
tggaatggagcatcaggctggaacgraggttttgcatcaagtagtctaat

SEQ ID NO: 23399 - DNA, 50 bp, homo sapien
ctcttgccttttattaactcctcaayctcatgtaatctgagttcctccct

SEQ ID NO: 23400 - DNA, 50 bp, homo sapien
atgattacttttcctcctgaccacakcttttggttccaaaatgtattaca

SEQ ID NO: 23401 - DNA, 50 bp, homo sapien
aagataaacgctgttatgtttcaaarttgtgccaagtttatgttgataaa

SEQ ID NO: 23402 - DNA, 50 bp, homo sapien
tgttaaagttatttcctagggcccarcttcctgaggaccacaggacaagg

SEQ ID NO: 23403 - DNA, 50 bp, homo sapien
gactggaagtgggccatccagactamtagatgggagtgtgaagtggggag

SEQ ID NO: 23404 - DNA, 50 bp, homo sapien
catgaaaattattttacatgatagawgatttcagaattacagaatgggca

SEQ ID NO: 23405 - DNA, 50 bp, homo sapien
tttttattaggaaatgtttatatcartacagcaaaactaaattttagaaa

SEQ ID NO: 23406 - DNA, 50 bp, homo sapien
agctacagcagtcatatggcaaccaygaggcaacaaacgtgggtgaaaac

SEQ ID NO: 23407 - DNA, 50 bp, homo sapien
ctcttggacacctgtgaacatcacamtgaaaaataatcctattctaggtg

SEQ ID NO: 23408 - DNA, 50 bp, homo sapien
tattttgcaaataagaagcaatgtasgcataaattaagaatagcaagttt

SEQ ID NO: 23409 - DNA, 50 bp, homo sapien
acgtgttccagtgtggttctacccayggcaaattccatggcactgtcaag

SEQ ID NO: 23410 - DNA, 50 bp, homo sapien
gcagcgataagtaaaaagttcaagargacctatattggcaggatcagggc

SEQ ID NO: 23411 - DNA, 50 bp, homo sapien
agaaggtaatcgttgctgcggacaamggaacaagtagagtaggctaaggg

SEQ ID NO: 23412 - DNA, 50 bp, homo sapien
cctgacatagtatgtacttaacttcwcaataaatatttgctaagcagaag

SEQ ID NO: 23413 - DNA, 50 bp, homo sapien
tctcaggatgtggctggtgctacacragaagatatggctgtctgtcaaat

SEQ ID NO: 23414 - DNA, 50 bp, homo sapien
ttcctgttctaggttgttctgtaacrggtgtttctagtctttcctctaag

SEQ ID NO: 23415 - DNA, 50 bp, homo sapien
agagaatttgaccaggttaacttacyctttaggatccagcaatcgttcca

SEQ ID NO: 23416 - DNA, 50 bp, homo sapien
agttttgtttctgatcagcctaagtsaatcagagtaggttggaagcctat

SEQ ID NO: 23417 - DNA, 50 bp, homo sapien
ctattgtatctttagcacctgtaatracatgccattaatattggttgaat

SEQ ID NO: 23418 - DNA, 50 bp, homo sapien
ccatgtcaacagacaggctatgcaaktacagagaagacaggggaggtcag

SEQ ID NO: 23419 - DNA, 50 bp, homo sapien
atctagtgagaggtgcctgtgcagcsagcagtaaacatggaagcactgag

SEQ ID NO: 23420 - DNA, 50 bp, homo sapien
agagtttatcttcttaggcaaattayagttacgtacatatgttaatacca

SEQ ID NO: 23421 - DNA, 50 bp, homo sapien
attgacaagtaaacaggcgatttaawgcacggtgtgataatgctgtgata

SEQ ID NO: 23422 - DNA, 50 bp, homo sapien
ttggataccataggagattttgaaaragcattaaattcagtcctgccttg

SEQ ID NO: 23423 - DNA, 50 bp, homo sapien
gaaatcttatatcccagatagataarcatacaaggtaatcaaattcctag

SEQ ID NO: 23424 - DNA, 50 bp, homo sapien
agctacttttttggaaagagtataakggttgaataattaaacaatagggt

SEQ ID NO: 23425 - DNA, 50 bp, homo sapien
catcctgctgttgcagcactaggcayctactgtaattatcactttatttg

SEQ ID NO: 23426 - DNA, 50 bp, homo sapien
tcaattgtatttagaaacatcagtaraagtcggtcagagaattaagagga

SEQ ID NO: 23427 - DNA, 50 bp, homo sapien
agagctcttttggtttagagcccaartcttactaatggctgtaaggtaga

SEQ ID NO: 23428 - DNA, 50 bp, homo sapien
aagcaaaatgagcagatgtaaaataygtatacgaacatgtatgtatagag

SEQ ID NO: 23429 - DNA, 50 bp, homo sapien
ccccacctcttctggcaggaaataastccctattgatgagtgagaaggtt

SEQ ID NO: 23430 - DNA, 50 bp, homo sapien
gttttgggggccttcctgcgagtaayagatgtttgagtttcagggaagca

SEQ ID NO: 23431 - DNA, 50 bp, homo sapien
aggaaaagcacaaacatccatgacaytgagagcagagagaaatcattctg

SEQ ID NO: 23432 - DNA, 50 bp, homo sapien
gcaaactgttttatcctagtagcaamccaatcttcattgtttgctgcttt

SEQ ID NO: 23433 - DNA, 50 bp, homo sapien
agctcaagcttccaagagggaattasaaatgcccttcatgagaggctcac

SEQ ID NO: 23434 - DNA, 50 bp, homo sapien
gcgctatgatctaccactcagcatascacgaaagttgtcatagttactac

SEQ ID NO: 23435 - DNA, 50 bp, homo sapien
ttgcccatctgggaatggtgtttacygaaaaccagagaaaacaggcacat

SEQ ID NO: 23436 - DNA, 50 bp, homo sapien
aaatatgagatacacctaagtgggaragaattcactaaatgccaacatgg

SEQ ID NO: 23437 - DNA, 50 bp, homo sapien
accccagtttctgagcccaccgagasatagtgcaatgtgtgttaatagtt

SEQ ID NO: 23438 - DNA, 50 bp, homo sapien
gctttggtgaatgctgtccttggcaytgcaagtataaagtttgtttaaaa

SEQ ID NO: 23439 - DNA, 50 bp, homo sapien
tgacaagctctcatttatatttaatyatcctcttcagatccaaggacatt

SEQ ID NO: 23440 - DNA, 50 bp, homo sapien
gatggaagttgtttatgtaactggckatcaaaagagtgatttcaagaatc

SEQ ID NO: 23441 - DNA, 50 bp, homo sapien
tgccctagaccttaagtctgactgcsagcattactggaccggggcctcac

SEQ ID NO: 23442 - DNA, 50 bp, homo sapien
agaggcgttctggaaacacaactgaragacgtttgtcaaactgaaatcaa

SEQ ID NO: 23443 - DNA, 50 bp, homo sapien
gttatatgctaaatatactcatgtcmcaaatttctcaaatctttttggtc

SEQ ID NO: 23444 - DNA, 50 bp, homo sapien
aagcacaacattccttgttaacatayctgcacaaaaacccagaaaacaaa

SEQ ID NO: 23445 - DNA, 50 bp, homo sapien
aacactgccattttatgtgttctccraataatcaaatgggcccagttgct

SEQ ID NO: 23446 - DNA, 50 bp, homo sapien
caaaaaagacagtattagaagaaaaygtccttcaagagttttaatgtagg

SEQ ID NO: 23447 - DNA, 50 bp, homo sapien
gaaataaatggaagtccagaccagartaagtgtccacagtttccattttt

SEQ ID NO: 23448 - DNA, 50 bp, homo sapien
gtacttagcgacattcctttagataygttgtgcaaaatagtaagaaacct

SEQ ID NO: 23449 - DNA, 50 bp, homo sapien
aactattatgtatcaataattttaasagaccttgtaatttgcagaagaag

SEQ ID NO: 23450 - DNA, 50 bp, homo sapien
ctcagtatttaagtgattcgttggcmatttttactacctgcaacatgaga

SEQ ID NO: 23451 - DNA, 50 bp, homo sapien
taagtgatttatgaataagggaatcyctgttcgtgtgctcagaaagaccc

SEQ ID NO: 23452 - DNA, 50 bp, homo sapien
ctatagacatgtttatcttctaaaawctatcccactggtcataactcaat

SEQ ID NO: 23453 - DNA, 50 bp, homo sapien
acgcaaactcagtaactatagagaargtggagtgcgatggctcacacctg

SEQ ID NO: 23454 - DNA, 50 bp, homo sapien
ggagagaaagagctgcagtgtaacartatgagcaagtcaccaacatacct

SEQ ID NO: 23455 - DNA, 50 bp, homo sapien
aaattgtggtttatattttactgccrctaattgctatgattatcgctact

SEQ ID NO: 23456 - DNA, 50 bp, homo sapien
cacacctgttttctcttacaaaggamgcaagcaaataagagtcaggtgaa

SEQ ID NO: 23457 - DNA, 50 bp, homo sapien
catttgatctattaaatgtctctgartaccatttatgatggaatggagca

SEQ ID NO: 23458 - DNA, 50 bp, homo sapien
gaaaaatcctcccgtcattctactckaggctaaattctgaagttgtagta

SEQ ID NO: 23459 - DNA, 50 bp, homo sapien
ggaagtctgagagattttcccttgamgttgtagaagaaatcctttgctta

SEQ ID NO: 23460 - DNA, 50 bp, homo sapien
gaaacagaccaggttcttttagttarggtgactgtacagcctcgtttgcc

SEQ ID NO: 23461 - DNA, 50 bp, homo sapien
tatgaattcacgtacatgttaggcaraattttatactctttcaaggatct

SEQ ID NO: 23462 - DNA, 50 bp, homo sapien
ttctgccatgagcattttcaggttaygttgtctacatgttatctaatacc

SEQ ID NO: 23463 - DNA, 50 bp, homo sapien
tctccttgcctcgcttgagaccatgrcatatagtatagaaattatgtaga

SEQ ID NO: 23464 - DNA, 50 bp, homo sapien
atcgatttcagtttttctcaacccarcgtttctgaagaggtccatgacac

SEQ ID NO: 23465 - DNA, 50 bp, homo sapien
cattaacaagagcagtgcaatatacrcagttcatataaatgtcaaatata

SEQ ID NO: 23466 - DNA, 50 bp, homo sapien
gtattcagtattgactggagatcaaytgccagtatagtaaggcaaaacaa

SEQ ID NO: 23467 - DNA, 50 bp, homo sapien
ggaggagcgctcatgtgcactcacartatgggcagccaagttctaggcct

SEQ ID NO: 23468 - DNA, 50 bp, homo sapien
tgtggggagggaggattggaaaagayacttagagaagcagcaataacatg

SEQ ID NO: 23469 - DNA, 50 bp, homo sapien
ctgatttacttaaaaatacttatacygagctactactgtatgtcaatcct

SEQ ID NO: 23470 - DNA, 50 bp, homo sapien
ggaataataatgatggttagactagrctaatagaaccgtctaattcagtg

SEQ ID NO: 23471 - DNA, 50 bp, homo sapien
ctttagttagcattagatttgataartattcccaggaagaagacaaatga

SEQ ID NO: 23472 - DNA, 50 bp, homo sapien
agggctatttgggatgagtcttcaamgatgagaattttaatgggcagaca

SEQ ID NO: 23473 - DNA, 50 bp, homo sapien
aagcttcatgggtcagaggagtggcrcattcatggtgaaggctgtggctg

SEQ ID NO: 23474 - DNA, 50 bp, homo sapien
aggattacttttctaatgatccagamaactacctctgaggatacgctgaa

SEQ ID NO: 23475 - DNA, 50 bp, homo sapien
ccagccaggtgaatccttttaaccaygtagctgaaggagacgtgctgaaa

SEQ ID NO: 23476 - DNA, 50 bp, homo sapien
gacaagtgataatgagatctcagacmgaactacgttttattttactttta

SEQ ID NO: 23477 - DNA, 50 bp, homo sapien
taggcttcctgggacacagattagartagtttgaaacaaaggggcggaag

SEQ ID NO: 23478 - DNA, 50 bp, homo sapien
attccactgcactcttgatgggatcrcctcccagaagctgagggatatgg

SEQ ID NO: 23479 - DNA, 50 bp, homo sapien
taaatccccagagagctgcttccctyagaactgacctgttaatgggtgat

SEQ ID NO: 23480 - DNA, 50 bp, homo sapien
agcttctaagaaataaaactgatatsactggcaatgcctaccattggtca

SEQ ID NO: 23481 - DNA, 50 bp, homo sapien
acttctcactgtgtgcaataaaagamatcaaccctaaatatagagatgta

SEQ ID NO: 23482 - DNA, 50 bp, homo sapien
gagtttcagctttacctcttcagtcrattttttaaatttcattccagaaa

SEQ ID NO: 23483 - DNA, 50 bp, homo sapien
cctagcagcatctgaattcccagackaatcttaagaattcatggacctga

SEQ ID NO: 23484 - DNA, 50 bp, homo sapien
aatcatgcaaaaaaatcccaggcaartagtgcatgaaatcagcagagcct

SEQ ID NO: 23485 - DNA, 50 bp, homo sapien
tgttcatgacagactgagaaaaatakgaatgggaaatatagtttgaaaat

SEQ ID NO: 23486 - DNA, 50 bp, homo sapien
cacctcatcgtaaccattagaggaaytggggtcttttattttttgttttt

SEQ ID NO: 23487 - DNA, 50 bp, homo sapien
attgctggaaaatttttagtgcaacsaagtgttccctacccatctggcca

SEQ ID NO: 23488 - DNA, 50 bp, homo sapien
agggtctgatgtttacacaaagccasctgaggttagttcttcatataatt

SEQ ID NO: 23489 - DNA, 50 bp, homo sapien
tcagaaaagacttttgggctcagagkctctatctctaacaacaaatcctc

SEQ ID NO: 23490 - DNA, 50 bp, homo sapien
tgtcccaggaaccttttgtgtttaaytcaaacctcttctaatcacttctc

SEQ ID NO: 23491 - DNA, 50 bp, homo sapien
tgaaaaacatgaacaggcacttcacraacagtatatccaaatggccgata

SEQ ID NO: 23492 - DNA, 50 bp, homo sapien
tattatggtttgttgtcttgttttayagcacttatgcccttctaatgcca

SEQ ID NO: 23493 - DNA, 50 bp, homo sapien
cctaattgtgtactttaggcacaatsatatgaaaatctaggtttcatcca

SEQ ID NO: 23494 - DNA, 50 bp, homo sapien
cagaatacgagatcagtaacaatacraagtctggtggtccagaaaaggaa

SEQ ID NO: 23495 - DNA, 50 bp, homo sapien
atgaggtattcaataatgaagctgaygctaacttaaatataaccagactc

SEQ ID NO: 23496 - DNA, 50 bp, homo sapien
ggagagccggtaagcacagtaagaamgagtttacagcttccttcctcaaa

SEQ ID NO: 23497 - DNA, 50 bp, homo sapien
tttcaaatgtttgggtatttttaackgaagacacgaatacgaaatacttg

SEQ ID NO: 23498 - DNA, 50 bp, homo sapien
gttaaagatgtcaacggagcttaaayaggcattctgtaagttaggcatcc

SEQ ID NO: 23499 - DNA, 50 bp, homo sapien
taagtatatataaaacaaggctccasagttgatgaaggtatacttatatt

SEQ ID NO: 23500 - DNA, 50 bp, homo sapien
aggggctgcactgccaatgttgaacygggatagacaagagcataacaaag

SEQ ID NO: 23501 - DNA, 50 bp, homo sapien
gcaaatttcacaacacattcaatgasaggcatatatacaatgatacttac

SEQ ID NO: 23502 - DNA, 50 bp, homo sapien
ctcatctacttctatcataagagaamaaattttgaattaatgcacagtta

SEQ ID NO: 23503 - DNA, 50 bp, homo sapien
acctgttccgattcctttgtacatasctctgataggaccagctcctatct

SEQ ID NO: 23504 - DNA, 50 bp, homo sapien
aattaagtgtgtctagtcctttaaarccaattcattttcttttgaaaaat

SEQ ID NO: 23505 - DNA, 50 bp, homo sapien
tgtctgtggcccacacgaaggtttayaatagtatcctcaaaagctctgtc

SEQ ID NO: 23506 - DNA, 50 bp, homo sapien
aaacaagcaaatttgtctcagccggwatttgggaaaaccactgccagcaa

SEQ ID NO: 23507 - DNA, 50 bp, homo sapien
tgctcacacccttaagttttggaggycagtgattaagagcacgcatgtgt

SEQ ID NO: 23508 - DNA, 50 bp, homo sapien
ttggaatttatttgttacagtgacaycttatgtagtcttttttcctgttc

SEQ ID NO: 23509 - DNA, 50 bp, homo sapien
gaaatgaaatatgtaacattcttaastataggcagctacatgcaaacaac

SEQ ID NO: 23510 - DNA, 50 bp, homo sapien
gctaaatgcacatggttcctccgaarataatagaaccctggcatttagga

SEQ ID NO: 23511 - DNA, 50 bp, homo sapien
ttctatatttctgataaaccatgtamcttcggtggctatacgtacccttt

SEQ ID NO: 23512 - DNA, 50 bp, homo sapien
aagcttaaaaagaaaatcactggagsaactgatcttggaatggagtatgc

SEQ ID NO: 23513 - DNA, 50 bp, homo sapien
ttaatcaactcttatactaattacastagcaagccaacttacagttaccc

SEQ ID NO: 23514 - DNA, 50 bp, homo sapien
tcctggggggaaatgatccgtaggarcttagtattgttaacactttctag

SEQ ID NO: 23515 - DNA, 50 bp, homo sapien
ggtacccagtgactagtgagtacaaytgaaccacttcttgatggttaggg

SEQ ID NO: 23516 - DNA, 32 bp, homo sapien
accttgggcaagttackatactcttcatgcct

SEQ ID NO: 23517 - DNA, 50 bp, homo sapien
gctcttctctgccattataaagatgwactaatttgctacttggcaactgc

SEQ ID NO: 23518 - DNA, 50 bp, homo sapien
taaatatgggaaacattatggatcawatccaaggaaggtcttaaatatat

SEQ ID NO: 23519 - DNA, 50 bp, homo sapien
ataagaatgggattcatttatgttcygaaatttggcactctgtccagtaa

SEQ ID NO: 23520 - DNA, 50 bp, homo sapien
tcaaaatatgtatattgctagacagraagttttggacacattttatcaaa

SEQ ID NO: 23521 - DNA, 50 bp, homo sapien
gcatatgtaagattttcttccaccaygaaactagtgaaattgcgtggata

SEQ ID NO: 23522 - DNA, 50 bp, homo sapien
aattcccgttttgttgtaaggatatragataataatgtgtgatctctatg

SEQ ID NO: 23523 - DNA, 50 bp, homo sapien
aagacaaattcccattttgtaagaaytgtactgatgttttagtatgtcct

SEQ ID NO: 23524 - DNA, 50 bp, homo sapien
ggttaaagaaaccaacatccagaacygagcatggaaggcaaagctgcctg

SEQ ID NO: 23525 - DNA, 50 bp, homo sapien
tgataacagagttaaaggtttagcasctctttaccactttacccaacaag

SEQ ID NO: 23526 - DNA, 50 bp, homo sapien
ataagtgaaatattaaatcttgtcaygttcagggttttagggttcttaaa

SEQ ID NO: 23527 - DNA, 50 bp, homo sapien
tgtgtgaaacaacactaaatcactaytaaaaaggaaagaatgaggttatc

SEQ ID NO: 23528 - DNA, 50 bp, homo sapien
acaaacagaaatcaactattaagtayggctgtgaattaaggatttcaaaa

SEQ ID NO: 23529 - DNA, 50 bp, homo sapien
cagaggattggagacaatgatgtaamtgaagcagtcctcacaaggcagaa

SEQ ID NO: 23530 - DNA, 50 bp, homo sapien
agttctgaaagaccatagggatgackactacacaaacagaaatcaactat

SEQ ID NO: 23531 - DNA, 50 bp, homo sapien
taattgacttgacctcaaattgtgaytaacatgctactctgatattttca

SEQ ID NO: 23532 - DNA, 50 bp, homo sapien
tgtcaaaaactgttacctctttttargtacttgtctttgtgaatcaaaac

SEQ ID NO: 23533 - DNA, 50 bp, homo sapien
aaagaaacttgcacttccctagtgasaaaatcacagccacaggcagctgc

SEQ ID NO: 23534 - DNA, 50 bp, homo sapien
ggagcagtaaactggcatgtattcaracatttcctaactacacaaagaag

SEQ ID NO: 23535 - DNA, 50 bp, homo sapien
ttccattaaagttggacaagtgtaaragctatagagaattatgctaggct

SEQ ID NO: 23536 - DNA, 50 bp, homo sapien
gtattaatagaggaatgacagagggragaaattataactgcaaggtcttc

SEQ ID NO: 23537 - DNA, 50 bp, homo sapien
tgcccacactttccctgcaggagtamattcagtagaaccctataattctg

SEQ ID NO: 23538 - DNA, 50 bp, homo sapien
aactgatggctagctaaaagaacaamtgatcacagcagtggtgtccaaac

SEQ ID NO: 23539 - DNA, 50 bp, homo sapien
ccagtttctcttctgtttttatgacratgtctaaccaaactataataatc

SEQ ID NO: 23540 - DNA, 50 bp, homo sapien
tgtagagatactcatcaagcagttgsatagttggtctggatctcaaataa

SEQ ID NO: 23541 - DNA, 50 bp, homo sapien
actccttccaacccacctggcttcayagtacacctagagtaatccttcca

SEQ ID NO: 23542 - DNA, 50 bp, homo sapien
taagaaacattctggctacaaaacakcttttcgtatacaaacttatgaaa

SEQ ID NO: 23543 - DNA, 50 bp, homo sapien
tgtaaatgtacagaatagtaagttaygagaccatagtcacaaaacaaaag

SEQ ID NO: 23544 - DNA, 50 bp, homo sapien
tttttatttttttacaaaacccaatyattagtctattgatgtagtttgct

SEQ ID NO: 23545 - DNA, 50 bp, homo sapien
attttacttatattcttcaatatgcrccaaaaagtattgtaatatgagga

SEQ ID NO: 23546 - DNA, 50 bp, homo sapien
ggttaaggataaggaagaaggcctaygagcattacaaaaaatactggtat

SEQ ID NO: 23547 - DNA, 50 bp, homo sapien
agtaaatctcctgaataattgacaamatcttggtaactttgaacatggaa

SEQ ID NO: 23548 - DNA, 50 bp, homo sapien
tgtgcactatggaagagaataccaaraagagttgggatagatgctctatg

SEQ ID NO: 23549 - DNA, 50 bp, homo sapien
tggcagtagctgctacaatcattgamgagtgaacaaataagaggtgggag

SEQ ID NO: 23550 - DNA, 50 bp, homo sapien
ttgtctgctgtataaagaaaaatacraaagtgataacttcaaaggatgta

SEQ ID NO: 23551 - DNA, 50 bp, homo sapien
tgacttttaaataaaacagcttccaytattcaaaaatccagaatggcaac

SEQ ID NO: 23552 - DNA, 50 bp, homo sapien
aaagttgataaaatatagctgtatamgccttagagttctatgtgtccagg

SEQ ID NO: 23553 - DNA, 50 bp, homo sapien
agttgaaaaataaaaaagttactaaytatatgtctttcaaaaatgttctt

SEQ ID NO: 23554 - DNA, 50 bp, homo sapien
cctggaattggagtcatgagttttayagtaatggatatatgactcattaa

SEQ ID NO: 23555 - DNA, 50 bp, homo sapien
caagcaaaaagttcagctggatgtayataaatatgccatttagtaaatat

SEQ ID NO: 23556 - DNA, 50 bp, homo sapien
tttctgaacatgtgggactcctggawtatagtatatgtctttctttttct

SEQ ID NO: 23557 - DNA, 50 bp, homo sapien
ttacaaatatatagcaaacttgaacycaaattttatgtacaatagtatta

SEQ ID NO: 23558 - DNA, 50 bp, homo sapien
ggtatttctacacattacttttaatkataagcaatttccagctaagactt

SEQ ID NO: 23559 - DNA, 50 bp, homo sapien
ttattttgcagagtagttgatttcaygtcttcatcgtgtcattggtcttt

SEQ ID NO: 23560 - DNA, 50 bp, homo sapien
gtgttagtttgcactggctccaggcrataccacagctttaccacctctga

SEQ ID NO: 23561 - DNA, 50 bp, homo sapien
tccagccacttctaccagaagtcacygagctttagccacctcctccctgc

SEQ ID NO: 23562 - DNA, 50 bp, homo sapien
tagccagggtctattccaggtatcamatgccctgtatcagatgcccctgt

SEQ ID NO: 23563 - DNA, 50 bp, homo sapien
tgccactgcttctttctccacattarattcacgcctcgtttttaagcttc

SEQ ID NO: 23564 - DNA, 50 bp, homo sapien
ctgttgctgctatctctacagtaatsatcatagcttcttccctagggaaa

SEQ ID NO: 23565 - DNA, 50 bp, homo sapien
tccctttgttattcttaagtccagasgaatcaatcaaaacaactgcttgt

SEQ ID NO: 23566 - DNA, 50 bp, homo sapien
cattcagcaggtctggagcggaacaytgttcagaatatcagaaaggcaga

SEQ ID NO: 23567 - DNA, 50 bp, homo sapien
ctgacaaaaatgtattgcaaaagaakctgccatgccacttatcatattaa

SEQ ID NO: 23568 - DNA, 50 bp, homo sapien
gcgggaactgtttatgattggttcayagtgagataaagaactttaatcag

SEQ ID NO: 23569 - DNA, 50 bp, homo sapien
caagctttctgagtttgtgtggctcmatttctccagatctgtatccccat

SEQ ID NO: 23570 - DNA, 50 bp, homo sapien
aagagctaacagtataataggatcartacccaaataatgactattatgta

SEQ ID NO: 23571 - DNA, 50 bp, homo sapien
gatgcccagaggctgctggtccaaakattatcctctgagtagcaaggcta

SEQ ID NO: 23572 - DNA, 50 bp, homo sapien
caacaaaaatgatgatcttttttggraattcgaattgttctgatactccc

SEQ ID NO: 23573 - DNA, 50 bp, homo sapien
ttcaattttaattgacatcattctayctctggcagttataaatggatcag

SEQ ID NO: 23574 - DNA, 50 bp, homo sapien
gtaaaatcctgggcaagtctaagccraaaataacctagttacctagttac

SEQ ID NO: 23575 - DNA, 50 bp, homo sapien
tgcggcaaaaggaaagctgtgtttayatggaagaaagtaaggtgcttgga

SEQ ID NO: 23576 - DNA, 50 bp, homo sapien
gctaggtcagcaattttgactcaagwaagtaccccctgcgagctttccag

SEQ ID NO: 23577 - DNA, 50 bp, homo sapien
catgagggaagctttcgtgggactgrattataaatatgattgcctttctg

SEQ ID NO: 23578 - DNA, 50 bp, homo sapien
aaaccactcactagagagatgagaartagtgttaattaagttcatctccc

SEQ ID NO: 23579 - DNA, 50 bp, homo sapien
cccctctccacctgtcaaaatcctawctctcttctctggtttatttcaca

SEQ ID NO: 23580 - DNA, 50 bp, homo sapien
ccaaccaagtgaacacagccataaargtccagaatgctgaaccaagtttc

SEQ ID NO: 23581 - DNA, 50 bp, homo sapien
atcccctgtgacttcctgcataggaygggtacttagtaaatgctcaataa

SEQ ID NO: 23582 - DNA, 50 bp, homo sapien
gtagaatgaaaagtaagatactgctyagatgaacgtcatcttctaggaag

SEQ ID NO: 23583 - DNA, 50 bp, homo sapien
agcagccaaaagataaaggaaaggartatacacacaaatttaggcttctc

SEQ ID NO: 23584 - DNA, 50 bp, homo sapien
aggtaacagtcattcttgcatattarggtttgtaaagtactgttctagga

SEQ ID NO: 23585 - DNA, 50 bp, homo sapien
ggtgacactttgatttagagccacaygaaaaggtaagtgactgatgtcat

SEQ ID NO: 23586 - DNA, 50 bp, homo sapien
ccaaagcttctatacaactgaccaasttctccatatgctgaggctgtcag

SEQ ID NO: 23587 - DNA, 50 bp, homo sapien
aggatccagggcctccgagtccttgyactatcattggtttgctactgttg

SEQ ID NO: 23588 - DNA, 50 bp, homo sapien
aatatcagagggcaaagtgaaaatayctagtcagtcatcaggtttccaga

SEQ ID NO: 23589 - DNA, 50 bp, homo sapien
caaatcaggattctctgatttagtgrattttcagttcagtattccttcag

SEQ ID NO: 23590 - DNA, 50 bp, homo sapien
tcactcactagcagtcctgttgggawgtgtaataagtgctctctctatcc

SEQ ID NO: 23591 - DNA, 50 bp, homo sapien
ggaacagagactcagagcattaaccyaagatctctcagccagtctctggc

SEQ ID NO: 23592 - DNA, 50 bp, homo sapien
ctggaaagggctttggaagtggaaayacaagagcaactggtctgtaggat

SEQ ID NO: 23593 - DNA, 50 bp, homo sapien
aaaacctatttttgtaagccacataytaaaaatcactttaaaaaatcaaa

SEQ ID NO: 23594 - DNA, 50 bp, homo sapien
gcacaggctacaagagtcctttgaarcctcaagctcagcttattaacagc

SEQ ID NO: 23595 - DNA, 50 bp, homo sapien
ctcagcagaaataaatcaaataaackgtagaagaattcaataaaactgat

SEQ ID NO: 23596 - DNA, 50 bp, homo sapien
agacaaagactgatgaagaaagacastatccagctgtgatgcagatgaaa

SEQ ID NO: 23597 - DNA, 50 bp, homo sapien
ggcttcatctgtgatattgaatatcrgagggcaaagtgaaaatacctagt

SEQ ID NO: 23598 - DNA, 50 bp, homo sapien
cgccctgtctagttttcaaagtccayaaactcagcttaaatttttttaac

SEQ ID NO: 23599 - DNA, 50 bp, homo sapien
tggtactgactccttgattcatgtasgaaacatgtttggctatctgtaaa

SEQ ID NO: 23600 - DNA, 50 bp, homo sapien
tcagcttccacaattctgattgaaarattaaagttgagcaaactttccac

SEQ ID NO: 23601 - DNA, 50 bp, homo sapien
ataaaataaagcttactactttgtgmaaaccacttacctactgataagtc

SEQ ID NO: 23602 - DNA, 50 bp, homo sapien
gtcgtgagccaccacacctggccagwaattttatggtctcatacagacat

SEQ ID NO: 23603 - DNA, 50 bp, homo sapien
caaggagcacgttcttctgagataaraaacagcttttacaatacaagcta

SEQ ID NO: 23604 - DNA, 50 bp, homo sapien
aaccaccaataaatctaggaccaagraaaacgtgttgacttttattattg

SEQ ID NO: 23605 - DNA, 50 bp, homo sapien
atttttatagtacatttataatttayccacagaagtaagagtcatgttca

SEQ ID NO: 23606 - DNA, 50 bp, homo sapien
gctaacaagtcagtttccgaagataygcagctttggcgaaacaacaaagt

SEQ ID NO: 23607 - DNA, 50 bp, homo sapien
actcttgtcctcataattccacttcsaagtaatacagcttaggaagaaag

SEQ ID NO: 23608 - DNA, 50 bp, homo sapien
aagataggcacatacctccaactcargaagactatattggggtgagtgac

SEQ ID NO: 23609 - DNA, 50 bp, homo sapien
tgttttctgagagtaaatcttaagasaggacttcagggttccttgttatg

SEQ ID NO: 23610 - DNA, 50 bp, homo sapien
aaatgagagaatgtttgtagactgtmaagtgagacaaaaataaaaatttt

SEQ ID NO: 23611 - DNA, 50 bp, homo sapien
ctcttctccacccgctaggttcttaygctggcagctcatatttttacaag

SEQ ID NO: 23612 - DNA, 50 bp, homo sapien
atatgagctcctaaaaatcaccacamtatgcaaaactaaaaaccacagag

SEQ ID NO: 23613 - DNA, 50 bp, homo sapien
aagtcctgatataaataacctcaaayagtctactcagagaaaaaaaagaa

SEQ ID NO: 23614 - DNA, 50 bp, homo sapien
taaatctcctagcagtttccagcaaycagaagactgactctcataacaag

SEQ ID NO: 23615 - DNA, 50 bp, homo sapien
gtcagccctatggcttttgacatccyacttatgaaaaatataagaaacat

SEQ ID NO: 23616 - DNA, 50 bp, homo sapien
tgattcaattgtaagactttctgaasaacaaatcaagactatttagtacc

SEQ ID NO: 23617 - DNA, 50 bp, homo sapien
ctcatctaaaatataactataataamagttacctgcagaggattaacagg

SEQ ID NO: 23618 - DNA, 50 bp, homo sapien
ttggtctctgattctattcccgaagrcattcccaagaaggacatcgttta

SEQ ID NO: 23619 - DNA, 50 bp, homo sapien
cacaaatgggtgtgtataactcacayagtagcttacaactgtagcaagtc

SEQ ID NO: 23620 - DNA, 50 bp, homo sapien
acaagacagcattacagagttatcamatgacacttaattaaaattggcac

SEQ ID NO: 23621 - DNA, 50 bp, homo sapien
aagcttctaggaaagaacacctccaygatgggcagatgaaagtaagattt

SEQ ID NO: 23622 - DNA, 50 bp, homo sapien
tgtgatcacagcagccaggttcgcaygccctaggaatgaggttaaatgtt

SEQ ID NO: 23623 - DNA, 50 bp, homo sapien
aaccgcaaaattatacactctttgayaaagaccaagaataagtcatggca

SEQ ID NO: 23624 - DNA, 50 bp, homo sapien
caaatcataattatgtcttctgatastactgttagaattttctgcctgtg

SEQ ID NO: 23625 - DNA, 50 bp, homo sapien
atttttaaataccttagatgctatartaataaaaatattaaaatatatat

SEQ ID NO: 23626 - DNA, 50 bp, homo sapien
cagatttagttactcctgagtatgcraattcttttccaaaacttatttct

SEQ ID NO: 23627 - DNA, 50 bp, homo sapien
tttgaaacagatgaaacattttatarctagagccaaataactaaattata

SEQ ID NO: 23628 - DNA, 50 bp, homo sapien
catctgtaacatggctgtaataatgrcacctactcgttgctgttagcatt

SEQ ID NO: 23629 - DNA, 50 bp, homo sapien
aaactcagggtttggaatggatgtayagttatcttaagttctcatcttgt

SEQ ID NO: 23630 - DNA, 50 bp, homo sapien
tttgcttatacttcctgacaacaagmagaaaccttagaagagtggtctgt

SEQ ID NO: 23631 - DNA, 50 bp, homo sapien
tgtcattctggccctgtgaagaaacyatgaggagaatctggtcgatgcat

SEQ ID NO: 23632 - DNA, 50 bp, homo sapien
attaattcacaccagtaaaacagagwcaatgtaagaaacagaagcatcct

SEQ ID NO: 23633 - DNA, 50 bp, homo sapien
gaccctttcatccgcagggctgtcaycttttctccaagctccctgagaca

SEQ ID NO: 23634 - DNA, 50 bp, homo sapien
ttttcaattctgaaatttccattgamgtcttttgtatcatttctctgttg

SEQ ID NO: 23635 - DNA, 50 bp, homo sapien
tgttaacccattgttctaaggcatcragtctataataacacaagagctgt

SEQ ID NO: 23636 - DNA, 50 bp, homo sapien
aacaaaatttaaaacagtacaggaaraaagaatgtatatgggaaatcata

SEQ ID NO: 23637 - DNA, 50 bp, homo sapien
ttcatctttgtttctctcacacaacwatcattagagttctgtcagattat

SEQ ID NO: 23638 - DNA, 50 bp, homo sapien
accatggaaggctgcttcaatgtcasgactggatcaggcttcactgtttt

SEQ ID NO: 23639 - DNA, 50 bp, homo sapien
atagacacttgccaaaagtacactaratttacgaaaacactttctgtttg

SEQ ID NO: 23640 - DNA, 50 bp, homo sapien
gtattaattcctattgaacttactaycctttctattgaattttagtgcag

SEQ ID NO: 23641 - DNA, 50 bp, homo sapien
tattcattttgacacaaaagttaatraaggacatgacaaactcttttcat

SEQ ID NO: 23642 - DNA, 50 bp, homo sapien
cacacgcagttataaacaattatacrgtaagattctgcttataatatcac

SEQ ID NO: 23643 - DNA, 50 bp, homo sapien
aggcatggtagtgagggtagagagasacgaaacaattatttatggtgaca

SEQ ID NO: 23644 - DNA, 50 bp, homo sapien
ccagcggtggcggccctggatgtctraaatgctgtccagaacattgagag

SEQ ID NO: 23645 - DNA, 50 bp, homo sapien
actgtttcgatgcaacagaaagatcmacaaattgaggatattgagagaaa

SEQ ID NO: 23646 - DNA, 50 bp, homo sapien
tgtgtacaaatatatgtataatcatyaaagtcacttaagcaaacatataa

SEQ ID NO: 23647 - DNA, 50 bp, homo sapien
aagcttccttactttggagaaattayaaatgtgagtgggagacctcatgc

SEQ ID NO: 23648 - DNA, 50 bp, homo sapien
cagggtcaccaggagtgttcttgagwcctgctagtggcagtgagttctac

SEQ ID NO: 23649 - DNA, 50 bp, homo sapien
ttctgcacttcagcttcttcccatasgcgctctgacaggtcctggctctc

SEQ ID NO: 23650 - DNA, 50 bp, homo sapien
gtcgataccattgtgaaccttaggcrcaatgtaatgcacttattaaataa

SEQ ID NO: 23651 - DNA, 50 bp, homo sapien
cttcatttgcaggttttacttgatasagtttattatgtcatggtaacatt

SEQ ID NO: 23652 - DNA, 50 bp, homo sapien
attttttgcactatgctaggcattgyatgttgcacaattggataaaagtc

SEQ ID NO: 23653 - DNA, 50 bp, homo sapien
aacgttcttcttctccctgccagtaycttaatgatttctgattttaagtt

SEQ ID NO: 23654 - DNA, 50 bp, homo sapien
caaaaagggtgttgaggtatagctgycaaaaccaattaaaagtaaccaga

SEQ ID NO: 23655 - DNA, 50 bp, homo sapien
ctgtacaccccttcaccatgtaagcraactgaaaaattgccatgaaaaag

SEQ ID NO: 23656 - DNA, 50 bp, homo sapien
gcctactatacccttatgctagatgraatagcctattgttcctagggtgc

SEQ ID NO: 23657 - DNA, 50 bp, homo sapien
tacaacccacagagagtaggagttakgatgaggaaaaatggcctttaaag

SEQ ID NO: 23658 - DNA, 50 bp, homo sapien
tggagccaggaggcagcatgctgtasgatcacagaattagtgaggcacac

SEQ ID NO: 23659 - DNA, 50 bp, homo sapien
taaatgaaatatctctgccctttatsaaattgtgcagatttggtcaccat

SEQ ID NO: 23660 - DNA, 50 bp, homo sapien
tggaggaacaccatcatatagaggakattcgatcaaagcaaaggattttt

SEQ ID NO: 23661 - DNA, 50 bp, homo sapien
aattcctctttcatgagcattaaatyagtccagttgtttagaactgctag

SEQ ID NO: 23662 - DNA, 50 bp, homo sapien
taataaagggttaaaaatataataaygacttgcaaacctgttggtaaatt

SEQ ID NO: 23663 - DNA, 50 bp, homo sapien
catgaaaagcagactctgggaattamctagagaaatcatttgtcaaacca

SEQ ID NO: 23664 - DNA, 50 bp, homo sapien
tctttgagtaataaaaatggagaaawgcgtgactgacttatttaccatga

SEQ ID NO: 23665 - DNA, 50 bp, homo sapien
taaagcttataagtgccactttcccwattttaaaacattcttttagtatg

SEQ ID NO: 23666 - DNA, 50 bp, homo sapien
agctcgttgtaacctccacctcccayactcaagcggtcctcatgcctcaa

SEQ ID NO: 23667 - DNA, 50 bp, homo sapien
ctccagcttggtacatcgtaaccaartctcactagtctcagagcctgcac

SEQ ID NO: 23668 - DNA, 50 bp, homo sapien
atattcctctttctttggataagcaktataaatcccatgacttacttgac

SEQ ID NO: 23669 - DNA, 50 bp, homo sapien
aaaatagcttacctttttctgattayaagtaaattctcattgtaaaacac

SEQ ID NO: 23670 - DNA, 50 bp, homo sapien
gatgagagtatcctagagctctagaygcttaccattttaggaggtttgta

SEQ ID NO: 23671 - DNA, 50 bp, homo sapien
aaagcctgaatgtcaatgaagatgcyattattattaaagaagcaagccgc

SEQ ID NO: 23672 - DNA, 50 bp, homo sapien
ttcttttttcctgtcttataaagaaytcgagacaaataggagaatatatt

SEQ ID NO: 23673 - DNA, 50 bp, homo sapien
attgacctaaaaacctacccagaaastattggcatgagaatttggcagct

SEQ ID NO: 23674 - DNA, 50 bp, homo sapien
tcttttaattgtcattaacaagatasaacattttgaattaaataccacaa

SEQ ID NO: 23675 - DNA, 50 bp, homo sapien
taccagcactccaaggtatggcatawtacagcaaaactggtggtggtaac

SEQ ID NO: 23676 - DNA, 50 bp, homo sapien
atgccctcaagcaatgccacgtcacmagtatctcctcctattttagggca

SEQ ID NO: 23677 - DNA, 50 bp, homo sapien
gtgacagcctgactatgataaaataycctgataaaggcaaaagcaatgtg

SEQ ID NO: 23678 - DNA, 50 bp, homo sapien
taaaacctcattttccacagtggtargtcactagataatgtgtaaaataa

SEQ ID NO: 23679 - DNA, 50 bp, homo sapien
aagcaccacatatatacacggtaatraagactgccccatgtttccttttc

SEQ ID NO: 23680 - DNA, 50 bp, homo sapien
taagagatttgatcatcaatagcaakaaatacctttcatttgaactgtgt

SEQ ID NO: 23681 - DNA, 50 bp, homo sapien
gactatcaagtctacttttattcaawacattgttactgagtatctctcct

SEQ ID NO: 23682 - DNA, 50 bp, homo sapien
aataaaagtagacttgatagtcctargtatcacagtggggaaaatagaac

SEQ ID NO: 23683 - DNA, 50 bp, homo sapien
acacagctcactgagtgtaaatggaragaactaaacaggctctcattggt

SEQ ID NO: 23684 - DNA, 50 bp, homo sapien
catccctcacttcttacaaaaccacygcatgagtcgaaattaatgcatgt

SEQ ID NO: 23685 - DNA, 50 bp, homo sapien
ttaggattttaaacaccatttatcaygcagagttgcaaaaacatagatca

SEQ ID NO: 23686 - DNA, 50 bp, homo sapien
catgcctgcctacttctctatggcamcaaatcggcagttctcaatgctga

SEQ ID NO: 23687 - DNA, 50 bp, homo sapien
cttgactatgtcttgtgaatcattasaagacattgtttacaagacgtgtc

SEQ ID NO: 23688 - DNA, 50 bp, homo sapien
taaggagactttgaggagttgagtcwctaggctaaccaggacccagacca

SEQ ID NO: 23689 - DNA, 50 bp, homo sapien
taggaaatttgaccattttcatagcrgaaagaaatcaaaacaacgaaaga

SEQ ID NO: 23690 - DNA, 50 bp, homo sapien
ttttctcctttctgcttttagactartagacaaagttgtaggtagagacc

SEQ ID NO: 23691 - DNA, 50 bp, homo sapien
gattacctgaacaaggtagtaacacygagcattgaaataaatggacagat

SEQ ID NO: 23692 - DNA, 50 bp, homo sapien
ctctatttccttgctagaataatcaktagcttccaaatcatttataggtt

SEQ ID NO: 23693 - DNA, 50 bp, homo sapien
agatgaagaaaccatttgtcagacaytcagcgggtgaaggacaaacaaga

SEQ ID NO: 23694 - DNA, 50 bp, homo sapien
actcagagtgtttgagaaagtattamgagaaaggcttgtcattgagttgg

SEQ ID NO: 23695 - DNA, 50 bp, homo sapien
acacacacacacacacgttttcttaygatggatgtaacatgagaccagaa

SEQ ID NO: 23696 - DNA, 50 bp, homo sapien
gaaaaccgatgtgcctttttgcttcmcatgtttaactaaagtcggttata

SEQ ID NO: 23697 - DNA, 50 bp, homo sapien
agaaattcaacttagttctctagtamatgctataaaagctacattttcac

SEQ ID NO: 23698 - DNA, 50 bp, homo sapien
tctgctcccttgctggacctccatasgttgtagtcatatctcagttatag

SEQ ID NO: 23699 - DNA, 50 bp, homo sapien
agtttttaactaaacttggttgaaasaatcagctctttgccgatagataa

SEQ ID NO: 23700 - DNA, 50 bp, homo sapien
tattattttctttgcacataaataarctgttaagaattataatacatcat

SEQ ID NO: 23701 - DNA, 50 bp, homo sapien
tgtgaaatatagtcatccagaccaakacagtatcatcatttgactctttc

SEQ ID NO: 23702 - DNA, 50 bp, homo sapien
tgccatgctaggaaatccagactcaraccggcaagtgacaagaaacaagg

SEQ ID NO: 23703 - DNA, 50 bp, homo sapien
ctttcatgttaaggaagaattccaamagaggaatgcacaagaacgcacaa

SEQ ID NO: 23704 - DNA, 50 bp, homo sapien
agcaaaatatatttgtgatggtttasaaaaaatggtgccaattctttcat

SEQ ID NO: 23705 - DNA, 50 bp, homo sapien
agtcatcataataaagcattatagaytagaccaccaaggagaactttatt

SEQ ID NO: 23706 - DNA, 50 bp, homo sapien
agattagatggatcattataaaaagrataactgagtggtttatctttatg

SEQ ID NO: 23707 - DNA, 50 bp, homo sapien
tgttgtaggtacagaagggactaatracagaagtggtatatatggaccct

SEQ ID NO: 23708 - DNA, 50 bp, homo sapien
gagatgctttaggcaaatttgattargagagaggatgctgccagttgtgt

SEQ ID NO: 23709 - DNA, 50 bp, homo sapien
cattgcacttgaaagttgtccctaayacctcttaaatattccctcctttg

SEQ ID NO: 23710 - DNA, 50 bp, homo sapien
ttagaaactacagagccttctggcckaaactaagagtagcaagtgtgtat

SEQ ID NO: 23711 - DNA, 50 bp, homo sapien
gtaaagtgaaagtgagcttctctccmatcaggataaacttagcggggtcc

SEQ ID NO: 23712 - DNA, 50 bp, homo sapien
gccaaagggctactaagataaaagcragtttcaagtaacttaaattgctg

SEQ ID NO: 23713 - DNA, 50 bp, homo sapien
tacacaggccctcccaggtagagcayggactctttgaaaggacgatgcag

SEQ ID NO: 23714 - DNA, 50 bp, homo sapien
gcctatgtttattacagcttactcaktcaacgttatttgggtagcaactt

SEQ ID NO: 23715 - DNA, 50 bp, homo sapien
gaacatagtcctgaatcatgcaacartatgctagacagatagtccttaga

SEQ ID NO: 23716 - DNA, 50 bp, homo sapien
tttcttcaaaaaggagctccatatawgctaaactaaattctggcccctga

SEQ ID NO: 23717 - DNA, 50 bp, homo sapien
ttcaccctcacttttaacaactcatractgggtcttatgattcttggtcc

SEQ ID NO: 23718 - DNA, 50 bp, homo sapien
agtcagacacaaaccggtgttatcamacagaactgtcacgtatttgatct

SEQ ID NO: 23719 - DNA, 50 bp, homo sapien
ggagaatgatttttcagaattacaakgcctaatgctgtatatcttgtgaa

SEQ ID NO: 23720 - DNA, 50 bp, homo sapien
cctcttagagctagctggattgaaartgtttccattcatatcaaagtctc

SEQ ID NO: 23721 - DNA, 50 bp, homo sapien
agaaaaaagcccatttaagatgtgaktaggtcatcattggtttgatttca

SEQ ID NO: 23722 - DNA, 50 bp, homo sapien
gtccaatatggggtctaaataggaarcacgaggaacttttcaaaaaaggc

SEQ ID NO: 23723 - DNA, 50 bp, homo sapien
tctgttacctaacttattcagagcascttacatcatataatcacagggca

SEQ ID NO: 23724 - DNA, 50 bp, homo sapien
tcattttagctccagcactttgcacyataactggaccttcatcagtcagc

SEQ ID NO: 23725 - DNA, 50 bp, homo sapien
taaatcatgctctattgtatcatgamaagggtaaagaaatcatgctgtca

SEQ ID NO: 23726 - DNA, 50 bp, homo sapien
ttaatgggttgacttagaaaagtcaragtaattcagtgggatttgagatg

SEQ ID NO: 23727 - DNA, 50 bp, homo sapien
tgtgttaaagcccattgccttcctcrataaaataaagcatgatacccagg

SEQ ID NO: 23728 - DNA, 50 bp, homo sapien
aaaaagcagggaaacaaaataatgayagatgacaagcattgctgtgctgg

SEQ ID NO: 23729 - DNA, 50 bp, homo sapien
aagtgaagttctccactaggcaaaaygtgtacactatgggaggcatttct

SEQ ID NO: 23730 - DNA, 50 bp, homo sapien
cataatgggaacataaattggaacarcttctacagtgggtgttttgataa

SEQ ID NO: 23731 - DNA, 50 bp, homo sapien
catctctgaattgtaaggataagtaygtaaagtgcctaaaactataagaa

SEQ ID NO: 23732 - DNA, 50 bp, homo sapien
aggaatggtgtgagataatacacaaygaatagctatcagaaattcaacag

SEQ ID NO: 23733 - DNA, 50 bp, homo sapien
aaagaaatttgggacagctgctgaamgaaaaaacaggacttgcttaatga

SEQ ID NO: 23734 - DNA, 50 bp, homo sapien
gttcagtgaatgttaatgtttgcaastgacatattactctcatccacttg

SEQ ID NO: 23735 - DNA, 50 bp, homo sapien
tgacaatttttcatgatttgattcartcgtgggttatgagaataagcccc

SEQ ID NO: 23736 - DNA, 50 bp, homo sapien
atttgtaaagttttctttgacatgasgaattttaattgagattgggaaaa

SEQ ID NO: 23737 - DNA, 50 bp, homo sapien
ttgtcagaaccatactggtgactcastcttaacatggttccgtcagagtg

SEQ ID NO: 23738 - DNA, 50 bp, homo sapien
taaagaaatatgattcacatttttayaatactattagcattcacaacgtc

SEQ ID NO: 23739 - DNA, 50 bp, homo sapien
cataccacattgattctaccacaaargttgtatgatcattgtaacaatat

SEQ ID NO: 23740 - DNA, 50 bp, homo sapien
gtggcctcccctcactgtgaactcaycataagccctccgagttggtatac

SEQ ID NO: 23741 - DNA, 50 bp, homo sapien
atgctagatagatgtaaattttccayagaaagaagtggtttgggtagtca

SEQ ID NO: 23742 - DNA, 50 bp, homo sapien
caaccaaaaagcaaactgtcacagartagaattcaatatgaaatgagtga

SEQ ID NO: 23743 - DNA, 50 bp, homo sapien
aggtatggggtacctggagggaagamgtgtttatatcactcccataacaa

SEQ ID NO: 23744 - DNA, 50 bp, homo sapien
gcgttggaagtgagatggaccttaaytgggaagacagaagcaggaagagc

SEQ ID NO: 23745 - DNA, 50 bp, homo sapien
tgcagctggaacttgatatgcaggasagagtagcagagaaaaattctcta

SEQ ID NO: 23746 - DNA, 50 bp, homo sapien
aaagaacatgagcggagagacaacaytggtgccatagacagtgtgcagtg

SEQ ID NO: 23747 - DNA, 50 bp, homo sapien
tcttgaataattgatgtagctaaagwcaattattcataccaggcttagct

SEQ ID NO: 23748 - DNA, 50 bp, homo sapien
ccatactggtttcttcctttcttacrcttccatagagtttcaaaaaacat

SEQ ID NO: 23749 - DNA, 50 bp, homo sapien
gtgcttcagggatggaagactcagaygctacaggcttgacctgccttcaa

SEQ ID NO: 23750 - DNA, 50 bp, homo sapien
ctctggagatggacatggggattcaktagagaagaagaaatggaaggcat

SEQ ID NO: 23751 - DNA, 50 bp, homo sapien
ccaactttatcctccttctcctttgracagtgatcctctaagaaagcagg

SEQ ID NO: 23752 - DNA, 50 bp, homo sapien
ttaaaataatttaccatttaaaatcrcaagacaaatattttataagataa

SEQ ID NO: 23753 - DNA, 50 bp, homo sapien
acaagttaccagaagacgcagatcaygtgaacatagtataattgtgatac

SEQ ID NO: 23754 - DNA, 50 bp, homo sapien
atcaaataagcttgggtatttttacrcactggactgttagtagaggagtc

SEQ ID NO: 23755 - DNA, 50 bp, homo sapien
attttcttgagtctgcaacaattatyacatgagcttgatgttatgctctt

SEQ ID NO: 23756 - DNA, 50 bp, homo sapien
tctgattcttcacaagaatgacaaasaaatttacaaagagagtctcactt

SEQ ID NO: 23757 - DNA, 50 bp, homo sapien
cataaaacctttgaaggtacttaccratgcactttctggatcacagtgac

SEQ ID NO: 23758 - DNA, 50 bp, homo sapien
tgataggaatttgctgactagaagawtatcagctgacagcactaaatgaa

SEQ ID NO: 23759 - DNA, 50 bp, homo sapien
tttccctcaccagattatgatctcckcttggtaagggatgctatcttatc

SEQ ID NO: 23760 - DNA, 50 bp, homo sapien
tccacatagtacatggacaagacctmaataaacattctgctaatctattg

SEQ ID NO: 23761 - DNA, 50 bp, homo sapien
gatattaacatatcttgatatccaaygaaaatgaaataaacctaatctta

SEQ ID NO: 23762 - DNA, 50 bp, homo sapien
atgggtatatgaatatatttatctcrgactagctttgtgagaagacatct

SEQ ID NO: 23763 - DNA, 50 bp, homo sapien
ctagtctgtagaaatacagcattgawcaaaattagacttttctgcaccga

SEQ ID NO: 23764 - DNA, 50 bp, homo sapien
ggacgctcactaattgcagtatgagsaaaataagagcccttctgcagagt

SEQ ID NO: 23765 - DNA, 50 bp, homo sapien
tatctcttaaacactcagcacagaayctatacctagaagaactttagtag

SEQ ID NO: 23766 - DNA, 50 bp, homo sapien
ttttactaatgtactcaagttcataygatgatttaattcaggatttgaca

SEQ ID NO: 23767 - DNA, 50 bp, homo sapien
tgatacctacatctcgaatactttaygcacatccattcaaaagagatttc

SEQ ID NO: 23768 - DNA, 50 bp, homo sapien
cttagccacattaccgttaaagaaasttggatgtggatcgacacaaataa

SEQ ID NO: 23769 - DNA, 50 bp, homo sapien
catctatcaaaactgggccacctgaytcaaaaaccattttattccaagtt

SEQ ID NO: 23770 - DNA, 50 bp, homo sapien
tcctttttgaggaggaataataataycaagttgtactttttgagtttcca

SEQ ID NO: 23771 - DNA, 50 bp, homo sapien
gattcttctattaagctaaactaccrctggataaatgtgaatgcttaatt

SEQ ID NO: 23772 - DNA, 50 bp, homo sapien
caatctattataatgctaatcagcakggttgcacctgtttgagatttagt

SEQ ID NO: 23773 - DNA, 50 bp, homo sapien
tgtaaaattccattttatacttggasaagaagagagaacaaaggtgagtt

SEQ ID NO: 23774 - DNA, 50 bp, homo sapien
cctgaactctagactttatatatggsattgccttcaggtcctcagctttc

SEQ ID NO: 23775 - DNA, 50 bp, homo sapien
gacttatgatgcgcaatagaaatgawgtataattaatatattatgcataa

SEQ ID NO: 23776 - DNA, 50 bp, homo sapien
ttcaggctaagttatggaaaatcagsatgagacagagagaagggacagag

SEQ ID NO: 23777 - DNA, 50 bp, homo sapien
ttgtacaaagagaataagatgagtayatgcctttgaggagattacagtag

SEQ ID NO: 23778 - DNA, 50 bp, homo sapien
ccctccaaagaaatactgtctaaccyatctcacgcacgtatttacatctc

SEQ ID NO: 23779 - DNA, 50 bp, homo sapien
acctctagtcctcaggcatgtcacaytgtctatttcctaggttttcatac

SEQ ID NO: 23780 - DNA, 50 bp, homo sapien
tgatgaaattagatagaaatgcatascaagggctgactcaagggtgagaa

SEQ ID NO: 23781 - DNA, 50 bp, homo sapien
aagtattttaagatctctccagatayaaggtgtagccagagggaagaaca

SEQ ID NO: 23782 - DNA, 50 bp, homo sapien
atgtaattttagaactagaaacaaargtcaactgttttagatgaacatat

SEQ ID NO: 23783 - DNA, 50 bp, homo sapien
agagcagagtgtgagaaaacaagaamctaaaatggaaatctgcaattaca

SEQ ID NO: 23784 - DNA, 50 bp, homo sapien
ggtttcttttttccacgtaatgtacractccattttaggacacaaatgaa

SEQ ID NO: 23785 - DNA, 50 bp, homo sapien
gaatgaaccaagtgaggagtctctaygtgttgtgccatgctatgctagct

SEQ ID NO: 23786 - DNA, 50 bp, homo sapien
gtgtccttatcattacaataaactaygttgaacacagcacaattttattt

SEQ ID NO: 23787 - DNA, 50 bp, homo sapien
tctaaaaatcactagcctagttagtkaagcctatctcctccatccagata

SEQ ID NO: 23788 - DNA, 50 bp, homo sapien
ttgagttcttgagttaggtgatttayggaggacttaaggaagcaggcttc

SEQ ID NO: 23789 - DNA, 50 bp, homo sapien
aaagggggagatttattggctcccasaatggaaagaaaccttaaataaca

SEQ ID NO: 23790 - DNA, 50 bp, homo sapien
taactgctcctgtataagatcaaaaygcttggaaaattgttggaaaactc

SEQ ID NO: 23791 - DNA, 50 bp, homo sapien
tatttttttgtttctactcagtatcmcatttatcttctgcgatttataaa

SEQ ID NO: 23792 - DNA, 50 bp, homo sapien
taggcacaaagcaatgtggagataargaactgactgagacacttgtccct

SEQ ID NO: 23793 - DNA, 50 bp, homo sapien
tcttcaatacatttttattgctctcrgaaccaaatcaaaagtccccctct

SEQ ID NO: 23794 - DNA, 50 bp, homo sapien
gtgcaacagaggtgctgaatgaagamctatcgatgattgattgatacgtt

SEQ ID NO: 23795 - DNA, 50 bp, homo sapien
atagaccaaggacaagcggcattgayaccacccgacagcttgttagcaat

SEQ ID NO: 23796 - DNA, 50 bp, homo sapien
gtccaacccctcactttacagagaamgaatcttaggaaaagagaaatgac

SEQ ID NO: 23797 - DNA, 50 bp, homo sapien
gaggcctgagaaccagggaaattgayggtataactctgagtctgaagtca

SEQ ID NO: 23798 - DNA, 50 bp, homo sapien
ccccatacatcattttgaatcagtgraagttgttgtcatgtggaatttgt

SEQ ID NO: 23799 - DNA, 50 bp, homo sapien
aatgtttaaaaataacaatatataastaaactggcttgcaaaaatcactc

SEQ ID NO: 23800 - DNA, 50 bp, homo sapien
cctctcttaggctctttatattgacmcactcttctcttgccaaaagcttg

SEQ ID NO: 23801 - DNA, 50 bp, homo sapien
tacacagcaggtgtcagtggtatacrggtgagttttaggacagagatgct

SEQ ID NO: 23802 - DNA, 50 bp, homo sapien
attgatttaattgataataattagamaaactgaactaaatttttttaaca

SEQ ID NO: 23803 - DNA, 50 bp, homo sapien
gcctttgcaaatcagccttatttcastagagatgagactgagactcgatg

SEQ ID NO: 23804 - DNA, 50 bp, homo sapien
tcccagtgctagttgctgcttctccrgatgttttttatttcccccgagtg

SEQ ID NO: 23805 - DNA, 50 bp, homo sapien
aagaattatctccaaaaatttataayatgattcacagcttaatactcacc

SEQ ID NO: 23806 - DNA, 50 bp, homo sapien
tgatgttgctgtttgtttcaaaatayaggtttacctccacaaggtagcag

SEQ ID NO: 23807 - DNA, 50 bp, homo sapien
gagatgatgtgataattttgttggasagttcccttgaaaggcttctgaaa

SEQ ID NO: 23808 - DNA, 50 bp, homo sapien
atagttctttattagcataataatasagcatttgtattgatctcttcaat

SEQ ID NO: 23809 - DNA, 50 bp, homo sapien
taatttcttcctatgcataaaaagarcagcgtgctagaaaaagaatagag

SEQ ID NO: 23810 - DNA, 50 bp, homo sapien
gtttacctggaatgaggcatacaatwaggactggataataggatagagcc

SEQ ID NO: 23811 - DNA, 50 bp, homo sapien
ttaaaaattcaaactgttttcaatastacgaaataagaaaaaaatttatc

SEQ ID NO: 23812 - DNA, 50 bp, homo sapien
acttatcatgtgtaaagatcacagarggttgagtcttgagacaagcaagc

SEQ ID NO: 23813 - DNA, 50 bp, homo sapien
aaggtagacagtatcttcacattacrgagttgaaagctcagggttgaagc

SEQ ID NO: 23814 - DNA, 50 bp, homo sapien
tccaacttccacatctataaaggtaraattatgagtataaactataccac

SEQ ID NO: 23815 - DNA, 50 bp, homo sapien
ccaccaatccctattagaccattccraataggcatcccataaatatcttt

SEQ ID NO: 23816 - DNA, 50 bp, homo sapien
aagagccctaaaatctgctttggatkacaatcaattagaaatgtttcaaa

SEQ ID NO: 23817 - DNA, 50 bp, homo sapien
gctattgatggatcaatataagaggraatatctataacaaacttgtttag

SEQ ID NO: 23818 - DNA, 50 bp, homo sapien
ggagtgaaatcttagtggtattaacygagaatttagttctcaattgttct

SEQ ID NO: 23819 - DNA, 50 bp, homo sapien
agacagaacagctggttctctctgakctactgttttggattcagctgcag

SEQ ID NO: 23820 - DNA, 50 bp, homo sapien
tatttctgactcagtcataaaacccragacttttgatttgcccaaatcca

SEQ ID NO: 23821 - DNA, 50 bp, homo sapien
atttttgtaagcaaatagatgtcacrgaaggatttttctggcaaagaata

SEQ ID NO: 23822 - DNA, 50 bp, homo sapien
ctgattgcaaaaggattgatttccarcaaatgtggcaaaatgagtaagaa

SEQ ID NO: 23823 - DNA, 50 bp, homo sapien
atcatgatgctagctaaagggcatgycaatgtattattcaaatgcatctt

SEQ ID NO: 23824 - DNA, 50 bp, homo sapien
gaccatgtttattttctgtttttaayacttactttgtatggcccatttgt

SEQ ID NO: 23825 - DNA, 50 bp, homo sapien
cctgacactatttataaagcactaascaaacaaactaaatgatatatgtt

SEQ ID NO: 23826 - DNA, 50 bp, homo sapien
cttctcagaaaagagaaaattgatakcttcggcaagccataatgcaaatg

SEQ ID NO: 23827 - DNA, 50 bp, homo sapien
gcttaacaaagggcttgccatacacyggcgattattgttattacttagca

SEQ ID NO: 23828 - DNA, 50 bp, homo sapien
ttctcaaaacactctcattgtaaacrgattttatcattctttggctctcc

SEQ ID NO: 23829 - DNA, 50 bp, homo sapien
ttgctttcacataacatcatagagaktcagaagatttatacatgaataca

SEQ ID NO: 23830 - DNA, 50 bp, homo sapien
gttgtttttcctcaaaggtaaaagayagaagttcatttgtgtgccataca

SEQ ID NO: 23831 - DNA, 50 bp, homo sapien
tagattacctctgctctctaagacaygccagtaatctaaagaggatatct

SEQ ID NO: 23832 - DNA, 50 bp, homo sapien
atttcttttttacgaggctcatcaaratgtatttcagttggttaactaat

SEQ ID NO: 23833 - DNA, 50 bp, homo sapien
agggttaaccccattctagtaattcmatccaccttgctaccattaagttc

SEQ ID NO: 23834 - DNA, 50 bp, homo sapien
tgcccttgtcctgtgtactgtagaaygtttcaaagattcctgacctctac

SEQ ID NO: 23835 - DNA, 50 bp, homo sapien
aagagcattcaagtgtggtgtagatkacatagaagtttaatatgcataca

SEQ ID NO: 23836 - DNA, 50 bp, homo sapien
tccatcccgtaggacagcatttaacraacacttcttgaataaatgaaggc

SEQ ID NO: 23837 - DNA, 50 bp, homo sapien
tagcatgaagaactaggatgtacgawgtattgatagcagtgttctgttgt

SEQ ID NO: 23838 - DNA, 50 bp, homo sapien
tgctgctggaaaataatgaagatgtyaatccacaaagcaactaatggaca

SEQ ID NO: 23839 - DNA, 50 bp, homo sapien
agtctaacagtattaacagtctaccrccaaaaattcctgacaaatttgtt

SEQ ID NO: 23840 - DNA, 50 bp, homo sapien
tttaatttttaaactactaattcaawgttattcatggaaatgtaattttt

SEQ ID NO: 23841 - DNA, 50 bp, homo sapien
gcttacccagcaaattgttaaaataygacaaatgttaaaatgcccatttc

SEQ ID NO: 23842 - DNA, 50 bp, homo sapien
aataagtaaatgaagaattttgtaascattttttccgcactggacatgat

SEQ ID NO: 23843 - DNA, 50 bp, homo sapien
gtttactataaaatggattgacttaygtatgtatgcatgtaacatgcata

SEQ ID NO: 23844 - DNA, 50 bp, homo sapien
taaaaagttttattggcctcaggctkaagtttgcaattatattccaaata

SEQ ID NO: 23845 - DNA, 50 bp, homo sapien
atgttcacattaaccagaattttaaractctttgttgataatattttatg

SEQ ID NO: 23846 - DNA, 50 bp, homo sapien
tggtcagtccacctgccttgagtgascacctactgtgcattagccctgag

SEQ ID NO: 23847 - DNA, 50 bp, homo sapien
tcaatggtagctatgtaagcagctgyagaaaaagttcctcagaattcctg

SEQ ID NO: 23848 - DNA, 50 bp, homo sapien
tttggataagccttacctgactgtaygaacttgtagataaacgaagaaga

SEQ ID NO: 23849 - DNA, 50 bp, homo sapien
taagaagagagtttaaataatttcayccataattggaattattctctcaa

SEQ ID NO: 23850 - DNA, 50 bp, homo sapien
ctgaactgttatctacctttttacartaatagaaatgagtttataaataa

SEQ ID NO: 23851 - DNA, 50 bp, homo sapien
aacaaaggtgagagataaagatgagratgatagcggtgaggatagttgaa

SEQ ID NO: 23852 - DNA, 50 bp, homo sapien
ttgaaaaaaaagcgatagaatgttaraccacccatctcatcatatatcta

SEQ ID NO: 23853 - DNA, 50 bp, homo sapien
cactcttcctgtcctgtctgtgttayaccaaaaaggcatgagcattatat

SEQ ID NO: 23854 - DNA, 50 bp, homo sapien
atatggagagaaatatgatgaagatkaaatatgacaacagaatcaaggta

SEQ ID NO: 23855 - DNA, 50 bp, homo sapien
gtcaattgctatcatcaactgttgasgtaacaataatgttaatatttccc

SEQ ID NO: 23856 - DNA, 50 bp, homo sapien
gaaaggcatggtcagaaaaatcaaamtgctataaaacaaatgtaagggag

SEQ ID NO: 23857 - DNA, 50 bp, homo sapien
ttagtgtggtccatcagtaattattraaagagactgtcctgtccctttta

SEQ ID NO: 23858 - DNA, 50 bp, homo sapien
aatatgaacctatccgtaatagtaaytgttatgcacaaggagtgatcagt

SEQ ID NO: 23859 - DNA, 50 bp, homo sapien
tgcaattacaaattaaatctcatcamtatggaaatgttgcagcattttta

SEQ ID NO: 23860 - DNA, 50 bp, homo sapien
agtttcatatagacagaaattgataygtagatttatagatatagcgatat

SEQ ID NO: 23861 - DNA, 50 bp, homo sapien
agaaaacaatctattttagacttgayatctttacacatggacttggctag

SEQ ID NO: 23862 - DNA, 50 bp, homo sapien
atgacaaaggaatccttgtagttcastccatcacagtaggagaccacaga

SEQ ID NO: 23863 - DNA, 50 bp, homo sapien
gaatataataggctaacaatgggagmcagttaatatttctttcaactaag

SEQ ID NO: 23864 - DNA, 50 bp, homo sapien
gatttcaaccacttaaattctaatcyctgtctcctcagtttactactgca

SEQ ID NO: 23865 - DNA, 50 bp, homo sapien
agcttgggcaagccgtttctctagtmaattgctatcatcaactgttgacg

SEQ ID NO: 23866 - DNA, 50 bp, homo sapien
catacaatgaagcacaatctcccacyattaccccattgcacacacatcca

SEQ ID NO: 23867 - DNA, 50 bp, homo sapien
aacgcagggttggaaaatatgagtgraactgccaaagcaaaacatttaaa

SEQ ID NO: 23868 - DNA, 50 bp, homo sapien
ggctaagcatatttctccaaacctcyatactgcgttcttgtcctcaagcc

SEQ ID NO: 23869 - DNA, 50 bp, homo sapien
tgttgggtttatcacctggaagataygctgattctctgtttgttaaactg

SEQ ID NO: 23870 - DNA, 50 bp, homo sapien
taaccataccagaatcgcaccaaacragtaataaactaactgcagagagc

SEQ ID NO: 23871 - DNA, 50 bp, homo sapien
attgaaaatcattttgcatgtgttcmgaaacaattagatatatgttaatg

SEQ ID NO: 23872 - DNA, 50 bp, homo sapien
ctctgattattcctaaacagttatcrcaattgtcttagcccaaatccatt

SEQ ID NO: 23873 - DNA, 50 bp, homo sapien
ttctagaattttaagctaccagaacycttacactgcaaggacaaatacta

SEQ ID NO: 23874 - DNA, 50 bp, homo sapien
attatagacttttctttttcaccacratttgaagctcagtttaaatccaa

SEQ ID NO: 23875 - DNA, 50 bp, homo sapien
gtttcacagccatgggcaagattatmagtacagtaccttgatcagaaata

SEQ ID NO: 23876 - DNA, 50 bp, homo sapien
gtttacattattttgttcctaagaartatgatttggtttcttaatccaaa

SEQ ID NO: 23877 - DNA, 50 bp, homo sapien
gaattgccttagtttgattgtcacaytggaaattcctaatcgctatcacg

SEQ ID NO: 23878 - DNA, 50 bp, homo sapien
tgtaatttaacttctcgtacaggagkcgttatatggtttcctggaatgga

SEQ ID NO: 23879 - DNA, 50 bp, homo sapien
tcctacttcatcacttcttctattaygactaatgtcttctgatgtttacc

SEQ ID NO: 23880 - DNA, 50 bp, homo sapien
cacaagccttctatgagttgtctacraaatatcatccttcttacaaatca

SEQ ID NO: 23881 - DNA, 50 bp, homo sapien
gcaattatctataaaggatatgctgragtattaatcatctctataagctt

SEQ ID NO: 23882 - DNA, 50 bp, homo sapien
cagtacctgtttctttctaatttcaytccctgttgaatcttccagggaac

SEQ ID NO: 23883 - DNA, 50 bp, homo sapien
gaacaaaacaacaataaagataaaaytattaggtgacccataaaccaata

SEQ ID NO: 23884 - DNA, 50 bp, homo sapien
gcttagaaaggtattttctagtacartgtaaggttttcaactccactgac

SEQ ID NO: 23885 - DNA, 50 bp, homo sapien
aagaaagaaaaaagaggaatttagcmacattaaagattatgtcagaataa

SEQ ID NO: 23886 - DNA, 50 bp, homo sapien
caaccagaaataagtgcaaatacaayaagggacagtaactagacagctct

SEQ ID NO: 23887 - DNA, 50 bp, homo sapien
agtagaaaccattctttactgacacyctaagacttctactggttgggtac

SEQ ID NO: 23888 - DNA, 50 bp, homo sapien
ctgtcctaatatactaattttaacasaacaccggcctgtattacaccagc

SEQ ID NO: 23889 - DNA, 50 bp, homo sapien
tttctttgagaaaattaatgatctgracaagcagaagtattagcactttt

SEQ ID NO: 23890 - DNA, 50 bp, homo sapien
gttgatgaatttaaatagaaacctawcattttggtagcttcaattttcaa

SEQ ID NO: 23891 - DNA, 50 bp, homo sapien
gttttcttattttaaaatcttagggyatgctaacaattacaagaatgaca

SEQ ID NO: 23892 - DNA, 50 bp, homo sapien
acatattttcctctttcttttctaastgctcactgtatttgagggagaaa

SEQ ID NO: 23893 - DNA, 50 bp, homo sapien
tattcagtcatctgaacctgtcctayacgtgatccttagtaactgatcaa

SEQ ID NO: 23894 - DNA, 50 bp, homo sapien
aattgcattgcattcattccataaastgcttaattagagaaatggttcct

SEQ ID NO: 23895 - DNA, 50 bp, homo sapien
aactaagatggatactaagctcagamaaaaatgatatggctttgtaataa

SEQ ID NO: 23896 - DNA, 50 bp, homo sapien
ccgccacacccaacccaagaatatcmatttttaaaaccaacattccaatt

SEQ ID NO: 23897 - DNA, 50 bp, homo sapien
tataataggtttgatattaggaagaktaattttctggagtcataataaga

SEQ ID NO: 23898 - DNA, 50 bp, homo sapien
gtggtaagaataaaagatgattaaargtttgtgtttatgtgtgggagaca

SEQ ID NO: 23899 - DNA, 50 bp, homo sapien
tgtgttgctgctactagtaaagtacraaagtttgtgagagatttatattc

SEQ ID NO: 23900 - DNA, 50 bp, homo sapien
ttgttttcctaaatactacacttcayagatgtgccaacattttctccaag

SEQ ID NO: 23901 - DNA, 50 bp, homo sapien
tctgacacataaaaggaatatttgaygaaacatataaaatgcaactatca

SEQ ID NO: 23902 - DNA, 50 bp, homo sapien
cccaaggcctctttcagaaagattgyatggacaactgacaacaaaggtgg

SEQ ID NO: 23903 - DNA, 50 bp, homo sapien
tttgatttaagttttcagtttcacartgagtttacacttttaatatggca

SEQ ID NO: 23904 - DNA, 50 bp, homo sapien
agttcccatttccacaagtgcacaasaagaggctggtggaaacttcctgg

SEQ ID NO: 23905 - DNA, 50 bp, homo sapien
attaatgtgtataccaaccttggaaragtaggacaaatctattattccac

SEQ ID NO: 23906 - DNA, 50 bp, homo sapien
gagttgattcttactattaaacacargattctgagaaagagtcaaaaact

SEQ ID NO: 23907 - DNA, 50 bp, homo sapien
ttatgaagacccaaggaataaataayagtaagcagtcaagatacattata

SEQ ID NO: 23908 - DNA, 50 bp, homo sapien
aaattgttattacccggctatataaycaactttacatatcaatgatttac

SEQ ID NO: 23909 - DNA, 50 bp, homo sapien
tttctgcgtgtcctttcctaatctaygccgtgttcaaaagtatcctctac

SEQ ID NO: 23910 - DNA, 50 bp, homo sapien
ctaagcacagagctaattatcacaaracaataaagtattccagataaccc

SEQ ID NO: 23911 - DNA, 50 bp, homo sapien
tttgtttacacagttaattcggcacraaaattttgaatctagcacagacc

SEQ ID NO: 23912 - DNA, 50 bp, homo sapien
atggaatttataaagtcatatttccyattgatggcatccttcacaggtta

SEQ ID NO: 23913 - DNA, 50 bp, homo sapien
agaaaaatcttccgtaatagtgatargtgtttttcagtaattgaaaggta

SEQ ID NO: 23914 - DNA, 50 bp, homo sapien
actttgtgaaggtaagttggaaataycttaacacttgacttctaaatact

SEQ ID NO: 23915 - DNA, 50 bp, homo sapien
attaagatttctacttgtttctgtayaatatgcatccacccatctccaga

SEQ ID NO: 23916 - DNA, 50 bp, homo sapien
atctttattcactgactataatacamcttctagcgtatattataatccca

SEQ ID NO: 23917 - DNA, 50 bp, homo sapien
atactgaactgccagaatactgagaraagatattacaatcactagttgaa

SEQ ID NO: 23918 - DNA, 50 bp, homo sapien
cccctgctcaggacaattcaaccaayggactgtggaaagaaagtaatgta

SEQ ID NO: 23919 - DNA, 50 bp, homo sapien
gtcagtagaaagctagaaattcttawatgttgaaaatatattgtcaagtt

SEQ ID NO: 23920 - DNA, 50 bp, homo sapien
ctctaaaactccatgtctagttaatyagcaagtgtagttcagcagtctag

SEQ ID NO: 23921 - DNA, 50 bp, homo sapien
atggatgtttattttacaactcaatmatatatggtcattgtcttagtctg

SEQ ID NO: 23922 - DNA, 50 bp, homo sapien
gcaggaatggaattagagcccataaytggttgataaacttttctcatatt

SEQ ID NO: 23923 - DNA, 50 bp, homo sapien
aatgtatgcccagccacagcagagartaagtgctcaacaaatatattttg

SEQ ID NO: 23924 - DNA, 50 bp, homo sapien
tttccagagctctgcttcttagtcartaagtttgtgatcttccttctaga

SEQ ID NO: 23925 - DNA, 50 bp, homo sapien
gcgtatcagaaaactaaagaagaaamatcacattatcatatcaatggatg

SEQ ID NO: 23926 - DNA, 50 bp, homo sapien
acaattaaaacagatgaatatggtargtaatacattttagttattataaa

SEQ ID NO: 23927 - DNA, 50 bp, homo sapien
atttccaaattgaagaccttttaaaraaattgaagcagtccaataatttt

SEQ ID NO: 23928 - DNA, 50 bp, homo sapien
tcactggttatcttcaaccgtcaacsatctaccactgaaatgatttccgg

SEQ ID NO: 23929 - DNA, 50 bp, homo sapien
accctaacaagcctagaatagatacwcaatggaccctgattttaatttga

SEQ ID NO: 23930 - DNA, 50 bp, homo sapien
atgaagtgatattagaattatattamgaaatattgctgtgagactttgtc

SEQ ID NO: 23931 - DNA, 50 bp, homo sapien
atgtgaggtgatagcctatgggttakattggtcctgaccagacctgacat

SEQ ID NO: 23932 - DNA, 50 bp, homo sapien
aatttgtgaaataacaaatatgatgsacaaagaggcagatggcaagattt

SEQ ID NO: 23933 - DNA, 50 bp, homo sapien
tactaaaccttctctttcttgtacayattctttgacaggttatattttct

SEQ ID NO: 23934 - DNA, 50 bp, homo sapien
ctaactgggccggccagactgttccygagcagagaggatccatgccttgg

SEQ ID NO: 23935 - DNA, 50 bp, homo sapien
caccttctctactgtaaacctttgargactaggtgaaggagaggcatgtc

SEQ ID NO: 23936 - DNA, 50 bp, homo sapien
tcatcatttgcagtgaactttcacaygcgtcatctcgttaccttctcata

SEQ ID NO: 23937 - DNA, 50 bp, homo sapien
aaaaaaagccatctttgaaaaatagrcctttgacggatgaattgtaatat

SEQ ID NO: 23938 - DNA, 50 bp, homo sapien
taacatctcacatttttggaacatcygaggttaaattatagacatgtagt

SEQ ID NO: 23939 - DNA, 50 bp, homo sapien
ttaatgtctgataatacattaatgasgcagttaaaatctctaggctaaaa

SEQ ID NO: 23940 - DNA, 50 bp, homo sapien
ctcttcttctggaactctgataaaartgaatgctacatatttcggtatag

SEQ ID NO: 23941 - DNA, 50 bp, homo sapien
tggtagaacttgtgggtcctcaaaawaaagcacataatgctaaaggttgg

SEQ ID NO: 23942 - DNA, 50 bp, homo sapien
agcctggttaaccgagtaccgaaaayagttcccgatgactttgagaccat

SEQ ID NO: 23943 - DNA, 50 bp, homo sapien
ctccagtgaatacacaaatgataagwatgaaacaggcttcttgttcttat

SEQ ID NO: 23944 - DNA, 50 bp, homo sapien
tttttgagtctgtctatggactaatratcaagcagctaaaaataacaaca

SEQ ID NO: 23945 - DNA, 50 bp, homo sapien
ctcatcctggctgcacaatagaatckccgtgacactttttgttgactttc

SEQ ID NO: 23946 - DNA, 50 bp, homo sapien
caccactgactcatttatctgtctasctgaacatacacatatacatgata

SEQ ID NO: 23947 - DNA, 50 bp, homo sapien
gggttcgtcctgaattctgaattaaytgtccttggttgtgttactttgca

SEQ ID NO: 23948 - DNA, 50 bp, homo sapien
aagaatgaagggagaatcaagcacastagctcacctgaagcttgttgaat

SEQ ID NO: 23949 - DNA, 50 bp, homo sapien
actttaccctatctttttagaaacartaattctcacaattccaccagagt

SEQ ID NO: 23950 - DNA, 50 bp, homo sapien
aataacagtatctttgttataacackgcatagacttattgattctattaa

SEQ ID NO: 23951 - DNA, 50 bp, homo sapien
aacatggtcttagaaaacatttaagraagaatacaggcatacagggaaga

SEQ ID NO: 23952 - DNA, 50 bp, homo sapien
attcatctcctagcaaagtacctcasgcataaatagtagaattctaagca

SEQ ID NO: 23953 - DNA, 50 bp, homo sapien
tgtctcaacaataagtcagaaaatargctatagtctgaattctaccacta

SEQ ID NO: 23954 - DNA, 50 bp, homo sapien
ggttggtgtctacccagtgatttgasagtaatgctggaatttggtttaaa

SEQ ID NO: 23955 - DNA, 50 bp, homo sapien
gtaggcattcagtaaatttttgccaytcttacaaacaaaaaggtagcctc

SEQ ID NO: 23956 - DNA, 50 bp, homo sapien
caccctagctggaagttaacagactraacaatagcagcagcaattaagtg

SEQ ID NO: 23957 - DNA, 50 bp, homo sapien
ctgcggggaatcctcctggggccaastgggtaattggtcattttgatgtg

SEQ ID NO: 23958 - DNA, 50 bp, homo sapien
tttcaggaataatatataagtgaagycatacagtacgtaatctttgagga

SEQ ID NO: 23959 - DNA, 50 bp, homo sapien
ctgaactgcagggccaaagagaggartatgattttcttttcttttgagac

SEQ ID NO: 23960 - DNA, 50 bp, homo sapien
agaaattctgaagattaaaaatgcaygtgacatattgaaatatgcatcag

SEQ ID NO: 23961 - DNA, 50 bp, homo sapien
ttttgggggaaaaaaatggcaaataygtagcaactttgtagagcaagcac

SEQ ID NO: 23962 - DNA, 50 bp, homo sapien
cagccctcttgttctggggttaacaytgtatgatctctgtgttccaccac

SEQ ID NO: 23963 - DNA, 50 bp, homo sapien
cagctagaaagtggaggaattaaaawctgacaggtctgtctgataccaaa

SEQ ID NO: 23964 - DNA, 50 bp, homo sapien
tagcaagcttgaaggagcagttacayacgaaagaacttgcttaacaagtg

SEQ ID NO: 23965 - DNA, 50 bp, homo sapien
gggctcatgtttagagagacagataygagtttggaatagctgatctcatg

SEQ ID NO: 23966 - DNA, 50 bp, homo sapien
cagctcttaatctctgtctttatacygagtttttaccagatgatcacttt

SEQ ID NO: 23967 - DNA, 50 bp, homo sapien
tttctcttgagagtgtccatttgtaygcaaattagtgcagtcaagcagcc

SEQ ID NO: 23968 - DNA, 50 bp, homo sapien
agtctcccaatacatttgatcatcartatcagtattataagatttatata

SEQ ID NO: 23969 - DNA, 50 bp, homo sapien
aatcaaatgttgatataaacagtctyacaattcagctgattagcattaat

SEQ ID NO: 23970 - DNA, 50 bp, homo sapien
gcaaaatgttttatttgttcagctgsaataaaacttaaacgcccaagcat

SEQ ID NO: 23971 - DNA, 50 bp, homo sapien
gaatctcgcttagccatagtgaaaaygatgaaagtattacagggggcaaa

SEQ ID NO: 23972 - DNA, 50 bp, homo sapien
gctttgcaaatacagtggacattgtsaatctcaatccaatttttacctat

SEQ ID NO: 23973 - DNA, 50 bp, homo sapien
gtttaatggttaactgtaaatatcartctaggaaatggcaaacagaaaat

SEQ ID NO: 23974 - DNA, 50 bp, homo sapien
taggggacacagacttattggatgcragtataaaagccttatagtagaag

SEQ ID NO: 23975 - DNA, 50 bp, homo sapien
gagtgccaactctatcactttctaamtaaataggcttcagcaaatctaag

SEQ ID NO: 23976 - DNA, 50 bp, homo sapien
tgattcaagaaataatacttttaaaytgactcacatctcaaaccatactt

SEQ ID NO: 23977 - DNA, 50 bp, homo sapien
aatatactcaacagtaccaggctgaygatggatagggtgaatttcttaaa

SEQ ID NO: 23978 - DNA, 50 bp, homo sapien
cccaggtttttgaaaaatcaaaccastggtgatatgctaaaagctaaatt

SEQ ID NO: 23979 - DNA, 50 bp, homo sapien
actgctctctaatgcagatgaggacrcaaccgttctgttccctgctgttc

SEQ ID NO: 23980 - DNA, 50 bp, homo sapien
cagtggaagggtgattcctaagaaastgctatatcttctgtgtctttcct

SEQ ID NO: 23981 - DNA, 50 bp, homo sapien
tgtactctacctgttagagtgttgayatagtggcagataaagaagctcga

SEQ ID NO: 23982 - DNA, 50 bp, homo sapien
aaagattgttctttcccccaattaaygttcttggcatctttgtcaaaaat

SEQ ID NO: 23983 - DNA, 50 bp, homo sapien
taatctaggtatcctgcaaatgttasactccttttccttgaccctctctc

SEQ ID NO: 23984 - DNA, 50 bp, homo sapien
ttggacttttccaaccctaagagacyggcaagatagaaatgacaactggt

SEQ ID NO: 23985 - DNA, 50 bp, homo sapien
ttggggcatagagagatttgtcaaarttagccttggtgccaaagaaagca

SEQ ID NO: 23986 - DNA, 50 bp, homo sapien
cccaaacagagactcattaagcacayagtgtactaaccacagcataccct

SEQ ID NO: 23987 - DNA, 50 bp, homo sapien
attttaatgaaatagtcacactttcyaagaatgcagcaatgtttttctac

SEQ ID NO: 23988 - DNA, 50 bp, homo sapien
taagggtatggtattttagataatgsagttagaaaaggcctctctgaaga

SEQ ID NO: 23989 - DNA, 50 bp, homo sapien
tagtcacctgctcttgtgatcaatamacctctaaaacattatactaatat

SEQ ID NO: 23990 - DNA, 50 bp, homo sapien
acttactacaaatcgtacacttttasgtcaatttgctaaaaatctattca

SEQ ID NO: 23991 - DNA, 50 bp, homo sapien
cttggttaatttttgaacattggagkattttctgatttttgttgttctta

SEQ ID NO: 23992 - DNA, 50 bp, homo sapien
tcagcacccttattaaaattaaacawtctatcatacaacagaaactatgc

SEQ ID NO: 23993 - DNA, 50 bp, homo sapien
aatactggtttaaatcagatgtctawcaatttggcctcacatatatgtat

SEQ ID NO: 23994 - DNA, 50 bp, homo sapien
ctataggaagtatccttatagtcagraggcatatcctctctccttccttc

SEQ ID NO: 23995 - DNA, 50 bp, homo sapien
aacggtggtcttatctctaaaataayatgatcaactctctgaaagactgg

SEQ ID NO: 23996 - DNA, 50 bp, homo sapien
gcctgtgtttggcaccagactattaracaggtggttccttagccttctga

SEQ ID NO: 23997 - DNA, 50 bp, homo sapien
gattaatcattcatatgttctattawtaaaactaacccgttctcccacct

SEQ ID NO: 23998 - DNA, 50 bp, homo sapien
taagcacttgtggtatgaatgcctaygggttgataaataagtgtgaaata

SEQ ID NO: 23999 - DNA, 50 bp, homo sapien
ttcgctgattcttatgcacgttcaartgtgagaaccattgttccagggac

SEQ ID NO: 24000 - DNA, 50 bp, homo sapien
aaaaggccttttattgagactctcayatgtaaggatttggaaaacttttt

SEQ ID NO: 24001 - DNA, 50 bp, homo sapien
gaaaaggcccttggattcacctcctkaagtgtgcaccatgcaggagaacc

SEQ ID NO: 24002 - DNA, 50 bp, homo sapien
ttctattccactcaaatgtatcttcyacctggttcttaatgatctttcta

SEQ ID NO: 24003 - DNA, 50 bp, homo sapien
tgaattaccctttctatctcaagaamctgtgcattcaataagtggtcctt

SEQ ID NO: 24004 - DNA, 50 bp, homo sapien
caaggagcataacgtagatctgagaygattcataaactgtaaagaaacag

SEQ ID NO: 24005 - DNA, 50 bp, homo sapien
tacattctaaaacagatccgatgggyatatcgcctggataaaattattct

SEQ ID NO: 24006 - DNA, 50 bp, homo sapien
aacccaatattcactctcataaattmaaaaatattagattcctgttgttt

SEQ ID NO: 24007 - DNA, 50 bp, homo sapien
ccccactgagtatgcatgtgttaaartattcataaattatgtttattgtg

SEQ ID NO: 24008 - DNA, 50 bp, homo sapien
gtgaatttgataaaacataatgtackggactgacagtaaaaaggctttgc

SEQ ID NO: 24009 - DNA, 50 bp, homo sapien
aatccagttattagtctcttcactarccacagggaatcttgaggttgaag

SEQ ID NO: 24010 - DNA, 50 bp, homo sapien
aaaagagagtttggatcactagaaamcttccaagaagaaaagaatcctga

SEQ ID NO: 24011 - DNA, 50 bp, homo sapien
tcaaaaatatccctccacgaaagaayatatgtgcctggagttagtcaaca

SEQ ID NO: 24012 - DNA, 50 bp, homo sapien
cagtctccatttccttattgtgaagrcctcttatacttctaaaaagcatt

SEQ ID NO: 24013 - DNA, 50 bp, homo sapien
ttttcacttactggcagattcattcraaagggttttgttacataacgtct

SEQ ID NO: 24014 - DNA, 50 bp, homo sapien
tattgagattgtctttgtagcttaayatatgatcagtttttataaaagtt

SEQ ID NO: 24015 - DNA, 50 bp, homo sapien
gttcatgatattttgttcatcactgyattttgcctttgaatgaaaaagtt

SEQ ID NO: 24016 - DNA, 50 bp, homo sapien
tggaaacgagctatctttgtatttcracatgcaagaaaggtagtatgggc

SEQ ID NO: 24017 - DNA, 50 bp, homo sapien
ttcttacagcatcttccaactagaawcagggccccggcctcacagacaag

SEQ ID NO: 24018 - DNA, 50 bp, homo sapien
gaatacttaaaatcagtaaaacataygtagtcatgattgtgtttaaaaaa

SEQ ID NO: 24019 - DNA, 50 bp, homo sapien
catactttagggtgagaaccgagcayctttgataacttcctcaatgtccc

SEQ ID NO: 24020 - DNA, 50 bp, homo sapien
gtctagagaaagttgtctaccacaarcaatacattaagaagatgtgttgt

SEQ ID NO: 24021 - DNA, 50 bp, homo sapien
atctctgggcctctttcctcaggtayaaggtgatagcattagtagttttc

SEQ ID NO: 24022 - DNA, 50 bp, homo sapien
aatacttggttcttgggttgtgatcratttttcaggcaatttagagaatc

SEQ ID NO: 24023 - DNA, 50 bp, homo sapien
aatgaagtcaagtttccttatacagrcattcaagggttttcacaatctgg

SEQ ID NO: 24024 - DNA, 50 bp, homo sapien
ggtgtctgtgtcttgcctcatcaackaaactaaaaaatccatgagggttg

SEQ ID NO: 24025 - DNA, 50 bp, homo sapien
agaggagtggagaccaggagtctgayggtgacgctgatgctaaatacctc

SEQ ID NO: 24026 - DNA, 50 bp, homo sapien
aagagagaacagtaagatgggaaccmattgaaaataaagacaaatagtag

SEQ ID NO: 24027 - DNA, 50 bp, homo sapien
ggagtcagaataagacttctagtagracatcctttactccagtgttgagt

SEQ ID NO: 24028 - DNA, 50 bp, homo sapien
agatgacatgattgtatatttggaaraccctatcatcggctgggcgtggt

SEQ ID NO: 24029 - DNA, 50 bp, homo sapien
agaaagggtccatattggatgatgartaaacattattgtctttcttctgc

SEQ ID NO: 24030 - DNA, 50 bp, homo sapien
ctttcacagtggagtatcacttttayagttcttggaagtctgcactataa

SEQ ID NO: 24031 - DNA, 50 bp, homo sapien
tgtcttttcacaagttgacatttccrcaaacactacttttgtccttataa

SEQ ID NO: 24032 - DNA, 50 bp, homo sapien
aacctgtaagatgttcttcctctctwaaaaggctgtatatatctgctttg

SEQ ID NO: 24033 - DNA, 50 bp, homo sapien
tgcttaaagtgatcgttcaaattaamaaacttggctgaaactagtaattg

SEQ ID NO: 24034 - DNA, 50 bp, homo sapien
tgttcaataatcttttgatctcaccyggagaaatagtacctgaagtgatc

SEQ ID NO: 24035 - DNA, 50 bp, homo sapien
agtgacagtcactcagctttcggaartctgtttctctctaccaaaattgg

SEQ ID NO: 24036 - DNA, 50 bp, homo sapien
tttttcagatatgccaggtagtcccrgaaaactgagacattttcattctg

SEQ ID NO: 24037 - DNA, 50 bp, homo sapien
ttattaattttaaatgcaatattgargctatagatgtacataaaagctta

SEQ ID NO: 24038 - DNA, 50 bp, homo sapien
ctgggcctgtgctagccctgttaaayttggctggagcaatcctgctaaaa

SEQ ID NO: 24039 - DNA, 50 bp, homo sapien
gagatcaaaaaagatctatttatacycttcagattccaacactaaatgtc

SEQ ID NO: 24040 - DNA, 50 bp, homo sapien
tttattttaatacttacaacagtccyatgaagtgtgtattattattattc

SEQ ID NO: 24041 - DNA, 50 bp, homo sapien
gccagcctttcaaattcagttctacratgaatcaacttttaaaaatactc

SEQ ID NO: 24042 - DNA, 50 bp, homo sapien
aaaagacaggagaggtttgaaagacyggcagaaaatgaagggcttaaaat

SEQ ID NO: 24043 - DNA, 50 bp, homo sapien
ttattgttatgttagcacattaaaartaccccaattaggtaaattattat

SEQ ID NO: 24044 - DNA, 50 bp, homo sapien
catccattcatgtttcctataatacsgatccaaaagactgagataggatc

SEQ ID NO: 24045 - DNA, 50 bp, homo sapien
tcaggatattcagattttatgagaaytgagattttcagaatacactgtgc

SEQ ID NO: 24046 - DNA, 50 bp, homo sapien
atttaaagccaactttcggcatatawaatataaagcacagtgtattctga

SEQ ID NO: 24047 - DNA, 50 bp, homo sapien
gcccatgtatgcagcaggattggtamgtacaaaaatctctctgcatgtat

SEQ ID NO: 24048 - DNA, 50 bp, homo sapien
agcagagttccaacttccaaccttarccattatcccctactacattaatc

SEQ ID NO: 24049 - DNA, 50 bp, homo sapien
atccaaaaagatcaggcatctatacraacacctgtgctctgtctacccac

SEQ ID NO: 24050 - DNA, 50 bp, homo sapien
actacttctctactcttacataatayggtcattgtatcagttagcaatca

SEQ ID NO: 24051 - DNA, 50 bp, homo sapien
tatattttaccttctcttagatgtayatttataagtaggaacatgtcctt

SEQ ID NO: 24052 - DNA, 50 bp, homo sapien
ttattatacttggtgattcacgtgcraaggttaactgcatggcctttttc

SEQ ID NO: 24053 - DNA, 50 bp, homo sapien
gtgtagctttgcaatttttgataaartaagacgtgttgccttcccctcta

SEQ ID NO: 24054 - DNA, 50 bp, homo sapien
gttttgagggtggtggtagacgtacrcatcatctaccttccactgagttg

SEQ ID NO: 24055 - DNA, 50 bp, homo sapien
ggcaatcaaggaggaaaacaatgaaktaaaataaaacaaaaaggtcctct

SEQ ID NO: 24056 - DNA, 50 bp, homo sapien
ccttataaaggcctgttcagcaataytaacttttcagttactttgaaatg

SEQ ID NO: 24057 - DNA, 50 bp, homo sapien
taaataatatggatgttattagatcraagaggtggattaaattatttcta

SEQ ID NO: 24058 - DNA, 50 bp, homo sapien
agtagcagtagtaataaatttatackccgtggaaaataccaaaactgtca

SEQ ID NO: 24059 - DNA, 50 bp, homo sapien
tttgtggacccagtcactttccctgragataagaacaaacttttagaacc

SEQ ID NO: 24060 - DNA, 50 bp, homo sapien
ggcaattaaacaaaaatttaaagtaycaccctgagaggtaaaaagagtaa

SEQ ID NO: 24061 - DNA, 50 bp, homo sapien
gggtgcttctgaacaaatgctgagcrataagactttcattctaggatatg

SEQ ID NO: 24062 - DNA, 50 bp, homo sapien
ccagggacttctgttgcactggagamcctatgttgttaacttctgattaa

SEQ ID NO: 24063 - DNA, 50 bp, homo sapien
tcttgggcataaggcttaaataaaaygacatgccaaggttcagatgctta

SEQ ID NO: 24064 - DNA, 50 bp, homo sapien
gaggccactcctgatgccacataacmggcttactctaggcaaaggcctga

SEQ ID NO: 24065 - DNA, 50 bp, homo sapien
atggacacccagacaggtttttctargtaatttacaaatagacccggaaa

SEQ ID NO: 24066 - DNA, 50 bp, homo sapien
ctgtgtatgctaaacttcttagcaaygtatagatgtattttcatgatctg

SEQ ID NO: 24067 - DNA, 50 bp, homo sapien
gtaggcctgtacgactctattctcayagtgtggaagtctcagaccttctg

SEQ ID NO: 24068 - DNA, 50 bp, homo sapien
ttggttttcagatatgtatccaggcyctttcagattgacacacagccctt

SEQ ID NO: 24069 - DNA, 50 bp, homo sapien
agccagtaaaaaacctcttgagagascaaagtgggactaagcacagaaaa

SEQ ID NO: 24070 - DNA, 50 bp, homo sapien
aaattttacctgtaactccaagctcsaaggactaaattctcttcctccat

SEQ ID NO: 24071 - DNA, 50 bp, homo sapien
tgaagctttccaagattgaatgccarctatctttgtttcctgattctctt

SEQ ID NO: 24072 - DNA, 50 bp, homo sapien
ccagcagtggacggctagaaatagayaccagtgcccagaataagcataac

SEQ ID NO: 24073 - DNA, 50 bp, homo sapien
ttaattgatttttggcaagaggatayattgtaagcagtgcattgctttga

SEQ ID NO: 24074 - DNA, 50 bp, homo sapien
tggagaggatcaggtttgtgtttcaraaataagcatagtgactaacagag

SEQ ID NO: 24075 - DNA, 50 bp, homo sapien
cccgacagccctaatgaggtagataycataaagttcatgcaactcagact

SEQ ID NO: 24076 - DNA, 50 bp, homo sapien
ggggagctaattaagtcaaatataastagatggctttgacagttcagtaa

SEQ ID NO: 24077 - DNA, 50 bp, homo sapien
actctcccgctgaaggtttcctgaasaattaccttgattctgcttaatgt

SEQ ID NO: 24078 - DNA, 50 bp, homo sapien
tccaattcctaatctataaaacaaarttagtgcacctacctgatggggct

SEQ ID NO: 24079 - DNA, 50 bp, homo sapien
acagaagctgaagccatacttcagargttttgagaagacccttaaggatg

SEQ ID NO: 24080 - DNA, 50 bp, homo sapien
gttcttccaaaaattcagagaaattsaatcaaaagttatgtgttctctca

SEQ ID NO: 24081 - DNA, 50 bp, homo sapien
agtgtcaggtggtcataaggaatgayataaaccacatacagtagtattta

SEQ ID NO: 24082 - DNA, 50 bp, homo sapien
tctggggtgtctaccgaattctccakgtattcagcaaagtctcttcactc

SEQ ID NO: 24083 - DNA, 50 bp, homo sapien
tttgtgattgggcaacaatgactcaratcagaccagttctgtgtcttcat

SEQ ID NO: 24084 - DNA, 50 bp, homo sapien
attaactttgctaaggccactaaaaygaccagtgtgtccctcatatgtcc

SEQ ID NO: 24085 - DNA, 50 bp, homo sapien
tgtaatttagagcattatcaaaatayggcaagtgacaggaggtaaagaaa

SEQ ID NO: 24086 - DNA, 50 bp, homo sapien
agtagccagggtcacccaagtggtgkattttcataacattgaaggcaaca

SEQ ID NO: 24087 - DNA, 50 bp, homo sapien
tgctgacgccctgcaggtttataaartgatgcttccccagatcataacca

SEQ ID NO: 24088 - DNA, 50 bp, homo sapien
attcctctctacagaggccagaaagyctttagagtcacagaactgaccct

SEQ ID NO: 24089 - DNA, 50 bp, homo sapien
aataattcctgattaaaaaaataagrccatccttgacaagacttttccac

SEQ ID NO: 24090 - DNA, 50 bp, homo sapien
ctttgaatcaggttaaacacacatcmagataatcaaatcaacatttggca

SEQ ID NO: 24091 - DNA, 50 bp, homo sapien
ccagacaacacctcagcactacactsaagggtcattttaaacaatgaaat

SEQ ID NO: 24092 - DNA, 50 bp, homo sapien
gctgctttagagaataccttgaaacygcatagaattggatgagaaattca

SEQ ID NO: 24093 - DNA, 50 bp, homo sapien
gaggattgagaagtctgtggggacasattagttctgtggactgctggtaa

SEQ ID NO: 24094 - DNA, 50 bp, homo sapien
ggataactttaagcaaatgttagaasagacagtttgttattgatcaaagg

SEQ ID NO: 24095 - DNA, 50 bp, homo sapien
cttgtaccctccttgagcaaatccamgtggcgttccagccttcctgttgt

SEQ ID NO: 24096 - DNA, 50 bp, homo sapien
ctttaggacaaaataggctactatgratgaaagggccacatcaggggtgt

SEQ ID NO: 24097 - DNA, 50 bp, homo sapien
ttatggaaagaattgaacatgtacaraaagatataggatctcagccccct

SEQ ID NO: 24098 - DNA, 50 bp, homo sapien
aataactagtccacattcacattgargataatggttcatattcttcctat

SEQ ID NO: 24099 - DNA, 50 bp, homo sapien
ctgtggcttctcccacctcggacatwatggatgtgtgccttcccttcacg

SEQ ID NO: 24100 - DNA, 50 bp, homo sapien
ctagtgtctgcttcaaacaggctaawcaaatctacatttcttcctttgaa

SEQ ID NO: 24101 - DNA, 50 bp, homo sapien
ggcttggttaggaaagagctagaaamctgtctgtgcctgtagaaggaaaa

SEQ ID NO: 24102 - DNA, 50 bp, homo sapien
ttattttcaggcatagtataaataarccaaatctcacttttttccttcta

SEQ ID NO: 24103 - DNA, 50 bp, homo sapien
ggctggcccttcctgagtgtgtaaaygaatgaacttgaacttgaaacctt

SEQ ID NO: 24104 - DNA, 50 bp, homo sapien
tatcatttaatcctcagaacaacaarcatatatattggcatgtaatatgg

SEQ ID NO: 24105 - DNA, 50 bp, homo sapien
caaggctctccacaactcacttttcyaatgctctatgttctgaccacagg

SEQ ID NO: 24106 - DNA, 50 bp, homo sapien
tggcacaagaagaggaggtaccgagraaattgtaccaaacaccaagagag

SEQ ID NO: 24107 - DNA, 50 bp, homo sapien
atcccagattctcctagaaagtcaakcaggtacatagttgccaagagaag

SEQ ID NO: 24108 - DNA, 50 bp, homo sapien
catgccagccatggtctcctaaccaygactgttaattgcattaatgcttt

SEQ ID NO: 24109 - DNA, 50 bp, homo sapien
gggattttgaaaatgtatttgtaaargtccaagtaactagagcaaccacc

SEQ ID NO: 24110 - DNA, 50 bp, homo sapien
caagttatctgtgtgggcattatcaytgagagggaattatgaataattaa

SEQ ID NO: 24111 - DNA, 50 bp, homo sapien
atgccttgacactcctttcactcatkatccttgggtagattggctcaatt

SEQ ID NO: 24112 - DNA, 50 bp, homo sapien
gcacgtgtgtatgtgtgtataattayatggtgcattaacttccatccgta

SEQ ID NO: 24113 - DNA, 50 bp, homo sapien
cacatgagtgtcagatctatagtgaycgtgcttccaacaccatgtggtgg

SEQ ID NO: 24114 - DNA, 50 bp, homo sapien
tggcagagtgtcctctccacagtgaraacctgggtgcactattcaagtgg

SEQ ID NO: 24115 - DNA, 50 bp, homo sapien
aacttgtttgttcttagttttgtatyaggcagcttaactgatattaagag

SEQ ID NO: 24116 - DNA, 50 bp, homo sapien
gataccagctctggtcaagtttcaayacttaatcttctgacctacattta

SEQ ID NO: 24117 - DNA, 50 bp, homo sapien
gtattaggcagcttaactgatattamgagcaacacttcatcctatctttt

SEQ ID NO: 24118 - DNA, 50 bp, homo sapien
ttatctctaaggttattagtgaagayagtattcctggagacccgttttac

SEQ ID NO: 24119 - DNA, 50 bp, homo sapien
tagggccatctgtccaaaatttctawccataaattcagtgggtagacatt

SEQ ID NO: 24120 - DNA, 50 bp, homo sapien
tctttcttacctgaataaaattgtcraaatctgtgcctcattacatgcaa

SEQ ID NO: 24121 - DNA, 50 bp, homo sapien
ggctattgtatgctatgagtattcartaataataaaattgggtgcagaga

SEQ ID NO: 24122 - DNA, 50 bp, homo sapien
gttggttcttatggcttcttccctgwacagctaatgttttgccatcttcc

SEQ ID NO: 24123 - DNA, 50 bp, homo sapien
catttctaactgttatttcagccacrgatatgatttctttaacacagcag

SEQ ID NO: 24124 - DNA, 50 bp, homo sapien
gcttttgcttgcagtaaaaatttccrcctttgatgtcttggggcagctct

SEQ ID NO: 24125 - DNA, 50 bp, homo sapien
tgttctcttgaccacactggctaaargttatcactaaatcctaaattgtg

SEQ ID NO: 24126 - DNA, 50 bp, homo sapien
actctggcagagtgttgtaaaataamagcacattagctacttggaagcag

SEQ ID NO: 24127 - DNA, 50 bp, homo sapien
attgtaagttttggcagaatattgaratgttgtcttcataagtatgggga

SEQ ID NO: 24128 - DNA, 50 bp, homo sapien
cacatttgtagtcatttggcccaacsattaaaacaagcagggagaaaacc

SEQ ID NO: 24129 - DNA, 50 bp, homo sapien
actgggggaatagatacagcacggasagttaatagagtggttagtagtcc

SEQ ID NO: 24130 - DNA, 50 bp, homo sapien
ctaacttgtaattggtaatcttacawgtaattccgaagacagtgccctaa

SEQ ID NO: 24131 - DNA, 50 bp, homo sapien
aaaaattatggccataactgcattayctaagatttggcatcaagaaaaga

SEQ ID NO: 24132 - DNA, 50 bp, homo sapien
tttgaggtctttgatttaaatgttaygtattcaggtcaattaccactacc

SEQ ID NO: 24133 - DNA, 50 bp, homo sapien
tgtgctgtaattcaattctcaagtarcaagatttagcctcattaacagac

SEQ ID NO: 24134 - DNA, 50 bp, homo sapien
actttttttggagatagagtctttayagtggtaaccaagttaaaatgaga

SEQ ID NO: 24135 - DNA, 50 bp, homo sapien
ggttagaacaatctaataattataargtttcatgtagtacctgaagtgag

SEQ ID NO: 24136 - DNA, 50 bp, homo sapien
tagggggattaagtaaggtaaagtaygcaaacagcttttccccatgcctg

SEQ ID NO: 24137 - DNA, 50 bp, homo sapien
ctgtcatcccccagaaggcggaaaamaccattgctgtgaagcattcgagc

SEQ ID NO: 24138 - DNA, 50 bp, homo sapien
aggctttggtgtgtttgagcactaaragccaagaccggccggttggtgtg

SEQ ID NO: 24139 - DNA, 50 bp, homo sapien
acttgatgtcgtcagtctttttttcwagccatttaatgggtacattgcag

SEQ ID NO: 24140 - DNA, 50 bp, homo sapien
ccaaagcaactctgactacctaatcraaacaggacattattagaaggagc

SEQ ID NO: 24141 - DNA, 50 bp, homo sapien
tacactggattaagtacagcttgaaygaggttacttgtgttggtgaggtg

SEQ ID NO: 24142 - DNA, 50 bp, homo sapien
agtgagatgctttaacgaaagttcakaacagcggcagatctggcaccaaa

SEQ ID NO: 24143 - DNA, 50 bp, homo sapien
ctgtggactacactttaagcgtcaargcattatatcctgctccaggtacc

SEQ ID NO: 24144 - DNA, 50 bp, homo sapien
gatatgaacatcgcagtcacttccartcttgaagcaagcaatcaaatacc

SEQ ID NO: 24145 - DNA, 50 bp, homo sapien
caagatgcatgcagtgtcacattcaragatgaggtataaagacattcgag

SEQ ID NO: 24146 - DNA, 50 bp, homo sapien
tgagttattttcttttctttacaaayggctgccctaaaatctaatactat

SEQ ID NO: 24147 - DNA, 50 bp, homo sapien
gcatttaaacttgtcatttttgcacragactgaaaccttcacagggacta

SEQ ID NO: 24148 - DNA, 50 bp, homo sapien
ggcccatttacctcctcactagaacwctggtcactactgagtctgccagc

SEQ ID NO: 24149 - DNA, 50 bp, homo sapien
acttatttttctgttcattagaataycttgtgttcaaagctgacttcctt

SEQ ID NO: 24150 - DNA, 50 bp, homo sapien
aaataaatatactttaacctcaaagsctttcttaaatggtccactactaa

SEQ ID NO: 24151 - DNA, 50 bp, homo sapien
gttcacaggtttcaaagcaatagctraaagttgaaagcctgagcagaaag

SEQ ID NO: 24152 - DNA, 50 bp, homo sapien
tgaagtccatttctaccttagttgcygattgtacttcccgttaagctatt

SEQ ID NO: 24153 - DNA, 50 bp, homo sapien
ctaccttcaaatcatcgcaatcccargtctgatcaaggtgatctgtccct

SEQ ID NO: 24154 - DNA, 50 bp, homo sapien
agttactttataatatgtgaaactcraatgtcttgattttgtgttagtct

SEQ ID NO: 24155 - DNA, 50 bp, homo sapien
gaaggaaaactgctaggcaaaggcawcattagaaacaatagtatgagaaa

SEQ ID NO: 24156 - DNA, 50 bp, homo sapien
ggcatgaggaaaacgggatcaaggartcataaaggagcacagaaagtggc

SEQ ID NO: 24157 - DNA, 50 bp, homo sapien
ttctccatttgcaaagtaggcatggraaattataaacatgtgagtaatat

SEQ ID NO: 24158 - DNA, 50 bp, homo sapien
cttttctcaggaactttcaagtggcrattagaatcatggcattctaataa

SEQ ID NO: 24159 - DNA, 50 bp, homo sapien
ggcattctaataatgaagggtctcayggaaattttccagtcctatctcct

SEQ ID NO: 24160 - DNA, 50 bp, homo sapien
aattggcttggagatcaagttctaaygtagaaaaccatggattaaaaaac

SEQ ID NO: 24161 - DNA, 50 bp, homo sapien
cccatttttccttattcctgacatasctgcaattgtattagctagaacca

SEQ ID NO: 24162 - DNA, 50 bp, homo sapien
aacaaatcacagatttgtaacaattraaggaaaacactaaaaaggcacat

SEQ ID NO: 24163 - DNA, 50 bp, homo sapien
aagcccaggaagaagagccagtcccraggtaaggagacaacaagatgatg

SEQ ID NO: 24164 - DNA, 50 bp, homo sapien
ctaacatgactgatgcctgtctccaytgacacaaagtagcacaagtgagt

SEQ ID NO: 24165 - DNA, 50 bp, homo sapien
attcaaatgtcaagataaactgcaaygtcttgtaataaaactttgcagac

SEQ ID NO: 24166 - DNA, 50 bp, homo sapien
ttggaaagtagaacagttatatgtakggaaagttgcatgtagtgaagtgg

SEQ ID NO: 24167 - DNA, 50 bp, homo sapien
cccatagtcctgggaagaagcaatcygatctttatcctttatcttacttg

SEQ ID NO: 24168 - DNA, 50 bp, homo sapien
acaaaacaactaatgaaaattacccrattggcaacaagtcctgtattcca

SEQ ID NO: 24169 - DNA, 50 bp, homo sapien
ccagcaggcaaggagagaagctcaakagactggttttatgaggagctgaa

SEQ ID NO: 24170 - DNA, 50 bp, homo sapien
cacagaattataatgtcttctaatayccaatgttctaccaagtcactcaa

SEQ ID NO: 24171 - DNA, 50 bp, homo sapien
atatggatccctttaatttctactaygcttcacagttttcaggcaatttt

SEQ ID NO: 24172 - DNA, 50 bp, homo sapien
gatagattggacaccatttagctggkattatgatgtcattacttcaagtg

SEQ ID NO: 24173 - DNA, 50 bp, homo sapien
tctctcaacagatcctaagtaaggargtaaatgctcaacttgaaaaaggc

SEQ ID NO: 24174 - DNA, 50 bp, homo sapien
tcaaacacaaattttctttattgacyggctgatgcctgaaatttcactag

SEQ ID NO: 24175 - DNA, 50 bp, homo sapien
atcctatggtaattattaaataataygaaagcacaactacagttccgttt

SEQ ID NO: 24176 - DNA, 50 bp, homo sapien
tatatggctcctattgtcttaacacsgatcagaagcagggcctttttctt

SEQ ID NO: 24177 - DNA, 50 bp, homo sapien
tgatgctcaagttttatcctagtaaygaactatcaaaatgatccctgaga

SEQ ID NO: 24178 - DNA, 50 bp, homo sapien
gtgatcttgtaaaaattacttaacawctctgaacctcatcttgtaaaatt

SEQ ID NO: 24179 - DNA, 50 bp, homo sapien
aggatcagaaattccattttcataaytctagtaacccacataaatttatt

SEQ ID NO: 24180 - DNA, 50 bp, homo sapien
aagccataattgcttgcgtaactccragaggcaaacaggaagctggagca

SEQ ID NO: 24181 - DNA, 50 bp, homo sapien
atgtattttagataacactgccaatkatattcagtagcatgtaatttttt

SEQ ID NO: 24182 - DNA, 50 bp, homo sapien
gtggccaataaagagtagatatgtaygctttgaaatgtaatcaaattatt

SEQ ID NO: 24183 - DNA, 50 bp, homo sapien
aagtgggtgaggtttagcatgtcacygaaatttcccgttgatgcatatct

SEQ ID NO: 24184 - DNA, 50 bp, homo sapien
gcaagtatacagttgtattgatatakgtaccttagttacagcagataaaa

SEQ ID NO: 24185 - DNA, 50 bp, homo sapien
tccaccgttttctatccttgaatcarctttaatatagtaacaaccaaagg

SEQ ID NO: 24186 - DNA, 50 bp, homo sapien
tctacagctgaaaagtgtatttcaaratgtataaaggctgggtgtggtgg

SEQ ID NO: 24187 - DNA, 50 bp, homo sapien
ctcgtttgacaaaagattacagatarctattacatcttatagagcatagg

SEQ ID NO: 24188 - DNA, 50 bp, homo sapien
agactaaggggtgagcaaaccctgaktatctgggcatccacacggaggtg

SEQ ID NO: 24189 - DNA, 50 bp, homo sapien
tctgaaaagcttttgataagcatctkaagtgtagacagacatctcatgtg

SEQ ID NO: 24190 - DNA, 50 bp, homo sapien
agacattcccctctgctatactgccratggaaatagatacgggttattct

SEQ ID NO: 24191 - DNA, 50 bp, homo sapien
aggcaacgtattttctaagctatcayagtcagcagtgtctacttggggtt

SEQ ID NO: 24192 - DNA, 50 bp, homo sapien
tcagctgtagtaataatgaccatccratacacatccaattccaagccaat

SEQ ID NO: 24193 - DNA, 50 bp, homo sapien
tcatgaatctactatatacatttaargttccatgtagaaattgcctaaaa

SEQ ID NO: 24194 - DNA, 50 bp, homo sapien
ccaggaatttgagagcttgttaaggraaagttttcaaatgtaagaacaaa

SEQ ID NO: 24195 - DNA, 50 bp, homo sapien
ttataatttcataatggagatgccaygagagattaataaaccaagttaca

SEQ ID NO: 24196 - DNA, 50 bp, homo sapien
acttagataaggttcctaaacccaaygacataaatgcaaatttctaattt

SEQ ID NO: 24197 - DNA, 50 bp, homo sapien
tttctctgtgaggttagtgggaacckcttggataagcctattgggattaa

SEQ ID NO: 24198 - DNA, 50 bp, homo sapien
cagggcgtgtactgattggaattgamacgcttattctgtctacctatcag

SEQ ID NO: 24199 - DNA, 50 bp, homo sapien
gtctgacttctggagcgggtaagatyatagccactcaggccatcagcctc

SEQ ID NO: 24200 - DNA, 50 bp, homo sapien
gctaaatctatcaaaaattattaaaygaagtcagaagatagccacttgag

SEQ ID NO: 24201 - DNA, 50 bp, homo sapien
cctttcatcatcacaacagaaagcayggagtatttgaatctctaagaata

SEQ ID NO: 24202 - DNA, 50 bp, homo sapien
tggaaaactgaaaactatatatcccrgacttccttgcaccaagataacca

SEQ ID NO: 24203 - DNA, 50 bp, homo sapien
aaattatgcaagaagtgtgagttatkaatgtttgaaacagggaaattaga

SEQ ID NO: 24204 - DNA, 50 bp, homo sapien
agtctgccataaaactatatatcaaytagtagccaaccatgattgttctg

SEQ ID NO: 24205 - DNA, 50 bp, homo sapien
ctgccaagtttggggacattagggaycctgtgcttacttgcaaaagaatt

SEQ ID NO: 24206 - DNA, 50 bp, homo sapien
ttatttttgaagtgatcatttggacmcaatatgtgggaaacataaccaag

SEQ ID NO: 24207 - DNA, 50 bp, homo sapien
agtttaaagaatgtttgtttctagamgtagtataaattaaattaaacttt

SEQ ID NO: 24208 - DNA, 50 bp, homo sapien
atctctaaaatggaggcacctattaygaggattaaataaaagctctgaca

SEQ ID NO: 24209 - DNA, 50 bp, homo sapien
ggaaatcaggagagtgtgtaatgacmggttaaaaaagaacaaatttctca

SEQ ID NO: 24210 - DNA, 50 bp, homo sapien
ccctgctgagttccaggagacaacayggtgcttttctctttcagacgcca

SEQ ID NO: 24211 - DNA, 50 bp, homo sapien
agatgccctctgctcccttcctgagrcatgtaggcagtggtcatcatggt

SEQ ID NO: 24212 - DNA, 50 bp, homo sapien
ctgaagatgggcactgaatcaaagcragaataaacctctgagtggaaaca

SEQ ID NO: 24213 - DNA, 50 bp, homo sapien
agatactgttgatttagttccagacmactgccgtaatggtcacagtaaag

SEQ ID NO: 24214 - DNA, 50 bp, homo sapien
acttcagctctttatattaaatgaargtaatctctcatcacactaaagga

SEQ ID NO: 24215 - DNA, 50 bp, homo sapien
tctaggtcatgacctggagtcccaaygatgaggcagttacccaggtgcct

SEQ ID NO: 24216 - DNA, 50 bp, homo sapien
catgattaaaggtagccaggttagayaagaggaaggttgctggacctgag

SEQ ID NO: 24217 - DNA, 50 bp, homo sapien
tatgttgctacacaaatgttctgacygctacatagtcatgcaaaaattat

SEQ ID NO: 24218 - DNA, 50 bp, homo sapien
gccaagatgaggcactagcagatgasaggatgtgtggaggaaaaatattt

SEQ ID NO: 24219 - DNA, 50 bp, homo sapien
atatataactagcagcatatttccaragaaaatctccagctggctttttg

SEQ ID NO: 24220 - DNA, 50 bp, homo sapien
attgctgctgatcaggtcataaaaarcatcacaatctgaaggcaagttat

SEQ ID NO: 24221 - DNA, 50 bp, homo sapien
actatgcaatattgaaaatttataasaagagtgaactttttaaacaatgt

SEQ ID NO: 24222 - DNA, 50 bp, homo sapien
aaatgcactcttcgttagttctacayggttcttcttataaataacatatt

SEQ ID NO: 24223 - DNA, 50 bp, homo sapien
ggttacaattctggaagacagcttgsaaacaagtaagattcccagcctta

SEQ ID NO: 24224 - DNA, 50 bp, homo sapien
tctggaaatcaaccagtgagactacyaaattcttgtgatccagtcctatc

SEQ ID NO: 24225 - DNA, 50 bp, homo sapien
aggaatacccataggcttggcaatasagacaacttcgcaatgggtgcact

SEQ ID NO: 24226 - DNA, 50 bp, homo sapien
tgttttgtgggtgtatatttgtgtasgattatgaattagacagtattctg

SEQ ID NO: 24227 - DNA, 50 bp, homo sapien
ataaaagacatgaagtttcaagaaaktgatgtgacaaagattgcttcaaa

SEQ ID NO: 24228 - DNA, 50 bp, homo sapien
gttggctctgtgtccacaattgatcrcaaaaggctttctacaggaaaggt

SEQ ID NO: 24229 - DNA, 50 bp, homo sapien
attgtaaaaaaaggctgagcagagawctaatattgtgaaccacttaagaa

SEQ ID NO: 24230 - DNA, 50 bp, homo sapien
aattcaagggctcttgccaattgtaraagatttcattagacagggactta

SEQ ID NO: 24231 - DNA, 50 bp, homo sapien
caaccagcctctacctccagagacaytatcaaatttagcctaccctgcag

SEQ ID NO: 24232 - DNA, 50 bp, homo sapien
tctctctaattactagctgtaaaackcctatcaaaatagaaagcttattt

SEQ ID NO: 24233 - DNA, 50 bp, homo sapien
tccttatcctgcaagactctacttaygcttcacctagtcctcgaaacctt

SEQ ID NO: 24234 - DNA, 50 bp, homo sapien
cattcataggttccagggattaagaygcagaaatatattttggcaggggt

SEQ ID NO: 24235 - DNA, 50 bp, homo sapien
cctgccatctggtcagcatttctagyaaaggtgtcttgaagaccttggca

SEQ ID NO: 24236 - DNA, 50 bp, homo sapien
agactatcatttaagtactgaacccycatgatatgtgaactgctctgaga

SEQ ID NO: 24237 - DNA, 50 bp, homo sapien
aaaggtcacagcattagagcaaccasaatgttcaaaagtgtgttggtttc

SEQ ID NO: 24238 - DNA, 50 bp, homo sapien
aacagggaaagcaaagtattaagcartatggagtgatcattttgcactgt

SEQ ID NO: 24239 - DNA, 50 bp, homo sapien
agacaatcaggcaatattttcaggartaggtagtctttgaaaagaaactt

SEQ ID NO: 24240 - DNA, 50 bp, homo sapien
gcgggaaggggagtggtggtctcacratactgtgactctgagtaactaat

SEQ ID NO: 24241 - DNA, 50 bp, homo sapien
aaaagtttagagtggtctatttggasgttaataggtgacacactttaaat

SEQ ID NO: 24242 - DNA, 50 bp, homo sapien
agacaaggatgtccactcttgtccartcaacctaagggtccatcaaagga

SEQ ID NO: 24243 - DNA, 50 bp, homo sapien
tctgatggcaaggaagccttgatccracattagatctatgtatttatcat

SEQ ID NO: 24244 - DNA, 50 bp, homo sapien
gacataattcccaattcatacttaartctcaccgttgcaatttagacata

SEQ ID NO: 24245 - DNA, 50 bp, homo sapien
ttactgggtgtccaatgtatgtttaygttctggaatcctttaataggggt

SEQ ID NO: 24246 - DNA, 50 bp, homo sapien
tgtcacattcactgcacgtttgtcayattcacgttcactgcagctctctt

SEQ ID NO: 24247 - DNA, 50 bp, homo sapien
tatatgtttataattgttatacccaygtgatggtatcattgttatatcca

SEQ ID NO: 24248 - DNA, 50 bp, homo sapien
cagccaagctatttaaacagtagacygcaggactagccatagctcttcag

SEQ ID NO: 24249 - DNA, 50 bp, homo sapien
caaattccaaattgtatggcatatarcgtttttcattggtggtttccaag

SEQ ID NO: 24250 - DNA, 50 bp, homo sapien
tcaaatgatataatcctaaagactcraataggaaaaaatgtgtattttaa

SEQ ID NO: 24251 - DNA, 50 bp, homo sapien
gaggatctaggtttaactgcttttgkaactgctcaaagtatgggattgtt

SEQ ID NO: 24252 - DNA, 50 bp, homo sapien
aacataccaaaacttaagagatatamcaaaaacaatattaagagataatt

SEQ ID NO: 24253 - DNA, 50 bp, homo sapien
agctatgtcaaagtcatatggtacakgtatataaagtttcagtttcgggt

SEQ ID NO: 24254 - DNA, 50 bp, homo sapien
cagtaggcagaaatatagtatagtaygtatcaatatgcagagtgtgttgg

SEQ ID NO: 24255 - DNA, 50 bp, homo sapien
acggagggctccaggggcttacctcrcactttggaccttgttgaatggcg

SEQ ID NO: 24256 - DNA, 50 bp, homo sapien
caggctgtgcttatgagattcagctmacaaccctgggctaaatcggtggg

SEQ ID NO: 24257 - DNA, 50 bp, homo sapien
tatccaccctcatagaaatcaataarttatattctagcatgaccttagcc

SEQ ID NO: 24258 - DNA, 50 bp, homo sapien
aaaaaatcatgtaactactcatttayactatgaattgtcactcagaagct

SEQ ID NO: 24259 - DNA, 50 bp, homo sapien
tctttttcttttcctgaattagtgaygcgaaccacaggaattcgagggca

SEQ ID NO: 24260 - DNA, 50 bp, homo sapien
ttcaaccccagcagtgtccatacaamatgactgaactcttatgttttgtg

SEQ ID NO: 24261 - DNA, 50 bp, homo sapien
tcttcctctatttgggagatcaagarctaattcactacaaaataaaaacc

SEQ ID NO: 24262 - DNA, 50 bp, homo sapien
ttaggagatgaagatattttgagagkatggttaatgtacactctgctgta

SEQ ID NO: 24263 - DNA, 50 bp, homo sapien
gtgctgaagccacgttggttcctaaratcatccctgtgttagtggttttg

SEQ ID NO: 24264 - DNA, 50 bp, homo sapien
ctggccaggaagtactgatacgacckgaagatgactactctcttaaaaac

SEQ ID NO: 24265 - DNA, 50 bp, homo sapien
atttacagattgtatctctggcctaygggttttgaagtgattcttatttt

SEQ ID NO: 24266 - DNA, 50 bp, homo sapien
gcttactggtttccactgttaaaatyaatggttggtgaaatatgtggtag

SEQ ID NO: 24267 - DNA, 50 bp, homo sapien
cgctccctaacacgttgagaaaatasatgccaataacaaacacgtcctcc

SEQ ID NO: 24268 - DNA, 50 bp, homo sapien
aaagccaactgaataacactgttgayggaacactgcttttcctcattaat

SEQ ID NO: 24269 - DNA, 50 bp, homo sapien
ttgatattatttgttcagcatttaasactagaatgtgttcctatagagtc

SEQ ID NO: 24270 - DNA, 50 bp, homo sapien
ctgtgcaaacaaaaccctcaggcaawttctattttctgaatgatgttact

SEQ ID NO: 24271 - DNA, 50 bp, homo sapien
tgttgggctgtcccagtgctgctagrcaacagcttccggtgccttccctg

SEQ ID NO: 24272 - DNA, 50 bp, homo sapien
tattgaaatgttctgaagtcattgcrctgccaggtcctgcaaactgtgag

SEQ ID NO: 24273 - DNA, 50 bp, homo sapien
ggaaacaaatagaaattctgcagctraaaagtacagtaacaaaaattctt

SEQ ID NO: 24274 - DNA, 50 bp, homo sapien
ggagtagggaactctagggctcttgyaaaaacacctaataagcttccaga

SEQ ID NO: 24275 - DNA, 50 bp, homo sapien
aagcatttgatccaatctgttttaastatttaaaaggccattatatacta

SEQ ID NO: 24276 - DNA, 50 bp, homo sapien
gagttgaatcagtcaaagaaagtgcmaaatatactagaatttacaacaaa

SEQ ID NO: 24277 - DNA, 50 bp, homo sapien
actatcagaagtgcaggttaatacasagaaattcaagtcaacagtacagg

SEQ ID NO: 24278 - DNA, 50 bp, homo sapien
acaactgggtgccaggcaggcagackattgaatccttgctctcctgcctt

SEQ ID NO: 24279 - DNA, 50 bp, homo sapien
tacagagaaattcaagtcaacagtayaggtttgaaggttaatcctcagta

SEQ ID NO: 24280 - DNA, 50 bp, homo sapien
gctgcaacaggcctaatattcttaamtggttatttcacaggacttctcag

SEQ ID NO: 24281 - DNA, 50 bp, homo sapien
tgaatacacaaatgataagagagcamaatagccttatggttgttatggag

SEQ ID NO: 24282 - DNA, 50 bp, homo sapien
tctccaaccaaattacaaagaaggcraacatgtataatcccaaatctcaa

SEQ ID NO: 24283 - DNA, 50 bp, homo sapien
  misc_feature (6)..(6): n is a, c, g, or t
ctcagnccaatggctttgaataatcyaacacctttagaaaggccgttcct

SEQ ID NO: 24284 - DNA, 50 bp, homo sapien
gtaggactttttgtcgcaagtaagakaaatacattttaataagccagggg

SEQ ID NO: 24285 - DNA, 50 bp, homo sapien
aaagcaacacactatgaatggacacrgtaatttgaatgaagctcaaagga

SEQ ID NO: 24286 - DNA, 50 bp, homo sapien
agaaacaggaaaatgaaataatacamatgattaataaggtgatatgaaga

SEQ ID NO: 24287 - DNA, 50 bp, homo sapien
acgatttgagagttgatcctcagacrctgaattggaagtgctcttagtct

SEQ ID NO: 24288 - DNA, 50 bp, homo sapien
catttttttgggacagtttattccayctgtaagcagctctgatgactgga

SEQ ID NO: 24289 - DNA, 50 bp, homo sapien
gactttttcttttaggtatgagagascttatcaaatataaattaaaatct

SEQ ID NO: 24290 - DNA, 50 bp, homo sapien
gttatgggtacaagtcagcactggaratagaagaatttgccaaaagtcag

SEQ ID NO: 24291 - DNA, 50 bp, homo sapien
gagggaagcctgtcggataatcagaygaacctgtttggggcataaactcc

SEQ ID NO: 24292 - DNA, 50 bp, homo sapien
acagagttccctttcatgaatactcycttggacataggcaatagtccaga

SEQ ID NO: 24293 - DNA, 50 bp, homo sapien
tggaaaaaatgaaacaaaaatactargtggaaactgaatacagtggctaa

SEQ ID NO: 24294 - DNA, 50 bp, homo sapien
ggaagagtctgtgtttgtgatagtcratctaattgtccctgagcccccac

SEQ ID NO: 24295 - DNA, 50 bp, homo sapien
tcagtccacaggaattgccaggtagwcatgtaactgaagatgtgctgaag

SEQ ID NO: 24296 - DNA, 50 bp, homo sapien
ttttgaatacatgcatggaatatctraatgtctatccttaggcatgtgtt

SEQ ID NO: 24297 - DNA, 50 bp, homo sapien
ttcagggacagctgaaatctttagartacctttactttgatctctatctg

SEQ ID NO: 24298 - DNA, 50 bp, homo sapien
ccctgctttactgatgttttccaagwaatgattcacaaggtcaagtttat

SEQ ID NO: 24299 - DNA, 50 bp, homo sapien
tactcctctttctctccggcctatcyagtctcagggcttgtgggctggct

SEQ ID NO: 24300 - DNA, 50 bp, homo sapien
ttccagccaatgaatggaaagacaaygtgttatatcctaccagcctactt

SEQ ID NO: 24301 - DNA, 50 bp, homo sapien
ccctggggctaaacagcaaagttacygcctttccactattattgccaact

SEQ ID NO: 24302 - DNA, 50 bp, homo sapien
agagctcacaattcttaggtatcaargaccaatgcagtggttgtcaaccc

SEQ ID NO: 24303 - DNA, 50 bp, homo sapien
cagaagcattgaagatgtgttgatamcaagggagctgaaatttaggttac

SEQ ID NO: 24304 - DNA, 50 bp, homo sapien
ttatgaaatacaataataaccttgasgaaatgaagaaaagaattatacat

SEQ ID NO: 24305 - DNA, 50 bp, homo sapien
aaaagcttgtattattattactacarctatgactttgcctttgattacta

SEQ ID NO: 24306 - DNA, 50 bp, homo sapien
ttaataaaaagattgaaatcctacawgtatcttttctgactataagaaaa

SEQ ID NO: 24307 - DNA, 50 bp, homo sapien
aatgatataggttgataaattttcargttaaactctctgataggacaaga

SEQ ID NO: 24308 - DNA, 50 bp, homo sapien
ctcctttcttgcgttaggatcttcakggattgcaacattgcaccctttac

SEQ ID NO: 24309 - DNA, 50 bp, homo sapien
atttatagaataatcctttcaacaasagtgacgatacattcttctttacc

SEQ ID NO: 24310 - DNA, 50 bp, homo sapien
gagtgaggttgggtggcatgatatamtaaaaatgttgaatgatatatgtt

SEQ ID NO: 24311 - DNA, 50 bp, homo sapien
atcttcagcatgcaacaaagacctaygaacattttgtctttgcaagcaaa

SEQ ID NO: 24312 - DNA, 50 bp, homo sapien
tgatggagaagcagttgacatcatartaatgcaaataacttcacatggag

SEQ ID NO: 24313 - DNA, 50 bp, homo sapien
aagagaaagcttgccctattcttcasgcttgaggtgcttgagaataacac

SEQ ID NO: 24314 - DNA, 50 bp, homo sapien
gaaatggtgcattctcttagatataygctgcttggaaaatgataatattt

SEQ ID NO: 24315 - DNA, 50 bp, homo sapien
atgaaagtccaaaacactttgagagyaaattaagagctcctttctgcaag

SEQ ID NO: 24316 - DNA, 50 bp, homo sapien
aactattcggatactgactttgagayaaaataaattctccagggatgatg

SEQ ID NO: 24317 - DNA, 50 bp, homo sapien
ggtattgtttccgtgaaaatcttgasgcgaagaacaatttctaatgaggc

SEQ ID NO: 24318 - DNA, 50 bp, homo sapien
gtacaactgggtacatcagtagataygatccataaagtaacaaggcagaa

SEQ ID NO: 24319 - DNA, 50 bp, homo sapien
gaaagtttaaaattgcttttggttayatgagtaatttcatttaaaacttt

SEQ ID NO: 24320 - DNA, 50 bp, homo sapien
tttgagcaattttatatagttttgargacaggagccctgtaagagtctct

SEQ ID NO: 24321 - DNA, 50 bp, homo sapien
tctatacccaaaagcgtttgttgaaytggagaaagccagggagcagagag

SEQ ID NO: 24322 - DNA, 50 bp, homo sapien
attatgcagatacctggcacacagcratacaccaaaggtagataaaacta

SEQ ID NO: 24323 - DNA, 50 bp, homo sapien
cccttgctaccactaagtaatagtaygctaaaatcataagggcaggccga

SEQ ID NO: 24324 - DNA, 50 bp, homo sapien
aaatgaaacgtaaagcgattgcctgyatcataaagctagttaggagcaga

SEQ ID NO: 24325 - DNA, 50 bp, homo sapien
aacaatcagatctctcaggaacgaayagagaaagagttcatttattactg

SEQ ID NO: 24326 - DNA, 50 bp, homo sapien
taaaactggtgaaaagtaataagacracagtaagatgcataagcttggac

SEQ ID NO: 24327 - DNA, 50 bp, homo sapien
ggcaagctgacaataatagaaactcragagaatttgaaattttcctgtaa

SEQ ID NO: 24328 - DNA, 50 bp, homo sapien
actaattcaatatgaacagaggcacraaagtctacagtaaaaaacaaaca

SEQ ID NO: 24329 - DNA, 50 bp, homo sapien
ccatggaccacacagtgaatgtcaakgtatcagagcgctgtttctcaaaa

SEQ ID NO: 24330 - DNA, 50 bp, homo sapien
acagagacaggtataggaaggtgaaractgtgcttatgttatttaattca

SEQ ID NO: 24331 - DNA, 50 bp, homo sapien
ttacagtaatagagatgaagaagaakaatacagagacaggtataggaagg

SEQ ID NO: 24332 - DNA, 50 bp, homo sapien
tatcattttgttcttagattaattayatggttcattatactggaatgtgt

SEQ ID NO: 24333 - DNA, 50 bp, homo sapien
cactataaaagtaaagaaagtaaaaragtgtcagggaagattagtaggtg

SEQ ID NO: 24334 - DNA, 50 bp, homo sapien
cttcctttcctcccatttctgaatayggtggccctgttgtagaaaaagtg

SEQ ID NO: 24335 - DNA, 50 bp, homo sapien
cattactctgaataaagattagtgawcatgcagctgaaaaattcaatagc

SEQ ID NO: 24336 - DNA, 50 bp, homo sapien
agctctaaaaacatgacaacatttaraggcataatagaagagaagcaata

SEQ ID NO: 24337 - DNA, 50 bp, homo sapien
atacctcctttatttcatatcattcraccatttctgatttgtccccatgt

SEQ ID NO: 24338 - DNA, 50 bp, homo sapien
caatagcaactggaggaagtaataaygatttgccacaagttataaggact

SEQ ID NO: 24339 - DNA, 50 bp, homo sapien
aagcaagcagatacagcaactggtarcatcattatatacagctgagttga

SEQ ID NO: 24340 - DNA, 50 bp, homo sapien
agaacctatattctctgattggcaaygtcatatggaagtttctatgtatg

SEQ ID NO: 24341 - DNA, 50 bp, homo sapien
ggaagagaggtattagaaatgtagaygagctaaacttttgtatttcaaag

SEQ ID NO: 24342 - DNA, 32 bp, homo sapien
tggtacaaaattcttawgttctttccaattat

SEQ ID NO: 24343 - DNA, 50 bp, homo sapien
tcctgggacatatttgcgtggagtgyattgatcgataggctcccttgacc

SEQ ID NO: 24344 - DNA, 50 bp, homo sapien
gcaggcaaataagtaaataaacaaasgaaatcattatagacagcactggg

SEQ ID NO: 24345 - DNA, 50 bp, homo sapien
aagaatagattgtttgaggctaatawggacatagggatagcaattagaag

SEQ ID NO: 24346 - DNA, 50 bp, homo sapien
cctaatggctgactctcacatactartaaacattaccatttctgtaaata

SEQ ID NO: 24347 - DNA, 50 bp, homo sapien
catgaagtacaaaaaactccacatasattaaatataaagacatcttcact

SEQ ID NO: 24348 - DNA, 32 bp, homo sapien
aactatttccttctaaktgctatccctatgtc

SEQ ID NO: 24349 - DNA, 50 bp, homo sapien
atctgaagaaaactaagtctaattakgtagtcaaatgttttggttaaatg

SEQ ID NO: 24350 - DNA, 50 bp, homo sapien
actctgcagtcctttctcaggcaagsctcctaagaccttctccaatggaa

SEQ ID NO: 24351 - DNA, 50 bp, homo sapien
ggcaagtctgaattctactgcctaaratattagaaatgatgattggtaca

SEQ ID NO: 24352 - DNA, 50 bp, homo sapien
tctgtctgggctctgacctaaaagtracagttgaataacaatcaatgcca

SEQ ID NO: 24353 - DNA, 50 bp, homo sapien
tagttacctaaaactgtatgctttakattattggcattcaaaagtttgac

SEQ ID NO: 24354 - DNA, 50 bp, homo sapien
acaagagaccgaaactgtcttaactyacacttactcatgtacccaatgga

SEQ ID NO: 24355 - DNA, 50 bp, homo sapien
caccaactaactaacagttgctagaycattgtgggttactacaatcattg

SEQ ID NO: 24356 - DNA, 50 bp, homo sapien
tgttaggctcttttagattgcaaggwagagacatactcaggttatctaag

SEQ ID NO: 24357 - DNA, 50 bp, homo sapien
caggatgaagctgacgccatggaaasaaaacagagatggaaagaaatcaa

SEQ ID NO: 24358 - DNA, 50 bp, homo sapien
caaagatgtataatcaatattcttayaggcaagtggaaggaaagggggct

SEQ ID NO: 24359 - DNA, 50 bp, homo sapien
aaagtcctgagttttaacagtgtgamtaaacatgcatggtaaaacgagta

SEQ ID NO: 24360 - DNA, 50 bp, homo sapien
ttaaatgttaaccacattcaaaaacracttcatggaaatacccagaataa

SEQ ID NO: 24361 - DNA, 50 bp, homo sapien
tatgttactgatttaacaacatatakaatcctgttacagtcaattaaaaa

SEQ ID NO: 24362 - DNA, 50 bp, homo sapien
ggatatgggtctgttctgtgcaggaygtaaaggatgataatagagaacgg

SEQ ID NO: 24363 - DNA, 50 bp, homo sapien
tgtaccccataaatatacacagctaycatgtacccacaaacattttaaaa

SEQ ID NO: 24364 - DNA, 50 bp, homo sapien
gaataatacagagtgtgacattgaaratttgcaaagtcatcatgatgttg

SEQ ID NO: 24365 - DNA, 50 bp, homo sapien
aatgagaaattctcatgcagagaaarggaatgtttaatccactaaactcc

SEQ ID NO: 24366 - DNA, 50 bp, homo sapien
taacctcaatgtaaaccatcacaackgatcaatatttactgaacatctac

SEQ ID NO: 24367 - DNA, 50 bp, homo sapien
tagcttcattcctgtattcaaaataygtacccagcaatgctaaggtatat

SEQ ID NO: 24368 - DNA, 50 bp, homo sapien
gctaaaaactacgatgtagagttgaygtacagattactattttatggtat

SEQ ID NO: 24369 - DNA, 50 bp, homo sapien
tagtttagagttggtgtctgacataygaaaggtaatttataatagtatat

SEQ ID NO: 24370 - DNA, 50 bp, homo sapien
tacctaatggaccttttttgagatayaaggttgagccacagctctagctg

SEQ ID NO: 24371 - DNA, 50 bp, homo sapien
tcattacattacttttagcctaggamgacattcagactatggcctcgtgg

SEQ ID NO: 24372 - DNA, 50 bp, homo sapien
aaattgggcataagaggtttctaacyctaggacaaggaattcaaccatga

SEQ ID NO: 24373 - DNA, 50 bp, homo sapien
tctttcatctgtatagtaaaaatagracttggtggaattctcaaaatcaa

SEQ ID NO: 24374 - DNA, 50 bp, homo sapien
tactatttgtggtatcaattcattcwcattgggtttactaaattattatt

SEQ ID NO: 24375 - DNA, 50 bp, homo sapien
tctgagttcatagggccaagtaaaayatcattcttcttgatgtttcctca

SEQ ID NO: 24376 - DNA, 50 bp, homo sapien
acatcctatagctatcctgtattcakagagtagacagctaattgtaaacc

SEQ ID NO: 24377 - DNA, 50 bp, homo sapien
agtataaattatcttcatgcttaaartatgtttccatagatagttctcaa

SEQ ID NO: 24378 - DNA, 50 bp, homo sapien
gcagggtacccatgcactagatgaaygggtcacaccaatggcatgaaatg

SEQ ID NO: 24379 - DNA, 50 bp, homo sapien
cagtcctgagttgaattctggaagargtgcaggccatgggctaacattaa

SEQ ID NO: 24380 - DNA, 50 bp, homo sapien
atgcagtagcatctctgtggtaagaratttaatggaagtgtcattaagga

SEQ ID NO: 24381 - DNA, 50 bp, homo sapien
tgtctttcagtcacctgtgacctccragtacctatgcagggaggagacat

SEQ ID NO: 24382 - DNA, 50 bp, homo sapien
agaggagaaaaaaaatgcaatagtawccatccagtttgaaatgtgaccca

SEQ ID NO: 24383 - DNA, 50 bp, homo sapien
tatttttctttggaagtaaacatgcwcaaaggtctttgtctggcaaggca

SEQ ID NO: 24384 - DNA, 50 bp, homo sapien
gtaaagattgccatttgggatgagawtaatatatgctaataccacacaac

SEQ ID NO: 24385 - DNA, 50 bp, homo sapien
gtagcatcctgttgtttaaccaatcrcttatgtttggccagaggcatcaa

SEQ ID NO: 24386 - DNA, 50 bp, homo sapien
ctaggagaaagcaggtggaagaataygaaaggactagacttgctgagtct

SEQ ID NO: 24387 - DNA, 50 bp, homo sapien
ttcttaatgtctcaagacagaaatcrgatttagacttaacctaaggccac

SEQ ID NO: 24388 - DNA, 50 bp, homo sapien
gaagctacaacaggaaaaatgtgtgracatgaagggaacttgtgagtagg

SEQ ID NO: 24389 - DNA, 50 bp, homo sapien
atttcaatcaggaatgactacacaawacaatatgtttcatctcaagcaga

SEQ ID NO: 24390 - DNA, 50 bp, homo sapien
ttatttcctgagccatatccagtcarctgatgagtccattaaagattttt

SEQ ID NO: 24391 - DNA, 50 bp, homo sapien
gaaaaaatagattatctacaagttargatgacttcagactcctgatctgc

SEQ ID NO: 24392 - DNA, 50 bp, homo sapien
gtgcttctatttgcttatatttgcayaaatggtctctggaagggcacttg

SEQ ID NO: 24393 - DNA, 50 bp, homo sapien
tagctctgtaattcagtagatataamgagcttgcaatccttgtgaactgt

SEQ ID NO: 24394 - DNA, 50 bp, homo sapien
cttgcaatccttgtgaactgtcagcragggcatgttagtgggtactggta

SEQ ID NO: 24395 - DNA, 50 bp, homo sapien
ctaaacagctacatctttaatgaagscaattctttacatgaccactgttt

SEQ ID NO: 24396 - DNA, 50 bp, homo sapien
tgacacaatgtctggcatagactaartgctcttcatttaaatgaaccata

SEQ ID NO: 24397 - DNA, 50 bp, homo sapien
gaataatgaggctagaaaattattamggcaagagatgaagacaggttatg

SEQ ID NO: 24398 - DNA, 50 bp, homo sapien
ccagccccaaagagaatcctaactawataaagccaaccagattatgatct

SEQ ID NO: 24399 - DNA, 50 bp, homo sapien
gggtttggtttacaaattatttcagsacccaggtaataagcataacactg

SEQ ID NO: 24400 - DNA, 50 bp, homo sapien
tgtccaacagaggattagatttaggrattcacaggttgcagggtctccag

SEQ ID NO: 24401 - DNA, 50 bp, homo sapien
ctgtaggtattgaagaaattgtacawgataagattcatttctttaaaaaa

SEQ ID NO: 24402 - DNA, 50 bp, homo sapien
cccatcatcactcccagttattttaygcactttgaaatttgaacttttca

SEQ ID NO: 24403 - DNA, 50 bp, homo sapien
tgtgtctggcccagataaaattgccwtggttatctctgtcttccagtaaa

SEQ ID NO: 24404 - DNA, 50 bp, homo sapien
ttttccactcactgcattaacataaytcaagagaagttgccagaacggac

SEQ ID NO: 24405 - DNA, 50 bp, homo sapien
ctcagttgtctcatgtgtaaatgacygggttgtcgcagtggttttcaacc

SEQ ID NO: 24406 - DNA, 50 bp, homo sapien
ttctccacagtctggcatagttaaartaggttagtgacaattgctaggca

SEQ ID NO: 24407 - DNA, 50 bp, homo sapien
tgtgttaaaatgccatattatataasctctaaaatctttatgcatgataa

SEQ ID NO: 24408 - DNA, 50 bp, homo sapien
tgcttctgtgattctacaaaatccartaaagaaggatatcataactatca

SEQ ID NO: 24409 - DNA, 50 bp, homo sapien
ctgagtcctcattaatgccatttaamaggaaattcagctaaagccccaag

SEQ ID NO: 24410 - DNA, 50 bp, homo sapien
gaattcatcttagaaataaggaatcraagtgaacctgaccaagtatatag

SEQ ID NO: 24411 - DNA, 50 bp, homo sapien
gaataccaggaggacaaaactgcacygaaagacagcttgggagaactaca

SEQ ID NO: 24412 - DNA, 50 bp, homo sapien
tctctagcaggaaatatgagtccacmgatagcaaagactatttactgtat

SEQ ID NO: 24413 - DNA, 50 bp, homo sapien
tttgtagctttctgcttatactcctyaagttcttccattttcctttctct

SEQ ID NO: 24414 - DNA, 50 bp, homo sapien
gatttagtgccatccacaaagttaakcaaaggcataaatgactcattctt

SEQ ID NO: 24415 - DNA, 50 bp, homo sapien
ctctccccagatcacttttcacataygataggtagtaaaaaaatatttga

SEQ ID NO: 24416 - DNA, 50 bp, homo sapien
gaggttttgcataaattgattaggawatgctcctgtcttgtccagtcctt

SEQ ID NO: 24417 - DNA, 50 bp, homo sapien
agggcacacagacattcagaccatasgatatttggacatttttctatatc

SEQ ID NO: 24418 - DNA, 50 bp, homo sapien
atgactgtagtcccaagaatagggcyagttgcatattagaaatgccacaa

SEQ ID NO: 24419 - DNA, 50 bp, homo sapien
tcatcctttaaacttagcatggtaayggttggtcctcaacatccctgcag

SEQ ID NO: 24420 - DNA, 50 bp, homo sapien
ctcgtctaaatatcatcagctcaaawctctcaaatttcatcatttaaatc

SEQ ID NO: 24421 - DNA, 50 bp, homo sapien
agctccagcctctttggtggactatragattaataaaatgtggttcaaag

SEQ ID NO: 24422 - DNA, 50 bp, homo sapien
gaattttttgctattcagtttatgcraatgatctcaatacttaaaaaaat

SEQ ID NO: 24423 - DNA, 50 bp, homo sapien
aaacaaacttttatatgatccttaargtaaaagcagaattgaaactggcc

SEQ ID NO: 24424 - DNA, 50 bp, homo sapien
atttgcttcaatatccggttgtcaaytgtagaacaacgaaattttttcat

SEQ ID NO: 24425 - DNA, 50 bp, homo sapien
tatgactgaagcacagatgtgtctartagaaatcacccttcacccaaaag

SEQ ID NO: 24426 - DNA, 50 bp, homo sapien
atagatttgatgtgaatattatgcartctacaaaataaacatgttaaaat

SEQ ID NO: 24427 - DNA, 50 bp, homo sapien
ttacctgtttttcgaggctattttcmagtcagtgcctagagatcaaactc

SEQ ID NO: 24428 - DNA, 50 bp, homo sapien
gtgatgttaattccaaataatttacrggttcttgagcttttcatcatggt

SEQ ID NO: 24429 - DNA, 50 bp, homo sapien
gtagcatccatacaaattttatgagkccgtttttatttcattagagaccc

SEQ ID NO: 24430 - DNA, 50 bp, homo sapien
aagtctcatggctggtaacaaagacrgcgttaggacagactctttactca

SEQ ID NO: 24431 - DNA, 50 bp, homo sapien
catcaaaaaacaggtggcgccatgarcggtgaatctatgttactgtatta

SEQ ID NO: 24432 - DNA, 50 bp, homo sapien
aacaaacaaatgccatgggccatagratcaaactttaaaagcaaaatagc

SEQ ID NO: 24433 - DNA, 50 bp, homo sapien
tttggaaaaaccgtagaaaacactaygactggcggaagcatgctggccca

SEQ ID NO: 24434 - DNA, 50 bp, homo sapien
catttgtttgtttggcctgtgttggkcaaatagagttaaaaacaccttac

SEQ ID NO: 24435 - DNA, 50 bp, homo sapien
gagtcccccactgagaatgactataycttcaaagacaatgttactcctta

SEQ ID NO: 24436 - DNA, 50 bp, homo sapien
tgagccaccatgcctggcagatttayattgttcaaaataacgtcactttt

SEQ ID NO: 24437 - DNA, 50 bp, homo sapien
aagcttatgttgtaaagtagaaagcmaagtgttttcagctcatgcactct

SEQ ID NO: 24438 - DNA, 50 bp, homo sapien
aaaatgtagaaaactcagcaaggtargaagataagaaataagagttatag

SEQ ID NO: 24439 - DNA, 50 bp, homo sapien
gaatacgacaattgaaaatttcaaakgtctggagagtaaacaattgtttg

SEQ ID NO: 24440 - DNA, 50 bp, homo sapien
acaatggcagagacagaccatttaartaaaccttgccaatattccaaaat

SEQ ID NO: 24441 - DNA, 50 bp, homo sapien
cagtcaacattttcccattattgacsatacaaacatttattattattatt

SEQ ID NO: 24442 - DNA, 50 bp, homo sapien
ctcttttatatttatcttgcttacaytatgtggcaatatttttttctcac

SEQ ID NO: 24443 - DNA, 50 bp, homo sapien
ctttgcaaatatcaaataaacactaycaggtagatcttcttattgctgta

SEQ ID NO: 24444 - DNA, 50 bp, homo sapien
agggtgatgctggtttgactggacgsaaaatcattgtggacacttatggc

SEQ ID NO: 24445 - DNA, 50 bp, homo sapien
atttgcctctagtaattcaagtaaaygcaaggcaagatcttgtggtctat

SEQ ID NO: 24446 - DNA, 50 bp, homo sapien
tcacatttgccccgtcagttgagaasagatgttatgctcaggcgcagaca

SEQ ID NO: 24447 - DNA, 50 bp, homo sapien
gacccagctacctctacaactgtcayctcagttcattctcaaaaatcctc

SEQ ID NO: 24448 - DNA, 50 bp, homo sapien
tcatcaatttcaaaaccatctctcarattcttacttcactttgaagtgta

SEQ ID NO: 24449 - DNA, 50 bp, homo sapien
attttccttcctatcaactcctagaratattattcattaatcacttggaa

SEQ ID NO: 24450 - DNA, 50 bp, homo sapien
tgtgataacagaaactaaaagaacarcaatcgcaataattatacttatgt

SEQ ID NO: 24451 - DNA, 50 bp, homo sapien
catttcgagccccattccaactatcragggaggctgtctgagaacaaagg

SEQ ID NO: 24452 - DNA, 50 bp, homo sapien
tttttttgcaccagagtacttttcasatgaatgcttgaaatcctctcatt

SEQ ID NO: 24453 - DNA, 50 bp, homo sapien
ctagagcacaattcatagtagagaaygttgtatttgccagaggtttatcg

SEQ ID NO: 24454 - DNA, 50 bp, homo sapien
tttaactggtcattaaaacctgactkaagatttctccttagaagcttggt

SEQ ID NO: 24455 - DNA, 50 bp, homo sapien
ttgatctgagaatattaagcgcaccyatttgatttattcagatgtgagac

SEQ ID NO: 24456 - DNA, 50 bp, homo sapien
ctcataaaatatataaaaagatatasgcttaccttctggtatactctatt

SEQ ID NO: 24457 - DNA, 50 bp, homo sapien
agacaaagaaagcaccattaacccaygctaatcatcaagtttgacattat

SEQ ID NO: 24458 - DNA, 50 bp, homo sapien
gtgtacaacatacaacatacatatayctttaaatctcacaagtattctgc

SEQ ID NO: 24459 - DNA, 50 bp, homo sapien
agaaatattaaagcaagcaagaatckaagtcaaaatatgaggttgagcag

SEQ ID NO: 24460 - DNA, 50 bp, homo sapien
tttgttggtctgcctttctctctgaygtgtacaacatacaacatacatat

SEQ ID NO: 24461 - DNA, 50 bp, homo sapien
ttattaagcttttgatacagaaaatsatatgtaaaaaagagaaacaatga

SEQ ID NO: 24462 - DNA, 50 bp, homo sapien
tctgtgggatttaattttgtatttaygagccaaaaaatacctcaggtaat

SEQ ID NO: 24463 - DNA, 50 bp, homo sapien
ataaatagaagatgatttcattcaamgcaaattaaactaaaagctcattt

SEQ ID NO: 24464 - DNA, 50 bp, homo sapien
atcaaactctctacgtatgaattgaycttatgactctacttatgaatagg

SEQ ID NO: 24465 - DNA, 50 bp, homo sapien
tactatcttgagatgtacaaaattarcaggcctcatttgcatttcctaaa

SEQ ID NO: 24466 - DNA, 50 bp, homo sapien
aataaaactagacaccttaagaggcyacgttgattaacatatttcataca

SEQ ID NO: 24467 - DNA, 50 bp, homo sapien
ttttttgagatatgatgttggtatgyaaccataataagcagcacattgaa

SEQ ID NO: 24468 - DNA, 50 bp, homo sapien
atctcttccaaccatgaataatgaasacatctaaatctcctatcgatcta

SEQ ID NO: 24469 - DNA, 50 bp, homo sapien
attccatagaaaactctggattaagycaaattaaagaaacatttttcata

SEQ ID NO: 24470 - DNA, 50 bp, homo sapien
attacaactgaaaatacactgtaaakgtagatagatacacagatgctccc

SEQ ID NO: 24471 - DNA, 50 bp, homo sapien
gcacgtgtgtgtgtacgtttgcaatyacatcactcatgcatttattgatt

SEQ ID NO: 24472 - DNA, 50 bp, homo sapien
atttctgaatgggtaaccaaatctayatttcaaagtaaaaacttagagaa

SEQ ID NO: 24473 - DNA, 50 bp, homo sapien
cttagggtttttttgaggaaaaagayggattttgcttgttaaaaaaagaa

SEQ ID NO: 24474 - DNA, 50 bp, homo sapien
tcacataaagataccaaaatacagaktacacataatacagagacaaaaac

SEQ ID NO: 24475 - DNA, 50 bp, homo sapien
tagatggtgtctctctacattaacamctatctgtagctttaaaatcagac

SEQ ID NO: 24476 - DNA, 50 bp, homo sapien
aggtatttttcttctaatgcttcacrcttggaacaaagacgagaataagc

SEQ ID NO: 24477 - DNA, 50 bp, homo sapien
tagccttggggaggtaaagacctctyaaggtgaactcctcattagcaaag

SEQ ID NO: 24478 - DNA, 50 bp, homo sapien
ttggtcagtgttctttcccaaggtasataattaagtcttttccaatgtaa

SEQ ID NO: 24479 - DNA, 50 bp, homo sapien
caggaagtccttactattcacaaaamgttttcattttgattgtcagaaac

SEQ ID NO: 24480 - DNA, 50 bp, homo sapien
ctgtctagtagagcttttagtggaaktgttctctatctctatactgtcca

SEQ ID NO: 24481 - DNA, 50 bp, homo sapien
ttggtacttatacactttaaatccaytaacacttaatacaaaaaagaaaa

SEQ ID NO: 24482 - DNA, 50 bp, homo sapien
gtgttgcaatcatgtagaaagcctarggacataaaatcctctgtaactgt

SEQ ID NO: 24483 - DNA, 50 bp, homo sapien
ctaacttgcatcacatccctttaatyagcctttctgatgtgagagtgatg

SEQ ID NO: 24484 - DNA, 50 bp, homo sapien
agtgttaagacatttatgacatagargctaaaatctgtgttttacaccac

SEQ ID NO: 24485 - DNA, 50 bp, homo sapien
aactctacctactagataacaatgaygcccattccatttgtgacagctaa

SEQ ID NO: 24486 - DNA, 50 bp, homo sapien
ggtggggccgaccctgagggtatgcygagctgatccagaaacacctgtgg

SEQ ID NO: 24487 - DNA, 50 bp, homo sapien
caacaaatattgactgaatacttcakgtgtccgatccattatgctaggaa

SEQ ID NO: 24488 - DNA, 50 bp, homo sapien
agaagaaaaagcaagtcgtttcccamgtttacctataaacagaacctgat

SEQ ID NO: 24489 - DNA, 50 bp, homo sapien
ctcctctagatctctgaatccattargaacatgtgccattattaagatct

SEQ ID NO: 24490 - DNA, 50 bp, homo sapien
gaagcattttaagggatcagatacarattcatcaaggagcgagactgcat

SEQ ID NO: 24491 - DNA, 50 bp, homo sapien
taaaaggaagtggtacactagtaaakgctcaacaatcaactgtctggaaa

SEQ ID NO: 24492 - DNA, 50 bp, homo sapien
gagttttagttgccaacccttggtakagatggacccaaagaagtgggcaa

SEQ ID NO: 24493 - DNA, 50 bp, homo sapien
taatgtttaacttatgccttcatcamaattatagttaagggttagtggaa

SEQ ID NO: 24494 - DNA, 50 bp, homo sapien
gttttggaagcagggacggttccacrgtcttgcctaggtgccattactgg

SEQ ID NO: 24495 - DNA, 50 bp, homo sapien
atcgaacatcataaagataagctgayaatgtgcaaactttaggacccaga

SEQ ID NO: 24496 - DNA, 50 bp, homo sapien
tcatcaagctgttattggcctatcargttagtcagctgagtgcttcagaa

SEQ ID NO: 24497 - DNA, 50 bp, homo sapien
tttctaccaagttgtgcgaaacctcragacctttgaaagtgtggttactt

SEQ ID NO: 24498 - DNA, 50 bp, homo sapien
actgtatgttatgccaaaattgtgayggttttgcaccttaatgaagtcta

SEQ ID NO: 24499 - DNA, 50 bp, homo sapien
atgttaaccatatgcaatctatataygtgtgttgaacatactttctatat

SEQ ID NO: 24500 - DNA, 50 bp, homo sapien
agaaactaaataaaatttcgactgaygtatacttaaggaatgcacagaga

SEQ ID NO: 24501 - DNA, 50 bp, homo sapien
gtctatgagctatgatgtcccagagragactgtcaagattatcaagacag

SEQ ID NO: 24502 - DNA, 50 bp, homo sapien
tgtatacttaaggaatgcacagagartataatcaccatcttctttttctc

SEQ ID NO: 24503 - DNA, 50 bp, homo sapien
atcaactggagtaacacacaatagaygaattaagaaaaataaaagaactg

SEQ ID NO: 24504 - DNA, 50 bp, homo sapien
taggccttctgattgcaaattgaacraccacctagaatcccagtttgaaa

SEQ ID NO: 24505 - DNA, 50 bp, homo sapien
tcggtattttgtgctgtccaatacaytcaaaagattttatagtgctgaac

SEQ ID NO: 24506 - DNA, 50 bp, homo sapien
tttcaagtcctttattatgtttcccygctaaaaaatgaattgacttctac

SEQ ID NO: 24507 - DNA, 50 bp, homo sapien
tagataatgaggacaaatagctaccrgagacttttgattctaagggatct

SEQ ID NO: 24508 - DNA, 50 bp, homo sapien
tgtgcagaaagatgtagtttgggccrcagagttccatacctgtggcatca

SEQ ID NO: 24509 - DNA, 50 bp, homo sapien
aaggactaaaaggagatgacttaagsagtaaaaccttctacaaagctata

SEQ ID NO: 24510 - DNA, 50 bp, homo sapien
caggtcaccaaatctgttagagaagycagttgaacgtagggtgtcacaaa

SEQ ID NO: 24511 - DNA, 50 bp, homo sapien
tggaaggataaaactgagaggtatcyagctccttttcatcaattttaaat

SEQ ID NO: 24512 - DNA, 50 bp, homo sapien
catatgaaaagttcttgattcttcaytcaaagacaaaaaaatggataatt

SEQ ID NO: 24513 - DNA, 50 bp, homo sapien
aaaaaacacattaaaagttgtttccyaatattcatccagtcttttttttt

SEQ ID NO: 24514 - DNA, 50 bp, homo sapien
tcaataaacaagcatttcctgaccaygtcttaagagtttcatcctgagtt

SEQ ID NO: 24515 - DNA, 50 bp, homo sapien
tatctcacacttcactggattcttaygacaacacaaagtcttcggctata

SEQ ID NO: 24516 - DNA, 50 bp, homo sapien
actaatttgtactgaacccttgatakagattaccttttataacatcacca

SEQ ID NO: 24517 - DNA, 50 bp, homo sapien
actttagaataaattgcatattgtawcaggctccgagactaatttgtact

SEQ ID NO: 24518 - DNA, 50 bp, homo sapien
ttaccttggaaaatatcacactgacsatacagtactttagaataaattgc

SEQ ID NO: 24519 - DNA, 50 bp, homo sapien
tctttctttctctgtagaccacacaygtttgaaaactgggaagctaatat

SEQ ID NO: 24520 - DNA, 50 bp, homo sapien
aactggaagctagatcacaagaacastatgaggtaaagccataagatctc

SEQ ID NO: 24521 - DNA, 50 bp, homo sapien
gcatctaagatgtgcaaattctatgraactttgaaactattaacttctcc

SEQ ID NO: 24522 - DNA, 50 bp, homo sapien
ggcccgcattcagacgccagctttasaatataccagttatttaacctctt

SEQ ID NO: 24523 - DNA, 50 bp, homo sapien
aatgatcaaatttatgtaaaaattamgacagagtgaaaattaggggataa

SEQ ID NO: 24524 - DNA, 50 bp, homo sapien
attatttatttaattactccataaakgtttattgcattaagtggtgagca

SEQ ID NO: 24525 - DNA, 50 bp, homo sapien
aaagacctggctacttctctatctayctagtaacagccaagtcaacaaga

SEQ ID NO: 24526 - DNA, 50 bp, homo sapien
atcttcccagcaatctaatattcaarttctgaagagagatctatgaatag

SEQ ID NO: 24527 - DNA, 50 bp, homo sapien
gcattagtcagaaaccatgctataayagttgagcactgcaatgaatttgg

SEQ ID NO: 24528 - DNA, 50 bp, homo sapien
actgaaaatatgttgcaatcagaaayggtcttttctctccaattccatcc

SEQ ID NO: 24529 - DNA, 50 bp, homo sapien
cttaaacaatttataataaatctaamtgttgagaaatgactatttactag

SEQ ID NO: 24530 - DNA, 50 bp, homo sapien
tgcaggctgactgacaactttcaaarggtgaaattccatggtttgtgttt

SEQ ID NO: 24531 - DNA, 50 bp, homo sapien
aagatgaagaggttgaaaagactcaraagttgtagaaaacagacttaaac

SEQ ID NO: 24532 - DNA, 50 bp, homo sapien
taaagctgcagtactgtgtcattaaratctctgtgacatgttaaatcact

SEQ ID NO: 24533 - DNA, 50 bp, homo sapien
agaggcagatatgtcactccaatacmacctcaatactgcaggaaggaaag

SEQ ID NO: 24534 - DNA, 50 bp, homo sapien
tctgggctcagtggtttaaagtagckctttcaaagtagaggactgattaa

SEQ ID NO: 24535 - DNA, 50 bp, homo sapien
gatctactaagaataacatcttacawcctttcttgctacatcaccaatag

SEQ ID NO: 24536 - DNA, 50 bp, homo sapien
tctgtaagtgttggaatggagtccaragacattagcagcgaacgtaggag

SEQ ID NO: 24537 - DNA, 50 bp, homo sapien
ctgtcgctcttctaacacttagatgraaatcttaattaggtaatacgatt

SEQ ID NO: 24538 - DNA, 50 bp, homo sapien
ttagctgacacattccatattacaaratgccttttctgaaattacttttt

SEQ ID NO: 24539 - DNA, 50 bp, homo sapien
gaggctctttataatattttcactaygtatcattttgcaagaaaatttcc

SEQ ID NO: 24540 - DNA, 50 bp, homo sapien
aaataacttgttcaaatgatgacaamaaggcactgacaaaggttgacatt

SEQ ID NO: 24541 - DNA, 50 bp, homo sapien
tccacctgtctggattgcagaataasgaagatacctggaaaaacagcatg

SEQ ID NO: 24542 - DNA, 50 bp, homo sapien
cacttggggaaagctccagacgatastaaacctatgagttgaagcttggg

SEQ ID NO: 24543 - DNA, 50 bp, homo sapien
taacctgattacctgtattatagcartgactatcatccagcaggctttag

SEQ ID NO: 24544 - DNA, 50 bp, homo sapien
tgctatggattctatcttatttttawccagctaaggtaatggaaagatgt

SEQ ID NO: 24545 - DNA, 50 bp, homo sapien
ttttttaaaaactgcattatttcaamatctttaaacatttttttcacacc

SEQ ID NO: 24546 - DNA, 50 bp, homo sapien
ttttattttgccagcagctaccctaygaccaatatctagatgcaaattga

SEQ ID NO: 24547 - DNA, 50 bp, homo sapien
tttaggtgacatcagccttctagaamtatagtcagtgtaaggagttacag

SEQ ID NO: 24548 - DNA, 50 bp, homo sapien
aagctaattatatagttaagtaggayagacaatgctagcatataaactgt

SEQ ID NO: 24549 - DNA, 50 bp, homo sapien
agaaatcagtgaagaacaagaaatcrgagggtaatagatgtagagaagaa

SEQ ID NO: 24550 - DNA, 50 bp, homo sapien
ttctcagaaggtacaccactttgaakttatctattctccttctcttatgc

SEQ ID NO: 24551 - DNA, 50 bp, homo sapien
tgatttgaatattatcagtttccaayatttttaggaatgtatattaccta

SEQ ID NO: 24552 - DNA, 50 bp, homo sapien
tgctgggactaacatgataaattggycagcctatgatatctactatccca

SEQ ID NO: 24553 - DNA, 50 bp, homo sapien
aagaaaacctgtggtcaagggctcamcttaaactccttggaaacagcata

SEQ ID NO: 24554 - DNA, 50 bp, homo sapien
tttgaaatatgattaacaagccagtraacaataagtttgaagtttagaac

SEQ ID NO: 24555 - DNA, 50 bp, homo sapien
ctatggagacctatgtttggagaccragtaagtatgcaagactcccaaac

SEQ ID NO: 24556 - DNA, 50 bp, homo sapien
tgataccaactatcaataggcttaayacccattttgctctgtttggattt

SEQ ID NO: 24557 - DNA, 50 bp, homo sapien
gaaaaagtgaaaaatagatcattaasatagaaggctccagacacctcata

SEQ ID NO: 24558 - DNA, 50 bp, homo sapien
agaggtattcctgtaggaaccttgamaatctaacagacattggatccaga

SEQ ID NO: 24559 - DNA, 50 bp, homo sapien
aaaaaagtggatatggggactcaaaygatgcagatggaatcaggtctctg

SEQ ID NO: 24560 - DNA, 50 bp, homo sapien
tggcctggcaatgggtatgacaaaamtaccttaataattagatgtgtcag

SEQ ID NO: 24561 - DNA, 50 bp, homo sapien
gtgactcatctggaatcgtcaagtcmatccaaagcagaagctatgaggaa

SEQ ID NO: 24562 - DNA, 50 bp, homo sapien
agatgaatagtgatcactaagaaccygacactgcagaccagctgaagact

SEQ ID NO: 24563 - DNA, 50 bp, homo sapien
ccaaaccataataagtatcagttcaycacatttactttaatccatatatt

SEQ ID NO: 24564 - DNA, 50 bp, homo sapien
caagaaggagaagttgaactgagtargtgaagaaaaatcaagggccagaa

SEQ ID NO: 24565 - DNA, 50 bp, homo sapien
ctgaaattttcatttctgtagatgaygtatattttttatcttttttctgt

SEQ ID NO: 24566 - DNA, 50 bp, homo sapien
gatgggctcgtgctagggtgaactasaaaaccacatcattaacaatccta

SEQ ID NO: 24567 - DNA, 50 bp, homo sapien
ataagcacaaatacaataatggggcracttcatacttaacttttgtcatt

SEQ ID NO: 24568 - DNA, 50 bp, homo sapien
ttaactattcttatatcacctaataraacactaaaacagtatcattttat

SEQ ID NO: 24569 - DNA, 50 bp, homo sapien
tgttttctaaaattaacatctctgaratatagaaagacatgcaaaggggc

SEQ ID NO: 24570 - DNA, 50 bp, homo sapien
acatacagcagtttcatggtatggaraatatggaattcacatcctgattt

SEQ ID NO: 24571 - DNA, 50 bp, homo sapien
ctctcacctccaattcgagttttcarattccaattgattctatgcagaca

SEQ ID NO: 24572 - DNA, 50 bp, homo sapien
gaggcaaattaaagttgattatatgsaagattttgtgtaaaataactctt

SEQ ID NO: 24573 - DNA, 50 bp, homo sapien
cagtttggtcagcagtgctaatgacrcatcaggtgaaagagatttccatc

SEQ ID NO: 24574 - DNA, 50 bp, homo sapien
cagtgtaactgttagacatttaatamagacagatgagccacactgactcc

SEQ ID NO: 24575 - DNA, 50 bp, homo sapien
tgcttatttttttaggaacacctaayattgtgtcaaaaggaaaacacaca

SEQ ID NO: 24576 - DNA, 50 bp, homo sapien
aatccaacagttatcctacacaaaaktatgacaaaattaccgttgcagaa

SEQ ID NO: 24577 - DNA, 50 bp, homo sapien
ttacagtaacaatcaaactcagtggkatggttcaacaggaaggtggcaga

SEQ ID NO: 24578 - DNA, 50 bp, homo sapien
caaattagtaggtaattaattctgargattagttagtgattgttgaggca

SEQ ID NO: 24579 - DNA, 50 bp, homo sapien
atgaaaaagtgagacacttcatgcaragccctccgtacagtgtgggtaca

SEQ ID NO: 24580 - DNA, 50 bp, homo sapien
actcttctcttttctaactaaatatracctttctaataatgatcattagg

SEQ ID NO: 24581 - DNA, 50 bp, homo sapien
aatacagctacaaagcggtgagaaayggcaattggctgagggcactaatt

SEQ ID NO: 24582 - DNA, 50 bp, homo sapien
taaccctggagctcaagttattttayggagcttagcttttaccaaaacct

SEQ ID NO: 24583 - DNA, 50 bp, homo sapien
ataatattaaatatcatttattgaarctactgtgtgccaggcattttata

SEQ ID NO: 24584 - DNA, 50 bp, homo sapien
attaaattaattcatgataaatacawcttaagaattagttcctcagttcc

SEQ ID NO: 24585 - DNA, 50 bp, homo sapien
gtagctaacagccttgaactaggagycagaaattattttactagatattt

SEQ ID NO: 24586 - DNA, 50 bp, homo sapien
ggaggagcatctttcttcttatcacmatgttttcttcagatttgttactc

SEQ ID NO: 24587 - DNA, 50 bp, homo sapien
atctctcagggatctatagattgaaygggcttagctgggcaattcttact

SEQ ID NO: 24588 - DNA, 50 bp, homo sapien
attcattcttaactgggaaactttayacttgctttctgtttccctaaaat

SEQ ID NO: 24589 - DNA, 50 bp, homo sapien
aaataaagtgaaaatgtgctattcakgtgggaacataaaaaaaagttaaa

SEQ ID NO: 24590 - DNA, 50 bp, homo sapien
ctctagccattaagaatcctgccaaygtttgggtcttcagtttaactttt

SEQ ID NO: 24591 - DNA, 50 bp, homo sapien
tagggtattctgatgctactgctccrgaactacactttgagtagcaaccc

SEQ ID NO: 24592 - DNA, 50 bp, homo sapien
agcaagtttatggagctttatacaargaatatgtgaacattctttccaaa

SEQ ID NO: 24593 - DNA, 50 bp, homo sapien
caaactccatttatgtgcgttaaaartaatgtcttgatcaatgaagatac

SEQ ID NO: 24594 - DNA, 50 bp, homo sapien
gtgaggtagttaccacccaccgcaaygatgagacttaggcttacaaaatt

SEQ ID NO: 24595 - DNA, 50 bp, homo sapien
agtctcactaatgtggagtctagtargatcatctaaggacaatcacgtgt

SEQ ID NO: 24596 - DNA, 50 bp, homo sapien
taaaagactgagcaatattatgtggsataccatgtcaatacattagtcat

SEQ ID NO: 24597 - DNA, 50 bp, homo sapien
cgccagtgggcaaagtaaggtaaagwagagtcctgaagactcttctttca

SEQ ID NO: 24598 - DNA, 50 bp, homo sapien
aataggaattccactgtacataccayatactcaaccatcaaaaatcagcc

SEQ ID NO: 24599 - DNA, 50 bp, homo sapien
cccaggtaggtatcaatgccctaaayttcctttcaagccttcaaggctca

SEQ ID NO: 24600 - DNA, 50 bp, homo sapien
aacctcatttgtaccaaattgcagaygatgtgtatacaaccccatcgttt

SEQ ID NO: 24601 - DNA, 50 bp, homo sapien
gtgagggaggttctacgagataacayggcatctttcaaagttcagtccag

SEQ ID NO: 24602 - DNA, 50 bp, homo sapien
ctataaaagttatgttattacaacargtaaagagagagagaggtgaaaga

SEQ ID NO: 24603 - DNA, 50 bp, homo sapien
atcaaaatgaaagctgagacatcctwagatcctggaaagtgcccaaaggt

SEQ ID NO: 24604 - DNA, 50 bp, homo sapien
tcatcccatgctggtatcgcacctcrcatcgtgctgggctccagcagggc

SEQ ID NO: 24605 - DNA, 50 bp, homo sapien
caaatgtgtgagtgtcatgaaagtamagaggaacagataaacgatgccaa

SEQ ID NO: 24606 - DNA, 50 bp, homo sapien
gacagtcaaactatcaagggaaagcraggcatggagacctgaaagatagc

SEQ ID NO: 24607 - DNA, 50 bp, homo sapien
tttccaaaatatttttcgtatataayaatcatcatcaaaaagtatatgtt

SEQ ID NO: 24608 - DNA, 50 bp, homo sapien
aaagggaatctcctccatctgagtgyataatagaatagcacaaatttgat

SEQ ID NO: 24609 - DNA, 50 bp, homo sapien
atgtgcaagactctcctgtttatccrgacacttctcatctatgacttgcc

SEQ ID NO: 24610 - DNA, 50 bp, homo sapien
cacatcgaatcagctatgaaattaaractccattgcaggttatcctaatt

SEQ ID NO: 24611 - DNA, 50 bp, homo sapien
gggtggctgccctcagcaggtaccaygaattttggctgagtgaacagggg

SEQ ID NO: 24612 - DNA, 50 bp, homo sapien
gttgttttcagttgcacataaatgartcattattacagatgtttaaccaa

SEQ ID NO: 24613 - DNA, 50 bp, homo sapien
taatttaccatgagtgttcagtacarctattagcaagtcagcaaagagga

SEQ ID NO: 24614 - DNA, 50 bp, homo sapien
agaatcacctttgaactttgaagacrcatggatacccgtctctctgctgc

SEQ ID NO: 24615 - DNA, 50 bp, homo sapien
ttagcatttagttgcagacaaaagargccatctcagtaaattaatcagaa

SEQ ID NO: 24616 - DNA, 50 bp, homo sapien
ccccaaataacagaataaagactgayggttagaaagttacatgtgatcac

SEQ ID NO: 24617 - DNA, 50 bp, homo sapien
aacaagaagatctatgtagcacaacraaaaagttaattggaaactatgat

SEQ ID NO: 24618 - DNA, 50 bp, homo sapien
ggtgagaagagaaacaaacgaagtgmaattgatgatgtaggaaagacata

SEQ ID NO: 24619 - DNA, 50 bp, homo sapien
tggtcacaggagtcagaattccgtayggggaagatttcactgaggatggg

SEQ ID NO: 24620 - DNA, 50 bp, homo sapien
caccacagacagagaactagagctargtttacataactgaaccttactaa

SEQ ID NO: 24621 - DNA, 50 bp, homo sapien
taaccctatgtggtaggtgttagtgraataattttatctttgagaaaacc

SEQ ID NO: 24622 - DNA, 50 bp, homo sapien
gagttttaaaataagactcaaactasaatctcggcttagtttattgctac

SEQ ID NO: 24623 - DNA, 50 bp, homo sapien
agtcacacaaaaattagtgataaaascagatttagaattccagattctca

SEQ ID NO: 24624 - DNA, 50 bp, homo sapien
ctgtccattaggacatgtctgtcatraaaaagcctccaaaagcttttcaa

SEQ ID NO: 24625 - DNA, 50 bp, homo sapien
agtcccctatctgcactacctaggarataattgcaaaggaagcaagactc

SEQ ID NO: 24626 - DNA, 50 bp, homo sapien
tacaagcatttctggatttcggcaaycatatatacacagcataaatgcaa

SEQ ID NO: 24627 - DNA, 50 bp, homo sapien
taaacaactcttcctggtttgaccartaatcatcagcatctttcatctaa

SEQ ID NO: 24628 - DNA, 50 bp, homo sapien
tgacaagtctaaaaatagagaatttwaaaaataacacggaacaaattcca

SEQ ID NO: 24629 - DNA, 50 bp, homo sapien
gtttggggaagcttttattttagccsataatctgatttgtctcaatattt

SEQ ID NO: 24630 - DNA, 50 bp, homo sapien
tcagacttctaagggtatctgtatgwactgctagtgaaccagggtttctg

SEQ ID NO: 24631 - DNA, 50 bp, homo sapien
tgcggacacttctaccagatacctcrctatattccagtggccctaggaac

SEQ ID NO: 24632 - DNA, 50 bp, homo sapien
agctggatctatgagtactcagatasgtcaccagcctacatgcttttgtt

SEQ ID NO: 24633 - DNA, 50 bp, homo sapien
acaagtgtgtgcaaatagttgcccartggacaccagtgcttgttctctct

SEQ ID NO: 24634 - DNA, 50 bp, homo sapien
catgcagttcttagcatcagacttarctctcctacctgactcagaacatt

SEQ ID NO: 24635 - DNA, 50 bp, homo sapien
tattctatgccaagaacttgtgctgyaagataaaagaatgtgactgtagt

SEQ ID NO: 24636 - DNA, 50 bp, homo sapien
gagatctttcaaatatgatttattcrcctctaatgcacagagcagcccaa

SEQ ID NO: 24637 - DNA, 50 bp, homo sapien
gtagatagtaagcgtaattttcataycacaggcaagaaagtcaaagagtc

SEQ ID NO: 24638 - DNA, 50 bp, homo sapien
atatttgaaagatctccattcttacygctacattctgttcctttgtctct

SEQ ID NO: 24639 - DNA, 50 bp, homo sapien
tcttaaaagacttctttgttatttcraatggagtttggcagaaagatttg

SEQ ID NO: 24640 - DNA, 50 bp, homo sapien
ctttttctttatccttttcactctgwcaagattatcagaatacttacttt

SEQ ID NO: 24641 - DNA, 50 bp, homo sapien
caaaaggaatatttatcattgatggwagttcaagttttctaataaactcc

SEQ ID NO: 24642 - DNA, 50 bp, homo sapien
aatcactatcttgcactgtcgccatyaattatccattaattttcatagaa

SEQ ID NO: 24643 - DNA, 50 bp, homo sapien
caaaagtcaaggatagcataagactyaaaaggtgatgcaagaccaaatgc

SEQ ID NO: 24644 - DNA, 50 bp, homo sapien
attatactgcattactcagccattaygttttgacctctacactgtcattt

SEQ ID NO: 24645 - DNA, 50 bp, homo sapien
taatatttctaatagaagagttttaygatggatcttaacttcagagactg

SEQ ID NO: 24646 - DNA, 50 bp, homo sapien
gatatgcatcagtctatgtacaaaargcaagtgacatagataatgaatct

SEQ ID NO: 24647 - DNA, 50 bp, homo sapien
ggttgttttgttgccaccaagtaaayctgtctgtcctttctgctcattgt

SEQ ID NO: 24648 - DNA, 50 bp, homo sapien
catagcaggttcctattcttctctgyaagctgctgatatattgctaaagc

SEQ ID NO: 24649 - DNA, 50 bp, homo sapien
tccaggagccttggataaggcttcartaaaaactcctgtacatgtatctc

SEQ ID NO: 24650 - DNA, 50 bp, homo sapien
tatagccaacttactgttaatgaccsaagatagatccttactctgtgaaa

SEQ ID NO: 24651 - DNA, 50 bp, homo sapien
aacctccttactgccttagtcagtarggttcacaatgagatttcacagag

SEQ ID NO: 24652 - DNA, 50 bp, homo sapien
ggcaagctgaccactcctctacaaaytaagccacgcatgtaaagatcact

SEQ ID NO: 24653 - DNA, 50 bp, homo sapien
ttactgtcctactttagggatatatyaactctttggctttgtgtcataat

SEQ ID NO: 24654 - DNA, 50 bp, homo sapien
gctcaacactttcccaatgtgaaaaygtaaatacagtaagttacatagcg

SEQ ID NO: 24655 - DNA, 50 bp, homo sapien
tggccagactttgctgctgagcacckatctgtgtggcacatgtctgggat

SEQ ID NO: 24656 - DNA, 50 bp, homo sapien
caacaccaacacattcatattcaggraagatactgtttttacgtgcagac

SEQ ID NO: 24657 - DNA, 50 bp, homo sapien
aggaagtgtccctaaccagaaagaaycaggaagacacaaactatctgcta

SEQ ID NO: 24658 - DNA, 50 bp, homo sapien
ttcagattaatctcatagaatctaasctcattgaaccagctttttcttaa

SEQ ID NO: 24659 - DNA, 50 bp, homo sapien
gactccctagaatttaagtccaaagmatggtgtgattttctttgttgagc

SEQ ID NO: 24660 - DNA, 50 bp, homo sapien
gacagagacatcgaatgtcggtgaayaggagtgaccttgggtctcaataa

SEQ ID NO: 24661 - DNA, 50 bp, homo sapien
gctatattcactgaacatatctaaartcgaatccttgtagcacctagagg

SEQ ID NO: 24662 - DNA, 50 bp, homo sapien
gcccaggtgatgacagatattctaasaaaccaaatatgcaaccacctcaa

SEQ ID NO: 24663 - DNA, 50 bp, homo sapien
gcctgagccaccgcacttggccagtkaatcctttaccgcataattgtgat

SEQ ID NO: 24664 - DNA, 50 bp, homo sapien
gggatatagggaaaattctctgacargtgaaatatgaggactcttgggct

SEQ ID NO: 24665 - DNA, 50 bp, homo sapien
tgttttacatacaactctgacatgcrccaagagatttggtgtcctgctaa

SEQ ID NO: 24666 - DNA, 50 bp, homo sapien
tctgttttttacctttatgctgctaycatggactgcttccaagtgagaat

SEQ ID NO: 24667 - DNA, 50 bp, homo sapien
caaagttaggcaaaattttgcacccrataacaagataaacatcttagcaa

SEQ ID NO: 24668 - DNA, 50 bp, homo sapien
cccaaatttgctgaatatgtgatgtkaataattaatgaaaaaacaagaga

SEQ ID NO: 24669 - DNA, 50 bp, homo sapien
gcagtcaattgtgtatttctaagaaraacatagcagccaatcttagcctt

SEQ ID NO: 24670 - DNA, 50 bp, homo sapien
tattcaggaggggaagtcttagttgsagattagggaaaaaatacctatat

SEQ ID NO: 24671 - DNA, 50 bp, homo sapien
aaagcttatgttctcacgggctttcyctaacactgtggagatgcattacc

SEQ ID NO: 24672 - DNA, 50 bp, homo sapien
agtctgtgaattaaattagtctcaargccatactatacctcaggctgact

SEQ ID NO: 24673 - DNA, 50 bp, homo sapien
gttgcagaattacaaaagaggcaacragataaatgcatattatgaggcgc

SEQ ID NO: 24674 - DNA, 50 bp, homo sapien
actgttttctgcagaggaagctgccwaccgttgatataatttcttctttt

SEQ ID NO: 24675 - DNA, 50 bp, homo sapien
aacctcaaattgatttcatgaaccaytgcattttgaaacatgctgtgtgg

SEQ ID NO: 24676 - DNA, 50 bp, homo sapien
gcatggcctgtactctccctgtacarctcggtgctaaaggaagcaacctc

SEQ ID NO: 24677 - DNA, 50 bp, homo sapien
atagattttcacaagacgttgacagrctaataaaacaagcaattccagaa

SEQ ID NO: 24678 - DNA, 50 bp, homo sapien
atacaaacactgactctcacttgtasaaatactgctgagattttgattga

SEQ ID NO: 24679 - DNA, 50 bp, homo sapien
aatgaagcaatacagttggaaagaargttttagataacctgtgtccattc

SEQ ID NO: 24680 - DNA, 50 bp, homo sapien
tgcagcttccagtaattacgttatcsaaacatattgggcagtctttttat

SEQ ID NO: 24681 - DNA, 50 bp, homo sapien
ttgccacatttttctctttaaatgarcatggtttatcccctttaactgac

SEQ ID NO: 24682 - DNA, 50 bp, homo sapien
ctttaggtgtcacatgtaacccagawgggatctaaataaaatgaccttga

SEQ ID NO: 24683 - DNA, 50 bp, homo sapien
agaattgacaaatagggtgatgcggmattaaaacttacgtctaaaagaac

SEQ ID NO: 24684 - DNA, 50 bp, homo sapien
cactgtattcatcactttttgtcaarccgaagcacaataataaaagaaac

SEQ ID NO: 24685 - DNA, 50 bp, homo sapien
tagggaaggattgatgcaatttcagrcaataatgagatacctgtagtatt

SEQ ID NO: 24686 - DNA, 50 bp, homo sapien
tgaaagccaacctcacagaatactaygttgctacggagaaaatgttttaa

SEQ ID NO: 24687 - DNA, 50 bp, homo sapien
attacaattggcaatctgcttttaasagtacacccaaaactgatgtgagt

SEQ ID NO: 24688 - DNA, 50 bp, homo sapien
atccaacccaaagcagaaactaaacyggagcactggccatatggttgtga

SEQ ID NO: 24689 - DNA, 50 bp, homo sapien
gtcaataaatgttgttaaggttaaargtgaagcaagacagacttggttaa

SEQ ID NO: 24690 - DNA, 50 bp, homo sapien
aatatatatactcactacaaattgaygccaaaaagatacctttaaagctt

SEQ ID NO: 24691 - DNA, 50 bp, homo sapien
ctcaattggagaatatgcaagtaaarttaacaaaaccgtacactattaaa

SEQ ID NO: 24692 - DNA, 50 bp, homo sapien
ccagatgaaagcactaagtactgcargttccatcatgactctgtggcctg

SEQ ID NO: 24693 - DNA, 50 bp, homo sapien
taaaactagctacagattactactaygaatgaatcattaagttttgtgtc

SEQ ID NO: 24694 - DNA, 50 bp, homo sapien
tttaatcttgatctgttttagtagasatttttatacattaatcttgatct

SEQ ID NO: 24695 - DNA, 50 bp, homo sapien
ttgaagcttgtcagtgcaccactaaycatataatgtatttttattacaga

SEQ ID NO: 24696 - DNA, 50 bp, homo sapien
ctttaccacccttcataaatggatamgaatggatgtaagcagatatggac

SEQ ID NO: 24697 - DNA, 50 bp, homo sapien
ttctgtttttttcagacgggtctaamgtagtgtggatgaaaagcacttat

SEQ ID NO: 24698 - DNA, 50 bp, homo sapien
agagtggggagatagagacagtaaarataatgcagtaaataggagagaac

SEQ ID NO: 24699 - DNA, 50 bp, homo sapien
tttgaaatctcagtggtgtttccacrggatactgtattaatctgtcaatt

SEQ ID NO: 24700 - DNA, 50 bp, homo sapien
tacttaatggtttttaaaatctttaygagactggccaaagtaaaaatata

SEQ ID NO: 24701 - DNA, 50 bp, homo sapien
tacaggtttacaggcattatctcackcagtgttgttttgctccctttcac

SEQ ID NO: 24702 - DNA, 50 bp, homo sapien
cactactctcacagtttcatggtaartatacaacactaccctgaacttga

SEQ ID NO: 24703 - DNA, 50 bp, homo sapien
ctttgcccactccagtgtgaaatgayaagagtaccagtcaagaaatcaga

SEQ ID NO: 24704 - DNA, 50 bp, homo sapien
aaatcagctattaactcttgtcagcsaaacaggaaatatattgatgtaat

SEQ ID NO: 24705 - DNA, 50 bp, homo sapien
ctctactttcaaaatcataagccaayctagtatatacatgcaaactatat

SEQ ID NO: 24706 - DNA, 50 bp, homo sapien
attgatctacagactcaaggcaatawctattagagtcctagggagcttct

SEQ ID NO: 24707 - DNA, 50 bp, homo sapien
aaccttaccttggcaaattataaggyccatatgcagagaaaaagcaaaac

SEQ ID NO: 24708 - DNA, 50 bp, homo sapien
agcagcaaatgtgacccatagcaaarggaaaatagaccatgttctgggta

SEQ ID NO: 24709 - DNA, 50 bp, homo sapien
tttaaacttccatttatcatttaaarttcaattcacctttctacttcttc

SEQ ID NO: 24710 - DNA, 50 bp, homo sapien
aaatgtcaacatttgaataaacttcycagaacctactcctagacagacgt

SEQ ID NO: 24711 - DNA, 50 bp, homo sapien
aatttttctaaaataagataaacacmaagaggcaaaaagttaaagaaata

SEQ ID NO: 24712 - DNA, 50 bp, homo sapien
ggggttggtagtacctggcgtgcgawagggatttaaacgtgtggaacaga

SEQ ID NO: 24713 - DNA, 50 bp, homo sapien
gaatacaagtgttttataatacaagrccatgttccacacatattggggta

SEQ ID NO: 24714 - DNA, 50 bp, homo sapien
ttaatacaagcccatagtgggtgaasctattgacaaactgatgatgggga

SEQ ID NO: 24715 - DNA, 50 bp, homo sapien
taaattggagaggttggaataattayggtcatatctctagaaacacaagt

SEQ ID NO: 24716 - DNA, 50 bp, homo sapien
tttgaggtctcctcggtaacctgggwcataaaacagagtattaataaagt

SEQ ID NO: 24717 - DNA, 50 bp, homo sapien
gacaggcatggagttacaagtggcargttacaagggacagacagcatgat

SEQ ID NO: 24718 - DNA, 50 bp, homo sapien
ctcatgttctcaaagtcactaataamcactgtgaccaggagaaggctgga

SEQ ID NO: 24719 - DNA, 50 bp, homo sapien
ccagttcttgtttactgtatcatcamattatcattacaattcttatagaa

SEQ ID NO: 24720 - DNA, 50 bp, homo sapien
cattttctttttatgaaaagtattcraagtttattacagcaaagaatctc

SEQ ID NO: 24721 - DNA, 50 bp, homo sapien
aagcaaattagtcattaatcaagttwaaaaaattggtgttattctgactt

SEQ ID NO: 24722 - DNA, 50 bp, homo sapien
atcaagcctaggaggctgggaccccratcatgcccattctcctggccagg

SEQ ID NO: 24723 - DNA, 50 bp, homo sapien
aatttctgatcaaacttcatgtcaayttccagagagttactttatactga

SEQ ID NO: 24724 - DNA, 50 bp, homo sapien
gcagagtaaagtagagaatgaatcaracagggaccttgtcctcatcgtga

SEQ ID NO: 24725 - DNA, 50 bp, homo sapien
ggctttgctgcacagagcaaaggtarcatgaagccctgctcccaagctgt

SEQ ID NO: 24726 - DNA, 50 bp, homo sapien
tagtcatttgcctccatgctttaacrctgataccatttatccccataatt

SEQ ID NO: 24727 - DNA, 50 bp, homo sapien
ggttttagaacactaatgttacctgmagaagtcttgtctctgagtttgcc

SEQ ID NO: 24728 - DNA, 50 bp, homo sapien
aatccttgatgatgaatgatcacgarctatacattctgtaagcaatctta

SEQ ID NO: 24729 - DNA, 50 bp, homo sapien
agccagtcaacaagcatttgctcaaktccttctatgctttactttgagtt

SEQ ID NO: 24730 - DNA, 50 bp, homo sapien
gattaatttcttagaagattttcagyacaggacaaagtagactacttgac

SEQ ID NO: 24731 - DNA, 50 bp, homo sapien
ttcaaattaagtgaatgcagtcttamaattctttttaggttccctatcaa

SEQ ID NO: 24732 - DNA, 50 bp, homo sapien
aagaaacagtaaagattgggctaaargatcaaaggatgttgaaaaaaatg

SEQ ID NO: 24733 - DNA, 50 bp, homo sapien
ttctgtgagaggaatgagctgcaatractattaagatggatacaaagtct

SEQ ID NO: 24734 - DNA, 50 bp, homo sapien
agcaaatatttagcactacttcacarattcatccagtgatacctaaaact

SEQ ID NO: 24735 - DNA, 50 bp, homo sapien
ttactttctcataagaaacaactaarttactctacaaaatatgcaaaacc

SEQ ID NO: 24736 - DNA, 50 bp, homo sapien
aaggcatttgattaaactgattcaarttatatcgtatcaaatttctttct

SEQ ID NO: 24737 - DNA, 50 bp, homo sapien
acaaaggggcttgggatactttcagractttcagtgacagccaggacagg

SEQ ID NO: 24738 - DNA, 50 bp, homo sapien
tatttcaaaggacagtagttccttgyatgcactaaaaataccccgaaaca

SEQ ID NO: 24739 - DNA, 50 bp, homo sapien
tcatagatggacaggacactcattamaattttctatgattggactaaaac

SEQ ID NO: 24740 - DNA, 50 bp, homo sapien
aacatttgcatttaaagcaagccaargtaaaattatgtagcggtagaaga

SEQ ID NO: 24741 - DNA, 50 bp, homo sapien
atttaatcattgttttctcatagaasgaaaaaaatgaatgccgaggacag

SEQ ID NO: 24742 - DNA, 50 bp, homo sapien
ataggtgaagagtgaattttcatcaracgattaaaaaaaagtgaaacaac

SEQ ID NO: 24743 - DNA, 50 bp, homo sapien
ctttctaaatttcagggcattaaaayaatatatgtgctacctaccacagg

SEQ ID NO: 24744 - DNA, 50 bp, homo sapien
tcttaactttcttctcagacaggaaktgaaactttgcagctgacatttgg

SEQ ID NO: 24745 - DNA, 50 bp, homo sapien
tagatctagaacatgaacccaaagartccaatacatggtcaatgtgattt

SEQ ID NO: 24746 - DNA, 50 bp, homo sapien
atctagattggaaagaatcttaaagyaaagtgctgcctaaagtaattatt

SEQ ID NO: 24747 - DNA, 50 bp, homo sapien
tttattccggctttaggatagcatamattccacctgattactcacttccc

SEQ ID NO: 24748 - DNA, 50 bp, homo sapien
ttcaaaagtgcttgataagtagctgmaatttacttgactgtcaaccaaaa

SEQ ID NO: 24749 - DNA, 50 bp, homo sapien
atattagatccaggtggatttgtcaygataactggaccacaagaaaaaaa

SEQ ID NO: 24750 - DNA, 50 bp, homo sapien
ataacatgcaccaaagttggagaacratgagaattatctgtgttgctgga

SEQ ID NO: 24751 - DNA, 50 bp, homo sapien
ctccttggcatctccacaaaaggatragcaagaaaaatagagatgaggct

SEQ ID NO: 24752 - DNA, 50 bp, homo sapien
atccccaaaacagatgcaagtaaatsacggagtagcaaacattatactaa

SEQ ID NO: 24753 - DNA, 50 bp, homo sapien
ttgagtctaaaatttttcagattcartattatcagcacctgaacctgaaa

SEQ ID NO: 24754 - DNA, 50 bp, homo sapien
ttccaattttacagaaaataaatcaygtggcctgcttaaggtcacagagc

SEQ ID NO: 24755 - DNA, 50 bp, homo sapien
cttctcagtcacaagctgtttgaccrccctaaagcctgtttccttatcta

SEQ ID NO: 24756 - DNA, 50 bp, homo sapien
atgcctggtagtcatcaaatactcartaggttgtaataacaattacagtc

SEQ ID NO: 24757 - DNA, 50 bp, homo sapien
ctaatctggattctgcagaaccagamgtataagagaggtagatactaaga

SEQ ID NO: 24758 - DNA, 50 bp, homo sapien
tcctaaaatgtaaattgcttctccayacattcaaacatagtaggtaattt

SEQ ID NO: 24759 - DNA, 50 bp, homo sapien
tgtggtctttcataggtcttacaaargtgacttcagtcctgagcaaggag

SEQ ID NO: 24760 - DNA, 50 bp, homo sapien
tctcccatttgtctgccaaaatttarcgatcacctacttagttccagtat

SEQ ID NO: 24761 - DNA, 50 bp, homo sapien
actgctgttcaaatggtttatctacygcccaagaattaacagtgaggcag

SEQ ID NO: 24762 - DNA, 50 bp, homo sapien
gtcccctcacaaaatcaccgtggaawaaaacagggacagcttacattgtt

SEQ ID NO: 24763 - DNA, 32 bp, homo sapien
aggtctgaccttttaartggaaaacaatacct

SEQ ID NO: 24764 - DNA, 50 bp, homo sapien
tacttgggtaatttactgactcggcractgtctacttctcgggtcagtgg

SEQ ID NO: 24765 - DNA, 50 bp, homo sapien
gtgtcagtaattaaatttatatcacrgactaaacagagtttctttttgtt

SEQ ID NO: 24766 - DNA, 50 bp, homo sapien
acatatacacatgtatcacaccttckatgttgaagtattagtataaaata

SEQ ID NO: 24767 - DNA, 50 bp, homo sapien
tgttccgttggttagtcaatcatgcrcaaatgtcacagtattttaatgat

SEQ ID NO: 24768 - DNA, 50 bp, homo sapien
gtgcaactttaaatattatccagtaraatttcctttccagctgagatttt

SEQ ID NO: 24769 - DNA, 50 bp, homo sapien
gttggtgatagtgctgatgttactcygagcctgtggtgtatgtattgtgg

SEQ ID NO: 24770 - DNA, 50 bp, homo sapien
gaccttgggagaaaggagatatagaygatgagattgaaagaggttacaga

SEQ ID NO: 24771 - DNA, 50 bp, homo sapien
aaagtaaataactgtcaatatcaccrctttctaaggtgaattattgaaag

SEQ ID NO: 24772 - DNA, 50 bp, homo sapien
cttaagaatgatgaaaggtattatayattttagaaatttaacccaggtct

SEQ ID NO: 24773 - DNA, 50 bp, homo sapien
agaaataatttaagatcaatcttaaygaaagagtaaaaagagggctgggt

SEQ ID NO: 24774 - DNA, 50 bp, homo sapien
tgctcacagtcatggtggttcccaarataattgctagaatgatgttttcc

SEQ ID NO: 24775 - DNA, 50 bp, homo sapien
tgggaactatctgcctactgcatagraattcttgttaaaaaattaatctg

SEQ ID NO: 24776 - DNA, 50 bp, homo sapien
tctcgtgtgattcctaagcatctccrcttcctattttcaaatttaaaaat

SEQ ID NO: 24777 - DNA, 50 bp, homo sapien
tctgaggaccctgagatcctcaggamcttgagtagggaatcgtggctctc

SEQ ID NO: 24778 - DNA, 50 bp, homo sapien
tgaacatctcaccgttttgagattcrcaaacctatcaagttatttctgag

SEQ ID NO: 24779 - DNA, 50 bp, homo sapien
ctcagtttaggctgtttcctgataayatttgggcaattcttcaaagctca

SEQ ID NO: 24780 - DNA, 50 bp, homo sapien
tccctctgtggccctacctagttctwaatgagttcttcaatctcagctgc

SEQ ID NO: 24781 - DNA, 50 bp, homo sapien
catgctaattctctatccttcatccrcaggagtgccaatatgggataaga

SEQ ID NO: 24782 - DNA, 50 bp, homo sapien
ctgtgagaggtaacctcccaagataraagcggctcctggagaaggagcat

SEQ ID NO: 24783 - DNA, 50 bp, homo sapien
gttgggctagaggtcacgaatcacaytgacagttctttattatgcatatt

SEQ ID NO: 24784 - DNA, 50 bp, homo sapien
taattataacacaggaaactatccaygtgacatttaggcatttggattcc

SEQ ID NO: 24785 - DNA, 50 bp, homo sapien
aggtcagaggacatgcattgacagarggaagtagaaaaccattccagatt

SEQ ID NO: 24786 - DNA, 50 bp, homo sapien
catgctttgtcgagttatcttacaamgagttattgttgtctttacctcct

SEQ ID NO: 24787 - DNA, 50 bp, homo sapien
gtttttgatgctgggtttccatttayaacggttgctgaaaaccactgagt

SEQ ID NO: 24788 - DNA, 50 bp, homo sapien
ggataaatagtttattcttcatggayctttgctctgtaagctgctgaggt

SEQ ID NO: 24789 - DNA, 50 bp, homo sapien
tattaagtgtgcgattgcattattasgaatcctcccatctcctctctcct

SEQ ID NO: 24790 - DNA, 50 bp, homo sapien
atcacagttctcaaactacactacakcagtttttcaaattacataaagta

SEQ ID NO: 24791 - DNA, 50 bp, homo sapien
gagctcaaggaaaatacatatttcaygcgagttctttctttccaactaac

SEQ ID NO: 24792 - DNA, 50 bp, homo sapien
gtggagatttgtgttggctttcaagyagttcaaccaatctacctatggcc

SEQ ID NO: 24793 - DNA, 50 bp, homo sapien
tttctattcccctgagtactctctaygctgtttcataagttgaagctaca

SEQ ID NO: 24794 - DNA, 50 bp, homo sapien
acctggatgggtgtgaaatatgctarggatgtcttctttggaggtcatgg

SEQ ID NO: 24795 - DNA, 50 bp, homo sapien
gttggctgtgtattatcatgttgaasaagtttccttccattcctgacctg

SEQ ID NO: 24796 - DNA, 50 bp, homo sapien
gtctggaagagtcatggggatgataygaattgttcatgtatcattgcctg

SEQ ID NO: 24797 - DNA, 50 bp, homo sapien
atagatttacctgcactgaattatasaaaatgggaggtggcactggtcac

SEQ ID NO: 24798 - DNA, 50 bp, homo sapien
caaattggcattggccaaaagaaccmgacgatgtgcagatggtgtgtggt

SEQ ID NO: 24799 - DNA, 50 bp, homo sapien
gtggatttcactggtgtcaatacacrcattcacatccatgagaggccact

SEQ ID NO: 24800 - DNA, 50 bp, homo sapien
gcaactctgcataagttcctgaacaytgattaaaagggacccccgataca

SEQ ID NO: 24801 - DNA, 50 bp, homo sapien
tcattatgattcaaatcacattttasactaataatgggaagaaagattga

SEQ ID NO: 24802 - DNA, 50 bp, homo sapien
atgtcagaagtaatgagatcagtaawatacaaggataaaaaaggcttgag

SEQ ID NO: 24803 - DNA, 50 bp, homo sapien
ttattccaaaaataataggaagtcaytgaatggtcttaagcttgaaaagg

SEQ ID NO: 24804 - DNA, 50 bp, homo sapien
atctctcagcttataaggacagctcygaaattaattacaaaacaaaacct

SEQ ID NO: 24805 - DNA, 50 bp, homo sapien
cctgtcctcaaatcttcgtttataasattctcccaccatgacactgagct

SEQ ID NO: 24806 - DNA, 50 bp, homo sapien
tctgttactatcactgtagtctgaamcaatattatcttttacctagacca

SEQ ID NO: 24807 - DNA, 50 bp, homo sapien
aaaaaaaatgagtctgtgataggaartatgtttttagtaattgttaaaat

SEQ ID NO: 24808 - DNA, 50 bp, homo sapien
gaacatgccttttggtgactatatgyaggcatttctgttgagtctgtgcc

SEQ ID NO: 24809 - DNA, 50 bp, homo sapien
ctgcaaaatttaacctgctaaactgyacgagcaatagagaacatcagtgt

SEQ ID NO: 24810 - DNA, 50 bp, homo sapien
agtaaacactaataaaaatataccaraaaattagagtatacttttctcat

SEQ ID NO: 24811 - DNA, 50 bp, homo sapien
ggaatcaaatgcctctttgagagaarggcttttgttcacaatgctgaatg

SEQ ID NO: 24812 - DNA, 50 bp, homo sapien
gatagtcttttgattgatgttcatgyagtcaggtttctcttgagtaatcc

SEQ ID NO: 24813 - DNA, 50 bp, homo sapien
tcttaacctaatatctcaagaagacrataaacaaggacatagaagagtca

SEQ ID NO: 24814 - DNA, 50 bp, homo sapien
ttccgaaagacaagcaagactgtaaygatattctatgactataccacttg

SEQ ID NO: 24815 - DNA, 50 bp, homo sapien
catagtcatcagattctctcagattraaatgaaagaaaaatgttaaaggc

SEQ ID NO: 24816 - DNA, 50 bp, homo sapien
caaattggcattatggatcagtttcsaggaggacaaataaagaaagagtt

SEQ ID NO: 24817 - DNA, 50 bp, homo sapien
gcatgcaagaagcattgccaagtgasagaccagagagcaggggccatgtg

SEQ ID NO: 24818 - DNA, 50 bp, homo sapien
gtgatgttaattagcacagtgttgtraaaatggtgcacaacctacacagt

SEQ ID NO: 24819 - DNA, 50 bp, homo sapien
tatctgcctaataattcctagaaccygagtataaagatattacgggttcc

SEQ ID NO: 24820 - DNA, 50 bp, homo sapien
tattggttaaaaaaagttcacactasatcgttaaatttaaaatgcaggtt

SEQ ID NO: 24821 - DNA, 50 bp, homo sapien
gataatcgaaggttaatgcacaatckaattttttccttcctggatcaagc

SEQ ID NO: 24822 - DNA, 50 bp, homo sapien
tgggaacattgtttaacctgttcacrctctgttactccttcccccagaaa

SEQ ID NO: 24823 - DNA, 50 bp, homo sapien
aagccactaaattgcccaaaactcayggattagaattacaatttggaaac

SEQ ID NO: 24824 - DNA, 50 bp, homo sapien
atgcttgcctcacacaaaatcatatsacatctcctcactgggtcttgaac

SEQ ID NO: 24825 - DNA, 50 bp, homo sapien
ataagtttgcagaatcaataaaacaytgtcacaaagtaggtatcttcatt

SEQ ID NO: 24826 - DNA, 50 bp, homo sapien
ggtctcctggccaccatttaccaagsatgtaccacaggccagctacagct

SEQ ID NO: 24827 - DNA, 50 bp, homo sapien
aactcttcaagctaacacatagcaaygtctgagaaaccgtccctgtgttc

SEQ ID NO: 24828 - DNA, 50 bp, homo sapien
aaagaccaacatccttaaaaggtccrcaagggattaattgaaagcttttt

SEQ ID NO: 24829 - DNA, 50 bp, homo sapien
tttaatgaatctcttcataaatatartaactcctaaagtttctagagcac

SEQ ID NO: 24830 - DNA, 50 bp, homo sapien
gttccagcagtaaataacattcctaragaagtgagatatcaccaaccctc

SEQ ID NO: 24831 - DNA, 50 bp, homo sapien
ggataagatctaccacaaaaggccaygaggattaaatgtagtcttctgca

SEQ ID NO: 24832 - DNA, 50 bp, homo sapien
tggccttctttttttcttatcagtartaactcagtctttgagaaaaaata

SEQ ID NO: 24833 - DNA, 50 bp, homo sapien
ttctatgatttaagaactgcacttaygtaaaagtatcttacttaggataa

SEQ ID NO: 24834 - DNA, 50 bp, homo sapien
ttataaaatgtatctcaaatggttamgtaaatcaccaaagattgtacttt

SEQ ID NO: 24835 - DNA, 50 bp, homo sapien
caggatgcctttgttttccatttccragaaaacagaggactatggaaaac

SEQ ID NO: 24836 - DNA, 50 bp, homo sapien
tggcacctttgttaggaataattcaycgtgaaacatctggcagactcata

SEQ ID NO: 24837 - DNA, 50 bp, homo sapien
gcttgtaatatttaagtggctaacaytgcatcctttcagattaaagcaaa

SEQ ID NO: 24838 - DNA, 50 bp, homo sapien
agaagtcagcttgcagaatgttagartattgaagtaaagctgcagggttt

SEQ ID NO: 24839 - DNA, 50 bp, homo sapien
aattaaataaatacattactaagaarggctataaatgaaatgttattata

SEQ ID NO: 24840 - DNA, 50 bp, homo sapien
gtgctgcgggtaaagaaatcttgatyaccttgagaaagtgctgctgccaa

SEQ ID NO: 24841 - DNA, 50 bp, homo sapien
tatcttctgcatatacaggaagagaygggtttggtgatcagcagagctta

SEQ ID NO: 24842 - DNA, 50 bp, homo sapien
tgtcattcccactcattgtactctasactggtccgaatatatgagactgt

SEQ ID NO: 24843 - DNA, 50 bp, homo sapien
gaacttgggttataatataatcgtaytacaataggaggcagcatagttta

SEQ ID NO: 24844 - DNA, 50 bp, homo sapien
tcaataattgaaatgaatgtactacygctaatgtaataaagttaataagt

SEQ ID NO: 24845 - DNA, 50 bp, homo sapien
tggcatgtgtttaattgtttaagaamaatgatttctattgccccaaatat

SEQ ID NO: 24846 - DNA, 50 bp, homo sapien
aacacctgtggtgttcaccataaggyatacagagattatcctgtccaagc

SEQ ID NO: 24847 - DNA, 50 bp, homo sapien
tcgacccactgggctctgggttctckacaggtcctggtccatctcatcac

SEQ ID NO: 24848 - DNA, 50 bp, homo sapien
tgtggggagaatgaaggttgccagcrgaatactgagagaaagagggtccc

SEQ ID NO: 24849 - DNA, 50 bp, homo sapien
gatcttatgttaagtgtccttatcayaaaacatgagaattagaaatgaag

SEQ ID NO: 24850 - DNA, 50 bp, homo sapien
agtcgatgctcttaaagtattcagcracttgcatcatgaaaatattgggt

SEQ ID NO: 24851 - DNA, 50 bp, homo sapien
ggaaagtcccccaaaatcgagattakatggcctaatgctaaaaacagtcg

SEQ ID NO: 24852 - DNA, 50 bp, homo sapien
taggattatactctctattaagcacmgaattgaatatatgtataatcaga

SEQ ID NO: 24853 - DNA, 50 bp, homo sapien
atagattctttgagtcaggaatctgracataacgtagctggatccttggg

SEQ ID NO: 24854 - DNA, 50 bp, homo sapien
ggattaatagaaatcctcccagtgaygagaaactcaaattccattgtttt

SEQ ID NO: 24855 - DNA, 50 bp, homo sapien
aggtactcaggaggaaagaagtagaratttggataaatactagcaatgtc

SEQ ID NO: 24856 - DNA, 50 bp, homo sapien
ggtgaggcagactgggagagatttcrccaagaactagggaggtctgtatg

SEQ ID NO: 24857 - DNA, 50 bp, homo sapien
ggtctattgataatattttgtaatcrctaatattcatataaaccgtgcac

SEQ ID NO: 24858 - DNA, 50 bp, homo sapien
gttgtcaggaaccaaattcaatataygtccgttactcaactttattttta

SEQ ID NO: 24859 - DNA, 50 bp, homo sapien
atgaacctaagctacaaacacatcaygaatagtaaaacattttggcccaa

SEQ ID NO: 24860 - DNA, 50 bp, homo sapien
gaagggaatggcctcaagtaaaatcratgttctgggaaagttgggagagt

SEQ ID NO: 24861 - DNA, 50 bp, homo sapien
ccttcaggtttcttttttctcatagkagtatagatatacatacttacaga

SEQ ID NO: 24862 - DNA, 50 bp, homo sapien
ttaacagcataaaataatacactaascagtctctaaactcgatgaagaac

SEQ ID NO: 24863 - DNA, 50 bp, homo sapien
taacccttgatctgtagctcatgaastaatccatgcaaatgatgaaataa

SEQ ID NO: 24864 - DNA, 50 bp, homo sapien
agtctttgagttggttctccctaaaygttatatagagtgtctctttcact

SEQ ID NO: 24865 - DNA, 50 bp, homo sapien
gagaaaagaatactccaaatggtgcyatatgtgaaagtactcagataagg

SEQ ID NO: 24866 - DNA, 50 bp, homo sapien
tttaggcaggtgctgggattaagcayatctaccactcagaaaataataca

SEQ ID NO: 24867 - DNA, 50 bp, homo sapien
agcacatctaccactcagaaaataawacaaataagaaccacggtccacat

SEQ ID NO: 24868 - DNA, 50 bp, homo sapien
tccaagtgtatcaaatggatccaacrctgtcctgtgcggagtaaaagagg

SEQ ID NO: 24869 - DNA, 50 bp, homo sapien
cagtaatatgcctcaataacctctamaaaattaatatcacttgatacagt

SEQ ID NO: 24870 - DNA, 50 bp, homo sapien
atataaagctgactagtgtaaaggasatctggagatagttaaatttttat

SEQ ID NO: 24871 - DNA, 50 bp, homo sapien
ttgctacagtttgcaatatagattcrctactaatccaagcccccttttac

SEQ ID NO: 24872 - DNA, 50 bp, homo sapien
ttgctattatttttgttgttcttcakcagctaacattagtgttagtgtat

SEQ ID NO: 24873 - DNA, 50 bp, homo sapien
aaatctggcgagaagtaggacttcayctgtgttcaaggttgcatttactt

SEQ ID NO: 24874 - DNA, 50 bp, homo sapien
ccaggaaattaaaaaaaatcatggcygacaagaatgtagaatactgctct

SEQ ID NO: 24875 - DNA, 50 bp, homo sapien
gcatttggaaggtgcacatttttacraaagaatatattacaagctatgag

SEQ ID NO: 24876 - DNA, 50 bp, homo sapien
ctgaataataataattaataagagasgtaagccaaatttaaagatgccag

SEQ ID NO: 24877 - DNA, 50 bp, homo sapien
gccctaaagcacaattagagcaataygtatggttgttgagtgttttgtac

SEQ ID NO: 24878 - DNA, 50 bp, homo sapien
atattctttttattcctctgatattsaacttcttaacgtaagctttgttg

SEQ ID NO: 24879 - DNA, 50 bp, homo sapien
tctggcatgtctagtaactaccggargacagtaatgactactttgcacaa

SEQ ID NO: 24880 - DNA, 50 bp, homo sapien
ctgctttcagctttatttttcctaayttaactttcaggtatcatcatctt

SEQ ID NO: 24881 - DNA, 50 bp, homo sapien
tatgcctagatcagtgcttcatataygtatagttgatgttcaaaaatgtt

SEQ ID NO: 24882 - DNA, 50 bp, homo sapien
attaagaaagcaagcataattgataytaccaagtttttaaaaagatgata

SEQ ID NO: 24883 - DNA, 50 bp, homo sapien
cgttatttttctaactcagattataygtaatgcaatgttaaatgaaataa

SEQ ID NO: 24884 - DNA, 50 bp, homo sapien
tcttaagcctctcctgcctcacaaamgcctatttcaaatattgacttcaa

SEQ ID NO: 24885 - DNA, 50 bp, homo sapien
tgggagagaggtagataatgaggaargagaagaaataatgaggtaatatg

SEQ ID NO: 24886 - DNA, 50 bp, homo sapien
ctgagctaagcactcatgtattccawcttggctcctaactgcctaggata

SEQ ID NO: 24887 - DNA, 50 bp, homo sapien
tgaagatttcaaacatatattaaacragtgagtataacgaatccctctga

SEQ ID NO: 24888 - DNA, 50 bp, homo sapien
aatgcaaataaactataactcccatraacaatagatacgtaaaaatccca

SEQ ID NO: 24889 - DNA, 50 bp, homo sapien
tggcatttcattccaatttagtgtasgtttggctcttcatcgtttttatt

SEQ ID NO: 24890 - DNA, 50 bp, homo sapien
ctgtgacctgccataggaagtctaaytgttataatgtggcagtcaaggcc

SEQ ID NO: 24891 - DNA, 50 bp, homo sapien
ttgctgaattatacaactcgttaccrctgtcttacactagggtagggacc

SEQ ID NO: 24892 - DNA, 50 bp, homo sapien
gcctgagatttctctaaaagacatcrcctctatgtgaaacacaaatggtt

SEQ ID NO: 24893 - DNA, 50 bp, homo sapien
aaagaacaaatatattggggtgtgcratgattcaactctggaaacatata

SEQ ID NO: 24894 - DNA, 50 bp, homo sapien
atagatgagaaatgttctcactgacraattagtagctagttctgctcaat

SEQ ID NO: 24895 - DNA, 50 bp, homo sapien
tgacataaatacaattagctgtgtcyacctctggctttttcttctgtttc

SEQ ID NO: 24896 - DNA, 50 bp, homo sapien
aaaaaagtcaatttaagaaccaggaygacttaggtaatagccacaggaag

SEQ ID NO: 24897 - DNA, 50 bp, homo sapien
aaataaataaataaataaataagaamgtgcatgccacagggtatgagaaa

SEQ ID NO: 24898 - DNA, 50 bp, homo sapien
cgtctggaatgcttaatagctctgcracttttggaaatctactctgacct

SEQ ID NO: 24899 - DNA, 50 bp, homo sapien
caaaaaacaaaaaaaggcttgaagasctatgagctaaaccattccatctt

SEQ ID NO: 24900 - DNA, 50 bp, homo sapien
acagtaaaactccgtatcaaaaaaamgagtgatgctagtgggttctttgc

SEQ ID NO: 24901 - DNA, 50 bp, homo sapien
gctgatgtctaagaaagttcacaccsagagtcacgcacagggctgagggt

SEQ ID NO: 24902 - DNA, 50 bp, homo sapien
gaaatcctactggtctgaactgacamactaaaaatggaaaaaatcagctt

SEQ ID NO: 24903 - DNA, 50 bp, homo sapien
attgaatggactaaatggagagaaayggatggagaaagatgcaagtcaca

SEQ ID NO: 24904 - DNA, 50 bp, homo sapien
catatctaataacatgttacacataycacggcctcagtcttttttttttc

SEQ ID NO: 24905 - DNA, 50 bp, homo sapien
tacaagtgcggatactttgatggtcyaggaagagagagtgtgcattgtgt

SEQ ID NO: 24906 - DNA, 50 bp, homo sapien
gggggtataaattaataattgaaacmacctataataattctgtaattcca

SEQ ID NO: 24907 - DNA, 50 bp, homo sapien
ctactaggcagggcaatcagagatcmaatttagaacaacgggtctgaggt

SEQ ID NO: 24908 - DNA, 50 bp, homo sapien
ttgtgcttgctttggccaagaatcasataagtagtaccatcctgggatta

SEQ ID NO: 24909 - DNA, 50 bp, homo sapien
ataaaaaataatctaattctagggaygttaaaccatttctagcagctaga

SEQ ID NO: 24910 - DNA, 50 bp, homo sapien
tcttggggggttcaaagtcatgcaarggatttggtataaattaagatggc

SEQ ID NO: 24911 - DNA, 50 bp, homo sapien
cacaatttattacgagttgtcagatraaactatgaaatgtaaacgctgcc

SEQ ID NO: 24912 - DNA, 50 bp, homo sapien
gtttacattccccaagtaatctcaaygtctagaaaaattttgaaaacctc

SEQ ID NO: 24913 - DNA, 50 bp, homo sapien
ttaatagatacttcaagaaaacctaygtgctgtgcaaaataagaaacaga

SEQ ID NO: 24914 - DNA, 50 bp, homo sapien
ttaaaaataaaaaaggtagtaatgayattatcgttgttaaaaaaatgaag

SEQ ID NO: 24915 - DNA, 50 bp, homo sapien
tcacaacttggaaacttaatgacaasagtaatttatgaggcacttataga

SEQ ID NO: 24916 - DNA, 50 bp, homo sapien
aaatatcttctgccaagacttaatckccatcacatttgcttgtttttatg

SEQ ID NO: 24917 - DNA, 50 bp, homo sapien
aaataggtaaaatgcaaatgcattargatgctaaagattcaagatatgac

SEQ ID NO: 24918 - DNA, 50 bp, homo sapien
agttaaaaagttcagtgtaacttcawactgaaaaaaatatacattgctac

SEQ ID NO: 24919 - DNA, 50 bp, homo sapien
gccaagattcttgttatagagatgaygcctcataggtagtgtccttcaga

SEQ ID NO: 24920 - DNA, 50 bp, homo sapien
cacaactgaccaggattaatattaamatagacatcataagctgaccaaac

SEQ ID NO: 24921 - DNA, 50 bp, homo sapien
gttacatttctcctctcacacagaartatttaacctattggatttttttg

SEQ ID NO: 24922 - DNA, 50 bp, homo sapien
agcatagatatatatgtttgaaaaayttgaaagctagaaggaaagaaaga

SEQ ID NO: 24923 - DNA, 50 bp, homo sapien
ttgcttcttatagctgctgagagaartagtaggaagactctgaaagccga

SEQ ID NO: 24924 - DNA, 50 bp, homo sapien
aattataagaggctgtaatctttggratcataaataaaacaaacaaacag

SEQ ID NO: 24925 - DNA, 50 bp, homo sapien
aaaacaagacaatttacatagtctcwctgaagttaaccttcccaaagtaa

SEQ ID NO: 24926 - DNA, 50 bp, homo sapien
atctaaagagaagagaactatctcamaacaaacttccctttccttataga

SEQ ID NO: 24927 - DNA, 50 bp, homo sapien
gtcagtgccccacattctgataatayggattgactactttttaatgtcca

SEQ ID NO: 24928 - DNA, 50 bp, homo sapien
ttattcgctgaccttgttggaagaayatatgccgctttgtacttactctc

SEQ ID NO: 24929 - DNA, 50 bp, homo sapien
gtcatggctaataaatgcaataatamgtgcaataatagaaaaatattcct

SEQ ID NO: 24930 - DNA, 50 bp, homo sapien
gaaatggaaggttggctctaggaccrgatgcatcaggcttcaggtaggct

SEQ ID NO: 24931 - DNA, 50 bp, homo sapien
gtttttagaatgcacaagtaagtggratatcttgattctcaatctcagat

SEQ ID NO: 24932 - DNA, 50 bp, homo sapien
cttctctatacctaggactgaaagaygtaagcaaatgaatataactgtgt

SEQ ID NO: 24933 - DNA, 50 bp, homo sapien
agttcaccaaataagcaggagcctayctgaagcctgatgcatctggtcct

SEQ ID NO: 24934 - DNA, 50 bp, homo sapien
tgcaggggattttttagccatgggascttgagtatcattacagtcctcta

SEQ ID NO: 24935 - DNA, 50 bp, homo sapien
aagtctttggtcacaagaaaatttamgcataattacagcagcaagatgaa

SEQ ID NO: 24936 - DNA, 50 bp, homo sapien
tagtcaggctttgcacatgaactagrctagagctagagtaaccatcttat

SEQ ID NO: 24937 - DNA, 50 bp, homo sapien
gttgattaaattacataaaatttggrcacactggataataagtacagaga

SEQ ID NO: 24938 - DNA, 50 bp, homo sapien
tcatgttctgtttctagttctattargtcttatgataacatctttgaaga

SEQ ID NO: 24939 - DNA, 50 bp, homo sapien
aatcatctgctgctacagagcctaaratgaaccaggagagcataggagct

SEQ ID NO: 24940 - DNA, 50 bp, homo sapien
ccgttcttggcatgtatatctctgarctactcacgcttcatcaaaccagt

SEQ ID NO: 24941 - DNA, 50 bp, homo sapien
aaactgtactgaagcatgctgtatamtactgcttatgcacaacttgcttt

SEQ ID NO: 24942 - DNA, 50 bp, homo sapien
tatctgaaatgttatagtagtgttcygaaaagggcataagctttggtttt

SEQ ID NO: 24943 - DNA, 50 bp, homo sapien
gcatctagtccaggttcatcactcartatgtgttagctacaagtgctttt

SEQ ID NO: 24944 - DNA, 50 bp, homo sapien
ctgattagctctgggtttatttccaygctaaattctggactggcctttcc

SEQ ID NO: 24945 - DNA, 50 bp, homo sapien
aaattactcataaagccataggtaastggtgcaacaacacgagtaacatt

SEQ ID NO: 24946 - DNA, 50 bp, homo sapien
aagggcaataggtatcaagtgaatayacaggaaataagtagcagcatctc

SEQ ID NO: 24947 - DNA, 50 bp, homo sapien
tattaataagtgtgaagaatggaatraaagtacaccagttcccaagcagc

SEQ ID NO: 24948 - DNA, 50 bp, homo sapien
gtattttccaaccagtatattgtacrccagaatattacatttttctttta

SEQ ID NO: 24949 - DNA, 50 bp, homo sapien
tttgaggagaaatccattgggaaaaktcaacctgggcatgatccaagcaa

SEQ ID NO: 24950 - DNA, 50 bp, homo sapien
gggttgaggaaaggaatcaacttacsatactttaatatttatttttaact

SEQ ID NO: 24951 - DNA, 50 bp, homo sapien
attacaagaatgaaaaaatataatgratggccttacactagtaaaccgga

SEQ ID NO: 24952 - DNA, 50 bp, homo sapien
aacacatggaaaacacagtaaatgayggcctgggattctttatagccatt

SEQ ID NO: 24953 - DNA, 50 bp, homo sapien
tcttcaccatattagaatgtgccctsaactaaattcaacatgcaagtgga

SEQ ID NO: 24954 - DNA, 50 bp, homo sapien
gttggaaatgtctagtgatcattgaragacatgggagtcccactccaaaa

SEQ ID NO: 24955 - DNA, 50 bp, homo sapien
cttacctgcgaattaatgatgcgtayggtggttttattcccaacatcttt

SEQ ID NO: 24956 - DNA, 50 bp, homo sapien
tctgaaaagtttcctgaagaaataayttaagtgttccagattccttgaaa

SEQ ID NO: 24957 - DNA, 50 bp, homo sapien
aatctctggatcttgctccacagaasttaatattggtcttggacagaaca

SEQ ID NO: 24958 - DNA, 50 bp, homo sapien
ggggatggtaaatccatacaataaartactgtacacaagaaagaaaacat

SEQ ID NO: 24959 - DNA, 50 bp, homo sapien
ttcgttgtgtataaattttgtactayagctttccactttgcatcatataa

SEQ ID NO: 24960 - DNA, 50 bp, homo sapien
aaaattgcaagtctatgtgaaaaatsaacctcaatttatctaaatgggat

SEQ ID NO: 24961 - DNA, 50 bp, homo sapien
ttggaagcttcaggtccaactgggayggctatgaacagcaagaactaaat

SEQ ID NO: 24962 - DNA, 50 bp, homo sapien
agtgtatgtttgtttataaactactwagatatatttgcttctaacagagt

SEQ ID NO: 24963 - DNA, 50 bp, homo sapien
atgagcagcccatgttgcaaataackgaaacttatgaatgcacttggaag

SEQ ID NO: 24964 - DNA, 50 bp, homo sapien
agggctcacttccctctgagtttcawcaacaaaaacattctaagagagat

SEQ ID NO: 24965 - DNA, 50 bp, homo sapien
atatgctgaaattacttgatttggcycattttaaatagcaatacacaggt

SEQ ID NO: 24966 - DNA, 32 bp, homo sapien
tgcctcctgtagtcacrccctcatggagtgcc

SEQ ID NO: 24967 - DNA, 50 bp, homo sapien
aatggcagacacatacatttatttckcagatcaaaatttctttttttttg

SEQ ID NO: 24968 - DNA, 50 bp, homo sapien
ggatccagcggagtcatctgcaagcyataaaaatgttgtataaataaatt

SEQ ID NO: 24969 - DNA, 50 bp, homo sapien
ttgtgtttactttgacagatactgamatttgtgtcctctcttttcaagtt

SEQ ID NO: 24970 - DNA, 50 bp, homo sapien
ttgtaaaaagttgttattaaatgaayggcagattttacagtcaaatgaca

SEQ ID NO: 24971 - DNA, 50 bp, homo sapien
ttcatgtataaaaccggagaagcaayatgtacctctaaacatcatgagga

SEQ ID NO: 24972 - DNA, 50 bp, homo sapien
acattctgacagacccatgaaaatasacacagtgtcctagactggatgta

SEQ ID NO: 24973 - DNA, 50 bp, homo sapien
tcaaaaatacaaacacttcacatacraggaatgctaaaattagactagaa

SEQ ID NO: 24974 - DNA, 50 bp, homo sapien
taatatttatggttacctgctatcayggcatattagttaaataagtgccc

SEQ ID NO: 24975 - DNA, 50 bp, homo sapien
aaatagaagatcaaatgatgttggargttattggaatatatatgtcttca

SEQ ID NO: 24976 - DNA, 50 bp, homo sapien
tttgctttttgttcaagttcatcaaytcttagaaaattttaatcttacta

SEQ ID NO: 24977 - DNA, 50 bp, homo sapien
aataataagatggtgggaacattaakgagcatttgttgaagggggagaga

SEQ ID NO: 24978 - DNA, 50 bp, homo sapien
atggagttgttagaattctgtaatgyatttatcaaaatccttggcacata

SEQ ID NO: 24979 - DNA, 50 bp, homo sapien
tccatgaagcaaattttacatgtgargtaattgacatattatgcaattaa

SEQ ID NO: 24980 - DNA, 50 bp, homo sapien
actgtgtgtcttactgtctacataargatactaaaggctctgagcaattc

SEQ ID NO: 24981 - DNA, 50 bp, homo sapien
agggcgctgaggcaagtagggcagayagtgtagtcccaaattacaattga

SEQ ID NO: 24982 - DNA, 50 bp, homo sapien
cacttacaaattaattagggattcasaggcaagtcatttcactttgagac

SEQ ID NO: 24983 - DNA, 50 bp, homo sapien
tatgagattgctgaaataaagagacrcaaattttgagacaaagaaagtaa

SEQ ID NO: 24984 - DNA, 50 bp, homo sapien
cttttcaactacagctgggttttgarcatatcttaattaacaaaaaaact

SEQ ID NO: 24985 - DNA, 50 bp, homo sapien
ataatatgctaccagggagagacaamtgaacttgacctcaagactccttg

SEQ ID NO: 24986 - DNA, 50 bp, homo sapien
gaggtagacctggtgatgggttggckatatcagatcagagtccatttctg

SEQ ID NO: 24987 - DNA, 50 bp, homo sapien
tgcagcataagtgatagttaaagaayagaataaggcacaagtaaggctaa

SEQ ID NO: 24988 - DNA, 50 bp, homo sapien
ggctaataaacacgtgggtaaaaagrccatctatgtgctctgctccttct

SEQ ID NO: 24989 - DNA, 50 bp, homo sapien
gcagtatgccagcagttttcccaacrgcctgtcttaatgttttgaaattc

SEQ ID NO: 24990 - DNA, 50 bp, homo sapien
atgacagatttctgttcaatcagtaycagaaggcacttcccaaacaatgt

SEQ ID NO: 24991 - DNA, 50 bp, homo sapien
tagtttgagtcacttacaagtagaasatttctgattataaaaagaatact

SEQ ID NO: 24992 - DNA, 50 bp, homo sapien
gtgtgagtctttctcttgagttcccragatcaacatggagttagttccca

SEQ ID NO: 24993 - DNA, 50 bp, homo sapien
cagtgataggccatttaaagataagrccataaactgatatctagagaact

SEQ ID NO: 24994 - DNA, 50 bp, homo sapien
ggcaggtatcaaactcttgggcttgracaatcctcttgtgtctggagttg

SEQ ID NO: 24995 - DNA, 50 bp, homo sapien
gaatagtatagcaggttagagttcartcatccagataggatgtctgactt

SEQ ID NO: 24996 - DNA, 50 bp, homo sapien
ggatctcaatcttgcagaaccagatractcaacaaatgctgtattattag

SEQ ID NO: 24997 - DNA, 50 bp, homo sapien
agcctatggatcaggtcattctaacyggagagcattattcatttttatct

SEQ ID NO: 24998 - DNA, 50 bp, homo sapien
atgagcaggcctataaagagacttaygtggtaaaaaatgaagtctcctgc

SEQ ID NO: 24999 - DNA, 50 bp, homo sapien
gtaaaaaaccactagatcctttccaragaatttcacagtaggtcacagat

SEQ ID NO: 25000 - DNA, 50 bp, homo sapien
gtgtaaaatgtgatttgaatcataaygacttcttagatttgtgtgcttgt

SEQ ID NO: 25001 - DNA, 50 bp, homo sapien
actaaaagcttgagattggtagtcayctgtgcttttgatgagtaaagtta

SEQ ID NO: 25002 - DNA, 50 bp, homo sapien
tgacaatggctatatgaacagttgarcttaaataagggatgcatatgcat

SEQ ID NO: 25003 - DNA, 50 bp, homo sapien
tggttttgtggtcaatacatgaagckctggctaagatggattcaaacatt

SEQ ID NO: 25004 - DNA, 50 bp, homo sapien
taatatttgcagtgaattagcatcartccaatacacatgggaataattca

SEQ ID NO: 25005 - DNA, 50 bp, homo sapien
ttgctttgttcactctctttctcaaygaaatacttaaatatagcaatctt

SEQ ID NO: 25006 - DNA, 50 bp, homo sapien
gcacactgtttgagaatatttaggaytcagttataccaagtccatttaga

SEQ ID NO: 25007 - DNA, 50 bp, homo sapien
aactccacaaacacaatctctgcacygtgatcaattatttagcagaaaac

SEQ ID NO: 25008 - DNA, 50 bp, homo sapien
cagagattgtgtttgtggagtttaamaaagtgattagagcagggaacatt

SEQ ID NO: 25009 - DNA, 50 bp, homo sapien
gttaggtctaatgagcagggtgaagmccacagaactgtagttgcaaatct

SEQ ID NO: 25010 - DNA, 50 bp, homo sapien
gactttgcaataacaagttgcatgayctttacttctctgagctttgttct

SEQ ID NO: 25011 - DNA, 50 bp, homo sapien
atataaagacaattttatcaaacacratttcacctttatatatgaatagt

SEQ ID NO: 25012 - DNA, 50 bp, homo sapien
gcagaaaagcaaattccggagaaaawcgttgctatagaataagcatgcca

SEQ ID NO: 25013 - DNA, 50 bp, homo sapien
tggaatatggtaaatattgttaaacmcaggtaatacatgaacgatctgca

SEQ ID NO: 25014 - DNA, 50 bp, homo sapien
tgcagagaacaaagatattgccatasaatttttaagtttagctcaattta

SEQ ID NO: 25015 - DNA, 50 bp, homo sapien
tgaattttggattctcaacttaccaratcttttcacatctccaagacctt

SEQ ID NO: 25016 - DNA, 50 bp, homo sapien
aagatgacttctacttgcctctgagmcatttgaccatagtgctaccttag

SEQ ID NO: 25017 - DNA, 50 bp, homo sapien
cagtacttgcatttcacatgtatgamaaaaggataaaataaaaaggctga

SEQ ID NO: 25018 - DNA, 50 bp, homo sapien
actccaagatcatcgagggaatacamacagaggtgatgggctctggtgag

SEQ ID NO: 25019 - DNA, 50 bp, homo sapien
aaacatatgcaagatacaatggtgargagattaatttggtgagctccttg

SEQ ID NO: 25020 - DNA, 50 bp, homo sapien
gtacaagacatttgcctcattggtamgttaatgcattggtattttattct

SEQ ID NO: 25021 - DNA, 50 bp, homo sapien
aagtcagatgtaaagactccgagcascgctagaaccgagcagttttacta

SEQ ID NO: 25022 - DNA, 50 bp, homo sapien
attgaaccttgctaaatgctcctatwagttctagtaactattatgtagat

SEQ ID NO: 25023 - DNA, 50 bp, homo sapien
ccaccatatcctcattcaacctaccyggcatatacaaaagacagatgaat

SEQ ID NO: 25024 - DNA, 50 bp, homo sapien
gagcagaagcaagacaagttactggkaaggagtaagaagcacaaatgctg

SEQ ID NO: 25025 - DNA, 50 bp, homo sapien
aacttctttaaaaaatttgctttaartaaagtattctgcctagttaaggc

SEQ ID NO: 25026 - DNA, 50 bp, homo sapien
tctaaaattcattttgcagaattcartataactggaagggaaggatggag

SEQ ID NO: 25027 - DNA, 50 bp, homo sapien
tagcttctatttttctcagagtacaycatggttttcttaggtttctcaat

SEQ ID NO: 25028 - DNA, 50 bp, homo sapien
cctgatagtgttgcttcacagtgaakaaacatccttagctatcaacacag

SEQ ID NO: 25029 - DNA, 50 bp, homo sapien
gggggtaggacagaaataaagagaargaatcatgtttcctttattttaac

SEQ ID NO: 25030 - DNA, 50 bp, homo sapien
tttgaatagtgctggctgatagcaayactaattatataacaataaaaatt

SEQ ID NO: 25031 - DNA, 50 bp, homo sapien
cttttatttatttttcttagagcacyggttagtatgctaaagacagccac

SEQ ID NO: 25032 - DNA, 50 bp, homo sapien
aaagggcaaaacagctataccaaagraagggaataaactattttaaaagc

SEQ ID NO: 25033 - DNA, 50 bp, homo sapien
gaagtctgtaggaagctaagattcaraggtgaggaaggactgaggtttgg

SEQ ID NO: 25034 - DNA, 50 bp, homo sapien
atcataataaatagtaaagcgtaaarggaaacaatacaaattgactttaa

SEQ ID NO: 25035 - DNA, 50 bp, homo sapien
gcaaagagaaatactgtttccatgcrccacagtggtcgttggtggggaga

SEQ ID NO: 25036 - DNA, 50 bp, homo sapien
gctatctgcaaattactttatatgasatgtaatttttcaataactaaatc

SEQ ID NO: 25037 - DNA, 50 bp, homo sapien
agtatatgtttattgacttgtacgaygtaagcagaactctttttagatgt

SEQ ID NO: 25038 - DNA, 50 bp, homo sapien
ggtaactttaaagtcaggatcagatyaagagataggataccttctgtgct

SEQ ID NO: 25039 - DNA, 50 bp, homo sapien
ataataaaaaataaaataaagtgagsctaatactatatttaatgttataa

SEQ ID NO: 25040 - DNA, 50 bp, homo sapien
aagataacctgcccttccttaaaacygaactgtatgaaatcaatggcacg

SEQ ID NO: 25041 - DNA, 50 bp, homo sapien
actcctattcctttctccacagaaastatacaccagtgtctacacatccc

SEQ ID NO: 25042 - DNA, 50 bp, homo sapien
tgacttggtaggaagtgggaaattaycaaaatgctctgacttggaaagtg

SEQ ID NO: 25043 - DNA, 50 bp, homo sapien
ccattgcatggatacattcggcctcygacaagattttgaagacatgaaca

SEQ ID NO: 25044 - DNA, 50 bp, homo sapien
attttggtaatttcccacttcctacyaagtcaggtccaaactactgtctg

SEQ ID NO: 25045 - DNA, 50 bp, homo sapien
tgaaatgaaagggataaggtatgccyatgtggctagcagagttccatatt

SEQ ID NO: 25046 - DNA, 50 bp, homo sapien
tggccatttcctttagtaatttagtwaataatctctttcctactgcagca

SEQ ID NO: 25047 - DNA, 50 bp, homo sapien
attaaaactctgggagaagagaatcrcagactcgggttagccaccattga

SEQ ID NO: 25048 - DNA, 50 bp, homo sapien
ttcaagctagtttcaaccagatatasagaaatataaaaatagatcagtct

SEQ ID NO: 25049 - DNA, 50 bp, homo sapien
agaatattcttgtctttaagaaactyagaaaataggataagagatattca

SEQ ID NO: 25050 - DNA, 50 bp, homo sapien
gaaatttaaattgtaaaacccatgamcttcagagcatcaaatccccctca

SEQ ID NO: 25051 - DNA, 50 bp, homo sapien
gattgccctgcgaatcagtactaaaktcctatactacagtgctgcaggga

SEQ ID NO: 25052 - DNA, 50 bp, homo sapien
atcttgtgtgaactatttcatgtgaytaagaactcattcatcaccaagcg

SEQ ID NO: 25053 - DNA, 50 bp, homo sapien
gatccaggaaaaaccatcagtaagartctatcagtatcctcactaaataa

SEQ ID NO: 25054 - DNA, 50 bp, homo sapien
ttgtgcaggatatggtctcagtgaakgtactgtgtggactttaaactaat

SEQ ID NO: 25055 - DNA, 50 bp, homo sapien
ttttgaacttcctacttgcctcaaarttaatacctccatttatgtttaat

SEQ ID NO: 25056 - DNA, 50 bp, homo sapien
agaaagaagggatgaacaaattgcamaacaagaggctggtcggtggtgag

SEQ ID NO: 25057 - DNA, 50 bp, homo sapien
ctcagtataaaacctagaatgaaaasttcaccatgaaaagcacttactgc

SEQ ID NO: 25058 - DNA, 50 bp, homo sapien
aactaattttaattaatagactccayagtttctgtctggaacccaggtgt

SEQ ID NO: 25059 - DNA, 50 bp, homo sapien
catcaggaaaatgttataattatgasaaaagtaaattgttatgagttcaa

SEQ ID NO: 25060 - DNA, 50 bp, homo sapien
caataatgaccacttgttaactaaaytgctgatctgtaaaatgggatgaa

SEQ ID NO: 25061 - DNA, 50 bp, homo sapien
gttgttgataattcaactactggtaygcttaggtaggctgaaatgcaatt

SEQ ID NO: 25062 - DNA, 50 bp, homo sapien
ccctggtacagacctaaaggaccacsatcaaatatccattgttaagtact

SEQ ID NO: 25063 - DNA, 50 bp, homo sapien
aactctgattacatttatttcaaccragagatgaaggaaacaaaggtcca

SEQ ID NO: 25064 - DNA, 50 bp, homo sapien
gcagcaagtctccaatactcaaagtraagactccttccacctcctactct

SEQ ID NO: 25065 - DNA, 50 bp, homo sapien
aacaactcgtctacttcctgtttcaratgctccgatattctcatatagct

SEQ ID NO: 25066 - DNA, 50 bp, homo sapien
agtagaaaatacctccagttaatgaytaataataaaaaacagatcatagc

SEQ ID NO: 25067 - DNA, 50 bp, homo sapien
gaggagcccatttgtattccaatcaygcagggaagaacttttttctaatt

SEQ ID NO: 25068 - DNA, 50 bp, homo sapien
acacaactcatcaacaaaaatgagtraactactaatgcatgccacaaaga

SEQ ID NO: 25069 - DNA, 50 bp, homo sapien
ttggagcaaactttcaaatagccctraagttatcataaaaaacaacagca

SEQ ID NO: 25070 - DNA, 50 bp, homo sapien
tctagggcatggtccttattcctaaratataacccaatattctcagtgag

SEQ ID NO: 25071 - DNA, 50 bp, homo sapien
aaatctattgagtgggagcatttaayagtaaggtagaaattgtaatattg

SEQ ID NO: 25072 - DNA, 50 bp, homo sapien
aatttacattaaacctttgaagaagsatgtaacttttctgctcataaatt

SEQ ID NO: 25073 - DNA, 50 bp, homo sapien
gtaaacctgttttctagggttgtgayagaagttattgtgattgtttagtg

SEQ ID NO: 25074 - DNA, 50 bp, homo sapien
cttaaaatctagaacctgtaactcartaagatgtcagtcacaatgtgtcc

SEQ ID NO: 25075 - DNA, 50 bp, homo sapien
tgttctgccatctttattcttttgaygagcctctttactaatttctttct

SEQ ID NO: 25076 - DNA, 50 bp, homo sapien
gaagctgagagaataaatggcattawcagtttctacaataggaaaaagat

SEQ ID NO: 25077 - DNA, 50 bp, homo sapien
aggggatataatagaacttgtcagcrgaagttactcagtaaacccgtgaa

SEQ ID NO: 25078 - DNA, 50 bp, homo sapien
gcctagctacctctggatgactcgtwacataacacagttaacctctcacc

SEQ ID NO: 25079 - DNA, 50 bp, homo sapien
atgcttgggaacatgttctaggtaartagctccaatggaatgaagttttc

SEQ ID NO: 25080 - DNA, 50 bp, homo sapien
ggtctcaagtgctagaaccaaaattyaacatggccaggactctttctttg

SEQ ID NO: 25081 - DNA, 50 bp, homo sapien
ccgtcctcaacagtgaatcagggaaygccttggaagaactcactttaaat

SEQ ID NO: 25082 - DNA, 50 bp, homo sapien
aaggcttggtagaactcattggtgawaccatcaggttcagggcttttctt

SEQ ID NO: 25083 - DNA, 50 bp, homo sapien
ggaatgaaagtatataaaaatgtcawtagaaattctaagtatggggtaat

SEQ ID NO: 25084 - DNA, 50 bp, homo sapien
aagggtgataaagtcaaaataacaakcacatttcatatcgatcagtgggg

SEQ ID NO: 25085 - DNA, 50 bp, homo sapien
ttttcttcaaaaatgtattctctcaygtattctatggaatactacttgac

SEQ ID NO: 25086 - DNA, 50 bp, homo sapien
tgacatgtagggcccagacaagggayctacatgaaactgagctaaatggg

SEQ ID NO: 25087 - DNA, 50 bp, homo sapien
cctgcatggttgttcaacaagcctcrcccatagatctttgagccactgtg

SEQ ID NO: 25088 - DNA, 50 bp, homo sapien
attactcccatcttactagtggatayggtgaattcacactggctttcttt

SEQ ID NO: 25089 - DNA, 50 bp, homo sapien
agtttctcatcactgtaagactcacyacatattcaaaagaccattaggaa

SEQ ID NO: 25090 - DNA, 50 bp, homo sapien
gttattacgaagactaaatgagataygcatgttaattcccagcccacaga

SEQ ID NO: 25091 - DNA, 50 bp, homo sapien
ttgtgcaaactataagtcttgcattmaacttcaaacagtcgacaagtcat

SEQ ID NO: 25092 - DNA, 50 bp, homo sapien
ctcaagcaagtaatgtatcttctaaraacaatatgatcttcatctgtaaa

SEQ ID NO: 25093 - DNA, 50 bp, homo sapien
cagcttttctgggatagtaagcatamcttacattcatagaacacagtgta

SEQ ID NO: 25094 - DNA, 50 bp, homo sapien
atcagtgggcagcttatttgtgtgamtcaagattttcttaatatttagca

SEQ ID NO: 25095 - DNA, 50 bp, homo sapien
aatttgacatcaccttagtcacttayagagaggaaaaaaagtttcatgag

SEQ ID NO: 25096 - DNA, 50 bp, homo sapien
agtgacatgagagttggtctttcaaytgggcgagattaatggctgtgggc

SEQ ID NO: 25097 - DNA, 50 bp, homo sapien
tacaaagaaaattcaatgaaatgtasgttcttctcaatgtcataagaata

SEQ ID NO: 25098 - DNA, 50 bp, homo sapien
cttgtttaaggtgacacagaaaatakgtagtgtctggtattagccgctgc

SEQ ID NO: 25099 - DNA, 50 bp, homo sapien
tcagctacaaaacaaacataactaargagaaagtcaaatgagagccataa

SEQ ID NO: 25100 - DNA, 50 bp, homo sapien
cattaaaacatcaaaattgttgtaaygttagagtacatttcaccatgatt

SEQ ID NO: 25101 - DNA, 50 bp, homo sapien
tacatcatcttacctattgcatcacygtgactatgtggccagtactgtta

SEQ ID NO: 25102 - DNA, 50 bp, homo sapien
ctactatacatcaaatactatgcaamgtgtttgacctgcgttacccagtc

SEQ ID NO: 25103 - DNA, 50 bp, homo sapien
tagtaatcaagacctggttcgaaagmatgtaccagtgctagcaggagata

SEQ ID NO: 25104 - DNA, 50 bp, homo sapien
ttctggaagatgttgggtaagctaayggaaggaggataacaagaatgtat

SEQ ID NO: 25105 - DNA, 50 bp, homo sapien
ttttttgaaacttaatttttaggtaygacattctctggtagccataacat

SEQ ID NO: 25106 - DNA, 50 bp, homo sapien
aagaataaatccttctattaaagcaraaataatgtattcagtggaagaca

SEQ ID NO: 25107 - DNA, 50 bp, homo sapien
agggtctcaaaagtgaactgaagaaytgctaggcaaacaagcagtatcca

SEQ ID NO: 25108 - DNA, 50 bp, homo sapien
taattccagcatctaacaaagaaccrgaagaaagaacataaaagtttcac

SEQ ID NO: 25109 - DNA, 50 bp, homo sapien
agtcacctgacaaatttccatgagamgagagataaggaacattatgagcc

SEQ ID NO: 25110 - DNA, 50 bp, homo sapien
caagcacgttcaatgactagtgaaayaggagtacaaaggctataaagacc

SEQ ID NO: 25111 - DNA, 50 bp, homo sapien
aagtgttcctaggatgcagtctctcmaatgaggttttggagctatatcac

SEQ ID NO: 25112 - DNA, 50 bp, homo sapien
ggtgcttgagccggtgcagcaagcaygcccttctgtattcctctcttgag

SEQ ID NO: 25113 - DNA, 50 bp, homo sapien
tggccctcaataatgcagcactgaaygactctaaacaaacagcaagggta

SEQ ID NO: 25114 - DNA, 50 bp, homo sapien
taaataacaaaaacttgaaaacaatsaacagggctatgatctaacaacaa

SEQ ID NO: 25115 - DNA, 50 bp, homo sapien
aaatcatttttactatgggttacaawtaatcaattaaaaatgaaaacaaa

SEQ ID NO: 25116 - DNA, 50 bp, homo sapien
aggcaaaaagttccacttccactcaragatggaaatgctgggtagtttga

SEQ ID NO: 25117 - DNA, 50 bp, homo sapien
gtgcacttatagctcaatcttttacraacccaaacaacaaaagcttgtgt

SEQ ID NO: 25118 - DNA, 50 bp, homo sapien
tttgatcttccaaaaaaactgtgatwacctgttccaaagaaatcacaaac

SEQ ID NO: 25119 - DNA, 50 bp, homo sapien
attaggtttggaaaatgaggagttaratatctcaaaagaaacattttcaa

SEQ ID NO: 25120 - DNA, 50 bp, homo sapien
cttgtaaaaatgcttccagatttgaygaagtatctgcagagactatagaa

SEQ ID NO: 25121 - DNA, 50 bp, homo sapien
gcaaaactaaagctacgtacgtgaayactgttttgcagagaccacatcta

SEQ ID NO: 25122 - DNA, 50 bp, homo sapien
ttcttattttctacaaataataacasagtatatgcagtaggaatgcaaac

SEQ ID NO: 25123 - DNA, 50 bp, homo sapien
tgtgcaatctcagaggattgtttaaygtacacgtgtgtactccaggtgcc

SEQ ID NO: 25124 - DNA, 50 bp, homo sapien
aaaaatgaacataaagcatatcttgmataagacaacagaggcctgtaatt

SEQ ID NO: 25125 - DNA, 50 bp, homo sapien
ttcaactgttttatcatgcttggtgmaacaatgaatacatttctttttta

SEQ ID NO: 25126 - DNA, 50 bp, homo sapien
aagctatcataaaatgtgtatttaaygtccagagtaatagtctcccttta

SEQ ID NO: 25127 - DNA, 50 bp, homo sapien
acttgtagttctatttacatttacarctcgacttccgtttcacatctcag

SEQ ID NO: 25128 - DNA, 50 bp, homo sapien
gcctgctagaactaattacagttcaygctctttccagctgctatgcactt

SEQ ID NO: 25129 - DNA, 50 bp, homo sapien
atgctctaataagagaagagaaataraacgagaaccagaggtgtaagact

SEQ ID NO: 25130 - DNA, 50 bp, homo sapien
atcttcctcctccttatggactgccrggcaatatcctgttgaaccccttc

SEQ ID NO: 25131 - DNA, 50 bp, homo sapien
agctcttcaaaaccataagatatcaragaagtagcctggtgccttttcat

SEQ ID NO: 25132 - DNA, 50 bp, homo sapien
tattagtcagattgttacgaagtctsaaggtctttagggagaaaacagat

SEQ ID NO: 25133 - DNA, 50 bp, homo sapien
tcttataagggcacagttggtgacaytccaaaacaattagcttagtaaaa

SEQ ID NO: 25134 - DNA, 50 bp, homo sapien
agtctaatggaaatttccccatacawaatttgatgctttctcttgctgtt

SEQ ID NO: 25135 - DNA, 50 bp, homo sapien
atggaaataaagcagagtcatgtgartagaccagattggtattttagcta

SEQ ID NO: 25136 - DNA, 50 bp, homo sapien
agttcagggatgcagttgtgttttcrataactaggaccacaaccaaaagc

SEQ ID NO: 25137 - DNA, 50 bp, homo sapien
ttcagatgtgtgtgctgacaggaaaygaagacactttcttctcagacagt

SEQ ID NO: 25138 - DNA, 50 bp, homo sapien
acagagagatccagaaggagacgtgyaaaatgcagaataactggggaagt

SEQ ID NO: 25139 - DNA, 50 bp, homo sapien
tctcacttgcaaccagaactatacarccagttaacaaggtgtagaggttt

SEQ ID NO: 25140 - DNA, 50 bp, homo sapien
gggttgttaatgactttatttcttcrcctcacctagattctggtctagaa

SEQ ID NO: 25141 - DNA, 50 bp, homo sapien
gggtaccaaactaaatcactcaaatmagaatagctattggtatggccaga

SEQ ID NO: 25142 - DNA, 50 bp, homo sapien
tttggtcaaaagacaaagattgtgargttaatttaaaaacaaatccatat

SEQ ID NO: 25143 - DNA, 50 bp, homo sapien
agattcccgggaattaaagaattacrgcatggaatgagagatgcaggcgg

SEQ ID NO: 25144 - DNA, 50 bp, homo sapien
tcagtgattatagcacagattctgamattttaagggtggggttctttttg

SEQ ID NO: 25145 - DNA, 50 bp, homo sapien
agcgagagaatccgtaataacaagarattccataaatcccatagatccgt

SEQ ID NO: 25146 - DNA, 50 bp, homo sapien
cgaggtaatatgcaaatatagaatawgtttcagcccgtaccaggcaatac

SEQ ID NO: 25147 - DNA, 50 bp, homo sapien
aacctcagccactcattgtggagtcyaattacatcttgtccaaattatca

SEQ ID NO: 25148 - DNA, 50 bp, homo sapien
ctttctatgatcaatacagagtgcaytgagctgacaatacacagaaaacc

SEQ ID NO: 25149 - DNA, 50 bp, homo sapien
taccataagaatttgcacttgttgaygtgtttttttgtactgtttccttc

SEQ ID NO: 25150 - DNA, 50 bp, homo sapien
aagtgctcatacatatcattaacaarcctttagagagggtgagtactcag

SEQ ID NO: 25151 - DNA, 50 bp, homo sapien
ctacatacacacaccttaggcactayggctagaacatgaacaagaaacgt

SEQ ID NO: 25152 - DNA, 50 bp, homo sapien
ctaaatcaagaagtcagctcttacayagagggtgtggagtggtcaatgtg

SEQ ID NO: 25153 - DNA, 50 bp, homo sapien
gaaattgatcacctgggttatatacygaaatcataagtcagaactgtgct

SEQ ID NO: 25154 - DNA, 50 bp, homo sapien
ttgaatgttgcacatcttatagcagraaggaattctccctagcagatcag

SEQ ID NO: 25155 - DNA, 50 bp, homo sapien
ctattaaactagtggcaaaacagaaytggtcccttagttttttagattac

SEQ ID NO: 25156 - DNA, 50 bp, homo sapien
tatctaatagaccatagagaggaaakaattctgatatccagctccatttc

SEQ ID NO: 25157 - DNA, 50 bp, homo sapien
ccagcttcagtccaagcatgtataaktcactgggattctcattctgggaa

SEQ ID NO: 25158 - DNA, 50 bp, homo sapien
agagtcgctcagatcacgtagaggaygaaccttctatttttttttcaaac

SEQ ID NO: 25159 - DNA, 50 bp, homo sapien
attaaataaatctaatcatggaaatraactgacccaggtgatgggcacag

SEQ ID NO: 25160 - DNA, 50 bp, homo sapien
tagctcccttaaatccagaaaatgartaagactgacatgacttcgctcca

SEQ ID NO: 25161 - DNA, 50 bp, homo sapien
taaaaacatttctcctgcctgggcawaattaggttcagagcagcatttac

SEQ ID NO: 25162 - DNA, 50 bp, homo sapien
aggttttatcatgacagttgagctaygtgttgagacatgggcaagaattg

SEQ ID NO: 25163 - DNA, 50 bp, homo sapien
agaaaatcaaatactgcatgctgtcrcttatacttggaagctaaacaaaa

SEQ ID NO: 25164 - DNA, 50 bp, homo sapien
ccatatcttaatcatttctatattcycagtggcttgtcagtgcctggcca

SEQ ID NO: 25165 - DNA, 50 bp, homo sapien
taagactcagatggtctcattgttawaaattaaggctgatcaaagtgact

SEQ ID NO: 25166 - DNA, 50 bp, homo sapien
gtaaatattttaggctttgtgggacrctttcactgttacatattcttatc

SEQ ID NO: 25167 - DNA, 50 bp, homo sapien
tcccccttcaaaatagccacctaggmaagttatgtaattattccagtgat

SEQ ID NO: 25168 - DNA, 50 bp, homo sapien
ttgtaacaaatcttaaagtgtaagcrgagttagcccaaataaggagagag

SEQ ID NO: 25169 - DNA, 50 bp, homo sapien
ttcacatgcctttcgtggtattcaasggtctgatactgaaaaagttaaat

SEQ ID NO: 25170 - DNA, 50 bp, homo sapien
acctcttcatctcactctgggtaacraatgaggaattttgaggactactg

SEQ ID NO: 25171 - DNA, 50 bp, homo sapien
attttgaggactactgggcactatarcttttcagagcaggcagggctgct

SEQ ID NO: 25172 - DNA, 50 bp, homo sapien
tggcccctatctgggggtggcggtargtaacaaaagatgaagaatatttg

SEQ ID NO: 25173 - DNA, 50 bp, homo sapien
taatcaatagttcattgcttttcacygctaagcattattttattataggg

SEQ ID NO: 25174 - DNA, 50 bp, homo sapien
atcttaaaacagaaaccgagttaggmatgcttctcacagcaagaagaaag

SEQ ID NO: 25175 - DNA, 50 bp, homo sapien
acacctggagaactgtcctgcgttgratagaatactcagaagaaatttgt

SEQ ID NO: 25176 - DNA, 50 bp, homo sapien
ggaagctttgaaatctagttcatcaytgacaaatccggtgaaaattaatc

SEQ ID NO: 25177 - DNA, 50 bp, homo sapien
taactaatatttaaaaagcaagtccsagtatcacatcagctatgcagact

SEQ ID NO: 25178 - DNA, 50 bp, homo sapien
attcattctagcaagtcgtgctgaayctaaacactttaggattaagatta

SEQ ID NO: 25179 - DNA, 50 bp, homo sapien
agaaatatatcagtattcaagtaccrgaagattatagatcatcaagaaga

SEQ ID NO: 25180 - DNA, 50 bp, homo sapien
ggggttagtaaattatctttaggatyatcaatggatttgaaaaacataca

SEQ ID NO: 25181 - DNA, 50 bp, homo sapien
cactgtgactacataacactgataastgacttcaaagaaaatcagatgag

SEQ ID NO: 25182 - DNA, 50 bp, homo sapien
aagtttggtcaagagttccataaaakgtgtatatatgcttatatgtatat

SEQ ID NO: 25183 - DNA, 50 bp, homo sapien
gattcactaagcccacctgagttgtyaagcatcacataccaaagaaaggc

SEQ ID NO: 25184 - DNA, 50 bp, homo sapien
gccaattattgtgcataactaaagckgatgctagaagacagtttagcctt

SEQ ID NO: 25185 - DNA, 50 bp, homo sapien
ctttggccataggtcacctgtctcakctttgtaaggatcatacatagacc

SEQ ID NO: 25186 - DNA, 50 bp, homo sapien
actcttctattttcaagttcctgtaygattctcaagtaattctaaacctg

SEQ ID NO: 25187 - DNA, 50 bp, homo sapien
tactaagctctatgggtgatactcartaactgacaatgtagctgggaagg

SEQ ID NO: 25188 - DNA, 50 bp, homo sapien
aacagtattcaacatagttgctaaayaatatttgaagtcatgactaaatc

SEQ ID NO: 25189 - DNA, 50 bp, homo sapien
tgctgacaagccaacataacttaaayatggtctcttctggttcaagtagt

SEQ ID NO: 25190 - DNA, 50 bp, homo sapien
tgatcttctttattctttactttctsaaatgatgagtagtcaaaatttgt

SEQ ID NO: 25191 - DNA, 50 bp, homo sapien
tgtcctttggtggtttgtcataaaasagaggccaatgcactgatcactcc

SEQ ID NO: 25192 - DNA, 50 bp, homo sapien
tggaataacaccacctgaggaaataygtggctctcagcacttgttcaagc

SEQ ID NO: 25193 - DNA, 50 bp, homo sapien
gcagcaagaggttagtggacagtgamaaggtggttgagatggcagatcag

SEQ ID NO: 25194 - DNA, 50 bp, homo sapien
ggctctcagcacttgttcaagcacaktaatttgacagcatgcacgagctg

SEQ ID NO: 25195 - DNA, 50 bp, homo sapien
accaggggagactctggggcttatargataacatcaattttgagcatcag

SEQ ID NO: 25196 - DNA, 50 bp, homo sapien
tctactgagagaagctaatcctcaamtcatcctgctcagtgggaagtgaa

SEQ ID NO: 25197 - DNA, 50 bp, homo sapien
aacttaaattccttggtacagttcaygaggctttttgttatcttgtttct

SEQ ID NO: 25198 - DNA, 50 bp, homo sapien
gtttcgtttagtttgctctcatgaamggtgacggtaatgttcctcagcta

SEQ ID NO: 25199 - DNA, 50 bp, homo sapien
ttcgtaccttggaaaagaaatccaaktattcagtccttcacgagactgat

SEQ ID NO: 25200 - DNA, 50 bp, homo sapien
gaaatcttatctcacaaaaacggtarggttcattcccatggaattcgttg

SEQ ID NO: 25201 - DNA, 50 bp, homo sapien
gaagtggatctcccttcacatggaargcatcattaagaggactccaccct

SEQ ID NO: 25202 - DNA, 50 bp, homo sapien
gaaacaactgaaagttaatcaaagcrgagggagatcaaaatatcagctgc

SEQ ID NO: 25203 - DNA, 50 bp, homo sapien
tagaaaaaatacataatggagaaaaytatcacatattgagcaactttgca

SEQ ID NO: 25204 - DNA, 50 bp, homo sapien
ttggctttatttgtacaactttatamcattttcaaatactgatgactgta

SEQ ID NO: 25205 - DNA, 50 bp, homo sapien
ttaaaagattttgaagtcagaaataygcaattagatagaaaatttagctt

SEQ ID NO: 25206 - DNA, 50 bp, homo sapien
ggactcctggtattgtcactttttcrcagtattttgaattttagttaaca

SEQ ID NO: 25207 - DNA, 50 bp, homo sapien
tgagccaataaagacttattgagcarctactctacaataggcaacaggaa

SEQ ID NO: 25208 - DNA, 50 bp, homo sapien
atctacagcagtgaaatctttaacgraagactgtcatctgcctctgtgct

SEQ ID NO: 25209 - DNA, 50 bp, homo sapien
aaaaccaaaccaagaacatacatgcrctacttttgttttagatttagtaa

SEQ ID NO: 25210 - DNA, 50 bp, homo sapien
cagtgtttgctgttatttaccaagayagcaaatggtcctgcaccctcacc

SEQ ID NO: 25211 - DNA, 50 bp, homo sapien
tggacgttgaacatccagttcctcaratcaattcagttttaatatgatgg

SEQ ID NO: 25212 - DNA, 50 bp, homo sapien
gaaataagaaaggagaagtaaaaatkacaatcaaggaaagagaaccaagg

SEQ ID NO: 25213 - DNA, 50 bp, homo sapien
catcttgttaaaggattttcccagargtgaagttaaagtagccccagact

SEQ ID NO: 25214 - DNA, 50 bp, homo sapien
agtggctcttgctaggcaacatcaayggagtaatttttaaaagtgacagc

SEQ ID NO: 25215 - DNA, 50 bp, homo sapien
tataatacaaacagtataataactaygaagcattattctacaataggatg

SEQ ID NO: 25216 - DNA, 50 bp, homo sapien
tcctgggtgatttaagaaagagcacratgtgggtaaattgctggtccata

SEQ ID NO: 25217 - DNA, 50 bp, homo sapien
atggctctcacagacaacctaataaytaaatcagatttccttcttttcct

SEQ ID NO: 25218 - DNA, 50 bp, homo sapien
aacataacactaccaaatgtccctaygtctcagttacaacagtgtttggg

SEQ ID NO: 25219 - DNA, 50 bp, homo sapien
tttggaaaaatccctagcctaataawcagacttctatcaacggtgtcatt

SEQ ID NO: 25220 - DNA, 50 bp, homo sapien
atgtctgtaggtaagaaagatggccygaaacagtgttttctatggtgcat

SEQ ID NO: 25221 - DNA, 50 bp, homo sapien
aatatcagaatatcagaacccaacartattatcccgtccacttataagta

SEQ ID NO: 25222 - DNA, 50 bp, homo sapien
tacccctgtggggtgactagtggaaytcctggtagtgagaaaaagtgaga

SEQ ID NO: 25223 - DNA, 50 bp, homo sapien
gattcttatttcaggtttacacttaygtctccattcattttgttctataa

SEQ ID NO: 25224 - DNA, 50 bp, homo sapien
agaagagaagctgtaaaacaatgaartgtgccaaatgagactatagggaa

SEQ ID NO: 25225 - DNA, 50 bp, homo sapien
cagccttccactgcctatatcttagwcatttttttaatggcctcaactgt

SEQ ID NO: 25226 - DNA, 50 bp, homo sapien
tgaaaaaaagggagaaattgagaacrcttccattataaggtaactgcact

SEQ ID NO: 25227 - DNA, 50 bp, homo sapien
tctattacaaaattttagccaggagwcacttatatagacaggtatatttc

SEQ ID NO: 25228 - DNA, 50 bp, homo sapien
tcatatgcctcagcttaaacctacaragcccgatataatacaaacagtat

SEQ ID NO: 25229 - DNA, 50 bp, homo sapien
accagcatgagtggtaaactcaggasacctagatgctggttctgccaata

SEQ ID NO: 25230 - DNA, 50 bp, homo sapien
cacctgcctcagaccaatgaaggacraactaatctctagctagaatttga

SEQ ID NO: 25231 - DNA, 50 bp, homo sapien
tttacaagggtgttgatgattttacraaatttaaggcagagattacattt

SEQ ID NO: 25232 - DNA, 50 bp, homo sapien
gtcagactccccaaactctggatcaycctagactgataatttcttttgga

SEQ ID NO: 25233 - DNA, 50 bp, homo sapien
acttttcctccgtctatcagttctcraccagcattaaatgaatagttaga

SEQ ID NO: 25234 - DNA, 50 bp, homo sapien
ctaaaaaccccatcctcaatcaggcraagtgataaataacacaaacagta

SEQ ID NO: 25235 - DNA, 50 bp, homo sapien
gatggattcagctaatagatgaagayggtagtgatcaaacaaaagaaatg

SEQ ID NO: 25236 - DNA, 50 bp, homo sapien
ttcctttcagactttttgtctgtccrataatgtaattcatgtaattggga

SEQ ID NO: 25237 - DNA, 50 bp, homo sapien
tattatttatcatgtctactttccayataacaacagaacacaatttagtc

SEQ ID NO: 25238 - DNA, 50 bp, homo sapien
tggaattgctttatggtcataaaggwaatattttggccactctgagggat

SEQ ID NO: 25239 - DNA, 50 bp, homo sapien
agcacttattgagcatcttttggaaygtctattatcccgcttcttcaaag

SEQ ID NO: 25240 - DNA, 50 bp, homo sapien
ccccctatatctgattaatgacaaakgtatatcacttcaaatgcataaag

SEQ ID NO: 25241 - DNA, 50 bp, homo sapien
ctactatgtagaaaggctaagacaaygaataagataagatttctctcctc

SEQ ID NO: 25242 - DNA, 50 bp, homo sapien
ctgggcgatgggggccctggactcayaccgattaaggaagaagacaatgg

SEQ ID NO: 25243 - DNA, 50 bp, homo sapien
agttccaaaagtaccagtgattctgyagttacatagagaatagattcaaa

SEQ ID NO: 25244 - DNA, 50 bp, homo sapien
actctcagatgattccaactacctaygtctggtggttacaaataatattt

SEQ ID NO: 25245 - DNA, 50 bp, homo sapien
atcaaactgatggtcttaggaatgaygatctaaccagaattgaaatggct

SEQ ID NO: 25246 - DNA, 50 bp, homo sapien
ccagttatttgcacataatgctagtyactaatacagagctgtagataact

SEQ ID NO: 25247 - DNA, 50 bp, homo sapien
aatatctcagtaatgacgttatcatraacaatacaactctcttgggaaaa

SEQ ID NO: 25248 - DNA, 50 bp, homo sapien
ctgtccttttagaaatatgtaataaygctttcagaatcagtgtttatttg

SEQ ID NO: 25249 - DNA, 50 bp, homo sapien
tgctccaggatccaatccaagaaacrcattaaatttacttatcatactcc

SEQ ID NO: 25250 - DNA, 50 bp, homo sapien
caatctctctcactatctaatttcargtagtggtaagtgactaagtgcta

SEQ ID NO: 25251 - DNA, 50 bp, homo sapien
aaattcactgtctgcttattttaaastgtgttgcaaagaattgttttcat

SEQ ID NO: 25252 - DNA, 50 bp, homo sapien
tctgctatgttctaccatttttttcyatattggaagacttatcacacttg

SEQ ID NO: 25253 - DNA, 50 bp, homo sapien
tcctctcctagggtcatcaaggacckatatgatttgtgcccatttgtatc

SEQ ID NO: 25254 - DNA, 50 bp, homo sapien
ttatctggtttatttatctctacatyatctgggcagagaagcttggctaa

SEQ ID NO: 25255 - DNA, 50 bp, homo sapien
caaacagtggttttatttagaaaaaragtgtgatacgtagtgcattgcat

SEQ ID NO: 25256 - DNA, 50 bp, homo sapien
tcacaggatacctcttttgctcttargtaagtggattcttgagggaagct

SEQ ID NO: 25257 - DNA, 50 bp, homo sapien
ctgttctggtcttcagcttgaaatgwagcaacaaatttaaattccaaata

SEQ ID NO: 25258 - DNA, 50 bp, homo sapien
gagtcctatttgttatttcttcacakgggaattgtgtttttataattttg

SEQ ID NO: 25259 - DNA, 50 bp, homo sapien
tctaccaggggatctaaggggccaartagtagccagcaaatgacctgggt

SEQ ID NO: 25260 - DNA, 50 bp, homo sapien
ctttttgtagaaatgcctaaggaaaktaatcgaactatttctcatatgaa

SEQ ID NO: 25261 - DNA, 50 bp, homo sapien
gttgaaatatgcttacagataaaaayggacatgccctgctcttatggggt

SEQ ID NO: 25262 - DNA, 50 bp, homo sapien
tttatgacaccaaagcaaaggagtaygtaaaagcaagtagaaacatagaa

SEQ ID NO: 25263 - DNA, 50 bp, homo sapien
aatatattgttattaaatgcagttamcataacatatattagatctcttga

SEQ ID NO: 25264 - DNA, 50 bp, homo sapien
tggcaatggccactgactataatgawaatgtaattctcatctttgttact

SEQ ID NO: 25265 - DNA, 50 bp, homo sapien
ttacagatgtctttactcgactttayacttgatcagtagtttggccaggt

SEQ ID NO: 25266 - DNA, 50 bp, homo sapien
aactgacaaactggtaacaacaaagrctgagactgaagtaaggtgatgaa

SEQ ID NO: 25267 - DNA, 50 bp, homo sapien
ttaactaagtactgctttctgatackgcttctctagctacagactgactt

SEQ ID NO: 25268 - DNA, 50 bp, homo sapien
ttattgatctcagtgttcctagagaycatttcccctaacattccaatgaa

SEQ ID NO: 25269 - DNA, 50 bp, homo sapien
gctgaaaagagagtggacagctgccrgaccagtttgagaagataatcaga

SEQ ID NO: 25270 - DNA, 50 bp, homo sapien
gccctgtgggagacacaccagcgaaygaggaaatgtaccagcatgcccgg

SEQ ID NO: 25271 - DNA, 50 bp, homo sapien
ctaattaattttgaattaacaaatartaagtatgactttttctgtttttt

SEQ ID NO: 25272 - DNA, 50 bp, homo sapien
acgttgatagcttttaaacatttcayctttggtattagaaacagtagttt

SEQ ID NO: 25273 - DNA, 50 bp, homo sapien
tctttttcaaagcatattaagatagwattatggatccaaatgcaaaccta

SEQ ID NO: 25274 - DNA, 50 bp, homo sapien
atatctctagaaaatggcacccttgyaacattggaggttctgctattccc

SEQ ID NO: 25275 - DNA, 50 bp, homo sapien
atgagacagttgactccaggtaatgkatcaggacctttagaactggattg

SEQ ID NO: 25276 - DNA, 50 bp, homo sapien
aatttatatttgtgaaatggaaataygtttgaaagtccaggagaccctcc

SEQ ID NO: 25277 - DNA, 50 bp, homo sapien
gatcagcaagtaaatatcatttcatmaaacacgcaaatctgccaacttca

SEQ ID NO: 25278 - DNA, 50 bp, homo sapien
aatcaagaacaaagagcacatcaatsagtagtggaacagagaggaatctt

SEQ ID NO: 25279 - DNA, 50 bp, homo sapien
acaagcactcagctggttaaaagtaygaagctgaggcatggaacaggaca

SEQ ID NO: 25280 - DNA, 50 bp, homo sapien
agcccagactctgccactgagattgrattaacaggagctcacagggctct

SEQ ID NO: 25281 - DNA, 50 bp, homo sapien
catagttattttattcaaaagccacraggttcaacatgattttggcatac

SEQ ID NO: 25282 - DNA, 50 bp, homo sapien
aaaaagaaaaaaaaaaggacagcaakttcaacgtggaggtgaagagaaag

SEQ ID NO: 25283 - DNA, 50 bp, homo sapien
cacatgctttagtttcagcaacacasattagtgaattttcagtttagtca

SEQ ID NO: 25284 - DNA, 50 bp, homo sapien
ataaacatttcctatatcacactaarataagtttgttacacttgatttta

SEQ ID NO: 25285 - DNA, 50 bp, homo sapien
aatccctcctcaatccagacttgaastagtggtgctgcatgaaagaaagg

SEQ ID NO: 25286 - DNA, 50 bp, homo sapien
aacaaaggttttgttttcctaaagcrctaatttgatcaagtcttttagct

SEQ ID NO: 25287 - DNA, 50 bp, homo sapien
ttctctggtttacatccagtaagaarttcacattctctataaaaactata

SEQ ID NO: 25288 - DNA, 50 bp, homo sapien
aactttcctctcagtacattcagacrcatagactaacactagtccattaa

SEQ ID NO: 25289 - DNA, 50 bp, homo sapien
gtaaggcaaaataggtagatttgacrcaacttgggcttccagctacagac

SEQ ID NO: 25290 - DNA, 50 bp, homo sapien
gccagtgcagcaattaacctcagtargaacattcattaaagtccttcatt

SEQ ID NO: 25291 - DNA, 50 bp, homo sapien
ataaggaaccaagtccaaatgaggcsagcttaatttgagctagcagaatt

SEQ ID NO: 25292 - DNA, 50 bp, homo sapien
ggatttttttttaacctctctgcaargctgtatcacaaagacactacaag

SEQ ID NO: 25293 - DNA, 50 bp, homo sapien
gagttgaataatcacaaaagagttamatccgcattacatatatctcttag

SEQ ID NO: 25294 - DNA, 50 bp, homo sapien
aaaattaacttgctgcaaatacatcsgagctaatttagagctgaagcgat

SEQ ID NO: 25295 - DNA, 50 bp, homo sapien
tatagttcaaatattctctctaaaartataatgctgggaagagttaagga

SEQ ID NO: 25296 - DNA, 50 bp, homo sapien
tcaattattgaaatcataggtgtagragaaagtcagcaaagggtagcaca

SEQ ID NO: 25297 - DNA, 50 bp, homo sapien
caatgacatttaagacattctgaaastacagggcagattccgtgtcagaa

SEQ ID NO: 25298 - DNA, 50 bp, homo sapien
aaggtgtcaggaaagtagtacactawgaacttcccttgatgtcaaccctt

SEQ ID NO: 25299 - DNA, 50 bp, homo sapien
tcctctgtatgacttgattatcttayctgtcaaatgggtatagtaattca

SEQ ID NO: 25300 - DNA, 50 bp, homo sapien
aattttggtattatcatacagtgcargaagaaaacagggataggtttatc

SEQ ID NO: 25301 - DNA, 50 bp, homo sapien
tagcatagaaggcctacctttccacygtcattgtaactttcttttaccct

SEQ ID NO: 25302 - DNA, 50 bp, homo sapien
ctgactcactccaaggccgtgctagrattaagataactttatatacaagg

SEQ ID NO: 25303 - DNA, 50 bp, homo sapien
caaacacttaagtcactgtagcataygtagtcaatagttcaattattatt

SEQ ID NO: 25304 - DNA, 50 bp, homo sapien
tccaaagaaactaagttgagaaggtmaattaaatatccatatacctggca

SEQ ID NO: 25305 - DNA, 50 bp, homo sapien
gtgctgacttgctcagagttaagggycccctgaattgtggtgcctctctg

SEQ ID NO: 25306 - DNA, 50 bp, homo sapien
ctcacaaaatattcaaaaactaagcygctagtacatgaatacaaatacct

SEQ ID NO: 25307 - DNA, 50 bp, homo sapien
attattttgactgattataagaacakgagtcctatcggttagggtcatga

SEQ ID NO: 25308 - DNA, 50 bp, homo sapien
attaatgtttaaattcatggactacycttcatagtgaggactggcctcat

SEQ ID NO: 25309 - DNA, 50 bp, homo sapien
tgtaacaaggatagttacaatttackctgcatttagtatctgaagtatgt

SEQ ID NO: 25310 - DNA, 50 bp, homo sapien
tagctatagcccctgagagtttagaygttaattaataaagtccttaccag

SEQ ID NO: 25311 - DNA, 50 bp, homo sapien
gttgcatttgaagtggcaagagttawctggaatatttgtttatgtgaaac

SEQ ID NO: 25312 - DNA, 50 bp, homo sapien
ttttattaaaatatcttgtacaaaartatctttaaaagagcaatacatat

SEQ ID NO: 25313 - DNA, 50 bp, homo sapien
aagtccttcaaattcaaaagcatgayggcaaataaaagtgccctaacttt

SEQ ID NO: 25314 - DNA, 50 bp, homo sapien
agaggagtagggcacatagcatggarcctgacatatagcaatgataacag

SEQ ID NO: 25315 - DNA, 50 bp, homo sapien
taacttgctatccacagagtcaatcrcaactggcttataagccgagattt

SEQ ID NO: 25316 - DNA, 50 bp, homo sapien
gtcctagaaatatagaactagacaasacatgtaagatctctgatgttatg

SEQ ID NO: 25317 - DNA, 50 bp, homo sapien
ctgttttccttttctccatccttcakgttctaagtttcagcccagccagt

SEQ ID NO: 25318 - DNA, 50 bp, homo sapien
ggcaaacagaaaagaataatttacamctagagagctaaaaaagagagggc

SEQ ID NO: 25319 - DNA, 50 bp, homo sapien
catgtatgggaatgtggcctagagaytaggatatcaacaaatataaattt

SEQ ID NO: 25320 - DNA, 50 bp, homo sapien
tcttgccacctcttgcctaagaagamcatagttgcatattttcgtagctt

SEQ ID NO: 25321 - DNA, 50 bp, homo sapien
cttgtcccccaaatagtggtgacctyaaactgtaatatgatgatgaaacc

SEQ ID NO: 25322 - DNA, 50 bp, homo sapien
caccagattcatttctaagtaataayaatgtctcttcaagcttgaggtgg

SEQ ID NO: 25323 - DNA, 50 bp, homo sapien
gagacagcaacaagagggtaaagaastcatttcagaaggaagtcaggcca

SEQ ID NO: 25324 - DNA, 50 bp, homo sapien
tgtaggtgccatggcagcctgcccaygtttgtcactgatcagctgtctcg

SEQ ID NO: 25325 - DNA, 50 bp, homo sapien
ttttaacataattttgttttatcaaygtcttagactacttcatccattgt

SEQ ID NO: 25326 - DNA, 50 bp, homo sapien
ataaacctgagattctgtgatccaakgactgagcaacagcaggttaccaa

SEQ ID NO: 25327 - DNA, 50 bp, homo sapien
cccaggtcatctcccaatctaaggcraaaggtaccatagtcagtaaccta

SEQ ID NO: 25328 - DNA, 50 bp, homo sapien
acacttacacaggctataagggaaartaaaataatggacagatgttggag

SEQ ID NO: 25329 - DNA, 50 bp, homo sapien
ccaaaagctggaaaccattattatcrataggaagaaagtttggttgagtg

SEQ ID NO: 25330 - DNA, 50 bp, homo sapien
cccttttctttgtcaccgtgtgtacrgtaaagaaccaggcaacatggtgc

SEQ ID NO: 25331 - DNA, 50 bp, homo sapien
caactgtgccaatagtaaagggctaycttgaagccaggtatgttcaacat

SEQ ID NO: 25332 - DNA, 50 bp, homo sapien
tttggaagtccagcttctgttactgraggaatgtcttaatatcagacttg

SEQ ID NO: 25333 - DNA, 50 bp, homo sapien
cttatttcttctgcactcatacttcyacccattctacctcccagtagctt

SEQ ID NO: 25334 - DNA, 50 bp, homo sapien
ttattcagggttttctgagataatcygatcgccgaagtatcttttctcca

SEQ ID NO: 25335 - DNA, 50 bp, homo sapien
gtcagcaattttctccttctatgctyaagggcccatttaaaatacacatt

SEQ ID NO: 25336 - DNA, 50 bp, homo sapien
gactataaaaactgtcatcaataacyaattttccaagcaggctaaatttg

SEQ ID NO: 25337 - DNA, 50 bp, homo sapien
cattaatgatccatcgagacaactamatgagattttaagtaaaatagaaa

SEQ ID NO: 25338 - DNA, 50 bp, homo sapien
ttcctcatgctgtggtcttcacaaargtctcggttcctccatttccgatc

SEQ ID NO: 25339 - DNA, 50 bp, homo sapien
tacgtcattagtaatgttgaggaaartgaattggactagtggctgcaaat

SEQ ID NO: 25340 - DNA, 50 bp, homo sapien
agacgccacactttaccaataactasatgaggattttactccatttctag

SEQ ID NO: 25341 - DNA, 50 bp, homo sapien
agaggtgtgaaaaattgtcaaaagtyactgttgggtgctgtgggtagaag

SEQ ID NO: 25342 - DNA, 50 bp, homo sapien
attacctttatacattacaattgccyacatggctgttacagtctcttgaa

SEQ ID NO: 25343 - DNA, 50 bp, homo sapien
ccagtgatttgtaactctatatcacrctggtttctattagaacagttcta

SEQ ID NO: 25344 - DNA, 50 bp, homo sapien
actacgatcatgtcattcaatgaaasttagctcactgatggaaagtacag

SEQ ID NO: 25345 - DNA, 50 bp, homo sapien
ttgctccaaatgtcagggccttcccratccgtcattccacatgaagagcc

SEQ ID NO: 25346 - DNA, 50 bp, homo sapien
aaatattgattaattgtacatatcaygaataagtgaatgaatgtctcatt

SEQ ID NO: 25347 - DNA, 50 bp, homo sapien
aacatctaaaagagtaatgatcaagyagcatggagcttcaacaagcagtc

SEQ ID NO: 25348 - DNA, 50 bp, homo sapien
aagcttcataaatatgcacataaagyattagactcatcaggaatactcaa

SEQ ID NO: 25349 - DNA, 50 bp, homo sapien
aggtttcttcctcagaccatgtaagrctattataactccacctcctcctg

SEQ ID NO: 25350 - DNA, 50 bp, homo sapien
tgttaaacactgagagatccacaacratacataaaacaacattccaaatt

SEQ ID NO: 25351 - DNA, 50 bp, homo sapien
attatgcaaaccaagatggaaaagaygaatcaaagtaggctttatttgta

SEQ ID NO: 25352 - DNA, 50 bp, homo sapien
tattttgatgatattggcacaactcygaatctagttaaaaaacattgaat

SEQ ID NO: 25353 - DNA, 50 bp, homo sapien
ctcttagcacttgtccaaaagtcctyagcttgcattctatgtgttgggtt

SEQ ID NO: 25354 - DNA, 50 bp, homo sapien
ttcattcctttttatcgtcaaacaayattcaactgtatggatatatcacc

SEQ ID NO: 25355 - DNA, 50 bp, homo sapien
gggaagggagggaatggctttgaaartcaagtagcaagtccaacagccca

SEQ ID NO: 25356 - DNA, 50 bp, homo sapien
ctcagaaagtcgtttgcttactctcygacacttgttccaaacccttctgg

SEQ ID NO: 25357 - DNA, 50 bp, homo sapien
ctgaacaagcttaagaagttccctaratcaaaggtgtcaaaaaccagaag

SEQ ID NO: 25358 - DNA, 50 bp, homo sapien
tttatgcaaatacaacactcccattyaaattctaaacacatcatcatgcc

SEQ ID NO: 25359 - DNA, 50 bp, homo sapien
tattgcttccattacctgtatcacamgttagtcaatgtgttcattgcatc

SEQ ID NO: 25360 - DNA, 50 bp, homo sapien
tatgtcagcccaaaactattgacacsaactgcaagtttgagggtatatta

SEQ ID NO: 25361 - DNA, 50 bp, homo sapien
accagcctgacttcttttccccaatyaggactccgcaaatatagttcact

SEQ ID NO: 25362 - DNA, 50 bp, homo sapien
tactgcttgcttatatatctttctcratccttttactttcaaccaatttg

SEQ ID NO: 25363 - DNA, 50 bp, homo sapien
ctgctataagtggtcacctgaatacrattcctttcctgctacaacctttt

SEQ ID NO: 25364 - DNA, 50 bp, homo sapien
ctttacaccgtggaggttgtaaggamaagtgcatgcacaggggagagaat

SEQ ID NO: 25365 - DNA, 50 bp, homo sapien
cacttgagttgtttaattctaactamggtctagactcagcttctctaatc

SEQ ID NO: 25366 - DNA, 50 bp, homo sapien
tcagagaaagatgagccctaaagaaytgagctaatgacttcatctctact

SEQ ID NO: 25367 - DNA, 50 bp, homo sapien
aggaataaaatccaggtctgcttaamtattacccaaattgtaaggctaat

SEQ ID NO: 25368 - DNA, 50 bp, homo sapien
tcaaaaggtctgaggaagacctcagraatgttttagacaggaggagtaaa

SEQ ID NO: 25369 - DNA, 50 bp, homo sapien
actttgatggtttcaaatctagaaastagtcgaacagggattcaaatcaa

SEQ ID NO: 25370 - DNA, 50 bp, homo sapien
cctaaggtgtttggtggccggtaaasatagatgaagaaactaggcctgct

SEQ ID NO: 25371 - DNA, 50 bp, homo sapien
gagacagagggagagtccatttcaawacaaatgacaacaaaaagaaaact

SEQ ID NO: 25372 - DNA, 50 bp, homo sapien
ttaccttgcctgatagacacacttayaaaaactaatgtaggacacacaca

SEQ ID NO: 25373 - DNA, 50 bp, homo sapien
caaagatcccttccagatagtaaacmatagatatcataaacaagtaaatg

SEQ ID NO: 25374 - DNA, 50 bp, homo sapien
tattttacatgccacataaagttccratcctggatcccaacctcggtcag

SEQ ID NO: 25375 - DNA, 50 bp, homo sapien
gcacacacagtatttaaagccgtggyaaatgtagcctattctcaggcaac

SEQ ID NO: 25376 - DNA, 50 bp, homo sapien
ggccaataaatattattgttgttacyaataaaacgccatgccacattcat

SEQ ID NO: 25377 - DNA, 50 bp, homo sapien
atacaaagaatattttctcatcatartaaaagcaaattagggatcaatga

SEQ ID NO: 25378 - DNA, 50 bp, homo sapien
ggcattcacttttgcccttcccttaygaccagcaagatcagcagggaatt

SEQ ID NO: 25379 - DNA, 50 bp, homo sapien
tgtgttgactagtcacattactgatraagtgttcaaagcaactaagaaat

SEQ ID NO: 25380 - DNA, 50 bp, homo sapien
cttgcaccatctcccactcttgcacraaggaaagtactagcatttcccat

SEQ ID NO: 25381 - DNA, 50 bp, homo sapien
taagagcctgtatttatgaaaagaartcccagtgaaaattgtcatttaag

SEQ ID NO: 25382 - DNA, 50 bp, homo sapien
ttagaatgagaaatagaaacttaaargcaaattatatgggaggcaatgca

SEQ ID NO: 25383 - DNA, 50 bp, homo sapien
aatactccctccagactgggtagaaycattgctcttatctgcgaagttgc

SEQ ID NO: 25384 - DNA, 50 bp, homo sapien
aataagggtagaccttgaagtctggraaggaattacatttggggaagagt

SEQ ID NO: 25385 - DNA, 50 bp, homo sapien
tggtggactaagcaatccagctactraatttattggtgagctacagatga

SEQ ID NO: 25386 - DNA, 50 bp, homo sapien
cttaattctataaagcacgtttatcscaagatgctcaggaagcttatatt

SEQ ID NO: 25387 - DNA, 50 bp, homo sapien
  misc_feature (44)..(44): n is a, c, g, or t
aaattatcacagcaagcgaggcgaayggacactcaaggatcatnacgacc

SEQ ID NO: 25388 - DNA, 50 bp, homo sapien
ctctatttgattccgagcatgaacgycattttctattatagcaaggagag

SEQ ID NO: 25389 - DNA, 50 bp, homo sapien
agatggagtgacaggaattctaccartcagataaattccaaaactactta

SEQ ID NO: 25390 - DNA, 50 bp, homo sapien
gtcagggtgagttgagtttgggtagyaagtttgtgtatctcagcactggg

SEQ ID NO: 25391 - DNA, 50 bp, homo sapien
cagtttgccagcataccactacttargctgtccatatactgtctctctga

SEQ ID NO: 25392 - DNA, 50 bp, homo sapien
aaaacttactggccaattctatcgcraggattccgatgaggaccacccgg

SEQ ID NO: 25393 - DNA, 50 bp, homo sapien
actcaacactcttgcaggattatcarctccattttataagtgtggaaact

SEQ ID NO: 25394 - DNA, 50 bp, homo sapien
tgtaatttcctgagtcataataatamggctttaacatattagctcagtga

SEQ ID NO: 25395 - DNA, 50 bp, homo sapien
gcaagaaatacaaaattttctataaygccttagaattgttatttgagccc

SEQ ID NO: 25396 - DNA, 50 bp, homo sapien
cacgaactcatggttgacttctcatwatacttgggtttgtcattgttcct

SEQ ID NO: 25397 - DNA, 50 bp, homo sapien
tttaaaaatttgtattattgattaaygtgataataaaaattgggatttaa

SEQ ID NO: 25398 - DNA, 50 bp, homo sapien
cctattaagaatttggactagaccastatttccctcatatataccttcag

SEQ ID NO: 25399 - DNA, 50 bp, homo sapien
cagagaaatggaacagggtgagaacrgaatggtaagaatcggcagtttgt

SEQ ID NO: 25400 - DNA, 50 bp, homo sapien
ggatgccaataatgccagaattacargacggcaatgaggattagaaacaa

SEQ ID NO: 25401 - DNA, 50 bp, homo sapien
aatgaggatctctattattttgaccrccctcaaacacacctgaaggaaac

SEQ ID NO: 25402 - DNA, 50 bp, homo sapien
aagttgttataaaataagccaataayaggagaggatgtaaacataagaga

SEQ ID NO: 25403 - DNA, 50 bp, homo sapien
ctattgccttatacatttcttcttaycactactgaggcagtgttgtcctc

SEQ ID NO: 25404 - DNA, 50 bp, homo sapien
ccaggaaggtacagattcaatattaygacgctgaagaataagtatctgcc

SEQ ID NO: 25405 - DNA, 50 bp, homo sapien
gtgctgcaatttctctgtgccttaartaactatttgacaatggggaatgt

SEQ ID NO: 25406 - DNA, 50 bp, homo sapien
tttatttctaggaaccttaaaaacargtctataaatgccaccattcgctc

SEQ ID NO: 25407 - DNA, 50 bp, homo sapien
aactctcgtagctgaaatgggtcacyacaattacaccactaaaatcctgt

SEQ ID NO: 25408 - DNA, 50 bp, homo sapien
cccttgggcttataatatgcaagacrgatactatgattttcatgacgtac

SEQ ID NO: 25409 - DNA, 50 bp, homo sapien
ccgtatttatgaatgaagaaacaaaycctagatatgcagagaaaaacaac

SEQ ID NO: 25410 - DNA, 50 bp, homo sapien
ttccatgaggtttcttttctgactgsaattattaacagcattgtgcctcc

SEQ ID NO: 25411 - DNA, 50 bp, homo sapien
ttgggatgagattttcatagcttctraatgtccaacaaattcaaccctat

SEQ ID NO: 25412 - DNA, 50 bp, homo sapien
taaacaaatatttacaagattcatawtaaaattctaagccaataaatgga

SEQ ID NO: 25413 - DNA, 50 bp, homo sapien
gtatagtttaaagttatgaaacccaygtaatatatatgtgaaattttata

SEQ ID NO: 25414 - DNA, 50 bp, homo sapien
catttaagttaagggagaagtatcayctcaaataatcatcggaatgagca

SEQ ID NO: 25415 - DNA, 50 bp, homo sapien
ttataaaagtagaataattggattamagtttagactacattggctaagta

SEQ ID NO: 25416 - DNA, 50 bp, homo sapien
accatttctaaccctacacatatcascaacatagtaaggggaatgataaa

SEQ ID NO: 25417 - DNA, 50 bp, homo sapien
agtgaagcccatgttagacatccaaygtgcagaactgtaagataataagt

SEQ ID NO: 25418 - DNA, 50 bp, homo sapien
cattcttaattaacagtttggaaatsattacacataagctgcatgagcca

SEQ ID NO: 25419 - DNA, 50 bp, homo sapien
tgacacatcctgagaatgatttcacygatttccaacaagatatttctctc

SEQ ID NO: 25420 - DNA, 50 bp, homo sapien
tataacctgccttttctttcaactayaagcatatcagttattaagaaagc

SEQ ID NO: 25421 - DNA, 50 bp, homo sapien
atgaaggatcaaagtctgaatctgayagtgaaatttagaactctctgata

SEQ ID NO: 25422 - DNA, 50 bp, homo sapien
taaaaatcaacatctaaattctacartggtacaatattacctagatatta

SEQ ID NO: 25423 - DNA, 50 bp, homo sapien
tgcttttagcttatttcaagtgtcayggttttctcagtactgaagtgtct

SEQ ID NO: 25424 - DNA, 50 bp, homo sapien
cactgaatttaggtaagcaagatgayctttcattagaattaatgtagaaa

SEQ ID NO: 25425 - DNA, 50 bp, homo sapien
tgatctggataaaaatcttgatgctyagaatagggcagggaaattgaaag

SEQ ID NO: 25426 - DNA, 50 bp, homo sapien
aaactaaaatttctcatggaaacacragcatatactttattacttaatag

SEQ ID NO: 25427 - DNA, 50 bp, homo sapien
aaaacattgtggagtatagggagagrctaaaacatgcatttctgttgctc

SEQ ID NO: 25428 - DNA, 50 bp, homo sapien
taatgtttgtcaagtgaatgtttcargagtaaaatgaatgaatccagttg

SEQ ID NO: 25429 - DNA, 50 bp, homo sapien
atagactctttagaattagtgtagayaaatatcagaaattcagtcttaaa

SEQ ID NO: 25430 - DNA, 50 bp, homo sapien
cacaattacagtgtgagatccatgargaaaagaatcttacctgtcttatc

SEQ ID NO: 25431 - DNA, 50 bp, homo sapien
aatatcttcatgtgacttatctgtaycttttttctagctctcttattttt

SEQ ID NO: 25432 - DNA, 50 bp, homo sapien
gttgttttaagattcagggaaagaayggctccctcaacaggctgtaagtt

SEQ ID NO: 25433 - DNA, 50 bp, homo sapien
agtagacttgtttacatgtaacctawgtaaagaaatacaagtccatattc

SEQ ID NO: 25434 - DNA, 50 bp, homo sapien
cattcatatgttttactttcatacaytgatacttagagaatttaataacc

SEQ ID NO: 25435 - DNA, 50 bp, homo sapien
caaatgaacatatcaatcgcctgttsaaattttacagtacactttggaga

SEQ ID NO: 25436 - DNA, 50 bp, homo sapien
tttaaaactctgctactgaaatatcracatacacatttttctcaagctca

SEQ ID NO: 25437 - DNA, 50 bp, homo sapien
ttcttttgttatctagatctgtatcrgagagtaattaaaaacttagcaat

SEQ ID NO: 25438 - DNA, 50 bp, homo sapien
actggtattgccctttattaaaatcyacttgccttattcttatttaggaa

SEQ ID NO: 25439 - DNA, 50 bp, homo sapien
tcctgaagatgtatctatggtgttcrctggatatggcactttgtctttga

SEQ ID NO: 25440 - DNA, 50 bp, homo sapien
tttgctctactaaaagaaagctcacmgagataatgtaaccaacaaaaaca

SEQ ID NO: 25441 - DNA, 50 bp, homo sapien
actcaaggatatatttaaaatgggamgtatacagtaaaggacagacagct

SEQ ID NO: 25442 - DNA, 50 bp, homo sapien
tagtactgagaaactgctcatacacyaatttcattaccaatttctctctt

SEQ ID NO: 25443 - DNA, 50 bp, homo sapien
gcctaataatatgatcttcctctcaycaagactaatggagccactaccat

SEQ ID NO: 25444 - DNA, 50 bp, homo sapien
tatgctattggagtaattagggataygtgattaatcgcgaatggagggag

SEQ ID NO: 25445 - DNA, 50 bp, homo sapien
gtctttacgttatcatctaatagccmatccggaattacgaaacaataact

SEQ ID NO: 25446 - DNA, 50 bp, homo sapien
atacaattgttacaatttcttcttaygataggcaatacatatttaatact

SEQ ID NO: 25447 - DNA, 50 bp, homo sapien
aaaattgtctaccttttcaaaaatgyatattcataatcgaaaggggatac

SEQ ID NO: 25448 - DNA, 50 bp, homo sapien
atggcactcagacatatttgactgayctttatggattaaaagtcaagata

SEQ ID NO: 25449 - DNA, 50 bp, homo sapien
tcactatgttaaagtaattgggtgaraaagctattcccctgatatgctaa

SEQ ID NO: 25450 - DNA, 50 bp, homo sapien
tggaactccttaggttgtatacctcyatttagactcatattaagcttctg

SEQ ID NO: 25451 - DNA, 50 bp, homo sapien
tggtaggatgaatctcgttcctgtarcaacatacctgataatgtaccctc

SEQ ID NO: 25452 - DNA, 50 bp, homo sapien
taatattggaaaaacaggcgttggayggtaaatagcctattattcctcca

SEQ ID NO: 25453 - DNA, 50 bp, homo sapien
aggaagaaagtaagtctacaactatkaagatttctgagttttaattccgt

SEQ ID NO: 25454 - DNA, 50 bp, homo sapien
ctagttagtgtgattatagctaacamattaattaaagatcattagccaaa

SEQ ID NO: 25455 - DNA, 50 bp, homo sapien
tatggagggatatcagaagaagaatsacaggtagtcaaataggaaagcaa

SEQ ID NO: 25456 - DNA, 50 bp, homo sapien
tcacccaaaaagaattaagaatcatyatcattagctaagaaaaaaagttc

SEQ ID NO: 25457 - DNA, 50 bp, homo sapien
attcatagggctaatgaggatttaayagatgagcacaaaagtactagaag

SEQ ID NO: 25458 - DNA, 50 bp, homo sapien
cccttgttattgctaagggttagaargtaggaaattgagaccaagacttt

SEQ ID NO: 25459 - DNA, 50 bp, homo sapien
ttggctgttgtttgttttagtaggartaatttgcaacatgtttttgtatc

SEQ ID NO: 25460 - DNA, 50 bp, homo sapien
tggaaagcataaatttgattcatacycttacaaaatttaatatagtgaat

SEQ ID NO: 25461 - DNA, 50 bp, homo sapien
atttaggttttagtatcaacttgacrgattctgagctctctcaatccagg

SEQ ID NO: 25462 - DNA, 50 bp, homo sapien
ccttttatttttctactttgaacacrctagtattttatttcttgaaagcc

SEQ ID NO: 25463 - DNA, 50 bp, homo sapien
gtcttgccaatcatgttgtttagtasatggaacgtctcataattataatt

SEQ ID NO: 25464 - DNA, 50 bp, homo sapien
tctttttgaggcaagttcttattcckccagtaaactgacatttatccctt

SEQ ID NO: 25465 - DNA, 50 bp, homo sapien
ttaaggactaagatcagtctccagasaaataatgttaagtgcagcctaaa

SEQ ID NO: 25466 - DNA, 50 bp, homo sapien
tgttattaatgacaccttaggacaaytaggagtggctggagttggaggaa

SEQ ID NO: 25467 - DNA, 50 bp, homo sapien
cctgggtaacatggtaagttggctgratctgtcttcagaggttgcagata

SEQ ID NO: 25468 - DNA, 50 bp, homo sapien
ttatacatgttgtagcgtgtgtcaamtatgtagttcctttttatggttga

SEQ ID NO: 25469 - DNA, 50 bp, homo sapien
tttcaaagtaatcaactatactaaayttaaagtcaatatataagtccgat

SEQ ID NO: 25470 - DNA, 50 bp, homo sapien
catctctctttctctccatcctttckatttaggctatctctatacaagcc

SEQ ID NO: 25471 - DNA, 50 bp, homo sapien
ccttaggatatttaatgtaatataamattcagtggagaagtcagttaatc

SEQ ID NO: 25472 - DNA, 50 bp, homo sapien
ataactaaaggtaaaaagcccagtakgatctgttgtaaaaaataccaaat

SEQ ID NO: 25473 - DNA, 50 bp, homo sapien
gtaacagaactcttgtcaaaatagakcatcataaaacaaacaaaatttta

SEQ ID NO: 25474 - DNA, 50 bp, homo sapien
gagaagtcttgctcagaatttaggargtgactctggaaaatcttgtacag

SEQ ID NO: 25475 - DNA, 50 bp, homo sapien
gagtgaatttagaagagtaactacaygcattaaaatttttattttgctct

SEQ ID NO: 25476 - DNA, 50 bp, homo sapien
gacatctgagtatggcacgaaagaawaggtaacatgtggtctgaagagat

SEQ ID NO: 25477 - DNA, 50 bp, homo sapien
agcccacaaatggcagtattttcacrccagtgctagagtttagaaggggg

SEQ ID NO: 25478 - DNA, 50 bp, homo sapien
tcagggttcatttatgagcatttacrgattatcctctgtgttttcagcat

SEQ ID NO: 25479 - DNA, 50 bp, homo sapien
ccacacactctgcaagggccattcckagttctgctatttcccaggacaga

SEQ ID NO: 25480 - DNA, 50 bp, homo sapien
cttgaagcactataccatgctgtaayggcaactttattttatgcctctca

SEQ ID NO: 25481 - DNA, 50 bp, homo sapien
aagtgtaaacactggtcaatattctyacccatgaatgatggtaggatctt

SEQ ID NO: 25482 - DNA, 50 bp, homo sapien
aaactaaatgcaagtaatattcctcmaagttttactaacctatgcacaca

SEQ ID NO: 25483 - DNA, 50 bp, homo sapien
ccaatatagttataaagacagaaccraactgcagtggcatttaaagaaag

SEQ ID NO: 25484 - DNA, 50 bp, homo sapien
agccataccactggttttagactcarggacattttctgtgcttactgaat

SEQ ID NO: 25485 - DNA, 50 bp, homo sapien
gaattttctcagtaaaagtgagcaayctatgacatgtctggttgctttgt

SEQ ID NO: 25486 - DNA, 50 bp, homo sapien
aataatataacacaggccttagatgsatcctattccagatgtcatatgaa

SEQ ID NO: 25487 - DNA, 50 bp, homo sapien
ataacaaaatttcatggaaaattcgyattttgatctgaaggacagtgttt

SEQ ID NO: 25488 - DNA, 50 bp, homo sapien
taatagaatttttgaactgaacttcygaagtgatagagaataactacata

SEQ ID NO: 25489 - DNA, 50 bp, homo sapien
tctgcaatatttaagaagaaatcccraatgtagacaatacatcattatta

SEQ ID NO: 25490 - DNA, 50 bp, homo sapien
atcaattttctcacatatagttctaygagatagtcacccttgttaatgtc

SEQ ID NO: 25491 - DNA, 50 bp, homo sapien
aaatattgcagaatagttgtaaataygtaacgcttttcaaaggtgtcttt

SEQ ID NO: 25492 - DNA, 50 bp, homo sapien
gctctaactaaactaaaagtgacaamtgaacaatgcagtggaatgaatga

SEQ ID NO: 25493 - DNA, 50 bp, homo sapien
tgagaaaaataagattaaacaaatgratctgtggtacaaatgtattaatc

SEQ ID NO: 25494 - DNA, 50 bp, homo sapien
ttatattttaaatgtaaatgcaaaasttaattattttttagaggacctga

SEQ ID NO: 25495 - DNA, 50 bp, homo sapien
gaagcttcaataaattctgactatcraagttctctttcttggcattgttt

SEQ ID NO: 25496 - DNA, 50 bp, homo sapien
tccatgaggaaatctaaattagcaastacttccaatcatgaattgccaaa

SEQ ID NO: 25497 - DNA, 50 bp, homo sapien
ttgacatcagtaattactatagttaygagacatttttcacaaagtattat

SEQ ID NO: 25498 - DNA, 50 bp, homo sapien
ttggatctgtgtacaatttctagcaytacccagaataaataccaggagac

SEQ ID NO: 25499 - DNA, 50 bp, homo sapien
cacagtgccagagttaccttcactayagggcaaggagtaagctttgcctg

SEQ ID NO: 25500 - DNA, 50 bp, homo sapien
tctggcacaagtactaagaacttackctcttcagtatggagaaaaatgct

SEQ ID NO: 25501 - DNA, 50 bp, homo sapien
atgtatttcctttctctgatttggayagtagcttctttggcttcaccctc

SEQ ID NO: 25502 - DNA, 50 bp, homo sapien
gcctccacctttctaacagaagatayattcggtgtatgtaaatgtgttat

SEQ ID NO: 25503 - DNA, 50 bp, homo sapien
tggaaaaagccaagtaaaaatgtagkaataggattaacatatcttaacaa

SEQ ID NO: 25504 - DNA, 50 bp, homo sapien
gtatggatatagaatgaaaaaaaccrcataaatccagtacatctacttaa

SEQ ID NO: 25505 - DNA, 50 bp, homo sapien
ttaaaatgtgtaatatttgtgtaaaytggcttctcttacattgtcctact

SEQ ID NO: 25506 - DNA, 50 bp, homo sapien
tgagaatctctgagcatacaataaaytcaaagggtgaagtgagtaacagt

SEQ ID NO: 25507 - DNA, 50 bp, homo sapien
tcctttttggtgggattcttatctaygctagttcggaatattgcaataat

SEQ ID NO: 25508 - DNA, 50 bp, homo sapien
cacatcccacattatttagcaagggwcattaacggagaggcagaagaaaa

SEQ ID NO: 25509 - DNA, 50 bp, homo sapien
tagactctgtgccaagtgtcatgatkatataaactaataagatattgtcc

SEQ ID NO: 25510 - DNA, 50 bp, homo sapien
ttcccagcaaacatgtcttagtttcyatccatttttccttagcagctaga

SEQ ID NO: 25511 - DNA, 50 bp, homo sapien
cctaaaaatttcacgtacacacatamcatcatatccagtgatttacttgc

SEQ ID NO: 25512 - DNA, 50 bp, homo sapien
gccgggttttggaaatcacattgcckgactgtctgtttctatcatgacac

SEQ ID NO: 25513 - DNA, 50 bp, homo sapien
gaaaagaagtgaaaaacccaacaaaktagttagatgtgggggctttttag

SEQ ID NO: 25514 - DNA, 50 bp, homo sapien
accaaaatataattactgtttagcayggtggtatattttcttcaagtctt

SEQ ID NO: 25515 - DNA, 50 bp, homo sapien
tgctcatggacggtccagcaacttaycagaatgactgtggggcttacaaa

SEQ ID NO: 25516 - DNA, 50 bp, homo sapien
atgagattcctcaaagccaacagtayatgcaacatttagggggttttcaa

SEQ ID NO: 25517 - DNA, 50 bp, homo sapien
cattagatttgtttcacttatgcagyctataatgtcattaatattcacat

SEQ ID NO: 25518 - DNA, 50 bp, homo sapien
aaaaaaacatagtatactatcaagaygaaacaagaaccaaattaaaagat

SEQ ID NO: 25519 - DNA, 50 bp, homo sapien
gtgaagtagcagtgctatcaaaatasagtgcaactgcttcacgtcaaatg

SEQ ID NO: 25520 - DNA, 50 bp, homo sapien
ccccaatgacccaattaagcatagaygttgtgtttttcagaaatgtaatt

SEQ ID NO: 25521 - DNA, 50 bp, homo sapien
caagcttttttagactataaattaaygttcgttgacgacagtactccaca

SEQ ID NO: 25522 - DNA, 50 bp, homo sapien
tgtaacactttttaaaaataagtcargagtcaatgattctaatgacaggc

SEQ ID NO: 25523 - DNA, 50 bp, homo sapien
agataaagtcatcagattgtactacraagcaaagacactcaattaaaata

SEQ ID NO: 25524 - DNA, 50 bp, homo sapien
catttaaaatcaacccaatagaaacraatcttttgcactttttaaacatc

SEQ ID NO: 25525 - DNA, 50 bp, homo sapien
ctcggggccataataagagccatgcragtaaaacagcctgaataaagtat

SEQ ID NO: 25526 - DNA, 50 bp, homo sapien
ctcatggattcagggtgcaactagawggccctttacaaacacagaactct

SEQ ID NO: 25527 - DNA, 50 bp, homo sapien
tagagaagcaggtgcacatttacagmagttgtggtttacagtattttctt

SEQ ID NO: 25528 - DNA, 50 bp, homo sapien
cttctaaatagtagaaactattagaygcccttgttgacttgcaaatgtgg

SEQ ID NO: 25529 - DNA, 50 bp, homo sapien
aaatattacacagccctattatagargtcacacgatgatgggaattattg

SEQ ID NO: 25530 - DNA, 50 bp, homo sapien
tgcttttaatatgttgtattaaatcmcaaagaaatccattaacaaagctg

SEQ ID NO: 25531 - DNA, 50 bp, homo sapien
cttgtaaattatctgaatgttctaaytatgtcaaagtggtatagtctcaa

SEQ ID NO: 25532 - DNA, 50 bp, homo sapien
ttgaaaggttaaatagtcctctaaartgtgccatgagggttaacatttgt

SEQ ID NO: 25533 - DNA, 50 bp, homo sapien
gaataaattagaggccagagtcaacscacggcattaagcatcataactca

SEQ ID NO: 25534 - DNA, 50 bp, homo sapien
ctgttaaagtgtccagtatgtagccragaaccatatggagaacatcaaat

SEQ ID NO: 25535 - DNA, 50 bp, homo sapien
tacaggtgtgagtcattgctgatagsctaaaattagttttcaattttcat

SEQ ID NO: 25536 - DNA, 50 bp, homo sapien
acacttatttatgtattgtctgaatkatgtgagtgatgggttctgctgac

SEQ ID NO: 25537 - DNA, 50 bp, homo sapien
ccaaatgcatatattctttcactcckgagaagaagctgaagtatcagtgg

SEQ ID NO: 25538 - DNA, 50 bp, homo sapien
atattacaaattatatgacacgaaamccaacattatatctaattttgaga

SEQ ID NO: 25539 - DNA, 50 bp, homo sapien
tcattcagtcttgtaatgacggtctyaatcactaacagtagtaactgctg

SEQ ID NO: 25540 - DNA, 50 bp, homo sapien
catacacagtttgttggtttgacaaygttctgcattaatgagaaagtttg

SEQ ID NO: 25541 - DNA, 50 bp, homo sapien
cacagctctctagcatgagagacaasggaactcaggcatttatacaccca

SEQ ID NO: 25542 - DNA, 50 bp, homo sapien
aaacctcagttaaacacttcagttaygttaagattatcatatttagcaaa

SEQ ID NO: 25543 - DNA, 50 bp, homo sapien
caggattttcctttctctgttcacastattatgttctatctgctaacaca

SEQ ID NO: 25544 - DNA, 50 bp, homo sapien
cagcctgggtgacagagcaaagaggmatgtcaatatgaaagatatagtgt

SEQ ID NO: 25545 - DNA, 50 bp, homo sapien
aggaaattaaataacttggccaaaaytgcacactaaaaaaaatgccatgc

SEQ ID NO: 25546 - DNA, 50 bp, homo sapien
gaggggtaacataagggtttcaatayagggatgtctaaaattacatttga

SEQ ID NO: 25547 - DNA, 50 bp, homo sapien
attggtcaatatgttttacggaggakatagagagctgattaagtgggagt

SEQ ID NO: 25548 - DNA, 50 bp, homo sapien
ttacttacacaaagtgtagagtgtayagttatagacaaagtgtagaatgt

SEQ ID NO: 25549 - DNA, 50 bp, homo sapien
ttatatttcagttgttagcattccamgattagctggtttaactatgttta

SEQ ID NO: 25550 - DNA, 50 bp, homo sapien
cttgtgaataatatttatagttccayggtcaaatccaatttaaactttga

SEQ ID NO: 25551 - DNA, 50 bp, homo sapien
catttcttttcctatcagggacaatsaagtgatgactggaaaataccttg

SEQ ID NO: 25552 - DNA, 50 bp, homo sapien
ccttaatattccaaatcagaatcackatgtgcatatcaataaagaatgtg

SEQ ID NO: 25553 - DNA, 50 bp, homo sapien
attgtatccttaatctaattgttggragaaaattattggtatctcaaaag

SEQ ID NO: 25554 - DNA, 50 bp, homo sapien
actatgatgttttggcatgttcttarcacaaaatctgttgaatactatca

SEQ ID NO: 25555 - DNA, 50 bp, homo sapien
tttgtataggtagagctgtttgatawgtaataaaggagtagattgaagat

SEQ ID NO: 25556 - DNA, 50 bp, homo sapien
gtatgatatgcctaattaacagaaarcattacatatactcattcatttat

SEQ ID NO: 25557 - DNA, 50 bp, homo sapien
gtcatgttcttaatcagctcaacagraaatattaggaaaatagaaaagta

SEQ ID NO: 25558 - DNA, 50 bp, homo sapien
aaaatgagaagtgtttctgtctcaamtgggatcagagaaagcttcctgaa

SEQ ID NO: 25559 - DNA, 50 bp, homo sapien
tcttaaaagtttttttggtgtatccyaattcttacattcaaatcttcatt

SEQ ID NO: 25560 - DNA, 50 bp, homo sapien
gcaagcaagcaacaagagtcatgaaygcctgtcatatcctatgaatggca

SEQ ID NO: 25561 - DNA, 50 bp, homo sapien
gcagtaacagtatcaaagataaaccrctatattaggaatactaaatgata

SEQ ID NO: 25562 - DNA, 50 bp, homo sapien
gtgagcttacaaaatttgaaaaataygcagttaccatgggaatgttgttg

SEQ ID NO: 25563 - DNA, 50 bp, homo sapien
ccataaattatggtttgctctttgaygcaatggttcacaaagtatgatcc

SEQ ID NO: 25564 - DNA, 50 bp, homo sapien
aagtttctgaactgctgcttaagtgyatcctagtaatatgaaagagtcaa

SEQ ID NO: 25565 - DNA, 50 bp, homo sapien
tcatgtcatattatgtaataataagsctgtaaaacaaaatgattctaagg

SEQ ID NO: 25566 - DNA, 50 bp, homo sapien
taaaaatgctctagatgtaccagcaygtaaatttatacaaaaatatttgc

SEQ ID NO: 25567 - DNA, 50 bp, homo sapien
cctcaaggagaacgcagtattggcasatactttcatgttaatgtaatctg

SEQ ID NO: 25568 - DNA, 50 bp, homo sapien
ttaggctgagtggatgtaagcaagayataagagtagtggaaagaaaagaa

SEQ ID NO: 25569 - DNA, 50 bp, homo sapien
taagcaagttaaagacttccctcaamtggagaaaaaactagccccaaatc

SEQ ID NO: 25570 - DNA, 50 bp, homo sapien
aatcacagaaatcagtgtgaatctgwcaactagaccttctattacttata

SEQ ID NO: 25571 - DNA, 50 bp, homo sapien
gacattgctgatatttttcacttcaytaattagaatagacaccggcaacc

SEQ ID NO: 25572 - DNA, 50 bp, homo sapien
actgataaagttgtgcaaataaaacrgtccactgaagtatgatttctctt

SEQ ID NO: 25573 - DNA, 50 bp, homo sapien
agcaaatacttattcattggcagtarcaacaagaggattatcggtaactt

SEQ ID NO: 25574 - DNA, 50 bp, homo sapien
tccagtctctgaattccttttctcaytcaggttgaggacagtcctactgt

SEQ ID NO: 25575 - DNA, 50 bp, homo sapien
agtctatttttaaatgattgcctccragacaaacaaaggtagaaaatggg

SEQ ID NO: 25576 - DNA, 50 bp, homo sapien
atgcaaatcaaatttagctatctatsaagttaataagaaaataagcatga

SEQ ID NO: 25577 - DNA, 50 bp, homo sapien
gaaaccaaaatcaagggattaagcaygagaggaaagcaaatctgatataa

SEQ ID NO: 25578 - DNA, 50 bp, homo sapien
agtcttttataacattcttcatttcyaaggcaaataatgtgacactgaca

SEQ ID NO: 25579 - DNA, 50 bp, homo sapien
tagatacaacacgataaatagaataygaaaccaaaatcaagggattaagc

SEQ ID NO: 25580 - DNA, 50 bp, homo sapien
aatagtctttgctctgaatcttatayggtactcatcattttattagcaag

SEQ ID NO: 25581 - DNA, 50 bp, homo sapien
ttagagatggaacaaagatcagcatragaaagaactgattctcttctact

SEQ ID NO: 25582 - DNA, 50 bp, homo sapien
aaaatgaacttaggctagcggagtaratgccaaatttcagtcccttgagc

SEQ ID NO: 25583 - DNA, 50 bp, homo sapien
catggactcttattatctaaaacacwctaatgacttcctcttgctcttga

SEQ ID NO: 25584 - DNA, 50 bp, homo sapien
aaacatcattgcatacaatctgtacraagtatttacaagccccagtagca

SEQ ID NO: 25585 - DNA, 50 bp, homo sapien
agctaatatattttggaaaagttacsgaagtatacggtagaagaaaaata

SEQ ID NO: 25586 - DNA, 50 bp, homo sapien
attgatttttaacaaaatgttatacmatgtaaagccttaaaattaaaggt

SEQ ID NO: 25587 - DNA, 50 bp, homo sapien
ttgaaaattagttttcattcacttakgtagattgacacattcttcttcac

SEQ ID NO: 25588 - DNA, 50 bp, homo sapien
aaaattatttcattagaagtcatcayaaactaatcttaagcatgtgactc

SEQ ID NO: 25589 - DNA, 50 bp, homo sapien
tagttcattgccctctattctctaaycttatagtttgggaccatgctctt

SEQ ID NO: 25590 - DNA, 50 bp, homo sapien
ctcagcagctccactaacaataatamaaatgcctctgcctaaaggtgaca

SEQ ID NO: 25591 - DNA, 50 bp, homo sapien
gtgcttcctctttcaaaaacacctcrattgcagtggatctcttataaaat

SEQ ID NO: 25592 - DNA, 50 bp, homo sapien
ccaagattgtatagatatgttttacygacatttttggaacaggttatctt

SEQ ID NO: 25593 - DNA, 50 bp, homo sapien
gttttaaaatttctaggtgaaaagasgcaagatatatatcaactcattct

SEQ ID NO: 25594 - DNA, 50 bp, homo sapien
cttacttcaacaaggtgtgattcaayaataacatcaacaaatcacaccag

SEQ ID NO: 25595 - DNA, 50 bp, homo sapien
taatataaacttaatacctaggtagwcattgttacattttatgtgtccaa

SEQ ID NO: 25596 - DNA, 50 bp, homo sapien
tttagatccagatattacgctaaaaygtctcatcacttactaccttccag

SEQ ID NO: 25597 - DNA, 50 bp, homo sapien
ggtgttggcagaaacccttgcaagarccatcaatcccaatagtctgctgc

SEQ ID NO: 25598 - DNA, 50 bp, homo sapien
agggtaattagcagttaatttagaaygaatgtggcagggttttgggaaat

SEQ ID NO: 25599 - DNA, 50 bp, homo sapien
tacaggaatgattactgcaaaggaayggtaatcaagaaataaatatttag

SEQ ID NO: 25600 - DNA, 50 bp, homo sapien
ggtctaaagttaaagaagaaaaggaytaagatggaggctggaagcacttg

SEQ ID NO: 25601 - DNA, 50 bp, homo sapien
tccaaatgagaaggatgcaataaatwaaaaggagaatcagagaaagggat

SEQ ID NO: 25602 - DNA, 50 bp, homo sapien
tagatatttgcctgtttggccactaytaccaatgaagtattttcataact

SEQ ID NO: 25603 - DNA, 50 bp, homo sapien
aataggatcttaatctaatgattgaytattatgattcctaggagctagaa

SEQ ID NO: 25604 - DNA, 50 bp, homo sapien
ccaagaaaaccactgctttattccawtgaaaataagaccttgatgggtca

SEQ ID NO: 25605 - DNA, 50 bp, homo sapien
ttcagaagacagggagaccagggtarataccatatattgaagctgctgtc

SEQ ID NO: 25606 - DNA, 50 bp, homo sapien
taaccactatttgtaaacacactaayatatgcagtttctcacttcattga

SEQ ID NO: 25607 - DNA, 50 bp, homo sapien
ctctaagagcctacagtgatgatcakagccataaccactatttgtaaaca

SEQ ID NO: 25608 - DNA, 50 bp, homo sapien
catgtgctcagactccgggtgcaaaytccataggacccaaacagtcacgc

SEQ ID NO: 25609 - DNA, 50 bp, homo sapien
attgttcaatgtattgagacattccygactaaaagttgtagtaccatgat

SEQ ID NO: 25610 - DNA, 50 bp, homo sapien
ttgttttttaaaaatgtcttgaccgrataattttacttctagtacagtgt

SEQ ID NO: 25611 - DNA, 50 bp, homo sapien
gaccatttatgattgtatatacttaygggatacaaagtgatggtatgatt

SEQ ID NO: 25612 - DNA, 50 bp, homo sapien
cctcaataaaatctgaatttttgccraaagctggaatgaactgtatgaaa

SEQ ID NO: 25613 - DNA, 50 bp, homo sapien
ggtcacttctaacagtcaagtctcaygtttaggtgctacataaaagcaca

SEQ ID NO: 25614 - DNA, 50 bp, homo sapien
tgggaaagagcccctaagaaactcasgtataatggctatggatatcccaa

SEQ ID NO: 25615 - DNA, 50 bp, homo sapien
cagagccttaaataaagccaacacartccattcttaatgctcagttctca

SEQ ID NO: 25616 - DNA, 50 bp, homo sapien
ttgaaattctgcatatggtctaacawctcctttgtaatacagtatggagg

SEQ ID NO: 25617 - DNA, 50 bp, homo sapien
agcaccttaaaaatgttttcttagtraatgaaatgttcaaccctctctaa

SEQ ID NO: 25618 - DNA, 50 bp, homo sapien
tcaagagatgatatggcttgagattraaaggccaaatcaagcatgtgctt

SEQ ID NO: 25619 - DNA, 50 bp, homo sapien
aaccccctactttgtgtatatgaacmatgacaaggttacaggtgaatgtc

SEQ ID NO: 25620 - DNA, 50 bp, homo sapien
atctttacaaatttgaatatgaagamcctgattgtttagcttttttcatc

SEQ ID NO: 25621 - DNA, 50 bp, homo sapien
aaatatgaggagaaatcattaacatyagaagcacatttaaggcttgatgt

SEQ ID NO: 25622 - DNA, 50 bp, homo sapien
tccattcagctgtgagctctaatccrgagtgggacattgagcaaagtgaa

SEQ ID NO: 25623 - DNA, 50 bp, homo sapien
gagggaaggattattaactcctttgwaattcttaaagaactgatataagg

SEQ ID NO: 25624 - DNA, 50 bp, homo sapien
ttatccttctcaaaggtatctcctayagtatatcctatcccttgaaatga

SEQ ID NO: 25625 - DNA, 50 bp, homo sapien
gtacaaactattacttagtattgacraaatgtcttgggctttgcttgact

SEQ ID NO: 25626 - DNA, 50 bp, homo sapien
aggtcacatcagtagtctacaatcaytattcctggagagtacagtccctc

SEQ ID NO: 25627 - DNA, 50 bp, homo sapien
attgtagactactgatgtgaccttawacatttctcctggtttggtttcgt

SEQ ID NO: 25628 - DNA, 50 bp, homo sapien
tggaacatgatgcccagtgttgtaaytgaacctcaccttaagggttatat

SEQ ID NO: 25629 - DNA, 50 bp, homo sapien
cttgagtccttcctccctcggcttaygttctcttccagaaggctcctcaa

SEQ ID NO: 25630 - DNA, 50 bp, homo sapien
caccagctcacgccccaatcactgamtcaacattccaagctccaaaaagt

SEQ ID NO: 25631 - DNA, 50 bp, homo sapien
atattgaaaggatcattaataatcayatagttcactgtttttcaaactat

SEQ ID NO: 25632 - DNA, 50 bp, homo sapien
tcaggaacaaattgtggaagtccaakagataggatggtaacttgcactgc

SEQ ID NO: 25633 - DNA, 50 bp, homo sapien
tgatatcatttgattttaaagaaacygttatatggaatatcatcaaacta

SEQ ID NO: 25634 - DNA, 50 bp, homo sapien
aacatacgctacatttgcaaactcawattttgtagtagtgagagagaacg

SEQ ID NO: 25635 - DNA, 50 bp, homo sapien
gctgtcactgctcaaagagttgaacragtcaattcctcccagatagatgt

SEQ ID NO: 25636 - DNA, 50 bp, homo sapien
aagagattcctttttatttctaatcwaatgggttttcttttacaggaaga

SEQ ID NO: 25637 - DNA, 50 bp, homo sapien
tttctggagaagttattcaaattaargagcttgcagcagaatagaaagca

SEQ ID NO: 25638 - DNA, 50 bp, homo sapien
ttgtgaaaatgcaacaactaatgagrcaattaacttccaaaacttaaatg

SEQ ID NO: 25639 - DNA, 50 bp, homo sapien
ttaataaataccgtatgtgcttacastaggaatcttgcttgtcccgtttg

SEQ ID NO: 25640 - DNA, 50 bp, homo sapien
tcagggtagtgattgtcttttattcrcgtctctcccttgtttctgctgct

SEQ ID NO: 25641 - DNA, 50 bp, homo sapien
ataaatagatatatacgtacatcgayacatggatattcagatattgaaga

SEQ ID NO: 25642 - DNA, 50 bp, homo sapien
gaacaaacaaaatcctgtattcccaygatatccctctacaaggatctaac

SEQ ID NO: 25643 - DNA, 50 bp, homo sapien
ctatttatctatctttcttttctccratcttcaatatctgaatatccatg

SEQ ID NO: 25644 - DNA, 50 bp, homo sapien
ggcttatgaagaatagactctgggarcacattggaaatcaacactcttgc

SEQ ID NO: 25645 - DNA, 50 bp, homo sapien
tgtttgaaatactattgataataaakcctcatttgtatcagtgagggctc

SEQ ID NO: 25646 - DNA, 50 bp, homo sapien
cctgatctttttcttagaaagctaaytgtaagtaggatatggtgccaaga

SEQ ID NO: 25647 - DNA, 50 bp, homo sapien
tggcataacctactgaaagatgacaratagtgagtttaataataataata

SEQ ID NO: 25648 - DNA, 50 bp, homo sapien
aaaccccaagttcagaggttaaaaartgggctcaaagtcatatagatagt

SEQ ID NO: 25649 - DNA, 50 bp, homo sapien
caagcacaatattatgaaacaagacrctgtatctctgcagagtttggaca

SEQ ID NO: 25650 - DNA, 50 bp, homo sapien
gtcaataaaaatctacagtagtaaamtaacattgagtctgggaggctggt

SEQ ID NO: 25651 - DNA, 50 bp, homo sapien
gtaaacgatgtatttttagcacatayctgtctggaagtattttaaaattg

SEQ ID NO: 25652 - DNA, 50 bp, homo sapien
ttcaattattctgtattttgtcaaarcctaattccctgaaagctaatagg

SEQ ID NO: 25653 - DNA, 50 bp, homo sapien
tgagagccaccatgtccagccaaaarttatgattctttagattctacgca

SEQ ID NO: 25654 - DNA, 50 bp, homo sapien
gctcaaaacaacttacctataagacyctgttcagcttttatcaaccacac

SEQ ID NO: 25655 - DNA, 50 bp, homo sapien
ttgccaagaaaagcaaaaggtgaagragttatttattatccagagacctc

SEQ ID NO: 25656 - DNA, 50 bp, homo sapien
aagaaaacttttaacacaagcaatayaaaagaatgatcaactttaaaaca

SEQ ID NO: 25657 - DNA, 50 bp, homo sapien
aagcttatgtataatttgtaagtaartcaagaagagaatgattttctgcc

SEQ ID NO: 25658 - DNA, 50 bp, homo sapien
tctttctttcgttcctacaaatgackatcaccattttggtcacatactct

SEQ ID NO: 25659 - DNA, 50 bp, homo sapien
gcctcttattaaaaatggtgacactsagattcaaagatgcaagtgattga

SEQ ID NO: 25660 - DNA, 50 bp, homo sapien
gctatgtgctttttaactgctggtckaagttcctttcctcctcatctgtg

SEQ ID NO: 25661 - DNA, 50 bp, homo sapien
ccacatagtatgagtaaaacaaaaarttaacaccactccccacgccaagt

SEQ ID NO: 25662 - DNA, 50 bp, homo sapien
gacagtgaaagataacagttaagaayttccaaaggattcaaggatgtaga

SEQ ID NO: 25663 - DNA, 50 bp, homo sapien
aataatttggtaaatttttataacargttgttccctggtatctttggagc

SEQ ID NO: 25664 - DNA, 50 bp, homo sapien
taatccagctaagagttctggtcccragatttaaagttaaatgcttatcc

SEQ ID NO: 25665 - DNA, 50 bp, homo sapien
acagaaaattcagttcatctataccyattaaaatagccctgtgttgtgat

SEQ ID NO: 25666 - DNA, 50 bp, homo sapien
aactctagagctagacagtccaagastaattaacagttctgtggtccaca

SEQ ID NO: 25667 - DNA, 50 bp, homo sapien
tatcactttaatgctaaggtcaaaasgattattttgtatgcctaatttag

SEQ ID NO: 25668 - DNA, 50 bp, homo sapien
aggtatcattctttgtccaaaggaaytgcttcatgctctcaggcagtcca

SEQ ID NO: 25669 - DNA, 50 bp, homo sapien
agttcttatgaaaattgtgtaagaaragatgaaacgccattcattcattc

SEQ ID NO: 25670 - DNA, 50 bp, homo sapien
gctgaactgcatgtgttcaacctatmactaaactgtaactcagtatatgc

SEQ ID NO: 25671 - DNA, 50 bp, homo sapien
tatccaaaagttgtagtacataaagyccctttcactaatagatcaaatta

SEQ ID NO: 25672 - DNA, 50 bp, homo sapien
caaaattgtttttgatacccttccaraataatcttatgttatcttgagat

SEQ ID NO: 25673 - DNA, 50 bp, homo sapien
gtcaaaatcacagcttgcttcctgaygtaggttttgtctatcatggcagt

SEQ ID NO: 25674 - DNA, 50 bp, homo sapien
gtacagatgaagggagagaaatggamgcaagaaggccaactttgagatta

SEQ ID NO: 25675 - DNA, 50 bp, homo sapien
tacaaaataatgtttacctaattacygaacatggtattttacctttgggt

SEQ ID NO: 25676 - DNA, 50 bp, homo sapien
tttaaaatatttctaaaatacattcyctgtttcatttaaatatgattatc

SEQ ID NO: 25677 - DNA, 50 bp, homo sapien
ctgatgaaatccaatcaatagagacrattaaatgacacatacagagtcat

SEQ ID NO: 25678 - DNA, 50 bp, homo sapien
attttaggcacttcattaatttctcraagctctctaaagggtaaaaatat

SEQ ID NO: 25679 - DNA, 50 bp, homo sapien
aatatgtcaatacaggacatttttarcactgccaataaggacataaaatt

SEQ ID NO: 25680 - DNA, 50 bp, homo sapien
gggcagtaagacagaagatctctcamcttccatagagaaaaggagatgtt

SEQ ID NO: 25681 - DNA, 50 bp, homo sapien
taactggagctcagagttaatcctaygtccaaggaacaaatgtaagctaa

SEQ ID NO: 25682 - DNA, 50 bp, homo sapien
ctgttagttatatgagttgagataayagccatcagagcttaccatttcct

SEQ ID NO: 25683 - DNA, 50 bp, homo sapien
actgatgtgggcagtagttccagtaygttgtgacattttttcattgtggc

SEQ ID NO: 25684 - DNA, 50 bp, homo sapien
ggatcgtagcttgtgaaggtaggagwagtaggaggaacctttccagggca

SEQ ID NO: 25685 - DNA, 50 bp, homo sapien
tcaagcttgggatgtaacatattccyagtaagaggcattggtatgcatat

SEQ ID NO: 25686 - DNA, 50 bp, homo sapien
ttgccaggctgtctgttttgagggcrcgttgaaaacagtgttaggtgaac

SEQ ID NO: 25687 - DNA, 50 bp, homo sapien
aaaattaaacccagaatctagcatartacttggttcatagttgatatcca

SEQ ID NO: 25688 - DNA, 50 bp, homo sapien
aatctgtccagttcaccctcaccacyatttaaatcctatcactctgacat

SEQ ID NO: 25689 - DNA, 50 bp, homo sapien
ataatccaattcttctctattattayagttcctaagagtaagtgaatggg

SEQ ID NO: 25690 - DNA, 50 bp, homo sapien
ttgcttattctctttccttgtatatsacctacagaatgccatgtatataa

SEQ ID NO: 25691 - DNA, 50 bp, homo sapien
ccatgtatataaacaggtgtacttakgttaggttgtgcctattcgtacat

SEQ ID NO: 25692 - DNA, 50 bp, homo sapien
gtgagagcaagccagttagtttacayaacaaagagtgagttcaggtttgg

SEQ ID NO: 25693 - DNA, 50 bp, homo sapien
attgtgtattaacaaataacagagaractcggaaataatagtaatttaaa

SEQ ID NO: 25694 - DNA, 50 bp, homo sapien
ttttagctcatgattttatcatcagrataactgataactgtgtttgtaga

SEQ ID NO: 25695 - DNA, 50 bp, homo sapien
agtatcctcaacaacaaaccactccrattgcttgcagactgcactggctt

SEQ ID NO: 25696 - DNA, 50 bp, homo sapien
atattccctggaaactgaaaaattawgtatgttaaatagtgttttaattg

SEQ ID NO: 25697 - DNA, 50 bp, homo sapien
gtaatagtggcaatttatggagcaartgacacgctgtaactttgttatat

SEQ ID NO: 25698 - DNA, 50 bp, homo sapien
ctaagaaactgacaacctcaaagaartaatagctgaaaatttcccaaatt

SEQ ID NO: 25699 - DNA, 50 bp, homo sapien
ctcacattcatatgtctgagtgccaytatgtaggtcctgggaatggggag

SEQ ID NO: 25700 - DNA, 50 bp, homo sapien
gcttttactctccaccgtatttaacwcctcaaaatataataggaaagccc

SEQ ID NO: 25701 - DNA, 50 bp, homo sapien
gtatccacatattccatcatgttaamcttggtggtaaatgctcatctctt

SEQ ID NO: 25702 - DNA, 50 bp, homo sapien
ttggaattttgtattttattaatcarcagataccctatgggaatttgaaa

SEQ ID NO: 25703 - DNA, 50 bp, homo sapien
tgtatagacttagtgccaacatgtaygaataggcacaacctaacctaagt

SEQ ID NO: 25704 - DNA, 50 bp, homo sapien
ttgaaagaaaggatcaaaatgagaayatagaatagtagatatgtgcaaaa

SEQ ID NO: 25705 - DNA, 50 bp, homo sapien
ttcaatatgtaggtaaaatgtattamaactatgcatattataattgttca

SEQ ID NO: 25706 - DNA, 50 bp, homo sapien
cccagatgctagtaagaaaactgccygagatgcaaagaaggtgccgcttc

SEQ ID NO: 25707 - DNA, 50 bp, homo sapien
ggttaggataagatttattaattacwgaacttactaaatatatagaaaac

SEQ ID NO: 25708 - DNA, 50 bp, homo sapien
gaattgcctctaagcacacatggaamcacttttgtttgtagctccactga

SEQ ID NO: 25709 - DNA, 50 bp, homo sapien
gcacaccattgacaatgttgactacmgggctgatcagaatagatgatgat

SEQ ID NO: 25710 - DNA, 50 bp, homo sapien
agtttcatttaatgctgccttacacyatgaaaatgcaaagaactctggga

SEQ ID NO: 25711 - DNA, 50 bp, homo sapien
tacttcagttgaataaaagaacacayccgatcttgaagaatatctaatag

SEQ ID NO: 25712 - DNA, 50 bp, homo sapien
cacatttaaatgccttggagttccawaagacaaatatatcctcgtgtaat

SEQ ID NO: 25713 - DNA, 50 bp, homo sapien
agggatttgcctctaaaactgaggaygctcctttatattttccaggaggt

SEQ ID NO: 25714 - DNA, 50 bp, homo sapien
agtaatcaatcaaaacatatttaagragcattataatcgacctcgaaggg

SEQ ID NO: 25715 - DNA, 50 bp, homo sapien
ttgctgtctttacagtgatccatcayggaacttttgccaaacagactgga

SEQ ID NO: 25716 - DNA, 50 bp, homo sapien
atttgtatgacagcggttggtataayagcccttctgcttcttacatttaa

SEQ ID NO: 25717 - DNA, 50 bp, homo sapien
atctgttcaactttataatgctgcaragaaatatcagtaactgtttagtc

SEQ ID NO: 25718 - DNA, 50 bp, homo sapien
agtatttattgagcacttactatggrcaaagtactgtgtttggctctgga

SEQ ID NO: 25719 - DNA, 50 bp, homo sapien
cattctatttatattttaaactcacratttcaactattaggaaaaagctg

SEQ ID NO: 25720 - DNA, 50 bp, homo sapien
tttatttaaaacactttctccataaycgttgatttcttgtacatatcttg

SEQ ID NO: 25721 - DNA, 50 bp, homo sapien
aaaattaccagaggcttattctgcayagtaagattttggatgatgattct

SEQ ID NO: 25722 - DNA, 50 bp, homo sapien
aaggagcatccatatcaaatgcagayagtaaagtcataggaggtagacat

SEQ ID NO: 25723 - DNA, 50 bp, homo sapien
ctacactttgagtgacaaggctgtasactaactggttcactaaaatcatg

SEQ ID NO: 25724 - DNA, 50 bp, homo sapien
gttttgaagactcaagaggttgatayattttggaagggatcacaattgac

SEQ ID NO: 25725 - DNA, 50 bp, homo sapien
acaaactcactctcacaataatgaamccatcctatgataacaacattaat

SEQ ID NO: 25726 - DNA, 50 bp, homo sapien
actttttgtctttaggttgagtggawcttataaactggttcttccatgta

SEQ ID NO: 25727 - DNA, 50 bp, homo sapien
gccttcagttaaatatttttcataastaagtaccactaaacttaccacta

SEQ ID NO: 25728 - DNA, 50 bp, homo sapien
agtttaaaactatttcaatctattcyaatttgtctagttgtttcatgatc

SEQ ID NO: 25729 - DNA, 50 bp, homo sapien
attcgatattatcagagatttatacraagttacagagtaggcaataaaaa

SEQ ID NO: 25730 - DNA, 50 bp, homo sapien
tttctttgtcgttaaggtaactgtaygatattagttggtaaatattgttt

SEQ ID NO: 25731 - DNA, 50 bp, homo sapien
tccaaattactatttgctgtcatcaytaaagagcaatcttagtctgagca

SEQ ID NO: 25732 - DNA, 50 bp, homo sapien
taggataggtattggagagtaaatakaagacttcaaggagttattctatt

SEQ ID NO: 25733 - DNA, 50 bp, homo sapien
cagtgtgaattaggaaatgaggatarccatacctagtctgatttccagga

SEQ ID NO: 25734 - DNA, 50 bp, homo sapien
tcatctaattacagtaactgctcaasagtaatgtggaacaaatgcagtgc

SEQ ID NO: 25735 - DNA, 50 bp, homo sapien
tgatatatacgttatcgcaattttgraacggtgtgaattgaggttggaga

SEQ ID NO: 25736 - DNA, 50 bp, homo sapien
ggggttttgtttatgaaagattgacygcattgttcataatttgatgtatt

SEQ ID NO: 25737 - DNA, 50 bp, homo sapien
ttctcaattcactaagtttgtattarcatcctaaaatgcatctctccccc

SEQ ID NO: 25738 - DNA, 50 bp, homo sapien
cttttgaccacttgacattggtctcwcttggtatcatcattcttcaaagg

SEQ ID NO: 25739 - DNA, 50 bp, homo sapien
tagttgtgagcagatgaaccaaaaawatcaaaggagccagctaaagcagc

SEQ ID NO: 25740 - DNA, 50 bp, homo sapien
atttacttctgatacttttaataaayatggagaatgtcttagctcagact

SEQ ID NO: 25741 - DNA, 50 bp, homo sapien
agaaagagtatcctttatgtagatawccgaagtgttttaaaatacatttt

SEQ ID NO: 25742 - DNA, 50 bp, homo sapien
tcatcatgcagcctgataccatcacraactggaaatgtatttaaggttca

SEQ ID NO: 25743 - DNA, 50 bp, homo sapien
gcttaaggctcaccttgtatgtgtcrcctctgatttcacactctggcttc

SEQ ID NO: 25744 - DNA, 50 bp, homo sapien
aagggagaatatgggctgaaagtggyatcttgagccagggctccattctc

SEQ ID NO: 25745 - DNA, 50 bp, homo sapien
ttcctctgctggatctgagcaaaatyaattgaatatcttctggaaaggat

SEQ ID NO: 25746 - DNA, 50 bp, homo sapien
gcttcttttctctgtatatagatcaratccttttcaaaagtatctccaag

SEQ ID NO: 25747 - DNA, 50 bp, homo sapien
tacccagaaatatggatagaactatraaccactttctatctttagctctc

SEQ ID NO: 25748 - DNA, 50 bp, homo sapien
gttcaagtttttaaatgatcagtagragatatgaagaagatatgggtggt

SEQ ID NO: 25749 - DNA, 50 bp, homo sapien
ctcccttgatatcattgcctgggaayagaaaataaaaatatgatattcag

SEQ ID NO: 25750 - DNA, 50 bp, homo sapien
atggcttcagaataggtagttaatcratatttttaggtaaataaacaaaa

SEQ ID NO: 25751 - DNA, 50 bp, homo sapien
aaccctcttttccagaagcccatcasagagaaataagtagcagatcagcg

SEQ ID NO: 25752 - DNA, 50 bp, homo sapien
gacatttactctcattattctatagyccttgaagtccaaaatctaggtat

SEQ ID NO: 25753 - DNA, 50 bp, homo sapien
gggatgtgatcaaaatcaaagagtgragccgaactaagggctaatatcta

SEQ ID NO: 25754 - DNA, 50 bp, homo sapien
gctacttctttcttcttacgtaatasaacaagaacaaacatattttataa

SEQ ID NO: 25755 - DNA, 50 bp, homo sapien
tactctctttttcttccagatcagamccaaataactcaagactaattttt

SEQ ID NO: 25756 - DNA, 50 bp, homo sapien
agcctctttggttagccaatgaacaratagtgaaatggtcaggcaatgag

SEQ ID NO: 25757 - DNA, 50 bp, homo sapien
aacagtccatgcctcagttaagtccygaaataatcagtttacagtgtatg

SEQ ID NO: 25758 - DNA, 50 bp, homo sapien
tgaaaccattcttggaccttaattgraaatattcattttatttgaccagg

SEQ ID NO: 25759 - DNA, 50 bp, homo sapien
gtaatttacatcataggggtacctgraaataaattagatgcaaacaaaac

SEQ ID NO: 25760 - DNA, 50 bp, homo sapien
aaaggcatatcagacaggaagagaayggatattaaagttctagcattgtt

SEQ ID NO: 25761 - DNA, 50 bp, homo sapien
tttaaaatttgtaaaccaagatgtaktaaatgaattgataactccacata

SEQ ID NO: 25762 - DNA, 50 bp, homo sapien
gtctgacagactttattctctatcargctatgatgactgttagccaatac

SEQ ID NO: 25763 - DNA, 50 bp, homo sapien
gttcaagttgttgtagagatggtcargtatagaggttcaatatgtggcat

SEQ ID NO: 25764 - DNA, 50 bp, homo sapien
cacgtccagggcaacttaaccagcarcagagatttcacagaagcccttac

SEQ ID NO: 25765 - DNA, 50 bp, homo sapien
gctggaaacagtaagagggttctgcrcttcgtaatagccaggtggcacat

SEQ ID NO: 25766 - DNA, 50 bp, homo sapien
tttgccaaagcagtataaatgtggaygcttagacactgagaatgttacat

SEQ ID NO: 25767 - DNA, 50 bp, homo sapien
aagaattattcattttcttttttaaygtgaaagtagagcaagaacattct

SEQ ID NO: 25768 - DNA, 50 bp, homo sapien
gtcttcatctgttgtcctaggaagayactgaaatcatgctagggagaaac

SEQ ID NO: 25769 - DNA, 50 bp, homo sapien
aaacaggaaaggaagcgtcttttcayagagcataaagacaatcaaaagac

SEQ ID NO: 25770 - DNA, 50 bp, homo sapien
gaatgggtctttcagtttttgagaaycagcaaaagagtgttgttgtagca

SEQ ID NO: 25771 - DNA, 50 bp, homo sapien
ggaacattgataatttggacttgcawctattactttccccatttcaatac

SEQ ID NO: 25772 - DNA, 50 bp, homo sapien
aagaaggggtatcaggagaaaatcaytgaatatggaaaaacgaaaggacc

SEQ ID NO: 25773 - DNA, 50 bp, homo sapien
ttatttcttccatgagtaaggctgcyctatttatcaaataaaaactcaga

SEQ ID NO: 25774 - DNA, 50 bp, homo sapien
aggccactggaagagctataaccagscacgatgcaatttccacctagaaa

SEQ ID NO: 25775 - DNA, 50 bp, homo sapien
cctttgacccctagctcagcttaacsgcattgctctgctcacctgaagtt

SEQ ID NO: 25776 - DNA, 50 bp, homo sapien
gaagctcaggtcatctttgtatttaygcaatgagtcaggaaaggaccaag

SEQ ID NO: 25777 - DNA, 50 bp, homo sapien
aaagatactcatagccagaactccaygagaaagggctgaaatattcatag

SEQ ID NO: 25778 - DNA, 50 bp, homo sapien
aagcctttactcatctaagcaaccayggtggagcaaccacacagccattt

SEQ ID NO: 25779 - DNA, 50 bp, homo sapien
agacaatctttcaagcatatttaacyatacagttttggtgttcaatgaat

SEQ ID NO: 25780 - DNA, 50 bp, homo sapien
ttcattccatgtataattgagatcarcctctgcagaaaactgggacacct

SEQ ID NO: 25781 - DNA, 50 bp, homo sapien
gtaggagatggttcctctactgaaakaactcttttctcaactgggaagat

SEQ ID NO: 25782 - DNA, 50 bp, homo sapien
agtttaccaccctttcattagatgcyattgttaattactacaagtctccc

SEQ ID NO: 25783 - DNA, 50 bp, homo sapien
cattctggtatgagtttctaccatckacgtgaactgtgaaacaaattgct

SEQ ID NO: 25784 - DNA, 50 bp, homo sapien
acatgagaggaattctgggacaaaamgtcaaacaacacacttggcaaaag

SEQ ID NO: 25785 - DNA, 50 bp, homo sapien
tttgtattaataatatattgagaaarctattcagatacattagaatgttc

SEQ ID NO: 25786 - DNA, 50 bp, homo sapien
acatgagactatctttagaaaacaaytattgtgatcatatatcctctagc

SEQ ID NO: 25787 - DNA, 50 bp, homo sapien
ggtgggagtcattccaaattatagamtatcaggctgacagccctagcatc

SEQ ID NO: 25788 - DNA, 50 bp, homo sapien
gaatttgggggcactatatatagcaytaatttctacgaattgaatcaaat

SEQ ID NO: 25789 - DNA, 50 bp, homo sapien
tattctagttgtttctttatgcaggyatttagtagaatctcacttgtcct

SEQ ID NO: 25790 - DNA, 50 bp, homo sapien
attttgtctagggcatttaggtaatsaaaaaaggtctaaaaaaaaaaaag

SEQ ID NO: 25791 - DNA, 50 bp, homo sapien
ccatcagtacatggcttgttacttaycagttctgtaatcctgggatcttt

SEQ ID NO: 25792 - DNA, 50 bp, homo sapien
gagaaagggaaatgtgcaggagatcrccctaaattatttcacaattttgc

SEQ ID NO: 25793 - DNA, 50 bp, homo sapien
tatctttaaaatacttcagcatagaygataccatggataccatgtgtgaa

SEQ ID NO: 25794 - DNA, 50 bp, homo sapien
gagaaaataatattaacaatgtgagwaaggaaactgccctatttttgcat

SEQ ID NO: 25795 - DNA, 50 bp, homo sapien
gtgcatagtatgtaacttccgcacaygtgtatatttgtgtaaccactgct

SEQ ID NO: 25796 - DNA, 50 bp, homo sapien
tatgaaaaattcagagaactgtgaargtcaaacataaaaatgtgtatgag

SEQ ID NO: 25797 - DNA, 50 bp, homo sapien
tctttcctgaattattatttagtgarccatcaatccattaaaattttgtt

SEQ ID NO: 25798 - DNA, 50 bp, homo sapien
aagggcaagcttttgcaggacagcargctagcctaatggaaacagatttt

SEQ ID NO: 25799 - DNA, 50 bp, homo sapien
ttctgggaaaataatcattttcagartcatggcctaaaaaggtagaatga

SEQ ID NO: 25800 - DNA, 50 bp, homo sapien
ttatgaatattcttattttgtgaatkaatgctaataaatactatggttac

SEQ ID NO: 25801 - DNA, 50 bp, homo sapien
tgcttcccttaagattttgagaaacsctattgttatatggaagtagtctg

SEQ ID NO: 25802 - DNA, 50 bp, homo sapien
gactttggtgatggtatataatagaraaactgaataccatatttgcctct

SEQ ID NO: 25803 - DNA, 50 bp, homo sapien
tgggaaagagttgcagccatcaatartaaatggagcttgcccttctgtaa

SEQ ID NO: 25804 - DNA, 50 bp, homo sapien
aacactgttttcctctggattaaaarccattccccatcttcctatccttc

SEQ ID NO: 25805 - DNA, 50 bp, homo sapien
ccattgtgcagaagagtggaaaatcrattagcaactacaagcttgggtac

SEQ ID NO: 25806 - DNA, 50 bp, homo sapien
agaaatctgaaaatggaaatattcargatgaaggtaagcaagataactaa

SEQ ID NO: 25807 - DNA, 50 bp, homo sapien
agatgctggagttgtccaagaaattmaagcaagcagatggataatggccc

SEQ ID NO: 25808 - DNA, 50 bp, homo sapien
gagctctttttataggataacataayctccaacatgtagtttactaaatt

SEQ ID NO: 25809 - DNA, 50 bp, homo sapien
ttatgttatcctataaaaagagctcmaaataactttgtgagaattataaa

SEQ ID NO: 25810 - DNA, 50 bp, homo sapien
aacagacagtggatcttagaatagamcctatattacctgttaaagatagt

SEQ ID NO: 25811 - DNA, 50 bp, homo sapien
catgtagatttgaataagttgttgayactattttgaacaaaatgttatct

SEQ ID NO: 25812 - DNA, 50 bp, homo sapien
ctagtgcatttgtgcttcgtttctaygagatcctaattgatcaagcttta

SEQ ID NO: 25813 - DNA, 50 bp, homo sapien
ggctttcagaattttttctagctcayggtatacagatctgttgtctatat

SEQ ID NO: 25814 - DNA, 50 bp, homo sapien
cagtgcatattagtctgaatgcgtayctagaagaattgcttactccccag

SEQ ID NO: 25815 - DNA, 50 bp, homo sapien
cagacccaggagttggaaaatgaacycttgcataagtatgtagatcatgc

SEQ ID NO: 25816 - DNA, 50 bp, homo sapien
ttcaagcttctctttattcaaacacrctaagcatagttttataatctgcc

SEQ ID NO: 25817 - DNA, 50 bp, homo sapien
ccacattcattactacattttgagamgataaagagcaagacacaactccc

SEQ ID NO: 25818 - DNA, 50 bp, homo sapien
ggttgccccataattcagtcatcccyaattcagcaataagtgataagagt

SEQ ID NO: 25819 - DNA, 50 bp, homo sapien
ctgaatttctcccttcccctcttgakgactattaatgaacaagcttgaat

SEQ ID NO: 25820 - DNA, 50 bp, homo sapien
cgcttttctaaagcagaaatcactamgcatctcagatacctcaagttgca

SEQ ID NO: 25821 - DNA, 50 bp, homo sapien
actcagggtgcagaaaactgaatgaytaataggagggcattagatgagat

SEQ ID NO: 25822 - DNA, 50 bp, homo sapien
caccctacactcaagctctacacaamtgcttcctgtaattccatgggtct

SEQ ID NO: 25823 - DNA, 50 bp, homo sapien
tgctcacattataatgtaacaccttmaagaagactaagagcatcaccaag

SEQ ID NO: 25824 - DNA, 50 bp, homo sapien
ctgcaggaagaggtagagatacagaygaaactattagggattctatggta

SEQ ID NO: 25825 - DNA, 50 bp, homo sapien
gtagactgaaatgatctgtatgatawtaaaatgtgttatacaacagtaat

SEQ ID NO: 25826 - DNA, 50 bp, homo sapien
taaattttagttaatgaatctgtcamtatccaagtcattttaaaaaactt

SEQ ID NO: 25827 - DNA, 50 bp, homo sapien
agtgatgcctatctgagacagaaaarttgaatttggattggagtagggca

SEQ ID NO: 25828 - DNA, 50 bp, homo sapien
ctatagctaacattaacctagtatayattttgagatagctagaagagaaa

SEQ ID NO: 25829 - DNA, 50 bp, homo sapien
atttcacaagttccacaaaagcattraagatctcataaaaggtcaacttt

SEQ ID NO: 25830 - DNA, 50 bp, homo sapien
tgacaggtcacctgttaaaagctaartgaaattgccattatactcaagtg

SEQ ID NO: 25831 - DNA, 50 bp, homo sapien
cagacttgattcagggaaaaccaaawgtcagatgtaccaagtcccaattg

SEQ ID NO: 25832 - DNA, 50 bp, homo sapien
ttatggatatcttatccaggatatcycatgtgaagaaatttttgttacct

SEQ ID NO: 25833 - DNA, 50 bp, homo sapien
agtggtataaacctcagcgttgaagsctaataaaatgtctcctaagatgg

SEQ ID NO: 25834 - DNA, 50 bp, homo sapien
gaattccctggggaacttacttaaawtacagaattccaaattccataccc

SEQ ID NO: 25835 - DNA, 50 bp, homo sapien
taaagatctctaaattaaatttccaktagcaattagtttttatgtcactg

SEQ ID NO: 25836 - DNA, 50 bp, homo sapien
aatctgccaatgatgccttgaagccyaaacatctggagtacctaaaaaaa

SEQ ID NO: 25837 - DNA, 50 bp, homo sapien
cttgtttcattttaatataaaaatasctaccttgatgtcaggatgttcca

SEQ ID NO: 25838 - DNA, 50 bp, homo sapien
tactaagactgtaatgtgagataaaygatttaacatctcttaggcatcat

SEQ ID NO: 25839 - DNA, 50 bp, homo sapien
atcaaatgactctaggatgattacasagggttgccagataacttacattt

SEQ ID NO: 25840 - DNA, 50 bp, homo sapien
cctaagagatcacttttctcttcacrgtccaataagatctttgatattct

SEQ ID NO: 25841 - DNA, 50 bp, homo sapien
caggaggaaaggaaggtgtaaacaawtcaaatacaggctatataggtgct

SEQ ID NO: 25842 - DNA, 50 bp, homo sapien
caataaatgggagagaagtattatcraggatttgtttcaatagaatgaat

SEQ ID NO: 25843 - DNA, 50 bp, homo sapien
gactttatccaagtccctaatctcartgaatctcagagggataacatgaa

SEQ ID NO: 25844 - DNA, 50 bp, homo sapien
ttttcaagaattaatatgattcttakgtgaactgcttacattttcctaga

SEQ ID NO: 25845 - DNA, 50 bp, homo sapien
aaggaaatccttaagcgatattcatmaacaacagaattcataattcataa

SEQ ID NO: 25846 - DNA, 50 bp, homo sapien
gctcagtggatcctcaataagttcaygtttatcttaattccaaatacagt

SEQ ID NO: 25847 - DNA, 50 bp, homo sapien
agtaacgaaagctttatatgtaatcraagagcaatgcacagcctaagaaa

SEQ ID NO: 25848 - DNA, 50 bp, homo sapien
taaaaccatctgtattccaaacataraaaaatgatggattattaaaaacc

SEQ ID NO: 25849 - DNA, 50 bp, homo sapien
tttgtacaaaaacatacagtctacawctgattaaagcacagaagcttaag

SEQ ID NO: 25850 - DNA, 50 bp, homo sapien
tctggttatccttcttctagtcaaayttatttacttctttgtacaaaaac

SEQ ID NO: 25851 - DNA, 50 bp, homo sapien
agtagatcaggaaaaatgctttaagraagttgccctttgagtcagatttg

SEQ ID NO: 25852 - DNA, 50 bp, homo sapien
tggagaaagaacattacatacagaasagttagcaagacaaaggtactgag

SEQ ID NO: 25853 - DNA, 50 bp, homo sapien
cccattttatggtgatgatagctgartaataatcaaaatatgttgtcgtg

SEQ ID NO: 25854 - DNA, 50 bp, homo sapien
atagaattttttttgtagtttgatawgagtagataaatcaaacatcaaaa

SEQ ID NO: 25855 - DNA, 50 bp, homo sapien
gcaatatttctaatgagaatgaatckaaatctgtggcgagaaaaccatat

SEQ ID NO: 25856 - DNA, 50 bp, homo sapien
acgtcacctaattcatgggtgtacargcaagaatcaccaagagacagatc

SEQ ID NO: 25857 - DNA, 50 bp, homo sapien
ctgtggtggaaactaaggaaacacastaatcatatttgaatattgtgctt

SEQ ID NO: 25858 - DNA, 50 bp, homo sapien
actttctactagtttaatatttcatraccaagaagatccaatatgcctat

SEQ ID NO: 25859 - DNA, 50 bp, homo sapien
tgagtctaccatgtacttttaatgaycaccacatgtctagagccaactat

SEQ ID NO: 25860 - DNA, 50 bp, homo sapien
gttttattatcatgtgctttagaaayacacgttactgtcattcctttttg

SEQ ID NO: 25861 - DNA, 50 bp, homo sapien
tattatttaaaaattctctaggccaygctgtaaataaataatcctgttcc

SEQ ID NO: 25862 - DNA, 50 bp, homo sapien
aagttgatggtctaagtaaatattayctgatacagcaacataactgattt

SEQ ID NO: 25863 - DNA, 50 bp, homo sapien
tagatacacaaataaatgttgattayatatgtccataatcctttttcaaa

SEQ ID NO: 25864 - DNA, 50 bp, homo sapien
aggaatctgattatactgcaggtcarattatatcctaaagatatatttgt

SEQ ID NO: 25865 - DNA, 50 bp, homo sapien
aaggccacaacttcaacacatttcarggaagttcaggatcaggagcacca

SEQ ID NO: 25866 - DNA, 50 bp, homo sapien
cttcctgggtcactttctatatagaycacctggtgtaggcaaacagctca

SEQ ID NO: 25867 - DNA, 50 bp, homo sapien
ccactattatatttcatctgtcatayaggtattctaaaggcaatgtctgt

SEQ ID NO: 25868 - DNA, 50 bp, homo sapien
aagccttgtctgaaatccatactacrgtacatcgcgcacaattggcaatg

SEQ ID NO: 25869 - DNA, 50 bp, homo sapien
tgtcaagcaaacagtggtaggaaackgaaattctgtgactgaacaccctc

SEQ ID NO: 25870 - DNA, 50 bp, homo sapien
tgctggtagtaaagaactgcgcatcrgaaataatacctctgaataccatt

SEQ ID NO: 25871 - DNA, 50 bp, homo sapien
gattctatagttttctaacttgagargatgaccattattttaaataattt

SEQ ID NO: 25872 - DNA, 50 bp, homo sapien
acacgtaaaatacactaatgatagcygatgagttttttaaaaaagtcaca

SEQ ID NO: 25873 - DNA, 50 bp, homo sapien
taagtgactgaaatttcaaaaataartaacacctgtagttcccaacattg

SEQ ID NO: 25874 - DNA, 50 bp, homo sapien
tgattgaccttgttttgagggaacartaactgtataggcagtgcaaatga

SEQ ID NO: 25875 - DNA, 50 bp, homo sapien
aaaagctcacattctggttgatgtasaaagtgtgaaatgcctgggagatt

SEQ ID NO: 25876 - DNA, 50 bp, homo sapien
ctatgtatttcaatttcgctaaaatsaagatattaatatttgtctcaaag

SEQ ID NO: 25877 - DNA, 50 bp, homo sapien
tggtacatggtagactcttaacacasaactacaataatcatctaaccaaa

SEQ ID NO: 25878 - DNA, 50 bp, homo sapien
catagtttctcctggctatttataaytcacatttctccccatgccttcac

SEQ ID NO: 25879 - DNA, 50 bp, homo sapien
caccaggtgctgtttgcacagaatcyaattttggtgtatttaattcatta

SEQ ID NO: 25880 - DNA, 50 bp, homo sapien
ctctataaagcttagactataaatayatgtacacacacaaaaaaagcaac

SEQ ID NO: 25881 - DNA, 50 bp, homo sapien
tttcaataacataacaattaaaacargtactaatgatattcctgaaacac

SEQ ID NO: 25882 - DNA, 50 bp, homo sapien
atataccagattttcatagccctacmgcgttattgtcccttacccactag

SEQ ID NO: 25883 - DNA, 50 bp, homo sapien
tcagggtgacggaaacatgaagcacyaatagtattccttcctccacagga

SEQ ID NO: 25884 - DNA, 50 bp, homo sapien
aggcctacttggaagcacataaagcratttttatttattgaagccggaag

SEQ ID NO: 25885 - DNA, 50 bp, homo sapien
aagcaccgagatttgagcctagatayggtcacttctaaaatttattacta

SEQ ID NO: 25886 - DNA, 50 bp, homo sapien
ccattagccctgaatccctgttttayggatgagaatactgagggtcattt

SEQ ID NO: 25887 - DNA, 50 bp, homo sapien
acaccgtgcttaataaatgacaaaaygattataaccttgatggtttctaa

SEQ ID NO: 25888 - DNA, 50 bp, homo sapien
gccaataagcagaaaattatcaacarctactttttctgaaaggataaaat

SEQ ID NO: 25889 - DNA, 50 bp, homo sapien
cagcattatcagagaaaatggtcagyataatgtcttggtacctgcctaaa

SEQ ID NO: 25890 - DNA, 50 bp, homo sapien
acatagcagatggacatgcaacgaartaactagcaaagagaccttgtttc

SEQ ID NO: 25891 - DNA, 50 bp, homo sapien
attcccttgaaactaagcacaatcartgactctttgtaattagatcttgc

SEQ ID NO: 25892 - DNA, 50 bp, homo sapien
gagagtagtctacaaaaagtctaggwaggcaaagtatagttatatcacaa

SEQ ID NO: 25893 - DNA, 50 bp, homo sapien
taaatttgataattaacactttcatkaggacatcaataagagaagatgga

SEQ ID NO: 25894 - DNA, 50 bp, homo sapien
tgcaggtgtacaaaatgtctgtaagraaataatgataaaagtttcaactt

SEQ ID NO: 25895 - DNA, 50 bp, homo sapien
ttatagagaacataagatgttttaasacatggaccttggccttgaaaaga

SEQ ID NO: 25896 - DNA, 50 bp, homo sapien
aagtcttaatagattcaaaataattsaaatgatacagcttatgttccttg

SEQ ID NO: 25897 - DNA, 50 bp, homo sapien
tcccagtaatggcttctgagggtgartatcccaagtagttgtttaaaatt

SEQ ID NO: 25898 - DNA, 50 bp, homo sapien
aaaaaatgagatgttcgtttcctaayaaaataataagaaaattgtaaatc

SEQ ID NO: 25899 - DNA, 50 bp, homo sapien
gtgaggccagaaagctctgtattaaraggtgtcccgaccaagtgtgatga

SEQ ID NO: 25900 - DNA, 50 bp, homo sapien
ctgatgacataccaaagaactaatcrcctgcttttcagtatattcattct

SEQ ID NO: 25901 - DNA, 50 bp, homo sapien
gtttgggaagttctctgttattatayattggaataaactttgtacctgta

SEQ ID NO: 25902 - DNA, 50 bp, homo sapien
gaagttttgctcattcacacaagtamctccaatctaactcagtaattaaa

SEQ ID NO: 25903 - DNA, 50 bp, homo sapien
agaatattccactaacgtcattatawaactcaccaatgatgtaatgaatt

SEQ ID NO: 25904 - DNA, 50 bp, homo sapien
tagttgttttggctatttgagatccyatcaaaatttgtatgaattttaga

SEQ ID NO: 25905 - DNA, 50 bp, homo sapien
gacttctcttctacattactacatawctagtgtctgaatagttcattgaa

SEQ ID NO: 25906 - DNA, 50 bp, homo sapien
cgttcatataccatcacttgtatcaytaataaataagtaggtgacaaaaa

SEQ ID NO: 25907 - DNA, 50 bp, homo sapien
agaattctctgtcttatgaatataaygagataatgacttctcttctacat

SEQ ID NO: 25908 - DNA, 50 bp, homo sapien
gtttaaataagtagtgaatggattayagtaaaaacagttacaggattttt

SEQ ID NO: 25909 - DNA, 50 bp, homo sapien
aaaatatgtcaactcctgactgttgsagaaaatgaagggtcaaaaataaa

SEQ ID NO: 25910 - DNA, 50 bp, homo sapien
atgcaagtattagcaaattaacaacyctatgcatgtaggcggtgattaga

SEQ ID NO: 25911 - DNA, 50 bp, homo sapien
agaccaccccgacgactaatgaaaasaaattttggcagccgctgttaaag

SEQ ID NO: 25912 - DNA, 50 bp, homo sapien
tggtctgcagggggaactgttgggasaattggcaggagataattaggtgg

SEQ ID NO: 25913 - DNA, 50 bp, homo sapien
tgattttaaactttaaaatgctctayccaattaactcaggtgagagtcgg

SEQ ID NO: 25914 - DNA, 50 bp, homo sapien
tctgtttactctctgaaacatacccwctttctacatttgtgccatacttt

SEQ ID NO: 25915 - DNA, 50 bp, homo sapien
aaagaggaacccaaagtctgcagaaktaggcaagttaacactagatttaa

SEQ ID NO: 25916 - DNA, 50 bp, homo sapien
atgtttccagaattcttgagtgaggyattccaatattcatgagaaacatt

SEQ ID NO: 25917 - DNA, 50 bp, homo sapien
aaaccctggcaggtgattagccttcragtggactaagcatgtatactttt

SEQ ID NO: 25918 - DNA, 50 bp, homo sapien
ctgattaatattatcaccaaccttckcataaataactgagtacttgaaga

SEQ ID NO: 25919 - DNA, 50 bp, homo sapien
tccactaccatagtggtcctgtgtamattaattagaatgaaaacactaat

SEQ ID NO: 25920 - DNA, 50 bp, homo sapien
atttatagctgtgttgtgcttaaatsaatgtttatacaaacaataggaat

SEQ ID NO: 25921 - DNA, 50 bp, homo sapien
aacatcagcatgctgcctggctagaraaatcaacatcagatgacctcact

SEQ ID NO: 25922 - DNA, 50 bp, homo sapien
attgttaattccaatggacataatamaatggttacgattctttaaaatta

SEQ ID NO: 25923 - DNA, 50 bp, homo sapien
gggttttgttgttaagaattggaaaytgaaacttaataaaattacttaga

SEQ ID NO: 25924 - DNA, 50 bp, homo sapien
tggagggaaagagagagtgatggcaytgataaattaacgtgggaaaataa

SEQ ID NO: 25925 - DNA, 50 bp, homo sapien
agtagcttccttttagaatcacctaygctttcaaatacatattaatgatc

SEQ ID NO: 25926 - DNA, 50 bp, homo sapien
aattttagaaatcttgtattgtggtyaacaatttctacttagtgcagaaa

SEQ ID NO: 25927 - DNA, 50 bp, homo sapien
ttcggtatgaacctagattcatttgyatttaattttgtttgacaggtttt

SEQ ID NO: 25928 - DNA, 50 bp, homo sapien
caaatttcttcatgtgaaatgggatkatcatactaccttacaaagttgtt

SEQ ID NO: 25929 - DNA, 50 bp, homo sapien
ttttggtaatcataggtctataagarctaagaacaggttgctaatggaaa

SEQ ID NO: 25930 - DNA, 50 bp, homo sapien
agataaatggactcattctatattcraaaaggagtagatgtcccttcttt

SEQ ID NO: 25931 - DNA, 50 bp, homo sapien
cctgtaacagtacttgtggcctttcracataaagtgtgtgtgtgtgtgtg

SEQ ID NO: 25932 - DNA, 50 bp, homo sapien
agagaagagtctgaggcttagagacrataagtagcttgcttcaggttata

SEQ ID NO: 25933 - DNA, 50 bp, homo sapien
agctcatgtaatctaggagtggctgwatcatacttattttattctaattg

SEQ ID NO: 25934 - DNA, 50 bp, homo sapien
aaccctgaaatagcatagattgcctwaaaggtgggtgctagactttccac

SEQ ID NO: 25935 - DNA, 50 bp, homo sapien
tcatcaagctcaggatttagactcasaattatatggacaatttccccatc

SEQ ID NO: 25936 - DNA, 50 bp, homo sapien
gtttcccaacagataaatacacctaraactggtaatcggcagctttcagg

SEQ ID NO: 25937 - DNA, 50 bp, homo sapien
tctactttaatataaaataaatacartcagaggttatatgatgatcacta

SEQ ID NO: 25938 - DNA, 50 bp, homo sapien
acttttcgtgcttaagaaattcaatsatgtagtaagctgacaactaacat

SEQ ID NO: 25939 - DNA, 50 bp, homo sapien
agcctagtgtccattccaatttcgartagaaaatcttagtcttctaatga

SEQ ID NO: 25940 - DNA, 50 bp, homo sapien
cttgcatgtgctaaggataaggtacyaaacaacagcgactctgcactcat

SEQ ID NO: 25941 - DNA, 50 bp, homo sapien
tattctttcagtcctcattccataamaatttcttaacatgttactttagg

SEQ ID NO: 25942 - DNA, 50 bp, homo sapien
caactttaaacgtctaacaactcggycatgaagcctaagcattgaaagca

SEQ ID NO: 25943 - DNA, 50 bp, homo sapien
aacaaccaaaacccaggagctgacaytcaatcattaaaggatcccagtcg

SEQ ID NO: 25944 - DNA, 50 bp, homo sapien
tcttccatcgacagataggcctaaawgtcataagtacagagtgttcccaa

SEQ ID NO: 25945 - DNA, 50 bp, homo sapien
agccctgaatttctctaaccttctarcccctttcaattcgaaactcatct

SEQ ID NO: 25946 - DNA, 50 bp, homo sapien
tagtcagctatgtaaattaaaatccwcattatgtataagcatagagaggt

SEQ ID NO: 25947 - DNA, 50 bp, homo sapien
tgggaaatcttctagaaatggttcartctatgtttatgtttttgaaaaac

SEQ ID NO: 25948 - DNA, 50 bp, homo sapien
atgcagtaataggaagggataaacamcaaattacttgatactgaatgcag

SEQ ID NO: 25949 - DNA, 50 bp, homo sapien
taaaagaaaaaatactaaaggtaaasaacctcaaagatttaatgtatata

SEQ ID NO: 25950 - DNA, 50 bp, homo sapien
aaattgttctcgtcaccagaagttakgagtcaacactggaatggacctat

SEQ ID NO: 25951 - DNA, 50 bp, homo sapien
ttgagcttcagtttatatatagacaytctggaacattttattataaagca

SEQ ID NO: 25952 - DNA, 50 bp, homo sapien
gtattgggtgagtataacataatgcygatgtaattaatccttctgatgct

SEQ ID NO: 25953 - DNA, 50 bp, homo sapien
ctggaaatctgagggaggtcttcccrgatgtctgccatctgccagtgctc

SEQ ID NO: 25954 - DNA, 50 bp, homo sapien
tgtctctctcaatcctgttaagtcayagcttagttttgtcactgcatcct

SEQ ID NO: 25955 - DNA, 50 bp, homo sapien
atcctttatttatgtcacttactcartatgttttctactttttcttcttt

SEQ ID NO: 25956 - DNA, 50 bp, homo sapien
tattgttctaagcccaatcacttcarataaaattatgatgccacattctg

SEQ ID NO: 25957 - DNA, 50 bp, homo sapien
tgctgtttgatgggtgacacctgtawcttatgtctgtgcctatttcactg

SEQ ID NO: 25958 - DNA, 50 bp, homo sapien
gaatggaaagggacttatcctaataygggtcatctccaaaagcctacata

SEQ ID NO: 25959 - DNA, 50 bp, homo sapien
agatgacaggtgtgttaaagcatgargcaagtgtgtaacttggctttgta

SEQ ID NO: 25960 - DNA, 50 bp, homo sapien
caagggtctatcggaagtttaaagcmatgcagcgggaagtaccttgcctt

SEQ ID NO: 25961 - DNA, 50 bp, homo sapien
atggcttcatttacatttgatgctakaaaaaagcaagttattaatatagg

SEQ ID NO: 25962 - DNA, 50 bp, homo sapien
atttttattaaattaataaatcctamcttatctcttaaaggttttaatat

SEQ ID NO: 25963 - DNA, 50 bp, homo sapien
aatatagcaggaaatattgcttagamataacagctctacatattgatcta

SEQ ID NO: 25964 - DNA, 50 bp, homo sapien
gagtggattgcctggaaagttcctaygtaattgtctaactctgaggaata

SEQ ID NO: 25965 - DNA, 50 bp, homo sapien
tttctaagcatgtttgcttcattcamagtaaatagtaaacccacagctca

SEQ ID NO: 25966 - DNA, 50 bp, homo sapien
tgtaaatgaatagcctaatacttgayatgatttagttagagaaactgctg

SEQ ID NO: 25967 - DNA, 50 bp, homo sapien
caatcacactgattacaaacttgaarcaagcctccctacttacagcagct

SEQ ID NO: 25968 - DNA, 50 bp, homo sapien
gatgttagtttctaaagagtaatgcygcagtcgttctaaaacatcaagag

SEQ ID NO: 25969 - DNA, 50 bp, homo sapien
tgggctgttttcagaagtatctttayagcatttgttaattttgttgtaac

SEQ ID NO: 25970 - DNA, 50 bp, homo sapien
gaaactgtcaagtttgttgattatayggcttcataactagattatccagg

SEQ ID NO: 25971 - DNA, 50 bp, homo sapien
aatatttaagaatatgtccaatcaartataaacgtcaagatcaagatata

SEQ ID NO: 25972 - DNA, 50 bp, homo sapien
ctgaaaaaaaaatcaaatcagttctraaaagaaaggatcaattacacaaa

SEQ ID NO: 25973 - DNA, 50 bp, homo sapien
aagagaagacaactcacatgaaataygaaaattaaaggttaatactcacc

SEQ ID NO: 25974 - DNA, 50 bp, homo sapien
cgtccccaaaactatattgcaagcargaggtacaaaagcaattagaagat

SEQ ID NO: 25975 - DNA, 50 bp, homo sapien
gtatggcttagttctctccaaaggayaatgagtggaagagctatctgcca

SEQ ID NO: 25976 - DNA, 50 bp, homo sapien
tttccatgtgtctagatttctcatawctaaaatccaatctgagcaaattg

SEQ ID NO: 25977 - DNA, 50 bp, homo sapien
ttttatgcagcctctcgaactaaaarttgtcttgtggatgctgtgagaaa

SEQ ID NO: 25978 - DNA, 50 bp, homo sapien
agttggacagtactgagtgaaataayggactagccttgtaccaccactgc

SEQ ID NO: 25979 - DNA, 50 bp, homo sapien
aaatggagaaattaaactatataccyatgatctagatgtaacaaagtcaa

SEQ ID NO: 25980 - DNA, 50 bp, homo sapien
tctgtcaaaatttacctaagaagaartacaccatctgaattttctattaa

SEQ ID NO: 25981 - DNA, 50 bp, homo sapien
tctatctttgctacatctttccaccrccaggtaggttttgggttcccatt

SEQ ID NO: 25982 - DNA, 50 bp, homo sapien
tgaaattgttgcttatgatgatgtargagagattgcctataaatgggaag

SEQ ID NO: 25983 - DNA, 50 bp, homo sapien
tatgctgcatcaatgcattcctctgmaatgaaggtactctgcgttccact

SEQ ID NO: 25984 - DNA, 50 bp, homo sapien
cacaataaatatttcattatgtatgkaactaattccttgttgtaggataa

SEQ ID NO: 25985 - DNA, 50 bp, homo sapien
ttattcaacccagtacaacagcattmaagcctgaaatagatcacgtggag

SEQ ID NO: 25986 - DNA, 50 bp, homo sapien
gaatctgctaattgtttagtatgtaygcttacagattagataaataactt

SEQ ID NO: 25987 - DNA, 50 bp, homo sapien
cctctaggtctttgttcctgtctgtkaaataaggacattagacaagatga

SEQ ID NO: 25988 - DNA, 50 bp, homo sapien
tgtacatgccttcagatcagggccasgtattatagtgctttgctttcaac

SEQ ID NO: 25989 - DNA, 50 bp, homo sapien
gtgactttaatgcttctggatttttwaaaaagtgttatctaaaagatgga

SEQ ID NO: 25990 - DNA, 50 bp, homo sapien
tccaagacaaaaagacatcagattcrccatagtcactgtgaaataaaaaa

SEQ ID NO: 25991 - DNA, 50 bp, homo sapien
atctaaacctctttcaatcttttaaytggaatgcctagaatcctgtctcc

SEQ ID NO: 25992 - DNA, 50 bp, homo sapien
gaaccagaagaggagagataaattargtcttggtaaaccttcagtctagc

SEQ ID NO: 25993 - DNA, 50 bp, homo sapien
agggccataaattaagtcaaatggamaaggtcaggttaaattctttggaa

SEQ ID NO: 25994 - DNA, 50 bp, homo sapien
aggaaagtgtgtaatacatttcagaragattcccttcaaaatatttttaa

SEQ ID NO: 25995 - DNA, 50 bp, homo sapien
catagagaaatcacctcaatgtcgamgttacttttggaagagatggacag

SEQ ID NO: 25996 - DNA, 50 bp, homo sapien
ttttataccacactctcgattgacaraagtctcagaaagtgaaattttag

SEQ ID NO: 25997 - DNA, 50 bp, homo sapien
gtccagtttttctcctgagaagcatkaaatcttaagttggagttccactt

SEQ ID NO: 25998 - DNA, 50 bp, homo sapien
tcagcagatggaataacccagtttcratgacactttccctaatcttatca

SEQ ID NO: 25999 - DNA, 50 bp, homo sapien
gggaactggttttatcagccaagaaytgtgttaacccagcctggttcctg

SEQ ID NO: 26000 - DNA, 50 bp, homo sapien
tcattccacttacaaccactgtccaycagttttgagtttatttacagagg

SEQ ID NO: 26001 - DNA, 50 bp, homo sapien
tcaatcttacctgtttctttcatgcraaatattcctttcatataaaacac

SEQ ID NO: 26002 - DNA, 50 bp, homo sapien
aatggaagtatgtacttatctgataytaccctaattgtaagtctttcttg

SEQ ID NO: 26003 - DNA, 50 bp, homo sapien
aagggacttgctacacatcatcaaasagcggcaaaaaaccaaaggtttca

SEQ ID NO: 26004 - DNA, 50 bp, homo sapien
tttcttgggctttgtttggccttacrattgtatcctgctatcctgtgaaa

SEQ ID NO: 26005 - DNA, 50 bp, homo sapien
catacacatccaaataaactatagaygctaaagctcagaacaagcttgaa

SEQ ID NO: 26006 - DNA, 50 bp, homo sapien
actggtatgtgatgtataagttgaayattgaatatgtttagtaaatcttt

SEQ ID NO: 26007 - DNA, 50 bp, homo sapien
ctaataatgagagagagacagtaagwatttgaagaaaaacaagaatttga

SEQ ID NO: 26008 - DNA, 50 bp, homo sapien
taaaaaaaatgctttcagtatggctyaaaaaccttagagatcaacacttt

SEQ ID NO: 26009 - DNA, 50 bp, homo sapien
atgcacatctgaattaatcactgtaygtcaactctgcatttcatataata

SEQ ID NO: 26010 - DNA, 50 bp, homo sapien
ctaggctgggtagaagacagtcacgraatatgattaattcttctgacact

SEQ ID NO: 26011 - DNA, 50 bp, homo sapien
agtgaagaagcccaaagcagcagacyaattttcaaggaaaaagttaattt

SEQ ID NO: 26012 - DNA, 50 bp, homo sapien
tgcatatactctacctattctctctraaaatacaatactgtgttcatggc

SEQ ID NO: 26013 - DNA, 50 bp, homo sapien
agtgtattccatggaaagaacatccmgaacttgggagaagataacgtaac

SEQ ID NO: 26014 - DNA, 50 bp, homo sapien
attttctaagcgaatgtacaaattasaagtccttagtttcgtaagatgct

SEQ ID NO: 26015 - DNA, 50 bp, homo sapien
cctttggtgctcattatcagtggaamccagctttcatgcagatctgtcat

SEQ ID NO: 26016 - DNA, 50 bp, homo sapien
tttacatatgttgatattttatagamctaggaatgcttgtattttcaaaa

SEQ ID NO: 26017 - DNA, 50 bp, homo sapien
agggcaaatgtcacatccctgactayactttaggtaacttagcaatatat

SEQ ID NO: 26018 - DNA, 50 bp, homo sapien
gaaaagcctaaagatttaagctactraaatatttggagactgattagttg

SEQ ID NO: 26019 - DNA, 50 bp, homo sapien
tgtaatctcattagcaccatattctmaccaatttagctgactcctattta

SEQ ID NO: 26020 - DNA, 50 bp, homo sapien
gggaaatcaatagctaaaaaatgtcmacaccctggcttccttttatcagg

SEQ ID NO: 26021 - DNA, 50 bp, homo sapien
atccattttaaaagtacactaggaayatcagcttatcagaggtataagaa

SEQ ID NO: 26022 - DNA, 50 bp, homo sapien
aggacaagtaatatttgtgtgataasaggtagaagagtatctgtaatcag

SEQ ID NO: 26023 - DNA, 50 bp, homo sapien
agagggagggatcagcagattatgcyatatttgtgatgaaaaatgctgga

SEQ ID NO: 26024 - DNA, 50 bp, homo sapien
tttcttcaagcacaaatggctggtgwcaaaactagttgcaacagtgctat

SEQ ID NO: 26025 - DNA, 50 bp, homo sapien
gaagtcctattttagagaagtctgcrataacatctagctccttggaatgt

SEQ ID NO: 26026 - DNA, 50 bp, homo sapien
cttctcatgttcttgttaaaattacrgacgaatcattattaccatggaag

SEQ ID NO: 26027 - DNA, 50 bp, homo sapien
acaaaggagccatgtttccgctccamagaggtgctttaaaattgaacagg

SEQ ID NO: 26028 - DNA, 50 bp, homo sapien
ttagttgcatgtgtattaaaatgtgwagggcagtatattattaatcaaaa

SEQ ID NO: 26029 - DNA, 50 bp, homo sapien
caggacaagtaaacaatagggtgaartatcatttgcatggaatcaatgaa

SEQ ID NO: 26030 - DNA, 50 bp, homo sapien
atagtgggcatagttaaataaataayaggaagtgattatcatttacaaaa

SEQ ID NO: 26031 - DNA, 50 bp, homo sapien
atctctgagtccaaccaatatcctcygagaatgtttgattttttcttctg

SEQ ID NO: 26032 - DNA, 50 bp, homo sapien
gatgatgtaaaattttcaactattaragacgatctcatgcatgtatttta

SEQ ID NO: 26033 - DNA, 50 bp, homo sapien
agtccctgcttatattaaggtgtccraccaccactgcacatggccctcag

SEQ ID NO: 26034 - DNA, 50 bp, homo sapien
ttcttctcatatgtatgaactctgayggtccaaacatatataagcaccag

SEQ ID NO: 26035 - DNA, 50 bp, homo sapien
acttctgaaattatcaggctagccaygcttggtaatgtgtaattaatctc

SEQ ID NO: 26036 - DNA, 50 bp, homo sapien
tctcagcttggtaatttgtaggaaawtgtgtactaatgcagagcagatga

SEQ ID NO: 26037 - DNA, 50 bp, homo sapien
tgtttgattttccttatgtgccagamggatttaaaaaaaaaaacccaaaa

SEQ ID NO: 26038 - DNA, 50 bp, homo sapien
aaatcatgcttccttacataaatccraaaacaaatatcatggaaagtttt

SEQ ID NO: 26039 - DNA, 50 bp, homo sapien
ggtggacaatgagacggaagcattamgtttggtagaataatctatattga

SEQ ID NO: 26040 - DNA, 50 bp, homo sapien
tttggactcagaggtaatccccttayggtagtgagcattatccaggtaat

SEQ ID NO: 26041 - DNA, 50 bp, homo sapien
ttgttcattggcaggcactttcaaayaggtagtcaattccaacaacacta

SEQ ID NO: 26042 - DNA, 50 bp, homo sapien
ctcaagacagtgattcaagagttcamataagttttggcaaacacaaactt

SEQ ID NO: 26043 - DNA, 50 bp, homo sapien
gcaagcgcttctattttctgaatggraacgtcaagtccgtctttgtcatg

SEQ ID NO: 26044 - DNA, 50 bp, homo sapien
tttcaaccaaaataaaaattggtcayggtcctaaatatctatctcagagg

SEQ ID NO: 26045 - DNA, 50 bp, homo sapien
tcaggctggtaaatattttaaggccracagatttctttaagttacctgct

SEQ ID NO: 26046 - DNA, 50 bp, homo sapien
acaaaatgcagataatctttatatcrattcatgtgcatttcgctctgatt

SEQ ID NO: 26047 - DNA, 50 bp, homo sapien
tactaatgaaagacatatcttattaragttgaatagtatagtaagcacat

SEQ ID NO: 26048 - DNA, 50 bp, homo sapien
gccagtcatgaggtcattttctttgsattgctatataaaactttaaaaat

SEQ ID NO: 26049 - DNA, 50 bp, homo sapien
gcactggagtttataaggaagtgaawctgttaatatatagttgtggtggg

SEQ ID NO: 26050 - DNA, 50 bp, homo sapien
atgctgacccagaccactgataatasaaaaggagaggaaaagaaaaaagc

SEQ ID NO: 26051 - DNA, 50 bp, homo sapien
ctgcaaggggcatccgtggcgaaccraaagatctctcagttgaagaccag

SEQ ID NO: 26052 - DNA, 50 bp, homo sapien
caaaatattcatgtgttttagcctastaattcctctctgggaaacaattc

SEQ ID NO: 26053 - DNA, 50 bp, homo sapien
agctagtttgggtctgctcagttaaygtatctatgctcatattttccttc

SEQ ID NO: 26054 - DNA, 50 bp, homo sapien
ttgacggtatatattatgtaatcagsactatgcctagcacattgtaaaca

SEQ ID NO: 26055 - DNA, 50 bp, homo sapien
tctgagtctttagttttgatggtaamctttttctcctgcttcttgcttct

SEQ ID NO: 26056 - DNA, 50 bp, homo sapien
cacaaaagagaaaccagtagtttaayatttgaccattcctttccttttgt

SEQ ID NO: 26057 - DNA, 50 bp, homo sapien
tatgtaataaacacctagacagaaayaaatacctagacagaaggcagtcc

SEQ ID NO: 26058 - DNA, 50 bp, homo sapien
ttgttacaacttaaaataatttggakagtcacctttactatgtttcacat

SEQ ID NO: 26059 - DNA, 50 bp, homo sapien
agaggtacaaaaagttggtttccatratcttgtctactttctagctctaa

SEQ ID NO: 26060 - DNA, 50 bp, homo sapien
attagaattgtttaaccttgcaagartactgggcttggtcaaaagaaact

SEQ ID NO: 26061 - DNA, 50 bp, homo sapien
caccatatattaaaagaactaacgcmatgccttttactcgacaaatagat

SEQ ID NO: 26062 - DNA, 50 bp, homo sapien
ttgcacataactgttttctcaagaasgcactgaagtgagctggcaaccat

SEQ ID NO: 26063 - DNA, 50 bp, homo sapien
ctccaggccagcctttaaagcctaaygtaagtaccaccacatccacgaag

SEQ ID NO: 26064 - DNA, 50 bp, homo sapien
ttttgcagtttcaaaactgaaattakcttgggtagttttatcaatatttg

SEQ ID NO: 26065 - DNA, 50 bp, homo sapien
ctcagcacatatttattataaatacragaaatagcgtggtggcgttatag

SEQ ID NO: 26066 - DNA, 50 bp, homo sapien
atacagttatctccagcacatcctgraatgataatacttcacagaatcat

SEQ ID NO: 26067 - DNA, 50 bp, homo sapien
agataccaaggaaatgggttgaaccrctacatagtctgatgctatgtgga

SEQ ID NO: 26068 - DNA, 50 bp, homo sapien
ttgcctttggagacagagctattaawgtttatctcaagactctggagaca

SEQ ID NO: 26069 - DNA, 50 bp, homo sapien
caacacttaacctctcaaaaaccacmgatttgattgctattagccttaga

SEQ ID NO: 26070 - DNA, 50 bp, homo sapien
atatttaaatttaattttcagcaacsaattttatgaattattggtgtgaa

SEQ ID NO: 26071 - DNA, 50 bp, homo sapien
aattaatttgctccattggcttgaayagtgataactataatagaaaggaa

SEQ ID NO: 26072 - DNA, 50 bp, homo sapien
agttttcagttttcatcagttttatraatgggttgacagaggaattaatt

SEQ ID NO: 26073 - DNA, 50 bp, homo sapien
ccgtccaatcacatttcaaccccgaygtagtatttccaattgtaattact

SEQ ID NO: 26074 - DNA, 50 bp, homo sapien
atcatgcagtcctcgttaatagtccragaagattgaaccagcagcttctt

SEQ ID NO: 26075 - DNA, 50 bp, homo sapien
tgcaggtcaccttgacctcaaattayagtatctcacataagacattgtta

SEQ ID NO: 26076 - DNA, 50 bp, homo sapien
taaattaccttaaacaagttcaaccygataactatgaaaaaggttacgtt

SEQ ID NO: 26077 - DNA, 50 bp, homo sapien
tttttttcaccatgttagttttatcragaatttgctcccttttaaatgta

SEQ ID NO: 26078 - DNA, 50 bp, homo sapien
gatacttttataattttgagaaatasctttagttaaccaaatgttcctaa

SEQ ID NO: 26079 - DNA, 50 bp, homo sapien
taattcatcaactttgaatatctaaytctactcataaaccaggcatttgc

SEQ ID NO: 26080 - DNA, 50 bp, homo sapien
aatttataaggacatacattttattwaactttctacagttgtgtctaata

SEQ ID NO: 26081 - DNA, 50 bp, homo sapien
tttgatttggagaacaacaaaaatayggttttcatttgttatttaatata

SEQ ID NO: 26082 - DNA, 50 bp, homo sapien
tctttagcctcagttcatggactaasgtttttatggatgataggattgcc

SEQ ID NO: 26083 - DNA, 50 bp, homo sapien
aataggttagaaaagtctatcagtgsatactgtctaatcacaaatgggta

SEQ ID NO: 26084 - DNA, 50 bp, homo sapien
aaaagattactaaaagtcactcaaartattaaattgactctcattcactt

SEQ ID NO: 26085 - DNA, 50 bp, homo sapien
ctgatagggaagcaggaatagacaaraatttgctttttctttcactctgc

SEQ ID NO: 26086 - DNA, 50 bp, homo sapien
agcatttcctgtgcaagttggctacrgactgaatacaaatgtgcacccac

SEQ ID NO: 26087 - DNA, 50 bp, homo sapien
ctcagagagtctcatacaaacagcaytccaaggtcttctctctttgttga

SEQ ID NO: 26088 - DNA, 50 bp, homo sapien
agttgaagagatagaaaattgcttayagatcatgcggcttgcagatttca

SEQ ID NO: 26089 - DNA, 50 bp, homo sapien
tgattccccaggcaaacacattacaraaaggaattcaccattatatatta

SEQ ID NO: 26090 - DNA, 50 bp, homo sapien
ccatcaatccataatttttaagataytaatgtgcaatttttcaccacaag

SEQ ID NO: 26091 - DNA, 50 bp, homo sapien
taagtagttactattattgtgtggayaatttttgctacagttgtcaaatt

SEQ ID NO: 26092 - DNA, 50 bp, homo sapien
ccaataatttttaatctcctgtgtakgcagaaataatataaaagagaata

SEQ ID NO: 26093 - DNA, 50 bp, homo sapien
atgctttagagaagggatggtggaaytctgtaatatttcatggtttgtac

SEQ ID NO: 26094 - DNA, 50 bp, homo sapien
aagaataaacataaattacagtttakatgtctgcttattatgagccatta

SEQ ID NO: 26095 - DNA, 50 bp, homo sapien
gaattatgacttctatcctatacctyacaatcctaacttgtgttttcaga

SEQ ID NO: 26096 - DNA, 50 bp, homo sapien
attgggtcttcattgactgaggtccrccatttcctttcaataagatgagt

SEQ ID NO: 26097 - DNA, 50 bp, homo sapien
ggaaatgcttttctacacataactcsataagaggattcattagaaatact

SEQ ID NO: 26098 - DNA, 50 bp, homo sapien
ataaattatttctatcttaaatgcayggtctggaagatttggagaaatga

SEQ ID NO: 26099 - DNA, 50 bp, homo sapien
atatttttatggaaaaatgattagargtaataagcggtagaaaacaaagc

SEQ ID NO: 26100 - DNA, 50 bp, homo sapien
aattagtatggcattctctgccatargtgttagtggaagaatgactttga

SEQ ID NO: 26101 - DNA, 50 bp, homo sapien
aagacaagacttttattatatcaaamaatttgagcaatatgataaggcag

SEQ ID NO: 26102 - DNA, 50 bp, homo sapien
tgtccattttgtactgaaactctgcyatttattttaaactattttcaccc

SEQ ID NO: 26103 - DNA, 50 bp, homo sapien
agtcagggtctttgcagattctaaarttatacatgaatacatcaaagtgg

SEQ ID NO: 26104 - DNA, 50 bp, homo sapien
gctctcactacccaaatgtaactcaygtcttttgagtatctgatgccaac

SEQ ID NO: 26105 - DNA, 50 bp, homo sapien
ttttcactaagtgtcctctagtatgyaagtcattataagcacaattccta

SEQ ID NO: 26106 - DNA, 50 bp, homo sapien
attctagaaactacaaaagcgagagyaaataagaacatatttatagttta

SEQ ID NO: 26107 - DNA, 50 bp, homo sapien
gccatttcccacctgttatctcctaygcttgctgccatggttttgaatca

SEQ ID NO: 26108 - DNA, 50 bp, homo sapien
aatggattagtaatgtatgcaattgraggacagctgtgagaggcccactc

SEQ ID NO: 26109 - DNA, 50 bp, homo sapien
ggaaatgagataaaataaccaagagratggggtgtgaatggaggactttt

SEQ ID NO: 26110 - DNA, 50 bp, homo sapien
aatatggtatattgcatagaggttamgagtctggtatcttattttcagag

SEQ ID NO: 26111 - DNA, 50 bp, homo sapien
cagcccattatgaacttgtcagctaygaatttaactaaaaccttttgcaa

SEQ ID NO: 26112 - DNA, 50 bp, homo sapien
tattcctgactcctatttcaagtgcrataaatcattcaataggattatgg

SEQ ID NO: 26113 - DNA, 50 bp, homo sapien
tagagtccaccacaaacctttaccaygagaaatgctcaacactattgaaa

SEQ ID NO: 26114 - DNA, 50 bp, homo sapien
gaacccttgaatgaactgaaacaaaraaacagatcatcgtctgactgcat

SEQ ID NO: 26115 - DNA, 50 bp, homo sapien
tattatttctcaagagatatatgtcratctaagttataacttttgggtat

SEQ ID NO: 26116 - DNA, 50 bp, homo sapien
acggctctcccaatgttatcttcaargaatgcacaaatctattttcctcc

SEQ ID NO: 26117 - DNA, 50 bp, homo sapien
ggagaaggctgttaatgccataagarcaaaggaagaaagggaaacaaaca

SEQ ID NO: 26118 - DNA, 50 bp, homo sapien
aatggatttaggaagcctgtggacayatccaacaatccagtgtttcctct

SEQ ID NO: 26119 - DNA, 50 bp, homo sapien
aatgtggggcttgtaaatacaggaaytggacaagtgttagcaacatgaaa

SEQ ID NO: 26120 - DNA, 50 bp, homo sapien
ggagtctgctagtactagattaggaktcccaggattagagtaaatccatg

SEQ ID NO: 26121 - DNA, 50 bp, homo sapien
actgggatagcccagattccttcaarttatcaagagagagcaggacagtt

SEQ ID NO: 26122 - DNA, 50 bp, homo sapien
agggtgtaggcaactagataaatcaktctaaccaaatagttcacttatag

SEQ ID NO: 26123 - DNA, 50 bp, homo sapien
tttcctttgtattataaagattccartatgatttatgttatttgtaacaa

SEQ ID NO: 26124 - DNA, 50 bp, homo sapien
gatgctttagaaaatcttgataaagscaaattattaaaaactgttgctaa

SEQ ID NO: 26125 - DNA, 50 bp, homo sapien
aaagcccctttaaaatcttcagaacycttggtccacaaactgattctatc

SEQ ID NO: 26126 - DNA, 50 bp, homo sapien
gaataggatatgagctccctctgggycataacagaaccttgggttttgta

SEQ ID NO: 26127 - DNA, 50 bp, homo sapien
gctgtcctgatttcaatgcaaactastaaatatcactgctgagaaactca

SEQ ID NO: 26128 - DNA, 50 bp, homo sapien
agtgagcaatttctatggttctaaamtgtgtgtaaactgcctcggttaca

SEQ ID NO: 26129 - DNA, 50 bp, homo sapien
aactgtagcaattcttaataataaaraggattcattttctggttaagaga

SEQ ID NO: 26130 - DNA, 50 bp, homo sapien
ctgggtagtatttgttttacttgaartatgtttcccaggaatataaatga

SEQ ID NO: 26131 - DNA, 50 bp, homo sapien
taatgtagctggtgtgtggacaatcygaatatgaaggtgttatggtacag

SEQ ID NO: 26132 - DNA, 50 bp, homo sapien
gaataataattttcttttcagcatgrcatatgagaacttaacatttgatg

SEQ ID NO: 26133 - DNA, 50 bp, homo sapien
ggatagccagtgtacatgattcagcrtaatctgtttttcaatttcagtat

SEQ ID NO: 26134 - DNA, 50 bp, homo sapien
acacagtggctcccttggaaaccgargaaatgagacttagacatgtcaca

SEQ ID NO: 26135 - DNA, 50 bp, homo sapien
ctcctttaatttctgctctctgatgkagaacatacctaatcccaaagcca

SEQ ID NO: 26136 - DNA, 50 bp, homo sapien
aatagctttaaattaggttttagtaygctccacttttggattacctttta

SEQ ID NO: 26137 - DNA, 50 bp, homo sapien
tctattaatgcacatgactatgaatsaaatcatatttttaaaaaagtttg

SEQ ID NO: 26138 - DNA, 50 bp, homo sapien
cagaaaccagactttgagtggcaaartggtagactgagctttgaaagaag

SEQ ID NO: 26139 - DNA, 50 bp, homo sapien
caactgtttgaaaaaagatagaataygtttatcctcatggcttattaata

SEQ ID NO: 26140 - DNA, 50 bp, homo sapien
ttgcttctgatgattattgaaatgartaaggatttaatatacactcttgg

SEQ ID NO: 26141 - DNA, 50 bp, homo sapien
cacaagtattttggatagtaatcaayaaaaccaatcaggtcccaggtatg

SEQ ID NO: 26142 - DNA, 50 bp, homo sapien
atgaagcattacatttcttttggaaytatgggttttataactatcttact

SEQ ID NO: 26143 - DNA, 50 bp, homo sapien
acaattactgttctgcaatcataaartttaagccagaaatgtaatggact

SEQ ID NO: 26144 - DNA, 50 bp, homo sapien
ttaagtagagaacagtcttgtattakgtaaccattcagaaaagtatagaa

SEQ ID NO: 26145 - DNA, 50 bp, homo sapien
ttggcatgtctgctgagacaaatcayggacaacatgtctctcagcaacaa

SEQ ID NO: 26146 - DNA, 50 bp, homo sapien
agggtgtatgcttttgtacttgtgayggagatacagtaatccttggagca

SEQ ID NO: 26147 - DNA, 50 bp, homo sapien
aagtaatttgattgttaattacaaamgcgcagggtgattgctctgcataa

SEQ ID NO: 26148 - DNA, 50 bp, homo sapien
aatagtactgtttcattgctgtaaamctatatttcatgacaagacaatat

SEQ ID NO: 26149 - DNA, 50 bp, homo sapien
atataatgagtggtcagtaagaaggrccaatatttaatgaatatagtttt

SEQ ID NO: 26150 - DNA, 50 bp, homo sapien
tgtaccttcagagagtcatcaaagargtcgaaacagacaaccacaattat

SEQ ID NO: 26151 - DNA, 50 bp, homo sapien
attatcacattcaatccccatgacartaactctgtaagttaaacatttct

SEQ ID NO: 26152 - DNA, 50 bp, homo sapien
gtctaatcaattcatatttctggaayacactagatgtacaactcttcact

SEQ ID NO: 26153 - DNA, 50 bp, homo sapien
ctaggaagaaagacccagctacacartgcaagtattatgatgatgattcc

SEQ ID NO: 26154 - DNA, 50 bp, homo sapien
caaactgttttataatgagactcacrattcactgtaattttgtgcctgga

SEQ ID NO: 26155 - DNA, 50 bp, homo sapien
aaatagagccctgaatctttgttaartcaatcaagtttgattagcctaaa

SEQ ID NO: 26156 - DNA, 50 bp, homo sapien
aataaattagcttcacagagtacccragagactgaggaattcgaatttag

SEQ ID NO: 26157 - DNA, 50 bp, homo sapien
ggtgaatcagcctggtagagaattasaaaaaggtgctcagtcctctaagc

SEQ ID NO: 26158 - DNA, 50 bp, homo sapien
tttttgtgctaaaagcattctgtagraactagaggtatctgaatgtgttt

SEQ ID NO: 26159 - DNA, 50 bp, homo sapien
aactgaggaaccagcatgatccaacragcagctacagatggttcttcttg

SEQ ID NO: 26160 - DNA, 50 bp, homo sapien
tgtgattaattttgctttaaattaaytaggcttctccaacaacaaatgaa

SEQ ID NO: 26161 - DNA, 50 bp, homo sapien
atacaaatgattctctcaataaaatrataatctaagccaagcttgtccaa

SEQ ID NO: 26162 - DNA, 50 bp, homo sapien
gagatagtctaaagatataaaaataygagatcagataaaaggctaggaaa

SEQ ID NO: 26163 - DNA, 50 bp, homo sapien
attacacacaagggaatgtcctataygactatcagtagatttctcagcag

SEQ ID NO: 26164 - DNA, 50 bp, homo sapien
aatgatactaacgtctttgagataayggctttgagaaatcaattaagatg

SEQ ID NO: 26165 - DNA, 50 bp, homo sapien
tcctgtcaatgatgttacagtgagamtctaatattgtattaaacccatgc

SEQ ID NO: 26166 - DNA, 50 bp, homo sapien
agagtgtgtccaagtttacggactaygagctgaaggcctatgccaaagca

SEQ ID NO: 26167 - DNA, 50 bp, homo sapien
ttcagaaatgtgtagccttagacacraagcctagtagtttagaagtaatg

SEQ ID NO: 26168 - DNA, 50 bp, homo sapien
gcctccagaaaatctcagcaaataayattagtcattgccagattatccaa

SEQ ID NO: 26169 - DNA, 50 bp, homo sapien
acaattattaaattgctgctaaatakcctccagaaaatctcagcaaataa

SEQ ID NO: 26170 - DNA, 50 bp, homo sapien
actttaatgcagttaagataagttcmaagatgattcagtagaaggaacaa

SEQ ID NO: 26171 - DNA, 50 bp, homo sapien
tcttcatattatttctgtattattarctagattgacaataccacataagt

SEQ ID NO: 26172 - DNA, 50 bp, homo sapien
tgggaagatactgtgacatccataaygtttcagccataagtccagtgtaa

SEQ ID NO: 26173 - DNA, 50 bp, homo sapien
attatagtatgttccagtaagtatayagcaaatccttaagaactccttcc

SEQ ID NO: 26174 - DNA, 50 bp, homo sapien
attgaacatgtaaggtgactggttasatataaagatgagagcattcaaga

SEQ ID NO: 26175 - DNA, 50 bp, homo sapien
cctactggaaagagaaaatgtaatakgatgagagttagtttgcataggaa

SEQ ID NO: 26176 - DNA, 50 bp, homo sapien
gccattacttcaaagaaggtatatarggaccaattctctcacccacatta

SEQ ID NO: 26177 - DNA, 50 bp, homo sapien
tgaagtgatgagataaaagtgcaaayctttgagagtaaatgagatagtct

SEQ ID NO: 26178 - DNA, 50 bp, homo sapien
taggcagcccctcaggtaggctttcragtaggaaagttacccaggtactc

SEQ ID NO: 26179 - DNA, 50 bp, homo sapien
gggggaaaagctttaagagttctgaygcctatttaagtaaattaactctt

SEQ ID NO: 26180 - DNA, 50 bp, homo sapien
ctttcccttcccaaatgcaacaatargatgacaatagtgccatttctgat

SEQ ID NO: 26181 - DNA, 50 bp, homo sapien
atgtaagttaacaagtagagacaaaycattgtttaattatcacataagct

SEQ ID NO: 26182 - DNA, 50 bp, homo sapien
caaatttttaagtcaacagatgttaragtcacaaattccagcaccaacat

SEQ ID NO: 26183 - DNA, 50 bp, homo sapien
ttataatatagaaatgacagaatctraagtccaagaactggataccttct

SEQ ID NO: 26184 - DNA, 50 bp, homo sapien
tgagatcttagggcaataatgtaacycaggagactatcttgctttcaaac

SEQ ID NO: 26185 - DNA, 50 bp, homo sapien
agtcagtttcctgtgaaaaatgagawaaccaaccagcatggactcctgtt

SEQ ID NO: 26186 - DNA, 50 bp, homo sapien
ctcatttaacaaaatgactcgtttarcaaaatgaaaacagcatggacaaa

SEQ ID NO: 26187 - DNA, 50 bp, homo sapien
cttactttaaaagccaatctaagagwccggctgctgctctgaatgagaac

SEQ ID NO: 26188 - DNA, 50 bp, homo sapien
aaatcagaaaaacagcctaaaaccawgacgttatctttgagaacagaaag

SEQ ID NO: 26189 - DNA, 50 bp, homo sapien
ctcgcactacatgttcctatctgtcraattaaatctttccaagcttttag

SEQ ID NO: 26190 - DNA, 50 bp, homo sapien
tgataggacttgaaactgcttgggayacaaggagagtggtgagggtgcaa

SEQ ID NO: 26191 - DNA, 50 bp, homo sapien
tctctttccttttattttgccactaraataataaactacaccaagttaca

SEQ ID NO: 26192 - DNA, 50 bp, homo sapien
ctattaaaacagtagcattcatttaygtaagtttaagaaactgggttata

SEQ ID NO: 26193 - DNA, 50 bp, homo sapien
gccattattgttatcttgttttccaygaggcttaatctagttacttcatc

SEQ ID NO: 26194 - DNA, 50 bp, homo sapien
gaagtaagtgtcaatataactgacartacaattcactggaactcatttct

SEQ ID NO: 26195 - DNA, 50 bp, homo sapien
gactgcccatgtacctcattttctcrcttccttcctccttccacacctat

SEQ ID NO: 26196 - DNA, 50 bp, homo sapien
ggttaagtcaagatccccgaagttgwagaggtcaaatacaggttaaacat

SEQ ID NO: 26197 - DNA, 50 bp, homo sapien
tttgaatagctttctttggacagagraattttgagtacttaatatttttt

SEQ ID NO: 26198 - DNA, 50 bp, homo sapien
ctctttcccagctgtaatgcagaaaytgagctacttctccagagaagatt

SEQ ID NO: 26199 - DNA, 50 bp, homo sapien
gtattaatacctatttgctcaaatcrgactgaatgccagtgtatttcaga

SEQ ID NO: 26200 - DNA, 50 bp, homo sapien
ggtgcacgtttgagcaaacaaataaygacctaagcacagtatttattgca

SEQ ID NO: 26201 - DNA, 50 bp, homo sapien
tgctcattgaggactggcttgttaamatttctctaccaggagggctagaa

SEQ ID NO: 26202 - DNA, 50 bp, homo sapien
agtgttcttaaactgaaggctaagawgagcgtaagagcatctgtaactct

SEQ ID NO: 26203 - DNA, 50 bp, homo sapien
aattctcaccctaatagaacactcaycagccaaatcctgcatgagccgtc

SEQ ID NO: 26204 - DNA, 50 bp, homo sapien
agcttgggcataaggctggaaactckattgttgaaaagactctactaaac

SEQ ID NO: 26205 - DNA, 50 bp, homo sapien
tccttatttttaaaattaaaatatcycattagtgcttgaaaataagtttt

SEQ ID NO: 26206 - DNA, 50 bp, homo sapien
tgtgtgagcttgttttatgcaattayaaggtttgcttcatgacttgtggg

SEQ ID NO: 26207 - DNA, 50 bp, homo sapien
gtaagaaaaaagagagcctattaaaytcaacaggatgagagcaacggaga

SEQ ID NO: 26208 - DNA, 50 bp, homo sapien
gagcaacggagaaattagtcattacsaactcaagaatctagagctgctcc

SEQ ID NO: 26209 - DNA, 50 bp, homo sapien
gactttaagacaaaaatcattgtgargtatagagaaggccactatatgaa

SEQ ID NO: 26210 - DNA, 50 bp, homo sapien
tacacctggattaagtatcagaagamtagtaacctgaaggtttggaacaa

SEQ ID NO: 26211 - DNA, 50 bp, homo sapien
agtcatcacaaagagcttatttatayggaatgctaatttcttttgcactt

SEQ ID NO: 26212 - DNA, 50 bp, homo sapien
atacattttttggcttgagctacaayaaaaataaagttaggaaaagctgt

SEQ ID NO: 26213 - DNA, 50 bp, homo sapien
ttaccaggaacttaatggagcagaartattaacggtatcttgtaggacag

SEQ ID NO: 26214 - DNA, 50 bp, homo sapien
tactttgcttcactttaataatcatmatctggtaggaaagagtagaagta

SEQ ID NO: 26215 - DNA, 50 bp, homo sapien
gcctgaatgacccaccatgaaataartctaactgttgctaagctatctat

SEQ ID NO: 26216 - DNA, 50 bp, homo sapien
gtgtactaaggagctaatttacaagscatacttactctgggaatatggcc

SEQ ID NO: 26217 - DNA, 50 bp, homo sapien
acacacacatacagtcacaaagaacrcagtttgtataaaagtacgaaaag

SEQ ID NO: 26218 - DNA, 50 bp, homo sapien
ccacccattctaaggatcacactatyagcatatactcgttttaattaaag

SEQ ID NO: 26219 - DNA, 50 bp, homo sapien
cgaatccaaccctaatactctctggycatattcccctcaaagacttcgtg

SEQ ID NO: 26220 - DNA, 50 bp, homo sapien
aatagaataaaatagggaaacaacartagagcacaataaacatatagttg

SEQ ID NO: 26221 - DNA, 50 bp, homo sapien
gctaagggattttcatgagtgtttgyaaatttcacctggcttttgcccta

SEQ ID NO: 26222 - DNA, 50 bp, homo sapien
gagaaaaaatggacatactcacacasgtaaaaattgacattcaccttcag

SEQ ID NO: 26223 - DNA, 50 bp, homo sapien
ttatgagagaagaggctgaaacaacyctgtgtaggacactgaccacaaat

SEQ ID NO: 26224 - DNA, 50 bp, homo sapien
gaatagtctgtccttgggcatttgastagaacagaaaacaattatctaca

SEQ ID NO: 26225 - DNA, 50 bp, homo sapien
gtgccaggttagaactgttaacgacygtagaaatgtgaagtgtgaaaagt

SEQ ID NO: 26226 - DNA, 50 bp, homo sapien
tttgtgatgaaattatcttaggcacrctttttctgataattttcacactt

SEQ ID NO: 26227 - DNA, 50 bp, homo sapien
ggtttctaattgtctttttctgatayatggaaataatggaggtctcctca

SEQ ID NO: 26228 - DNA, 50 bp, homo sapien
tggaaaatcaaggatgtaggacaacygtatcaatcctggacattaggatt

SEQ ID NO: 26229 - DNA, 50 bp, homo sapien
aaaatagaaaatgaggttctaatacrgtatgtgctatacatttctctcca

SEQ ID NO: 26230 - DNA, 50 bp, homo sapien
tttgaagtaaaattaaaaagcactaygttggaaaatcaaggatgtaggac

SEQ ID NO: 26231 - DNA, 50 bp, homo sapien
tgtaaaaaatgtgcatggatatagaytagaatttgtgaaggcaaatagca

SEQ ID NO: 26232 - DNA, 50 bp, homo sapien
tgatgaccaaagtaagaactgcccaratgccattctcacgttcctaagtc

SEQ ID NO: 26233 - DNA, 50 bp, homo sapien
catttctaatcttacttccaaaaaayagtctgcaagagtatcagaacatc

SEQ ID NO: 26234 - DNA, 50 bp, homo sapien
gagataattcaacactatgtcctcartatccaattcacggcctggctcac

SEQ ID NO: 26235 - DNA, 50 bp, homo sapien
ataaatagactaactgcttcagttgraagacaaagtcaagccattttttt

SEQ ID NO: 26236 - DNA, 50 bp, homo sapien
aaaaggagtgaagggtcagcagttayggagtaaaaatacaaagacttact

SEQ ID NO: 26237 - DNA, 50 bp, homo sapien
tgttttggaactctgtttagacatawgttagcctgtcttactctaatatc

SEQ ID NO: 26238 - DNA, 50 bp, homo sapien
tcataattctctttgaagtaaacaaygtatgaggacaggagatttgagtt

SEQ ID NO: 26239 - DNA, 50 bp, homo sapien
atgtcctcattagtacactttgcaarcaaacctactgaaaataaaacttc

SEQ ID NO: 26240 - DNA, 50 bp, homo sapien
attaattaacattgatgtcctatcamtcagacagtgcatttatagttaga

SEQ ID NO: 26241 - DNA, 50 bp, homo sapien
ctcccaaaaacattttgcatatgtcrgaaatactacccaattgattcctt

SEQ ID NO: 26242 - DNA, 50 bp, homo sapien
ggtttttcaatcacaattctcttgayctacttgagtcactatggggcagg

SEQ ID NO: 26243 - DNA, 50 bp, homo sapien
ttaatacatacacaatgcaagataakgatctaactttcttcttctgcatg

SEQ ID NO: 26244 - DNA, 50 bp, homo sapien
acttgcataaacagaggagaaataarcgtccactggatcttttccaggtt

SEQ ID NO: 26245 - DNA, 50 bp, homo sapien
gagaaaaagcaatttaacaccgatarcgttccagctcagagctccatctg

SEQ ID NO: 26246 - DNA, 50 bp, homo sapien
tcatttcttaatcattttgccatcawacctaggccatattcatgacagaa

SEQ ID NO: 26247 - DNA, 50 bp, homo sapien
atgaatcacattcacagttacagaayttaaaatggattccgtaatcaagt

SEQ ID NO: 26248 - DNA, 50 bp, homo sapien
agtcagcaagtcaaaataaaggcacrctgaaaatatacactaataaagct

SEQ ID NO: 26249 - DNA, 50 bp, homo sapien
gttcagttttttcataatgtaaatayctgtatatctgagagtaaaagtat

SEQ ID NO: 26250 - DNA, 50 bp, homo sapien
gatagaactgatcttggagaatgtasctttcatctgcagggagtggactt

SEQ ID NO: 26251 - DNA, 50 bp, homo sapien
cttgagatgtaaagttgtgattacaygtgaaaaagtctgaccatactatg

SEQ ID NO: 26252 - DNA, 50 bp, homo sapien
aaccctatgcctttcaggttttgacyctacagaataattttctgggtgcc

SEQ ID NO: 26253 - DNA, 50 bp, homo sapien
ccaacaaggacaaagatgctgtgaaytactaaatcctccaaaatagttct

SEQ ID NO: 26254 - DNA, 50 bp, homo sapien
gtgatatatgcctggaaccttattayattttagtgatactaagggaataa

SEQ ID NO: 26255 - DNA, 50 bp, homo sapien
caattggcatcttgaatttacagtgmagatgttttatactgatgtgtttt

SEQ ID NO: 26256 - DNA, 50 bp, homo sapien
ggtggtccttgtgagttatctaggamgagatggccaggaagcccttggaa

SEQ ID NO: 26257 - DNA, 50 bp, homo sapien
gcctgcatgaccttgagaaggaaacraaatgaggtaggaagttattatca

SEQ ID NO: 26258 - DNA, 50 bp, homo sapien
tctcttccattaaggatctgtgttcrctagctttttgtttgtttatggct

SEQ ID NO: 26259 - DNA, 50 bp, homo sapien
agaaagaggactttgtgcccaataarcaaaatatccattctttgcaaaca

SEQ ID NO: 26260 - DNA, 50 bp, homo sapien
atgttttactgagataaaaagatgcragttgacctacttttcaagctttt

SEQ ID NO: 26261 - DNA, 50 bp, homo sapien
taaaagcttgcaatctctcgacattraaatgggaccatgagataattaag

SEQ ID NO: 26262 - DNA, 50 bp, homo sapien
tttcatatgctcaatttcacggcaawaactaacatagataaatctactta

SEQ ID NO: 26263 - DNA, 50 bp, homo sapien
tctgttaacatgtcatctgtctagartatattttcaactctccaacagaa

SEQ ID NO: 26264 - DNA, 50 bp, homo sapien
ctgatagagcaccttagcctgcacamtaactgataaaattcatgagaaaa

SEQ ID NO: 26265 - DNA, 50 bp, homo sapien
aacaacttgagcctcataccacttayctgcaccggtagagttttcctctt

SEQ ID NO: 26266 - DNA, 50 bp, homo sapien
atttactctgcttccaggaatacctyagctgttatcaataagcagtcctt

SEQ ID NO: 26267 - DNA, 50 bp, homo sapien
ctacattaagagtgatcaattgtgaygtgcttctgacaccaggttcttga

SEQ ID NO: 26268 - DNA, 50 bp, homo sapien
taataacccccaaaaatatagactawgaacgttttaaaatttagaaaagt

SEQ ID NO: 26269 - DNA, 50 bp, homo sapien
caggacaacaagctggtatcccttayggtcaggttcattcacgatgctat

SEQ ID NO: 26270 - DNA, 50 bp, homo sapien
tcctttaacttggaatgacacacaartagaaataatcttcctgataagtt

SEQ ID NO: 26271 - DNA, 50 bp, homo sapien
gaactcagcaattgagtaaacaatamgttatctgctccataaagtgtgta

SEQ ID NO: 26272 - DNA, 50 bp, homo sapien
agctcaattttaaatttagtaacaayatgaacttgaaactatgctttggg

SEQ ID NO: 26273 - DNA, 50 bp, homo sapien
tggtgaagagaaaattctatgagaamctgtgagcagaaacagacatattt

SEQ ID NO: 26274 - DNA, 50 bp, homo sapien
ggccttgacctgtctgaaagttgaayggactatgtcttaagggcagttgt

SEQ ID NO: 26275 - DNA, 50 bp, homo sapien
gcactactagtaatgctgcattttcyattttcagtaggtatcacacatgc

SEQ ID NO: 26276 - DNA, 50 bp, homo sapien
agttgctttgcctcgggttgtatcamtagccagccattctttgactggct

SEQ ID NO: 26277 - DNA, 50 bp, homo sapien
ttccattagtcccgaaacatgttcastgaaataattatctaaaaatactt

SEQ ID NO: 26278 - DNA, 50 bp, homo sapien
aacatttattaaaagggctttaaggyataggccaagatttattcaattgc

SEQ ID NO: 26279 - DNA, 50 bp, homo sapien
gaatgcccttatgctgacatcaagcyactaaaattactctttggagccta

SEQ ID NO: 26280 - DNA, 50 bp, homo sapien
atttttgtctacaagtgtcagaaaaytcaattcaaagtgatgtaaacaac

SEQ ID NO: 26281 - DNA, 50 bp, homo sapien
gaaataaacagtcagttcccatgatyaaaaaaagtttacaactaagttgg

SEQ ID NO: 26282 - DNA, 50 bp, homo sapien
ttaaaagaatatactacgttatataygttttactacaacaaaataatatg

SEQ ID NO: 26283 - DNA, 50 bp, homo sapien
gcagagagaaatatatgtatatatargagaattgttagaagttggggaat

SEQ ID NO: 26284 - DNA, 50 bp, homo sapien
atatatttctctctgctcgggcccaratgacttttctctttctcaactta

SEQ ID NO: 26285 - DNA, 50 bp, homo sapien
agtagacactgtttcccaaatcaaamtttaggtctgcagttctgaaaatg

SEQ ID NO: 26286 - DNA, 50 bp, homo sapien
tggagacatgtaggtaatgcaggaargttaatatcacagtgggactcaat

SEQ ID NO: 26287 - DNA, 50 bp, homo sapien
tctaaaaacaagaggttgccctatarcaagtagatataatgggtactctt

SEQ ID NO: 26288 - DNA, 50 bp, homo sapien
ttagtaagctttcaaccacaatagcraagatcgtgtgttaaaggaggaac

SEQ ID NO: 26289 - DNA, 50 bp, homo sapien
tgtacctactatgtattgagaactaygcagagtatgcactgataaacagg

SEQ ID NO: 26290 - DNA, 50 bp, homo sapien
agtatggcaaaacttacagatttacraactagtgattcagaagaccaaaa

SEQ ID NO: 26291 - DNA, 50 bp, homo sapien
attttcatatccagtttttagaacastgcttgactcagaagtcatttcat

SEQ ID NO: 26292 - DNA, 50 bp, homo sapien
actgcttctggcatattttgaccagsagaaagtagtaaattagcacattt

SEQ ID NO: 26293 - DNA, 50 bp, homo sapien
gtatgtctgctatcctccatgattasaaataattgtcaaaagaaaaccca

SEQ ID NO: 26294 - DNA, 50 bp, homo sapien
aattatttctaatcatggaggatagsagacatactctgacataattattg

SEQ ID NO: 26295 - DNA, 50 bp, homo sapien
tttctgcgtaccacactaactgcaaygaacattaatatttatatgttacc

SEQ ID NO: 26296 - DNA, 50 bp, homo sapien
tcatcattataatggaaatttgacaygaggacagcattagaggagggagt

SEQ ID NO: 26297 - DNA, 50 bp, homo sapien
tcttgggtcaatataatttctaatcyctaggttgaatgggcaaaccttcc

SEQ ID NO: 26298 - DNA, 50 bp, homo sapien
gagattagaaattatattgacccaaraagcaagacttgctatatttagtc

SEQ ID NO: 26299 - DNA, 50 bp, homo sapien
gtgaaaagggctagaagtggcttcaygtcttggataattacacatttcta

SEQ ID NO: 26300 - DNA, 50 bp, homo sapien
tcaatctagtgctatcttttagcaartatttttgaattggagagtttctg

SEQ ID NO: 26301 - DNA, 50 bp, homo sapien
atacacctgtgtcacctgccaacaaygtccaaaacagacttcttaccaat

SEQ ID NO: 26302 - DNA, 50 bp, homo sapien
ttccttggaaatgatcttcagaaatraggtagatgactgagttgaaaaat

SEQ ID NO: 26303 - DNA, 50 bp, homo sapien
ataaacccattgtaagttgaaaataycatgtcagtaatgcatttaataca

SEQ ID NO: 26304 - DNA, 50 bp, homo sapien
tctttaaggtttaaaattaattcaasgtcaaagtaggccttcccgtaatt

SEQ ID NO: 26305 - DNA, 50 bp, homo sapien
atgattcatgcatttcatcttcttcraactaaaaacctttaagagccagg

SEQ ID NO: 26306 - DNA, 50 bp, homo sapien
agatcctagaagctggtgttgactgraagttttatggtaagtaccagcta

SEQ ID NO: 26307 - DNA, 50 bp, homo sapien
ctgaaaatgaatcatttatacttcayctttattgccatttgtttctatac

SEQ ID NO: 26308 - DNA, 50 bp, homo sapien
gatgtacaccccaccctttggtatgyatttcacaaaagtaggtaaaaagg

SEQ ID NO: 26309 - DNA, 50 bp, homo sapien
tctataatgtataaaatcattggctkaaatgagtgatgcaataggcttag

SEQ ID NO: 26310 - DNA, 50 bp, homo sapien
ctctttcttctggatgtaccctccaygtttttgtcatacgtttaatctct

SEQ ID NO: 26311 - DNA, 50 bp, homo sapien
caaaaacaacactgctaatctgaacratctacatggatgacaactcattg

SEQ ID NO: 26312 - DNA, 50 bp, homo sapien
tatggtttttgtccttcattctggasatatgatttatcaggttgattgat

SEQ ID NO: 26313 - DNA, 50 bp, homo sapien
aagaacagactatggggtggttaacygcaacaagaagaaaccagagatct

SEQ ID NO: 26314 - DNA, 50 bp, homo sapien
ggaaacaatcaacaatgtgagaagawaacccatacaatgggagagaatat

SEQ ID NO: 26315 - DNA, 50 bp, homo sapien
gtttaactgtgttttattaaaagatsaacacaaaactcttgaaattcgtg

SEQ ID NO: 26316 - DNA, 50 bp, homo sapien
cactgcccatttcctaaatatctgamaagacccttgaggccacccatccc

SEQ ID NO: 26317 - DNA, 50 bp, homo sapien
atctagcagacaggtgaacatgcaaygagaaactcagggcagaagtcaca

SEQ ID NO: 26318 - DNA, 50 bp, homo sapien
agtgaggctggatttgccctggggartattggtttctcttcaccaaccca

SEQ ID NO: 26319 - DNA, 50 bp, homo sapien
acattagcttatctatgctcatcacrggtcctaatgaacacagtttaacc

SEQ ID NO: 26320 - DNA, 50 bp, homo sapien
tctactcacctgcgggccacatatayctcctgaaaacagatacctagaaa

SEQ ID NO: 26321 - DNA, 50 bp, homo sapien
atcactatgttgctgatttaatttcratttgtggtcaaccacaacactcc

SEQ ID NO: 26322 - DNA, 50 bp, homo sapien
aagtgggtttggagtctggcaaaaaytttgaaggacctgatgaatgttga

SEQ ID NO: 26323 - DNA, 50 bp, homo sapien
tcaatagatctgaaagtcttaactamatcaatgcaaatagaaagtttgaa

SEQ ID NO: 26324 - DNA, 50 bp, homo sapien
cctcctgctgttttatttaacaaaakggctagctagaggcaggcagcagc

SEQ ID NO: 26325 - DNA, 50 bp, homo sapien
tttaatcactggatcctcttccttayagtttactctgaagtgaaaatagt

SEQ ID NO: 26326 - DNA, 50 bp, homo sapien
ggtctatccaagaacccaataaataygtactgcataaataaatcagatgt

SEQ ID NO: 26327 - DNA, 50 bp, homo sapien
actgcatctatttgtgagattgcaartaaggtttggtccatgcttccatt

SEQ ID NO: 26328 - DNA, 50 bp, homo sapien
ggaacataattagaaaagccagagaygtttttgagcataattccaaaatg

SEQ ID NO: 26329 - DNA, 50 bp, homo sapien
attcagtggactgttattgttcctaygcatactaactttatgaatcattc

SEQ ID NO: 26330 - DNA, 50 bp, homo sapien
taggtcaagttttaaaatgttgataygtgaccaaaagggagtactactta

SEQ ID NO: 26331 - DNA, 50 bp, homo sapien
tatttgttgattttgtgtcattaaayttaaaatccaacttcatgagccca

SEQ ID NO: 26332 - DNA, 50 bp, homo sapien
tctttataataagaaagcgtgagtawaattgatgacattacagaaaaaag

SEQ ID NO: 26333 - DNA, 50 bp, homo sapien
tcagcacacatcgtacaagggaattsaagttatctgtatctttataacct

SEQ ID NO: 26334 - DNA, 50 bp, homo sapien
tttctattttggatcctgtttctgakaatttttttcagtcaactgaaacc

SEQ ID NO: 26335 - DNA, 50 bp, homo sapien
gaaaaagataaatagaaaagccttgmaatatttggaaattatacagtgca

SEQ ID NO: 26336 - DNA, 50 bp, homo sapien
tgagttttagagctgtttcctgtaaygagagaggaggaaggaagaggaga

SEQ ID NO: 26337 - DNA, 50 bp, homo sapien
tactgatttacaataagatatcaatsaaaagtaactcttaagtctttaat

SEQ ID NO: 26338 - DNA, 50 bp, homo sapien
attattcttatttttatacaattcascagcttaatcaaaaacaaactact

SEQ ID NO: 26339 - DNA, 50 bp, homo sapien
attgtgttgataaaagtggaattcaygattagcaaagtaataagaaaagt

SEQ ID NO: 26340 - DNA, 50 bp, homo sapien
ggatagatgctcactggatgtctgakaactttgagagaccgaaaaagaag

SEQ ID NO: 26341 - DNA, 50 bp, homo sapien
caaatcttaatgcacaacatgatcartaacaaatagtgagaagtaaacac

SEQ ID NO: 26342 - DNA, 50 bp, homo sapien
tggaagtttacagtctaagagaggaycaagcaaggttacagttgaaggga

SEQ ID NO: 26343 - DNA, 50 bp, homo sapien
aaaggtcatcattgagtgtgttataytaaatgcaggagctagtgattgtt

SEQ ID NO: 26344 - DNA, 50 bp, homo sapien
acttcctctgtttaaaagtattaatracgtggagcactttgtatgggtct

SEQ ID NO: 26345 - DNA, 50 bp, homo sapien
tctgagacttgttcctgaattaacartggaaaccagagagaatgcaaggc

SEQ ID NO: 26346 - DNA, 50 bp, homo sapien
ggattatatcacaataaagcataaaycatcaattgtgttaagaaaaagta

SEQ ID NO: 26347 - DNA, 50 bp, homo sapien
caatgcatggtatataaacactcaasaagaacaactatatttttcttaca

SEQ ID NO: 26348 - DNA, 50 bp, homo sapien
tcctccactgtttctcttcacttccrccattatttagatgcccaagtcca

SEQ ID NO: 26349 - DNA, 50 bp, homo sapien
tgggaaaaaaaaaaaaaaacaacagratagtgcaataacatggaagctaa

SEQ ID NO: 26350 - DNA, 50 bp, homo sapien
taattgcttcaaaataaattgaagaygattgttgaaaattatgacttccc

SEQ ID NO: 26351 - DNA, 50 bp, homo sapien
atgctattctgtctctgtcctcttcsaaattttacttcttctatcagtaa

SEQ ID NO: 26352 - DNA, 50 bp, homo sapien
tgtgatagatatttctattactgcawagtcttggcaaaagagaagtttca

SEQ ID NO: 26353 - DNA, 50 bp, homo sapien
tgtttctttatggttgtattaaataygtgcttacattcttcacaacatat

SEQ ID NO: 26354 - DNA, 50 bp, homo sapien
gcataatggaatagtataactggaaytggtgggttgtactgatttacaat

SEQ ID NO: 26355 - DNA, 50 bp, homo sapien
attgaaagctaagattctagtgaaamacaaaatgcatggtttaaaaattg

SEQ ID NO: 26356 - DNA, 50 bp, homo sapien
gtaattaacagtttacattactagascaattatttccatttttatatatt

SEQ ID NO: 26357 - DNA, 50 bp, homo sapien
tcaatgaagtagatattttatcacayctgtgttcatttgggactgctaat

SEQ ID NO: 26358 - DNA, 50 bp, homo sapien
cttctttctcccatttttatgccacrataactgcccagtcttattgttgc

SEQ ID NO: 26359 - DNA, 50 bp, homo sapien
cgtggcattacctccagcaacagtcrataacaggattatttttggaaaaa

SEQ ID NO: 26360 - DNA, 50 bp, homo sapien
tgaaaggtcctagaatttgcctttayagcaagtgaagcacttggtgagaa

SEQ ID NO: 26361 - DNA, 50 bp, homo sapien
gcaagtattaaccgcgacatggtaaygacaaacacagaggatcgtgcagg

SEQ ID NO: 26362 - DNA, 50 bp, homo sapien
acccaaacactgtgtggccagaaacmattaacacactctagcccagaata

SEQ ID NO: 26363 - DNA, 50 bp, homo sapien
ctgtgtttgctgtttcataattagcrcctagaacatggctatgcctaacg

SEQ ID NO: 26364 - DNA, 50 bp, homo sapien
caaaagccacgtttgaaatgtaaacraggaatatgtgtagaaagtgctcc

SEQ ID NO: 26365 - DNA, 50 bp, homo sapien
tgaattctgattattggtgtaactcragtcacaagtgacagtggaatgaa

SEQ ID NO: 26366 - DNA, 50 bp, homo sapien
gcatttatacatccatcattttcagkattgttggtaaccacagcctattt

SEQ ID NO: 26367 - DNA, 50 bp, homo sapien
ggatttacaagctatgtactgtctawcctctagtacggtttataacatca

SEQ ID NO: 26368 - DNA, 50 bp, homo sapien
ttttcaatacaacacacagtctggaratcccaaaagaattcttcaaaaat

SEQ ID NO: 26369 - DNA, 50 bp, homo sapien
ctgaaaagtgaattagaagctgtacmatatcatcattagaaattctgcat

SEQ ID NO: 26370 - DNA, 50 bp, homo sapien
tatccacttttaatttcatctcataytacagagaaaatattatttgaaac

SEQ ID NO: 26371 - DNA, 50 bp, homo sapien
ttctacttatggtatgttaccacctyacaatacaaaggaatataacaata

SEQ ID NO: 26372 - DNA, 50 bp, homo sapien
acaactgccaggaactagccaattarctgtcaatctatctatgttcatac

SEQ ID NO: 26373 - DNA, 50 bp, homo sapien
atagaaattaattgtgctatacccayggttgctattttcaaagatttatg

SEQ ID NO: 26374 - DNA, 50 bp, homo sapien
aacgttttatataagcaggactcaarttagttaagagagtttattatgta

SEQ ID NO: 26375 - DNA, 50 bp, homo sapien
agtcttctaagctaatcttacatcartatcagaatgccaggccaggcgcg

SEQ ID NO: 26376 - DNA, 50 bp, homo sapien
gaaatcaccaagctatgaaatatacmacgaagctaatgtgccacacagct

SEQ ID NO: 26377 - DNA, 50 bp, homo sapien
tgaattgtatcattgccaagcatackgagaagacttcagggatatttgtg

SEQ ID NO: 26378 - DNA, 50 bp, homo sapien
ggtaaaggataaagttgcctaacaawcatacttcatgaaatcaaatttca

SEQ ID NO: 26379 - DNA, 50 bp, homo sapien
cagtccttaatgatgtgctatttgaygaagaaataggagactaccttgag

SEQ ID NO: 26380 - DNA, 50 bp, homo sapien
gccatcatgaactttaatctgattayggtcctaaaactacttcttcacga

SEQ ID NO: 26381 - DNA, 50 bp, homo sapien
attcctaaaagaatttctatagtccyatatgctaagtgtttggtcatagc

SEQ ID NO: 26382 - DNA, 50 bp, homo sapien
atcaaaccattccctttggccttagracattgaaagtctgttctagctcc

SEQ ID NO: 26383 - DNA, 50 bp, homo sapien
tgtaaaccaattgtcaggcttagaastgaattaagagtggtcattttcag

SEQ ID NO: 26384 - DNA, 50 bp, homo sapien
tatgaggtgctatgcgagatactcasggcttttttcccagtgcagttcag

SEQ ID NO: 26385 - DNA, 50 bp, homo sapien
atgctaacaagtatggtaaccctacrcagaatcaaggaccagtcttccca

SEQ ID NO: 26386 - DNA, 50 bp, homo sapien
tcatcagaattaacccattgacccawatggatctttgacacttcctaagt

SEQ ID NO: 26387 - DNA, 50 bp, homo sapien
attcgctgggacttaagaaaggagayatttaagagaaaacgtagatacta

SEQ ID NO: 26388 - DNA, 50 bp, homo sapien
gcttgatattcctcatctggattcayggtcagttcttcatcagctcataa

SEQ ID NO: 26389 - DNA, 50 bp, homo sapien
attttttcagcatagcttccattccrctctccaccctgctgctggcttca

SEQ ID NO: 26390 - DNA, 50 bp, homo sapien
atacactttgggaaaagaaacttaaygtaagagctccagacatgaaaata

SEQ ID NO: 26391 - DNA, 50 bp, homo sapien
acaaaataataccattagatatttayatgggacctccagtgtcctcgatc

SEQ ID NO: 26392 - DNA, 50 bp, homo sapien
cctacaacacatcctttaactctcgmaaagtgaactgaatatcatcagtt

SEQ ID NO: 26393 - DNA, 50 bp, homo sapien
aaatcaatggtatttgtacatgccaktaaaaattaatcagataatgtaac

SEQ ID NO: 26394 - DNA, 50 bp, homo sapien
aaacagaaacactcacaactgaaaaygaccactcttaattcagttctaag

SEQ ID NO: 26395 - DNA, 50 bp, homo sapien
tcatatatttcaaagagcaaggatcraagtgtgagtcaagggatgataaa

SEQ ID NO: 26396 - DNA, 50 bp, homo sapien
cacattcagtttctacactgcaaaayagagggatatctgtatggcttccc

SEQ ID NO: 26397 - DNA, 50 bp, homo sapien
gaaggtatttttccataaaaaaacawtgaaatcattagctgaactggata

SEQ ID NO: 26398 - DNA, 50 bp, homo sapien
gggacatacactgaagctgaaacccrggaaacccaggcccataataagtt

SEQ ID NO: 26399 - DNA, 50 bp, homo sapien
cttgatagagtttgtccgtgaaacartctaggtttggaatatttgttgtt

SEQ ID NO: 26400 - DNA, 50 bp, homo sapien
gaagctttataaggaatgaaatgaartaactgttcttgtctctgtagttt

SEQ ID NO: 26401 - DNA, 50 bp, homo sapien
attctgatctctggctagtttctcayggctttagagggtgaaactaaagt

SEQ ID NO: 26402 - DNA, 50 bp, homo sapien
gtaccatgttgtctttatatagttayggttgagtcatactgtggtttagt

SEQ ID NO: 26403 - DNA, 50 bp, homo sapien
ctgtcagtaggtgtgttgatctgcaygaaaactcgaggagacattaattg

SEQ ID NO: 26404 - DNA, 50 bp, homo sapien
tgtttctgtcacaaaatacattccargttaaatgggaggtgccagaaaca

SEQ ID NO: 26405 - DNA, 50 bp, homo sapien
ttgctttgtgacttcattgctatacscatgttacttataatctctctgaa

SEQ ID NO: 26406 - DNA, 50 bp, homo sapien
tgaaaaaaaataatcttcctgaaaarttcatttagtcccctaaagtcata

SEQ ID NO: 26407 - DNA, 50 bp, homo sapien
caagaagggaactcagaaaaagaackggcctatttataagcagggattca

SEQ ID NO: 26408 - DNA, 50 bp, homo sapien
cccactgttgatgggaaagtaagtayaactataatggaaaatagtatgga

SEQ ID NO: 26409 - DNA, 50 bp, homo sapien
aggttctagttaatgttaaaactgaktcaaaagcaagttagggattccgc

SEQ ID NO: 26410 - DNA, 50 bp, homo sapien
tatgtaagcttgggtttatttggaaktgtatgtagtagttctttgttatc

SEQ ID NO: 26411 - DNA, 50 bp, homo sapien
taaagcgtctaattctaagcaagatwatcattaaacagaaattataggta

SEQ ID NO: 26412 - DNA, 50 bp, homo sapien
tgatctagataaaataggaatcaatyaaaatctaacaaaaaggagaaata

SEQ ID NO: 26413 - DNA, 50 bp, homo sapien
agaaagacaaatagagcttactagaygacttttatttttcaaatcctctc

SEQ ID NO: 26414 - DNA, 50 bp, homo sapien
catcagtcattttgggtgtaagtgamggtctacaattacagctgtcaaga

SEQ ID NO: 26415 - DNA, 50 bp, homo sapien
tctgcagaaactcagtcctggttcartctaacaattcagtctcttgctac

SEQ ID NO: 26416 - DNA, 50 bp, homo sapien
ctacatataaataatacagacaatamgagggtaaatgtgattgagctact

SEQ ID NO: 26417 - DNA, 50 bp, homo sapien
tttataaaagcaggagagtaaacaarggaaaagagtcttctagctacatg

SEQ ID NO: 26418 - DNA, 50 bp, homo sapien
aactagatcagcagttctgagtaagragttgaataaatggatcaaaatgt

SEQ ID NO: 26419 - DNA, 50 bp, homo sapien
gcctgtacatttaaatacatgttacrctacttatcacaaggctgaattct

SEQ ID NO: 26420 - DNA, 50 bp, homo sapien
atggaactaattctcatttcagaacrgataagatccagcaaaagtttttt

SEQ ID NO: 26421 - DNA, 50 bp, homo sapien
gatatttatgttctgttctttactargtgcttcattaaatatgtggtcaa

SEQ ID NO: 26422 - DNA, 50 bp, homo sapien
gtggagggattggagccagctgaagycagagttgtgaagttctgcttaga

SEQ ID NO: 26423 - DNA, 50 bp, homo sapien
ctcacaacagaacactgactgactcmatcttgtttggtaataaggagctg

SEQ ID NO: 26424 - DNA, 50 bp, homo sapien
tcatcactgtctatcctgcttcaatkatctatttatctaccattagccaa

SEQ ID NO: 26425 - DNA, 50 bp, homo sapien
attacttaaagacaagggtagtaagyattacaaattctgctggcaagagt

SEQ ID NO: 26426 - DNA, 50 bp, homo sapien
ataatagcctctgcaagatcctctayaaatttcaaaggtatgagaatgcc

SEQ ID NO: 26427 - DNA, 50 bp, homo sapien
aaacctcagttaaccacaagtctcargagctattaatattaaactatgcc

SEQ ID NO: 26428 - DNA, 50 bp, homo sapien
aaccaagggaaatgagaagcaggaaygtagctcacaggtcagagccaaat

SEQ ID NO: 26429 - DNA, 50 bp, homo sapien
ttcctgcagtttatgttccataacayggcagttgattagaaagatgtagt

SEQ ID NO: 26430 - DNA, 50 bp, homo sapien
acaacaaaaaaaataaggtacatgamaatggttatagtaactgacaataa

SEQ ID NO: 26431 - DNA, 50 bp, homo sapien
ccaaagagattatccctgaaaagaargtgtcggtggtgcctcctaaaaag

SEQ ID NO: 26432 - DNA, 50 bp, homo sapien
tgtcaaaatgaaggaacacttatcayctgtaatgtgaatctttgtctccc

SEQ ID NO: 26433 - DNA, 50 bp, homo sapien
acaacaaaaagacctacagggcaatyattcttcacatggcaatgatattt

SEQ ID NO: 26434 - DNA, 50 bp, homo sapien
tagactttagcaaaattcatgtaccyatattacttaagattaagttcact

SEQ ID NO: 26435 - DNA, 50 bp, homo sapien
ccacaggagatatgatattagtgaaytgggtattataggaatagtaacta

SEQ ID NO: 26436 - DNA, 50 bp, homo sapien
taagccaggactttcagacaattaargatgttgagtcacttgttctgggg

SEQ ID NO: 26437 - DNA, 50 bp, homo sapien
tatggtcacttgtagtgactcagagsacccttccaccctatgtttgctac

SEQ ID NO: 26438 - DNA, 50 bp, homo sapien
atgtcctccaagtgctttgttgctcratcctctggactttgttgatgtat

SEQ ID NO: 26439 - DNA, 50 bp, homo sapien
attaagaaaataattacagaagtaasaaagacgactcaatcagtgtagct

SEQ ID NO: 26440 - DNA, 50 bp, homo sapien
tctatttctgtaagagaagtaggtasaatgtattaggcatgtaatattct

SEQ ID NO: 26441 - DNA, 50 bp, homo sapien
agagtgttttgatgatatacatttgsattgattctattggagacacaggg

SEQ ID NO: 26442 - DNA, 50 bp, homo sapien
tggcattaattaactattgatttagrcctaactggtcctttccttaccaa

SEQ ID NO: 26443 - DNA, 50 bp, homo sapien
gaaaaaatccctactgagcaaactayagcatctagatttagtggtcatac

SEQ ID NO: 26444 - DNA, 50 bp, homo sapien
tgccgatgtcagccttcatctgcacrcccttaaattaggagggaataggc

SEQ ID NO: 26445 - DNA, 50 bp, homo sapien
cagccacctaatcatacaaatgttcrctgaccgggggtataatctaagaa

SEQ ID NO: 26446 - DNA, 50 bp, homo sapien
tccagaattaataacaattacaacartattcagaaattcagcctgatcta

SEQ ID NO: 26447 - DNA, 50 bp, homo sapien
tcttacatcaaggagcaaaaactgaraattataatgacaacatttgggaa

SEQ ID NO: 26448 - DNA, 50 bp, homo sapien
ggttctcaataacacaccacacctaycttctgatctcttacatcaaggag

SEQ ID NO: 26449 - DNA, 50 bp, homo sapien
tagagctgggtctgtcgtttgaaaayaatgccaataataatgataccctg

SEQ ID NO: 26450 - DNA, 50 bp, homo sapien
ttggttcaggcattttttccacacasagttcagaaatatactatggaaag

SEQ ID NO: 26451 - DNA, 50 bp, homo sapien
tctaagctttattagttggacttaaygtcttaaacacatctctgcttcct

SEQ ID NO: 26452 - DNA, 50 bp, homo sapien
gttctaggcctactaaaaagcatgaytacaattgcagttgcaggcactgt

SEQ ID NO: 26453 - DNA, 50 bp, homo sapien
cagtttcacttttgagttcatcttasatccagggagtattttatcaaaga

SEQ ID NO: 26454 - DNA, 50 bp, homo sapien
gagagttgaaaagggctgcaagaagsaagaatgtaagttattaatatcac

SEQ ID NO: 26455 - DNA, 50 bp, homo sapien
gaagggatacttaatccttggaatakaagtaggagtctcttaggtggaaa

SEQ ID NO: 26456 - DNA, 50 bp, homo sapien
tagttagcatcaatcaacattttagsacataagacataatgcaacaagtc

SEQ ID NO: 26457 - DNA, 50 bp, homo sapien
ttctcctatgaccaaacttgttgagyccggttaggcaaaattgtaacaag

SEQ ID NO: 26458 - DNA, 50 bp, homo sapien
taagcctgatttgttttttatttaayggctacagagtaagtgaatcttcc

SEQ ID NO: 26459 - DNA, 50 bp, homo sapien
ttgaaaaatatttgtacatgactaaktaaagcgtattcctaaagcttttt

SEQ ID NO: 26460 - DNA, 50 bp, homo sapien
gattaggtcactaataagactgttaygacagaaagaaacaccaaaagctc

SEQ ID NO: 26461 - DNA, 50 bp, homo sapien
ctggcattgtgcaaatactatctgcwctgtgttaacatagcaatcactat

SEQ ID NO: 26462 - DNA, 50 bp, homo sapien
attctattctgggtcactgttaggcrcaacatcccattgagctgtgatga

SEQ ID NO: 26463 - DNA, 50 bp, homo sapien
agtttttatttctctaggctaaatawgtaggaataggatcactgggttat

SEQ ID NO: 26464 - DNA, 50 bp, homo sapien
ccccacaggtctatcttatacttgamatgtaggtgaacactgagtcctgt

SEQ ID NO: 26465 - DNA, 50 bp, homo sapien
atggcattttccagctaaaagatcargattcagatttaggcttatcaatt

SEQ ID NO: 26466 - DNA, 50 bp, homo sapien
ttaacgccaagcactgtaattggcayagaggattttagttaatatctctt

SEQ ID NO: 26467 - DNA, 50 bp, homo sapien
caacatttagggacaatgtatctcaygcttaattacttgtggtattaatg

SEQ ID NO: 26468 - DNA, 50 bp, homo sapien
agtaacaacatttactgcacagttayagtatgaagaaatgttaagaaata

SEQ ID NO: 26469 - DNA, 50 bp, homo sapien
tgaaacaaagaaatgaggttagatamgttttattctctcctagtaaacac

SEQ ID NO: 26470 - DNA, 50 bp, homo sapien
ggaataaggtatgttactctacttcrataaatgcacagattaaaactcaa

SEQ ID NO: 26471 - DNA, 50 bp, homo sapien
agcctatttgtagcctaggataagayaaatacaacatctcagcagtccct

SEQ ID NO: 26472 - DNA, 50 bp, homo sapien
aatcaggcatcttgtggagatggcaygaagttcccatagttcatcaaaat

SEQ ID NO: 26473 - DNA, 50 bp, homo sapien
gctgtgtagattgtctattataacartatatttcactgtcatttctggta

SEQ ID NO: 26474 - DNA, 50 bp, homo sapien
aggaatttgaaaatggttcaactaastggttctggctctgggtgttttat

SEQ ID NO: 26475 - DNA, 50 bp, homo sapien
aaggagaagagggcactttttctccraggatttagaggacacatggaaga

SEQ ID NO: 26476 - DNA, 50 bp, homo sapien
ttctgcatggtattaatagctgtcaygggataagggctctgtcaaataaa

SEQ ID NO: 26477 - DNA, 50 bp, homo sapien
gacagctattaataccatgcagaacrcacttcagggtgatttcttgattc

SEQ ID NO: 26478 - DNA, 50 bp, homo sapien
acgtaaggattattctcagaatttawgttcagattataaaattatctcat

SEQ ID NO: 26479 - DNA, 50 bp, homo sapien
tacaaacctcattttccatattaagracctaagacctacagaccttaaaa

SEQ ID NO: 26480 - DNA, 50 bp, homo sapien
tgacatattttagatcaactagcaarcctcaaaacaatttcactttaaca

SEQ ID NO: 26481 - DNA, 50 bp, homo sapien
gttgaagttcattataaaatgttcaytacttaagtcatattgttcagatt

SEQ ID NO: 26482 - DNA, 50 bp, homo sapien
tactaagtatttattgagctactacraagttaaacaatatgcgggactct

SEQ ID NO: 26483 - DNA, 50 bp, homo sapien
tgaaaactagaatttataattttacwaatcggattctccttttagatatg

SEQ ID NO: 26484 - DNA, 50 bp, homo sapien
atcccagagaagcccacagtgtaaamggcagccatgggactcaggataag

SEQ ID NO: 26485 - DNA, 50 bp, homo sapien
atcagggacactccatgattctaaaygacccttaggcttgggttttaaaa

SEQ ID NO: 26486 - DNA, 50 bp, homo sapien
gctgccaggatgatctaaaatacaayctcagtctcttttttaaaagcttc

SEQ ID NO: 26487 - DNA, 50 bp, homo sapien
attccctttattccagcaaaatcagragaattgggtaaccaacagaggct

SEQ ID NO: 26488 - DNA, 50 bp, homo sapien
tgctgctcagctactgatgctaaaaygcgagaatggaaatggaattagtc

SEQ ID NO: 26489 - DNA, 50 bp, homo sapien
ctacaataaataaaccaagttcagaracaaagaagtcaaagcgaaaatat

SEQ ID NO: 26490 - DNA, 50 bp, homo sapien
ggtctgcaggttctcagtttaagcaygtaagtctagtcaaataggacgtg

SEQ ID NO: 26491 - DNA, 50 bp, homo sapien
ggttatattaaaatggcatcaaaccrgagtcatgtacttttaatgtgtat

SEQ ID NO: 26492 - DNA, 50 bp, homo sapien
ctcttgattcttaagatgctctaacwcccatttcttaaacagagttggac

SEQ ID NO: 26493 - DNA, 50 bp, homo sapien
tgcctcagactcccaagtaatgaacrctttgcagaactgacattgttaag

SEQ ID NO: 26494 - DNA, 50 bp, homo sapien
cactcagacttccattagcttagtayctcacagcaacagccttactcacc

SEQ ID NO: 26495 - DNA, 50 bp, homo sapien
ttaagattccagtatatagatggaartaactcaaaaaaatcttaagttaa

SEQ ID NO: 26496 - DNA, 50 bp, homo sapien
ttgtgtgaattaaaaacactaaataygcagccaatgtttgtttaatatac

SEQ ID NO: 26497 - DNA, 50 bp, homo sapien
taaaagaatgagaaattatctctacmatttaaactaaaatgatttgccat

SEQ ID NO: 26498 - DNA, 50 bp, homo sapien
aaacgttcctcaacagccttttggartcactgagattgaataaatgttga

SEQ ID NO: 26499 - DNA, 50 bp, homo sapien
attttccatgtgtggcctccatgtcratgcttaacaatattatctcaaat

SEQ ID NO: 26500 - DNA, 50 bp, homo sapien
ttaccaaacattttagcccctgtgartaagaattgaatggaataattgat

SEQ ID NO: 26501 - DNA, 50 bp, homo sapien
aagtgaaagcaagtttattaagaaasaagcaaaaagaatggctactccat

SEQ ID NO: 26502 - DNA, 50 bp, homo sapien
atagaacctgtagttcagtacattaraagcaaaacatataagatgagaca

SEQ ID NO: 26503 - DNA, 50 bp, homo sapien
ggtgctaaaatcgatggctacatcaytagttacagagaagaagagcagcc

SEQ ID NO: 26504 - DNA, 50 bp, homo sapien
aatgtctctaagatcagacctaaacrgatatttagtaactgcatgaatcc

SEQ ID NO: 26505 - DNA, 50 bp, homo sapien
gtaatcttttcatggcttaatcaacygaaggcatcctatcatcaatggaa

SEQ ID NO: 26506 - DNA, 50 bp, homo sapien
accaaaaattgttgaatgactgccayatgtaaatactataataattaaaa

SEQ ID NO: 26507 - DNA, 50 bp, homo sapien
atggtaaagctttaactatctattayggttatacctcccaaatgagaaga

SEQ ID NO: 26508 - DNA, 50 bp, homo sapien
atggagcttttattttaagaatcagratcataaatgacttttgttagttc

SEQ ID NO: 26509 - DNA, 50 bp, homo sapien
aataaccctaaagttttcaaaattayggccagttttctctttaaaatttt

SEQ ID NO: 26510 - DNA, 50 bp, homo sapien
cctattgaactatcctactaaatgayattttgatgaccgtcaaggatgaa

SEQ ID NO: 26511 - DNA, 50 bp, homo sapien
gtggagtgtccttcttatataaaacsggtattgatagtaacgaaataaaa

SEQ ID NO: 26512 - DNA, 50 bp, homo sapien
ctatgaaatatgacactcactggacygtcactatttaatgcaacattgtt

SEQ ID NO: 26513 - DNA, 50 bp, homo sapien
tgaagggcctaagggtaaaggtaaaygtttgcagaagcctagagtagaat

SEQ ID NO: 26514 - DNA, 50 bp, homo sapien
tattcatactgtgattcctgataagwaagatctgaggtaaacagattata

SEQ ID NO: 26515 - DNA, 50 bp, homo sapien
aaagagtaaacaagaattggttaaayagaaacatcatttatcattgttat

SEQ ID NO: 26516 - DNA, 50 bp, homo sapien
taagtgtgctaaatactttattaacyatcaacacctgttatacatagtaa

SEQ ID NO: 26517 - DNA, 50 bp, homo sapien
ttgctttactcctagagtgtgtacartattaaatcctcaaataaacactt

SEQ ID NO: 26518 - DNA, 50 bp, homo sapien
ctgctttaaccttggtttacttctaygttataatctgaatacccaacttg

SEQ ID NO: 26519 - DNA, 50 bp, homo sapien
acaatgcagagatggtacattttcckatttgggtcatcataagagagctg

SEQ ID NO: 26520 - DNA, 50 bp, homo sapien
caagatgctctcagaaagatacctamcagcttcctatgtgagacataata

SEQ ID NO: 26521 - DNA, 50 bp, homo sapien
ggccttcaatgcctcatgtcaatccractccttccaaccacatcatgtgc

SEQ ID NO: 26522 - DNA, 50 bp, homo sapien
taaccatgcagagtactaagtctacratagcctgattccactgcctccca

SEQ ID NO: 26523 - DNA, 50 bp, homo sapien
ttatgtataataatgtttcttagctyaaggcactagtgtagggactaaag

SEQ ID NO: 26524 - DNA, 50 bp, homo sapien
tggtttacagttgggtacaagaccargatccaaatatttagtcacaggga

SEQ ID NO: 26525 - DNA, 50 bp, homo sapien
atcttcagcttggtctattttaatarcaaactacaatagaaatacagagg

SEQ ID NO: 26526 - DNA, 50 bp, homo sapien
aaatatagacatctgtggattaaaamgtttatagaatgatggttctgaac

SEQ ID NO: 26527 - DNA, 50 bp, homo sapien
aaatttctagatgaagctgaagagaygggatgggtttgccttcaatagag

SEQ ID NO: 26528 - DNA, 50 bp, homo sapien
ttcaacttccagctatcagagaaaartgtccctataattctataattgac

SEQ ID NO: 26529 - DNA, 50 bp, homo sapien
atttgatgtattctgattaaccagaygtgtgttacctgtttatccctgat

SEQ ID NO: 26530 - DNA, 50 bp, homo sapien
aaaattttttctggcattaccaatckgagagtcactttttatcaatatat

SEQ ID NO: 26531 - DNA, 50 bp, homo sapien
ccctctttctcttctcccaataggtraagtacgacagagctccttaggac

SEQ ID NO: 26532 - DNA, 50 bp, homo sapien
ccttgctattttgagatgttgaacaygaaagaacttttaaaagtgtacaa

SEQ ID NO: 26533 - DNA, 50 bp, homo sapien
ctgcaataataaactgtcaacagtaygctaaacagtgcttatccactctc

SEQ ID NO: 26534 - DNA, 50 bp, homo sapien
gttcaacatctcaaaatagcaagggmaaaaaacggcaatgctttaagaat

SEQ ID NO: 26535 - DNA, 50 bp, homo sapien
ctggctcagctacagcccaataggarattcctgaaaggatgtctgatcct

SEQ ID NO: 26536 - DNA, 50 bp, homo sapien
ttaggagagtcaaatgcttaagatakaggacacatgactaaaagtttcac

SEQ ID NO: 26537 - DNA, 50 bp, homo sapien
tgaaagttaccaaactcttagaaggwaatgaatatgttttccgtataatg

SEQ ID NO: 26538 - DNA, 50 bp, homo sapien
aaactattctctggtcacaaatcctraacactagccagctgccttgcaaa

SEQ ID NO: 26539 - DNA, 50 bp, homo sapien
actgagtctttcttcacttctcttayggtcaaattcacaggggcacttgg

SEQ ID NO: 26540 - DNA, 50 bp, homo sapien
tttatttctataattcgcagcatagwaccttcctagggataagctcataa

SEQ ID NO: 26541 - DNA, 50 bp, homo sapien
aaacatacaaaaatatagctaacgarcgcataaagtacacatgtaaataa

SEQ ID NO: 26542 - DNA, 50 bp, homo sapien
tgcttttctttagggcatagtcatasgtaaatcacatacacatattctgc

SEQ ID NO: 26543 - DNA, 50 bp, homo sapien
cagtgtgactaacgcgatcctctgaratttaggtgccgtgcaaaaaaaca

SEQ ID NO: 26544 - DNA, 50 bp, homo sapien
cttgaatcgtctgctataagagactyaggtaaacaaccatttgcatgaaa

SEQ ID NO: 26545 - DNA, 50 bp, homo sapien
atatggttccttttcttctgtaagayccattattgtaattctctaattat

SEQ ID NO: 26546 - DNA, 50 bp, homo sapien
cccactttccctaattcagaagacarctatcgtggccactgataaccaga

SEQ ID NO: 26547 - DNA, 50 bp, homo sapien
gtggaacaatttaactctctatttamctctacataagtgaatgctcttcc

SEQ ID NO: 26548 - DNA, 50 bp, homo sapien
ttctttcttaaataatgttaaaacarctttcataatataggatacactag

SEQ ID NO: 26549 - DNA, 50 bp, homo sapien
gacccctaaagaaataatctctatgwagaaatctcatctttgtaatacat

SEQ ID NO: 26550 - DNA, 50 bp, homo sapien
gtttactgaatggatgccaaaaatasaaatgaggaatgctgttctagccc

SEQ ID NO: 26551 - DNA, 50 bp, homo sapien
gggttcactccacctgttagcaacaytcattatttataagggagatacac

SEQ ID NO: 26552 - DNA, 50 bp, homo sapien
cagaattccacagatttgcggaagaycttttccaccattggataattttc

SEQ ID NO: 26553 - DNA, 50 bp, homo sapien
gccaaaactattttctgagatgctasaataatattttttccatttaaagc

SEQ ID NO: 26554 - DNA, 50 bp, homo sapien
gactatgtatagaaatagtctttcaktagttccacatctgggatgatcag

SEQ ID NO: 26555 - DNA, 50 bp, homo sapien
tagggctactcataatgtctagaagraagtcagtatgatagtcctggcct

SEQ ID NO: 26556 - DNA, 50 bp, homo sapien
gtctggaatacgaggcatttcagatmataagggtcatacttctactttta

SEQ ID NO: 26557 - DNA, 50 bp, homo sapien
ctccgtatgtcagctaataagataaygaaataacaaacatgttaagacta

SEQ ID NO: 26558 - DNA, 50 bp, homo sapien
ttcgttatcttattagctgacatacrgagtggtattattagtgtcgtact

SEQ ID NO: 26559 - DNA, 50 bp, homo sapien
acactaatttttttattgtgataaasaacacataacataacataaacaac

SEQ ID NO: 26560 - DNA, 50 bp, homo sapien
tagaaatagtgaggtttgagggaccyatgtcaagattttcaaatctaaat

SEQ ID NO: 26561 - DNA, 50 bp, homo sapien
ttaaatgttgaatggctattttcaaygctactacagtgtgcatctaggac

SEQ ID NO: 26562 - DNA, 50 bp, homo sapien
tattttctaggattgaatgcaatcayatactcaatgtattcatgacagaa

SEQ ID NO: 26563 - DNA, 50 bp, homo sapien
cagcatatctatagacattttctaaragtaccagctctactaggattaaa

SEQ ID NO: 26564 - DNA, 50 bp, homo sapien
agtcctgcctcttgattgattgcaayagtaggaagcagaggatgtgccct

SEQ ID NO: 26565 - DNA, 50 bp, homo sapien
gcactctcaccttcacctaactggargatttccgacgcagaaaacaaaca

SEQ ID NO: 26566 - DNA, 50 bp, homo sapien
ctaacatgtgacatccaaatagttaygttctgaaatgtgaagtatttatt

SEQ ID NO: 26567 - DNA, 50 bp, homo sapien
acaaattgaatttgtgggttgagaaytagaaacttagagggcattgacat

SEQ ID NO: 26568 - DNA, 50 bp, homo sapien
cttttcacttttgtattaaggtatarcatcttgaattattcttcagcagt

SEQ ID NO: 26569 - DNA, 50 bp, homo sapien
aagggactttaggttcattgttcagycaaatacttcaaggagaggacatt

SEQ ID NO: 26570 - DNA, 50 bp, homo sapien
tttgggtaggatgtgagaaggggagkagtacataataatgcccaatctct

SEQ ID NO: 26571 - DNA, 50 bp, homo sapien
ttgtactcagtgcagttcaacctccrataatagttattctgtatcatgct

SEQ ID NO: 26572 - DNA, 50 bp, homo sapien
attttcttttacttgtgtctattaayagggttatgtcacaccttgtcaac

SEQ ID NO: 26573 - DNA, 50 bp, homo sapien
gcaggtcaaaccaaactaaactgaartcaaattctaattaaatgttagtt

SEQ ID NO: 26574 - DNA, 50 bp, homo sapien
agtctaaatatactaattctacttayctacaatacagaatgaagattctt

SEQ ID NO: 26575 - DNA, 50 bp, homo sapien
cataactaataaataaaacaaacaawtattcatcaatattgagcaaaatg

SEQ ID NO: 26576 - DNA, 50 bp, homo sapien
acagagcaaacaagcaaaaggaatcmgaaagaagtctgaacatactttag

SEQ ID NO: 26577 - DNA, 50 bp, homo sapien
attcttaagtaataactgagcagatragtccaatataaatagcgttcaaa

SEQ ID NO: 26578 - DNA, 50 bp, homo sapien
cagtctagaaacacacttacctctcyagatcgacctcctacgatctggat

SEQ ID NO: 26579 - DNA, 50 bp, homo sapien
accatcaggtcaggctgtctgaggtraaaatttggcggaacatcagcata

SEQ ID NO: 26580 - DNA, 50 bp, homo sapien
aaactgatttcagtgcttagctgccygctatattgattttaaaatgggct

SEQ ID NO: 26581 - DNA, 50 bp, homo sapien
tgcatcctgcaaataaatgttacacrgcagttggtagctttactttgaaa

SEQ ID NO: 26582 - DNA, 50 bp, homo sapien
acatggatcactgggggggtcaagartagggtgtgtctgttacagatggc

SEQ ID NO: 26583 - DNA, 50 bp, homo sapien
taagagataatttcagtcacaaaaamtataaccctagctctcccagaata

SEQ ID NO: 26584 - DNA, 50 bp, homo sapien
tttttaaataaatacatttagagcckgagaagaacttctttaacattaaa

SEQ ID NO: 26585 - DNA, 50 bp, homo sapien
ctgaaacctcctaaagtcaaggtctwaatccacaggcaacacaatatttc

SEQ ID NO: 26586 - DNA, 50 bp, homo sapien
agtgtcttatgaaactcttttagccrccgtattgctgaaccattgacttt

SEQ ID NO: 26587 - DNA, 50 bp, homo sapien
catttaacctttgtgtggtgctaacmattagtgatcctataactaacaaa

SEQ ID NO: 26588 - DNA, 50 bp, homo sapien
gagaccactttgaaaagctgtggaayagagataacatcccataagaaaga

SEQ ID NO: 26589 - DNA, 50 bp, homo sapien
tgaccttacataacgggacttattayaaatatcagcctcctccatcccct

SEQ ID NO: 26590 - DNA, 50 bp, homo sapien
cacattttttatctttatgaatacastatctgaaagttttataaaatcta

SEQ ID NO: 26591 - DNA, 50 bp, homo sapien
aaccccccttgttaatagtcctttgsagtatgaaagccagtccagtccac

SEQ ID NO: 26592 - DNA, 50 bp, homo sapien
agacagtggatgaccagtcaataaargatgtccctatttggtgttcttca

SEQ ID NO: 26593 - DNA, 50 bp, homo sapien
gaaagttaagatcctggataattccrctgagccacagagaatggcttctt

SEQ ID NO: 26594 - DNA, 50 bp, homo sapien
tgggggaaagagtgatttcaaatatmaacctcaattagtcacaaaggcag

SEQ ID NO: 26595 - DNA, 50 bp, homo sapien
tggctaaatatagcaaagatgggacsaaatggaataaaatattactgatc

SEQ ID NO: 26596 - DNA, 50 bp, homo sapien
gggccagaatacagagggatgtgcartactcaaggtaaagtctctggcct

SEQ ID NO: 26597 - DNA, 50 bp, homo sapien
actaggcaaagcatgactttaactaraggacaatcagtaattgagaacac

SEQ ID NO: 26598 - DNA, 50 bp, homo sapien
ggaaataatgcatgtaaattcttacyatggtggctagaacactgaaggat

SEQ ID NO: 26599 - DNA, 50 bp, homo sapien
agcttttaaagcacaatatataacaytgatgaaagcagttctgatctgga

SEQ ID NO: 26600 - DNA, 50 bp, homo sapien
tactccatagagtacagctcaaaaaygatcagttatccccatcctggtca

SEQ ID NO: 26601 - DNA, 50 bp, homo sapien
acagacaacatgaacaaatcgaagcygaacaaatacttaagagttgaaga

SEQ ID NO: 26602 - DNA, 50 bp, homo sapien
caactataaaacaaaagagattttargtgatttttcattacattttacct

SEQ ID NO: 26603 - DNA, 50 bp, homo sapien
gttctggccactttttactctgtaayatctctcatctctttatactcaca

SEQ ID NO: 26604 - DNA, 50 bp, homo sapien
tttcctttaagggatttcaattatayccatgcattctttctttttctttt

SEQ ID NO: 26605 - DNA, 50 bp, homo sapien
gctttgagaaaaaaaaggaattacgraaagtggcaaatgctgacagaaag

SEQ ID NO: 26606 - DNA, 50 bp, homo sapien
atgataatcagataactgtagtagakaaagaagacactcagaaatctgct

SEQ ID NO: 26607 - DNA, 50 bp, homo sapien
agattgcccctgacattttgtgataygtttccaaaaatagactgtcaaca

SEQ ID NO: 26608 - DNA, 50 bp, homo sapien
ttttttgagttataaagttccacacrgtatttcattttaaaagactgcat

SEQ ID NO: 26609 - DNA, 50 bp, homo sapien
gtgttaatggtgtttaaacactagarctgacatgttagagatgatagatt

SEQ ID NO: 26610 - DNA, 50 bp, homo sapien
ggggtacagaagaggatatctaaaartgtgactaccataggcagatgcta

SEQ ID NO: 26611 - DNA, 50 bp, homo sapien
acaagaaaaatgataactcttaacasctattactagtagccaggctctgt

SEQ ID NO: 26612 - DNA, 50 bp, homo sapien
attctgttattttctagaaattctaygccagatccgtcacatatgcaatg

SEQ ID NO: 26613 - DNA, 50 bp, homo sapien
gcagagagcacaggtttcacacggarcgactctgagtttggatactaggg

SEQ ID NO: 26614 - DNA, 50 bp, homo sapien
cttctgatctaatctgagtgccagtwaaagtggctcttagatgaaaggct

SEQ ID NO: 26615 - DNA, 50 bp, homo sapien
cttgacagagtttaatagaccttaasaacaacagcgaaacattttcctaa

SEQ ID NO: 26616 - DNA, 50 bp, homo sapien
atataaaaactactaaggaatgagastatattatttttgtaatacttcgt

SEQ ID NO: 26617 - DNA, 50 bp, homo sapien
gatgtgacagactgcagtgtgagaaygtggtaaaatgtaattggagccaa

SEQ ID NO: 26618 - DNA, 50 bp, homo sapien
atcttttttcctttatttgttatagraagtgctttagatcttcaagattt

SEQ ID NO: 26619 - DNA, 50 bp, homo sapien
atcctttattctcttagctactacaytgattgtcctatgactaaaggtta

SEQ ID NO: 26620 - DNA, 50 bp, homo sapien
gatactctaggattctagtatactaygctggtttttagttctaaagtatt

SEQ ID NO: 26621 - DNA, 50 bp, homo sapien
tatatcaacttacaaagtatgttgamctaatacatcttatttgaatcaga

SEQ ID NO: 26622 - DNA, 50 bp, homo sapien
ctaagcctcacaaaactctactacaygcttatatccctagtacagtccct

SEQ ID NO: 26623 - DNA, 50 bp, homo sapien
acattttaatattggaacgtatatcmaactttgtaaaatatgtcttacat

SEQ ID NO: 26624 - DNA, 50 bp, homo sapien
acctaactaaggcaaaacaagtgtcragcaagattaaattggactcttct

SEQ ID NO: 26625 - DNA, 50 bp, homo sapien
accatgaaaatccagataattagtaygttcatatatatatataccacgaa

SEQ ID NO: 26626 - DNA, 50 bp, homo sapien
taatgtgtagccaaaactgaacaacwcttctctgaaagagagctaagaat

SEQ ID NO: 26627 - DNA, 50 bp, homo sapien
tattaacatattttgccagtaagaaktcaaaggcttagaaacaacgtgta

SEQ ID NO: 26628 - DNA, 50 bp, homo sapien
taaggagaaatggcagatttgaaacsgtgataggtataaatgaattgtgg

SEQ ID NO: 26629 - DNA, 50 bp, homo sapien
ttggcactgctaaaaatagctcataycaaattgagaaaactgcgttatgg

SEQ ID NO: 26630 - DNA, 50 bp, homo sapien
aaaaaaggagtgtaatcctttgtcaytaaatcctgctgcttaaaagacac

SEQ ID NO: 26631 - DNA, 50 bp, homo sapien
aactaaatgtataattaaggtctaaygccatgccacaattgagcaactta

SEQ ID NO: 26632 - DNA, 50 bp, homo sapien
gtgtttggtcttaatttgaaggagartaacttaagaatcatgtagaggat

SEQ ID NO: 26633 - DNA, 50 bp, homo sapien
atagaaagtactgataaaactagaaragtatagatctgtattacagagaa

SEQ ID NO: 26634 - DNA, 50 bp, homo sapien
agaaaaagagaagatcaagaagtacmacgttcgatgaaacactgagttat

SEQ ID NO: 26635 - DNA, 50 bp, homo sapien
tgctagggattttgtgtagagtaaamagacagtattataaacaacatcaa

SEQ ID NO: 26636 - DNA, 50 bp, homo sapien
tacattattactcttaggttagttayggcgaagagattccaacctcaata

SEQ ID NO: 26637 - DNA, 50 bp, homo sapien
taattgctttctattacaacattaarctgaaaaaaattcccttgggtcaa

SEQ ID NO: 26638 - DNA, 50 bp, homo sapien
tataatttattactcaagtaaaatargattttttccagcttttcttatct

SEQ ID NO: 26639 - DNA, 50 bp, homo sapien
ttgcccactgtgaattttatctttcraacggccaagatttttgagaggtc

SEQ ID NO: 26640 - DNA, 50 bp, homo sapien
aattctagaaaaaatgtccaacgacygcctacacttatcatacttctaca

SEQ ID NO: 26641 - DNA, 50 bp, homo sapien
actggaagatacccaagtaaaagacwatgacccatctgggatggacacag

SEQ ID NO: 26642 - DNA, 50 bp, homo sapien
acagaagccataaacataaggcagaktatctcttctccctttattctgac

SEQ ID NO: 26643 - DNA, 50 bp, homo sapien
accccatacccagagaccgcattcayaaagtaaaaagaaggagggtcctt

SEQ ID NO: 26644 - DNA, 50 bp, homo sapien
catccgtagataagactgtctaaacraagagaacgggagaccagagatgc

SEQ ID NO: 26645 - DNA, 50 bp, homo sapien
agatgcaccatgatacctcagcaatsacgtcttaataagttttataaatt

SEQ ID NO: 26646 - DNA, 50 bp, homo sapien
gtgtaccataaatattgctagttaaragcatgtatactgttgagttctac

SEQ ID NO: 26647 - DNA, 50 bp, homo sapien
tcatcattgtcaatttttatatgaarcctacttggatatttctgattaca

SEQ ID NO: 26648 - DNA, 50 bp, homo sapien
tctgaaaatgagaaatataatactayctaacttccaggatttatttaaat

SEQ ID NO: 26649 - DNA, 50 bp, homo sapien
atcacctgggagtaataaatgtgaayaactgtgctctacccctagagatt

SEQ ID NO: 26650 - DNA, 50 bp, homo sapien
gatagagccttatcaatgttctcggkacttcatctgatcctgttctacat

SEQ ID NO: 26651 - DNA, 50 bp, homo sapien
tatcacacaaatgtgaggaagtcaayatagcagtaattaagaaaaagaga

SEQ ID NO: 26652 - DNA, 50 bp, homo sapien
aaggaggccaggaaagaacattgagwaagatctcaggaggaagtcatctc

SEQ ID NO: 26653 - DNA, 50 bp, homo sapien
tagacactccaagaaatatacgaaawgtcatgaatcaaatcgaaaagtag

SEQ ID NO: 26654 - DNA, 50 bp, homo sapien
aacagagaatttggtaaacggaatcrcacattaaaattcagttcagaata

SEQ ID NO: 26655 - DNA, 50 bp, homo sapien
tactaactctttcatcatcttaaccrcattccaaagggagaaattaccaa

SEQ ID NO: 26656 - DNA, 50 bp, homo sapien
atgctgtgctttgtactgggtatgaraaggcattattaatacctacataa

SEQ ID NO: 26657 - DNA, 50 bp, homo sapien
gtctttgttatagaaaccagttgtamgacatgatacaggtaaatttctaa

SEQ ID NO: 26658 - DNA, 50 bp, homo sapien
tcacagcactttgctttggaagtcayggtgttatttatgtaggtattaat

SEQ ID NO: 26659 - DNA, 50 bp, homo sapien
cttaccaaaattgactcaagaaataractaccataattcatttttaaaaa

SEQ ID NO: 26660 - DNA, 50 bp, homo sapien
ttctgttttatacactataattttaygtagatttaaggcttgtgtataaa

SEQ ID NO: 26661 - DNA, 50 bp, homo sapien
agttagaaatttagaaattatgacaratgaaatgtaacatagtgggagag

SEQ ID NO: 26662 - DNA, 50 bp, homo sapien
tgtggcattttaaagcactataccaygcaacactgtagaaaattttgtca

SEQ ID NO: 26663 - DNA, 50 bp, homo sapien
atgtgattttacataactacatagaygtcataacggacctatgtcccctt

SEQ ID NO: 26664 - DNA, 50 bp, homo sapien
tcttttaagacaggtaagataaccaragaaggaaaataagcttttcaaat

SEQ ID NO: 26665 - DNA, 50 bp, homo sapien
tgaattaagtggaaagaatcaagtaygactcaaccactctgcttctagct

SEQ ID NO: 26666 - DNA, 50 bp, homo sapien
tcaaacaatggattgaatgtttctgyaaaatactgagtttggaaagtcag

SEQ ID NO: 26667 - DNA, 50 bp, homo sapien
tatatttcaaatgatttgggataaawtaatagttggcttaacccaaaatt

SEQ ID NO: 26668 - DNA, 50 bp, homo sapien
acaagggataaaggcattaaaaagarggataataagagttcagtcttaaa

SEQ ID NO: 26669 - DNA, 50 bp, homo sapien
taaaaacatagttcttactactagcwctaaaatattcataaaaagggaag

SEQ ID NO: 26670 - DNA, 50 bp, homo sapien
gaagtgacatacttagatcttttgayatttgtctgtggtctgccagtaga

SEQ ID NO: 26671 - DNA, 50 bp, homo sapien
ttaacataactagagtgtcaaattcratgaatataactgtgtattgggga

SEQ ID NO: 26672 - DNA, 50 bp, homo sapien
acctctggtcagttccatgaaattcracaaaaatctaactttataaccaa

SEQ ID NO: 26673 - DNA, 50 bp, homo sapien
atttttatctttgcaggagattgaargtctaaagcaataaagtcttcaac

SEQ ID NO: 26674 - DNA, 50 bp, homo sapien
aaattcgactggttgagtaattaaamtgagtttttgaaggtcaaagacat

SEQ ID NO: 26675 - DNA, 50 bp, homo sapien
aagttttgcatagatttgttaaaaaytgtatacattgttaaaaatattag

SEQ ID NO: 26676 - DNA, 50 bp, homo sapien
ttattgtagaggtatattagtcttcyccttgctcatttgtagaagaaagc

SEQ ID NO: 26677 - DNA, 50 bp, homo sapien
tcagggagagtggaatgttgaaagcrgaaatgtcaaactgtaagttgatt

SEQ ID NO: 26678 - DNA, 50 bp, homo sapien
attgtaaattaagtagagactcagaratacacaaaatattttttgtgtaa

SEQ ID NO: 26679 - DNA, 50 bp, homo sapien
tttatttatcagcaaattgtagttayagttatttttaatactttggtctt

SEQ ID NO: 26680 - DNA, 50 bp, homo sapien
gctgtgatacctgtaatagactgcamtattgttccaagtttttacctctc

SEQ ID NO: 26681 - DNA, 50 bp, homo sapien
tttgttttaaatacagtatattgaawatgacaatggtcatattgatctct

SEQ ID NO: 26682 - DNA, 50 bp, homo sapien
caactccatacatttccaaagttccractctgaactatatcactctctct

SEQ ID NO: 26683 - DNA, 50 bp, homo sapien
tcataaaacagaaaatagagaattgmatctttgacatgaaaagtatttca

SEQ ID NO: 26684 - DNA, 50 bp, homo sapien
atagcccctgagaagtagttttgaayaagtaggaaaagtgggatatggac

SEQ ID NO: 26685 - DNA, 50 bp, homo sapien
ttatatagtgaagaatcaactaagasaaatgaaatgcattctctggtaat

SEQ ID NO: 26686 - DNA, 50 bp, homo sapien
tattaatgctgtaaatttatcttcayatatgtcacgtaagatgcattatc

SEQ ID NO: 26687 - DNA, 50 bp, homo sapien
tattggagaaaactatctcttctacwccttcagtgaaattaattctgttt

SEQ ID NO: 26688 - DNA, 50 bp, homo sapien
aagggtgcttagattaattttgttaycaataaggttgttaatgttgatgc

SEQ ID NO: 26689 - DNA, 50 bp, homo sapien
cagtgcttagctcaatgactggcccrgaagcgtcaagcactttataaatt

SEQ ID NO: 26690 - DNA, 50 bp, homo sapien
tagtgttcccattcaatattgttcasattttttgaaacacagtttatttc

SEQ ID NO: 26691 - DNA, 50 bp, homo sapien
aggcatcactatttttcaataagaartaaactgtgtttcaaaaaatctga

SEQ ID NO: 26692 - DNA, 50 bp, homo sapien
acaagcaagaagttacaacttggagycaggcattgaggccaaaattccac

SEQ ID NO: 26693 - DNA, 50 bp, homo sapien
gctaccagtgtaaatgtattcactcrccaaccaggaaggccttgcttaga

SEQ ID NO: 26694 - DNA, 50 bp, homo sapien
tccttcttttcagcatactaatgaartgatcagatagaatttttaaagta

SEQ ID NO: 26695 - DNA, 50 bp, homo sapien
attcctggacttcagtgtcttctaaygaaaatacttgctaataactattt

SEQ ID NO: 26696 - DNA, 50 bp, homo sapien
gaaactgccagcagtaagctaaatasgaaattatggctatttcatgagac

SEQ ID NO: 26697 - DNA, 50 bp, homo sapien
atagataggtaaataatataatatcrgagaatgtaagcaaatgatatgag

SEQ ID NO: 26698 - DNA, 50 bp, homo sapien
ttctgcccagtatactacaggctgtsaaaccgaaatgctatgccagctag

SEQ ID NO: 26699 - DNA, 50 bp, homo sapien
aactttagagaggagggaatgaccarctgtaactcagggtgaaagcctgt

SEQ ID NO: 26700 - DNA, 50 bp, homo sapien
ttaactttattcaattactgaaaaaytgagtcggagattttacatagggg

SEQ ID NO: 26701 - DNA, 50 bp, homo sapien
gataataatcttatcacacggaacartcaagacagaaatcactcataaga

SEQ ID NO: 26702 - DNA, 50 bp, homo sapien
tttcctagacctagtgaagaaatcartcattttccagttggttaatgtca

SEQ ID NO: 26703 - DNA, 50 bp, homo sapien
ggagacaatataggacttaagagcayaggatttggacgtagacccttatt

SEQ ID NO: 26704 - DNA, 50 bp, homo sapien
ccataataattatatgagaatgaggkataagcataaaaactgagttgtct

SEQ ID NO: 26705 - DNA, 50 bp, homo sapien
aaatttacagtcggtattcagatgasagtaaattattcagtagctgtcag

SEQ ID NO: 26706 - DNA, 50 bp, homo sapien
tgaatgaaaatgtgttccttatataygtactttagaattgactgcaggga

SEQ ID NO: 26707 - DNA, 50 bp, homo sapien
aaatataatgccaaataagcggacayccttatgttttagaactgatagat

SEQ ID NO: 26708 - DNA, 50 bp, homo sapien
gataacactgctatagtcacttcacygtagctttttaggttctgtcactg

SEQ ID NO: 26709 - DNA, 50 bp, homo sapien
ttagacaacagtctcatggaacaaaygtgttatctggcaagtctgtgccc

SEQ ID NO: 26710 - DNA, 50 bp, homo sapien
tttaaaggcctttgaacagtttaaaygaccactcaataaaatggctctgc

SEQ ID NO: 26711 - DNA, 50 bp, homo sapien
gtaaagctgcaagatattttttataratgcaaaagaggtagagattattt

SEQ ID NO: 26712 - DNA, 50 bp, homo sapien
caaatggattgttcaaaggtctctcrattctgtgatgatctaaaatctta

SEQ ID NO: 26713 - DNA, 50 bp, homo sapien
ataatttaggccattgtgttttccayctagacaattgcatcagtgcccca

SEQ ID NO: 26714 - DNA, 50 bp, homo sapien
tagtacttatttgttgatatattaartactgtctggctgtgttctaataa

SEQ ID NO: 26715 - DNA, 50 bp, homo sapien
attcttcattttctttgcaatctctmaaaaggttttgttggtttgttttt

SEQ ID NO: 26716 - DNA, 50 bp, homo sapien
ctgttatcttagttgccttaaaatcyatttatattcgcaaataacaaaag

SEQ ID NO: 26717 - DNA, 50 bp, homo sapien
gattattcatcaataaagatgagtawgcaaaggtgtttgtaataagcttc

SEQ ID NO: 26718 - DNA, 50 bp, homo sapien
tgggggactggagaaaagagtattaygtttacaatgtactaaatgtttgt

SEQ ID NO: 26719 - DNA, 50 bp, homo sapien
gcagtaagtggttgttgaataaccawgtggatataaaatacagaatccat

SEQ ID NO: 26720 - DNA, 50 bp, homo sapien
taactcaaattgcttctttacaactsaagattatagagtggtggcaaccc

SEQ ID NO: 26721 - DNA, 50 bp, homo sapien
tgtagtaacagtcatgtgcaaacctyaccttggaaaaattccccaaactt

SEQ ID NO: 26722 - DNA, 50 bp, homo sapien
gctatatattggaaataactgtatcmaaatatctactttaaattggtctt

SEQ ID NO: 26723 - DNA, 50 bp, homo sapien
aaaaaggtgttctgtttctaggaagwatgtaataggctaccacaatccag

SEQ ID NO: 26724 - DNA, 50 bp, homo sapien
cttttataatttacatgaatgaatayggaaaaggtggtggaggtagaaag

SEQ ID NO: 26725 - DNA, 50 bp, homo sapien
ggtagttctacagaggtatgtaatgratgcacttaaatttggaaatgagt

SEQ ID NO: 26726 - DNA, 50 bp, homo sapien
ctccacatgtacttctgtgagttaaratgtaagactttaaaatggtgtaa

SEQ ID NO: 26727 - DNA, 50 bp, homo sapien
cagctccccacgcaagtaattagccygaaatgtcaatagtgccactgtta

SEQ ID NO: 26728 - DNA, 50 bp, homo sapien
ctgaacaagaataaaactatgttacygaagtcctttaaatgccattttct

SEQ ID NO: 26729 - DNA, 50 bp, homo sapien
tatgtgttgtgggagtagtagataasattacagtatttaatcttcatttc

SEQ ID NO: 26730 - DNA, 50 bp, homo sapien
cactacaacttgctccgcatcagcamtaaggctattttgctttcttatca

SEQ ID NO: 26731 - DNA, 50 bp, homo sapien
tattatagcagaattgtaacccttaygtcatcagaagctgtgttagatct

SEQ ID NO: 26732 - DNA, 50 bp, homo sapien
tgtggggaacaagaaaagtgggacawctggattggacttatcaggattgg

SEQ ID NO: 26733 - DNA, 50 bp, homo sapien
caacttaatctactgttaatatgtayatcacaaattcaaaagacatacct

SEQ ID NO: 26734 - DNA, 50 bp, homo sapien
aaggctcatatctatttgtgtggtawtaataatgtagagactgatggtaa

SEQ ID NO: 26735 - DNA, 50 bp, homo sapien
attattattaccacacaaatagatawgagccttcaattttaataaatatg

SEQ ID NO: 26736 - DNA, 50 bp, homo sapien
aaggacaatctctgagctgagaatawatatcaatagaaacttcaaaactg

SEQ ID NO: 26737 - DNA, 50 bp, homo sapien
tttggaaaggctaatcagaaatccaraagaatgtaaccgtttgtgtatca

SEQ ID NO: 26738 - DNA, 50 bp, homo sapien
ttgactatcttacagcagatagtagycccacaagtaaattctctccctct

SEQ ID NO: 26739 - DNA, 50 bp, homo sapien
aaatccctgattaaactgtgaatgaygtgccattgccaaaaggataaatt

SEQ ID NO: 26740 - DNA, 50 bp, homo sapien
aattggttctagctttacatagatayaattccctttcaaattaaacatct

SEQ ID NO: 26741 - DNA, 50 bp, homo sapien
aagtaagatgacatgaaaaatgtcamaggctaatataatgtgatagttat

SEQ ID NO: 26742 - DNA, 50 bp, homo sapien
ttattctgaaaagtggttgtgattawagttgcagaattttacaaatttac

SEQ ID NO: 26743 - DNA, 50 bp, homo sapien
cataacagaagtcaagataagaagakattaagagataaatgagaaataaa

SEQ ID NO: 26744 - DNA, 50 bp, homo sapien
aaatgcagggccaacttctgcaacaygaaaagaggaactgtctttgctta

SEQ ID NO: 26745 - DNA, 50 bp, homo sapien
agtagctatcttccagtagcctggcrgaagagtagatacttactccttag

SEQ ID NO: 26746 - DNA, 50 bp, homo sapien
gattatagcattgagatgaaaatgartacgtagaatagcaataaataaat

SEQ ID NO: 26747 - DNA, 50 bp, homo sapien
ggcagagaaaatcctctgtacttagrccaatgattctttagaccaagtga

SEQ ID NO: 26748 - DNA, 50 bp, homo sapien
ctcttattgtcttacgagattttgcrgattttcttgagtaaatgtttctt

SEQ ID NO: 26749 - DNA, 50 bp, homo sapien
ttctcaattgtgttacattataagakgatcaggcaagatgtgttattaag

SEQ ID NO: 26750 - DNA, 50 bp, homo sapien
ctcttgcagtgattaagggtgtccayggaaggtctggaaggaggggtgga

SEQ ID NO: 26751 - DNA, 50 bp, homo sapien
caatgtccttatccccagaacctgcraatggtaccttacttagaaaaagg

SEQ ID NO: 26752 - DNA, 50 bp, homo sapien
ttgtaaagtttatctgctattattawctcctgaatttattttaacccctc

SEQ ID NO: 26753 - DNA, 50 bp, homo sapien
actctcttgcaacataaaactaggartagctttggactataggtattagg

SEQ ID NO: 26754 - DNA, 50 bp, homo sapien
ccttttgttctggagagagcaaggaygttggtaacacaatttctcatact

SEQ ID NO: 26755 - DNA, 50 bp, homo sapien
aagtacaatttttgttttctgtttayctatagaccagtatgagaaattgt

SEQ ID NO: 26756 - DNA, 50 bp, homo sapien
atccattctttatatgttcactcaamatcttatcaattctcatctcctaa

SEQ ID NO: 26757 - DNA, 50 bp, homo sapien
aatgtatatagaagatagacactatragttaatggaataacaaatagaat

SEQ ID NO: 26758 - DNA, 50 bp, homo sapien
agcaaaacatatgcattacccattcratattaagtttgggaacctctttt

SEQ ID NO: 26759 - DNA, 50 bp, homo sapien
cagttttagcaatcggtgaagactaygacatccttagaatatttttcacc

SEQ ID NO: 26760 - DNA, 50 bp, homo sapien
cacactctatccactctttttgtgamcagctgtcagaattgtattaccat

SEQ ID NO: 26761 - DNA, 50 bp, homo sapien
ctttggtggagccatcttactaaacrgaacatgaggaggtgatatatctt

SEQ ID NO: 26762 - DNA, 50 bp, homo sapien
aacagctccggtctgcagctctcagyacgatcgtcacagaagatgggtgg

SEQ ID NO: 26763 - DNA, 50 bp, homo sapien
ggacacagtatgaaatgaaaacgcasactgattcttcaaaaagtaggaaa

SEQ ID NO: 26764 - DNA, 50 bp, homo sapien
agaaaccaatccaagtataaaaaaaygaagtcaacttggctcagtgctta

SEQ ID NO: 26765 - DNA, 50 bp, homo sapien
aggagtaacctaagtgaatatgggawcatctaattcattatccaaaactg

SEQ ID NO: 26766 - DNA, 50 bp, homo sapien
gttctacttcttgacatgtagcttasgcaggtattttctttttcttttct

SEQ ID NO: 26767 - DNA, 50 bp, homo sapien
agcttcgtgatcatacagagatgacrgaagattcttacttgactccattt

SEQ ID NO: 26768 - DNA, 50 bp, homo sapien
ttaatataaaaagttctgtatatgayaaaagtaaaatgtaatacacttat

SEQ ID NO: 26769 - DNA, 50 bp, homo sapien
aaacacttaaaagaatgaatgttaarattaagcaacatatgactacttgc

SEQ ID NO: 26770 - DNA, 50 bp, homo sapien
cagtatgattctgtggtttgggagasacaggtggcaaaagtatgtgaagg

SEQ ID NO: 26771 - DNA, 50 bp, homo sapien
ttttgacaaaagaaaggacatcttamaaatgaattcctgaatgtacggat

SEQ ID NO: 26772 - DNA, 50 bp, homo sapien
tgtttgttttatgttaactgaaaggyccaatctttgtagcttaaatctta

SEQ ID NO: 26773 - DNA, 50 bp, homo sapien
agaaagcagaaatgatagagcaataygaaaaggactttgaaattattagt

SEQ ID NO: 26774 - DNA, 50 bp, homo sapien
tcatgtgttgaagcacaatttttcarcgttagccccaaatcatagttcca

SEQ ID NO: 26775 - DNA, 50 bp, homo sapien
tcttttcctcccatctgttttgagaygtgttgccagatctgtgcttaccc

SEQ ID NO: 26776 - DNA, 50 bp, homo sapien
aaaagcttcatgatctggaagaaaarttagctgaggtctctttctgctaa

SEQ ID NO: 26777 - DNA, 50 bp, homo sapien
gagtctcgagatctgcagtagcataygggtttgaatcaacatggatctcc

SEQ ID NO: 26778 - DNA, 50 bp, homo sapien
ttagcttctgtaaatgctccacgaaytgaacttgctgcctttgactttca

SEQ ID NO: 26779 - DNA, 50 bp, homo sapien
tatggtgggagaatcaaagaaactcratcaatgaagaaagatgaagcttt

SEQ ID NO: 26780 - DNA, 50 bp, homo sapien
gtcagcagactgaaagtaaagactcmaccaacaacgtttcatagaattgt

SEQ ID NO: 26781 - DNA, 50 bp, homo sapien
gagaacaccttgacaagacaaggccracacaggagaaaagtcctaaagag

SEQ ID NO: 26782 - DNA, 50 bp, homo sapien
gtcatttcaaagtgaatttatttcayacttggttaatagggaaatcatcc

SEQ ID NO: 26783 - DNA, 50 bp, homo sapien
ggaaaaataggtttcgttcttgccarataagacaaaggttgaaatcaatg

SEQ ID NO: 26784 - DNA, 50 bp, homo sapien
atctggagattctgccctttgctggraagaccaattgactggatgatcta

SEQ ID NO: 26785 - DNA, 50 bp, homo sapien
agattcatacctgagtatttacttayaatttagataaagcctttgttcct

SEQ ID NO: 26786 - DNA, 50 bp, homo sapien
tatgttactactgaatctttaatcawctttcaggttctgtagttgttcat

SEQ ID NO: 26787 - DNA, 50 bp, homo sapien
ggtgcttacaaatattacaagtcaakggaattattgtgatagtattagct

SEQ ID NO: 26788 - DNA, 50 bp, homo sapien
gtagatttactgatgttactaaggakgtcctgaacaatattctcagccac

SEQ ID NO: 26789 - DNA, 50 bp, homo sapien
aaattaaggtgtgcttcattgtcaayatcaccagaatttaatggcaatta

SEQ ID NO: 26790 - DNA, 50 bp, homo sapien
ttggttcaccttgaatggagtaaaayggtaacaggatcaacaaagactca

SEQ ID NO: 26791 - DNA, 50 bp, homo sapien
acaagtctatttagaatggattgtcraaacaacatctggttttgacagat

SEQ ID NO: 26792 - DNA, 50 bp, homo sapien
ggcgagggagggtgctatcttctagmaagagtatagttggctagaacccc

SEQ ID NO: 26793 - DNA, 50 bp, homo sapien
gcaggtgtgatgctttttatgtgtcmattttaccaagccatgaggtgccc

SEQ ID NO: 26794 - DNA, 50 bp, homo sapien
accttgaccatagtactattattgasagtacccagtttgtgtacttccaa

SEQ ID NO: 26795 - DNA, 50 bp, homo sapien
gagctgactgcaaaaggaattgtatraaatatgttatctgtcagaagcag

SEQ ID NO: 26796 - DNA, 50 bp, homo sapien
agtttcttccacaattgatatttcasgaaaatgacatgtggaccttggag

SEQ ID NO: 26797 - DNA, 50 bp, homo sapien
ttatagcctttttaattggcagaaartatcattaggactgttattctaaa

SEQ ID NO: 26798 - DNA, 50 bp, homo sapien
tttgtatggggacacatacttaaacragatcattctgcccctggcccctc

SEQ ID NO: 26799 - DNA, 50 bp, homo sapien
tccagtagattttgccagtttaaagrcagtagaacaattaagacatcttc

SEQ ID NO: 26800 - DNA, 50 bp, homo sapien
tggggatgggagtgtaaaatactcaractgaaagaagatgtcttaattgt

SEQ ID NO: 26801 - DNA, 50 bp, homo sapien
aagtcattactgaacatcacatttaraggagatatatatattatatagcc

SEQ ID NO: 26802 - DNA, 50 bp, homo sapien
tttgcctctgggtctttcactgaaaygcggagatgcttattcagttttta

SEQ ID NO: 26803 - DNA, 50 bp, homo sapien
accataagaatacttgagttataaaygatgtatatataaaatgcaaatac

SEQ ID NO: 26804 - DNA, 50 bp, homo sapien
tgagtttacataattcgtattcaaaytaagaccaatcttttgtaaacttg

SEQ ID NO: 26805 - DNA, 50 bp, homo sapien
taatttttagcatcttacattgagakagtcttacttgtctagtgttaaag

SEQ ID NO: 26806 - DNA, 50 bp, homo sapien
tttgtaaatgcaggagctaagttgtyaaatgccagggcaccaacaggcaa

SEQ ID NO: 26807 - DNA, 50 bp, homo sapien
tgcactgtggccacagccttgtgaawctcggaaaagatgctgatgcctga

SEQ ID NO: 26808 - DNA, 50 bp, homo sapien
agtttagagcactaaaggaaactcaratgttccactaaacaatagaattg

SEQ ID NO: 26809 - DNA, 50 bp, homo sapien
taagattgttataggaagaaaagaaracactgtacatgaaagtgtgtttt

SEQ ID NO: 26810 - DNA, 50 bp, homo sapien
gtctaataaaacagtacctatactgragatctttttccatttctattcaa

SEQ ID NO: 26811 - DNA, 50 bp, homo sapien
gtctgtttcattattcatatgccacsattttagttttcctgcttgctaaa

SEQ ID NO: 26812 - DNA, 50 bp, homo sapien
tccgtttaaattttgtaactgttgtyaaacttattagcaatgtggagaaa

SEQ ID NO: 26813 - DNA, 50 bp, homo sapien
cacagcacctcgcccagtaaatgagratgttaaataaatattattgaaag

SEQ ID NO: 26814 - DNA, 50 bp, homo sapien
gatgcagctgttgtgcggctacacayccgtcgtccagagtttttatattt

SEQ ID NO: 26815 - DNA, 50 bp, homo sapien
ttttgacctatttcttctcttgataracctttcatttatgagactaagtg

SEQ ID NO: 26816 - DNA, 50 bp, homo sapien
gttggggaggactaaaatattcctaygtgtattcaatcagtttcaaaatt

SEQ ID NO: 26817 - DNA, 50 bp, homo sapien
ataagaaaatatattggcttccaacyatcctaaatggatttcaattatct

SEQ ID NO: 26818 - DNA, 50 bp, homo sapien
tgtcaccaattctgtattgttgatcrgagagctaactgctttacagaatg

SEQ ID NO: 26819 - DNA, 50 bp, homo sapien
ccaaattatttagatagtagagaaaytgcacttcagaagtgtaaatcagc

SEQ ID NO: 26820 - DNA, 50 bp, homo sapien
gtggaaattttgaggagaatggggaragtaagaaatagttgtcatgaaag

SEQ ID NO: 26821 - DNA, 50 bp, homo sapien
catcaaggtaggcattgaagagaccratggaatgaatgataattgtacct

SEQ ID NO: 26822 - DNA, 50 bp, homo sapien
agtcaaagtcaaattcagcatgctcragtaacataaacattacttgggtg

SEQ ID NO: 26823 - DNA, 50 bp, homo sapien
aaagcaaggagaacaaatgctttaawtctgttttcatgatggaatgtgga

SEQ ID NO: 26824 - DNA, 50 bp, homo sapien
cacacatcaccttgtggatttgaacrgctcctcttcagttgtctcccaca

SEQ ID NO: 26825 - DNA, 50 bp, homo sapien
agatgatgatctgccttactcaaaartattagtggctgtgtgcttggatt

SEQ ID NO: 26826 - DNA, 50 bp, homo sapien
ttcttggctctttacattccctctarattctgcatgtaaattgaccagtc

SEQ ID NO: 26827 - DNA, 50 bp, homo sapien
gctgcttttaaactggactttgaagkatcgatggtgaaaaaagacattct

SEQ ID NO: 26828 - DNA, 50 bp, homo sapien
cctgggctctgggcctttccactgtracaatactaacccatttcaaaggc

SEQ ID NO: 26829 - DNA, 50 bp, homo sapien
aattcgaaactcagtctgttttatamggaaacaacacatttttatggggc

SEQ ID NO: 26830 - DNA, 50 bp, homo sapien
gccctttcaggattctagacatggarccaattattaattcttttgcaaag

SEQ ID NO: 26831 - DNA, 50 bp, homo sapien
atgttccaagctgccttatgaagacragcatattttgagatgcactcagt

SEQ ID NO: 26832 - DNA, 50 bp, homo sapien
ctctcttagtcatgactaatcatagracttaaccttttcaagctgcagag

SEQ ID NO: 26833 - DNA, 50 bp, homo sapien
agtgaattactgctcaccattaggayggatcatgttttaagtaacagttt

SEQ ID NO: 26834 - DNA, 50 bp, homo sapien
agatatttctcagaagtagttgatgycataaagcagacaccttccaccag

SEQ ID NO: 26835 - DNA, 50 bp, homo sapien
ccaaagatttgggaaagtttaaaaamtgattctgaaggatatggaaaaca

SEQ ID NO: 26836 - DNA, 50 bp, homo sapien
tgcatttgcattgagcacattataartcaaaggttctttactgtgaaagg

SEQ ID NO: 26837 - DNA, 50 bp, homo sapien
aacatactctaactcctggaagaaamgagatatgatgtaatttttttcat

SEQ ID NO: 26838 - DNA, 50 bp, homo sapien
cccaggctagctctggcccttggctyacatttggacattgggaaatatat

SEQ ID NO: 26839 - DNA, 50 bp, homo sapien
cataatgttcctaccatagtcttaaratgattacaccagaataactgtag

SEQ ID NO: 26840 - DNA, 50 bp, homo sapien
tactaaataactaaatctgaattacyactataagacataaagatatatgg

SEQ ID NO: 26841 - DNA, 50 bp, homo sapien
aaactgtagacagatgcttaaggaartaagaagattaaggtaccttcgag

SEQ ID NO: 26842 - DNA, 50 bp, homo sapien
caattgacttaaaagataaatacaaraacattggagctaaacttgttcaa

SEQ ID NO: 26843 - DNA, 50 bp, homo sapien
aatcttggctgtaaatcttacatgtyaagtgataaggaggggaggggcac

SEQ ID NO: 26844 - DNA, 50 bp, homo sapien
aaaaataaaaaatgaagaaaaatgaracaagtaagtgaatctgtagatac

SEQ ID NO: 26845 - DNA, 50 bp, homo sapien
aaacaatcctatgctttgaaaataaygatgggtcctttattgtctcctat

SEQ ID NO: 26846 - DNA, 50 bp, homo sapien
agttaagaggcttaagtgacttccaygttggtgagatatcattatcacta

SEQ ID NO: 26847 - DNA, 50 bp, homo sapien
gcagttgaggaagggaagtaaaatgragacagaattatcagctcaggtag

SEQ ID NO: 26848 - DNA, 50 bp, homo sapien
ctcacctccttcaaacacttagagcmctttatttgtatacttgatctgca

SEQ ID NO: 26849 - DNA, 50 bp, homo sapien
cagagatggataggtgaaagagaacsaatatagtcaaagagggctttatt

SEQ ID NO: 26850 - DNA, 50 bp, homo sapien
agtatagagaacagtctacagagaartgatgagaacattgactagtccct

SEQ ID NO: 26851 - DNA, 50 bp, homo sapien
aaagaaggcacatgttggtttattayatttcctcaaactacaatgtgtgt

SEQ ID NO: 26852 - DNA, 50 bp, homo sapien
atgctttttctaagttattgaaagasactattattttactattttactat

SEQ ID NO: 26853 - DNA, 50 bp, homo sapien
gatatgtaatgcaaagagtcttagamaaggaaacaagatgcaggccgggt

SEQ ID NO: 26854 - DNA, 50 bp, homo sapien
ctgctgttagcctgatgtatctccargttttaaaatatttaaatagatgt

SEQ ID NO: 26855 - DNA, 50 bp, homo sapien
tttaattgttaaatacagaacttgaraattaaaaatctacacataagtgt

SEQ ID NO: 26856 - DNA, 50 bp, homo sapien
tgactgtcaccacatatgattatcaracatcaccacagattccagaatgt

SEQ ID NO: 26857 - DNA, 50 bp, homo sapien
acaggataggaacttaatgtgttcaygttaaaagaaactttttcagtcat

SEQ ID NO: 26858 - DNA, 50 bp, homo sapien
aatgttcttaccttcttcattcataktaatttaagataatgtaatttttt

SEQ ID NO: 26859 - DNA, 50 bp, homo sapien
atttgttcactagtgacaacagagaracttcattagagtaacaggagaga

SEQ ID NO: 26860 - DNA, 50 bp, homo sapien
ataccagggagcctacctgtatacartaaaacgtcatttgtccttggaag

SEQ ID NO: 26861 - DNA, 50 bp, homo sapien
agctccgtaaagaacttagtcattckagtctttaagtgtggcagaaaacc

SEQ ID NO: 26862 - DNA, 50 bp, homo sapien
ataccagtccacatgaacacaattayataagtacaagaatattaattgca

SEQ ID NO: 26863 - DNA, 50 bp, homo sapien
ctacatgttagcaatttgattttggrcaaattaataaatctctgaacatt

SEQ ID NO: 26864 - DNA, 50 bp, homo sapien
tagagtttcgtgacaaaaaatatagsattgactttagactttgtaaagtg

SEQ ID NO: 26865 - DNA, 50 bp, homo sapien
gtaggttactccccttgatgctgccracataaataagtaaatattcattc

SEQ ID NO: 26866 - DNA, 50 bp, homo sapien
atgattgtgaggtaaccattgaatcraggacaaacagaaatatgtcgaaa

SEQ ID NO: 26867 - DNA, 50 bp, homo sapien
ataacaacagggactacagaaaaaartgatcatgccatctaggaataact

SEQ ID NO: 26868 - DNA, 50 bp, homo sapien
ataaaagtttggatactgccaaacaraattaaagacatgaagacatttga

SEQ ID NO: 26869 - DNA, 50 bp, homo sapien
tgtcagtctaagcatgtgaagtgtgraagtaatataggatctagtcagga

SEQ ID NO: 26870 - DNA, 32 bp, homo sapien
ctgttaatctatgttaygtcaatttcatcctc

SEQ ID NO: 26871 - DNA, 50 bp, homo sapien
ggcaatattttatcagtctttgaaaygtggactgaatgatggatatgcga

SEQ ID NO: 26872 - DNA, 50 bp, homo sapien
aaccctacattaatcaggtattatckatggacatttttgtagaccacttt

SEQ ID NO: 26873 - DNA, 50 bp, homo sapien
tgtagggatgaaaacatttgtcatayaaggacacagaggaaatcaagctc

SEQ ID NO: 26874 - DNA, 50 bp, homo sapien
gactaggtaggatgtgtatcggatayggtcacgactctcagtactgggca

SEQ ID NO: 26875 - DNA, 50 bp, homo sapien
ttcttagtaatgatcctgagtcatcraattattttctgtctggcctaagg

SEQ ID NO: 26876 - DNA, 50 bp, homo sapien
tctctagggaatgtttgcaccttcaragtaaccgatgagcttagttggta

SEQ ID NO: 26877 - DNA, 50 bp, homo sapien
tataataaaccaaggatgctcttcargttgaataaatacatacagaacaa

SEQ ID NO: 26878 - DNA, 50 bp, homo sapien
tgatcgaaagtatagtaaatacatargccggtaacatagtcatttatttt

SEQ ID NO: 26879 - DNA, 50 bp, homo sapien
taatgtctaatctactgactgtaatsaacttcttcagctttgtgattatc

SEQ ID NO: 26880 - DNA, 50 bp, homo sapien
agattcagagtggtaactgcattccraggagctgtcaggaaggatgaccg

SEQ ID NO: 26881 - DNA, 50 bp, homo sapien
ttttgactgctgtgaatatgaccacyactctaaggacagagcataaaacg

SEQ ID NO: 26882 - DNA, 50 bp, homo sapien
atattgtattcctagtgagaaaccaygggatcaattttccacagtcgtgt

SEQ ID NO: 26883 - DNA, 50 bp, homo sapien
attttgtttaaatatgttttagagcrctttattaaggaactgatatttta

SEQ ID NO: 26884 - DNA, 50 bp, homo sapien
tggataattttttttaatgtgtcaaygatttgaagctcatggataatttg

SEQ ID NO: 26885 - DNA, 50 bp, homo sapien
aagattagcccagatttaaggagtcraaaagtagattccattgcttgata

SEQ ID NO: 26886 - DNA, 50 bp, homo sapien
caaaatgtgaccttggagcttgcaamattttcacattcatgatttgtaga

SEQ ID NO: 26887 - DNA, 50 bp, homo sapien
agatatcagcttttttttgcctagaygctggattcattatgctagatgta

SEQ ID NO: 26888 - DNA, 50 bp, homo sapien
aaaataacatttctttactgtcacarcatttggtggagacattcatttat

SEQ ID NO: 26889 - DNA, 50 bp, homo sapien
cataagccacaagcatgataaccaaygtcgctttactgatgctaacaaat

SEQ ID NO: 26890 - DNA, 50 bp, homo sapien
gcttttattagcagcaacagcaaagsattttttttctattctaaggaaat

SEQ ID NO: 26891 - DNA, 50 bp, homo sapien
gtacagcaaatgaacaactttatcayatttatcaggaataaattgataat

SEQ ID NO: 26892 - DNA, 50 bp, homo sapien
caatttaggataacatcttggggtayctaatatcatttaatctctctaga

SEQ ID NO: 26893 - DNA, 50 bp, homo sapien
taacaataatatcacctaatatcackaataaaataggtttctcaaagtca

SEQ ID NO: 26894 - DNA, 50 bp, homo sapien
ggggtacctaatgtcaccttatatartaacaataatatcacctaatatca

SEQ ID NO: 26895 - DNA, 50 bp, homo sapien
ttttgaagggtgattttgccaggtasagaattctagtttggttggtttct

SEQ ID NO: 26896 - DNA, 50 bp, homo sapien
ttaatgcataaaataaagacttgaaractatacattcaaagacaggatca

SEQ ID NO: 26897 - DNA, 50 bp, homo sapien
aaaagaggagttttacagaatgagaratttatgttcagtctttagactta

SEQ ID NO: 26898 - DNA, 50 bp, homo sapien
ctttgagaacttctccttccttcagkctaaccttgtttgggtgatatacc

SEQ ID NO: 26899 - DNA, 50 bp, homo sapien
tcgcaccatgcagttagatgacatartaacagtaacgtgtccaagcggct

SEQ ID NO: 26900 - DNA, 50 bp, homo sapien
aatttatggatttcacatttattcckcaatcttggtacctgccaccatct

SEQ ID NO: 26901 - DNA, 50 bp, homo sapien
tctcctctgtgtcaggttccacagaragaatggagactaagacaccatcc

SEQ ID NO: 26902 - DNA, 50 bp, homo sapien
agccattttgttgcaaggaattatayctatatctatctatctatctatgt

SEQ ID NO: 26903 - DNA, 50 bp, homo sapien
caatgtttaattcttgatgaaattamaagttaactgatgacataactggt

SEQ ID NO: 26904 - DNA, 50 bp, homo sapien
cattccttcactaattaaattcccgmaaagctgtctcatgaatcaggtgc

SEQ ID NO: 26905 - DNA, 50 bp, homo sapien
gaagtagaaggggtttgtgtatgacycaacatgtgtctctatgcatgcat

SEQ ID NO: 26906 - DNA, 50 bp, homo sapien
cagtcaccacgatgagaagggaagcracagttataaaagtcagtcatctg

SEQ ID NO: 26907 - DNA, 50 bp, homo sapien
ttttcaatttgagtaacatcccctaraagtcatactatgagaaacaggtt

SEQ ID NO: 26908 - DNA, 50 bp, homo sapien
aaagggacccaatagttctcaatagyatgtagttcccagcaataatcaga

SEQ ID NO: 26909 - DNA, 50 bp, homo sapien
taaacataaaacattagtgctacaayacgaagaatcagatttaagctttc

SEQ ID NO: 26910 - DNA, 50 bp, homo sapien
tactttaaagaaataacactggaagkcatatatatagcactattatttgt

SEQ ID NO: 26911 - DNA, 50 bp, homo sapien
aatgctgactagcacattgaacctcrctgtaaattcactcaagttattct

SEQ ID NO: 26912 - DNA, 50 bp, homo sapien
tcttgctccctaaatcggaatttatsaagactatcccttaattctagtgc

SEQ ID NO: 26913 - DNA, 50 bp, homo sapien
tctaggaaacaacttgtatcagttargatatggcttaaaataacgactta

SEQ ID NO: 26914 - DNA, 50 bp, homo sapien
taggatagatatctgaagtatcacaytgaaagtatagaggaaagcatata

SEQ ID NO: 26915 - DNA, 50 bp, homo sapien
agcacaaatacatcatagtgggcaamcttaaataaataaattttgtcttc

SEQ ID NO: 26916 - DNA, 50 bp, homo sapien
agctgctttctctatggcctactgartattttggtagaagtttgaaaaca

SEQ ID NO: 26917 - DNA, 50 bp, homo sapien
tttctgagactccttccttgtaaacyatttcgagttctctggaatctggg

SEQ ID NO: 26918 - DNA, 50 bp, homo sapien
gtttatttttctgtttgcaatctcargtaggttagcagaaattaaatttt

SEQ ID NO: 26919 - DNA, 50 bp, homo sapien
tgtcctgtctgtctttttgtaaatcrcatagtctacctgtaggccaccca

SEQ ID NO: 26920 - DNA, 50 bp, homo sapien
tcttgacttcttgaattaacctcccragcactccatttgtttatatattg

SEQ ID NO: 26921 - DNA, 50 bp, homo sapien
gataattctgtccaataaacttaaargattgcctcgaagttccagaacat

SEQ ID NO: 26922 - DNA, 50 bp, homo sapien
ctttaacatatgcttgaataagataygcttgacaagcccagttctgctgc

SEQ ID NO: 26923 - DNA, 50 bp, homo sapien
cttgactttgcatctcagaatataartgatggcaaatactactgttatga

SEQ ID NO: 26924 - DNA, 50 bp, homo sapien
tggatcatgtctaaggctggtcaaamgacctgagatttcagtagcagatc

SEQ ID NO: 26925 - DNA, 50 bp, homo sapien
acaaacacgataaaatcagtatgtayagtaaggaattattttgtgggtta

SEQ ID NO: 26926 - DNA, 32 bp, homo sapien
atatggtacttgcttarcttatatgttttaaa

SEQ ID NO: 26927 - DNA, 50 bp, homo sapien
ataaaaagctaattataacaaacacrataaaatcagtatgtatagtaagg

SEQ ID NO: 26928 - DNA, 50 bp, homo sapien
tgattgctttagtgcaccttatatamctttgagtctctatatttcaggct

SEQ ID NO: 26929 - DNA, 50 bp, homo sapien
aaacagaaaaatgccctgcattggamagatgagaagattaagaacaatta

SEQ ID NO: 26930 - DNA, 50 bp, homo sapien
gggaaaactatgccgcaccattaagwataatacagaatttaggccagcca

SEQ ID NO: 26931 - DNA, 50 bp, homo sapien
atgttcagagaaatcaactagtccayggctatacagaaagaaagtgactt

SEQ ID NO: 26932 - DNA, 50 bp, homo sapien
aagaaatcatctccagtctctatcaygtttcaacagttctttaccccatg

SEQ ID NO: 26933 - DNA, 50 bp, homo sapien
atttctctgaacatagttctttccartgatactatgagataataatatct

SEQ ID NO: 26934 - DNA, 50 bp, homo sapien
gctgtttgaatggtgacaggatgcaygacttctgaccttggctgtatgac

SEQ ID NO: 26935 - DNA, 50 bp, homo sapien
ttcacactcttcacatgtgaagctcsaaagtaaatctgattttcttaata

SEQ ID NO: 26936 - DNA, 50 bp, homo sapien
ccttatagtctactctgttgagaaartggcaaccgttagacatgacctca

SEQ ID NO: 26937 - DNA, 50 bp, homo sapien
ctgccgtcatagttacaatatctaayaggtgctcaccagttaactaggct

SEQ ID NO: 26938 - DNA, 50 bp, homo sapien
tttgttttatagttaagaatgaatayagaattgatggaacagtgattttc

SEQ ID NO: 26939 - DNA, 50 bp, homo sapien
atgtgggcaccctcactgctatttaygttcccaatacttggaattgaatg

SEQ ID NO: 26940 - DNA, 50 bp, homo sapien
cgactcagtgcacacattaagtccaygcacaatattcctaaccggtctat

SEQ ID NO: 26941 - DNA, 50 bp, homo sapien
aataatataaaaaagacaactggaaytgacatataggaatgttgccttct

SEQ ID NO: 26942 - DNA, 50 bp, homo sapien
agtagatattttaccaaaaaattgawtcaataagtatatatcaaaacaca

SEQ ID NO: 26943 - DNA, 50 bp, homo sapien
aattgagagataatatttttcttccwcaatatgcagttagtagttagtat

SEQ ID NO: 26944 - DNA, 50 bp, homo sapien
acaccataagctatgacatctctaaygaattctgaggtacatatgattca

SEQ ID NO: 26945 - DNA, 50 bp, homo sapien
tggtaataataatgataataatgcargttatggtttaaaaataattctgt

SEQ ID NO: 26946 - DNA, 50 bp, homo sapien
tgtgaaaatgggaagactttcaagayaacagtcaacagaaaactagatga

SEQ ID NO: 26947 - DNA, 50 bp, homo sapien
aatccattcttaaatttcaagttgaytaactcataaaaataatagcaggt

SEQ ID NO: 26948 - DNA, 50 bp, homo sapien
aaaacgactaggcctatttgaaaagracctaatggaattcctgaaaaata

SEQ ID NO: 26949 - DNA, 50 bp, homo sapien
ttttcaaactaagcatacagaaactsactgtgttcactgggtagaaatgg

SEQ ID NO: 26950 - DNA, 50 bp, homo sapien
ttcatataaggtacatgcaggttatsagtcagctctctgtcgctccttct

SEQ ID NO: 26951 - DNA, 50 bp, homo sapien
ttcacttcaaggatttaagagaccakcgaactttttctctgtggtagaaa

SEQ ID NO: 26952 - DNA, 50 bp, homo sapien
cactagcactggatgggacggtttaycactactttgacaatacttgccca

SEQ ID NO: 26953 - DNA, 50 bp, homo sapien
ctgctgcttggctgctcttagaaacsacatgggaaccagggctcacaatg

SEQ ID NO: 26954 - DNA, 50 bp, homo sapien
atctaagacccagaaaaggtatctarcgtgattaagctgttatttcaagt

SEQ ID NO: 26955 - DNA, 50 bp, homo sapien
agcctaaaggaattaggttgagaaayactaacatttgtgtaccagaacaa

SEQ ID NO: 26956 - DNA, 50 bp, homo sapien
atttggcctaagtgctacttcaaaasttgtgttcatctttatgaagttaa

SEQ ID NO: 26957 - DNA, 50 bp, homo sapien
tagctgttgttatctgcatagaggtraatactaaagacagggaaatgaat

SEQ ID NO: 26958 - DNA, 50 bp, homo sapien
tatttttccctcaaagactcacataygacagcggacaaatctatcatttg

SEQ ID NO: 26959 - DNA, 50 bp, homo sapien
tgtctttggtgactatctcgtggagyatttcctaaaaccaggcataatgt

SEQ ID NO: 26960 - DNA, 50 bp, homo sapien
tgtgaatactaagatgttgcaactgkaatgaaccctctaaataattttta

SEQ ID NO: 26961 - DNA, 50 bp, homo sapien
ttccaactctgacatcctttgattcyatgaacaagtctgtactaggatag

SEQ ID NO: 26962 - DNA, 50 bp, homo sapien
ttgtagcaaatgaatcatataaagcrgatcacactctaatcaaaataaca

SEQ ID NO: 26963 - DNA, 50 bp, homo sapien
ctagatggtggatttgctggcataargtcatgaaaaaaaaaaaaggggag

SEQ ID NO: 26964 - DNA, 50 bp, homo sapien
atgctcagcttagagttgacaggtayagtatgttaccacagatgaactct

SEQ ID NO: 26965 - DNA, 50 bp, homo sapien
ttcttctgtgtctgtatttatttccsaggatttaactcagcaaacaaaaa

SEQ ID NO: 26966 - DNA, 50 bp, homo sapien
tgctatataatgaaaggcaatataaygtcagccttgcaattcagattttt

SEQ ID NO: 26967 - DNA, 50 bp, homo sapien
agagaattattaatatactacttcawgttaatagagtagcatcctgttaa

SEQ ID NO: 26968 - DNA, 50 bp, homo sapien
gggagaaatagaaaatatattatccrgctagcattagctgtctctggtct

SEQ ID NO: 26969 - DNA, 50 bp, homo sapien
cttggagaatgttccatgtacttacraaaaggatgtatattctgcagttg

SEQ ID NO: 26970 - DNA, 50 bp, homo sapien
gagggacattatataatgataaaagsattcgtccagcaggaaaatatcac

SEQ ID NO: 26971 - DNA, 50 bp, homo sapien
acagtttagaccaattttgattcacycaagaccaggcacaccactgttct

SEQ ID NO: 26972 - DNA, 50 bp, homo sapien
gcatattgttgggtcaagaaagcackattcctatttgtaaagaagaaaat

SEQ ID NO: 26973 - DNA, 50 bp, homo sapien
gcagagtaatgaagcaaaaataagaygtccagagtcaccttttaagaaaa

SEQ ID NO: 26974 - DNA, 50 bp, homo sapien
atatacaagcttatcacttgagtcayagttagaacagccataaatcctag

SEQ ID NO: 26975 - DNA, 50 bp, homo sapien
tacttggtacacatatcttcaagaamagttggaagtaattttcaacctaa

SEQ ID NO: 26976 - DNA, 50 bp, homo sapien
tgctttgtttatttatgtatttaagsctaacgttacatttatgagttgat

SEQ ID NO: 26977 - DNA, 50 bp, homo sapien
atgtaatataaaagctattgcataarttagtttttaacagttcatatcac

SEQ ID NO: 26978 - DNA, 50 bp, homo sapien
ttccacactggaatatcgtgggaccrctttatgggaagcagtttaacaaa

SEQ ID NO: 26979 - DNA, 50 bp, homo sapien
tttacaagtatataatcgattgaacractaaatattaccagttttaacaa

SEQ ID NO: 26980 - DNA, 50 bp, homo sapien
tttttaactattaaagttcatgtaawgggacttacgcccagtctccaact

SEQ ID NO: 26981 - DNA, 50 bp, homo sapien
ttaaacccttcaatttattgaaagamaattgttaatgataagttgttctg

SEQ ID NO: 26982 - DNA, 50 bp, homo sapien
aagacatggaatcaaggacctactaygttctcaaatggagagggtaccaa

SEQ ID NO: 26983 - DNA, 50 bp, homo sapien
aaacatcatatttagatgtggaaaaytcctatgatatagttctaaaaatg

SEQ ID NO: 26984 - DNA, 50 bp, homo sapien
tgagactaaaggaacttattcctcaraccctagtgaaaggtaccacaaaa

SEQ ID NO: 26985 - DNA, 50 bp, homo sapien
ccggtaagttctttagaaatatatcscgcatgtgaaaacaggatcctgaa

SEQ ID NO: 26986 - DNA, 50 bp, homo sapien
atctctgtcagtttcttggcaaatartattcgattataaatttatgctcc

SEQ ID NO: 26987 - DNA, 50 bp, homo sapien
gactctaccgtgatatactcaggctracaaagttttaatatggataatgg

SEQ ID NO: 26988 - DNA, 50 bp, homo sapien
gctctaaaatgtagattgcttatcartaaatgttaaaggaagagcagagc

SEQ ID NO: 26989 - DNA, 50 bp, homo sapien
gatgtcaaaagatatgattgagtgayctctaatttctctatgccttgtgt

SEQ ID NO: 26990 - DNA, 50 bp, homo sapien
gccactgtattagggcatcttactayaactgaaaatataaggatcattta

SEQ ID NO: 26991 - DNA, 50 bp, homo sapien
ggaattagatatttctctgattccakatattcaaccagaattaattatct

SEQ ID NO: 26992 - DNA, 50 bp, homo sapien
ttttaacttagacataatgagaaacrctacatgaaaatattaaacagatt

SEQ ID NO: 26993 - DNA, 50 bp, homo sapien
ttagaaaattacaagtggctatccasaatgtctagaatggcagtacattt

SEQ ID NO: 26994 - DNA, 50 bp, homo sapien
atctcgttctgatgttagaacagtaygtctatatgacccatcacctgccc

SEQ ID NO: 26995 - DNA, 50 bp, homo sapien
ttaaggaaaagtaaaaactggacagsaggtagatggagaagctggaggtg

SEQ ID NO: 26996 - DNA, 50 bp, homo sapien
ttttcatgtggttctttttggagaawtcagagggctgaggtcaacatcta

SEQ ID NO: 26997 - DNA, 50 bp, homo sapien
catccatgtgagaaaacttaaaaaayagttgatatcatattgagctaaaa

SEQ ID NO: 26998 - DNA, 50 bp, homo sapien
gtggctaggctggttctctcatttcyaatcgagggcctctgttgcaaaca

SEQ ID NO: 26999 - DNA, 50 bp, homo sapien
ctagccagggcaacaaagtgaaactraacctgtcattaacattaagatcc

SEQ ID NO: 27000 - DNA, 50 bp, homo sapien
gaactgtgccagacacaaaggatacraaggcagataacagccttatagaa

SEQ ID NO: 27001 - DNA, 50 bp, homo sapien
cattaaacttaatagcaaattaatarcttcattaaacttagtagcaaaat

SEQ ID NO: 27002 - DNA, 32 bp, homo sapien
cttacaaaattaatgcrcagagagtagcagat

SEQ ID NO: 27003 - DNA, 50 bp, homo sapien
tattacatgagatttgtctctaaaamaatactagtttgattatatttctg

SEQ ID NO: 27004 - DNA, 50 bp, homo sapien
gcaaagatttttatattgtaatacayctaaactgtgataattgaagatat

SEQ ID NO: 27005 - DNA, 50 bp, homo sapien
cagttcatcattagaattgagagaawgaaaatacaggggaaaaaatctat

SEQ ID NO: 27006 - DNA, 50 bp, homo sapien
aggttaaaaaaaagtaatgagaaaaragtctagaaagatacttggtacca

SEQ ID NO: 27007 - DNA, 50 bp, homo sapien
ctgataaaaaggacatgcaaggcacrgaagaagaaaaagcacccctagct

SEQ ID NO: 27008 - DNA, 50 bp, homo sapien
ttacagcctcgaagatggagttccaygatcaacaggaattgactccctct

SEQ ID NO: 27009 - DNA, 50 bp, homo sapien
actcagagtttactcctataataacragcatttttaacggttttgtccaa

SEQ ID NO: 27010 - DNA, 50 bp, homo sapien
gcccatacacagccctttctcgatayacattgatcctccaaacccaggag

SEQ ID NO: 27011 - DNA, 50 bp, homo sapien
tttttatcgcaatgggaacccgtcasgtgcctttccaattactcagtgtc

SEQ ID NO: 27012 - DNA, 50 bp, homo sapien
gtcccccgcaggattgtcaaaattargaatgatttactgtgccatttttg

SEQ ID NO: 27013 - DNA, 50 bp, homo sapien
aagcttcccaggtattagagattagyaatattgtctgctgtgttttatcc

SEQ ID NO: 27014 - DNA, 50 bp, homo sapien
gcataaatatgacttaattattgcaygggacatccttatttttaaaagtt

SEQ ID NO: 27015 - DNA, 50 bp, homo sapien
caaaatataatggctttattattgargattaaagagagaatattgggaaa

SEQ ID NO: 27016 - DNA, 50 bp, homo sapien
aatttgagggagtgaccaagatgtcwcctatgtccagtgggaggccagtc

SEQ ID NO: 27017 - DNA, 50 bp, homo sapien
agtttctgcattcaggttccagtcaygtatgaatcttcttggttctgtag

SEQ ID NO: 27018 - DNA, 50 bp, homo sapien
aggaaaaaaaggagattctgggttgsaagagaaactcaagataaacattg

SEQ ID NO: 27019 - DNA, 50 bp, homo sapien
gaatatgcaaatgtgttcagattctyactattcatattgagatactttga

SEQ ID NO: 27020 - DNA, 50 bp, homo sapien
tcttagcatataaacagtcagtatasatggcatttattaagctttatcaa

SEQ ID NO: 27021 - DNA, 50 bp, homo sapien
aaagtgcatattactctgaaaagaaytggtaatatcgagatacacaagag

SEQ ID NO: 27022 - DNA, 50 bp, homo sapien
ttagaatattccttctttaaagacaygtggattattctcatcttctaaac

SEQ ID NO: 27023 - DNA, 50 bp, homo sapien
taggatagtgtcactcttgatttccygatatttcctaatatttttggatt

SEQ ID NO: 27024 - DNA, 50 bp, homo sapien
gcgtcttcaatgtctttctcaattaycttccatctacattttctactctc

SEQ ID NO: 27025 - DNA, 50 bp, homo sapien
tttggaattatatagttgtccatatragaaacagctagatagaaaattag

SEQ ID NO: 27026 - DNA, 50 bp, homo sapien
aaaagcttgaccttgatcatttcaaratgctaacaagtttgaagtaatct

SEQ ID NO: 27027 - DNA, 50 bp, homo sapien
ggcctgcctcttacaaaagagtgaartaatcaaaatgtgctttgcttgcc

SEQ ID NO: 27028 - DNA, 50 bp, homo sapien
tcctacagtttgccagtcacaacgaygtagaaaggcttccaaatatcttg

SEQ ID NO: 27029 - DNA, 50 bp, homo sapien
tgatgtttttaggacagttttttgasgaaatcactgttacaactttttgg

SEQ ID NO: 27030 - DNA, 50 bp, homo sapien
ttccaaaaagaaagctgtaaaaagasaggctacaatgaagactgtctact

SEQ ID NO: 27031 - DNA, 50 bp, homo sapien
tggggagcatcaggtcttactattaycatcttcaagaaaagttacgtttt

SEQ ID NO: 27032 - DNA, 50 bp, homo sapien
aaaaggcttattttatagcaaataartgatgtgacaagtacaaacactga

SEQ ID NO: 27033 - DNA, 50 bp, homo sapien
acatctgctgacaagaaaccagttaygtaaagatgtgagaaatggaaatt

SEQ ID NO: 27034 - DNA, 50 bp, homo sapien
agtgcccatcatggagtgaggaacayagtaaggcttccataaatgtctgt

SEQ ID NO: 27035 - DNA, 50 bp, homo sapien
taaagattaatacatacgttaaaaaraaagtctgtcaggattcaaacagt

SEQ ID NO: 27036 - DNA, 50 bp, homo sapien
gcttgtgctgtgaggacacaggtgaygtctttaaggaccttctttcctgc

SEQ ID NO: 27037 - DNA, 50 bp, homo sapien
aaccacatttgttgaatgtctaccaygtactataatatacagcaggaaat

SEQ ID NO: 27038 - DNA, 50 bp, homo sapien
tgttttttcccctcaaaggtccagakaaaatgttatttaagtcaatgaat

SEQ ID NO: 27039 - DNA, 50 bp, homo sapien
gtttatggattatcttattaccaacmatgtcctcagatcaactcagtgat

SEQ ID NO: 27040 - DNA, 50 bp, homo sapien
tcatttgtcttttaccacatttagartagaatttactgaacaggatcata

SEQ ID NO: 27041 - DNA, 50 bp, homo sapien
gaaagtatgtcaaattttactgaaaygagcctataaggaattcaaatata

SEQ ID NO: 27042 - DNA, 50 bp, homo sapien
tcaaatgacgatgacaataattacargttatcaaaagcctattttgtgcc

SEQ ID NO: 27043 - DNA, 50 bp, homo sapien
ttgtaatttcattttttaagagagakgccatgatgtaatatagtagcaga

SEQ ID NO: 27044 - DNA, 50 bp, homo sapien
acagaattatgtgagcattgtggtaygtccagagtcccaggaatgttaag

SEQ ID NO: 27045 - DNA, 50 bp, homo sapien
ttccctcatcatcttctaatgataayatagagatcaaaactcaagtggta

SEQ ID NO: 27046 - DNA, 50 bp, homo sapien
gaggccctctccaaagaggattagamagccttatcgaaatttcattgaaa

SEQ ID NO: 27047 - DNA, 50 bp, homo sapien
tgtttggtaactgtctcctctgttaraatgtaaatttcatgacgatattg

SEQ ID NO: 27048 - DNA, 50 bp, homo sapien
ttctcagaactcagagtgaagtatartaatcttttaagttattatccaat

SEQ ID NO: 27049 - DNA, 50 bp, homo sapien
ataggattgcacccagttgaagcgayattttgaggttagtgtcaaatgtt

SEQ ID NO: 27050 - DNA, 50 bp, homo sapien
ttattttgttgttatgaagtttagawccatggctgccatctagcttccaa

SEQ ID NO: 27051 - DNA, 50 bp, homo sapien
aaagataaataagaccaaatcattascttccagatatctagaacaagtct

SEQ ID NO: 27052 - DNA, 50 bp, homo sapien
cattctgtatgtgaatttttacatcrcatctctatggtcaatgcttggat

SEQ ID NO: 27053 - DNA, 50 bp, homo sapien
ataattaaatatggcatttggtgacyatcatacattcaacaaatacgtaa

SEQ ID NO: 27054 - DNA, 50 bp, homo sapien
ctgtacaaagccagggttctctaaaygtcaatgagttgtactctgtccac

SEQ ID NO: 27055 - DNA, 50 bp, homo sapien
acatgtaattagcctactggctctasaatagtcatgatatatccattaaa

SEQ ID NO: 27056 - DNA, 50 bp, homo sapien
aagtaaaatgggagaaaaaaccttaygattgcagtaaacatagtagtaac

SEQ ID NO: 27057 - DNA, 50 bp, homo sapien
gctcccagagtttgccctgtccaagkaattcaggggaaaacgatggtggg

SEQ ID NO: 27058 - DNA, 50 bp, homo sapien
gttttattttgtattgtaaagggaasgtatcagcacttaataactgaaag

SEQ ID NO: 27059 - DNA, 50 bp, homo sapien
ttagcattagttactcagatgactayacttatctcttaacctcttaccac

SEQ ID NO: 27060 - DNA, 50 bp, homo sapien
aaggaaggagagcctactatttggcmaggttggtatatcagatgacacta

SEQ ID NO: 27061 - DNA, 50 bp, homo sapien
tccactgaatatcataatttgacacrgtgataaaaacacaaagactccat

SEQ ID NO: 27062 - DNA, 50 bp, homo sapien
tatgtatctgagtcacgcagtatcaragtatgttagtggtggcaaatctg

SEQ ID NO: 27063 - DNA, 50 bp, homo sapien
actagaggagctgaggcagttaatayggaatcaagtcagggaattgggca

SEQ ID NO: 27064 - DNA, 50 bp, homo sapien
agtttcattaatatcatgtcatccaragcaagaggtttatatcccttgtc

SEQ ID NO: 27065 - DNA, 50 bp, homo sapien
gaatatgaagattaaaaagaggaaargcattagtagtaactgtaatcttc

SEQ ID NO: 27066 - DNA, 50 bp, homo sapien
aggggagaatggacctatccagatayaatcataacatgaagcataacaag

SEQ ID NO: 27067 - DNA, 50 bp, homo sapien
cagtcttaggagatgtttctgtctayggtttcaggtttaagaagtggttg

SEQ ID NO: 27068 - DNA, 50 bp, homo sapien
acttgttgtggattaatttcttcaayatctcatcctcataattggaaaag

SEQ ID NO: 27069 - DNA, 50 bp, homo sapien
gtaatcacagaaaatggttataagaytagagttcaatataaataaaacca

SEQ ID NO: 27070 - DNA, 50 bp, homo sapien
ctcaacaaatgctgggtatccaaatwacacaggagatactacatcagggt

SEQ ID NO: 27071 - DNA, 50 bp, homo sapien
gggacaatgagggagatctgtacatkacataccatttttgcatagtgtgt

SEQ ID NO: 27072 - DNA, 50 bp, homo sapien
atcaggtgaggtcaggtacaattagracaaaatcactccgtcggcaacca

SEQ ID NO: 27073 - DNA, 50 bp, homo sapien
tatagttaactgcgtactctaacaaygtgagaactttatgtggacaagaa

SEQ ID NO: 27074 - DNA, 50 bp, homo sapien
ctcatctcttcatttctcttctttawgatctataatggacattactttgt

SEQ ID NO: 27075 - DNA, 50 bp, homo sapien
gaaatgggttgttgaggtctttgaamgttattactatttttgtgggtgtt

SEQ ID NO: 27076 - DNA, 50 bp, homo sapien
acatccaagacaaactaactttgaarcaagaggcgtgttacttaggttta

SEQ ID NO: 27077 - DNA, 50 bp, homo sapien
ggaaatgggttaaacagaataatcaratctctttaggaagagggagtgca

SEQ ID NO: 27078 - DNA, 50 bp, homo sapien
attatatttcacaaaattttattgcrcattaggaatcctggcttagcaaa

SEQ ID NO: 27079 - DNA, 50 bp, homo sapien
gtgtttaaagtaaatgttcgaaagaygatttgaaaatgccagggactgcc

SEQ ID NO: 27080 - DNA, 50 bp, homo sapien
tgccaacctatgtgaacattaactamacttggcctgtcatgaaagcttcc

SEQ ID NO: 27081 - DNA, 50 bp, homo sapien
agggtgcaaatgtgtggtagataackctgaatttgtaaagctctcaaaga

SEQ ID NO: 27082 - DNA, 50 bp, homo sapien
agtataaagcataattgagcctacayggaaaagagaaacaatatttatgt

SEQ ID NO: 27083 - DNA, 50 bp, homo sapien
gaggtggatctccttattcatcacakcatctagggttccaacaatcttca

SEQ ID NO: 27084 - DNA, 50 bp, homo sapien
ttatgtgaccatgatatacaacttaygcttcacagctgtatactatttct

SEQ ID NO: 27085 - DNA, 50 bp, homo sapien
tagggagaaatgcaacttggtcataygcaaaatacatttttaggatataa

SEQ ID NO: 27086 - DNA, 50 bp, homo sapien
ttttggctatttaagacagaggaagrataaagtcctggagaattataagc

SEQ ID NO: 27087 - DNA, 50 bp, homo sapien
agatcaaataaattcatacattagartcacagtgtaaactttataacact

SEQ ID NO: 27088 - DNA, 50 bp, homo sapien
atgtagcatggtagaaaaaagcagaygatgaacaaaaacagcaaatgaaa

SEQ ID NO: 27089 - DNA, 50 bp, homo sapien
gttataatagtaccatgtaatgcacrctgaaaaaatatatatataatata

SEQ ID NO: 27090 - DNA, 50 bp, homo sapien
accttagcgttcttcgttcttcgtakgtccatctgcctgcagatataagc

SEQ ID NO: 27091 - DNA, 50 bp, homo sapien
tatttgttgaactgttaaagggacamtgacgatgataatgttggcctagg

SEQ ID NO: 27092 - DNA, 50 bp, homo sapien
gtggtcagtggtttatattttattaycaagaagtcaaagaaaatgtattt

SEQ ID NO: 27093 - DNA, 50 bp, homo sapien
tcacgaaaggacagaccagttgacaygggcctgattactttgcttacaaa

SEQ ID NO: 27094 - DNA, 50 bp, homo sapien
cagtctgagccttcttccgtatccayagttaatagttcattcaacttagt

SEQ ID NO: 27095 - DNA, 50 bp, homo sapien
tttgaacttgtattttataagtgaartccaatgggacaatggaacccgtg

SEQ ID NO: 27096 - DNA, 50 bp, homo sapien
agaaaacacagatgggttctgtatgraaaacggtcctggatgtcctagtt

SEQ ID NO: 27097 - DNA, 50 bp, homo sapien
tatgaaacaaaagaggagaaatccaygagcttaaagtgtcagcaaatctg

SEQ ID NO: 27098 - DNA, 50 bp, homo sapien
tattcaaacaatcctggttgacaaayctcaaacataaaatatttatatct

SEQ ID NO: 27099 - DNA, 50 bp, homo sapien
gagaggacaaatatccaagctatatyacctagtattcctcaggtcacaaa

SEQ ID NO: 27100 - DNA, 50 bp, homo sapien
aacaccatgtgtaaagtcaggaaaaytcattctgccagaagctttttttc

SEQ ID NO: 27101 - DNA, 50 bp, homo sapien
acttgaaaagctgctcctcttagaaygtatcactcgttttccagaaggca

SEQ ID NO: 27102 - DNA, 50 bp, homo sapien
agttctctcagaaacttaaatgagakaaatgagtgtaacaaaaaggattt

SEQ ID NO: 27103 - DNA, 50 bp, homo sapien
tcctgcctcctccaaaattttgtcawatatcccttcatggtctcacaatt

SEQ ID NO: 27104 - DNA, 50 bp, homo sapien
caatctctcataatgattgtttccaycaattttacatatatttctggtag

SEQ ID NO: 27105 - DNA, 50 bp, homo sapien
taataattatctatacatcattttcracttttaaaggtatttttacactt

SEQ ID NO: 27106 - DNA, 50 bp, homo sapien
tcaaattgttgagagtatatcctgargccaacggtatccccccaccccgt

SEQ ID NO: 27107 - DNA, 50 bp, homo sapien
ttattggtgatttcacccatttccastacaatagatcatacaaacactaa

SEQ ID NO: 27108 - DNA, 50 bp, homo sapien
gctacacagctagatactaatggcargagtgtttaattagaagtactttt

SEQ ID NO: 27109 - DNA, 50 bp, homo sapien
aggtattcatggatatttacttgatsaatttccttcttgagcattttctt

SEQ ID NO: 27110 - DNA, 50 bp, homo sapien
gttaattaatattttagctacagaayggattatgattctttttcattgca

SEQ ID NO: 27111 - DNA, 50 bp, homo sapien
gtcagaggtcaatagatcttctttcyaagtgactgctatcactttgagat

SEQ ID NO: 27112 - DNA, 50 bp, homo sapien
aaggttatttaataaattgttatgaygtaatgctactaaatctcctaaga

SEQ ID NO: 27113 - DNA, 50 bp, homo sapien
gagtaaaataatgagtacgtgataartaaatggattaaagaggtgaaaag

SEQ ID NO: 27114 - DNA, 50 bp, homo sapien
tgacgatctggattggctaatataayctgccatagcttgaaatgagaaat

SEQ ID NO: 27115 - DNA, 50 bp, homo sapien
ccatgtaagactttagtatagaaccyggcatatagtgagcattcagtaaa

SEQ ID NO: 27116 - DNA, 50 bp, homo sapien
cacagctcatgttcctttccagttaygaaggagactactgtcatgaagtc

SEQ ID NO: 27117 - DNA, 50 bp, homo sapien
ggcactatcttttattactatcatcrctatttttgcttctattatcactg

SEQ ID NO: 27118 - DNA, 50 bp, homo sapien
cactccatgcattattagctattacsattattcattatgttgactatttt

SEQ ID NO: 27119 - DNA, 50 bp, homo sapien
aaattcagcacagaacaaggagagayatttgagaagccatatgtagatag

SEQ ID NO: 27120 - DNA, 50 bp, homo sapien
agcttgcatatttgctgaagtactcycgtatcaaactagaacagattcat

SEQ ID NO: 27121 - DNA, 50 bp, homo sapien
gaatattcttgctggaatctagatasagtctgttaagttaaatgctctgg

SEQ ID NO: 27122 - DNA, 50 bp, homo sapien
attttgtctcatataggacacagaargaataatttaggacacagactctc

SEQ ID NO: 27123 - DNA, 50 bp, homo sapien
gtgagcagatagttcaacagattaayactggtaaacccacttactcggaa

SEQ ID NO: 27124 - DNA, 50 bp, homo sapien
cttcaatgatacgtggtatatgagayattgctgggctgaacatagcacat

SEQ ID NO: 27125 - DNA, 50 bp, homo sapien
gccaaattgtgtaggtaaccataccrctaggagaggagccatagcaaaaa

SEQ ID NO: 27126 - DNA, 50 bp, homo sapien
tacaaaatagaggcactatggaggcrcttatccgagatcatggattatgt

SEQ ID NO: 27127 - DNA, 50 bp, homo sapien
accacatttctgagagattcaataayataatgtattcctggtctagattc

SEQ ID NO: 27128 - DNA, 50 bp, homo sapien
ttttatacatgtagaagctgagactsaaattactagtcagaggtccctcc

SEQ ID NO: 27129 - DNA, 50 bp, homo sapien
ttctagtctagctaaagtttttcaayagatgagaggatttgagctactgg

SEQ ID NO: 27130 - DNA, 50 bp, homo sapien
ttatcaggattcttctgtgttcaacyggctaatctgaatactaaccataa

SEQ ID NO: 27131 - DNA, 50 bp, homo sapien
gatagaagtttggctttgggattcargagtaggaaaagaaaacatttgag

SEQ ID NO: 27132 - DNA, 50 bp, homo sapien
cagtttcatcaaattttaaaagtgcraagtatacagattttaaatgcatt

SEQ ID NO: 27133 - DNA, 50 bp, homo sapien
gtagagccagaattcaaacccaaccrctatggcacactgtgtgcaggcct

SEQ ID NO: 27134 - DNA, 50 bp, homo sapien
catttattatttattgaggaagacarctaaatgaatataggagatagaag

SEQ ID NO: 27135 - DNA, 50 bp, homo sapien
tgtagggtcatttctggctcatccaractttttattcttttttcagattt

SEQ ID NO: 27136 - DNA, 50 bp, homo sapien
caggcattaagatcgtaaatgctcartcctttagagagccagttagcttt

SEQ ID NO: 27137 - DNA, 50 bp, homo sapien
acaatctactgaggccagattcctasagcatttttccagcatcacatctc

SEQ ID NO: 27138 - DNA, 50 bp, homo sapien
ctcatcttacaatctttatactataygatccagaatagttattttgataa

SEQ ID NO: 27139 - DNA, 50 bp, homo sapien
aagtacttaaattcacatgttgaaastcaaactgaactagaataattaat

SEQ ID NO: 27140 - DNA, 50 bp, homo sapien
tatccattcccatgactataagcacsatcaatatccgataattcagagat

SEQ ID NO: 27141 - DNA, 50 bp, homo sapien
tcaaaaaaaaaattcttataaaatgwcatacgtatttgggactattatgg

SEQ ID NO: 27142 - DNA, 50 bp, homo sapien
cttacaaacaccaagcaattctctcraggtttccatcgctttaactttgc

SEQ ID NO: 27143 - DNA, 50 bp, homo sapien
accattagcattaaatccagttaaasataaaatgaattccattaaataaa

SEQ ID NO: 27144 - DNA, 50 bp, homo sapien
tttgttatggactaccataaccaaakatattacagagtgcacataatcct

SEQ ID NO: 27145 - DNA, 50 bp, homo sapien
ataaaatgcatcaagttcttcaaagrctttcctttcatatcaggcctaaa

SEQ ID NO: 27146 - DNA, 50 bp, homo sapien
acaatgcattcttgttcaaacataaraggattcttagagaaaaaacaagc

SEQ ID NO: 27147 - DNA, 50 bp, homo sapien
caaaaaaaagataaaggcaggaaccrattagtgaaaaaaaaacagctcat

SEQ ID NO: 27148 - DNA, 50 bp, homo sapien
tttgagaaacagcttattagtaaaaygaaaactcctgtcaactgtaaaga

SEQ ID NO: 27149 - DNA, 50 bp, homo sapien
atggcactgttataatcagcagatcmgagttctagactggttagcattag

SEQ ID NO: 27150 - DNA, 50 bp, homo sapien
cgaggagaaggcaagttcatcctcamgtttcacatttcacaccaatctaa

SEQ ID NO: 27151 - DNA, 50 bp, homo sapien
atatgcctgagctacgtatttacaartatgccatccagagaggcgaaaga

SEQ ID NO: 27152 - DNA, 50 bp, homo sapien
ttttgccctgtgatatttgtgagcayactgtgaaggtgatgctgatttcc

SEQ ID NO: 27153 - DNA, 50 bp, homo sapien
tgttaatgttcagtgtaaaggatgakagtgaagattgtttattccgtagt

SEQ ID NO: 27154 - DNA, 50 bp, homo sapien
gaagcaaaatcagattttggttgaastcaagacacatattaaatctgatg

SEQ ID NO: 27155 - DNA, 50 bp, homo sapien
tcttagccatatcactgaactccaawggcctagtaatatttatttcttat

SEQ ID NO: 27156 - DNA, 50 bp, homo sapien
cagtagttctgtagagcctttaggaygaaactaaactctgccttactgaa

SEQ ID NO: 27157 - DNA, 50 bp, homo sapien
tttatatgatttcaatggttggccawactttggaagaaagaaactagcaa

SEQ ID NO: 27158 - DNA, 50 bp, homo sapien
cacaaagatttaacgcctcaatagarcaaaagctgttcagttaattttaa

SEQ ID NO: 27159 - DNA, 50 bp, homo sapien
accagaaaagtagaaaagtttcttckattaagcaacaaaaggtgttgatc

SEQ ID NO: 27160 - DNA, 50 bp, homo sapien
tacttgctccagcttattctgtttcratgcagcagaataaagagctgtgg

SEQ ID NO: 27161 - DNA, 50 bp, homo sapien
attacactttgactaatcaaggagcraccaactaagggcagcttaaggac

SEQ ID NO: 27162 - DNA, 50 bp, homo sapien
ttatgctaaattttttcaaggctaawctactactgcctatcttaatagaa

SEQ ID NO: 27163 - DNA, 50 bp, homo sapien
caagttaattggccccttgttttcasggtgttgtccactacccacattag

SEQ ID NO: 27164 - DNA, 50 bp, homo sapien
ttaaccagggtaatttccaaaaagargacctcataattcataaatagaag

SEQ ID NO: 27165 - DNA, 50 bp, homo sapien
ccaattcacctcactcactgcaaaakgattatacatctctcctttgctgg

SEQ ID NO: 27166 - DNA, 50 bp, homo sapien
tgatagggattggaatattttcagakgtaagctgtgcctccacttctgac

SEQ ID NO: 27167 - DNA, 50 bp, homo sapien
ttctgacttgtttgagaggaatgtayagatgatttttattttgccgcagg

SEQ ID NO: 27168 - DNA, 50 bp, homo sapien
cagatgatcttctgcattaaacccarcagtattgcagtgccatgccatat

SEQ ID NO: 27169 - DNA, 50 bp, homo sapien
tcatcttaagaaccctgcagttatasgaagacagacttgttcataatcat

SEQ ID NO: 27170 - DNA, 50 bp, homo sapien
ataagaagcttataaactttgtcacyctgcagctattccttctccagatt

SEQ ID NO: 27171 - DNA, 50 bp, homo sapien
caaggagtcgtttcttctttttctaycatgatgagtgtccaccgtggaga

SEQ ID NO: 27172 - DNA, 50 bp, homo sapien
aagagcttcctaagtcaaagccaagwattgaaattggagggtaagactga

SEQ ID NO: 27173 - DNA, 50 bp, homo sapien
gggtatagcacaccccagtgaaacayaggttatcagcgctaacactggga

SEQ ID NO: 27174 - DNA, 50 bp, homo sapien
aagaagtgcttgctaaattaagtcartcaggtgttttggtcctggtgtta

SEQ ID NO: 27175 - DNA, 50 bp, homo sapien
ccatttggaagtgtttcagtggagarcaaaatgaataacaaagcgggctc

SEQ ID NO: 27176 - DNA, 50 bp, homo sapien
ttaattttgcatatatggcttctaaraaactagtctgtaagcttgctcta

SEQ ID NO: 27177 - DNA, 50 bp, homo sapien
caagagcaaaaattcattccaaaaasactactgtattaatcccttcatga

SEQ ID NO: 27178 - DNA, 50 bp, homo sapien
gtcccacaagatcaggtcattataaygcaaggtaacctctggtattttgc

SEQ ID NO: 27179 - DNA, 50 bp, homo sapien
aaactgtgtatctggtttccctgatkaaaactttgagctatttcacgtgt

SEQ ID NO: 27180 - DNA, 50 bp, homo sapien
ttgttgtgaaattttctttatcccaygactcatttgatactttcttttct

SEQ ID NO: 27181 - DNA, 50 bp, homo sapien
acatgcataaaattcatcagataatwaccaacctcccccttatgttttac

SEQ ID NO: 27182 - DNA, 50 bp, homo sapien
gcaaacattgcaagttgcctactgartacttttcttcatatactcttttc

SEQ ID NO: 27183 - DNA, 50 bp, homo sapien
gggttacagggttgtccagttgaaaytacaaaaagtctaatgaatgtcat

SEQ ID NO: 27184 - DNA, 50 bp, homo sapien
gtcattgcacagcatgggagtctctwacagtctacaggtagaaaacatca

SEQ ID NO: 27185 - DNA, 50 bp, homo sapien
tttatatcaaattccaattggatacratattaagacacggtagatactaa

SEQ ID NO: 27186 - DNA, 50 bp, homo sapien
agtcttaacagaaatctaggcaggtsaaaatcctaatctctttagaactt

SEQ ID NO: 27187 - DNA, 50 bp, homo sapien
gtcattttatgaaactcatttgtaaygtttatctctgaagatgtatttga

SEQ ID NO: 27188 - DNA, 50 bp, homo sapien
gtattcactctgctggccgttgatasaaaagtgaccgtgacttcatcact

SEQ ID NO: 27189 - DNA, 50 bp, homo sapien
gaatataggtagttcccaaatatacyggacataggaacctctcagggaat

SEQ ID NO: 27190 - DNA, 50 bp, homo sapien
ttgtctattcatctatcagttgtcasacatctgggttgtttccatcttca

SEQ ID NO: 27191 - DNA, 50 bp, homo sapien
aggaaacatacatgtgatacacttamataagagcccagtcataattatag

SEQ ID NO: 27192 - DNA, 50 bp, homo sapien
cctgaagagccagccctaagaaaggmatttacacaagatagtcatcaccc

SEQ ID NO: 27193 - DNA, 50 bp, homo sapien
cttggtccttttttctcactttctgmactttgctcatatggaatcttgct

SEQ ID NO: 27194 - DNA, 50 bp, homo sapien
atgtgagtttagcctcagtcaaacgratcctattgggatgttaaaacatt

SEQ ID NO: 27195 - DNA, 50 bp, homo sapien
gaatgtgcatttacactttggaacaycagttatggccatttaaaaaatat

SEQ ID NO: 27196 - DNA, 50 bp, homo sapien
ctagttctcatagcacaatagtaaayagaaagtgaaacaataaccaggta

SEQ ID NO: 27197 - DNA, 50 bp, homo sapien
tcaatataagactttatggctgtacrcttgtcagatgatgtagagattaa

SEQ ID NO: 27198 - DNA, 50 bp, homo sapien
gttgggggaaaaatagcacagagaaragaactactttaagcttcatgcaa

SEQ ID NO: 27199 - DNA, 50 bp, homo sapien
aacattgaaaggtggaaattataacyggcagatgtgagtataaaatgcct

SEQ ID NO: 27200 - DNA, 50 bp, homo sapien
tggagcctcagtctcttcatctgtayggcaaaatgaagacaataacaatg

SEQ ID NO: 27201 - DNA, 50 bp, homo sapien
aaaccagattccattgtcaataagargagatttggattgtacagtttcat

SEQ ID NO: 27202 - DNA, 50 bp, homo sapien
gacatctcttgtcatactctgccacragtgcttaggcaccaaatcctttt

SEQ ID NO: 27203 - DNA, 50 bp, homo sapien
gtccttaaagacaatacacactcacrgattacatatgcttttattcaggt

SEQ ID NO: 27204 - DNA, 50 bp, homo sapien
tgcatgctacatcataggctataaamacatatttgctggaataataaaaa

SEQ ID NO: 27205 - DNA, 50 bp, homo sapien
ctaccctgtgcaatgtcatgatgatmaggaggccttttctaccacacaca

SEQ ID NO: 27206 - DNA, 50 bp, homo sapien
tctaaatacatttactgattaaaaaratgcaagtgcttatgaataggttc

SEQ ID NO: 27207 - DNA, 50 bp, homo sapien
acaagacctaacttgggtgaatgttkaacaagtccagggaaatccagatg

SEQ ID NO: 27208 - DNA, 50 bp, homo sapien
ttagtaccgcactgtcatccaggaarggcaatttcagttttacttgtttc

SEQ ID NO: 27209 - DNA, 50 bp, homo sapien
catgctgactgcagtttggttgatcrctgggacaccacacacctacctcc

SEQ ID NO: 27210 - DNA, 50 bp, homo sapien
ctcaactttccccaccggactgtcarctcttaagaaggcagggactgcat

SEQ ID NO: 27211 - DNA, 50 bp, homo sapien
caggtttttgtccttgtttagaagasaaaagagaatttcaaaaacaaaac

SEQ ID NO: 27212 - DNA, 50 bp, homo sapien
ggctttccatagaactcaaaattccragtctctgtcccaagcttctggga

SEQ ID NO: 27213 - DNA, 50 bp, homo sapien
tttgtgtgtatggactttactgtcaygttatttcagttattagaagacaa

SEQ ID NO: 27214 - DNA, 50 bp, homo sapien
aggataaatagtttaaaccatgtggycatatgccagttgacgcccaaact

SEQ ID NO: 27215 - DNA, 50 bp, homo sapien
attcccaattgattcttcatctcctkaccttatcaagactgtattcctgt

SEQ ID NO: 27216 - DNA, 50 bp, homo sapien
cccaagggacaatttgttttgcttaygacatttgatgatagaaatcaaaa

SEQ ID NO: 27217 - DNA, 50 bp, homo sapien
ataaagtaacaattaaaatctcagaragcgttcataattcaagcttttat

SEQ ID NO: 27218 - DNA, 50 bp, homo sapien
gtcttctcttcaagtctttcatgccyatcttttctcttccctcccagaat

SEQ ID NO: 27219 - DNA, 50 bp, homo sapien
gtaaatacaatcggatattattaaasccttgaatgcttcaaaactcttct

SEQ ID NO: 27220 - DNA, 50 bp, homo sapien
ttttactacaagaagacaaaaatcaygcctcttttgttcatttttataga

SEQ ID NO: 27221 - DNA, 50 bp, homo sapien
ccaagtttaaactactctgacacaamtaagtgattcccactcctggaatt

SEQ ID NO: 27222 - DNA, 50 bp, homo sapien
atctcaaaggcacaaaggaggataamatgaagaaatagctaaagggggac

SEQ ID NO: 27223 - DNA, 50 bp, homo sapien
ctcttcttcaatattgtattctcaaygcccggtggacaatgttggtacta

SEQ ID NO: 27224 - DNA, 50 bp, homo sapien
tacaatggtagaaatcttagggtaartgttctgaattaactgacccatga

SEQ ID NO: 27225 - DNA, 50 bp, homo sapien
ccctgccatagatctggttgtgtgayggagaattgtgtggccctggagcc

SEQ ID NO: 27226 - DNA, 50 bp, homo sapien
gtttccttataaaagtgcaattttarctatttggcctctctctctctctc

SEQ ID NO: 27227 - DNA, 50 bp, homo sapien
aggaggtgcttcactttcctgataarctaccgtaaggcccctttctgcat

SEQ ID NO: 27228 - DNA, 50 bp, homo sapien
acaggaagacctccagaaatttgacragtaagttatttgttcttccttac

SEQ ID NO: 27229 - DNA, 50 bp, homo sapien
ggaagtgctgccccagctagctagaygccgcaacagaggaggcaaggaat

SEQ ID NO: 27230 - DNA, 50 bp, homo sapien
gattttgaattgttaccaaagagaastccattccgtgactcatatataga

SEQ ID NO: 27231 - DNA, 50 bp, homo sapien
agattttacactattgtaagtataamtagaaaaggcctaattagaatggg

SEQ ID NO: 27232 - DNA, 50 bp, homo sapien
gtaagcctaacactgtcgtattatayagattacacagttcataattatgt

SEQ ID NO: 27233 - DNA, 50 bp, homo sapien
aaagtccacagtgaataaatgtgagsagtcaagattacaaaggatgacat

SEQ ID NO: 27234 - DNA, 50 bp, homo sapien
taaacaagagcagtaaatactaaaayggcagctacacttgatccagacag

SEQ ID NO: 27235 - DNA, 50 bp, homo sapien
atagacaattgtgactgtaatgaggyccatgaacgtttagaatatgatta

SEQ ID NO: 27236 - DNA, 50 bp, homo sapien
tacaaaagatgaaactaagttccaasatgggttacacaatggacaaaatt

SEQ ID NO: 27237 - DNA, 50 bp, homo sapien
ttattgtgcctatagcatcagggcawctgcattgaaacctcagcaggaat

SEQ ID NO: 27238 - DNA, 50 bp, homo sapien
tcagctttggtggtgggttgaggtaraggtaataaagaagtggaagattg

SEQ ID NO: 27239 - DNA, 50 bp, homo sapien
aaactaataagatagcatgtaataarataatttgtggtatcacacaaaag

SEQ ID NO: 27240 - DNA, 50 bp, homo sapien
aagctgaaaatcaatatccaggttcrcatgaacaaaactgcatggtccag

SEQ ID NO: 27241 - DNA, 50 bp, homo sapien
attcaacagccagttctgaacataaytggaaggcagcctggtccactgga

SEQ ID NO: 27242 - DNA, 50 bp, homo sapien
atgctcaggaacttgtcagccaaccratgtaatcctttcagaataggcaa

SEQ ID NO: 27243 - DNA, 50 bp, homo sapien
tgtgttatttatatttcactaaaaaytgctacgaatacctatccttggct

SEQ ID NO: 27244 - DNA, 50 bp, homo sapien
cagggagcatggcgacagcaagaacraggtgacgacaaggacaggagccc

SEQ ID NO: 27245 - DNA, 50 bp, homo sapien
tgttaaattgaaaatcctattgatasatttgcaggttcctgtgcatgtcc

SEQ ID NO: 27246 - DNA, 50 bp, homo sapien
tttaaagcttcctttgtaaacctaayctagcatctaattagctcaaaaat

SEQ ID NO: 27247 - DNA, 50 bp, homo sapien
ccatggcctcagtttcctggaagacrataagaccagccagtcaaactgag

SEQ ID NO: 27248 - DNA, 50 bp, homo sapien
atgagtaaatgtactgtgtagacackctggactctttccttcatggcttc

SEQ ID NO: 27249 - DNA, 50 bp, homo sapien
tatctcttggaactgaactgaactayattcttctcaaagagccttgtagg

SEQ ID NO: 27250 - DNA, 50 bp, homo sapien
caatgtgacactaaaaggtactgggycatttagctctgctcctctacaga

SEQ ID NO: 27251 - DNA, 50 bp, homo sapien
cagactttcccttgcagaacagttayagtcttagctctcagagtggacac

SEQ ID NO: 27252 - DNA, 50 bp, homo sapien
gggtattaaatacataattgtcagaraaattgatgtaatggaaatgggga

SEQ ID NO: 27253 - DNA, 50 bp, homo sapien
tgccagccctagactatttgataaayaaactaactccataattgtgtgcc

SEQ ID NO: 27254 - DNA, 50 bp, homo sapien
gcactcctacagaattccctgtaagyaagaaaaaggaaggaggcagtggc

SEQ ID NO: 27255 - DNA, 50 bp, homo sapien
aactgggctatgttccaaaatatacraactttgcatgtacatttccacag

SEQ ID NO: 27256 - DNA, 50 bp, homo sapien
ttttcatttaatcctcttcttccagwctaattcctcagagatagctattg

SEQ ID NO: 27257 - DNA, 50 bp, homo sapien
gcagtcatgtgtattttctgaaaaakaattctagcttctctacaggattt

SEQ ID NO: 27258 - DNA, 50 bp, homo sapien
tagagatctgatctagtatccttggscagaactgcatgactaaggtgaaa

SEQ ID NO: 27259 - DNA, 50 bp, homo sapien
ttagatcttgaaactgtacaaggcaytcttctgcttttaatttatgcttt

SEQ ID NO: 27260 - DNA, 50 bp, homo sapien
caagtgtgaccctcgtatgtcatcasagatcatttttagtgccttattaa

SEQ ID NO: 27261 - DNA, 50 bp, homo sapien
tataagacgtaggattatttttcaayggtaccttcataggtcaacaaaca

SEQ ID NO: 27262 - DNA, 50 bp, homo sapien
ctataagtgatttaaaatattcaaarggatgtgcacaggttatatgcaaa

SEQ ID NO: 27263 - DNA, 50 bp, homo sapien
aaaacttctgtgaacgtttacatacrgagcttattgtggacaaatgcgtg

SEQ ID NO: 27264 - DNA, 50 bp, homo sapien
tgcaattatgcctggcttggtcccamaacctttcaccatggaccccacta

SEQ ID NO: 27265 - DNA, 50 bp, homo sapien
gaacagcagagcagaacttgaaggaraagtgtcaacttatcccgctccct

SEQ ID NO: 27266 - DNA, 50 bp, homo sapien
tcgtagttacctgtcaatggcaactyagttcataaatcttatctgctctg

SEQ ID NO: 27267 - DNA, 50 bp, homo sapien
ggtagcctctatccaactaccagtcrcaacgcttcctggcccaaactcaa

SEQ ID NO: 27268 - DNA, 50 bp, homo sapien
tttttaggattttgtcctaggaaaargtcatcttataatgagactttttc

SEQ ID NO: 27269 - DNA, 50 bp, homo sapien
cagtatctcttaatcactggatccakagtttttggtagttgtgttttatg

SEQ ID NO: 27270 - DNA, 50 bp, homo sapien
agggctcctaccttcctagagtttarggtacgagaagtcttaaagaagca

SEQ ID NO: 27271 - DNA, 50 bp, homo sapien
cacttatgttgattcctgctcctgartaaaaaactgagggtagtcaattg

SEQ ID NO: 27272 - DNA, 50 bp, homo sapien
aagatctctgttcgcccgttaacaayagaaataaggataaatttaggcaa

SEQ ID NO: 27273 - DNA, 50 bp, homo sapien
ttgccaagcttcttcaagtaaaataratttgtcctaagggagtaacttta

SEQ ID NO: 27274 - DNA, 50 bp, homo sapien
aacaaagtcttgttgagtgtacaaakaataaaaatatacgttgaataaag

SEQ ID NO: 27275 - DNA, 50 bp, homo sapien
gcctctatttctgttggttgcgtcartatcacctaagccctcaagtagaa

SEQ ID NO: 27276 - DNA, 50 bp, homo sapien
gggcatcatcatcttgccctaacatyatctcttgtctgaaatcctttagt

SEQ ID NO: 27277 - DNA, 50 bp, homo sapien
aagtatttagcatttgttcatagacyataccaggctgaggagagcaggga

SEQ ID NO: 27278 - DNA, 50 bp, homo sapien
gactcaggttccttgttccaaaggcmaaaaatattgaatattaaacatga

SEQ ID NO: 27279 - DNA, 50 bp, homo sapien
ttaaataagtaacccatattaacacragagtatgtactccaaaaatggcc

SEQ ID NO: 27280 - DNA, 50 bp, homo sapien
tgtttgcattcaccgtggcataatcmaaaatcaaatgggagctttaaagg

SEQ ID NO: 27281 - DNA, 50 bp, homo sapien
cactgctgaccagaggctgccctaastattggcagaaggccacctaccac

SEQ ID NO: 27282 - DNA, 50 bp, homo sapien
attttttggtaatgcattcaaactayggaaagtgatctagggaaaacatg

SEQ ID NO: 27283 - DNA, 50 bp, homo sapien
tccagacaatagtgataaatgagacratccttttagagagtgggaatttg

SEQ ID NO: 27284 - DNA, 50 bp, homo sapien
gtaagaagtctctcaactctagtcaytgaatctaccaaaatattttgttt

SEQ ID NO: 27285 - DNA, 50 bp, homo sapien
gactccctctgtttgtcatgctttayggttgatagagtccataacgattt

SEQ ID NO: 27286 - DNA, 50 bp, homo sapien
ccagtggagattttgttaagcaaacsgtgccctcagaaaatataccattg

SEQ ID NO: 27287 - DNA, 50 bp, homo sapien
atcatgtcgtcatcaaaacttttcayggtgcccacattgctagggaaaga

SEQ ID NO: 27288 - DNA, 50 bp, homo sapien
ttctgggcaactggcactatccttaygtacttttccacaaccaaaaggga

SEQ ID NO: 27289 - DNA, 50 bp, homo sapien
accgtttcatcccttctaccaactcrgagattatgatctccattataaga

SEQ ID NO: 27290 - DNA, 50 bp, homo sapien
gaaactggttctaataaacaatgtaygaggtcatgaaattattgtcatat

SEQ ID NO: 27291 - DNA, 50 bp, homo sapien
aagctcctgttccctcatgacttcartaatctcaaagtacagaaagatac

SEQ ID NO: 27292 - DNA, 50 bp, homo sapien
catttcagatttgtatttagagtaaygagattgtttattaaaaatatact

SEQ ID NO: 27293 - DNA, 50 bp, homo sapien
ctctaaatacaaatctgaaatggtayagggatagtcactgtaagattaga

SEQ ID NO: 27294 - DNA, 50 bp, homo sapien
attacatttttatgagtaaaacagayaaggatgtagattttgtgggaaga

SEQ ID NO: 27295 - DNA, 50 bp, homo sapien
gtaatatagttataaaatatcagaayggccttttaaaatacatattgcta

SEQ ID NO: 27296 - DNA, 50 bp, homo sapien
gaaaataccacgtatctttatagacyaggagctcagatatattatttcca

SEQ ID NO: 27297 - DNA, 50 bp, homo sapien
aagttttatagctcagttttagccaygggtattaaaatatgatctcctgc

SEQ ID NO: 27298 - DNA, 50 bp, homo sapien
tatgataagggcaggaatttataatracttgcatgcgggttccaatgtca

SEQ ID NO: 27299 - DNA, 50 bp, homo sapien
gttctagaagcctggatttaactacrgcttcataacttttcccagttcca

SEQ ID NO: 27300 - DNA, 50 bp, homo sapien
ctagatggggaacacaaaccatgtasaaatgagatctcctttggtgacca

SEQ ID NO: 27301 - DNA, 50 bp, homo sapien
tactaagtaaacattgttgcctgtartaacttagcaattgtctacattca

SEQ ID NO: 27302 - DNA, 50 bp, homo sapien
aagggcaataatcctagagactctawattctccatttcttttgaaatgag

SEQ ID NO: 27303 - DNA, 50 bp, homo sapien
gttttcaagtcaatctacgaatgacmctacatgctgtaacatgtaatcac

SEQ ID NO: 27304 - DNA, 50 bp, homo sapien
cttgaacttggggaaatcagaggtcrcagaaggccttaaacaacagaaga

SEQ ID NO: 27305 - DNA, 50 bp, homo sapien
tattaaggagacactatttattgacratccacagtatgcgaagcactgca

SEQ ID NO: 27306 - DNA, 50 bp, homo sapien
ttgtcaaaaagatgaaggagaccttwaaggagaaagctaagctctgagct

SEQ ID NO: 27307 - DNA, 50 bp, homo sapien
gaatcttatgatattactgtttaaayttactgaaaaagctcaatgtgatt

SEQ ID NO: 27308 - DNA, 50 bp, homo sapien
gtcccattaattcattcaagagtccyaatgctaattctatcaaaaaaccc

SEQ ID NO: 27309 - DNA, 50 bp, homo sapien
atcatgattgacaagactaaataaartgtatatcaggtgtctctttatgg

SEQ ID NO: 27310 - DNA, 50 bp, homo sapien
ataaaagaaccacagatgctcccgaygagatgaacttctataccaagagt

SEQ ID NO: 27311 - DNA, 50 bp, homo sapien
agctttagaaatcaaccatctgagaragttccagcattcaaaacgaaatc

SEQ ID NO: 27312 - DNA, 50 bp, homo sapien
gatctagaataacaaaaccaggcgartaaaaatgctgagctaaacctgga

SEQ ID NO: 27313 - DNA, 50 bp, homo sapien
ttggctgtcttaaaacatgggctcartaatcgctagttttgacgtagcat

SEQ ID NO: 27314 - DNA, 50 bp, homo sapien
tggaaaagtcaagagaggcttcttayatgcaggagtgttcaatccaaaca

SEQ ID NO: 27315 - DNA, 50 bp, homo sapien
catagtatcatatatcccacaggtcragaattaatgtggaagttctgcaa

SEQ ID NO: 27316 - DNA, 50 bp, homo sapien
ttcatcccttttttctaagttgctayggactaatctgttagcccttagac

SEQ ID NO: 27317 - DNA, 50 bp, homo sapien
ttaaaaatatacttgctgagatttaygtggattttaattaccttaatcac

SEQ ID NO: 27318 - DNA, 50 bp, homo sapien
cagatatatcttggccattgaatcayagtgccttaaaataagatagtaaa

SEQ ID NO: 27319 - DNA, 50 bp, homo sapien
gccacaaagatcttggaagtctgatratcacagtaacattttaaatgcaa

SEQ ID NO: 27320 - DNA, 50 bp, homo sapien
aaaaaatagggggaaatcaccaggartataaatgcaaattagtatttcaa

SEQ ID NO: 27321 - DNA, 50 bp, homo sapien
gagtagaaccaccatacaacatgccrgattgttaatggaaagtatatttc

SEQ ID NO: 27322 - DNA, 50 bp, homo sapien
atcaaggcattcagatagtatagacrcacaattaagaaattttctttgaa

SEQ ID NO: 27323 - DNA, 50 bp, homo sapien
gtttttgttatagctaacagagaaaygctagccaaggattttattgctgg

SEQ ID NO: 27324 - DNA, 50 bp, homo sapien
gtatgtccctatcagcttatgaaccrcttttaaataaagtcattgtgcat

SEQ ID NO: 27325 - DNA, 50 bp, homo sapien
gaattaattgcagaatgcaacatgaytacaggatataatctcaaaaaaaa

SEQ ID NO: 27326 - DNA, 50 bp, homo sapien
catcttctcaagaaatgctggttgakgaaaacattgacaaaaaagcatca

SEQ ID NO: 27327 - DNA, 50 bp, homo sapien
aagagacaaatacatgaatagaatasagtagaattaaacgacaggggtgg

SEQ ID NO: 27328 - DNA, 50 bp, homo sapien
ttattcctgaatgataatttcagaaytgacagtcccttttttcctgacac

SEQ ID NO: 27329 - DNA, 50 bp, homo sapien
agttcataaagtgtgttagatacaaycagacgtatgtagagttaattgag

SEQ ID NO: 27330 - DNA, 50 bp, homo sapien
ttatcactgacttctctatttagtamtaagtcatgttaatagttcctgag

SEQ ID NO: 27331 - DNA, 50 bp, homo sapien
tcccttaagccatccagacagggtgraacggtttctcagaaatctaagcc

SEQ ID NO: 27332 - DNA, 50 bp, homo sapien
gtcctcagtgagaaggaataggcacyggactccaaaaatggtgggaaaag

SEQ ID NO: 27333 - DNA, 50 bp, homo sapien
catctcagtgttcctgagaaagacaycattccctgacaacgactgtctct

SEQ ID NO: 27334 - DNA, 50 bp, homo sapien
tagcctaatcctcacagaaagaatayagttagcacacgaactctctctaa

SEQ ID NO: 27335 - DNA, 50 bp, homo sapien
tgctacaacttgtgaagctggcaagrattgaaccatattgcctaagatcc

SEQ ID NO: 27336 - DNA, 50 bp, homo sapien
ttctaagaaaaaaggcctctaaaaarcaaatatgaaaagtaagacagaat

SEQ ID NO: 27337 - DNA, 50 bp, homo sapien
aagaaagagtgtcctaccaagcaaamgtggatctcaaagctcagaaggca

SEQ ID NO: 27338 - DNA, 50 bp, homo sapien
ctagaccaagccctctaaaacacaawtacacagggagtacaagaagggga

SEQ ID NO: 27339 - DNA, 50 bp, homo sapien
tatggaatactaacagttttgaaatsaagtagggatgggatgtttgacgt

SEQ ID NO: 27340 - DNA, 50 bp, homo sapien
aaggacattctggagtgaaatcttaygcaacagtaaaacatcatgggctg

SEQ ID NO: 27341 - DNA, 50 bp, homo sapien
taggaattctttcagggacatttaaracaggtatatctatttatgcgaat

SEQ ID NO: 27342 - DNA, 50 bp, homo sapien
acacaattcctaccacataatatgcrcctgataatttatggttattgtac

SEQ ID NO: 27343 - DNA, 50 bp, homo sapien
cttagaaagcagtgagcctctagaaygagcacttttcaaagcatttttca

SEQ ID NO: 27344 - DNA, 50 bp, homo sapien
agtgaagcaaatgaagcatcatttcragaattgcttggccagtttccaaa

SEQ ID NO: 27345 - DNA, 50 bp, homo sapien
tgaactttgttacatggcaaaccatratgaaagggaagcagggacaaggg

SEQ ID NO: 27346 - DNA, 50 bp, homo sapien
gtacacaacacttctcaatagatccrgcaaggtctgctttaattccgacc

SEQ ID NO: 27347 - DNA, 50 bp, homo sapien
aaggtctactttatttgtaattacgycaggcatgcatatgtacatctgtc

SEQ ID NO: 27348 - DNA, 50 bp, homo sapien
actagggggaggaagcaataacctargtagaaaaaattctctaaaaatca

SEQ ID NO: 27349 - DNA, 50 bp, homo sapien
attaagggaggtgctcttgcctggawgaaaggcggaacagaggtctggta

SEQ ID NO: 27350 - DNA, 50 bp, homo sapien
gacttacttcttgttgagtgcattayctttattcattgcctccttaaaaa

SEQ ID NO: 27351 - DNA, 50 bp, homo sapien
caaagaagggacctaaagtgaaaaayaggtagatctctgatcagaactct

SEQ ID NO: 27352 - DNA, 50 bp, homo sapien
cctttcttccaaaagcctttcttctsaaacttagaccagaatattcaact

SEQ ID NO: 27353 - DNA, 50 bp, homo sapien
taggagtaaaacttacatctgtttgsaatatgttaaactggggtatgttg

SEQ ID NO: 27354 - DNA, 50 bp, homo sapien
tttgcctcatatcttccattctgaawcctggtgtcctgaagccctcataa

SEQ ID NO: 27355 - DNA, 50 bp, homo sapien
tatgagaaaaaagttgaattacatartaactaagaaacaggtcccacaaa

SEQ ID NO: 27356 - DNA, 50 bp, homo sapien
cagcatgtcatcatagaagtcaagayggtaaagggtttcaaggaggaagg

SEQ ID NO: 27357 - DNA, 50 bp, homo sapien
tagctctaatgaaaagatgaatttgyattgtgtaatttttctgaaatatt

SEQ ID NO: 27358 - DNA, 50 bp, homo sapien
attaattgaacatacacggtacacartcatggaattacaacaccttgggg

SEQ ID NO: 27359 - DNA, 50 bp, homo sapien
ataaagttgggtgtactgtttgaagycatagcattgaatgtaactctcca

SEQ ID NO: 27360 - DNA, 50 bp, homo sapien
atcttcttccctttatccactctaakgaacatattaacaacctgatcata

SEQ ID NO: 27361 - DNA, 50 bp, homo sapien
ccttttctttctatgacaccttgctsaagtctcactgcaatcacagggct

SEQ ID NO: 27362 - DNA, 50 bp, homo sapien
aaactagaaaacaactgactcattcyaggatggcaatgaagaaatcttct

SEQ ID NO: 27363 - DNA, 50 bp, homo sapien
aataaaataatgggctattgtgacakggatttagcaccagcagttgcttg

SEQ ID NO: 27364 - DNA, 50 bp, homo sapien
ttcattagaagtgttacaatcaatasctgccaattacttagtgagcagaa

SEQ ID NO: 27365 - DNA, 50 bp, homo sapien
aagcagatctcaataggagaggaaasttactttagtgctttaaaaataaa

SEQ ID NO: 27366 - DNA, 50 bp, homo sapien
acagcattcaaaaattcacctcaaaktatatttcacaaagagataattgc

SEQ ID NO: 27367 - DNA, 50 bp, homo sapien
ttgacccttgacactgtgattgagaygtattaatgacatacagtgaaggt

SEQ ID NO: 27368 - DNA, 50 bp, homo sapien
ttttatgtatactgcaaatcgaatcygaggtgtgtcttgtgagcattaaa

SEQ ID NO: 27369 - DNA, 50 bp, homo sapien
tcaaaacacagaacagttggtgtcaragtttctctaaagggagcattcat

SEQ ID NO: 27370 - DNA, 50 bp, homo sapien
aggttttcacaatacatgcttcggayctttctctacagtgtttctaagcc

SEQ ID NO: 27371 - DNA, 50 bp, homo sapien
aggtgacaccaaggtaactctatgasagaatcatggtattcagtgaaagg

SEQ ID NO: 27372 - DNA, 50 bp, homo sapien
gtcatttagcagcatttactgagagsccatgatatgccaaacattagatt

SEQ ID NO: 27373 - DNA, 50 bp, homo sapien
tattaatggtagaatcaggatagaaygagaactagatgctggatgtcctt

SEQ ID NO: 27374 - DNA, 50 bp, homo sapien
tgacattaacttgaccctcaacttaycttgatgtaccccaaagcatataa

SEQ ID NO: 27375 - DNA, 50 bp, homo sapien
cgattcagaggtatgaacttgttgaytaaaaaatgtttttaagaattttt

SEQ ID NO: 27376 - DNA, 50 bp, homo sapien
tgccttcattttgaagtgatagaaargttctttgttagggacagtgaggt

SEQ ID NO: 27377 - DNA, 50 bp, homo sapien
ctccaaagtattcaaaaatgccttargttgtaatactggctattatattt

SEQ ID NO: 27378 - DNA, 50 bp, homo sapien
ctgatttacatttattatcatgtgamatcttttagaaaaatgtctatata

SEQ ID NO: 27379 - DNA, 50 bp, homo sapien
ttgttaaattggtgtgagatcaacaygtcaaattaatagaatcatgctaa

SEQ ID NO: 27380 - DNA, 50 bp, homo sapien
taagaagctttggtgggtgatgacasaaagatattggagacaaattttgg

SEQ ID NO: 27381 - DNA, 50 bp, homo sapien
ccagggcatcaggtactgtgacgaayagcatgagagaaatagaatcccag

SEQ ID NO: 27382 - DNA, 50 bp, homo sapien
ctcggaaacattaagtgcttcaagartatcatctatagcctgaattcctt

SEQ ID NO: 27383 - DNA, 50 bp, homo sapien
atttacctattatttgtacgcattakactagacatattcctgattcacca

SEQ ID NO: 27384 - DNA, 50 bp, homo sapien
gttgtagtgaggagaaagtgagaacmattatagtagataacagcttcaca

SEQ ID NO: 27385 - DNA, 50 bp, homo sapien
cccaaacatttttataattgagtcayctattcctgttaccttttcctttt

SEQ ID NO: 27386 - DNA, 50 bp, homo sapien
gataatttatttaactgaatagtgaygaactgatattgaaaatgtttttc

SEQ ID NO: 27387 - DNA, 50 bp, homo sapien
atattcagagcatttactatgaaaaygagtgtagtcgatctttacagtcc

SEQ ID NO: 27388 - DNA, 50 bp, homo sapien
cccttttcacatgttcacatctctgragttctctcttgtgcagtttcaaa

SEQ ID NO: 27389 - DNA, 50 bp, homo sapien
tatgtgattatcatagtgttaaacaraagttataatttactgtccaggat

SEQ ID NO: 27390 - DNA, 50 bp, homo sapien
catcatataaaacacagtaatgtacratgtttatcaaaactaagagaaaa

SEQ ID NO: 27391 - DNA, 50 bp, homo sapien
tcagctccgcatgcccagggtctaaratgagcttttcccccaagattagc

SEQ ID NO: 27392 - DNA, 50 bp, homo sapien
tattgacatctcttccctgctttaayctgcttccattcctcaaaggcaag

SEQ ID NO: 27393 - DNA, 50 bp, homo sapien
tgctgtagcaaggctaacttatttgyattattggctaaggggatatgcct

SEQ ID NO: 27394 - DNA, 50 bp, homo sapien
aataagtggtgtgatggctgcatcakataaatttttaagtcacatataaa

SEQ ID NO: 27395 - DNA, 50 bp, homo sapien
tttaaaatcaagtaatcaagagaaaygaggacgttgacattgctttataa

SEQ ID NO: 27396 - DNA, 50 bp, homo sapien
gagggcgaagatggtgttcaaggtaytaaagaaacacaaatcaaagatgt

SEQ ID NO: 27397 - DNA, 50 bp, homo sapien
ttcttaggggcattatctctataaayttgttgtacagaatcaatgatttc

SEQ ID NO: 27398 - DNA, 50 bp, homo sapien
ttcatgattgcaaaacaattggaaartaaaaagcacaaggaaaaggcttt

SEQ ID NO: 27399 - DNA, 50 bp, homo sapien
ccttgacactctgacatatctgcaarggtctctagagttgctctgatctg

SEQ ID NO: 27400 - DNA, 50 bp, homo sapien
gtgcaatatggttgcaatgctaaaawcagtaactatgcaactagagataa

SEQ ID NO: 27401 - DNA, 50 bp, homo sapien
tgtatgaaatattcttaagtaaaacrcggtgagctccacagaagaaaggt

SEQ ID NO: 27402 - DNA, 50 bp, homo sapien
ttaagaatttgtctaatgtccttacraaataaagattaataaaactctgc

SEQ ID NO: 27403 - DNA, 50 bp, homo sapien
tcaagttacatgcagcaaatgcttcmaataatagtaaactatataactac

SEQ ID NO: 27404 - DNA, 50 bp, homo sapien
tattcatattatattagcagagtaarcaatgatccacaatgccttataaa

SEQ ID NO: 27405 - DNA, 50 bp, homo sapien
cctcaggtttctaattaaatgtaaamctttagagtcccataatgggttgt

SEQ ID NO: 27406 - DNA, 50 bp, homo sapien
caattcaacagagataatgaaatccrgatgtaagaaggcaaatactaaca

SEQ ID NO: 27407 - DNA, 50 bp, homo sapien
gggtctttttttgcttcaaggagtgyatagcagaattaggaagacgtgag

SEQ ID NO: 27408 - DNA, 50 bp, homo sapien
atatagtacatatatgtttggctaayggagaaaggaaaaataaaaatttc

SEQ ID NO: 27409 - DNA, 50 bp, homo sapien
aaatcatatgctttgtttttcagacrataagagctatataagccattatg

SEQ ID NO: 27410 - DNA, 50 bp, homo sapien
agggattctaatttaagaagctatcrcagtagtttaaggaaagatgaaaa

SEQ ID NO: 27411 - DNA, 50 bp, homo sapien
gggataattccctggcaaataataawaccttgcacttttacactgcattt

SEQ ID NO: 27412 - DNA, 50 bp, homo sapien
ccatcctcctgcccaggaactgcaargataatttttatttcttccctggc

SEQ ID NO: 27413 - DNA, 50 bp, homo sapien
tgtgaccaagtgtgttgactgctcakgatcctcaaaaagtacttcaaagt

SEQ ID NO: 27414 - DNA, 50 bp, homo sapien
agaaaagaactacaacttctgaccaygaaatctaaccatctacctgcagt

SEQ ID NO: 27415 - DNA, 50 bp, homo sapien
tgagcttaaaaccatgactcactacycaggtgacaagtatttcatctctt

SEQ ID NO: 27416 - DNA, 50 bp, homo sapien
catccccaaacccagtgcaccaacamgtccagttactcttatgtcctggt

SEQ ID NO: 27417 - DNA, 50 bp, homo sapien
cttttctgtctctgaagacagctaaytcctggctagaaacctgaaagtca

SEQ ID NO: 27418 - DNA, 50 bp, homo sapien
ggaaacatagtaggcacccaagttakgatttgatgatgcagaatgggatg

SEQ ID NO: 27419 - DNA, 50 bp, homo sapien
ggcgagggagggtccacttttctcamcttatgagttctgtacaattggaa

SEQ ID NO: 27420 - DNA, 50 bp, homo sapien
aaaatacctgatatctccctcagaawttcaagctgttcttattgagtccc

SEQ ID NO: 27421 - DNA, 50 bp, homo sapien
catttctcatctataaaataattacyatcactgaatggagatgttgcacg

SEQ ID NO: 27422 - DNA, 50 bp, homo sapien
gatccaggccaagtcctcattatcaytcctctacaatgtgctaaaatccc

SEQ ID NO: 27423 - DNA, 50 bp, homo sapien
tcagtatgtatttcagtatatctaaygggctttctttggaaaagggcagg

SEQ ID NO: 27424 - DNA, 50 bp, homo sapien
caagaagtgacagagttaagagttaycaggacataagagtaactggactt

SEQ ID NO: 27425 - DNA, 50 bp, homo sapien
gttttctctgttcttatctgtagaasgagaagactgatccagataacttc

SEQ ID NO: 27426 - DNA, 50 bp, homo sapien
gtatgatacaatctacaaacacatasagtgactcactagctctgctaggc

SEQ ID NO: 27427 - DNA, 50 bp, homo sapien
tttcatttagttttaatttgtctcaygatgtagttctctcagtaatcaca

SEQ ID NO: 27428 - DNA, 50 bp, homo sapien
acgcatcctgcattaagattgaaaargttataggagttggtaagtgtctg

SEQ ID NO: 27429 - DNA, 50 bp, homo sapien
tctgaatttaatacacgggtctatgyagattagcgtcattatgtagaaat

SEQ ID NO: 27430 - DNA, 50 bp, homo sapien
actgtcatttctgcttatttcaggamaactcacaagccatgtttttcctc

SEQ ID NO: 27431 - DNA, 50 bp, homo sapien
tgattgatatagtaattcaacttaaktctgtttttaatctttctaaatta

SEQ ID NO: 27432 - DNA, 50 bp, homo sapien
aacagcccaaatgtccatcaagtgaytaatgaataaacaaaatgtgatat

SEQ ID NO: 27433 - DNA, 50 bp, homo sapien
caaatccaatggtctgtgtttccatyagcatcacgacccaaaagcagcag

SEQ ID NO: 27434 - DNA, 50 bp, homo sapien
ctacactgcctctatatacctagackcttatattcttctcagaagtcttt

SEQ ID NO: 27435 - DNA, 50 bp, homo sapien
gaaataatagagttcaagtggtttamctcttattacatggtgtgctagag

SEQ ID NO: 27436 - DNA, 50 bp, homo sapien
ggttgggcgaggctaggttgaaagartagggtcgagtgagccaggctggg

SEQ ID NO: 27437 - DNA, 50 bp, homo sapien
attcgaagatcaattcaaaggatcawgtcaagttctcataatttcctgaa

SEQ ID NO: 27438 - DNA, 50 bp, homo sapien
atatttcaaatgcttgtaactcataygcacacatctgcaaacacacacac

SEQ ID NO: 27439 - DNA, 50 bp, homo sapien
aagtacccaagaccgtgtaaccaagrccactgattcagaagtcagtcaca

SEQ ID NO: 27440 - DNA, 50 bp, homo sapien
agtctctaacgagaggctagaaatargagtaaaataggaaaacaaatggt

SEQ ID NO: 27441 - DNA, 50 bp, homo sapien
tataaaaacagctaacatttgtgaargatttattatattccaggttccat

SEQ ID NO: 27442 - DNA, 50 bp, homo sapien
cagagtggctgcaataaactgaaacsattagtgctatttgcaaactaagt

SEQ ID NO: 27443 - DNA, 50 bp, homo sapien
agagacttcgtctggtatctggtacwcgagaaagattacttttcaccaag

SEQ ID NO: 27444 - DNA, 50 bp, homo sapien
ttttaaagtttcccccttaagaaaaytctctctacctaatgatacttaaa

SEQ ID NO: 27445 - DNA, 50 bp, homo sapien
tctgctgtaaagaaactttgcataaygatgttttcagaatttctttgagc

SEQ ID NO: 27446 - DNA, 50 bp, homo sapien
gtctttccatgtagtaacgagggacygtatatcagtaagaccccattgct

SEQ ID NO: 27447 - DNA, 50 bp, homo sapien
tttcaattgttaggtatatacaagcmcaggaaacactgaatataactact

SEQ ID NO: 27448 - DNA, 50 bp, homo sapien
tagagaattctgaattacgtctgtawaacatatgtatcgttacctatatt

SEQ ID NO: 27449 - DNA, 50 bp, homo sapien
aggaatcactcatgaacattacttasccagtttgcatgaaatagatattt

SEQ ID NO: 27450 - DNA, 50 bp, homo sapien
acgtaattcagaattctctaatacaygtacctggatgtggtcctcctgat

SEQ ID NO: 27451 - DNA, 50 bp, homo sapien
atcatattaaaatgcaagggttctayggatttgactcttattatcagata

SEQ ID NO: 27452 - DNA, 50 bp, homo sapien
tatcatgatatcaaggatagggccarctgtttttattattcctaagactt

SEQ ID NO: 27453 - DNA, 50 bp, homo sapien
ttgactaatgtatcaaaaaagaaacscaaaattatatgaaaaagatatta

SEQ ID NO: 27454 - DNA, 50 bp, homo sapien
ctacagcccttcaatatgcacataarccatctctggaatccttcttcctc

SEQ ID NO: 27455 - DNA, 50 bp, homo sapien
atttgcccaagtagtaggttgaaaaytagggattcagattcagctccaca

SEQ ID NO: 27456 - DNA, 50 bp, homo sapien
attccaggaattaagaatttccatckcagaatgtatcaggaagtggagaa

SEQ ID NO: 27457 - DNA, 50 bp, homo sapien
agtcaaacctgactgccattctagascctttgcttcaggtcaggtaattt

SEQ ID NO: 27458 - DNA, 50 bp, homo sapien
ggctttaattcgcatttcttatctasggtgcccaaaagttggctgtctct

SEQ ID NO: 27459 - DNA, 50 bp, homo sapien
ctattattataccaatatttagccaygattaggccaatattaaaattgga

SEQ ID NO: 27460 - DNA, 50 bp, homo sapien
aagtttatttacaaatgcaggtggaygtaaaagttcactagtttctttag

SEQ ID NO: 27461 - DNA, 50 bp, homo sapien
tacaagaggttacacacttactctawggattacatgtgaatcatatatga

SEQ ID NO: 27462 - DNA, 50 bp, homo sapien
gttcaccaaaacatcgcatagaaatyatctcagggatttttgaatatggt

SEQ ID NO: 27463 - DNA, 50 bp, homo sapien
ggctagacataatatctgtgaggaaygtattaacatagtatctgtgagga

SEQ ID NO: 27464 - DNA, 50 bp, homo sapien
tgtgtataacatactttactcatccraggcatgttgttaagaataagagt

SEQ ID NO: 27465 - DNA, 50 bp, homo sapien
actatttaatgtatgttgagatatayagacacctctaaaacaattataaa

SEQ ID NO: 27466 - DNA, 50 bp, homo sapien
ggatctgtgacctttggcagatggartagtatttgaatacacaaaatcag

SEQ ID NO: 27467 - DNA, 50 bp, homo sapien
ctcctctaaggcagatcttcaaaacraatctggtgaattaaggttgagat

SEQ ID NO: 27468 - DNA, 50 bp, homo sapien
attgagaaaaacacaataaggagtasaaaggaccatttcgatttggggac

SEQ ID NO: 27469 - DNA, 50 bp, homo sapien
cacacgtcttctagtaaaattgctayatttcactaggagatgtgcaattc

SEQ ID NO: 27470 - DNA, 50 bp, homo sapien
ccaggtgggatggggtatattaccasgcacaagatctctatggatagaag

SEQ ID NO: 27471 - DNA, 50 bp, homo sapien
ctctctatttgcttcctcctttagcrcatagtaatagtcattcatcccag

SEQ ID NO: 27472 - DNA, 50 bp, homo sapien
cttgaggtggctaagattaaatccaygaagttagaaggggtaggaagaga

SEQ ID NO: 27473 - DNA, 50 bp, homo sapien
taatcctttgggcaacaacagttgasatatcgcctaagtgaaaagttgaa

SEQ ID NO: 27474 - DNA, 50 bp, homo sapien
agtaattgatgggtagagaaataacygaacaaagaatagctttgagagag

SEQ ID NO: 27475 - DNA, 50 bp, homo sapien
gatattttataatatgatatgatagycctttgtatctactatcatgtggc

SEQ ID NO: 27476 - DNA, 50 bp, homo sapien
tcaacagcaatctccccagaacttaygatatgattcaattacatacaagc

SEQ ID NO: 27477 - DNA, 50 bp, homo sapien
tatgccctttacatttgtaatataayttagtggcccagatattaatggta

SEQ ID NO: 27478 - DNA, 50 bp, homo sapien
ccaaatgctctcagcatagttaaaayatcatgtcctgagctgaactaaga

SEQ ID NO: 27479 - DNA, 50 bp, homo sapien
atcacctggctcttagatacattaarcgtgtcacagcaagatataaatgc

SEQ ID NO: 27480 - DNA, 50 bp, homo sapien
tccatttcttctttctctattctgayaaattggtaggcctgatctaaacg

SEQ ID NO: 27481 - DNA, 50 bp, homo sapien
aagaagtgagacatcctcatctgaayctttttcagccatgcactcttctt

SEQ ID NO: 27482 - DNA, 50 bp, homo sapien
cccagttaacttactggctctgaaaygatactttcttaacctatatttaa

SEQ ID NO: 27483 - DNA, 50 bp, homo sapien
gaagcattcactaacagacattagcrgctaataaggcatcattatcacta

SEQ ID NO: 27484 - DNA, 50 bp, homo sapien
ctagttgactaccatgtgggtttgarcagtctgtttccttgcctccaaaa

SEQ ID NO: 27485 - DNA, 50 bp, homo sapien
agattaaagataggacatgttgcagycattgcctgattaattctattttt

SEQ ID NO: 27486 - DNA, 50 bp, homo sapien
cattttgattgctataactaaaatawcatagacgagtggctcaagccttt

SEQ ID NO: 27487 - DNA, 50 bp, homo sapien
ctcgtgttattctcctatgttcagaygttaatgaatccagagttgtgtgg

SEQ ID NO: 27488 - DNA, 50 bp, homo sapien
agaataagaagttgtatttagggaaytgtttttcagacatagggaaaaaa

SEQ ID NO: 27489 - DNA, 50 bp, homo sapien
ataaagtattattttgatttaggagragagtggaaatttgttttcatcac

SEQ ID NO: 27490 - DNA, 50 bp, homo sapien
ataagacaggtctttccgataccgamccatttaggagtcatgattctata

SEQ ID NO: 27491 - DNA, 50 bp, homo sapien
agaatagggtttctttcccaattccrcttgaaatcaacctaccttgactt

SEQ ID NO: 27492 - DNA, 50 bp, homo sapien
tgctttgaaaactggacaactcttaygctactacgtatcatcagtaaact

SEQ ID NO: 27493 - DNA, 50 bp, homo sapien
aacagagagagtgactgggaacccgyagtagattagccacaattccaaaa

SEQ ID NO: 27494 - DNA, 50 bp, homo sapien
agcagttcttgtatctgagagaataycatgcaaaggagaaaatattttga

SEQ ID NO: 27495 - DNA, 50 bp, homo sapien
agatggagtgatccctgcttctcacygtagccaagataagtcatgccttc

SEQ ID NO: 27496 - DNA, 50 bp, homo sapien
ttgcttccacgtttaatgcttagaaytgtctaattttcttacctatctag

SEQ ID NO: 27497 - DNA, 50 bp, homo sapien
caagaattattcttctctgacaccaratttaagtgtgtttacttttaaaa

SEQ ID NO: 27498 - DNA, 50 bp, homo sapien
aataaataatgatcacaggaatgaaygcatgctgaaaagaccactctttt

SEQ ID NO: 27499 - DNA, 50 bp, homo sapien
ctttggaattgaagacaaaacctacycttttcttgagcatttactgcacc

SEQ ID NO: 27500 - DNA, 50 bp, homo sapien
atttgaagaaaaattccaggacttayacattcaaaggagtggtgttccct

SEQ ID NO: 27501 - DNA, 50 bp, homo sapien
agtaactaaagttaagttatatttasagaaacatttttagataacttctg

SEQ ID NO: 27502 - DNA, 50 bp, homo sapien
agaaatatttacctgagtggaaagarcttagattttgggattacatagac

SEQ ID NO: 27503 - DNA, 50 bp, homo sapien
tcaatgcatatcccaaaaagtgtatsagtaagtaagagaagatttaagaa

SEQ ID NO: 27504 - DNA, 50 bp, homo sapien
ttttcccaggaatttaattttttgaygctattataagtgagactatttcc

SEQ ID NO: 27505 - DNA, 50 bp, homo sapien
aaagtttagtaaatatttttaatagycattatgttacagaaaagcaagct

SEQ ID NO: 27506 - DNA, 50 bp, homo sapien
tggttggatgtgacactaatctgaasgaccaccttgtagacaggagactt

SEQ ID NO: 27507 - DNA, 50 bp, homo sapien
cagtttgggggtggatgaagcaagayggtacatgatcggccatttgctgt

SEQ ID NO: 27508 - DNA, 50 bp, homo sapien
ggtgaatgaaatgggcatggacataygtgtgtttatactcacagtacatt

SEQ ID NO: 27509 - DNA, 50 bp, homo sapien
aggtaggtgacaggtgacagtaaacraggatggatccttatggggagcac

SEQ ID NO: 27510 - DNA, 50 bp, homo sapien
gtccctataaaattaatgcattgtayatgaagaattagcataaaacatac

SEQ ID NO: 27511 - DNA, 50 bp, homo sapien
ctctgataaagcagagatgttgagamcaaaagaggtaggtattggaggga

SEQ ID NO: 27512 - DNA, 50 bp, homo sapien
ctgtttgctagctttgtgacattggrcagtaatatggttaggctttgtgt

SEQ ID NO: 27513 - DNA, 50 bp, homo sapien
atatggtgacttctatatgcatacaytgagatacatgcagagcttaccaa

SEQ ID NO: 27514 - DNA, 50 bp, homo sapien
tccaagcttacaaatgctataaccaragagaatacactctagctccttct

SEQ ID NO: 27515 - DNA, 50 bp, homo sapien
ataatatagtacagaagatagtaacrgactttggtcatttacagtattat

SEQ ID NO: 27516 - DNA, 50 bp, homo sapien
tccaagcttgattctgtcttactaaygaagattttagatatttctaatga

SEQ ID NO: 27517 - DNA, 50 bp, homo sapien
aaaatcagcagatttaatgtgaaaarggatcttcagtaggtgcagaatcg

SEQ ID NO: 27518 - DNA, 50 bp, homo sapien
tctgttcaagtgggaaaatgggaccrcatacatcaatatctactagggtg

SEQ ID NO: 27519 - DNA, 50 bp, homo sapien
atggaatgaccctattgtcctggtaygatcccaacacagtgatgcagtac

SEQ ID NO: 27520 - DNA, 50 bp, homo sapien
agcaacgctatgttcaccttatcatkagtgcaagacaaatacataattga

SEQ ID NO: 27521 - DNA, 50 bp, homo sapien
tcagtcttatttctgaagacaagtcwatgtttaatgcagatcattccagt

SEQ ID NO: 27522 - DNA, 50 bp, homo sapien
attagctcccctgaaactaggccaaratgatgataggcagagtttcaaaa

SEQ ID NO: 27523 - DNA, 50 bp, homo sapien
ttcaaaaaatggatgttgtttagacyggtaaagtgcggtgtgatcttttg

SEQ ID NO: 27524 - DNA, 50 bp, homo sapien
ctgcatagcttctattaactacttayagcaagatgtgagaaaacagaaat

SEQ ID NO: 27525 - DNA, 50 bp, homo sapien
ctcttataaagtactttccaattcastattaggtaccagaaaaaataccg

SEQ ID NO: 27526 - DNA, 50 bp, homo sapien
accttacgaccagatctcaacaagcmaaaatttaataactggtcaaccaa

SEQ ID NO: 27527 - DNA, 50 bp, homo sapien
atagaaacatgggcagtaacgactakcctgatgaagcctcagatggaagt

SEQ ID NO: 27528 - DNA, 50 bp, homo sapien
ctgtgtctagactgtgtcttgggaayatgttatagttttctttaggttca

SEQ ID NO: 27529 - DNA, 50 bp, homo sapien
tttctatgagcattctggtcacaacyatttaggtgatcactaagaagaca

SEQ ID NO: 27530 - DNA, 50 bp, homo sapien
tgaatgaggacagaaatcagtaccarataagtgggggtgttgctacaaca

SEQ ID NO: 27531 - DNA, 50 bp, homo sapien
aaactcttctatttagactctcagcwcaaaggttatagaaatcttagata

SEQ ID NO: 27532 - DNA, 50 bp, homo sapien
tgtacctgttgttcaatatgtagagmaagccataggattcagggtggttt

SEQ ID NO: 27533 - DNA, 50 bp, homo sapien
gttgctcttggtctcctgtgttgaartggaagtgttagtttaaaagttca

SEQ ID NO: 27534 - DNA, 50 bp, homo sapien
ggtattttcccaatttgctgcagaaytgtctgttggattttagtatcttt

SEQ ID NO: 27535 - DNA, 50 bp, homo sapien
taagggcttctaatgcatataaaaaygatgccatcttgtccaggagcgtt

SEQ ID NO: 27536 - DNA, 50 bp, homo sapien
ttgtaacaaacgagcctcctctgtaycataactttgagttctgctgttct

SEQ ID NO: 27537 - DNA, 50 bp, homo sapien
atcaagtattcatttgaactttgctracattatctcaatgtatccaactt

SEQ ID NO: 27538 - DNA, 50 bp, homo sapien
ctctgcttgtcagcccttatcttaarcaaacacccaatagtccatgttgt

SEQ ID NO: 27539 - DNA, 50 bp, homo sapien
catttagcctttgtttgtttcaccartattaatttaaaaggaagcaagct

SEQ ID NO: 27540 - DNA, 50 bp, homo sapien
agttcaatgtatggcttgatagttamacaatgtacagttctagctacacg

SEQ ID NO: 27541 - DNA, 50 bp, homo sapien
aacacagagctgaagggtctaaatgractgtatggcagatcttggaatcg

SEQ ID NO: 27542 - DNA, 50 bp, homo sapien
atcactatcacacctaacaaagtagwattttaatatctgctagtacatta

SEQ ID NO: 27543 - DNA, 50 bp, homo sapien
actagctaaaatatttgattttgtargagtagagcaatgttgcatttata

SEQ ID NO: 27544 - DNA, 50 bp, homo sapien
tgtccaagagtatgtttggaaactasgttttaagatattgaaatttaccc

SEQ ID NO: 27545 - DNA, 50 bp, homo sapien
gtcttttgtttctctgtagtagaaamggttataaccaaatcttgactaat

SEQ ID NO: 27546 - DNA, 50 bp, homo sapien
tgtttgaggtctgattactcaattaygaaacctccttcaacaaaaggagg

SEQ ID NO: 27547 - DNA, 50 bp, homo sapien
cagatattctgttgtagcggcaacamaatgaatgaggacagaaatcagta

SEQ ID NO: 27548 - DNA, 50 bp, homo sapien
aaaaaaatctagttaaactattgcawctgtcctgagatttcaaaatacct

SEQ ID NO: 27549 - DNA, 50 bp, homo sapien
gatccaactatcagcatctatacaayttcaatggttacatgtgattttta

SEQ ID NO: 27550 - DNA, 50 bp, homo sapien
agcgaagacttgtttaatgtaaaaawtgcactgtttctcttcttctctct

SEQ ID NO: 27551 - DNA, 50 bp, homo sapien
agcattggtgcaatcacttctgatarcactgtagcagatttaaaagcttg

SEQ ID NO: 27552 - DNA, 50 bp, homo sapien
acactttatcataggtactatgatasactaagactttactctgaacagct

SEQ ID NO: 27553 - DNA, 50 bp, homo sapien
aaccaatatgaaatatacctctaaartatttgactgcatttgaatagcag

SEQ ID NO: 27554 - DNA, 50 bp, homo sapien
aaccatgcttttgtcaatcatgtgarataggaaagtaaaatcaaatagtt

SEQ ID NO: 27555 - DNA, 50 bp, homo sapien
aacataaacatctataaaataaatgrcaccattcaaggtatttgcaaaac

SEQ ID NO: 27556 - DNA, 50 bp, homo sapien
attcagataagtgctatagtggataygcatagaaggctgtgatagccaag

SEQ ID NO: 27557 - DNA, 50 bp, homo sapien
tcagtcactaagaacagttcaataaktagttttgcaatgttatttatctt

SEQ ID NO: 27558 - DNA, 50 bp, homo sapien
gctgaaagtcacaaagttaataaacrgctcaacagggatttacattttgg

SEQ ID NO: 27559 - DNA, 50 bp, homo sapien
aagtgcagtgtaactggcatatcccraggaggttaacctaggctggagtg

SEQ ID NO: 27560 - DNA, 50 bp, homo sapien
tgttgtgttcacagattaggagacaygatattgttaaaatgtaaattctc

SEQ ID NO: 27561 - DNA, 50 bp, homo sapien
tgagatattctgtttatgtattccaygtttgatctggtgttcagccatgt

SEQ ID NO: 27562 - DNA, 50 bp, homo sapien
agtacaaccactatggaaaacaatasagcgattctttaaagaactaaaag

SEQ ID NO: 27563 - DNA, 50 bp, homo sapien
tttcgttggtacatttggatgcatcrgaaaattatctttcattgctctct

SEQ ID NO: 27564 - DNA, 50 bp, homo sapien
aacctggcaatgattcttcataaaaytggtctgattcatcctagttattc

SEQ ID NO: 27565 - DNA, 50 bp, homo sapien
atgcccatggagtattacccacaaartatagacaaacgcaatcagactca

SEQ ID NO: 27566 - DNA, 50 bp, homo sapien
gaaggaggagattattctgaaatcaytctagatagattgagcagtcagca

SEQ ID NO: 27567 - DNA, 50 bp, homo sapien
tgtacctgatatgttcaccatatcarattgaatactttgggaaccctgac

SEQ ID NO: 27568 - DNA, 50 bp, homo sapien
agggacaaaaagaggaaagaaatccyagtaagcgatgtctgactcaggaa

SEQ ID NO: 27569 - DNA, 50 bp, homo sapien
atgctaataaattggatactgagaargtgcaaaaggaactgagtgctcct

SEQ ID NO: 27570 - DNA, 50 bp, homo sapien
gcttctcagtcatgagacacgaaacmattgcatatctatagactgatggt

SEQ ID NO: 27571 - DNA, 50 bp, homo sapien
tctgtaggcctatagtttagatctaygctttcctgacacatggtgaataa

SEQ ID NO: 27572 - DNA, 50 bp, homo sapien
gtggaatttttgattactctgactayagttgtacaattgacccctgaaca

SEQ ID NO: 27573 - DNA, 50 bp, homo sapien
tccaagttctatcctacttccaataygtgtcttgcatctttttctgtaca

SEQ ID NO: 27574 - DNA, 50 bp, homo sapien
aagaaaataatgtaaccagatagaaragtattgagttgatcagcttataa

SEQ ID NO: 27575 - DNA, 50 bp, homo sapien
tagtggggagaatcaactcagctaaygaagacttaacatatacaaacatg

SEQ ID NO: 27576 - DNA, 50 bp, homo sapien
ctcaccacattcatatccatgttacrgaacttagcacactgcaacactac

SEQ ID NO: 27577 - DNA, 50 bp, homo sapien
agttttgatgggtatatcttttaacwgagagatgataaattatttagtta

SEQ ID NO: 27578 - DNA, 50 bp, homo sapien
aaggtatggacttcacctggtacaasagccatgaagtggtaataagggaa

SEQ ID NO: 27579 - DNA, 50 bp, homo sapien
ccaaaaaaaatgggattcactgaacygggaaaaatagctgtgtgctcctg

SEQ ID NO: 27580 - DNA, 50 bp, homo sapien
taaacaacttgcgtgcaaccatttcracatgctactcatgaacaccattt

SEQ ID NO: 27581 - DNA, 50 bp, homo sapien
agaaaaagtgtgaaaattattttgarggtgatgatagaaacatgttgcaa

SEQ ID NO: 27582 - DNA, 50 bp, homo sapien
tttatacaatcaaaatgttctttaawaaaccatgcatacacttatctttg

SEQ ID NO: 27583 - DNA, 50 bp, homo sapien
gtgcagtttacctacaactatcacawctcatccatatcccaagcagattg

SEQ ID NO: 27584 - DNA, 50 bp, homo sapien
acctgtgttatctcaacatttagtaytaaggagcactctgttgccacata

SEQ ID NO: 27585 - DNA, 50 bp, homo sapien
tttctgtgctggtggtcttttctcargccaatcctccctcttttaggtaa

SEQ ID NO: 27586 - DNA, 50 bp, homo sapien
agcaaagcatcttatgcttcagtgayactttaattaccaagaaattaccc

SEQ ID NO: 27587 - DNA, 50 bp, homo sapien
aaatcccttgtgcacttctgaataarctcaatatttttggagactctctg

SEQ ID NO: 27588 - DNA, 50 bp, homo sapien
caatttataagtagacaaagctaaamgctgatttaagtacattaatatgt

SEQ ID NO: 27589 - DNA, 50 bp, homo sapien
accaactcttctttccttttttctaycagtagatacatattcttatattt

SEQ ID NO: 27590 - DNA, 50 bp, homo sapien
caccaacacacaggatggaatttaartctgtatagttagcagagatgaaa

SEQ ID NO: 27591 - DNA, 50 bp, homo sapien
attttactttggaatgagttctgcayagcaattctaatacaattttgtag

SEQ ID NO: 27592 - DNA, 50 bp, homo sapien
gccccaaatcagaaggactaggagaraagggatactgaattgactgagga

SEQ ID NO: 27593 - DNA, 50 bp, homo sapien
ataggcattctatatttcatacttakagcacttaatatagtaacagatca

SEQ ID NO: 27594 - DNA, 50 bp, homo sapien
taaaccatgcttttactaaattactracttttctggtcaagtggacagat

SEQ ID NO: 27595 - DNA, 50 bp, homo sapien
atggttctgaaattgatcatggaaaygaggtagtatttatcaggctttct

SEQ ID NO: 27596 - DNA, 50 bp, homo sapien
atttatgaaagcatttgatttggtayggtcaatgatagccttatttctga

SEQ ID NO: 27597 - DNA, 50 bp, homo sapien
tttattttgagattaaactatctggraagtattgagaaatttggtatatt

SEQ ID NO: 27598 - DNA, 50 bp, homo sapien
cacattgccgagaaatggactcacartcaaaaaggatggtttgttggcag

SEQ ID NO: 27599 - DNA, 50 bp, homo sapien
caaatgcaatagattaatttcttacrcgtcaccatttgggaacaaagtag

SEQ ID NO: 27600 - DNA, 50 bp, homo sapien
tttatagggtaatttgcaataacagrccaattagaatagctaacttttaa

SEQ ID NO: 27601 - DNA, 50 bp, homo sapien
cctggggtgaacttatcttcagggcrcaatgcttataaatgccctagctc

SEQ ID NO: 27602 - DNA, 50 bp, homo sapien
ttttctccaaaaaataagcctaaacygtgcgagtgaaaagaaaaataata

SEQ ID NO: 27603 - DNA, 50 bp, homo sapien
aggctgtaaactcaagcctttagacmactgtatgatgggaaaacataaaa

SEQ ID NO: 27604 - DNA, 50 bp, homo sapien
agcttggctagtttggtacctcctamggaatacataacatctgaaagatg

SEQ ID NO: 27605 - DNA, 50 bp, homo sapien
gtgctaggacccaagggcatggatargaatatcaagaaagcatcagagaa

SEQ ID NO: 27606 - DNA, 50 bp, homo sapien
ttcagtcagttccaactgctattaaygaattactgcagatctgggggctt

SEQ ID NO: 27607 - DNA, 50 bp, homo sapien
ggcctcagcagtgcgtctgtgtacargatcgctgcaggacgaactgagat

SEQ ID NO: 27608 - DNA, 50 bp, homo sapien
acagaaatgtcgtgagctgaagctcrcggtcgaatcttgaatttcctcag

SEQ ID NO: 27609 - DNA, 50 bp, homo sapien
tccgggatgtctcccaggatgatgaygtgttgaagctcaaaggaagacca

SEQ ID NO: 27610 - DNA, 50 bp, homo sapien
caacaagactttggatgcaaaaacaygttgggcaaaacaagacaagcttg

SEQ ID NO: 27611 - DNA, 50 bp, homo sapien
cagctgagttccactgagcaatatcyatgggcacatgaggcacagaggag

SEQ ID NO: 27612 - DNA, 50 bp, homo sapien
tacacatggggactacacagatggcygagcatgatatttggtgcatagat

SEQ ID NO: 27613 - DNA, 50 bp, homo sapien
ctcttcattattcttttaaatactcrcggctgttcttgaactttggctca

SEQ ID NO: 27614 - DNA, 50 bp, homo sapien
tgcccaggaagaactcagtcacaaamatttgttttaagttatttttactt

SEQ ID NO: 27615 - DNA, 50 bp, homo sapien
gattgaagggttgagatcggcaataygtaaccctggaggtacaggtggag

SEQ ID NO: 27616 - DNA, 50 bp, homo sapien
catcaatctgaaccaagtaagataamtcagtttcactatgaaccagacat

SEQ ID NO: 27617 - DNA, 50 bp, homo sapien
aggaacaatacgatttagtccatcartctgaaccaagtaagataactcag

SEQ ID NO: 27618 - DNA, 50 bp, homo sapien
agtggagggatattagtgaaattcartcaagacaggaaatgtagaaggaa

SEQ ID NO: 27619 - DNA, 50 bp, homo sapien
caggttccactccagaccttctgaamcaggaaccaggaactcagaggtga

SEQ ID NO: 27620 - DNA, 50 bp, homo sapien
ggtactctccatagatgtttccaacraatacttttagcaggagaatataa

SEQ ID NO: 27621 - DNA, 50 bp, homo sapien
cttggtaaatagagaaataatgtcartataacgtggaagtagtgttggtt

SEQ ID NO: 27622 - DNA, 50 bp, homo sapien
tcagagctttgactgcacatgtttamaatgacagtcctttaattaaaatt

SEQ ID NO: 27623 - DNA, 50 bp, homo sapien
tatgtatatgtaccttcaacacataygtaagaatctaatctgggttagat

SEQ ID NO: 27624 - DNA, 50 bp, homo sapien
gactaccttctttgtgccaagcaccygaaataagacttggaccctacata

SEQ ID NO: 27625 - DNA, 50 bp, homo sapien
tccttctaaagtttaaggaaattgcygaacaactttgctgttctggctgc

SEQ ID NO: 27626 - DNA, 50 bp, homo sapien
aaggctgagtgcccaggaccaaggamggtaggatgccaggtgctgctaac

SEQ ID NO: 27627 - DNA, 50 bp, homo sapien
tcaataaaacaaaccagacaacaaaragtacttgtgggattccagtgaca

SEQ ID NO: 27628 - DNA, 50 bp, homo sapien
aaaccaaaacatgaaagtactgaaartttatcacagatggtagtatgcaa

SEQ ID NO: 27629 - DNA, 50 bp, homo sapien
cacacacatatatatatttgagtaaraggaaatatagctgagcatcagag

SEQ ID NO: 27630 - DNA, 50 bp, homo sapien
aagaggtcataatttcttctgggaargatgtgttgttatagaaaggaatg

SEQ ID NO: 27631 - DNA, 50 bp, homo sapien
gcattttctatgccttttgtaagaayggactcacgcacaggctatttttg

SEQ ID NO: 27632 - DNA, 50 bp, homo sapien
ctatgacttttctaaaaacacaatargagcagaaatgagttgctttatgg

SEQ ID NO: 27633 - DNA, 50 bp, homo sapien
aaagtcttaattaccacacagtatgraaatgattcctattccaaatattt

SEQ ID NO: 27634 - DNA, 50 bp, homo sapien
gcttgtttatttctttgcccttttcrctgaggcatttatcttgtatttat

SEQ ID NO: 27635 - DNA, 50 bp, homo sapien
taatcattgcaactccatgagtaaayttaaaatgcaacactatcatgaag

SEQ ID NO: 27636 - DNA, 50 bp, homo sapien
cctgtttcaaaagaaataaaaggaartgtaggtggacagatggatttagg

SEQ ID NO: 27637 - DNA, 50 bp, homo sapien
ggaacgaatgctactcagtgtaagaygcaacttcaggataagaaagataa

SEQ ID NO: 27638 - DNA, 50 bp, homo sapien
tacccaggcccagttctaagcaactsagggagcactggactacttttttt

SEQ ID NO: 27639 - DNA, 50 bp, homo sapien
taattgcagtagtttataaacagtcwagtatatctgtgcttcttacacac

SEQ ID NO: 27640 - DNA, 50 bp, homo sapien
gtaagaacacagaagacctgaacaaygtaactttaagactgagtgtgtga

SEQ ID NO: 27641 - DNA, 50 bp, homo sapien
taccttatattccttactctggaaaktcttctacattctctatatgtttt

SEQ ID NO: 27642 - DNA, 50 bp, homo sapien
tctttgaatcatacagttttctcaakgtctgttataagtataattttatt

SEQ ID NO: 27643 - DNA, 50 bp, homo sapien
caatcaagaattccattactgaggawgcaagcactaaagtaattgctgct

SEQ ID NO: 27644 - DNA, 50 bp, homo sapien
tgagttaatatacaaatactcatgaygtaagctaaatccatttctgttac

SEQ ID NO: 27645 - DNA, 50 bp, homo sapien
taatctggtctagcagttggcatgawtcaaagtaccgcagagaaacatca

SEQ ID NO: 27646 - DNA, 50 bp, homo sapien
atttaatattttctaaagctataacrattgagctagagactggatccaaa

SEQ ID NO: 27647 - DNA, 50 bp, homo sapien
aataacacttagttgatctattcaarctggatctcaaccaagtttccaga

SEQ ID NO: 27648 - DNA, 50 bp, homo sapien
atggagggataaatacatttatgaasggtttttggaatatgtcttctttt

SEQ ID NO: 27649 - DNA, 50 bp, homo sapien
gggaaccatccccatgattcaattaycattatcccacattgacatgtggg

SEQ ID NO: 27650 - DNA, 50 bp, homo sapien
ttttggaaatgtgttaccagatactyaatttactgcaagttcattttgga

SEQ ID NO: 27651 - DNA, 50 bp, homo sapien
aaatatacaaataaatagacgtttcraaagtatgaagtgtgctgtggtgg

SEQ ID NO: 27652 - DNA, 50 bp, homo sapien
tttgatccccagggttcgttacaggwacaactgggcccaagttcagagct

SEQ ID NO: 27653 - DNA, 50 bp, homo sapien
tcttctgttctttcgtggcttctaaygtcaaaggacttttatttacctgt

SEQ ID NO: 27654 - DNA, 50 bp, homo sapien
ttgtctaccccatagatatagacaaygctacacttggaaagcagaacctt

SEQ ID NO: 27655 - DNA, 50 bp, homo sapien
aattccaccaaaatgggattttcaaraactataaactcagaaactataaa

SEQ ID NO: 27656 - DNA, 50 bp, homo sapien
aatataaattaggtcatattaacacyagatctcaccagctctttaggcct

SEQ ID NO: 27657 - DNA, 50 bp, homo sapien
tcctgtgggctccactttctcctcaygggacctttattaattcaacactt

SEQ ID NO: 27658 - DNA, 50 bp, homo sapien
tctgggcagaaacagtcaactctgcygaaaggaacaacttaagtaataca

SEQ ID NO: 27659 - DNA, 50 bp, homo sapien
gtggggaagacagatgtcattcaacrgtcaatggcaaaagaacgtgacat

SEQ ID NO: 27660 - DNA, 50 bp, homo sapien
gagaaccattcagtgtggccaattaycagagctgtttatcacaggtaatg

SEQ ID NO: 27661 - DNA, 50 bp, homo sapien
tgggggggttctggattagctacatyagaaacatctggatatagttttaa

SEQ ID NO: 27662 - DNA, 50 bp, homo sapien
gtgactgataaatataaattagctaragtagagccaggcacgttggaagt

SEQ ID NO: 27663 - DNA, 50 bp, homo sapien
cgttgtattgctacacttaatacacycaatagaaagagggcagcttttcc

SEQ ID NO: 27664 - DNA, 50 bp, homo sapien
agttttagtcaactattgattttacsatttattcagtagccaataagtgt

SEQ ID NO: 27665 - DNA, 50 bp, homo sapien
ccactattagatgtataagattttcractccattgcaattactatattgt

SEQ ID NO: 27666 - DNA, 50 bp, homo sapien
ttaatgcatttaatcctcacgataastctataaacctggtacaattatta

SEQ ID NO: 27667 - DNA, 50 bp, homo sapien
tgcaatttttcacagtgatagagaakttagtgagaacttgaggttgagtt

SEQ ID NO: 27668 - DNA, 50 bp, homo sapien
tacttcttaaatattttattctaacractttcataatgaatatctcaaac

SEQ ID NO: 27669 - DNA, 50 bp, homo sapien
aaataagtggtttagacaatagttasgaatgggcccaaagttaacgatat

SEQ ID NO: 27670 - DNA, 50 bp, homo sapien
agtacagttgtgtagatctgaaaacyatgtttaagtcaggactgcagttt

SEQ ID NO: 27671 - DNA, 50 bp, homo sapien
tgcttctaattgatatatctactcaytaatggccctaactattgttctta

SEQ ID NO: 27672 - DNA, 50 bp, homo sapien
tggggctacatcctggggtgaagaakatatgtgaaacagagccacagttg

SEQ ID NO: 27673 - DNA, 50 bp, homo sapien
ctgttacaaacagggaatcatctagkgtctaatgggtagaatccagggag

SEQ ID NO: 27674 - DNA, 50 bp, homo sapien
tcctattattctacctgtgattttargtgctcctcgtatctgcacaaact

SEQ ID NO: 27675 - DNA, 50 bp, homo sapien
ggtagatgtcttaaaataataacaaygagaaaagctggtcctcaaaagag

SEQ ID NO: 27676 - DNA, 50 bp, homo sapien
agaagccctaagcccacattctttcratagctcacggtggtgcatgagtg

SEQ ID NO: 27677 - DNA, 50 bp, homo sapien
gaatgtgtggattgaagacaaaaatwacgcagtcatcctcaacgtaatgt

SEQ ID NO: 27678 - DNA, 50 bp, homo sapien
tgggatgtgtatgtggtaaaataaargtgagtacatttccagccttgtag

SEQ ID NO: 27679 - DNA, 50 bp, homo sapien
tttttcttccccgaaatttcactcartaggctgaaaagattatcttacat

SEQ ID NO: 27680 - DNA, 50 bp, homo sapien
ctcttcaccatgatattatataatcrctttttcaggaaggaagcttggac

SEQ ID NO: 27681 - DNA, 50 bp, homo sapien
tcaatacattttgtttatttttgtawgagggcttcaacagtattgtcatg

SEQ ID NO: 27682 - DNA, 50 bp, homo sapien
agagcttagggtaatcatggctaggkagttatgcttgaaaaacaagcaca

SEQ ID NO: 27683 - DNA, 50 bp, homo sapien
ttaatattgctgcccattaatgtgaygcttaattataataaaggaaggag

SEQ ID NO: 27684 - DNA, 50 bp, homo sapien
tacaccattcatcactccttagcaakattgtataatgtaatagggtttta

SEQ ID NO: 27685 - DNA, 50 bp, homo sapien
ccaaagtgaaagacaaaattggctaygtcatcagattattgcatttctta

SEQ ID NO: 27686 - DNA, 50 bp, homo sapien
gcaatatgtttattcacaatataaastgtttggtaaaagataaacatgtg

SEQ ID NO: 27687 - DNA, 50 bp, homo sapien
tatttttacacagaggaattcatcartcaaacatccaactttgagatccg

SEQ ID NO: 27688 - DNA, 50 bp, homo sapien
cttccccccattactcaggtaaaagycttcttgttattctactctatgcc

SEQ ID NO: 27689 - DNA, 50 bp, homo sapien
gagaatatgagtcattaaaatatagkcataaactttagtcagacaaactg

SEQ ID NO: 27690 - DNA, 50 bp, homo sapien
atatctcctttgctgtaaaatgtaawccttgctaaatcaaacagtgagtc

SEQ ID NO: 27691 - DNA, 50 bp, homo sapien
tcaacacttctgtgtctaaattacaytcaaagccaggcgtgcctataatc

SEQ ID NO: 27692 - DNA, 50 bp, homo sapien
ttatattgcttttaacagcaggtaaygtaggagaaggagacagatttttt

SEQ ID NO: 27693 - DNA, 50 bp, homo sapien
tgcaagggcacgccactatgcccaastgatttttacaaattttattttta

SEQ ID NO: 27694 - DNA, 50 bp, homo sapien
gaagaacctacgcaactttgaatcayacgaaggagtaatagaatcttaga

SEQ ID NO: 27695 - DNA, 50 bp, homo sapien
gcagaggaccccattcggggctgagraagtcaggtgaagccacaaagctt

SEQ ID NO: 27696 - DNA, 50 bp, homo sapien
tttcccttttatcttgggtacaatgrcaaagcaggctgtctgttcctgac

SEQ ID NO: 27697 - DNA, 50 bp, homo sapien
agaaaacaagttagatgtataagaamtattcattaaatgcaggaaacaca

SEQ ID NO: 27698 - DNA, 50 bp, homo sapien
caaaataagatattatttgccaaaakacattgaaataacacaatataatc

SEQ ID NO: 27699 - DNA, 50 bp, homo sapien
atgatatatggtttcatgcatgtctmaaatggatgtgagcaaatatctgc

SEQ ID NO: 27700 - DNA, 50 bp, homo sapien
ttctatggacccattgagagcatgcratttaaagagaaaaaaaaatgacc

SEQ ID NO: 27701 - DNA, 50 bp, homo sapien
ataggagatagcagggacagctcaastcgtgtcacatgtgtgggccttga

SEQ ID NO: 27702 - DNA, 50 bp, homo sapien
tctatctgttattgttttcctaataygtggcttggaagggagttagacag

SEQ ID NO: 27703 - DNA, 50 bp, homo sapien
ttagggtggggacagcaaagttgaargcagtgtttagagatatggaggag

SEQ ID NO: 27704 - DNA, 50 bp, homo sapien
ccacatcaaaacccagcgatattaaytcactaatactactctccaaaaaa

SEQ ID NO: 27705 - DNA, 50 bp, homo sapien
aaaaatgagcccagaatattcaaaaygtcttcttcagaatgaccccagaa

SEQ ID NO: 27706 - DNA, 50 bp, homo sapien
cagactgagtgatcatgatagcctaygctgtactgtgcaagttgggtaaa

SEQ ID NO: 27707 - DNA, 50 bp, homo sapien
gagcaactccacatttgtatttccaygcgctaaggcctgcagtggtcgaa

SEQ ID NO: 27708 - DNA, 50 bp, homo sapien
ggtggacaacatcctaggaaaaggcrgcaaaccttgagtgtaacatgtgc

SEQ ID NO: 27709 - DNA, 50 bp, homo sapien
tcatctttgggaattcttggacctgmaaggaagcatttttttttccattc

SEQ ID NO: 27710 - DNA, 50 bp, homo sapien
ctcttaaaatgcaaaggtattcccamtgaatttctgacttatatgtgtgt

SEQ ID NO: 27711 - DNA, 50 bp, homo sapien
ccacaggacccaggaccacgataccygagacatttctcttccaagtgtca

SEQ ID NO: 27712 - DNA, 50 bp, homo sapien
cttatactgggtcaccagtaatatcragacttctatagcttcttccaaac

SEQ ID NO: 27713 - DNA, 50 bp, homo sapien
taaaatctgggtggaaaacgattgamgtatgagagaaaatgatcaaatac

SEQ ID NO: 27714 - DNA, 50 bp, homo sapien
aaatgctaattgttccagtaattagraagttctctggacaaagcccaagg

SEQ ID NO: 27715 - DNA, 50 bp, homo sapien
cagacaacttagggtttcctataaastctatttctaatatgcaagacaac

SEQ ID NO: 27716 - DNA, 50 bp, homo sapien
ggcccagctaaagataaatagcaaartgtaaaaatagctgagttagggac

SEQ ID NO: 27717 - DNA, 50 bp, homo sapien
cactgcttactgatcataagcatcartataagtttcctattcttatattc

SEQ ID NO: 27718 - DNA, 50 bp, homo sapien
gccatttagttattaggacaaaatcrgatgctgagtctttatgctttagt

SEQ ID NO: 27719 - DNA, 50 bp, homo sapien
attttacattgcgcgtctggatatayacccaccacctgagtgtgccattc

SEQ ID NO: 27720 - DNA, 50 bp, homo sapien
atttgtgaattttcactttccataawcccttcacaatgatttagaatgtt

SEQ ID NO: 27721 - DNA, 50 bp, homo sapien
gaacccatgtctcatcatatcagagmccctacgcttaagtgctatgcttc

SEQ ID NO: 27722 - DNA, 50 bp, homo sapien
gattttgcccaagtttattcttaaaktagtcaatatgtgtttatatagca

SEQ ID NO: 27723 - DNA, 50 bp, homo sapien
aagaagcaaattttctatctctttgraccatagactgtggatccactgca

SEQ ID NO: 27724 - DNA, 50 bp, homo sapien
gaagtttatcttcagaaaaaattgcyataagacacttcctataagccagc

SEQ ID NO: 27725 - DNA, 50 bp, homo sapien
atacaggctggtttgcctctggagayggaacacttaatgactatggcatt

SEQ ID NO: 27726 - DNA, 50 bp, homo sapien
aaaaaaatgaaactataagtgctaayggcttcctaaaataaataaggcat

SEQ ID NO: 27727 - DNA, 50 bp, homo sapien
aagaaactacttttttacatcgttaygtcatcccttatactcccttctgt

SEQ ID NO: 27728 - DNA, 50 bp, homo sapien
ggttaggattgtagagtgctgtaaawctaatcagatgctattttctctta

SEQ ID NO: 27729 - DNA, 50 bp, homo sapien
tctgattccatttgaattatttttargagctcacattttccatctagaag

SEQ ID NO: 27730 - DNA, 50 bp, homo sapien
atggagatggagctctgtaggagcasagtgtttgtttgcaattgaaatta

SEQ ID NO: 27731 - DNA, 50 bp, homo sapien
aaagtgcttataaattatgtttataratttaatcctcagcataatcatta

SEQ ID NO: 27732 - DNA, 50 bp, homo sapien
catttattcatgtttgttttaacacrcaagagaaaatcaaaattcaattt

SEQ ID NO: 27733 - DNA, 50 bp, homo sapien
ggaaggacagggtaatcataagagaygtgtcatttggaatagcagtgccc

SEQ ID NO: 27734 - DNA, 50 bp, homo sapien
ccctctactcagagctggtttatgargtcccagagtggctgagctctgtc

SEQ ID NO: 27735 - DNA, 50 bp, homo sapien
aactttcagggacttggaaacatatsaaggctttttcacacaagtgtgta

SEQ ID NO: 27736 - DNA, 50 bp, homo sapien
tgtggcacgtgtgtgtgcaggtaccrctctgataaagaaaacaaaaggta

SEQ ID NO: 27737 - DNA, 50 bp, homo sapien
cctctaattgacagaattcagatgawctctttatgagactaaatgctatt

SEQ ID NO: 27738 - DNA, 50 bp, homo sapien
aggtttaacagggatatttcttatakggctcttcaatatttaattgagag

SEQ ID NO: 27739 - DNA, 50 bp, homo sapien
aggctgcagcaagagcttatctttayatatgttaactcataaattatatt

SEQ ID NO: 27740 - DNA, 50 bp, homo sapien
gctctgtgcagagtgtttacctggaygaatgcagtttcagatcagagcaa

SEQ ID NO: 27741 - DNA, 50 bp, homo sapien
tataggaaatgtagaatgcacagaargttaacagtggcctggaagtaatt

SEQ ID NO: 27742 - DNA, 50 bp, homo sapien
ccctcaagcaatcaccaaatcaaagkattccatctttcatatctcttata

SEQ ID NO: 27743 - DNA, 50 bp, homo sapien
gatccagtcttagttgcagactgaaygagccgaagtgaactacaacaggg

SEQ ID NO: 27744 - DNA, 50 bp, homo sapien
aatattttattgtgccaagaaatacrgatgttctcacagaatgatgggag

SEQ ID NO: 27745 - DNA, 50 bp, homo sapien
acatatccatcaaataatgcaagggmaagctacagaattagagcaattga

SEQ ID NO: 27746 - DNA, 50 bp, homo sapien
tccatagaaacagagatgtttgcaayacataatcaactacctgacatcct

SEQ ID NO: 27747 - DNA, 50 bp, homo sapien
actttctctcctgactccactggaayaaggaggttaggagaatgagcact

SEQ ID NO: 27748 - DNA, 50 bp, homo sapien
ggatgtggacaaaaaagcaaaagcartagttgacctagaattttaaaaat

SEQ ID NO: 27749 - DNA, 50 bp, homo sapien
aaagaccaaatccacgattggttaastgatgggaagaatggaaccaagtt

SEQ ID NO: 27750 - DNA, 50 bp, homo sapien
aaaaccacatgtataatatccttccrcgctaggtacactagcagtagcat

SEQ ID NO: 27751 - DNA, 50 bp, homo sapien
tttcagtgggtaagactttaaagccraattattttctcctgtttcaaaat

SEQ ID NO: 27752 - DNA, 50 bp, homo sapien
cgctgtcctatcaacaagtaactccragaggcacacaagtacaagcacta

SEQ ID NO: 27753 - DNA, 50 bp, homo sapien
agagagctggatctatcacttaccarccatagcgtcacacttgtattttg

SEQ ID NO: 27754 - DNA, 50 bp, homo sapien
aaaattgatgtcttctacattctacygcatcatttatgcttaattcaata

SEQ ID NO: 27755 - DNA, 50 bp, homo sapien
tttagactaaagactacatctttcayattggtactcagtatctaatagag

SEQ ID NO: 27756 - DNA, 50 bp, homo sapien
tggctccagtctttggtttcaatggyacgagtggttacaatcaggaagtt

SEQ ID NO: 27757 - DNA, 50 bp, homo sapien
atacacataaagtaaaggtgtgttaycattctaaaccatccatgtgcaca

SEQ ID NO: 27758 - DNA, 50 bp, homo sapien
cctatgaaacgcgcctgtaacagcgycaagaacagtcaacacagcactag

SEQ ID NO: 27759 - DNA, 50 bp, homo sapien
ttgactgttcttcacctctgcataarcacgatttccacaacttacagaga

SEQ ID NO: 27760 - DNA, 50 bp, homo sapien
aagttgtttaacacttgtatttataraattgaccatgtttatgtcaaaag

SEQ ID NO: 27761 - DNA, 50 bp, homo sapien
tgacactgactttctaaatattccasaactatttccctgaacgtgaaggt

SEQ ID NO: 27762 - DNA, 50 bp, homo sapien
gtaaaaagctttgaaaaaaactcccraatgagctggagacactgctgtac

SEQ ID NO: 27763 - DNA, 50 bp, homo sapien
tatattggtaactatagtacagatawggtagaactaagactagctcactt

SEQ ID NO: 27764 - DNA, 50 bp, homo sapien
cacaagaaggtgtaaaacagtacaartcagtggagatggtaagaggcaaa

SEQ ID NO: 27765 - DNA, 50 bp, homo sapien
agagacattaatgtatgcattattaraaaaataacagtgagaagaacatg

SEQ ID NO: 27766 - DNA, 50 bp, homo sapien
ctaccggggaatactgatggccaaaytgtgtctatgaatatacctgctac

SEQ ID NO: 27767 - DNA, 50 bp, homo sapien
ccttgggtgactcaaatgtttcaaarctctgtgcacatccaccagtgagc

SEQ ID NO: 27768 - DNA, 50 bp, homo sapien
agaaacaccttttaatcactatttcycttgtaagtgacacttataaatcc

SEQ ID NO: 27769 - DNA, 50 bp, homo sapien
tttccttctgtttctgttacctccaytgaaagcataagaatcagatatta

SEQ ID NO: 27770 - DNA, 50 bp, homo sapien
tggaatttcttattacttaggatacrgacgatgcctttcaattcatgagc

SEQ ID NO: 27771 - DNA, 50 bp, homo sapien
ccatgcctctatctgttctctctaaytagctttctgttcctaatttttca

SEQ ID NO: 27772 - DNA, 50 bp, homo sapien
aggcaggaggtcttgaggatgaacarggaatctatgtcagctgctcagcc

SEQ ID NO: 27773 - DNA, 50 bp, homo sapien
aggctctctgttcagatgactggagraagcgtattttcagccagaagcct

SEQ ID NO: 27774 - DNA, 50 bp, homo sapien
atctgagtgattgccagttttacctmaatagttgtgggatccaaatatta

SEQ ID NO: 27775 - DNA, 50 bp, homo sapien
tgggaggaggaaaggagggttctccygagtattcaaattagcaccaagag

SEQ ID NO: 27776 - DNA, 50 bp, homo sapien
acagggagcctcttaaacagaatctwacctgtaaaactcaggagccgaga

SEQ ID NO: 27777 - DNA, 50 bp, homo sapien
cccactgtacttacatattgcctcayagaaggtagtacattgaaaaaaaa

SEQ ID NO: 27778 - DNA, 50 bp, homo sapien
ccaggcgctcaataagatattcgaasagaacaaaagaacaagcgtaggaa

SEQ ID NO: 27779 - DNA, 50 bp, homo sapien
tcatggcttcttcagagaattattamcaaagctcctagtgtatgtgctaa

SEQ ID NO: 27780 - DNA, 50 bp, homo sapien
aaccttcttgtgtctaggatttttayacttctctttctaaacttgacaga

SEQ ID NO: 27781 - DNA, 50 bp, homo sapien
ggaatatatagcacaagttaagaagrccacaccattatcctcttgatagt

SEQ ID NO: 27782 - DNA, 50 bp, homo sapien
aggacttgtttagagcactagggacrgactaaggccaggaccagatctgg

SEQ ID NO: 27783 - DNA, 50 bp, homo sapien
tgtcacttctctgggcctctgtttcmacaccaggaaaatccacaccaagc

SEQ ID NO: 27784 - DNA, 50 bp, homo sapien
cacaccagtggtttgtgcctatgcakggtttaaagaaatggagtttggag

SEQ ID NO: 27785 - DNA, 50 bp, homo sapien
tgcgggaagagttactctgtgattamgacttgtgcaacttgacagtatat

SEQ ID NO: 27786 - DNA, 50 bp, homo sapien
tgctgtaggaatgcctatgctctcarattaaaagccaactgaaatcaaaa

SEQ ID NO: 27787 - DNA, 50 bp, homo sapien
ttgcctgatcttgtggcaacttctakcaaataggacaaacattatttcct

SEQ ID NO: 27788 - DNA, 50 bp, homo sapien
agggcctgtgagagtgactggaatayggcagctgattgaaatgattcaac

SEQ ID NO: 27789 - DNA, 50 bp, homo sapien
aagaaagaacaatacaagctgcagaycacataaaagtgagtacttgaaag

SEQ ID NO: 27790 - DNA, 50 bp, homo sapien
atcatcatcatcatcattagtaagartatcatcatgttgttattattgaa

SEQ ID NO: 27791 - DNA, 50 bp, homo sapien
attcttttcaggaagagttctccaartatgtgaggcctgatataagatag

SEQ ID NO: 27792 - DNA, 50 bp, homo sapien
gattatagtgagaggattggaaaagmataagtccgtggagtttcttaaga

SEQ ID NO: 27793 - DNA, 50 bp, homo sapien
gccggctgttgtgcattgaccttgarccacactgtgcagacacatcggaa

SEQ ID NO: 27794 - DNA, 50 bp, homo sapien
aatgtaactcattcttttaactgtaygcacagaattccataggcaaaatg

SEQ ID NO: 27795 - DNA, 50 bp, homo sapien
taattatttcaagtggaaagcacacyggatactttcacttgtcatgtgta

SEQ ID NO: 27796 - DNA, 50 bp, homo sapien
ttgaaagctgcagtgaaaggactccrcgtctccaagtctcgtgctcagag

SEQ ID NO: 27797 - DNA, 50 bp, homo sapien
agaccccaaacagattaataaggcaycattagataaccagtaacagaata

SEQ ID NO: 27798 - DNA, 50 bp, homo sapien
aagcagtctatctctggaaagataawcaaaacccagcagtgatggtggcc

SEQ ID NO: 27799 - DNA, 50 bp, homo sapien
tgggggaggtcccagactccttaatwactagatctcacataaactcatta

SEQ ID NO: 27800 - DNA, 50 bp, homo sapien
cttccctcagaggtggtttcgtacawcatagtgagagaagcctaggatga

SEQ ID NO: 27801 - DNA, 50 bp, homo sapien
taatatagatggaaaaaaagaaggcsaaatatgtgccagacttactcatt

SEQ ID NO: 27802 - DNA, 50 bp, homo sapien
catgagccgccacacctggcctacayattttaataccctcagacaataca

SEQ ID NO: 27803 - DNA, 50 bp, homo sapien
atatttaaactgtgttggcataaagkcaactcatagttttcttgccactt

SEQ ID NO: 27804 - DNA, 50 bp, homo sapien
taccagtcatgtgccatcttaccaaygtattcgaggtacttgtgattatg

SEQ ID NO: 27805 - DNA, 50 bp, homo sapien
cacaatccccagttttatggctcctsagaatccagagacttcctattgat

SEQ ID NO: 27806 - DNA, 50 bp, homo sapien
tttccttcaccttattctattcccarattctcactaatggaaaccaaggc

SEQ ID NO: 27807 - DNA, 50 bp, homo sapien
cctatgtatctgcttctgattgctaraagaatggcttagaaacaagttgt

SEQ ID NO: 27808 - DNA, 50 bp, homo sapien
ataacactaaacttttgtttatctamagagtgtcaggtaagcaagtgaac

SEQ ID NO: 27809 - DNA, 50 bp, homo sapien
aaggatgaagatgtcttaaattccayggatgttggatccaaccaagaaag

SEQ ID NO: 27810 - DNA, 50 bp, homo sapien
tgtctatgacctgtagctctcatgcygataaaggttagaaatgcttatca

SEQ ID NO: 27811 - DNA, 50 bp, homo sapien
ccaaatagaagctgctgctttccaayatgaagattcaaataactcgtatt

SEQ ID NO: 27812 - DNA, 50 bp, homo sapien
cctattcttatcaccctgatttttawcatcacctcaactcactatgtcta

SEQ ID NO: 27813 - DNA, 50 bp, homo sapien
atttgggggccagttgaataggaaaygcccatggagaaagaagcagacga

SEQ ID NO: 27814 - DNA, 50 bp, homo sapien
aataggcagtgaattgcagaggttakatcagacttgaagaactcgtgaag

SEQ ID NO: 27815 - DNA, 50 bp, homo sapien
aggaataatatctgtatagctggcawcagaccaggaaaagaaattgaata

SEQ ID NO: 27816 - DNA, 50 bp, homo sapien
gggtcaaatgagatggtctaactcakaaatctaggaaaggccgtgagagg

SEQ ID NO: 27817 - DNA, 50 bp, homo sapien
tggacatggttaattctcatgtccastaactagaactcagtccaagtaat

SEQ ID NO: 27818 - DNA, 50 bp, homo sapien
aatggacaaatttgtctgtgatccayatattctctcttcctctagcttag

SEQ ID NO: 27819 - DNA, 50 bp, homo sapien
tgagagatgttgtaattaatttgagraacttcagatagaaacaggcttga

SEQ ID NO: 27820 - DNA, 50 bp, homo sapien
aaggttgcgtgggtggcaaggcttamgagctttggagctgtgactcatga

SEQ ID NO: 27821 - DNA, 50 bp, homo sapien
ccctataagcattcaagtccactcaraagaatatattccacactgcagtc

SEQ ID NO: 27822 - DNA, 50 bp, homo sapien
tgggagaatgaaaaggaaataattasagagaatactagcagcagcaaaag

SEQ ID NO: 27823 - DNA, 50 bp, homo sapien
gttaacaaaaaggatttccaacctcyagtatatgaaatcagataagtttg

SEQ ID NO: 27824 - DNA, 50 bp, homo sapien
gggtcacttaacatgtatttaatcakcttggattctggtctcttcactta

SEQ ID NO: 27825 - DNA, 50 bp, homo sapien
aggagggaactgccgttgttcctacrctgcagatgaagaaacaaaaggct

SEQ ID NO: 27826 - DNA, 50 bp, homo sapien
aatcttccagggacatatcagcaatracgatttggaaagcagtatgctgt

SEQ ID NO: 27827 - DNA, 50 bp, homo sapien
atatatctaccaaatagtccatgtgragtgaaatcctttacatacaccaa

SEQ ID NO: 27828 - DNA, 50 bp, homo sapien
cagccttttacacatctgtcaattgragaagttaacctctctgctgtttt

SEQ ID NO: 27829 - DNA, 50 bp, homo sapien
aataaaagttcactacaagtccacakcaatcaagataatgtggtactgga

SEQ ID NO: 27830 - DNA, 50 bp, homo sapien
acacttagactggtacaaaaatctcraccttcgttctcaaactaacatca

SEQ ID NO: 27831 - DNA, 50 bp, homo sapien
aatacagacaaacgcatatgaaaaaracacgagaatttttccaaacaaaa

SEQ ID NO: 27832 - DNA, 50 bp, homo sapien
atgaacaaagttaaatcctgatatgsactgttattacattctctaccact

SEQ ID NO: 27833 - DNA, 50 bp, homo sapien
aagctgatattaaggcaactcattamaagttgttgaagatagacagatgg

SEQ ID NO: 27834 - DNA, 50 bp, homo sapien
catcattagaaaaagggtttgtatgmaagccagtaaaagaaaggaaataa

SEQ ID NO: 27835 - DNA, 50 bp, homo sapien
aaacctaccatcattgctcatatcayaatggattacagtaggctctatgt

SEQ ID NO: 27836 - DNA, 50 bp, homo sapien
agagaacacgctttgtaaaaaattcratagcagggatggtatttccacta

SEQ ID NO: 27837 - DNA, 50 bp, homo sapien
cctgcaaagacacattaagtgaacayatgtgaacagtgaggacctggagg

SEQ ID NO: 27838 - DNA, 50 bp, homo sapien
gaagtcattcattaattaaaaactarattacactgacaaaactttaccct

SEQ ID NO: 27839 - DNA, 50 bp, homo sapien
aaatcctctgggcatgtgtcgggaamagagaacttcaggggaaaaacact

SEQ ID NO: 27840 - DNA, 50 bp, homo sapien
aagaccaaaaataaaatggcccgtgraagtatggatacattttcctggga

SEQ ID NO: 27841 - DNA, 50 bp, homo sapien
agagaacaactacgagagaattgcawactaacttgtaaatgggtatatcc

SEQ ID NO: 27842 - DNA, 50 bp, homo sapien
cttcaagtatttcaattagtaacaayggttgtgggtacacatatgtactt

SEQ ID NO: 27843 - DNA, 50 bp, homo sapien
agggcagtgacccaattatatgcaasggcgctgcttaaggagatctaaaa

SEQ ID NO: 27844 - DNA, 50 bp, homo sapien
taattgtgagggataaaaggttgacraataataaatacttaaagaaagaa

SEQ ID NO: 27845 - DNA, 50 bp, homo sapien
gctctcaaggagcctataattacaasgagaaaattctaatatcacaaata

SEQ ID NO: 27846 - DNA, 50 bp, homo sapien
atgctgcagctcatcagcaactttcrctggacagggagatggtggcccag

SEQ ID NO: 27847 - DNA, 50 bp, homo sapien
atgttagaataaagaaatgcgttcartaagcatcaggtactttgaaggat

SEQ ID NO: 27848 - DNA, 50 bp, homo sapien
gcggggtgatactccctgttaagcayagtaattactttttgcatcacgag

SEQ ID NO: 27849 - DNA, 50 bp, homo sapien
cactcagaccaaagttttggaaatarcaattctcttttgccaccttccct

SEQ ID NO: 27850 - DNA, 50 bp, homo sapien
ttcacatttctacacttcaacctaastatgctgtaaaaatccagagcttg

SEQ ID NO: 27851 - DNA, 50 bp, homo sapien
ccgctgcccttctctattgtttttaygctattgattctctcgtcttcaga

SEQ ID NO: 27852 - DNA, 50 bp, homo sapien
ggttcctgctctttagcattaaaccraaatttaatatccaggaagttgca

SEQ ID NO: 27853 - DNA, 50 bp, homo sapien
tgtttaagactttgatgtgcctaaarttaatctagatgaaatgaatgagg

SEQ ID NO: 27854 - DNA, 50 bp, homo sapien
agtgtccttctatgctctggcagaayctctggctcaggcacctgtgctgt

SEQ ID NO: 27855 - DNA, 50 bp, homo sapien
tctgtttcttttctcactcactccaygtgaaaggagcaatagctgttgac

SEQ ID NO: 27856 - DNA, 50 bp, homo sapien
ggaccacacactccagtactgagccratggttgatagggaattgcatctg

SEQ ID NO: 27857 - DNA, 50 bp, homo sapien
ccaaatgcctccatttcctagaataraaggtcacattgttcattacactg

SEQ ID NO: 27858 - DNA, 50 bp, homo sapien
catggagaagaacgagagttagggcraagaatatagaagacggtgtttga

SEQ ID NO: 27859 - DNA, 50 bp, homo sapien
agaggaaaagccaacaaattaaagaygatgagaaagtaagtgatcaataa

SEQ ID NO: 27860 - DNA, 50 bp, homo sapien
gataatttctcacagatgtctgaccrgaaagaaattctcaactttctaaa

SEQ ID NO: 27861 - DNA, 50 bp, homo sapien
ttgtagctgcacatgctcatctcatraaagaatcaagggggccagacatg

SEQ ID NO: 27862 - DNA, 50 bp, homo sapien
tgtaactcacaaaggcaattgacttkaactcctctaggttttgcttttgt

SEQ ID NO: 27863 - DNA, 50 bp, homo sapien
gtgagcaccgggagcagatatactasaggggacgtgactttttcagggaa

SEQ ID NO: 27864 - DNA, 50 bp, homo sapien
ctcggccagtgccagtcaatatcaargaatttggtccatttctagataag

SEQ ID NO: 27865 - DNA, 50 bp, homo sapien
ccacttgaaaggcctcctggacaaasctcaaaatcctgaagcttccagaa

SEQ ID NO: 27866 - DNA, 50 bp, homo sapien
ggttttttccaatagctttttacaaytagatctgaaaaatgaaactagta

SEQ ID NO: 27867 - DNA, 50 bp, homo sapien
tgagaaaaaataataccacctgttamaattgtgaaaacagaaaactataa

SEQ ID NO: 27868 - DNA, 50 bp, homo sapien
ttataataatggcagctgacagcaasggctttaaaaaatgctttccctcc

SEQ ID NO: 27869 - DNA, 50 bp, homo sapien
taagcaccacacatgtcatacattayagttttctgttttcacaattgtaa

SEQ ID NO: 27870 - DNA, 50 bp, homo sapien
tcgtgccaatggtttggcttaagagkcacgcagttccggagtattcactc

SEQ ID NO: 27871 - DNA, 50 bp, homo sapien
tgacttcgatctggcaaaacctaatsaagacagaaaagacattcatgctt

SEQ ID NO: 27872 - DNA, 50 bp, homo sapien
tagtgggtttaatgtttagtcagtgyactctgagtcctcattgttcagaa

SEQ ID NO: 27873 - DNA, 50 bp, homo sapien
agctcccgagaatttaaacatttaarctggcaaaggacttaagaaatcat

SEQ ID NO: 27874 - DNA, 50 bp, homo sapien
cacatcctcactgctaaatgtaggarcgcctcatttagtcttgcagtttc

SEQ ID NO: 27875 - DNA, 50 bp, homo sapien
gatagggcctgtttacactgagaaayagagcttagtgctgagggtaaaga

SEQ ID NO: 27876 - DNA, 50 bp, homo sapien
atctgattcatttgaaaacataaaarcgtaggatttagaattgcaaagac

SEQ ID NO: 27877 - DNA, 50 bp, homo sapien
ttccgcataggataaaattcagaaaygtaggaagacttcaattccaagcc

SEQ ID NO: 27878 - DNA, 50 bp, homo sapien
gactttaccataaaatataatttaaycatgagtcaaaattgggaatgcct

SEQ ID NO: 27879 - DNA, 50 bp, homo sapien
aagacgacaagcaagactcacctcaygaaggcatctaatatagggcagga

SEQ ID NO: 27880 - DNA, 50 bp, homo sapien
attagagttgtgcaatagcacttcamataacaattgttgatccttgtgtc

SEQ ID NO: 27881 - DNA, 50 bp, homo sapien
aatttagttatcagaataatttttaygctaagcactctggttgggtggta

SEQ ID NO: 27882 - DNA, 50 bp, homo sapien
ctttgagatttacaaagttggcttcratccccagactgaattctgtgcaa

SEQ ID NO: 27883 - DNA, 50 bp, homo sapien
acagcaaaaatatggccaatgtatarccttataaagaagttttaacaatt

SEQ ID NO: 27884 - DNA, 50 bp, homo sapien
cccccattcatgggcaaagtaataarctacaatctgaaggaattaaggaa

SEQ ID NO: 27885 - DNA, 50 bp, homo sapien
tcatgagggtaaaagcaacttaatarggacccatgcccatctattacatc

SEQ ID NO: 27886 - DNA, 50 bp, homo sapien
tcacaacgagcagatatgagcgctgracttccagggtcctcgaaagtagc

SEQ ID NO: 27887 - DNA, 50 bp, homo sapien
tagattaacacagttcctggatgtcycatctaagcaatgtacactcttat

SEQ ID NO: 27888 - DNA, 50 bp, homo sapien
tgcctttaggcagtcttattcttcayccagtaaacagcagaccatggatt

SEQ ID NO: 27889 - DNA, 50 bp, homo sapien
tggaattccattaggttccaatttawcccatcaaacaatgtcataaatca

SEQ ID NO: 27890 - DNA, 50 bp, homo sapien
cctttgacttttgtcatttagattcyactgaacaggatttagtcattttc

SEQ ID NO: 27891 - DNA, 50 bp, homo sapien
tcccaaggaaaccacacatcataacmgggcttctttccccttaagcttca

SEQ ID NO: 27892 - DNA, 50 bp, homo sapien
taaaaattagcattcaagcaattaayaggagtgatttcaaaaagaattta

SEQ ID NO: 27893 - DNA, 50 bp, homo sapien
tgggttaggctaccatggaaaatatragagccctggaaagcgtcattaca

SEQ ID NO: 27894 - DNA, 50 bp, homo sapien
atgtgctaaatgtgaaattgctgagraaaattacatgagcatatttaaaa

SEQ ID NO: 27895 - DNA, 50 bp, homo sapien
aaagctgatggcatatgacttgtaaytcattcttgtatataacagtagat

SEQ ID NO: 27896 - DNA, 50 bp, homo sapien
aggattacagaaaataatttggaacyaatcagatttatctgaggtgacct

SEQ ID NO: 27897 - DNA, 50 bp, homo sapien
aaaaaagctgactgttaaatcaggaygctatcactacagcgactagttcc

SEQ ID NO: 27898 - DNA, 50 bp, homo sapien
tttatcctcacagatgttttcctcayggctgaaatcactcttatgccctg

SEQ ID NO: 27899 - DNA, 50 bp, homo sapien
cagattaaaaagatgtcggattcacyacatgacatctgtgtacctactga

SEQ ID NO: 27900 - DNA, 50 bp, homo sapien
ggcgtgagccaccacgcctggccgcrctgcagtatttctaactaaaaaat

SEQ ID NO: 27901 - DNA, 50 bp, homo sapien
ttaaacgtctattggttaaatgatcrgagaatcagagaggagaaagcagt

SEQ ID NO: 27902 - DNA, 50 bp, homo sapien
taatttattaatttgttgactgttayggacaagcaaaaccttgtatgtgg

SEQ ID NO: 27903 - DNA, 50 bp, homo sapien
gcttattattttgactgtttagaaargttcaacctaatcttgattcggta

SEQ ID NO: 27904 - DNA, 50 bp, homo sapien
ggtgttggattatatgacattaatamgtgtgtcaaatgaatctgttttaa

SEQ ID NO: 27905 - DNA, 50 bp, homo sapien
gaggaatgctttgggatatggtagaygaagataagaggcatgaaggacag

SEQ ID NO: 27906 - DNA, 50 bp, homo sapien
tacaggactaggtgcatttgtcaaawtaaggtaaataaattacatctcaa

SEQ ID NO: 27907 - DNA, 50 bp, homo sapien
tgctatgaaacaaatagaaacctagraatttagtgcctattcaaatatta

SEQ ID NO: 27908 - DNA, 50 bp, homo sapien
tctgaaggagcttgttactgacagaytatcattttaggtcctttagttca

SEQ ID NO: 27909 - DNA, 50 bp, homo sapien
gcttgatggtggatacatgagtgtasataaaattattatttatgctattc

SEQ ID NO: 27910 - DNA, 50 bp, homo sapien
aaacttcagaggacactgcattgagyagactttgttagaggaagctaaag

SEQ ID NO: 27911 - DNA, 50 bp, homo sapien
aggtcttggccctcttagatattaaratctgctataaagttacaattgaa

SEQ ID NO: 27912 - DNA, 50 bp, homo sapien
gggttatctgcacacggcatctacaygtgctctctgtttataatcatcac

SEQ ID NO: 27913 - DNA, 50 bp, homo sapien
tgaaacctaaagcaataaatctttaygcccctgaagatagactagaagct

SEQ ID NO: 27914 - DNA, 50 bp, homo sapien
gtgagccaccatgcccggctactaartgcagtattccaacatttgggaca

SEQ ID NO: 27915 - DNA, 50 bp, homo sapien
tctctggaaagaaagtattcaatccrcacaaatgagctcatttcccacaa

SEQ ID NO: 27916 - DNA, 50 bp, homo sapien
tccaactgtcgacaattaaagtcaargaaagaattctgaaagcagcaaaa

SEQ ID NO: 27917 - DNA, 50 bp, homo sapien
ggtgaaactgtagccaaaactcttayaaattctatggtggacatttggtg

SEQ ID NO: 27918 - DNA, 50 bp, homo sapien
catcggcttactttgcaacagaaacsgtcctctttattgtcaagagccag

SEQ ID NO: 27919 - DNA, 50 bp, homo sapien
tgcaccacctgccatcaccttacaamgtatataatgaaaaggtggctttc

SEQ ID NO: 27920 - DNA, 50 bp, homo sapien
ttcaacaaatcttttaactcttttayggagtgccacattaaagatccctt

SEQ ID NO: 27921 - DNA, 50 bp, homo sapien
aagatgtaaaagtgaaaaacgccaartgtacaagctctttgccagcctat

SEQ ID NO: 27922 - DNA, 50 bp, homo sapien
taaatatacaaaaagctgtaaacctsagaaccttagacagctgagtacct

SEQ ID NO: 27923 - DNA, 50 bp, homo sapien
gggcaatttcccagattttttttccygagaacatcagtgccagcagcaat

SEQ ID NO: 27924 - DNA, 50 bp, homo sapien
caaggttcaggacgtgcgcctgtgayagcctcaggaggtccagatgacat

SEQ ID NO: 27925 - DNA, 50 bp, homo sapien
agaatgaatggtcacccaactcatayaagaacttagctgttggaatagtc

SEQ ID NO: 27926 - DNA, 50 bp, homo sapien
aagttctactttctgcccttgggtakataaatggtgtctttcagtgaagt

SEQ ID NO: 27927 - DNA, 50 bp, homo sapien
ctttggaaggggagatttgggacacsgattaggagtagggtcacaggaga

SEQ ID NO: 27928 - DNA, 50 bp, homo sapien
ttattatttcatgccctactgccatyagaaatttgtatctgggagaggta

SEQ ID NO: 27929 - DNA, 50 bp, homo sapien
agagtcttccaggtgtgacaatcagkatatagaaaaacaaacgtagtgtt

SEQ ID NO: 27930 - DNA, 50 bp, homo sapien
tacttccttttgagtctctgatggcyacaacatttcatttgagatgtttg

SEQ ID NO: 27931 - DNA, 50 bp, homo sapien
gcagtttgagttgcctatgttcaacmgaggttcaaaaatattaaatggaa

SEQ ID NO: 27932 - DNA, 50 bp, homo sapien
tggaatatttttgagtctcatgatayaaaaatttggcttctcagtatgtc

SEQ ID NO: 27933 - DNA, 50 bp, homo sapien
ttcatttttttagtggagtatttgaytagagagaaggtaaggcagaaata

SEQ ID NO: 27934 - DNA, 50 bp, homo sapien
tccattttggcattaattacatttcrctgaaagactattctcacatgcca

SEQ ID NO: 27935 - DNA, 50 bp, homo sapien
atgccacataatatatctgaactaaktaagaacaataagtcactttcaaa

SEQ ID NO: 27936 - DNA, 50 bp, homo sapien
actcttagacacaatggaaatgtaaygataagtttgtcagtgcgtggttt

SEQ ID NO: 27937 - DNA, 50 bp, homo sapien
tttcttcctaggatttcagtatatcmattgttttccttgattttattatt

SEQ ID NO: 27938 - DNA, 50 bp, homo sapien
agaactgtttgggttgtgagtgttayaaaattcattgtaaattagcttaa

SEQ ID NO: 27939 - DNA, 50 bp, homo sapien
ctgtgtggggatatttcacaaagagrcatggtgaagtgcggcactgccta

SEQ ID NO: 27940 - DNA, 50 bp, homo sapien
cagtaaagcttgattagaaaacacamatggccactctttaggtcttgacc

SEQ ID NO: 27941 - DNA, 50 bp, homo sapien
attttctgtgccaccaaagtgcatgkaaacttatctcctagaatctgaac

SEQ ID NO: 27942 - DNA, 50 bp, homo sapien
ataaataatatttgcatgggcaccargaataagtaaagagaatgaaagct

SEQ ID NO: 27943 - DNA, 50 bp, homo sapien
tttgccaaatctcagataatagaaaraaggttagaattctacagatagat

SEQ ID NO: 27944 - DNA, 50 bp, homo sapien
taaattttgaatgctgatagaaaagsctttaatagcttcattacagagcc

SEQ ID NO: 27945 - DNA, 50 bp, homo sapien
ttagtacaaatgtcttaaagttccayggaggagcaaggactgtggactct

SEQ ID NO: 27946 - DNA, 50 bp, homo sapien
gaatctgctggctactcatcagtcayggtttaaaattcatttgtcttgtt

SEQ ID NO: 27947 - DNA, 50 bp, homo sapien
taaagccttttctatcagcattcaamatttaaaataagttgctttacaga

SEQ ID NO: 27948 - DNA, 50 bp, homo sapien
gtccccgagtgcagttcgctgcatcrgagtgaaaatcttggggcaatatc

SEQ ID NO: 27949 - DNA, 50 bp, homo sapien
tttactcatagtcttactcagtagayacaagtggcagacactgaagccct

SEQ ID NO: 27950 - DNA, 50 bp, homo sapien
tgtttcagtcttccagaattgacgcratgacttcctttaaattaacaggt

SEQ ID NO: 27951 - DNA, 50 bp, homo sapien
ttatatgtcttctcttgagaaaggcwatgtgatagagaagtccaaaacaa

SEQ ID NO: 27952 - DNA, 50 bp, homo sapien
gcccagtgtcttccaccaagatggcrctcaatacgtatttattcagccaa

SEQ ID NO: 27953 - DNA, 50 bp, homo sapien
gtgctcaccaggaggtggttgcatamggcagatatctggatcaactgtac

SEQ ID NO: 27954 - DNA, 50 bp, homo sapien
actctaactctcaccttacctttacyctagtcttgacactgttcctaata

SEQ ID NO: 27955 - DNA, 50 bp, homo sapien
acattaggtttaaatctcaccctcayctaatgccagatctcatccccaat

SEQ ID NO: 27956 - DNA, 50 bp, homo sapien
agctatattgtcagcaattctaaagyataatcagtgctgcaacttccctt

SEQ ID NO: 27957 - DNA, 50 bp, homo sapien
caaactacaattatttccagatgtasaaagactaagatggtgaccatcca

SEQ ID NO: 27958 - DNA, 50 bp, homo sapien
aactcctttcagatggctaagtatawctccccttgaggatgactctctag

SEQ ID NO: 27959 - DNA, 50 bp, homo sapien
aagataacaaaagtgagtccagataktacatccttgcagcacataatcca

SEQ ID NO: 27960 - DNA, 50 bp, homo sapien
aaaagttatacttgcttagagttcayaatctggatagaattctggtagaa

SEQ ID NO: 27961 - DNA, 50 bp, homo sapien
tttgagtgacaaagtaaacataaggragaagccacatttctctaagctta

SEQ ID NO: 27962 - DNA, 50 bp, homo sapien
aatcccaattcttctctgtgatgtayggatctaaagtgtaggagccctga

SEQ ID NO: 27963 - DNA, 50 bp, homo sapien
actatacattagccctaacaaaatayggtctctggttttaatttttgaat

SEQ ID NO: 27964 - DNA, 50 bp, homo sapien
tggaagttgctacatcaccaatgacyggaatacctggtatttggacccca

SEQ ID NO: 27965 - DNA, 50 bp, homo sapien
tttcaatgctctctcatgtataaacsaggtgtggaatgatttgaaaagct

SEQ ID NO: 27966 - DNA, 50 bp, homo sapien
ccttctggtgccctcagtacttatcwccgtctgatatcttgtgtcttttc

SEQ ID NO: 27967 - DNA, 50 bp, homo sapien
tttgatgagacctgaagggaagtcayctcatatcctacactctaattgac

SEQ ID NO: 27968 - DNA, 50 bp, homo sapien
tgtcatcctgttgtaagcatccaaaygacccagattacataatctgcctg

SEQ ID NO: 27969 - DNA, 50 bp, homo sapien
acaataggctaaaggacaatgaataygaaaatctgggaaattaaggtata

SEQ ID NO: 27970 - DNA, 50 bp, homo sapien
gtaggtgtctatatagactggttccsaaactgaactaatgaaatgtttaa

SEQ ID NO: 27971 - DNA, 50 bp, homo sapien
ttaggcaactgtcacgaaaatcatamgactctacggaaagaaaaagactg

SEQ ID NO: 27972 - DNA, 50 bp, homo sapien
ggaacacccagtggatgttaagtacygggttaatgtgctagaaattaaaa

SEQ ID NO: 27973 - DNA, 50 bp, homo sapien
tttctacacagcaataatgatacaaytaggaatcacgccttatacatctt

SEQ ID NO: 27974 - DNA, 50 bp, homo sapien
tgtctcactaaattgaatctgtaaayttcctaggtctaatgtttttctta

SEQ ID NO: 27975 - DNA, 50 bp, homo sapien
aaaagatgcaggaagtaggacagcaygtaaaaactgtaagtccgggatca

SEQ ID NO: 27976 - DNA, 50 bp, homo sapien
atatgtagggtgtagataattacacyaatcattccaggatgttaagagga

SEQ ID NO: 27977 - DNA, 50 bp, homo sapien
tgcggaagaagaaaatgattagagcrctggttttcaaccttggctgtgca

SEQ ID NO: 27978 - DNA, 50 bp, homo sapien
tgcttatcaactggaaaatcatgtayaagggggtctagctagtctaagat

SEQ ID NO: 27979 - DNA, 50 bp, homo sapien
gagcaaaaaggaagtcttttttgackatgtcttgaacggtgtacttattt

SEQ ID NO: 27980 - DNA, 50 bp, homo sapien
acaagaaaacccagatatattagaarcgtcattccaagtcagacagaata

SEQ ID NO: 27981 - DNA, 50 bp, homo sapien
tgtcttcataagagtaacatgattamgtttgcattatcacaaattgtcat

SEQ ID NO: 27982 - DNA, 50 bp, homo sapien
catgaagccagggttgttaaaatcaygtggattgtgggataatattacac

SEQ ID NO: 27983 - DNA, 50 bp, homo sapien
aaccagattcaaagattaagtgacamcctgtaaaactcaaattatttccg

SEQ ID NO: 27984 - DNA, 50 bp, homo sapien
aaaaccctggcttagagagcagttcrctatgtagaattaatttaagaatt

SEQ ID NO: 27985 - DNA, 50 bp, homo sapien
ttttcctctgaaatacagcataatcycttttaagatgaacctcccatatg

SEQ ID NO: 27986 - DNA, 50 bp, homo sapien
ttgcccctgtctggtgtaatttcaaygtaaatccaatttgttctacatgc

SEQ ID NO: 27987 - DNA, 50 bp, homo sapien
ataagctttctcctaaaattgaaaayatactaggtagcagaagagaacag

SEQ ID NO: 27988 - DNA, 50 bp, homo sapien
ggagtgccaccaatttctgaggctayaacttttcatttttgtcagtgtca

SEQ ID NO: 27989 - DNA, 50 bp, homo sapien
ggctgcatctttgcatagaaccaagyagagatactagcatctttgctgct

SEQ ID NO: 27990 - DNA, 50 bp, homo sapien
tttattctatctatagacagtctaamtgcttgttggttaaaaaaataaag

SEQ ID NO: 27991 - DNA, 50 bp, homo sapien
cagaattatcttcaaaaatttaaatmagattgtgtgattcccctgctgaa

SEQ ID NO: 27992 - DNA, 50 bp, homo sapien
agaagactcacagcattccaggtgckatttccatcattcaaatcaatgtg

SEQ ID NO: 27993 - DNA, 50 bp, homo sapien
ttccactggagagctcaagttacacraccaggcccaaagtcaataagaca

SEQ ID NO: 27994 - DNA, 50 bp, homo sapien
tggaagtttttctaataagcagccartaagtgaataaaacgtattaattt

SEQ ID NO: 27995 - DNA, 50 bp, homo sapien
agtaatcagctatcaaagagtgctayggaggaaaagtaagtagaaggatg

SEQ ID NO: 27996 - DNA, 50 bp, homo sapien
tggactttattctttaaacaaattgsagagaatagagaaaaaaataggtt

SEQ ID NO: 27997 - DNA, 50 bp, homo sapien
cttggaaatattcggacaataaccasatgataaaaagagaataaagactt

SEQ ID NO: 27998 - DNA, 50 bp, homo sapien
gatgtaaatgttcctcaaggaagaamtctctgaataaaactcaatgacaa

SEQ ID NO: 27999 - DNA, 50 bp, homo sapien
tagctaagatcagctgagtcactgayactaatcctcccataaccagaaaa

SEQ ID NO: 28000 - DNA, 50 bp, homo sapien
cagtcacataaaaggcataattagayaatcaaataaagatctataagact

SEQ ID NO: 28001 - DNA, 50 bp, homo sapien
aaatgaaattttctccttgtaattaygccaatgagattgataaaaggcat

SEQ ID NO: 28002 - DNA, 50 bp, homo sapien
acccagcacctctttttcaaagccasatcaacacattctctttctcatct

SEQ ID NO: 28003 - DNA, 50 bp, homo sapien
gaaataggctaaaaagtcctaagtasagtgctattttctcatttgtttag

SEQ ID NO: 28004 - DNA, 50 bp, homo sapien
taaataagaatgtgtccctttttaartgaatacaaacatactacaattca

SEQ ID NO: 28005 - DNA, 50 bp, homo sapien
tattttgctgcaattttaaaaagtcrcacagctaacgcatgacaagagtg

SEQ ID NO: 28006 - DNA, 50 bp, homo sapien
cctttataactggccatttggtttcraaatactacaagtagtacccactg

SEQ ID NO: 28007 - DNA, 50 bp, homo sapien
tgggctgttaagtcattctctataayattgtggaatcgctaggttttata

SEQ ID NO: 28008 - DNA, 50 bp, homo sapien
cttccaccagcatctcttacaatcaytatttttctttgagaattccacaa

SEQ ID NO: 28009 - DNA, 50 bp, homo sapien
ataggtgagtgaacacagcctaagartatggaaacagaaagggctcattt

SEQ ID NO: 28010 - DNA, 50 bp, homo sapien
tttgtcccaaatatccgcttaaaaawtgctttctgatcagttgatttaaa

SEQ ID NO: 28011 - DNA, 50 bp, homo sapien
ttacagatactgcaagagaaggtcamctgctaattctctttcaaccagcc

SEQ ID NO: 28012 - DNA, 50 bp, homo sapien
tcaactttctgtccgaggcaacatasagcaccattcaggtttttccactc

SEQ ID NO: 28013 - DNA, 50 bp, homo sapien
catgagctgtgggccttttagtctcragtgggtaatttacttctcagggg

SEQ ID NO: 28014 - DNA, 50 bp, homo sapien
ttcccgagctctatgtgcactataaragttagttccagcatccaggggca

SEQ ID NO: 28015 - DNA, 50 bp, homo sapien
actaaaaagagcacttttatgggcawgtagaggatcatttgaaagagtaa

SEQ ID NO: 28016 - DNA, 50 bp, homo sapien
gcagtctcatagacaggcctttttayagaacatagtaatgagcacttaca

SEQ ID NO: 28017 - DNA, 50 bp, homo sapien
gaaattttagggacttccatattgascattcaatcatgtactaagttcaa

SEQ ID NO: 28018 - DNA, 50 bp, homo sapien
cagagatgtaaatggaggacatcaayacctaaagtaaagaagggaagggg

SEQ ID NO: 28019 - DNA, 50 bp, homo sapien
atcaaggatgactattccattcacamaaatcacataggaaccaactcata

SEQ ID NO: 28020 - DNA, 50 bp, homo sapien
ccactcaaccatgcctggaatagacrctcattaatgtttgttgatttagt

SEQ ID NO: 28021 - DNA, 50 bp, homo sapien
aatgaggggaagacatgatgtgaacyggaccacaggcccctaactaccac

SEQ ID NO: 28022 - DNA, 50 bp, homo sapien
acgtgagaatttttcagaactaatgraagatgcccattccgagatccaag

SEQ ID NO: 28023 - DNA, 50 bp, homo sapien
aaaaggtaatgagtagattgtcaaarcagacagaaaggaaaaacagataa

SEQ ID NO: 28024 - DNA, 50 bp, homo sapien
actcaaaatatgattcctatactacygctccaatcctatttaactgactc

SEQ ID NO: 28025 - DNA, 50 bp, homo sapien
attggattttgttttgatgttaccaygttccatctttttatctgagagtt

SEQ ID NO: 28026 - DNA, 50 bp, homo sapien
tatgccaagtcagtgataaaaatgawgaccatgtattgagtatattggta

SEQ ID NO: 28027 - DNA, 50 bp, homo sapien
ttattatgaaagacaatgaagcccayggaagctgtagaatttacaaggtg

SEQ ID NO: 28028 - DNA, 50 bp, homo sapien
gtgtggttctcaggtatccttcccartatttcttgcttcatgctactttg

SEQ ID NO: 28029 - DNA, 50 bp, homo sapien
ttaatccttttttgtattgattgcaygtttaaaggttaatattttggata

SEQ ID NO: 28030 - DNA, 50 bp, homo sapien
tggactcaccataaacatgatattayctactcacacttgttaagagtatc

SEQ ID NO: 28031 - DNA, 50 bp, homo sapien
gcaagtataaaaaataattagtgaayaactcaaggcttagaggattaagt

SEQ ID NO: 28032 - DNA, 50 bp, homo sapien
tgaagaacgtggagtgatcaccttcragtagttatacacagtcaactcga

SEQ ID NO: 28033 - DNA, 50 bp, homo sapien
aacatactctgggcaggattttaatsagcttgacttttttgctctcagac

SEQ ID NO: 28034 - DNA, 50 bp, homo sapien
aagttatgaactttgagtcctggcgmagatcaaccactcattaactgaat

SEQ ID NO: 28035 - DNA, 50 bp, homo sapien
gatcgttactctgctgtgaaaatgartattgggtttatggagaaagctaa

SEQ ID NO: 28036 - DNA, 50 bp, homo sapien
cacaatctacacatctgcgattgaarccttttgatgcgttctataaataa

SEQ ID NO: 28037 - DNA, 50 bp, homo sapien
ctgtaatacaaagcattggaattaaygacgtgtaaaattccttttctatg

SEQ ID NO: 28038 - DNA, 50 bp, homo sapien
tcctagtcctgagccaattccaaaaygctgaatttcatccttccactact

SEQ ID NO: 28039 - DNA, 50 bp, homo sapien
ccatctggacatctgccagtcactargaagagaatagatttttcaggcac

SEQ ID NO: 28040 - DNA, 50 bp, homo sapien
taagaaacttcttacattcagccatsatagtgaaatttttcattgctggc

SEQ ID NO: 28041 - DNA, 50 bp, homo sapien
attatttttaaataactagagttcartctaatgtaaactatatacaaaag

SEQ ID NO: 28042 - DNA, 50 bp, homo sapien
aacttggtgtgtactgtacgtgtggkatgatcaccaattgctgtttttac

SEQ ID NO: 28043 - DNA, 50 bp, homo sapien
aaggcaaaactgatttgcttccactraaccaaagctgtgaaatagaatag

SEQ ID NO: 28044 - DNA, 50 bp, homo sapien
tgggattcctctagttccctgattgyatatccgtaaaacctcttaccgaa

SEQ ID NO: 28045 - DNA, 50 bp, homo sapien
atccactgactgaggagaatcaaacrcttcacaatctagaactcagagat

SEQ ID NO: 28046 - DNA, 50 bp, homo sapien
caagcttaagagagaatccatgacaycatataaaacagctctttatttcc

SEQ ID NO: 28047 - DNA, 50 bp, homo sapien
cctctctctgcctcttagaagttgcscttagttttatgcctgcctgtgtg

SEQ ID NO: 28048 - DNA, 50 bp, homo sapien
agtttagttcaaacattgtattaaawattatccatgaaacagtcgctggg

SEQ ID NO: 28049 - DNA, 50 bp, homo sapien
cccagactcataagccagttctttcratagtaaccaaaagaggtatgaaa

SEQ ID NO: 28050 - DNA, 50 bp, homo sapien
tctccattttttttttttttttccakagcttattactcatcacttaaaat

SEQ ID NO: 28051 - DNA, 50 bp, homo sapien
gaggtcaggatgacctgctgtgacartcttcaaacttaggagtcgttaaa

SEQ ID NO: 28052 - DNA, 50 bp, homo sapien
caccaatctatcaccttgggaatcayaaaaatggccaatgataaggtaca

SEQ ID NO: 28053 - DNA, 50 bp, homo sapien
agcttgaatctccctctgaagcaacraacctaacaaaacaaaataatacc

SEQ ID NO: 28054 - DNA, 50 bp, homo sapien
caaggacctggtctcaccaatgaacyggcaagaactagagacataggcaa

SEQ ID NO: 28055 - DNA, 50 bp, homo sapien
ccccaacacttattaacagggtgacyataggtaagttgcctcagttttgc

SEQ ID NO: 28056 - DNA, 50 bp, homo sapien
gtttctactaaattaagagcagaaaytcataactagaagttaacacaaat

SEQ ID NO: 28057 - DNA, 50 bp, homo sapien
gaaacaaaccatctagttaggccaamataaaatcaaagtaaatggggggc

SEQ ID NO: 28058 - DNA, 50 bp, homo sapien
caactagttactgtgaaaccaaagarcttaccttgaagcagaagagataa

SEQ ID NO: 28059 - DNA, 50 bp, homo sapien
gcttctagcatgctttgacaatgatmaaaattcccaaattacataaatgc

SEQ ID NO: 28060 - DNA, 50 bp, homo sapien
ttgctttggccaatgaaatgtggtcrgaaatgtcagaagccagttctgag

SEQ ID NO: 28061 - DNA, 50 bp, homo sapien
tttctgtgaatatgtgcatagtttayaaaagtctgttgggcttctgatat

SEQ ID NO: 28062 - DNA, 50 bp, homo sapien
gaatatgaaatggttgttaagagtcractggaacctaatcttgtaccctc

SEQ ID NO: 28063 - DNA, 50 bp, homo sapien
cctcaccagtagaaccaagttatagmcagaattcagaaataacatttttg

SEQ ID NO: 28064 - DNA, 50 bp, homo sapien
tggtagtaattatttcaacttaatgyaaatggcatagtgatccaaagaaa

SEQ ID NO: 28065 - DNA, 50 bp, homo sapien
tagggtcagggataatcagtgaatcmaaagaaaagacataagactggaaa

SEQ ID NO: 28066 - DNA, 50 bp, homo sapien
ttttgactgacccagacctgtctgtraacgcgcaggtatgacagaagatg

SEQ ID NO: 28067 - DNA, 50 bp, homo sapien
cctgctcttcatatatttcacaacayctagcactgtcctcatatacagca

SEQ ID NO: 28068 - DNA, 50 bp, homo sapien
aagtggcttggaccacatagacacasgtaactgcttatcagagggttaaa

SEQ ID NO: 28069 - DNA, 50 bp, homo sapien
atgaggaatatgttaaagaaattgakgactttgcagaaataatgaaggtt

SEQ ID NO: 28070 - DNA, 50 bp, homo sapien
gctttgaaggataagtcacttggatkagataggtacattccaggcagaag

SEQ ID NO: 28071 - DNA, 50 bp, homo sapien
cccatgttcacagtaccttagtatamgaattaatttgcaaagggatcact

SEQ ID NO: 28072 - DNA, 50 bp, homo sapien
attctactttattcttagtattgcamatgtaagtactaattaatatttaa

SEQ ID NO: 28073 - DNA, 50 bp, homo sapien
aagctttgggttaaagattaagtgawccctttgcaaattaattcttatac

SEQ ID NO: 28074 - DNA, 50 bp, homo sapien
acttttagaagagtggtaggattcayataagtactgagtctgccatcttt

SEQ ID NO: 28075 - DNA, 50 bp, homo sapien
taaatgtggcacaaacacatttaccragaactataattttaagaattaag

SEQ ID NO: 28076 - DNA, 50 bp, homo sapien
tcagattaatgcgttggcagatcaayggttggaaaaattcaagaccactg

SEQ ID NO: 28077 - DNA, 50 bp, homo sapien
acaggaagatcaaccatagtgtttamaattcagttgccaatcactatatg

SEQ ID NO: 28078 - DNA, 50 bp, homo sapien
tgttttcccatcctctgttgcagaayacagtccatacttcccaatatggc

SEQ ID NO: 28079 - DNA, 50 bp, homo sapien
atgtgatgcttgtattagatggaacwataggacaatttcatatggctcaa

SEQ ID NO: 28080 - DNA, 50 bp, homo sapien
caattgatggttgccttgccaagtakaattaagaaaattcagcagcactg

SEQ ID NO: 28081 - DNA, 50 bp, homo sapien
aaaagttaagtaaaatcataattccrctagtttaaaatttctataaaata

SEQ ID NO: 28082 - DNA, 50 bp, homo sapien
gtaaatgattgcatgataatacatakgttgctttctactgagggtgaact

SEQ ID NO: 28083 - DNA, 50 bp, homo sapien
aacataatactttataaaactcatcyaaatacattgacatctattttctg

SEQ ID NO: 28084 - DNA, 50 bp, homo sapien
tcaggtaggattcccactttaccgaygtggaatatggaggctcacctgac

SEQ ID NO: 28085 - DNA, 50 bp, homo sapien
actcccaggcacttatggctctcggmaagtaaagcatctccaagtgccca

SEQ ID NO: 28086 - DNA, 50 bp, homo sapien
agaggccatgggaaggaagatggtgyatcaagccatacttgaagcttgaa

SEQ ID NO: 28087 - DNA, 50 bp, homo sapien
ataacctaccaccctgtacagtatayattgaaaaaatgggccccaaagac

SEQ ID NO: 28088 - DNA, 50 bp, homo sapien
tgttttcttaatctcatgatagtacmctcttcgcttgtgcatttgaactc

SEQ ID NO: 28089 - DNA, 50 bp, homo sapien
tccatttggaattctgttcaaatacrcgtggtcaaagactagatggagat

SEQ ID NO: 28090 - DNA, 50 bp, homo sapien
cattgaaagtttatatattccacacygtagattataaattgaacatttta

SEQ ID NO: 28091 - DNA, 50 bp, homo sapien
tttttagagttatttcttgattatayatgaaacaagggtggattatttgt

SEQ ID NO: 28092 - DNA, 50 bp, homo sapien
aagccttttgcagtatacaactgtakccttaatattcactataatcttac

SEQ ID NO: 28093 - DNA, 50 bp, homo sapien
tatcagttctaagagttttctggtasagcctagatttttctataaaaccc

SEQ ID NO: 28094 - DNA, 50 bp, homo sapien
ttccaggttcgatgtttttgatgtawgaatagaggcaccagaattcagag

SEQ ID NO: 28095 - DNA, 50 bp, homo sapien
ggacgtggacaaggatgtcacgtgawctccaatatcaagtcctaggccca

SEQ ID NO: 28096 - DNA, 50 bp, homo sapien
taaagacgtctgggtatcttcagtaygtaaaaagctgtgggaaaaaagag

SEQ ID NO: 28097 - DNA, 50 bp, homo sapien
aaatgtctcttcaccctgcaggaaaygagtttattagtgaaactttcaac

SEQ ID NO: 28098 - DNA, 50 bp, homo sapien
gttacagattttgcttcggtgactgmagaatttgaagtaatattccaatt

SEQ ID NO: 28099 - DNA, 50 bp, homo sapien
aagctttccacatggataacaaagayaaccaggatgattgttcagcctaa

SEQ ID NO: 28100 - DNA, 50 bp, homo sapien
ctagggaacattctcaggaaaatcaytattggtttctacaacagtgtctt

SEQ ID NO: 28101 - DNA, 50 bp, homo sapien
gcataccctctaaattattgtatgamctgttgccaatttattctcatcgt

SEQ ID NO: 28102 - DNA, 50 bp, homo sapien
gtgggatgctgaattgtctttcagakaaatgcctgatgttagcacaggaa

SEQ ID NO: 28103 - DNA, 50 bp, homo sapien
gtattatcagctgttgatctgtaacmgttaattgccaaagtctaccacaa

SEQ ID NO: 28104 - DNA, 50 bp, homo sapien
ggagcttgtagtaaatggttaaacaraaacaagacataaatcttatgaaa

SEQ ID NO: 28105 - DNA, 50 bp, homo sapien
ctaaaaatctttcttggtatactcaragcatcattattccctttaggata

SEQ ID NO: 28106 - DNA, 50 bp, homo sapien
ttctggactggttttaatcaatataygtagaaaacttactgttaggtagc

SEQ ID NO: 28107 - DNA, 50 bp, homo sapien
tagcagtactgtatgaaattgctccraagtggaaacgggtaggaatttaa

SEQ ID NO: 28108 - DNA, 50 bp, homo sapien
gaaacgctgagtttgatatttctacyagcaagacattgaggagatggtgg

SEQ ID NO: 28109 - DNA, 50 bp, homo sapien
tttgaggtagattttcatacacacgmatgcttattgaaattaaatgcatt

SEQ ID NO: 28110 - DNA, 50 bp, homo sapien
tttgcaatataatttttcttcaagarctcaagccagagttgcatgagttt

SEQ ID NO: 28111 - DNA, 50 bp, homo sapien
tggatggtgcaggtggtagcctccaygatcataacttattacgctagtgt

SEQ ID NO: 28112 - DNA, 50 bp, homo sapien
ataaaaattaccaaagaattgtcccraaatataaaatatggaaatctcaa

SEQ ID NO: 28113 - DNA, 50 bp, homo sapien
cattctattaactgcatagctcaaaytccgaaacatctgcaaagaaaatt

SEQ ID NO: 28114 - DNA, 50 bp, homo sapien
cttccagacatcttaccagctgtacrgaataagaacctgtgattggcaga

SEQ ID NO: 28115 - DNA, 50 bp, homo sapien
agagtataatcctaccgtgtgtccaragtggagagagcaggaaatatttg

SEQ ID NO: 28116 - DNA, 50 bp, homo sapien
acatgtataagaaaaatcaggtctamaggaataaatgcaggttatcaaat

SEQ ID NO: 28117 - DNA, 50 bp, homo sapien
agatgctgttaaagaacaaagcatgratttaacaagtttttacagcaaat

SEQ ID NO: 28118 - DNA, 50 bp, homo sapien
gcaagctctcaggcgatactagcgaygtaacagtgaaacagcgaaagaac

SEQ ID NO: 28119 - DNA, 50 bp, homo sapien
aaatggcttgaattaggacaggctayaatactctgaatgtacagtttgtc

SEQ ID NO: 28120 - DNA, 50 bp, homo sapien
ttgaggggagctgcaaaatgacatcrcaaggtatgagtccagggaagaga

SEQ ID NO: 28121 - DNA, 50 bp, homo sapien
tacagaaaataccatggaccctacargattagctggtggtggtgacaatg

SEQ ID NO: 28122 - DNA, 50 bp, homo sapien
aagcccagtttctctggacatcaaarttctcatttagaacaaagctgcca

SEQ ID NO: 28123 - DNA, 50 bp, homo sapien
tctgattgcatattttgcctgatcartatgaaaactacgcaaactttagt

SEQ ID NO: 28124 - DNA, 50 bp, homo sapien
gcacacagacaataagatcttaaaartaaatggaaataaccaaggtatca

SEQ ID NO: 28125 - DNA, 50 bp, homo sapien
tgggctagtgctttctgttttgacargttattaattatcaattcaatttc

SEQ ID NO: 28126 - DNA, 50 bp, homo sapien
caagaaggaacagacaatctgaaaargtctatatctattaaggaaattga

SEQ ID NO: 28127 - DNA, 50 bp, homo sapien
caggtggaggtatccagattctctaktacaaagagggctgggggaaacag

SEQ ID NO: 28128 - DNA, 50 bp, homo sapien
tcctggtcatggagggaagaatagaracgaaactatcatcatagtccagg

SEQ ID NO: 28129 - DNA, 50 bp, homo sapien
caaattctcctctgacgtaatccccraggtgattgttgcagatttttcag

SEQ ID NO: 28130 - DNA, 50 bp, homo sapien
tcctaagaactttgggattaaaaaamatgatatggaacatttttagtagg

SEQ ID NO: 28131 - DNA, 50 bp, homo sapien
ttggaggactggagcgactatatccrgaagatactgaatcaaacatctgg

SEQ ID NO: 28132 - DNA, 50 bp, homo sapien
agcgccaaagaacagagtagaacaaygggttgcctataatctctctctag

SEQ ID NO: 28133 - DNA, 50 bp, homo sapien
gaggaatctgtgagtctgaagaataygaaaggaaaacctagagagagatt

SEQ ID NO: 28134 - DNA, 50 bp, homo sapien
gccaaacatcactgcctcctcctacsaattcattttttaaaaatgatact

SEQ ID NO: 28135 - DNA, 50 bp, homo sapien
tcagccaaaccatctttagcccacartagctctcagtggacgttggatgc

SEQ ID NO: 28136 - DNA, 50 bp, homo sapien
tttccaggttaagcagaaacatggaygccatactaaactctgaacagaca

SEQ ID NO: 28137 - DNA, 50 bp, homo sapien
tgctttgctaacagcactgtagaacyatgccactcaagtatcctagaaca

SEQ ID NO: 28138 - DNA, 50 bp, homo sapien
tgcctaaaagtggtttcaaaaataaygatcaactgtcaaataggaaagct

SEQ ID NO: 28139 - DNA, 50 bp, homo sapien
acaataaaatggaataaagagttaarataaaccctccctcaaactgtgaa

SEQ ID NO: 28140 - DNA, 50 bp, homo sapien
ttcccgcagcactccataagtcaaaytgcatagcgagcttgatattcaag

SEQ ID NO: 28141 - DNA, 50 bp, homo sapien
taagctctttatgaatgttaatgaaycaattttgctgatttatttttttc

SEQ ID NO: 28142 - DNA, 50 bp, homo sapien
atttatagctctaaaaataaacggaygattttggatgaattcacaccaag

SEQ ID NO: 28143 - DNA, 50 bp, homo sapien
gttatgcctgtagcactaagatagaygcagtaatttgatttataccattc

SEQ ID NO: 28144 - DNA, 50 bp, homo sapien
aacatttatgttgcacttatccaaakatttgaccagaatagaaaatgccc

SEQ ID NO: 28145 - DNA, 50 bp, homo sapien
ttcctgacatgttatttcataataayaatgctcatatactttccaaatga

SEQ ID NO: 28146 - DNA, 50 bp, homo sapien
gaagtagtacatgttggctgaataamtgacccattcagcatcagctttgg

SEQ ID NO: 28147 - DNA, 50 bp, homo sapien
ctccagcaatcacactcattttgtcragcagaatgaaatgagctaggcac

SEQ ID NO: 28148 - DNA, 50 bp, homo sapien
ctacttaatttcagccatgatcaaartggttaagacctaactttcattta

SEQ ID NO: 28149 - DNA, 50 bp, homo sapien
gcttcttagttattttttatagtcarcttctgtgaattaaatactcttta

SEQ ID NO: 28150 - DNA, 50 bp, homo sapien
aaagcgagacctctactttgatcgayataatgtttttcttaccatttttt

SEQ ID NO: 28151 - DNA, 50 bp, homo sapien
gtaataagcatattcatcacctccartagcttccccctgcttccatgtgt

SEQ ID NO: 28152 - DNA, 50 bp, homo sapien
tagagaatgacatatatggagtttargattgctgaactttggagcagtgt

SEQ ID NO: 28153 - DNA, 50 bp, homo sapien
attaagcagaaaaatgacatcacaayagttttcacattttttaattgaaa

SEQ ID NO: 28154 - DNA, 50 bp, homo sapien
atcttctgatgcccaatactattaaygatgtttcttataaactatagtca

SEQ ID NO: 28155 - DNA, 50 bp, homo sapien
aaggaaccaactgacccgatgatgastaagagcttaaatatcccacctac

SEQ ID NO: 28156 - DNA, 50 bp, homo sapien
tgtaagtgattctatatgtggttcayagacatagtaaaatcttgaggtaa

SEQ ID NO: 28157 - DNA, 50 bp, homo sapien
ctgtctttattttccatgaggtgtcmaacacattgtagaaatatcccctg

SEQ ID NO: 28158 - DNA, 50 bp, homo sapien
taatgtcagttaaaatgtggaatacragaggaaagaatttagccaagagc

SEQ ID NO: 28159 - DNA, 50 bp, homo sapien
tgttgatgttttctccagaattagaraatcagaaggggtggttcatggcc

SEQ ID NO: 28160 - DNA, 50 bp, homo sapien
aaatataatggtaatttagtattcayggtggacacttcaggaatttataa

SEQ ID NO: 28161 - DNA, 50 bp, homo sapien
cttgagtgccaaagacatcattaaawgtgacaccatcaaatatgaagatg

SEQ ID NO: 28162 - DNA, 50 bp, homo sapien
agaaagataagaaatgagaatatcastattaggataaaagcaacttcctt

SEQ ID NO: 28163 - DNA, 50 bp, homo sapien
cctggaaaggacaacaccataaaaayaatgaaaagatcagtggttgccag

SEQ ID NO: 28164 - DNA, 50 bp, homo sapien
tcccacaagaagtaagaaataaaagrattaaggttgctttctgagatata

SEQ ID NO: 28165 - DNA, 50 bp, homo sapien
aatgcatctgaagtttattttcttaygtggtacaattaaatatgtaatta

SEQ ID NO: 28166 - DNA, 50 bp, homo sapien
agtttaacttttttgttgttattgtyaattaaaggcaactcttgggattt

SEQ ID NO: 28167 - DNA, 32 bp, homo sapien
cttatgatgtgatgcamctcttcctcctttac

SEQ ID NO: 28168 - DNA, 50 bp, homo sapien
ttgatttctatatatttgcagtgaayaaacaaaatttaaattccatttgc

SEQ ID NO: 28169 - DNA, 50 bp, homo sapien
ctgtgtacccattaaagaaggtaaayaagtggtaacaggttgtctctggg

SEQ ID NO: 28170 - DNA, 50 bp, homo sapien
tattaccactgctgtgtttaagggastatttttgttgctgtaattttggg

SEQ ID NO: 28171 - DNA, 50 bp, homo sapien
accagttgatttacctgcagtcaccygggagtttgcaagacccatgctta

SEQ ID NO: 28172 - DNA, 50 bp, homo sapien
tctatgtaatctagcccattattaasaaagagaatgctccctgtcttttg

SEQ ID NO: 28173 - DNA, 50 bp, homo sapien
aagatgataagatattacttgacctyaggtagtttaacaatagtgggaag

SEQ ID NO: 28174 - DNA, 50 bp, homo sapien
ttttctgtatgcatatagtgttctcwaggatgaaatcttgcatatgtgaa

SEQ ID NO: 28175 - DNA, 50 bp, homo sapien
tgggatgaattcttcaatgataagawcctgctattattgtccctgcttta

SEQ ID NO: 28176 - DNA, 50 bp, homo sapien
ttcctacaccatacaagtttagaacmatttcagacagttatgaatattgg

SEQ ID NO: 28177 - DNA, 50 bp, homo sapien
gggggagccctaactatgacagtaaycgacagtgccttaatcaggctacc

SEQ ID NO: 28178 - DNA, 50 bp, homo sapien
agggagtgaagcagcaggttatatayaatagttgctcagttaaaaacttg

SEQ ID NO: 28179 - DNA, 50 bp, homo sapien
tagactaataatttcaagtgataccrcatttttcagttccataagaataa

SEQ ID NO: 28180 - DNA, 50 bp, homo sapien
aaaactaaacctttgtaagatcctayacgatgactgcagctcactgtaga

SEQ ID NO: 28181 - DNA, 50 bp, homo sapien
aaccctatcacgacagtggaaatttwaaaaaatcttcatgacagaaaagg

SEQ ID NO: 28182 - DNA, 50 bp, homo sapien
gtagaattcactattaatagtaaagkcttccacaggagcagaaaaaagca

SEQ ID NO: 28183 - DNA, 50 bp, homo sapien
tcacatgttcaatttccagttaatayagagattttattcattgaacatta

SEQ ID NO: 28184 - DNA, 50 bp, homo sapien
agtatgatcagaagcaacttcgagargcacttaccctcatttcatgcagc

SEQ ID NO: 28185 - DNA, 50 bp, homo sapien
gtcataagttctaaggatattcttakgcctgagtagtggtggtgggggga

SEQ ID NO: 28186 - DNA, 50 bp, homo sapien
gataggacctttagttaactgtaacsggcagcatttattgcttgcttagt

SEQ ID NO: 28187 - DNA, 50 bp, homo sapien
tggaaaatgcttatagatacatgttyaaaggtatgaagatgaagattaac

SEQ ID NO: 28188 - DNA, 50 bp, homo sapien
ctctaaccctttactaattaacttaycatctttccttctagatgctagaa

SEQ ID NO: 28189 - DNA, 50 bp, homo sapien
cagtatggtctaagctatttttttcyaatactgcacttgtaatcacatca

SEQ ID NO: 28190 - DNA, 50 bp, homo sapien
gatacatagcataagatgatggtaaygttgaatttaataaaaacattact

SEQ ID NO: 28191 - DNA, 50 bp, homo sapien
ctatgtatcactctcatcaattatcraatgtcgtaaactttcagcagctg

SEQ ID NO: 28192 - DNA, 50 bp, homo sapien
gtttctcttctgccttttgtatttcyatatgtcactgctatctatattct

SEQ ID NO: 28193 - DNA, 50 bp, homo sapien
ctttgtctcccagtggagtaagttaycacacacccgaaatggtccccaag

SEQ ID NO: 28194 - DNA, 50 bp, homo sapien
cctcaaatgatcttttcttcttcacsgactaaaagagccatttatgtctg

SEQ ID NO: 28195 - DNA, 50 bp, homo sapien
tccctttctttcctgcctgcagtcaytcccagaagtttacctctaaggag

SEQ ID NO: 28196 - DNA, 50 bp, homo sapien
acattggactatcagggctttgtaaygatagctagcatatcctaaataca

SEQ ID NO: 28197 - DNA, 50 bp, homo sapien
ttattctctttgtttctctaattcaraggaagaagataagtaaagtgtct

SEQ ID NO: 28198 - DNA, 50 bp, homo sapien
ctgaaacagtctcccttcaatttaaygaactgctccaggcatcagtttct

SEQ ID NO: 28199 - DNA, 50 bp, homo sapien
gtttttcatattaagaagatgtcackattttctcttttcataaggcatca

SEQ ID NO: 28200 - DNA, 50 bp, homo sapien
ttgagatgtcgagagcgagccatcaraatgttctcaagaattaaattgaa

SEQ ID NO: 28201 - DNA, 50 bp, homo sapien
acctagccctgtgcaattacaaagckccctgtctaccacagcagagcttc

SEQ ID NO: 28202 - DNA, 50 bp, homo sapien
ttatacataggaatctttgaaattakgtctaaagcaatacattggctccc

SEQ ID NO: 28203 - DNA, 50 bp, homo sapien
agacaagaacatttataaaatattaycacaggctgagtgatatgggacat

SEQ ID NO: 28204 - DNA, 50 bp, homo sapien
ataatttcaaagattcctatgtatamcttctttaatttttattgactact

SEQ ID NO: 28205 - DNA, 50 bp, homo sapien
aaaaataaaattgaattaaggtaccrctatgctgctttcacgcaaaataa

SEQ ID NO: 28206 - DNA, 50 bp, homo sapien
ttctattttaaggtacctctcttcayggcagaatgacacagaaagacaaa

SEQ ID NO: 28207 - DNA, 50 bp, homo sapien
gcatccttttaagcagaccacaaccyggaatttatcactcatgatcttcc

SEQ ID NO: 28208 - DNA, 50 bp, homo sapien
gagcaataagacaagataaagacatwaaaggtattcaaattggaaaacaa

SEQ ID NO: 28209 - DNA, 50 bp, homo sapien
gctagcaaaacctgccggcgttacartgacaagctgctgttttacttgtc

SEQ ID NO: 28210 - DNA, 50 bp, homo sapien
cctagcacattatctgttataatagkagtggctataaatgaatgaatgtc

SEQ ID NO: 28211 - DNA, 50 bp, homo sapien
gaaaatccaatcagttagttagaatsatgatgaagaatcccaagaaggaa

SEQ ID NO: 28212 - DNA, 50 bp, homo sapien
gtgcctggaggtcagccttaaactcrcaaaagaaccacttggattgaggc

SEQ ID NO: 28213 - DNA, 50 bp, homo sapien
caaaagaacatggagatcaagttacwctctaaaaggtacataatttaatt

SEQ ID NO: 28214 - DNA, 50 bp, homo sapien
cttcttttgaccaaaaagattctacracaattatccagaagttacaatgc

SEQ ID NO: 28215 - DNA, 50 bp, homo sapien
ggagatcaaagctctattttaggacractcactcaatgatgttgttcagg

SEQ ID NO: 28216 - DNA, 50 bp, homo sapien
gaataacccaattatcaagatcaacmctagaggatattttagcaatgtat

SEQ ID NO: 28217 - DNA, 50 bp, homo sapien
ggccaaaggaatcccagttttctcastccagcaggatttgattcttagta

SEQ ID NO: 28218 - DNA, 50 bp, homo sapien
gattttcttccataacgctgttcctyacctctaaatggtcctttcactaa

SEQ ID NO: 28219 - DNA, 50 bp, homo sapien
aggaacaaatcaacaaacagactaaycaaaccttggagaagcttcctatg

SEQ ID NO: 28220 - DNA, 50 bp, homo sapien
cacagtgtgtgcggtgtcacttccarctaatacgcatacagaaatgatga

SEQ ID NO: 28221 - DNA, 50 bp, homo sapien
atatagcacatgaggaattctggacmaaaggtatggaagctaaagcaact

SEQ ID NO: 28222 - DNA, 50 bp, homo sapien
aattgcatttgaacacctataatacraaagcaggaaagtaccagggcccc

SEQ ID NO: 28223 - DNA, 50 bp, homo sapien
aatccccagtggcagggactcttacrataccaattttatagaggaggaaa

SEQ ID NO: 28224 - DNA, 50 bp, homo sapien
aatattttaaaaaacagttctgtaasatgaagtcccatttctaaatatat

SEQ ID NO: 28225 - DNA, 50 bp, homo sapien
gtcttataagccactcatttaaagaygaaagctcctctgattagcactgc

SEQ ID NO: 28226 - DNA, 50 bp, homo sapien
ctggggttaaagtctctgttttcacrcgtcggatttgggcttcattcccc

SEQ ID NO: 28227 - DNA, 50 bp, homo sapien
agataggtcacttctcctccgttcayaggctaatgaaggcatctttagag

SEQ ID NO: 28228 - DNA, 50 bp, homo sapien
actctgatgtcatatgaaggagtcasaaagtataaaatactacaaaagtc

SEQ ID NO: 28229 - DNA, 50 bp, homo sapien
aaaaacagcctaattattcttgtcawcaaggcatcccagagtgccccctg

SEQ ID NO: 28230 - DNA, 50 bp, homo sapien
ctgggggaaccaaagacagttggtcrccaaagccataaacaccaagagga

SEQ ID NO: 28231 - DNA, 50 bp, homo sapien
cttagaaggataagctgaagttgaasaggttgagacaaaagacaaaggga

SEQ ID NO: 28232 - DNA, 50 bp, homo sapien
gtctcttgggaacgagttgagagtgsaatatgccaaatttcctcttctta

SEQ ID NO: 28233 - DNA, 50 bp, homo sapien
gcgcaaacccactaactgattttacsgcagtttgagtgcacaggggctgg

SEQ ID NO: 28234 - DNA, 50 bp, homo sapien
agtggtcactcgttgttttcattatyaccaagatgtggatgaacaagccc

SEQ ID NO: 28235 - DNA, 50 bp, homo sapien
ttgaaaacaacttccgaggatgtcaygcagagggttaatatccttggtgt

SEQ ID NO: 28236 - DNA, 50 bp, homo sapien
aagtgataactaaaactagcactggyaaagacttaaatttcacatcatgt

SEQ ID NO: 28237 - DNA, 50 bp, homo sapien
tggattcatactgtagtatggcccawctttagagaaccttctcttgactc

SEQ ID NO: 28238 - DNA, 50 bp, homo sapien
gtacattaacatgcaggacaattgayatgttaagaatatttaatacatta

SEQ ID NO: 28239 - DNA, 50 bp, homo sapien
actatatattatcaggcactatactraatgctctacataaatatatttca

SEQ ID NO: 28240 - DNA, 50 bp, homo sapien
tcagctttcagctctcacccctagayggtattaatatagcagctcttctc

SEQ ID NO: 28241 - DNA, 50 bp, homo sapien
gttctagtgctttttgcctgaaataygtaactaaatggttgttaaaccta

SEQ ID NO: 28242 - DNA, 50 bp, homo sapien
ttttaagatttgatttttgtgtcacracttcttggtctcagtgttggcac

SEQ ID NO: 28243 - DNA, 50 bp, homo sapien
tcgatgtggattacagtcaacctaarctggtagtctatttatgtaaaatt

SEQ ID NO: 28244 - DNA, 50 bp, homo sapien
aatggagaacaaggcggtggcagackgtattactcaacgctgaccccagc

SEQ ID NO: 28245 - DNA, 50 bp, homo sapien
aatcttaagttctggttcatgtgtartaaagacagcaaaaatgcatgtaa

SEQ ID NO: 28246 - DNA, 50 bp, homo sapien
tgtgtaaaatggtagtatgcttctaratggacaggccattccaaaagaaa

SEQ ID NO: 28247 - DNA, 50 bp, homo sapien
gtagaattatctttgtgaggattaamggctgacgcaggaccataaaacaa

SEQ ID NO: 28248 - DNA, 50 bp, homo sapien
atctttcttctcaatccaattcctcraaaccctattgaagtactagcatg

SEQ ID NO: 28249 - DNA, 50 bp, homo sapien
aaacccaaagaaagttgaagaaaggwcataatgaagacaagaggcatggc

SEQ ID NO: 28250 - DNA, 50 bp, homo sapien
gttccttattggcaacaggccatcarctgcattcgttacgtaaggttatt

SEQ ID NO: 28251 - DNA, 50 bp, homo sapien
ttagcatgcaatttgtaagtcattayggtgcaaactatgtggtaagaaca

SEQ ID NO: 28252 - DNA, 50 bp, homo sapien
tggctgtgctttgattggagagtgaygaccctgtgcataatcattgatcc

SEQ ID NO: 28253 - DNA, 50 bp, homo sapien
ctccctgcccatcactaattgtacamccataaaaattaagacattattcc

SEQ ID NO: 28254 - DNA, 50 bp, homo sapien
ttaatctgttccctggaattccacaraccaaatctaatctcctcttcact

SEQ ID NO: 28255 - DNA, 50 bp, homo sapien
tccaggccatatacatgttctatgcrctggccattgtgtgtgatgacttc

SEQ ID NO: 28256 - DNA, 50 bp, homo sapien
acaatttactaactagttgttgtgayggctgcaattactctttgggtttt

SEQ ID NO: 28257 - DNA, 50 bp, homo sapien
aaaatacagcttcattcacatttacraattagtcactccctttctgtcaa

SEQ ID NO: 28258 - DNA, 50 bp, homo sapien
ctagaattcttccctttacttgtcartcttccaccatatgactgtgggtt

SEQ ID NO: 28259 - DNA, 50 bp, homo sapien
gcaacctcataactccttggtgaaaytataaggtaaatacttttaacatc

SEQ ID NO: 28260 - DNA, 50 bp, homo sapien
tctgcggtcccagcaacttttggtayggatctagggcagtctgacccctg

SEQ ID NO: 28261 - DNA, 50 bp, homo sapien
gcctttcactattcctttaccagccrcagaaataaaaaataattgaaagt

SEQ ID NO: 28262 - DNA, 50 bp, homo sapien
tggtggccttccctgatgtgcagtcrctatacatggcaggaagcagagtg

SEQ ID NO: 28263 - DNA, 50 bp, homo sapien
ttcatcgtagtcttattgtccattawcaggttattcagttacattggagc

SEQ ID NO: 28264 - DNA, 50 bp, homo sapien
gaccctcggtccaggaccatgcctcragcagtaaggttttaaagggtatg

SEQ ID NO: 28265 - DNA, 50 bp, homo sapien
gtcctggattggatgagaaacaataragtaacctcactgagaagcagagc

SEQ ID NO: 28266 - DNA, 50 bp, homo sapien
ctctttaaatgcaaaatttctgttasacatagctttaccagtgttttatc

SEQ ID NO: 28267 - DNA, 50 bp, homo sapien
tgtagcatggccgtgaacattctgamgtctcaggagcccttgcatgaatc

SEQ ID NO: 28268 - DNA, 50 bp, homo sapien
gtatagcatgatgaagaggtcatcargttaggacacggagatcttagtag

SEQ ID NO: 28269 - DNA, 50 bp, homo sapien
tcctgtaaacaatgtattatattgcragttggtaatatgtactatttaac

SEQ ID NO: 28270 - DNA, 50 bp, homo sapien
tccccttgccagaggaattcagaacrctgtcaaacttaaatagctatgta

SEQ ID NO: 28271 - DNA, 50 bp, homo sapien
ccaggactctggctaccactctagaycttctggcttttttagggacaatt

SEQ ID NO: 28272 - DNA, 50 bp, homo sapien
tataaaatgatcatttttgcaggaaraaaataactggatatcggcaattt

SEQ ID NO: 28273 - DNA, 50 bp, homo sapien
aggtagtggttatctatagcacccaygaagtctgcaaaagcagtttgcca

SEQ ID NO: 28274 - DNA, 50 bp, homo sapien
ctgctcttgcaaattaagtaattaargaaagagtgaacctgtgataattg

SEQ ID NO: 28275 - DNA, 50 bp, homo sapien
agcttctatagtactaactaaaacastgtctccaagcctaaaaggtgaga

SEQ ID NO: 28276 - DNA, 50 bp, homo sapien
taacgggatgtaattataacccatgkataaggccataaatactttagaag

SEQ ID NO: 28277 - DNA, 50 bp, homo sapien
tagcttgttgaagtcttacaaataarttaagccggctgggcgtggtggtt

SEQ ID NO: 28278 - DNA, 50 bp, homo sapien
ttaattttttttaccatattcataaytgaggaagtctgagcattgcgtta

SEQ ID NO: 28279 - DNA, 50 bp, homo sapien
tccctctgcacatcttcgtaaaatcrctgttcttttcaaacttgtacagc

SEQ ID NO: 28280 - DNA, 50 bp, homo sapien
tccaaattgtagccatggtttcaackagacagaattttgtgttcatcttg

SEQ ID NO: 28281 - DNA, 50 bp, homo sapien
acactggccacattctgcctgctcayacctgcattcctttgcccaaaggc

SEQ ID NO: 28282 - DNA, 50 bp, homo sapien
atttcaacaacaggaaactacactaygacaaagactagtttacacttgtt

SEQ ID NO: 28283 - DNA, 50 bp, homo sapien
tcactctaaggaagttcaccaaatakatgaattcttgtcagctgggccca

SEQ ID NO: 28284 - DNA, 50 bp, homo sapien
tgacaatatctgacctgcttacctcrcatgatgttataaggttccactga

SEQ ID NO: 28285 - DNA, 50 bp, homo sapien
ctagtcactttttccagactacaccrcagagcctattttaaacagcttta

SEQ ID NO: 28286 - DNA, 50 bp, homo sapien
agcctccagcagttggtccaggaaasgtagacagtcctgctgaggcccca

SEQ ID NO: 28287 - DNA, 50 bp, homo sapien
aagcacatgccactcatcttgctcascggatgtcgctataaaacctgaac

SEQ ID NO: 28288 - DNA, 50 bp, homo sapien
tcagcacagatgactcctggtctcartatgtccttcttgcaatctgttca

SEQ ID NO: 28289 - DNA, 50 bp, homo sapien
tgctttataatatttgttggataaaygcatgaataagttggtttttaaag

SEQ ID NO: 28290 - DNA, 50 bp, homo sapien
ctcctctatcttggcatcccatttaycaagcgcagtgactcccacagctg

SEQ ID NO: 28291 - DNA, 50 bp, homo sapien
tttcctaaatgcaatagcacaaaaartcatcataaaaagagaggcagaaa

SEQ ID NO: 28292 - DNA, 50 bp, homo sapien
cctggaataacatttgtctgtccaaygtgtaaaatattgagtaatacaaa

SEQ ID NO: 28293 - DNA, 50 bp, homo sapien
ctccattgtgtatctgcttcttatawatcaccagagacaatttctccctc

SEQ ID NO: 28294 - DNA, 50 bp, homo sapien
aactggggtggcagcagcacaaatascaaggaggaatgcaagcaagagat

SEQ ID NO: 28295 - DNA, 50 bp, homo sapien
tggctttgagtttagacttttggtcyaagtcaggttgggatcagaactca

SEQ ID NO: 28296 - DNA, 50 bp, homo sapien
aactgttgctgaatcagacagtccasgtatagggcatttccatcatcaca

SEQ ID NO: 28297 - DNA, 50 bp, homo sapien
tgggaagttgaaattacctttttgaygcagacaagcacttgtcctgaaga

SEQ ID NO: 28298 - DNA, 50 bp, homo sapien
ctttaatttcttttcttctttcttasatttttcaaccttttaactcccca

SEQ ID NO: 28299 - DNA, 50 bp, homo sapien
tggccccagggtaggttttccagaayatgatgctgttaggacgagatcac

SEQ ID NO: 28300 - DNA, 50 bp, homo sapien
acagtttttcccatcctggtatatgsacatctatcacttttctcatgaag

SEQ ID NO: 28301 - DNA, 50 bp, homo sapien
actactgcaatcaagataatgaataygcccacgattctaaaaggttatct

SEQ ID NO: 28302 - DNA, 50 bp, homo sapien
ttatagaaaaatgattcttttagcargttcttttaaaatataaataagtt

SEQ ID NO: 28303 - DNA, 50 bp, homo sapien
acataaactttgccaccaagtgaaasaaaatcctgttttcatccagaggg

SEQ ID NO: 28304 - DNA, 50 bp, homo sapien
tttgcagcccacacagtgatcagggrattctttattggtcactttttttt

SEQ ID NO: 28305 - DNA, 50 bp, homo sapien
ggtcagatcaagagagcctttggtgmaatgcaggagccagctccaagctt

SEQ ID NO: 28306 - DNA, 50 bp, homo sapien
gtccaacgctctgtgactcctggagscatggtataaaccgaatctgcagg

SEQ ID NO: 28307 - DNA, 50 bp, homo sapien
aaatatgcgttcttgtgtccacaaargtatgaattaaaaacaaaacaggc

SEQ ID NO: 28308 - DNA, 50 bp, homo sapien
tttatgtgtgttcatttttcagcatragaatggcttactccaaacacaca

SEQ ID NO: 28309 - DNA, 50 bp, homo sapien
ggcatccataaaagattcattctcaraaatagtaaagatccaaggtcata

SEQ ID NO: 28310 - DNA, 50 bp, homo sapien
gcactgagtctgaccatgaatttcaraagttcccaggtggtcatgtgcac

SEQ ID NO: 28311 - DNA, 50 bp, homo sapien
atcaagcagatgtttaaaaaaattamaagttgcagtatgtgctttaaagg

SEQ ID NO: 28312 - DNA, 50 bp, homo sapien
caggagcagagctagggtaggaaacmcgcagatgtggattgggtctggac

SEQ ID NO: 28313 - DNA, 50 bp, homo sapien
gtcactgtgtccactgtcacttccaytacttcctaggtttgtctaccttt

SEQ ID NO: 28314 - DNA, 50 bp, homo sapien
atttgtgttatataagccactccatkagcagttatttgttatggaagtaa

SEQ ID NO: 28315 - DNA, 50 bp, homo sapien
ggaggccctggtctgaattacaagayggtaaaataacatatgtcctccac

SEQ ID NO: 28316 - DNA, 50 bp, homo sapien
aagtaataacaaatgaatacactgascatctagagagtttctctacatgc

SEQ ID NO: 28317 - DNA, 50 bp, homo sapien
gaaaactttctctagaaatgctaaayaaaatctatgtgtcctttttttaa

SEQ ID NO: 28318 - DNA, 50 bp, homo sapien
tatgcgttttgtttggagggtgcagraattaaacctgtgagtctgcctcc

SEQ ID NO: 28319 - DNA, 50 bp, homo sapien
taatttctgcaccctccaaacaaaaygcataacaaaatgaaagtcacttc

SEQ ID NO: 28320 - DNA, 50 bp, homo sapien
ctgtaggagagtctttacacatccartcatgtttgagccttacaacagcc

SEQ ID NO: 28321 - DNA, 50 bp, homo sapien
tgaggagaatgtatgggaggtaaaawgattgtagtcactatgtggccagg

SEQ ID NO: 28322 - DNA, 50 bp, homo sapien
ttaaaagcttggatgagctttagcargtaaaaaatggagagaacctcacc

SEQ ID NO: 28323 - DNA, 50 bp, homo sapien
gagatggggtcaaaggttggaacacrcggtattctgacctctggccttct

SEQ ID NO: 28324 - DNA, 50 bp, homo sapien
gcaaaaacatacttaaatacatatarcattgacaccataaacacacacac

SEQ ID NO: 28325 - DNA, 50 bp, homo sapien
ctgctcaggatgagatccaggccacraggttcatcttcctccctgagtcc

SEQ ID NO: 28326 - DNA, 50 bp, homo sapien
ttgtaacctcacatcataaattttayaaaactgcttcataaaaaataact

SEQ ID NO: 28327 - DNA, 50 bp, homo sapien
tctacagctgtaaagattgctcaaayggaccttgcaaaaggaaagcttct

SEQ ID NO: 28328 - DNA, 50 bp, homo sapien
ggtgacatcaaagttggtcaatatascactagagaccttttcctttcaaa

SEQ ID NO: 28329 - DNA, 50 bp, homo sapien
actccagaaccatgaataccgttcasatgctggtccctgagaggaaggat

SEQ ID NO: 28330 - DNA, 50 bp, homo sapien
gcatggtttctccttgaagttcctaytaaaagccatttaacttagatact

SEQ ID NO: 28331 - DNA, 50 bp, homo sapien
agtggattagatcagttttctaatcygaactcccaaaatatgaggcaaaa

SEQ ID NO: 28332 - DNA, 50 bp, homo sapien
tgaagggatgatgtctatttccaaaygcatgtgcgtcacatgagctactg

SEQ ID NO: 28333 - DNA, 50 bp, homo sapien
cccacgtaaacactgaaaccctcaargacactgacttccaactgacctgc

SEQ ID NO: 28334 - DNA, 50 bp, homo sapien
cttggttttgatcctttataagacayggtctcaagtctggagatacaaat

SEQ ID NO: 28335 - DNA, 50 bp, homo sapien
acggtgcagtgtacaagacgacttasatgggttcaaaagctgtgatggga

SEQ ID NO: 28336 - DNA, 50 bp, homo sapien
attgccttctccctctgtgtagtaakgattggcttaatatttgtctccac

SEQ ID NO: 28337 - DNA, 50 bp, homo sapien
gttactgtagtaaccatggttagtayctttcctttgtccagcaggtggga

SEQ ID NO: 28338 - DNA, 50 bp, homo sapien
atcctttacaaggctacaaccaaacygtttagctgtagaccataaggttt

SEQ ID NO: 28339 - DNA, 50 bp, homo sapien
tctgaaggctctcgtgtgtatctgtwaaataattttgtcttttttttctt

SEQ ID NO: 28340 - DNA, 50 bp, homo sapien
taattttttggaatgttatgaaacartaaagtatctaagaaaaatctatg

SEQ ID NO: 28341 - DNA, 50 bp, homo sapien
tcagctccttttgaagatgattgtgracttaatattatgtgttctcatgt

SEQ ID NO: 28342 - DNA, 50 bp, homo sapien
ttagattagacacaaaaaagaactcsaatacatggaatgaaaaagataaa

SEQ ID NO: 28343 - DNA, 50 bp, homo sapien
tattatgtgttctcatgttttctcarctggacaaatgactagaatttctg

SEQ ID NO: 28344 - DNA, 50 bp, homo sapien
agcagcaaacattttgtgttttgacsaagtctctattttagaacattgta

SEQ ID NO: 28345 - DNA, 50 bp, homo sapien
ggtttaggttggcctttcatcgcaaygggaacatactctatttaaatgtt

SEQ ID NO: 28346 - DNA, 50 bp, homo sapien
agatctcagtatgtttttaattggayaaatcagaccttttatttattttc

SEQ ID NO: 28347 - DNA, 50 bp, homo sapien
gaaagcttacttttctgtatttagcraatgatgtcatccaaaacagtaaa

SEQ ID NO: 28348 - DNA, 50 bp, homo sapien
tgggtggggcatgaattggctctaaratgcaaaatttgaaagtgttgttt

SEQ ID NO: 28349 - DNA, 50 bp, homo sapien
tagttgctcctttcatccactcaatraagattttccctttagtcacatca

SEQ ID NO: 28350 - DNA, 50 bp, homo sapien
gatgtgtgatcatgcccttgaacttyaactcccggaatattgtttgggat

SEQ ID NO: 28351 - DNA, 50 bp, homo sapien
caatgaatatcaataattcacatccrattgacaagatagaaattcaaacc

SEQ ID NO: 28352 - DNA, 50 bp, homo sapien
tttaggaaactaggccaaatcttgarcttataatccttaaaggattttga

SEQ ID NO: 28353 - DNA, 50 bp, homo sapien
tgcaggagccaaaagaccatttgtcrgaaatgtggatgatctaaagtatt

SEQ ID NO: 28354 - DNA, 50 bp, homo sapien
ggccacaaaaacagaagtgtacttgmaatatgaccttcgttccttggagt

SEQ ID NO: 28355 - DNA, 50 bp, homo sapien
ggagaaagaaaagcattaatcttgaycaagggtaaaatccatgatgagaa

SEQ ID NO: 28356 - DNA, 50 bp, homo sapien
actcatattcctatctctggccttaygcctatccatccctttcctttaaa

SEQ ID NO: 28357 - DNA, 50 bp, homo sapien
aaccttcaactatcttctcatattcrcgactcctaaatttgtgtttccag

SEQ ID NO: 28358 - DNA, 50 bp, homo sapien
cttcccaagcgattcaacagcaaaayatttagatttcctcccacaaataa

SEQ ID NO: 28359 - DNA, 50 bp, homo sapien
ctgcagtcatctttagccagattagmaggatatattccacaatggtgtgg

SEQ ID NO: 28360 - DNA, 50 bp, homo sapien
ggaaagaggaggctgactataaaaamatcctagcaatattgcattctggg

SEQ ID NO: 28361 - DNA, 50 bp, homo sapien
acaatgtaaataatgtaagcctgtaygcaccacctcaaagctgtaacact

SEQ ID NO: 28362 - DNA, 50 bp, homo sapien
ctgttttaaaatgacacaattggaaragaacaaaaatgaaatgacagaac

SEQ ID NO: 28363 - DNA, 50 bp, homo sapien
tcaaggtaatatgaggtcatttcacygaagtaactctagaggcaacaaaa

SEQ ID NO: 28364 - DNA, 50 bp, homo sapien
taaaaaagctgccaagatttttggcragtggttggtctgaagtccttgca

SEQ ID NO: 28365 - DNA, 50 bp, homo sapien
tggaggaaagagaagcaattagaacygtaacaatggaagtaaccttacag

SEQ ID NO: 28366 - DNA, 50 bp, homo sapien
aacataaactgtctttatcagtatcratatccttacttgcaagttgggga

SEQ ID NO: 28367 - DNA, 50 bp, homo sapien
agtatctgtcaagtatctaaatgagragctacaaactagcatccagtagg

SEQ ID NO: 28368 - DNA, 50 bp, homo sapien
gtgctaaaaatacaaaaataacggargctcccatttctgaactcctcttt

SEQ ID NO: 28369 - DNA, 50 bp, homo sapien
tttatccattatagacaattgttcaragcacaacagtgtctatactgctt

SEQ ID NO: 28370 - DNA, 50 bp, homo sapien
atgaggtgtcttcctgagagttgcayattcactttgatggcaatcatttg

SEQ ID NO: 28371 - DNA, 50 bp, homo sapien
ggaggccattgacactaatacccgayagagtagttgtcttttcccatatg

SEQ ID NO: 28372 - DNA, 50 bp, homo sapien
gaaagaaaagctttgtacattatgascaatttataaaggcacaaaagttt

SEQ ID NO: 28373 - DNA, 50 bp, homo sapien
ggtgccttgcgtctggaggaggagaygaacgtgacctaaacagttgcact

SEQ ID NO: 28374 - DNA, 50 bp, homo sapien
gtactagggttcccttttctccacgycaatatttcaaatgttctgttaaa

SEQ ID NO: 28375 - DNA, 50 bp, homo sapien
aaggcaccctggaatcaggaaaccasaccagactttatagccccagtacc

SEQ ID NO: 28376 - DNA, 50 bp, homo sapien
caggcaattattccctttcattaggracagttctttttaagtttgggtgt

SEQ ID NO: 28377 - DNA, 50 bp, homo sapien
atatgggaagctctcctagggtcccratgagctgcatgtaggtcgctggg

SEQ ID NO: 28378 - DNA, 50 bp, homo sapien
caaattgccagtctggagaacagtargttaaataaatggttatttttttt

SEQ ID NO: 28379 - DNA, 50 bp, homo sapien
ccttctaataacatgacatagataarccgtactcactgggcagcaacaga

SEQ ID NO: 28380 - DNA, 50 bp, homo sapien
ttcagcagtaaatgaggagatttcaragagtcaaggacccattgcccagc

SEQ ID NO: 28381 - DNA, 50 bp, homo sapien
gacagtgccctgaactccagtcagamatttatttttgagaagtccctcag

SEQ ID NO: 28382 - DNA, 50 bp, homo sapien
aacctcatagctccatttcaaactaygttcagactctatgtaaacccaaa

SEQ ID NO: 28383 - DNA, 50 bp, homo sapien
tgataaaggagacgttagaaggaacrctttctcctctcctttcttcattg

SEQ ID NO: 28384 - DNA, 50 bp, homo sapien
tcattgtagatggctcgcccaagaaygatgacggacacaagactgaacag

SEQ ID NO: 28385 - DNA, 50 bp, homo sapien
acctccatctgctgctggcactgtayagaacctgacctctgggagctttt

SEQ ID NO: 28386 - DNA, 50 bp, homo sapien
acgagaatctattgcatagttgttayggggatcaaatgtgagcagttctt

SEQ ID NO: 28387 - DNA, 50 bp, homo sapien
ggggatacagaagagtggttacaaarcatcataacctgctcagacaggaa

SEQ ID NO: 28388 - DNA, 50 bp, homo sapien
agacagtgacaaggttggctggtccraaagccctcccggcaggagcaggg

SEQ ID NO: 28389 - DNA, 50 bp, homo sapien
ctgaccacaatgccagaagacaatamggaattactcagtacatgaagcac

SEQ ID NO: 28390 - DNA, 50 bp, homo sapien
gaggtgtagtttacatacgataaaaygcataatgaatttttacttatgta

SEQ ID NO: 28391 - DNA, 50 bp, homo sapien
cttccctctctcagggcagatatgamtaatccacgacagcacacctcccc

SEQ ID NO: 28392 - DNA, 50 bp, homo sapien
acttcagttttcaattatattaagcwgaattttaaaagaaaggggaaaag

SEQ ID NO: 28393 - DNA, 50 bp, homo sapien
gtgaatgccaacccttggatacctastaggcacttggaacctagcatgat

SEQ ID NO: 28394 - DNA, 50 bp, homo sapien
aagtgggagcacttatgtgtgtaaaygggagaagactaagtccctttgct

SEQ ID NO: 28395 - DNA, 50 bp, homo sapien
cagtctgtgctctgaattttacatayggttgcttcttatgttgggatttt

SEQ ID NO: 28396 - DNA, 50 bp, homo sapien
gctgatatttttcatggtgttaggasagccagtaatagaatcacagggga

SEQ ID NO: 28397 - DNA, 50 bp, homo sapien
ggagaggttatataacccggtattarcaccattcctagccaaatatagcc

SEQ ID NO: 28398 - DNA, 50 bp, homo sapien
agcggcaacagagtgaaagaaataartaacttcataacagagtgccacac

SEQ ID NO: 28399 - DNA, 50 bp, homo sapien
tctctcaagtctctattttggtcatyaccatatcaattccactattttgg

SEQ ID NO: 28400 - DNA, 50 bp, homo sapien
ttcatttcaaaattctctgacactayccgattcttttgtaaggctacgat

SEQ ID NO: 28401 - DNA, 50 bp, homo sapien
tgcttgctactgaggctactaaggcratcttatatctttagtagtctgct

SEQ ID NO: 28402 - DNA, 50 bp, homo sapien
ctctacagaggagacatccaaggcamaggagtattctaaagaacccaagc

SEQ ID NO: 28403 - DNA, 50 bp, homo sapien
atcacaatctccaggttccacttctraatgtattccactccttttatcca

SEQ ID NO: 28404 - DNA, 50 bp, homo sapien
gaggggacaaacgatttagacaaagraaatgacaagtgcaaaacgcaaac

SEQ ID NO: 28405 - DNA, 50 bp, homo sapien
tcctaatataccacaagtggatgacmagcagctctaatgcgaccaggtac

SEQ ID NO: 28406 - DNA, 50 bp, homo sapien
ttccaacttttcagcgaaaggatgayggatgacgtttagcgcagcaggcg

SEQ ID NO: 28407 - DNA, 50 bp, homo sapien
ttggggtgtttcttcttttctattaygacacaggtatttgtgatggagcc

SEQ ID NO: 28408 - DNA, 50 bp, homo sapien
ggaacctccaattagattaaccctayggtttcctaagcggcagccagctg

SEQ ID NO: 28409 - DNA, 50 bp, homo sapien
aacaggggtaacacggtaaaacatcygagatgaaaagagaacaacttgtg

SEQ ID NO: 28410 - DNA, 50 bp, homo sapien
cacagcatatgttcatgaatgtctaragtgtagcatgaaggttggccagc

SEQ ID NO: 28411 - DNA, 50 bp, homo sapien
acaaaatgtgactggaaagaagaacragaatcagttaagtaaaaggtagg

SEQ ID NO: 28412 - DNA, 50 bp, homo sapien
tctcaggaagtgtttgttgaatgcaygagtggacaaaagggaggacaatg

SEQ ID NO: 28413 - DNA, 50 bp, homo sapien
aactccatttttcctcttaaaccatsaaggagtctaaacgtcagctaaat

SEQ ID NO: 28414 - DNA, 50 bp, homo sapien
ggtttggggcaaaagagaaagatacrgccaatagtaattggattacagtt

SEQ ID NO: 28415 - DNA, 50 bp, homo sapien
tctgccacctttctctataaatatcrctatgttacacattagatttgaga

SEQ ID NO: 28416 - DNA, 50 bp, homo sapien
atctgtcaggttaggctagattacasctcaataacaaattcccaaatctc

SEQ ID NO: 28417 - DNA, 50 bp, homo sapien
agctcagagtccaatgggagaacaaraacacgctcaagacagcatgataa

SEQ ID NO: 28418 - DNA, 50 bp, homo sapien
gagatgcattaggcactgactggtasgctatgcagagatcaggtttagcc

SEQ ID NO: 28419 - DNA, 50 bp, homo sapien
catgcaggcaactgtgcgaggtctasaaagaaaataacttccaataccaa

SEQ ID NO: 28420 - DNA, 50 bp, homo sapien
tgtgaggctggtagtccactaagaamctaagccctatttcagtagatagc

SEQ ID NO: 28421 - DNA, 50 bp, homo sapien
gtgatgatttgaatgggatttgaagkacttgtgatcatctcttaatatgt

SEQ ID NO: 28422 - DNA, 50 bp, homo sapien
gtgcagacacctaattggcatatcayataacaccccagaactcctttgct

SEQ ID NO: 28423 - DNA, 50 bp, homo sapien
tattgcccctgaatgtttctgcaaasgttcttcaagcacaggtgaaatgc

SEQ ID NO: 28424 - DNA, 50 bp, homo sapien
taatgcatataatctgcgatcttctsacccaggatgtgcttctgcattga

SEQ ID NO: 28425 - DNA, 50 bp, homo sapien
aaatatttgctgattgaataagcaastcttctgtattggattacacacat

SEQ ID NO: 28426 - DNA, 50 bp, homo sapien
tagagcacttaccactttcctatgaygatttggaaatgtcctgtcatcct

SEQ ID NO: 28427 - DNA, 50 bp, homo sapien
acctgctgggagtaacccaggccacraaagacttcttacctccttgctca

SEQ ID NO: 28428 - DNA, 50 bp, homo sapien
agggctttgacagtccctgagttatragggccattccaaggctgtgatgg

SEQ ID NO: 28429 - DNA, 50 bp, homo sapien
ttacaaaaattccaaattagctcaaratctcagggtaggacacaggcccc

SEQ ID NO: 28430 - DNA, 50 bp, homo sapien
atactctaaaaagtaaaaaatgtcarataacgcaatgcaaaacagaacag

SEQ ID NO: 28431 - DNA, 50 bp, homo sapien
gcttctggggccctggtgcctaaaawtcccagtgagaagaccctggctcc

SEQ ID NO: 28432 - DNA, 50 bp, homo sapien
tcattcatatgtgcatattttgtcgkcccaatgagagtgttagcagaaag

SEQ ID NO: 28433 - DNA, 50 bp, homo sapien
agagacaggcagcaatactttgtgasaattttactaacagaaaaataagg

SEQ ID NO: 28434 - DNA, 50 bp, homo sapien
tgccaggttgttcattttctctgtcragttataggtttgtttgaaaaaaa

SEQ ID NO: 28435 - DNA, 50 bp, homo sapien
cttcagattttcccataaaaggaacmggctcatgtatgttttgtatcatc

SEQ ID NO: 28436 - DNA, 50 bp, homo sapien
tcatggtcatcatctatccacatacrggctttgttgggatatagcagaca

SEQ ID NO: 28437 - DNA, 50 bp, homo sapien
cttcctttcacaagcagctgaataaratacatactcccaattaaatgtca

SEQ ID NO: 28438 - DNA, 50 bp, homo sapien
atacataaacatatatggcagagaamgtcaatattttcaaatatgaaaaa

SEQ ID NO: 28439 - DNA, 50 bp, homo sapien
gctggagatctttctatgtgaaatcyaaccttgtcgtgcatcagagaact

SEQ ID NO: 28440 - DNA, 50 bp, homo sapien
atcatctcaagcttgaatgaagaacrgtgctcttagagaagtgaacataa

SEQ ID NO: 28441 - DNA, 50 bp, homo sapien
aactacactagaacttgtcttgaackgtccctagaaatgggagtgtctgg

SEQ ID NO: 28442 - DNA, 50 bp, homo sapien
cacagccacctccgcctggtttgccsgaactccaggatgtgggatctggc

SEQ ID NO: 28443 - DNA, 50 bp, homo sapien
ctctgtggttctagtttgacctatcragacccctaaactgctgaagttac

SEQ ID NO: 28444 - DNA, 50 bp, homo sapien
tagcaacatcccacaacagaaggttsaaacagcaagaaaagaagcttaaa

SEQ ID NO: 28445 - DNA, 50 bp, homo sapien
ctcacataacaatcaaataaaacacrgtcaattgtgacagactgggcacc

SEQ ID NO: 28446 - DNA, 50 bp, homo sapien
accttcctgagtccctgcctgaaagrataatatcatggccccaatggagt

SEQ ID NO: 28447 - DNA, 50 bp, homo sapien
acccaccatagacatacagaaaaccraggtggatcaggacttggaagaaa

SEQ ID NO: 28448 - DNA, 50 bp, homo sapien
ggctgaaagtcaatgctgttatcacwgtaactacactagaacttgtcttg

SEQ ID NO: 28449 - DNA, 50 bp, homo sapien
agcttttacctctgggtaaccttgamgggagagccaggacttacaaagcc

SEQ ID NO: 28450 - DNA, 50 bp, homo sapien
gctaagtggatgattgcaaaatattyaataattcctgtaagatattcaat

SEQ ID NO: 28451 - DNA, 50 bp, homo sapien
caggatcacttcatacatctgttaayatttgtgaataaatagcctttggc

SEQ ID NO: 28452 - DNA, 50 bp, homo sapien
taaatagtagatgtcattactactcycctcccatttatgtatgaggaaaa

SEQ ID NO: 28453 - DNA, 50 bp, homo sapien
cgtcctatgctggttattataggaamgacacagactcttcttacagaact

SEQ ID NO: 28454 - DNA, 50 bp, homo sapien
attcaaatctttacgtcacattccayattcccagggaaggactctgattg

SEQ ID NO: 28455 - DNA, 50 bp, homo sapien
acaagattatctaactaataattaawcaaaaatgtcaactaatagactgg

SEQ ID NO: 28456 - DNA, 50 bp, homo sapien
agaaggcagactggctaggatctcamcacctgaggaatgatatgatggtg

SEQ ID NO: 28457 - DNA, 50 bp, homo sapien
cacagatattttctaactgatcgtcrctggcatattctcaacatttattc

SEQ ID NO: 28458 - DNA, 50 bp, homo sapien
acagaactgtatactagataggatarattttactgcaggtaaataatgcc

SEQ ID NO: 28459 - DNA, 50 bp, homo sapien
ctaacataccctaagaacaaagtgartaggttctatccctgtcctacgct

SEQ ID NO: 28460 - DNA, 50 bp, homo sapien
aagatttgggttgaatttgaaattcygaacttgtacattatgaccatgtt

SEQ ID NO: 28461 - DNA, 50 bp, homo sapien
gagaacagagtgattattattcaacygagttagggctaagggtctttgga

SEQ ID NO: 28462 - DNA, 50 bp, homo sapien
agcatttcaatgtcctatgcacatcsagagtgagtaagggtagagacggc

SEQ ID NO: 28463 - DNA, 50 bp, homo sapien
gtgaggattaaatgagatgtaccaaytaaaggcccaggaacacaaagaat

SEQ ID NO: 28464 - DNA, 50 bp, homo sapien
attcattcaacaagaagaacttggaratttagatgtctgccataactgat

SEQ ID NO: 28465 - DNA, 50 bp, homo sapien
tccacctttcttgtctctacctgccygcagaaagaagtggccttttgcct

SEQ ID NO: 28466 - DNA, 50 bp, homo sapien
tgaaaagcttccaaggctctgcaaayttgttcagtaaaggactcaatggt

SEQ ID NO: 28467 - DNA, 50 bp, homo sapien
ctgaatggtgccgcggtctctaaggwcacgtgaatgattcctatttacta

SEQ ID NO: 28468 - DNA, 50 bp, homo sapien
aagcttaccattgtataaaataatayctggtgtctatagtccttcatctg

SEQ ID NO: 28469 - DNA, 50 bp, homo sapien
gcaagcgatttagcgacccgtagaaktgaaaacgtgcatcatctacaacc

SEQ ID NO: 28470 - DNA, 50 bp, homo sapien
tcaagttaatgtggaaagggtgcccrcatcattaaaaagaagtctgccct

SEQ ID NO: 28471 - DNA, 50 bp, homo sapien
tctatacatttctgctgtccagttaygcaatatgtgagtgtcccgataag

SEQ ID NO: 28472 - DNA, 50 bp, homo sapien
gcttccatgaagtatgtaacctcgcygaagacatggaactactcagagtc

SEQ ID NO: 28473 - DNA, 50 bp, homo sapien
tcatccttcatttctcggtgtaaacrgctcttactctgaaaggcagcccc

SEQ ID NO: 28474 - DNA, 50 bp, homo sapien
caatgtaagtattattacaaggtccratttactgtccagaaagaagcaat

SEQ ID NO: 28475 - DNA, 50 bp, homo sapien
ccaaactagacacaggccaatatggwaatttaatataagctagaagaggt

SEQ ID NO: 28476 - DNA, 50 bp, homo sapien
gggtcacttttaatagcactatacargaaatgctttcacattaaaaggtt

SEQ ID NO: 28477 - DNA, 50 bp, homo sapien
ttgcaggaaatagaaatgtccaaggrttgccatttattcaacagctggaa

SEQ ID NO: 28478 - DNA, 50 bp, homo sapien
ctccatgatgacttaaaatcctaccyagctcgatactgtttcagggcctt

SEQ ID NO: 28479 - DNA, 50 bp, homo sapien
gaggagctggtgaggacagaatgaaratagtctttggatgccagagtatc

SEQ ID NO: 28480 - DNA, 50 bp, homo sapien
cccagagaaagtcagcagcatctaamgccaaaacacgggatgttttctgg

SEQ ID NO: 28481 - DNA, 50 bp, homo sapien
aagaacttagaactaccactcgactyagcaatcccattaatacaaatcat

SEQ ID NO: 28482 - DNA, 50 bp, homo sapien
gaaggatgctattgaaatgtaagaayagatcataaataactggttggtca

SEQ ID NO: 28483 - DNA, 50 bp, homo sapien
ttaaatcattcaatccttattgccaygctaggaggcaggttactcttcct

SEQ ID NO: 28484 - DNA, 50 bp, homo sapien
agaactgatgagcacatgggtgtaasgaaactacccagggctgagagaga

SEQ ID NO: 28485 - DNA, 50 bp, homo sapien
agatcttattctaggatgaaaataaygaataggaaagagctgtttattct

SEQ ID NO: 28486 - DNA, 50 bp, homo sapien
tccccctttttttttaatttttacartaatgaagatcttattctaggatg

SEQ ID NO: 28487 - DNA, 50 bp, homo sapien
agatgtgggctcccagtacgataacygattattttatggataactttgag

SEQ ID NO: 28488 - DNA, 50 bp, homo sapien
ccacacgcccagtctgcctggacacraggttctcatggatggggcgcgag

SEQ ID NO: 28489 - DNA, 50 bp, homo sapien
aacctaacttatgccaaaattgagtwaaaacattttagccaagcccccaa

SEQ ID NO: 28490 - DNA, 50 bp, homo sapien
gaatctctaaggatttttataagacraagtaggaagtatgaatgcccact

SEQ ID NO: 28491 - DNA, 50 bp, homo sapien
tagcaccatgcttagctgactgtaaygaagcgtagcaggtatggtggtaa

SEQ ID NO: 28492 - DNA, 50 bp, homo sapien
caattttgtgcttgcaaaattcacasagtagcggaactggaagcctccct

SEQ ID NO: 28493 - DNA, 50 bp, homo sapien
actcatgtactgtcctcacataatcracagcctgggaatgagatgtagag

SEQ ID NO: 28494 - DNA, 50 bp, homo sapien
ttaaccagtgtccatctttcaagackcagttgagctgttacatcatccag

SEQ ID NO: 28495 - DNA, 50 bp, homo sapien
atgatatgaggaaatgatagtaatawgtatgactgaattcttgtcatgac

SEQ ID NO: 28496 - DNA, 50 bp, homo sapien
gcactaagaacttgtttctggagctraagatttttcatggctgtatctat

SEQ ID NO: 28497 - DNA, 50 bp, homo sapien
caaaagattatggagacaaagcagamtaacatgtaaactacacgcaaccc

SEQ ID NO: 28498 - DNA, 50 bp, homo sapien
agtgtcttcctaatgtgtcacaaaarttgaatcctgtaactagacattaa

SEQ ID NO: 28499 - DNA, 50 bp, homo sapien
tccaggcagacagaagaagtaacaartgtttactacacccagaggcttgt

SEQ ID NO: 28500 - DNA, 50 bp, homo sapien
agtgaggacaggacaataatttagasatttgcaaaacaaggttcttttct

SEQ ID NO: 28501 - DNA, 50 bp, homo sapien
catgccacatcttctcaatctaagargtctgagaaaccatcactgcctta

SEQ ID NO: 28502 - DNA, 50 bp, homo sapien
agcctcagattagaatatggacccgragaaacttgtaagcacagtacaat

SEQ ID NO: 28503 - DNA, 50 bp, homo sapien
caactctcgagaatggaaattattayctgtattgtccaaaggaagaaaat

SEQ ID NO: 28504 - DNA, 50 bp, homo sapien
gaagtctcctaccagtaagttagcaygtattggagaatctaagatctttc

SEQ ID NO: 28505 - DNA, 50 bp, homo sapien
gattcttctttctcacctacatccartatgttaacaagtcttttagttct

SEQ ID NO: 28506 - DNA, 50 bp, homo sapien
atgtgcatcattttacagtaggaaamggattctattatcatctacatttt

SEQ ID NO: 28507 - DNA, 50 bp, homo sapien
tggtagatggtgcagctaatgatgcygaccagtgcttatgctctaagccc

SEQ ID NO: 28508 - DNA, 50 bp, homo sapien
tcatggaagctggaactttgcttaaygtgaataagggtgactcactgctt

SEQ ID NO: 28509 - DNA, 50 bp, homo sapien
gaacagtgagtctggtattaaacaayatgattgcttgatgagttttatca

SEQ ID NO: 28510 - DNA, 50 bp, homo sapien
ttggaatataatgtggtttttcataygtagcgaggtcttaaatttgatga

SEQ ID NO: 28511 - DNA, 50 bp, homo sapien
attccactggatagaatcttccagartaacatgcaggaaagaaaattatt

SEQ ID NO: 28512 - DNA, 50 bp, homo sapien
aaaactaatattagccttattgtacrgatggagaaactgataccaagagg

SEQ ID NO: 28513 - DNA, 50 bp, homo sapien
gaaagctcttatctactaagatgcaytaattcaaaatgattcatcttctc

SEQ ID NO: 28514 - DNA, 50 bp, homo sapien
agcccctaggtgttaaagtaccaaargctccaatttactaagcacctact

SEQ ID NO: 28515 - DNA, 50 bp, homo sapien
ggagggagatgaggccaacttcaacratcccatgtcacaggcaggtcact

SEQ ID NO: 28516 - DNA, 50 bp, homo sapien
gccccttggtcttaggacaatggaartatctggatttaaacaattgagtg

SEQ ID NO: 28517 - DNA, 50 bp, homo sapien
ctggattttcttccatttggggaaastgtgatgtaataatccttcatttt

SEQ ID NO: 28518 - DNA, 50 bp, homo sapien
tagattctgacagaattgccctgtayatccatgtgtcaacatgaaagggg

SEQ ID NO: 28519 - DNA, 50 bp, homo sapien
agattatcagtgttcacaacaaatgyagcaaatatgaaataattacctca

SEQ ID NO: 28520 - DNA, 50 bp, homo sapien
atcatggaccataacttttcagttaycagatcaactaaagaaacatttgt

SEQ ID NO: 28521 - DNA, 50 bp, homo sapien
aaaaatgcaggcacataggtcagcayattaggcttaacaacaaatgtttc

SEQ ID NO: 28522 - DNA, 50 bp, homo sapien
gctccatgggacctagcagaaagtarctgccaatgggttgagagtggaac

SEQ ID NO: 28523 - DNA, 50 bp, homo sapien
ctgagtcccccaccagtcgagaaackgcttcctccacacaaagaagactc

SEQ ID NO: 28524 - DNA, 50 bp, homo sapien
ccaggatgagtggtctagcctctgaygacctcttggcttcaaaaactaac

SEQ ID NO: 28525 - DNA, 50 bp, homo sapien
aaatttattgtttttaaaaaagtagwagtgcaataacaattatcattgaa

SEQ ID NO: 28526 - DNA, 50 bp, homo sapien
tacttttttaaaaacaataaatttgkaagaggaatatctcttaaaattcc

SEQ ID NO: 28527 - DNA, 50 bp, homo sapien
tcaatatctctaagataccattcaarcattgagaagggagctttaattgc

SEQ ID NO: 28528 - DNA, 50 bp, homo sapien
aataaaacctattaagtccaaactartaatacaatataattaaagtcctg

SEQ ID NO: 28529 - DNA, 50 bp, homo sapien
tctttgtgagtacagcgatgtttaayggagggcccataaaagatattgat

SEQ ID NO: 28530 - DNA, 50 bp, homo sapien
aacaacataaatataaagacaaataraactgatcagttatataacatcag

SEQ ID NO: 28531 - DNA, 50 bp, homo sapien
atggaaggaaatatgccagaatattraagtggttaactgtgtagtaggaa

SEQ ID NO: 28532 - DNA, 50 bp, homo sapien
aaagctttcttatcaggcaacgtcayatcaatgtatggttttactgaaca

SEQ ID NO: 28533 - DNA, 50 bp, homo sapien
acctatagtattgagatatgtaatgmaatggatgttattttaagccattg

SEQ ID NO: 28534 - DNA, 50 bp, homo sapien
aatcaataaatctcagctgttattayatcattagtatcaggcatccagct

SEQ ID NO: 28535 - DNA, 50 bp, homo sapien
ggccaccctgcaccatgatattaacmctgggactctcgaacctttgtcct

SEQ ID NO: 28536 - DNA, 50 bp, homo sapien
ttggaaactttgggttagataaggtmaaataaatatatgtactacatgat

SEQ ID NO: 28537 - DNA, 50 bp, homo sapien
aagtcctttgcaaaataaatgagaargacttaaggcagaagaatgactca

SEQ ID NO: 28538 - DNA, 50 bp, homo sapien
cggggtcatttctggaatgtctcccraaagtgcaaggaaggcattgcttg

SEQ ID NO: 28539 - DNA, 50 bp, homo sapien
gccagagcctttattattgccatccrcaggtgatggatgaagaggttgac

SEQ ID NO: 28540 - DNA, 50 bp, homo sapien
gctgaattggtcaggatgccaaatgratttaatgtagtgttgaatggatc

SEQ ID NO: 28541 - DNA, 50 bp, homo sapien
tctgagtaatcatcatcatactgcaytctctagatgttgctataacttca

SEQ ID NO: 28542 - DNA, 50 bp, homo sapien
aaaagtagccatgtaatgtcatagcraattcatttgagcacagaagtaat

SEQ ID NO: 28543 - DNA, 50 bp, homo sapien
aacagaaagctcaacatggtaaacayagtatagggaatttattggctcat

SEQ ID NO: 28544 - DNA, 50 bp, homo sapien
ggttacacacaaacaggagtgaaacraatcatcatttgcaccataaacca

SEQ ID NO: 28545 - DNA, 50 bp, homo sapien
ttgtttgaggcgtagtagaatctatyagcttgagaaattggtctggaaat

SEQ ID NO: 28546 - DNA, 50 bp, homo sapien
caggaagcactggatgaacgttaacygggccattggatacaagcttttaa

SEQ ID NO: 28547 - DNA, 50 bp, homo sapien
tattaatatctccattcttattaccratatccatatagatgaagttcagt

SEQ ID NO: 28548 - DNA, 50 bp, homo sapien
tatgattgtcactttaggcagccggyaatcctcctaatctcatggctaac

SEQ ID NO: 28549 - DNA, 50 bp, homo sapien
tcaatttccgtcagatagaccctcaratgaatgaatagaattttcatctc

SEQ ID NO: 28550 - DNA, 50 bp, homo sapien
gccatcatgcaaagatgattgtaacygtcttcttagaaagcctgcttgtc

SEQ ID NO: 28551 - DNA, 50 bp, homo sapien
aaggaggggaattcaaaccataacargaatgagatatggagccaaaataa

SEQ ID NO: 28552 - DNA, 50 bp, homo sapien
tttttacaactcccttattatgggarcaaaagcaatctgagctcctttga

SEQ ID NO: 28553 - DNA, 50 bp, homo sapien
aagagcagaagatggaattaaatgasagaaatatatgtaactttctcagc

SEQ ID NO: 28554 - DNA, 50 bp, homo sapien
aaaattgagccagaaatctaagtaaytgagatgattgtaaataatacaca

SEQ ID NO: 28555 - DNA, 50 bp, homo sapien
ggacaagtgtaaccacccagggtcgkattgcatgtgactctgaagctgat

SEQ ID NO: 28556 - DNA, 50 bp, homo sapien
tataaaatcaaatcctcccaatctaygaagtttgagaatcttggattaca

SEQ ID NO: 28557 - DNA, 50 bp, homo sapien
ttagctcataggcactactccataartattagcttttcgtatcattaaga

SEQ ID NO: 28558 - DNA, 50 bp, homo sapien
tctaatgttcctcttttttcaccagragtagagaatgccttaggtagcca

SEQ ID NO: 28559 - DNA, 50 bp, homo sapien
gaaattctttttaatacttgaaccayatagtcctaggtattacaaacaaa

SEQ ID NO: 28560 - DNA, 50 bp, homo sapien
attttcaagttttaatctccattgasagaaccattaaagtgtctgtcccc

SEQ ID NO: 28561 - DNA, 50 bp, homo sapien
tgctgagtcagcgctgcctagactcrgaaaccctcattgtccgtccattc

SEQ ID NO: 28562 - DNA, 50 bp, homo sapien
ggctgatggagacagcgactgtcacraaggcttaatgggcatcatagtca

SEQ ID NO: 28563 - DNA, 50 bp, homo sapien
tgatctctatgacaacccatcctgayaccggtttgtaagtgtgaaagctt

SEQ ID NO: 28564 - DNA, 50 bp, homo sapien
gagcctccttgaaggaattcagggamcttataccagatatatttacacaa

SEQ ID NO: 28565 - DNA, 50 bp, homo sapien
caaattgtcctcttatttatagtacsatggctttaatttgtattgtccag

SEQ ID NO: 28566 - DNA, 50 bp, homo sapien
attacagtagcagtgactaaaataaygaagtaggaaacttgctccaaacc

SEQ ID NO: 28567 - DNA, 50 bp, homo sapien
aaccacagcctttgaaactcatgaawtgggtgagcccattggagcaaatc

SEQ ID NO: 28568 - DNA, 50 bp, homo sapien
ctggtaaatacgttcttcttccttargtttggctagtgctatctctaaga

SEQ ID NO: 28569 - DNA, 50 bp, homo sapien
tgaggtatatattaaaagaaaattaracatacttgctttatacatcttga

SEQ ID NO: 28570 - DNA, 50 bp, homo sapien
tttatagagaggagttcatgattacrattagaacctgaattaccaaccct

SEQ ID NO: 28571 - DNA, 50 bp, homo sapien
atggaagatgcgcttgtaaattagakagctcaggagaacatggcatgaga

SEQ ID NO: 28572 - DNA, 50 bp, homo sapien
cattacagatgaggctctagagtacragggtggcctcacaaacttgtagg

SEQ ID NO: 28573 - DNA, 50 bp, homo sapien
agattgatcaaaatcaagtagataayaagtgttagggttggaatcaaatc

SEQ ID NO: 28574 - DNA, 50 bp, homo sapien
ggatttttattgcactgtttggagayacatcgtgggaacaggagagtcca

SEQ ID NO: 28575 - DNA, 50 bp, homo sapien
atttgtttccatgttgacttaattcrctaacaactgtctcgtgttagtct

SEQ ID NO: 28576 - DNA, 50 bp, homo sapien
tggctactatttaaaacataggaaayaagtgatggtgaggacgtggagaa

SEQ ID NO: 28577 - DNA, 50 bp, homo sapien
agccgctgcagtttgtttctaaggaygatcagtaacgaatggggaatgct

SEQ ID NO: 28578 - DNA, 50 bp, homo sapien
accgaatattgcttagggatgcataygtatttgacaaaactataaaagaa

SEQ ID NO: 28579 - DNA, 50 bp, homo sapien
attgctccccatctggcttatgaaastgacagagaataaagcttctctct

SEQ ID NO: 28580 - DNA, 50 bp, homo sapien
tttctggtgtacctggcacttttagraaccatgaagtagggttatttaat

SEQ ID NO: 28581 - DNA, 50 bp, homo sapien
cgctaagacttatcaccatggctccraaatagctcttgatccactggaac

SEQ ID NO: 28582 - DNA, 50 bp, homo sapien
agtaagtagctgttgaataaatgaaygtacagcttcaaaatcccaaaatc

SEQ ID NO: 28583 - DNA, 50 bp, homo sapien
cttaacaatgataaataccataacaycagtttgtgccttgctttttaatt

SEQ ID NO: 28584 - DNA, 50 bp, homo sapien
agttgtttaattttcccgagaaaaaytgtagctcagcatgttaagatagt

SEQ ID NO: 28585 - DNA, 50 bp, homo sapien
atatgtaaaaacgacccagaggttasagacgctacacctataagtactgt

SEQ ID NO: 28586 - DNA, 50 bp, homo sapien
aaagaatatgaaacttcaaaaaaaargactgcagggtaagagggatttca

SEQ ID NO: 28587 - DNA, 50 bp, homo sapien
taatgatttccatggagattacttcyaacgaggctcttgtattttaggca

SEQ ID NO: 28588 - DNA, 50 bp, homo sapien
tactcgaatagtggtcttagtcaaartgaggccatattaacgtgtgggtc

SEQ ID NO: 28589 - DNA, 50 bp, homo sapien
gaagctacaaagctatgaacgtaaaygtataataataggtgctaacgacc

SEQ ID NO: 28590 - DNA, 50 bp, homo sapien
ctgcttctgacaacctgtgattagaygtggaaacaaagaaatgacttaaa

SEQ ID NO: 28591 - DNA, 50 bp, homo sapien
taggaaagatcctagatatttttcayactgggagagaagtgatgttactg

SEQ ID NO: 28592 - DNA, 50 bp, homo sapien
cttaattgtattactttatcaccaayatagaacagagagatccatagtgg

SEQ ID NO: 28593 - DNA, 50 bp, homo sapien
tgccaggcctgtgctagatgctctcrcctatataatctcatttacttctc

SEQ ID NO: 28594 - DNA, 50 bp, homo sapien
agctagattgaagggaaatgcagaartatagtaaaggcaatgatttaaaa

SEQ ID NO: 28595 - DNA, 50 bp, homo sapien
cccttggttgcactcatcaggctaaytgatcccatatttaacctcaagga

SEQ ID NO: 28596 - DNA, 50 bp, homo sapien
ggttacgaccatgcttcattgatccwccacgttctgccttagttaattct

SEQ ID NO: 28597 - DNA, 50 bp, homo sapien
ctgcacagacactcatttatttataragcacctcttctccaatacaatcg

SEQ ID NO: 28598 - DNA, 50 bp, homo sapien
agcaatattgttccagggcatttaarctgtggtgctcactataagttttc

SEQ ID NO: 28599 - DNA, 50 bp, homo sapien
ttctctcttttctcaaagtgtttagwccatagtgagttactttgcttcca

SEQ ID NO: 28600 - DNA, 50 bp, homo sapien
tcgagttttataccatttttgcttgyaagtataatctcctcaacctattt

SEQ ID NO: 28601 - DNA, 50 bp, homo sapien
gcagaggcctgtgcatgcgagctcayctcaatccagactgctcagtggga

SEQ ID NO: 28602 - DNA, 50 bp, homo sapien
atttattttaaagattactgatacckatagaccaggctggaaatcaacag

SEQ ID NO: 28603 - DNA, 50 bp, homo sapien
taaaatattatagaaaagcacaacartgtgaggaggggcgatgagttctg

SEQ ID NO: 28604 - DNA, 50 bp, homo sapien
aaactggcagcaaatctgtggtgaayggataaagaggaagggtgatgcca

SEQ ID NO: 28605 - DNA, 50 bp, homo sapien
ctctctcatttcccaggatgtaatamctcagccgctgctagatcagtatg

SEQ ID NO: 28606 - DNA, 50 bp, homo sapien
tgtctggcatcagggaacctaacaamactctgtgaaaacatggctcatgt

SEQ ID NO: 28607 - DNA, 50 bp, homo sapien
atgagaagaagcagctggaggtcagraactatggtcagagaggagttcag

SEQ ID NO: 28608 - DNA, 50 bp, homo sapien
cctcactgtggtcagatgtgtagatsagttaattctatgtctttttataa

SEQ ID NO: 28609 - DNA, 50 bp, homo sapien
tggggttttatatcccacaaatatamcgaagaaggagtttgaagagagtg

SEQ ID NO: 28610 - DNA, 50 bp, homo sapien
ctttaaggtttgttagctcttctacwaaactggaataataatgaataata

SEQ ID NO: 28611 - DNA, 50 bp, homo sapien
gattaattagtattgtacaagaacargcagcatgctcattaaaaccttgt

SEQ ID NO: 28612 - DNA, 50 bp, homo sapien
tgagactctgccctctccttagagcratacacagggatggttaataagaa

SEQ ID NO: 28613 - DNA, 50 bp, homo sapien
gtcactttgagtggtcatgtttttaygtgtttgactctacatctctccaa

SEQ ID NO: 28614 - DNA, 50 bp, homo sapien
tgtttccacagtaaaagcatctgcaygtgaaaaaagccctgtgagaacaa

SEQ ID NO: 28615 - DNA, 50 bp, homo sapien
tacatctctccaatacacttggtcargtatttctaaaacactcttccagt

SEQ ID NO: 28616 - DNA, 50 bp, homo sapien
tgcaattgaacttgggtaattctacygcaatctgcagattcaaggcactg

SEQ ID NO: 28617 - DNA, 50 bp, homo sapien
accatgaacgtgaagtgaaattggcsgagaacctttgaccagcatgccct

SEQ ID NO: 28618 - DNA, 50 bp, homo sapien
aaaacttatttcagtgtttatgcagkagtgccagtaagtatacagtgtga

SEQ ID NO: 28619 - DNA, 50 bp, homo sapien
tggcccctgtcttttgcagagaggaygttgagagcacgggggagaatcgg

SEQ ID NO: 28620 - DNA, 50 bp, homo sapien
ctattacatgctctccttgtagatastacctctctgtcatacccttatca

SEQ ID NO: 28621 - DNA, 50 bp, homo sapien
acattaataaactggctaaggaaagmctactcaacacgtgtgaaaagcgg

SEQ ID NO: 28622 - DNA, 50 bp, homo sapien
ggttgatctgaggtcctgcttagacraacccatgtaaacatacattacaa

SEQ ID NO: 28623 - DNA, 50 bp, homo sapien
ggggccaggttgagaggagctgtgcraatgaatatgaagcccacttcctt

SEQ ID NO: 28624 - DNA, 50 bp, homo sapien
aagtatgtcattatatgaagctaaawtaacattaacattcatttgagcat

SEQ ID NO: 28625 - DNA, 50 bp, homo sapien
acgtaaagggcctgggataacttacraagcattttcaaagccacggaagg

SEQ ID NO: 28626 - DNA, 50 bp, homo sapien
taatgaaaagggggcttatagacackgactccaattattttcaaatgata

SEQ ID NO: 28627 - DNA, 50 bp, homo sapien
tcagtattttccaaactgattttaawtgtcactattgtcacataatacat

SEQ ID NO: 28628 - DNA, 50 bp, homo sapien
aaggtagtatgtgctaggcacttcaygcaatactatacaaataatacact

SEQ ID NO: 28629 - DNA, 50 bp, homo sapien
gttagcccctgccctgggttgtaaargtgcagagatgagtcgggcaccgc

SEQ ID NO: 28630 - DNA, 50 bp, homo sapien
tgaacaaatgagggaatgaatacggkaaacagtttttcacaatggcaaga

SEQ ID NO: 28631 - DNA, 50 bp, homo sapien
aaaaccactgttgtaatgcaaatctkaatcccttctttcataatttttgc

SEQ ID NO: 28632 - DNA, 50 bp, homo sapien
aaactcatgttttgcagacttacaaygtcgccttcattctacctagggac

SEQ ID NO: 28633 - DNA, 50 bp, homo sapien
ggatctgatggtgtctatcttaaaayattcaggcttgttgtcactaaaat

SEQ ID NO: 28634 - DNA, 50 bp, homo sapien
cacaaattatcatgttgccagaatcrgaattaagtgattctccttcattt

SEQ ID NO: 28635 - DNA, 50 bp, homo sapien
tttgtgaagaaggaacatgagaataktagatttgcaagctctatcttggg

SEQ ID NO: 28636 - DNA, 50 bp, homo sapien
atctacttgatttcctaaaactagartcctggttgctaaaggttccataa

SEQ ID NO: 28637 - DNA, 50 bp, homo sapien
gcagtatttggacatgtgatgatgcraaggtagaagaaaccgaaggtagt

SEQ ID NO: 28638 - DNA, 50 bp, homo sapien
agaggagaatattttggggaaaagcraacataagctctaccagtgactac

SEQ ID NO: 28639 - DNA, 50 bp, homo sapien
caactgccagacttgagtgaggaagmcttaaggtgaatctagccccggtc

SEQ ID NO: 28640 - DNA, 50 bp, homo sapien
aaggtttttgaggagcacaatgtcawtatcaagggagtaaggggaaacag

SEQ ID NO: 28641 - DNA, 50 bp, homo sapien
gtgaaatgtagataataatcgttcayacccatggggttatactggaatta

SEQ ID NO: 28642 - DNA, 50 bp, homo sapien
agaatccacttcccctactcaaatargaaggaagctcttttaatcagatc

SEQ ID NO: 28643 - DNA, 50 bp, homo sapien
attataagcacattgtcagaacaccyacgccaaagtccaggaatgactgt

SEQ ID NO: 28644 - DNA, 50 bp, homo sapien
caagatttattcagggaaagagttamaagactagttacgagaatatgacg

SEQ ID NO: 28645 - DNA, 50 bp, homo sapien
tggggaatggcctttacccagctcarggttcagagatcggggacagaagc

SEQ ID NO: 28646 - DNA, 50 bp, homo sapien
agcgagcccaagccacttcagtcaarttcctgccagtaagtggggtgccg

SEQ ID NO: 28647 - DNA, 50 bp, homo sapien
ccatccctgttcctttacactgaatkatgagttggacatgcccatggtaa

SEQ ID NO: 28648 - DNA, 50 bp, homo sapien
ctccccttgtcactacgcaattgccrctctggcttccctccgatgtctag

SEQ ID NO: 28649 - DNA, 50 bp, homo sapien
ttgtcttatccataaagagaaataaratgctgctgagctatagagcattc

SEQ ID NO: 28650 - DNA, 50 bp, homo sapien
ctggaggaaaatggttgtctctccartaaatccacgtgcatcattgttaa

SEQ ID NO: 28651 - DNA, 50 bp, homo sapien
aagctttgagtaaccggtttgactaygctccacaaggttttttctttctg

SEQ ID NO: 28652 - DNA, 50 bp, homo sapien
aatggaaatagaaccaactctcaatragatagaatagatggatcttcaaa

SEQ ID NO: 28653 - DNA, 50 bp, homo sapien
gtttcctccagctgtatttactataygcacaaactgttgcttggcctggg

SEQ ID NO: 28654 - DNA, 50 bp, homo sapien
agcttgccaaggaaagcaagtgtaasagtctgggatccaaaattgctgac

SEQ ID NO: 28655 - DNA, 50 bp, homo sapien
gcacaaactgttgcttggcctgggaratactgaacctgcaaatgcaccat

SEQ ID NO: 28656 - DNA, 50 bp, homo sapien
atcagagtattccttgagctaaccaygtaacagctcactgctgcacaact

SEQ ID NO: 28657 - DNA, 50 bp, homo sapien
ttattggcaaaaacaccagaaattaygattctctctaagagctaagaggg

SEQ ID NO: 28658 - DNA, 50 bp, homo sapien
aactgataacacagattttgaagtcrgacggacccccaacttactagtat

SEQ ID NO: 28659 - DNA, 50 bp, homo sapien
aatattcaaggtagacaagggaatayggtcctacattatacctcttctta

SEQ ID NO: 28660 - DNA, 50 bp, homo sapien
ttttagcaaaagtagtcccaagttaygatgctcaggtagagaagacactg

SEQ ID NO: 28661 - DNA, 50 bp, homo sapien
taaaactggcatgttttgtttgttakaatattaatgtctacagcttaaaa

SEQ ID NO: 28662 - DNA, 50 bp, homo sapien
atcttcctttgtgtcctcttatcctkaagaatatttgtcatgcttacttt

SEQ ID NO: 28663 - DNA, 50 bp, homo sapien
cgaggaaacaagaataaatcaatgcrgatggagggtgttctcggcctact

SEQ ID NO: 28664 - DNA, 50 bp, homo sapien
gctttaaacacatctgtgaccctgakgaatctgatttgtccctccagccg

SEQ ID NO: 28665 - DNA, 50 bp, homo sapien
tcaagtgtctttgttgttttttgaayaggtactatggactagcagagaga

SEQ ID NO: 28666 - DNA, 50 bp, homo sapien
ggacgataaacctgacaatggtgctyacccttagagtccaacacactctt

SEQ ID NO: 28667 - DNA, 50 bp, homo sapien
ttttggcctcctacaaaaacgtaagrcagcaatgaggaaagacgtgatcc

SEQ ID NO: 28668 - DNA, 50 bp, homo sapien
tctttagggaattatttctagtgaaytgattaaaacatggcttgtattct

SEQ ID NO: 28669 - DNA, 50 bp, homo sapien
gttagaaaaaaaattacctacaccartatctctagagaagtaccaattat

SEQ ID NO: 28670 - DNA, 50 bp, homo sapien
tatatatctgacagcacatgaagacwcatctatgaatggtgtgaaagata

SEQ ID NO: 28671 - DNA, 50 bp, homo sapien
gtttgcctgtattcttttatctttakattttaggccctcttagaggaggc

SEQ ID NO: 28672 - DNA, 50 bp, homo sapien
ctgtgactagaacccagtaaaaaaakataggaatagccttgaatgctata

SEQ ID NO: 28673 - DNA, 50 bp, homo sapien
cttctatgattctcagtcctccaaaygaagataaggttggttggtttgtg

SEQ ID NO: 28674 - DNA, 50 bp, homo sapien
atgtacaaatacaccaaaagtaaaaytttcatggccacgaagagattttc

SEQ ID NO: 28675 - DNA, 50 bp, homo sapien
ggaaaacagcaaaatgatatttgacraagttttatcatgacattaattca

SEQ ID NO: 28676 - DNA, 50 bp, homo sapien
aataaggactacgttatactttatargcacacctgtatgtacataaggga

SEQ ID NO: 28677 - DNA, 50 bp, homo sapien
ttattctattctgtctttggataaartacataaaccaatacatataagaa

SEQ ID NO: 28678 - DNA, 50 bp, homo sapien
tcaatgtgaccttatgcctatataaygacatgcatataatcaaacactta

SEQ ID NO: 28679 - DNA, 50 bp, homo sapien
tatttgtacaatttcagttcttttaratttattgagaggctggacatggt

SEQ ID NO: 28680 - DNA, 50 bp, homo sapien
agaccagaacacagataaacgtaaaytagcttacatcaattggcacatcc

SEQ ID NO: 28681 - DNA, 50 bp, homo sapien
ttcacattggctgtactttatgtcaytattcctttgtgagatgaagcaaa

SEQ ID NO: 28682 - DNA, 50 bp, homo sapien
aacactagtggtagtgaagtaagacragatgagtgatgaaaagagagagt

SEQ ID NO: 28683 - DNA, 50 bp, homo sapien
gagattttgaattaaaaatatgacakggaaataaacaattctgagactga

SEQ ID NO: 28684 - DNA, 50 bp, homo sapien
aaaacgagctagttgtaaaagaaaaycataatgtcccaccagtgggtaat

SEQ ID NO: 28685 - DNA, 50 bp, homo sapien
taaagaggatttttaatttctctatsacactattctttttattgtgattt

SEQ ID NO: 28686 - DNA, 50 bp, homo sapien
tgaaaataattggtccattttaaccrcacagatctttctggcacacactg

SEQ ID NO: 28687 - DNA, 50 bp, homo sapien
ttttagggtgttaaatactgtcccayggctctgaatactgcaggttctgt

SEQ ID NO: 28688 - DNA, 50 bp, homo sapien
agtgactgtgcagaagaatatttaayggagaatatctgcaatgtgggaaa

SEQ ID NO: 28689 - DNA, 50 bp, homo sapien
ttatttttattttttgcacaacgaayagctctttgttgcttactttagct

SEQ ID NO: 28690 - DNA, 50 bp, homo sapien
ctgaggcattgatttatgggcatgamcttccatgtgccccgaggatggct

SEQ ID NO: 28691 - DNA, 50 bp, homo sapien
ccagtacacaacacacagtggcaaayaaaacagatgtgacctgttgtgca

SEQ ID NO: 28692 - DNA, 50 bp, homo sapien
tgaaaatgaatacaggatctgtctcyaataaaaacagaaaaagaattatg

SEQ ID NO: 28693 - DNA, 50 bp, homo sapien
taaagcaaattaattaaaatgactayggcacacctgaagtttgaaaaggg

SEQ ID NO: 28694 - DNA, 50 bp, homo sapien
gtcagggctttcagaaaatatctagyccaaagttctaaacaggcagccca

SEQ ID NO: 28695 - DNA, 50 bp, homo sapien
tttagaaattctattctgggtcaccraagttttctaactcttctgatgac

SEQ ID NO: 28696 - DNA, 50 bp, homo sapien
accttcagagcactcatttcgtccayactttgtgcatttgcccattcatt

SEQ ID NO: 28697 - DNA, 50 bp, homo sapien
taaaattacgctttccattagctaayaagtctgtggcacccgtttcccca

SEQ ID NO: 28698 - DNA, 50 bp, homo sapien
caggctgcattcgtttatacaaatcrcttgttttctagtgtaagacaata

SEQ ID NO: 28699 - DNA, 50 bp, homo sapien
ttccctagagtcccctaaatctcaaytcattccagcctttactcaaatat

SEQ ID NO: 28700 - DNA, 50 bp, homo sapien; identical to SEQ ID NO: 12567

SEQ ID NO: 28701 - DNA, 50 bp, homo sapien
actgtgaagtatgtaccttcaaaaamgaagaaagacactgacattttatc

SEQ ID NO: 28702 - DNA, 50 bp, homo sapien
ttgtgctcagtagcaagggttccatsatgctcacggtcctataggagagg

SEQ ID NO: 28703 - DNA, 50 bp, homo sapien
acaggctaatagagtagtgtaataayacaggagcctccgcagggaccatg

SEQ ID NO: 28704 - DNA, 50 bp, homo sapien
cgaccttgccccattcttccggttaygaggcacccgcaggggttgtccga

SEQ ID NO: 28705 - DNA, 50 bp, homo sapien
ttgcttattatgtggcaaatacttayagtgtattaatcaataagattaat

SEQ ID NO: 28706 - DNA, 50 bp, homo sapien
tttttcagggatgcctttttcgatcrctaaacagaaagtagcattcccgt

SEQ ID NO: 28707 - DNA, 50 bp, homo sapien
ataaacaagttgatatctatgtctayctgatcctaaggcatttgccactc

SEQ ID NO: 28708 - DNA, 50 bp, homo sapien
tctgaacgtcagtaagagccagtaarctgagtaaagatagaagagtgtta

SEQ ID NO: 28709 - DNA, 50 bp, homo sapien
agaaccagctcatgcaaaggctttcraacctaaactgcatccccaaactt

SEQ ID NO: 28710 - DNA, 50 bp, homo sapien
ggacaaggcctgaggaaatgccactyagatcgcaggtctctgagcctcct

SEQ ID NO: 28711 - DNA, 50 bp, homo sapien
tggtggttgtgagtgggtgcattackggggtacacatgattgtgtgtaca

SEQ ID NO: 28712 - DNA, 50 bp, homo sapien
gaaggggagaccagatgttggctgargcattgatttatgggcatgacctt

SEQ ID NO: 28713 - DNA, 50 bp, homo sapien
acataaaatcaatacatccatacaayttacagagaggtgctaggcactgt

SEQ ID NO: 28714 - DNA, 50 bp, homo sapien
tcagaacatgaccttgtttggaatamgggtctctcaactgccattaagtt

SEQ ID NO: 28715 - DNA, 50 bp, homo sapien
gcaagctaaatattgctattattccratgaaaaaaacagatctacaaagg

SEQ ID NO: 28716 - DNA, 50 bp, homo sapien
tggtttcctttcctcctgctcccaayaggctgagaagctcaatatcttat

SEQ ID NO: 28717 - DNA, 50 bp, homo sapien
cagaacatatatactgtgataaacaygggagactatttgtacctctactt

SEQ ID NO: 28718 - DNA, 50 bp, homo sapien
tagttagcttagttatccacgaaaayggttttggcttacaccagcgggat

SEQ ID NO: 28719 - DNA, 50 bp, homo sapien
tcttttgggggtgcagaagaaagaamctttatgaaatgactaatttgtct

SEQ ID NO: 28720 - DNA, 50 bp, homo sapien
aaaaagcttgtgttgtgagcagccasgtattaaacattttaggctttgtg

SEQ ID NO: 28721 - DNA, 50 bp, homo sapien
tctgagcttcaggaatagaaagatgyaactgttagaactgagatcgagag

SEQ ID NO: 28722 - DNA, 50 bp, homo sapien
ttgtcctggcataatcattagcagcrcctcacttctccaaaatgtctata

SEQ ID NO: 28723 - DNA, 50 bp, homo sapien
aggaattggttttgcaatttgaattwaagacttgacacatggatgaagtt

SEQ ID NO: 28724 - DNA, 50 bp, homo sapien
ttccaagcatgatttgttcagctcayggaattgaaagaaaagccaaaatg

SEQ ID NO: 28725 - DNA, 50 bp, homo sapien
caagtccatagaacatctgcaatgawgctctaggtcagaggggtgcagct

SEQ ID NO: 28726 - DNA, 50 bp, homo sapien
ttcttaacctcattatcaaaataacscatttagctaacttgccatgaagg

SEQ ID NO: 28727 - DNA, 50 bp, homo sapien
aagttttatcacattctccaggtacracgtgtgtattaataaatcaatag

SEQ ID NO: 28728 - DNA, 50 bp, homo sapien
tttctggcaacagtcaaaatgtataycaaggaaggagaaaggattcatga

SEQ ID NO: 28729 - DNA, 50 bp, homo sapien
agtaacttattttaaacaagagacamgaatacatcagaaaaggataatct

SEQ ID NO: 28730 - DNA, 50 bp, homo sapien
aaatagagatgatgattattactacsatacagaaaaaagtctacctggaa

SEQ ID NO: 28731 - DNA, 50 bp, homo sapien
attctccctggttatcataagcggaygcattttttcatttacttggaaga

SEQ ID NO: 28732 - DNA, 50 bp, homo sapien
ggaaacatgtattgctctagattggrcagtttaagtcattttaaagaaag

SEQ ID NO: 28733 - DNA, 50 bp, homo sapien
agaacctaacaggagccgcacattgkattaaccgagaaatctctctgtat

SEQ ID NO: 28734 - DNA, 50 bp, homo sapien
caggctgagaaagtgatttcatttasattgcaaaggagacagaaaaacaa

SEQ ID NO: 28735 - DNA, 50 bp, homo sapien
aaatcagccctgcctttcgtaaccayaagaactattagcaccactcttta

SEQ ID NO: 28736 - DNA, 50 bp, homo sapien
ttttaatgtcattcttatcacacacmattcatgggtttgcttctaagttt

SEQ ID NO: 28737 - DNA, 50 bp, homo sapien
cctattctactcatttctaataaggkcccctgattggttttcccaacaac

SEQ ID NO: 28738 - DNA, 50 bp, homo sapien
attttccaggcttcgctgacatgtaraaatcagtaagatcacatatatat

SEQ ID NO: 28739 - DNA, 50 bp, homo sapien
gcgaaagaaaaagattggaatattcraagtttaaggttacaacctaaact

SEQ ID NO: 28740 - DNA, 50 bp, homo sapien
ttttcactggattatgacactcatayattgtatttttcaggctcatttgc

SEQ ID NO: 28741 - DNA, 50 bp, homo sapien
ctttgtatttggttctttgttaggarataatttagacagtaattttttac

SEQ ID NO: 28742 - DNA, 50 bp, homo sapien
aagagatttcaatagccatgtatcartaacactaactcagtcaataaaat

SEQ ID NO: 28743 - DNA, 50 bp, homo sapien
cctatgtagaattcttcctagaccaytgattaccattacagtaacaactc

SEQ ID NO: 28744 - DNA, 50 bp, homo sapien
tgtcatctaataggatgtcttcctaygattctatatccaatgaattgatt

SEQ ID NO: 28745 - DNA, 50 bp, homo sapien
cctgagtaatgaaggaggtatattayagcattggttccaaagcttttaga

SEQ ID NO: 28746 - DNA, 50 bp, homo sapien
aaaacgtgttctcgtgactcagcaawttccttgtcagaatccattacctg

SEQ ID NO: 28747 - DNA, 50 bp, homo sapien
acaagcttttgtgcttgcaaaggaaygcgctgggaagaatttgaaggaca

SEQ ID NO: 28748 - DNA, 50 bp, homo sapien
accaaaattatgactgataacattgyaccagatttctaggaatagcatgt

SEQ ID NO: 28749 - DNA, 50 bp, homo sapien
ccctcaggggtttgagcagtggcaaygacccaacaggcaagccacacccc

SEQ ID NO: 28750 - DNA, 50 bp, homo sapien
cagagtgattatgatgtaaatgtccrcatgaaaagatgtaaactagttca

SEQ ID NO: 28751 - DNA, 50 bp, homo sapien
agatcttcctttccactcgcgcagakaacgtatttagagactgaaggcaa

SEQ ID NO: 28752 - DNA, 50 bp, homo sapien
gcactcacaatctgcaatagagtcasaattggatacaagtgtccaacaac

SEQ ID NO: 28753 - DNA, 50 bp, homo sapien
agtaatagatgcttattgttctagayagttttttgctattgttgataatt

SEQ ID NO: 28754 - DNA, 50 bp, homo sapien
tttctttactctagactttgatcacwctatagacagatttcctccgtgct

SEQ ID NO: 28755 - DNA, 50 bp, homo sapien
aagttgacaccacccttaataggaarcaatgtatcattctctaattatag

SEQ ID NO: 28756 - DNA, 50 bp, homo sapien
accttttttgagtaaataaattagaraagacaacaaaattaagcagcgac

SEQ ID NO: 28757 - DNA, 50 bp, homo sapien
gtctcaaccatgggttaaaatcagaygggatgaaagaacacctgcagtga

SEQ ID NO: 28758 - DNA, 50 bp, homo sapien
gcaccttcttctatcagactgggcaycttttcaaatcagattgtctcaag

SEQ ID NO: 28759 - DNA, 50 bp, homo sapien
cttattgactctggttatgttattaygggaactgactccactagggccag

SEQ ID NO: 28760 - DNA, 50 bp, homo sapien
aatccaattatttgaacatcacttaygaaaacatccctttttacccaatt

SEQ ID NO: 28761 - DNA, 50 bp, homo sapien
ggctggaggagaaatgctgtctacaytcatggcagggacccccgccagga

SEQ ID NO: 28762 - DNA, 50 bp, homo sapien
gatgttccctctctggtcaccagaaytgtcttaggcttaaccttaggcca

SEQ ID NO: 28763 - DNA, 50 bp, homo sapien
tagttacttaaaaataaacttttgcrctataagcaaactaaaaatgtaaa

SEQ ID NO: 28764 - DNA, 50 bp, homo sapien
agatcagagcattgacccaaattcartactctgggaaacaggctgcagga

SEQ ID NO: 28765 - DNA, 50 bp, homo sapien
cctacccttggaagccaaaaatagaygaaagtgctgagatatagtataaa

SEQ ID NO: 28766 - DNA, 50 bp, homo sapien
agaaaaagactctaaaaaaaagttcracaattctatgagaaaaacaagca

SEQ ID NO: 28767 - DNA, 50 bp, homo sapien
gaccctacatttgtcttctcaagtawaaaccaagatcctaggaggcactg

SEQ ID NO: 28768 - DNA, 50 bp, homo sapien
aattcttcccaggatgaacctataakattcacagcactttacatgttcag

SEQ ID NO: 28769 - DNA, 50 bp, homo sapien
taaaatctaattctctctgtctttcmaagagtataatcaaagtactgtgt

SEQ ID NO: 28770 - DNA, 50 bp, homo sapien
atgaggcactgttgatgccaatgcarcatttatacttaatgtagagaaag

SEQ ID NO: 28771 - DNA, 50 bp, homo sapien
catataagatgccagacttaataaaygtgtgcatgttctgactgctccac

SEQ ID NO: 28772 - DNA, 50 bp, homo sapien
acagtattaatttagtgttttctaawgagtaatgataaaaaaaaaattaa

SEQ ID NO: 28773 - DNA, 50 bp, homo sapien
acctgtattcatttacactgtatacmcattgagaggagagacttgttcag

SEQ ID NO: 28774 - DNA, 50 bp, homo sapien
ctctttccctgtgttaatgacattasaataatactaagaagaaaaaaaga

SEQ ID NO: 28775 - DNA, 50 bp, homo sapien
tggcctccttttggagcctattaacrcagcccttagctaaactttaaggt

SEQ ID NO: 28776 - DNA, 50 bp, homo sapien
actttgggaaggagtgatataccagmaaggagtcaaatgtcttaactctg

SEQ ID NO: 28777 - DNA, 50 bp, homo sapien
aaaaagtttttctttcttcatacacrgtatcccattggtacagggatcat

SEQ ID NO: 28778 - DNA, 50 bp, homo sapien
tgagtacctttttttacacttaacayggatgaaatcaaatttgctgatag

SEQ ID NO: 28779 - DNA, 50 bp, homo sapien
gcttggtttatgtttaaaaacaaatkattcaacggctcttttcacagact

SEQ ID NO: 28780 - DNA, 50 bp, homo sapien
cattccttggtaaccctgttcagacrgaaattatagaggccacagtgaga

SEQ ID NO: 28781 - DNA, 50 bp, homo sapien
ggaggctggaaccatattctattcarcaagaaaatttagacaaaggtaat

SEQ ID NO: 28782 - DNA, 50 bp, homo sapien
cctctctcctcaggtgatttgtagakaagccactattcaagcaaagggca

SEQ ID NO: 28783 - DNA, 50 bp, homo sapien
aatctacattggactagagatacaargcaatgctaagcaaccttgtttcc

SEQ ID NO: 28784 - DNA, 50 bp, homo sapien
ccaagtatgcacaatagagtcctacmaaatgcttgaatggagtcagtcag

SEQ ID NO: 28785 - DNA, 50 bp, homo sapien
gaaaccctcagtcagctcaaatgacrcactgaaaaatcttttgtaggttt

SEQ ID NO: 28786 - DNA, 50 bp, homo sapien
gccaagttgtagttgcctttgttccrctaaattgaaaaatttaccccgtg

SEQ ID NO: 28787 - DNA, 50 bp, homo sapien
tggagtctgttagggcttgaggagcragtagttcttgtggaagggaaggt

SEQ ID NO: 28788 - DNA, 50 bp, homo sapien
cactggtggagtgacaaaccgttackccttagagcagtgactctcaaact

SEQ ID NO: 28789 - DNA, 50 bp, homo sapien
acactttaattcactaaaaccaaccmaaattgatatggttcagagtttaa

SEQ ID NO: 28790 - DNA, 50 bp, homo sapien
aagtaaacatttcttgtcaaaggcaycctgacagtggtaattaagttcag

SEQ ID NO: 28791 - DNA, 50 bp, homo sapien
tcctatcatttgtgtgttcagtagartagaactttttattttattcaaaa

SEQ ID NO: 28792 - DNA, 50 bp, homo sapien
cactgcctcttctcaagtatatctgwagtatggctggttggagtatatca

SEQ ID NO: 28793 - DNA, 50 bp, homo sapien
tctgatcaccatctaatggcaaatgyatgggagaatctgggtggcaactc

SEQ ID NO: 28794 - DNA, 50 bp, homo sapien
tatatcttttccttttcatctcttakgatcctctgttagaatgactcagg

SEQ ID NO: 28795 - DNA, 50 bp, homo sapien
ccaaatttatattaagtactctggaygattttcataaaggtgagatatgt

SEQ ID NO: 28796 - DNA, 50 bp, homo sapien
ttacactctggctgatagctaagatyacgctgggaattccacggagagag

SEQ ID NO: 28797 - DNA, 50 bp, homo sapien
cattgaaagcagtcatatcatttaamatatccttatagtcaatccatact

SEQ ID NO: 28798 - DNA, 50 bp, homo sapien
caggtaagcaattttgagcctgtgargttagtagtctacgaagatatatt

SEQ ID NO: 28799 - DNA, 50 bp, homo sapien
atgcagaaatgtcaggaacgctcaaygcggggacaatctacaaaacaacc

SEQ ID NO: 28800 - DNA, 50 bp, homo sapien
aaaagtcagcaacatcgaaattccargccagtatagtgtgtgggtgtcat

SEQ ID NO: 28801 - DNA, 50 bp, homo sapien
agtgtagccactgatttggaaaaccygcatgtaaataagagatcatctgt

SEQ ID NO: 28802 - DNA, 50 bp, homo sapien
ctcagtaaaatcaagagaagatgcayaactcaaggcttctccttcaagag

SEQ ID NO: 28803 - DNA, 50 bp, homo sapien
aagatgtctcattccagaggaaacamtaaaaaatagtctgtagttcgaaa

SEQ ID NO: 28804 - DNA, 50 bp, homo sapien
agtgcgatgcgttatcaacattaccyaaagttatgcagcaaaaaaatgtt

SEQ ID NO: 28805 - DNA, 50 bp, homo sapien
atttcaaaacctctgttctcagaaayattaggtgggtacttttattctca

SEQ ID NO: 28806 - DNA, 50 bp, homo sapien
taaagagtggaatcgtttttaagccsggaagacattgtatttgcattttc

SEQ ID NO: 28807 - DNA, 50 bp, homo sapien
gaagcccaaaatttgttctgtagtcyagagtgtaattaaaagctttagag

SEQ ID NO: 28808 - DNA, 50 bp, homo sapien
atattttagcatttatgtatctctasactgtaatgaattgacagtttact

SEQ ID NO: 28809 - DNA, 50 bp, homo sapien
tgaattgacagtttacttgctacagraagaataacacaaagacaatattg

SEQ ID NO: 28810 - DNA, 50 bp, homo sapien
ggtaggtttaacaaagtgcaagcaamggtgactgtagcttacatagctaa

SEQ ID NO: 28811 - DNA, 50 bp, homo sapien
atttttccagaattgagggataacayagataggtatttttaaacaaataa

SEQ ID NO: 28812 - DNA, 50 bp, homo sapien
tcttatcaactagtgctcatggacaygtaaaaaataataatgcaattgcg

SEQ ID NO: 28813 - DNA, 50 bp, homo sapien
caacaccaatttgcacccatggacakatagggaaatccaaaactattagt

SEQ ID NO: 28814 - DNA, 50 bp, homo sapien
agaaccgtgtaaatatcatacagcartaatgggttttggaagttttcaac

SEQ ID NO: 28815 - DNA, 50 bp, homo sapien
gaattttacactttgcttgaaacaartacacatacacacagagaggtatt

SEQ ID NO: 28816 - DNA, 50 bp, homo sapien
ggcaagaggcttgatgtgagccaaasgaccaagagctaaaagaattatgc

SEQ ID NO: 28817 - DNA, 50 bp, homo sapien
ccctttgatttctacagttaaaagayattcagtaatacaaccactgagtt

SEQ ID NO: 28818 - DNA, 50 bp, homo sapien
aagagctaaaagaattatgctactgsaactaatttagcatcaagatgaag

SEQ ID NO: 28819 - DNA, 50 bp, homo sapien
tcacttaacctcttttcctagcatarcattccataagtatcaatacagtt

SEQ ID NO: 28820 - DNA, 50 bp, homo sapien
cccacttttgggacccagatttttgkatgcaggttaatttgcatgctgat

SEQ ID NO: 28821 - DNA, 50 bp, homo sapien
tctacaaatctgatccacttaaataraatatgataacaaaactgtgcctg

SEQ ID NO: 28822 - DNA, 50 bp, homo sapien
atgtagggtcatcctaagattttcarggtaagccttaaggttaatctatt

SEQ ID NO: 28823 - DNA, 50 bp, homo sapien
tagatagatagatagatagagtatakgcaactttaatccacgttatactg

SEQ ID NO: 28824 - DNA, 50 bp, homo sapien
tttgactaagtgtacagagatttcaraaccttatgataaaagtcattagc

SEQ ID NO: 28825 - DNA, 50 bp, homo sapien
aacaaaagcattatcaaatttcaagwcaaattcacaattgagtccagtat

SEQ ID NO: 28826 - DNA, 50 bp, homo sapien
ccagttaatctttacaaaaaagggcragagtacctatacagtgcctcata

SEQ ID NO: 28827 - DNA, 50 bp, homo sapien
cttattttctctacacaaggatttcrcctcaaagaattattttccagact

SEQ ID NO: 28828 - DNA, 50 bp, homo sapien
tataagtaaaatataaatgaatataygaaaagtgacttgcaaccaaataa

SEQ ID NO: 28829 - DNA, 50 bp, homo sapien
ttctttggactggcttattaaattayagtatgttattctcttgttctggt

SEQ ID NO: 28830 - DNA, 50 bp, homo sapien
ttatgggagagaaattaaatttttgracccaccatcttaacatggaagct

SEQ ID NO: 28831 - DNA, 50 bp, homo sapien
ctatcaaaactatatttcagacatargattattttgatgaagtgaaattt

SEQ ID NO: 28832 - DNA, 50 bp, homo sapien
cacacacattcttttttagaaattaygcaactcagaaatgcatctctaaa

SEQ ID NO: 28833 - DNA, 50 bp, homo sapien
gcctttgttatattgttaatggtgaygctaagataggtacgtatatacag

SEQ ID NO: 28834 - DNA, 50 bp, homo sapien
ataaaacaacattttaaatagctgarataaaatgtcaatgtagaattcaa

SEQ ID NO: 28835 - DNA, 50 bp, homo sapien
ggatttaaatgaatttaatcataaaygccgtaatatctattcatacttgc

SEQ ID NO: 28836 - DNA, 50 bp, homo sapien
ttacttgccgctatttgttgataaaytcttaggtatgattttaccacaat

SEQ ID NO: 28837 - DNA, 50 bp, homo sapien
tcataatggtttctgaaagagatctsaatggaagttaaatgaaaattcta

SEQ ID NO: 28838 - DNA, 50 bp, homo sapien
agggctaatattcgggtagtatacamaaggtttcgtctgtgccagttgtt

SEQ ID NO: 28839 - DNA, 50 bp, homo sapien
cactataaggaaaactgggaaaatcygaagttctgggaattagacaacag

SEQ ID NO: 28840 - DNA, 50 bp, homo sapien
aaagtatactaacctaaaaatgctaytaacactttgatccagagatgata

SEQ ID NO: 28841 - DNA, 50 bp, homo sapien
tgtcaacaatcaggaaaaggcattgkattatagaatctatttttgtccaa

SEQ ID NO: 28842 - DNA, 50 bp, homo sapien
cataattaagagatgtcagtattaasggacccagacacagggatgttcat

SEQ ID NO: 28843 - DNA, 50 bp, homo sapien
tatagtcaccaccaagaataatgaartacaaatcctacattttttcaagc

SEQ ID NO: 28844 - DNA, 50 bp, homo sapien
aggctccagtccacttctcgggcaayagttggtaggcttttgtcttacag

SEQ ID NO: 28845 - DNA, 50 bp, homo sapien
gtgcctcttgtctctgataagaagcrctcctttgttcctagtctgtgccc

SEQ ID NO: 28846 - DNA, 50 bp, homo sapien
aacaggaaactcatatcaatccaaakattcaaacttaccctgatataagg

SEQ ID NO: 28847 - DNA, 50 bp, homo sapien
aacccgaaaagatagaattcaaactsacactgacaattccaaatttcctg

SEQ ID NO: 28848 - DNA, 50 bp, homo sapien
agaatgtcctgattgtaactttcaayggaccacacatgaattcagccaac

SEQ ID NO: 28849 - DNA, 50 bp, homo sapien
gagaaatagcccagggtgtagagaascgaactgctgtttggaaaaataat

SEQ ID NO: 28850 - DNA, 50 bp, homo sapien
ttatgttagcaaagtaattttataaygaagacagagaaagtttaagtaga

SEQ ID NO: 28851 - DNA, 50 bp, homo sapien
gtaatgtttctaagatgttaacaaaygcatcttaaatgggtcctatattt

SEQ ID NO: 28852 - DNA, 50 bp, homo sapien
tttatgacttgccaaatgtgaattayctcctcaaatacacacgtgaattg

SEQ ID NO: 28853 - DNA, 50 bp, homo sapien
atccatcattatcatctaatcataartcactcttccaataaaagtataaa

SEQ ID NO: 28854 - DNA, 50 bp, homo sapien
ttaaaaaaccagttaaatctgaaaawtattaaaatgtactttaaacattg

SEQ ID NO: 28855 - DNA, 50 bp, homo sapien
ttccttctctttcaatcagacggtgraatttaatgtctgctcttagtatc

SEQ ID NO: 28856 - DNA, 50 bp, homo sapien
aaagaaaaacaaaatttcaaaagtcrctcaaatcataaagttctaagaag

SEQ ID NO: 28857 - DNA, 50 bp, homo sapien
gactcattctgcaatcagaacttgtmaatcagaatcctaagagttattct

SEQ ID NO: 28858 - DNA, 50 bp, homo sapien
atctttatatactggttatgttatcyaattacaatataagtatgtatgtg

SEQ ID NO: 28859 - DNA, 50 bp, homo sapien
ctggtgcgaagttggtattagaagckcaaaagaaaatttcacctggaacc

SEQ ID NO: 28860 - DNA, 50 bp, homo sapien
aacatttagtttaaacccaagaaggrcactaaactcagattgactaaata

SEQ ID NO: 28861 - DNA, 50 bp, homo sapien
ggtgtcatttaatgattaacagcaartgtgtttctacttataagataagg

SEQ ID NO: 28862 - DNA, 50 bp, homo sapien
tccaagattcaggttttcctttgaakgtatgaaagtatagcaacttttcc

SEQ ID NO: 28863 - DNA, 50 bp, homo sapien
agtgattgtgtacaattctgtcacgyatatgtgccctttgtactttttat

SEQ ID NO: 28864 - DNA, 50 bp, homo sapien
ttcctctaacatgtttgtaggaaaamcattagtccttatcttataagtag

SEQ ID NO: 28865 - DNA, 50 bp, homo sapien
gctccaattattgttgtaagatactragaggaaaggattaggtatgtttt

SEQ ID NO: 28866 - DNA, 50 bp, homo sapien
ataactgtacctcctaagccataatmagaaagcactggaagagggaagca

SEQ ID NO: 28867 - DNA, 50 bp, homo sapien
ttggtttctttaatattataccatamattcatacatgcatggggtttgaa

SEQ ID NO: 28868 - DNA, 50 bp, homo sapien
taattctgtgaagaatgtcaatggcracttaatgagaatagcattgaatc

SEQ ID NO: 28869 - DNA, 50 bp, homo sapien
aactaaccatattctggtattataargagctgcctgcaagaaaaatattt

SEQ ID NO: 28870 - DNA, 50 bp, homo sapien
cattaaaagaatataggcaactcctwacaataaaaataaagacgactagt

SEQ ID NO: 28871 - DNA, 50 bp, homo sapien
tactgcaatttagagagcctcaatayataaaagcagaaaaatcacactat

SEQ ID NO: 28872 - DNA, 50 bp, homo sapien
gttcatgttcttggagtttgtgatayaaagaataatgtacagccaatcaa

SEQ ID NO: 28873 - DNA, 50 bp, homo sapien
ttatctaatttaatccctgcaaccaytctatgaaagcaagtactactgta

SEQ ID NO: 28874 - DNA, 50 bp, homo sapien
agtggagaatcaaactgagtgtatawcatttgtgtattctgaagttttat

SEQ ID NO: 28875 - DNA, 50 bp, homo sapien
tagttgacttttcttaatgaggagtwaattaatgagagacagactaattt

SEQ ID NO: 28876 - DNA, 50 bp, homo sapien
taaaggatgcttatgactctataatraaatgtaaagcaatccaaatgggc

SEQ ID NO: 28877 - DNA, 50 bp, homo sapien
ttaatttcttctaagacagtatcaayatgtacttttcatcactactttaa

SEQ ID NO: 28878 - DNA, 50 bp, homo sapien
gaccacaatatttagggataacaacrgaagtcatttcctgcatccttcaa

SEQ ID NO: 28879 - DNA, 50 bp, homo sapien
cttttccagatgtgatctcagaggtkaatgtttctcagctgaagtgagga

SEQ ID NO: 28880 - DNA, 50 bp, homo sapien
gtaatttatgctgggaagtagtaagwattagtgaaaagatcatagaagca

SEQ ID NO: 28881 - DNA, 50 bp, homo sapien
tcacagattgtcttcccccaaagtartaaagaaatcaatcactcagactt

SEQ ID NO: 28882 - DNA, 50 bp, homo sapien
tggccaggtacgatgtaaaatgtaaygaggctagctagcacatccaacct

SEQ ID NO: 28883 - DNA, 50 bp, homo sapien
gtcaggagtcaacagcttcaccttarcattgtgcttatgatagagaagca

SEQ ID NO: 28884 - DNA, 50 bp, homo sapien
aatattgaagtgcaaaaagatgatamcaagtaaggttattgttcttctat

SEQ ID NO: 28885 - DNA, 50 bp, homo sapien
ttttaatgcatttgttctgtttcccrcttttatctacatgtctctcattt

SEQ ID NO: 28886 - DNA, 50 bp, homo sapien
ctacatgattattgtttaaattgtargacaatgattttaaatatgactgt

SEQ ID NO: 28887 - DNA, 50 bp, homo sapien
agacaaagcctgccatacagtaaccrcatgactgttgatgtcgctctcct

SEQ ID NO: 28888 - DNA, 50 bp, homo sapien
tgtccctaattttcagatccgaggargatttttttcagttctcatcttaa

SEQ ID NO: 28889 - DNA, 50 bp, homo sapien
taatattttaatttcatgttaggacrctctatttgtttagttgttagttc

SEQ ID NO: 28890 - DNA, 50 bp, homo sapien
tgtaccaatgtgatggcaatagagayagaaaaaaagaggacatgttccag

SEQ ID NO: 28891 - DNA, 50 bp, homo sapien
tattctttattcattaactgatagcraaatagccaaacttgttctgaatc

SEQ ID NO: 28892 - DNA, 50 bp, homo sapien
tttgcctgagaaaagggttctacacygcactagtacctaaacactagcag

SEQ ID NO: 28893 - DNA, 50 bp, homo sapien
gaattgaaaacaatatgacctgaatsatactcaaaaactgatatattaaa

SEQ ID NO: 28894 - DNA, 50 bp, homo sapien
tcaagaaaaaggcttagtttgtaaartaagctctatctgcatactggaag

SEQ ID NO: 28895 - DNA, 50 bp, homo sapien
taaccattttatgatcgcttaatatwagaggaaggagtttagattgtttt

SEQ ID NO: 28896 - DNA, 50 bp, homo sapien
gtaatttggtaaattataaagcaaasttatagccaattctcatgattcag

SEQ ID NO: 28897 - DNA, 50 bp, homo sapien
ctgatcaatgggaaaaaaaactgaastcagccatgaataatatgtatgcc

SEQ ID NO: 28898 - DNA, 50 bp, homo sapien
caaatgaatcagagatctaacccagwatcaagaattactaattattttat

SEQ ID NO: 28899 - DNA, 50 bp, homo sapien
tatttttttcaactttctgttaccastcatgcaattccccaagctaaatt

SEQ ID NO: 28900 - DNA, 50 bp, homo sapien
gcagggtgtggagaatgagtgtggayaatcatttatgctgagaattttgt

SEQ ID NO: 28901 - DNA, 50 bp, homo sapien
ttaattcctaggtaacagacaacaaycgtggcgaccagggaaggaatagg

SEQ ID NO: 28902 - DNA, 50 bp, homo sapien
catgtcattagtgccactttttctaytaaaattcagaaatttaactagtc

SEQ ID NO: 28903 - DNA, 50 bp, homo sapien
agcaaaaacatgattataggctcctractaccttttcctgagagctttac

SEQ ID NO: 28904 - DNA, 50 bp, homo sapien
agaggccctgacaattggcactgaaygttgattcttcagtaattacggag

SEQ ID NO: 28905 - DNA, 50 bp, homo sapien
tatacacaaacagtccattctaaacygcaagctactagtaagggaccgga

SEQ ID NO: 28906 - DNA, 50 bp, homo sapien
ctagagtgggaactgactaaagcatraagtacagggccaggttcatttgg

SEQ ID NO: 28907 - DNA, 50 bp, homo sapien
caaaaatggattttgatatcaaacamtacattaaataatagcttacattc

SEQ ID NO: 28908 - DNA, 50 bp, homo sapien
aaggtaagtccagtggaaatggatcygaagtggtctctcagggtaacgtg

SEQ ID NO: 28909 - DNA, 50 bp, homo sapien
caacagagaagccctcaggaaggccrcctaaatgtagatatttacctatt

SEQ ID NO: 28910 - DNA, 50 bp, homo sapien
ttactatagtgatcctaccttgccaytcaacatttaattcctaggtaaca

SEQ ID NO: 28911 - DNA, 50 bp, homo sapien
ataatgtgacatatactcactctgawctaaatttaacatcttcccacgtt

SEQ ID NO: 28912 - DNA, 50 bp, homo sapien
taatttttaagcttttttactcttgwatcaacacttagcttaaagcacaa

SEQ ID NO: 28913 - DNA, 50 bp, homo sapien
acaaacgaagagccttcaaactaccyagatgagatcaaacgtcgatgaca

SEQ ID NO: 28914 - DNA, 50 bp, homo sapien
ctttggaaggaaccataaaaatcatraagtcataaaattgtagaaaggaa

SEQ ID NO: 28915 - DNA, 50 bp, homo sapien
aaaatattttacaagtacagtcaagraattaatattaatgtttagaacat

SEQ ID NO: 28916 - DNA, 50 bp, homo sapien
cttatattgtatcaaataccgtaacygagggcaatgtttactcaaactaa

SEQ ID NO: 28917 - DNA, 50 bp, homo sapien
tgttgttgaatgagtgattgagtaartgtgtactagggcagctaatcata

SEQ ID NO: 28918 - DNA, 50 bp, homo sapien
ctgtcacaagtacagaaatctgacaytggagctggaagacagcaatagat

SEQ ID NO: 28919 - DNA, 50 bp, homo sapien
tggaaatactaaaaggagctagatayggtcttagtccttaagcagctgga

SEQ ID NO: 28920 - DNA, 50 bp, homo sapien
taaccaagaggataatttccaacaayattaatgtcaaatttagtgaaata

SEQ ID NO: 28921 - DNA, 50 bp, homo sapien
ggtcccttcacactaatctaaactayctgtaaaaacattcttgaagccct

SEQ ID NO: 28922 - DNA, 50 bp, homo sapien
aatcaccattttaaaggaccgtgtcyaccagttataaatgaataattact

SEQ ID NO: 28923 - DNA, 50 bp, homo sapien
gtaaactactcaaatgccattttcakaagtccaacattttcaaatcaaga

SEQ ID NO: 28924 - DNA, 50 bp, homo sapien
ggctgaggtgggcggatcaccccaartcagaagttcgagaccagcctggc

SEQ ID NO: 28925 - DNA, 50 bp, homo sapien
tccaaatgccgctagggaagtgtcaygtgtatagcatgctgtcaactcca

SEQ ID NO: 28926 - DNA, 50 bp, homo sapien
tagttaactatgagaaatagagaagwatgcaggatgtaacataaagaaaa

SEQ ID NO: 28927 - DNA, 50 bp, homo sapien
gagtaatgttctcatatcttaaaagraaatcgatacctgatattagatgc

SEQ ID NO: 28928 - DNA, 50 bp, homo sapien
ttcatctatgagtatatttttatacrccatctatgacctcaaaaataata

SEQ ID NO: 28929 - DNA, 50 bp, homo sapien
taagcttgcccactgactgtcctaastgtaacagacttaaacaacaatta

SEQ ID NO: 28930 - DNA, 50 bp, homo sapien
cattctgttaagacatagaagtaaasctctcgcctgatgtgttagctctg

SEQ ID NO: 28931 - DNA, 50 bp, homo sapien
agcttaaagatgaagagtaaagagaygaaataattggctatgcatgtgtc

SEQ ID NO: 28932 - DNA, 50 bp, homo sapien
tgataatagtatttgtaccacatgcyattgatttggactaagatctagta

SEQ ID NO: 28933 - DNA, 50 bp, homo sapien
gaattctaaatacttactacaattawatcaggcttcatcagatccttcaa

SEQ ID NO: 28934 - DNA, 50 bp, homo sapien
gttatacatttttaaattttagggaytatcaagtttgcctcccattttgt

SEQ ID NO: 28935 - DNA, 50 bp, homo sapien
ctgccccaattattatgaaatacacwaacatacctaaagactgtaactta

SEQ ID NO: 28936 - DNA, 50 bp, homo sapien
gtttgcttttgttttcttgttttacraaatctcaaaggaagtacttatgg

SEQ ID NO: 28937 - DNA, 50 bp, homo sapien
agcaaatccaaggcaactatattcayatcctagagtgcagtgatgatgga

SEQ ID NO: 28938 - DNA, 50 bp, homo sapien
tactcccttgaaatatctgcatagcrcctaatattgagtacaaaaatgca

SEQ ID NO: 28939 - DNA, 50 bp, homo sapien
cagcataaactttcattttagtagcraataataataacttttgataattg

SEQ ID NO: 28940 - DNA, 50 bp, homo sapien
acacttagggagaatcaaaatgtaasctactgcctccatcttcccaaaat

SEQ ID NO: 28941 - DNA, 50 bp, homo sapien
gaatgtaatttttttaaaggagcaartctatgttcaataaatgcttagta

SEQ ID NO: 28942 - DNA, 50 bp, homo sapien
gacttggatacatatcttagatttarggaattctgatgagatggaaaaaa

SEQ ID NO: 28943 - DNA, 50 bp, homo sapien
tacattgttagggccccttctttggratcagtataagtgaaagaaaaatt

SEQ ID NO: 28944 - DNA, 50 bp, homo sapien
gcctctatgtggaacactatcctaartattgtgaaaaatgcaaaggaatc

SEQ ID NO: 28945 - DNA, 50 bp, homo sapien
aaaatgcatgttctgtatcagtctargtctaatcaagaaagagaaaccac

SEQ ID NO: 28946 - DNA, 50 bp, homo sapien
tactgaagtaataattgtattctaartattgctttattgctagtatgtgt

SEQ ID NO: 28947 - DNA, 50 bp, homo sapien
ataaagctttagctatatgggaatargatggaagaaaggtaccaaaaaag

SEQ ID NO: 28948 - DNA, 50 bp, homo sapien
tttttgtaaaatttttgctctttaakgattataatcttttgcatagctgg

SEQ ID NO: 28949 - DNA, 50 bp, homo sapien
aatttttaagtccattatctaactascatattcagattgtgaaggaaaag

SEQ ID NO: 28950 - DNA, 50 bp, homo sapien
ctttatttacttccccagaggatatsaaatgaatggttcataggattctg

SEQ ID NO: 28951 - DNA, 50 bp, homo sapien
tattccatctatggaaaacatatgartagaaacaaagtagttattttttg

SEQ ID NO: 28952 - DNA, 50 bp, homo sapien
gtcttcttacctcatcacgttcttgraaatctaaatgactcaatatgtca

SEQ ID NO: 28953 - DNA, 50 bp, homo sapien
tagtggttactgtcactatacaaacsctgatgtcactatatttagctagt

SEQ ID NO: 28954 - DNA, 50 bp, homo sapien
aagatccaatctgttatttttaaackatgccattctattttgcaaatgcc

SEQ ID NO: 28955 - DNA, 50 bp, homo sapien
ggaaaatttataaaacaaatgacagrccatgttgatatttgtgaattgga

SEQ ID NO: 28956 - DNA, 50 bp, homo sapien
ttaaaaaataattttagtgatgtatyaactaatttttctctagtaacaaa

SEQ ID NO: 28957 - DNA, 50 bp, homo sapien
tggacagataatctatggttgcttcyagctccaaaattcagtgacccttt

SEQ ID NO: 28958 - DNA, 50 bp, homo sapien
cttaacatagtatttctaattaaaakattatgatgacacaatgatccatc

SEQ ID NO: 28959 - DNA, 50 bp, homo sapien
attaagacaaagacagagaaaccaayggaggtagataccagtcagaatct

SEQ ID NO: 28960 - DNA, 50 bp, homo sapien
cttgcctgcaatagaatgcctagaayatcttgttagttcaataatgtaaa

SEQ ID NO: 28961 - DNA, 50 bp, homo sapien
cacaatgatccatctctgttagatcycaaatgaaatgttaaagttgataa

SEQ ID NO: 28962 - DNA, 50 bp, homo sapien
atcctctttgatgaacagaaaataaraatggcgaatataggaaccttctg

SEQ ID NO: 28963 - DNA, 50 bp, homo sapien
tgagtgaagaaagactataaccagartctgagtgaccaatgaggagacta

SEQ ID NO: 28964 - DNA, 50 bp, homo sapien
ttttcaggaaacacaatttgcaaaakaagagttgagaagtgattaggaga

SEQ ID NO: 28965 - DNA, 50 bp, homo sapien
gtgctgcagtatccatactcagacayctaggttttaatataggttacacc

SEQ ID NO: 28966 - DNA, 50 bp, homo sapien
aaaaaaagtgactcaaggtcatttaygatacatgaaaataaacaaattta

SEQ ID NO: 28967 - DNA, 50 bp, homo sapien
atgaatgaggaacaaaggaaatttcyaggacaataagatattctatttca

SEQ ID NO: 28968 - DNA, 50 bp, homo sapien
gacagtccataaaaaccatattatamgaaactgatctaaacctatagtaa

SEQ ID NO: 28969 - DNA, 50 bp, homo sapien
ttagtttttcatatttattctgctgmaatttcattagcattacttatttg

SEQ ID NO: 28970 - DNA, 50 bp, homo sapien
tattcttctgaccatgagctccttcsatcctgtatattatgtctccattt

SEQ ID NO: 28971 - DNA, 50 bp, homo sapien
aatgttttctcaggagcataagtccrctgtagaaaggcctaatttaggtt

SEQ ID NO: 28972 - DNA, 50 bp, homo sapien
ctaagtgtatgacaaagaataaaacrcttcatatcatagctatgacgttg

SEQ ID NO: 28973 - DNA, 50 bp, homo sapien
actttagcttgaaaatattaacttamcagcataagatgatgcacataact

SEQ ID NO: 28974 - DNA, 50 bp, homo sapien
tcaagagcatgctacacactataaargaaagtaacctgactattcaatcc

SEQ ID NO: 28975 - DNA, 50 bp, homo sapien
gacaagaaattatgtagtcactctaygcatatggacaggtcctatcacca

SEQ ID NO: 28976 - DNA, 50 bp, homo sapien
ccctacagacagagcaatcactaaartaataaagtggtgtagatagcaag

SEQ ID NO: 28977 - DNA, 50 bp, homo sapien
agtaaaaaagacccaaatgtacaacmatatctcattcttattatttacat

SEQ ID NO: 28978 - DNA, 50 bp, homo sapien
tctaatgatttcaactcttaccctayctaatacattcactttcatcattg

SEQ ID NO: 28979 - DNA, 50 bp, homo sapien
cacctcttcaaaagatctgagtaccygagttagttagaacaattaaatcc

SEQ ID NO: 28980 - DNA, 50 bp, homo sapien
caaatgaaatgttaaagttgataaaygaattacagatacaaacctatatt

SEQ ID NO: 28981 - DNA, 50 bp, homo sapien
agcttctgtgaattaggatctggaawatttttgactcacagtggtaggac

SEQ ID NO: 28982 - DNA, 50 bp, homo sapien
aaactgtacatctaaaagcatcttaygaatggaaagaatatgttttcctt

SEQ ID NO: 28983 - DNA, 50 bp, homo sapien
tgttacttttagagcctctcacatcyatgaattcctacaaccctcattat

SEQ ID NO: 28984 - DNA, 50 bp, homo sapien
tgggaggttgaactacttggtaaaaygtttgaatctcatgcagttgaatg

SEQ ID NO: 28985 - DNA, 50 bp, homo sapien
gatgaagtgaaatttattatacatayggtgagacctaacttgtgttttta

SEQ ID NO: 28986 - DNA, 50 bp, homo sapien
tgttagctcacaggtctttgaaaatraatcaacaataattaaccccaact

SEQ ID NO: 28987 - DNA, 50 bp, homo sapien
gataatatccactatcatttatcacygactgctatgtgagtcgctttcta

SEQ ID NO: 28988 - DNA, 50 bp, homo sapien
attttggagcatccttagagagacaytgatttgtaattcagatcacatag

SEQ ID NO: 28989 - DNA, 50 bp, homo sapien
caccgtgaccagaaagctcaagtaaraaacacgaaccctgctgccagaca

SEQ ID NO: 28990 - DNA, 50 bp, homo sapien
gagctagggagacaaaaagttattamaggaatattgaacaagcttcttaa

SEQ ID NO: 28991 - DNA, 50 bp, homo sapien
gcttaaggctactttacttgaattaraaatggatacttagccaggtaaga

SEQ ID NO: 28992 - DNA, 50 bp, homo sapien
agtacgtgcagagttggcaactatarcggatgcaaagttgaaaaagtaga

SEQ ID NO: 28993 - DNA, 50 bp, homo sapien
cagaggattcctgtgttagctctatyagttctaccttccttgagaactgc

SEQ ID NO: 28994 - DNA, 50 bp, homo sapien
aaagaagttcttctgggtctgactargtaagtgaatctaagggaaccata

SEQ ID NO: 28995 - DNA, 50 bp, homo sapien
attggtttatggatatagcatatgaytaaatggaatttttatgtttaaaa

SEQ ID NO: 28996 - DNA, 50 bp, homo sapien
tacaagttgatgtgtggcaaatacaygctctagaaataatttgataaatg

SEQ ID NO: 28997 - DNA, 50 bp, homo sapien
aatacgtagtttagaaattcatcacyggagtacaaatgacaaggtacagg

SEQ ID NO: 28998 - DNA, 50 bp, homo sapien
attttcttacattattataagaaggycattggatatttaaaggagaaggg

SEQ ID NO: 28999 - DNA, 50 bp, homo sapien
taaacatcatttaaatatttctgaayaatgaaggttcaagtgtattctgc

SEQ ID NO: 29000 - DNA, 50 bp, homo sapien
gatgttttctataatagtaattatcycatctttagcaatttccataaaat

SEQ ID NO: 29001 - DNA, 50 bp, homo sapien
gactaagcaagcacagaaaactgaaygtggccaagaggtacatagtttat

SEQ ID NO: 29002 - DNA, 50 bp, homo sapien
gaaagctgggaaaatgaggcatacawtataacatttcttggtattctagg

SEQ ID NO: 29003 - DNA, 50 bp, homo sapien
ttatgtttatatacagaagagtacaktaagtgcatcatttttcataagaa

SEQ ID NO: 29004 - DNA, 50 bp, homo sapien
ttactctgtgtcacattactttaaaytgacttgtctatgactgtgaaaat

SEQ ID NO: 29005 - DNA, 50 bp, homo sapien
agtgtcatttgtcatttctaacaaaraatgattcaccacgggattgtgag

SEQ ID NO: 29006 - DNA, 50 bp, homo sapien
atatcaggagtgggcactcataagayagtataaatccacttgtctaaact

SEQ ID NO: 29007 - DNA, 50 bp, homo sapien
tgcctagataaaatagcacattatcyaagacctcaagtaatttttttaaa

SEQ ID NO: 29008 - DNA, 50 bp, homo sapien
aaatggtatattgccagagataacarcccggagatgagagatctaaggcc

SEQ ID NO: 29009 - DNA, 50 bp, homo sapien
accgaaattggcaccatccaatagcraaatcttctttattatttaaagtc

SEQ ID NO: 29010 - DNA, 50 bp, homo sapien
gtacagccttgtctttgtatctttcrctagatgtattccatgccacacat

SEQ ID NO: 29011 - DNA, 50 bp, homo sapien
ttctccagtccctttacataagagaygtgctgaaatagctgggtcatgac

SEQ ID NO: 29012 - DNA, 50 bp, homo sapien
ctcatctgtaatataactacctctartacgttgggatgtcaagaagataa

SEQ ID NO: 29013 - DNA, 50 bp, homo sapien
tttggcaaaatgctgacaactgaaayagaattgtagctgaacactctttc

SEQ ID NO: 29014 - DNA, 50 bp, homo sapien
gcattttgccaaaagtcaggcattcrgaactcttcccagacatgagaaaa

SEQ ID NO: 29015 - DNA, 50 bp, homo sapien
gtagcaggaattaccatgtaataccraacaattttcacagtgtatttcaa

SEQ ID NO: 29016 - DNA, 50 bp, homo sapien
gaaaatttgagaatgcaattaatcayctatagtaaaaagtcttttatagg

SEQ ID NO: 29017 - DNA, 50 bp, homo sapien
aaagcttaaataataatttcttcccwactatctaatgttcctagaatgtg

SEQ ID NO: 29018 - DNA, 50 bp, homo sapien
gcggtaagttcaacataaatacctaygcagctgtgatgccacacctcaac

SEQ ID NO: 29019 - DNA, 50 bp, homo sapien
aaaatttttttgcatatctcttggawgttttgagtattaggttttaagtc

SEQ ID NO: 29020 - DNA, 50 bp, homo sapien
ttgtatcatatcacactggtaataaragaaggaaaatagcttaaaataag

SEQ ID NO: 29021 - DNA, 50 bp, homo sapien
aataatccaaagtcacatacaaaaakatagatggatcttaaaatataatt

SEQ ID NO: 29022 - DNA, 50 bp, homo sapien
taatgtctttaaagtggagtatgtasctgaatcaaacagaatatttgcaa

SEQ ID NO: 29023 - DNA, 50 bp, homo sapien
cccaaagtttcatctctaggttaccyaaattttaattgcacactttcgta

SEQ ID NO: 29024 - DNA, 50 bp, homo sapien
tcccaataactactaagatgtctatraatacatgaaataaatggaaaact

SEQ ID NO: 29025 - DNA, 50 bp, homo sapien
aaaagaatgtaaaacataaaataaayggtagatattagaagcaataaaaa

SEQ ID NO: 29026 - DNA, 50 bp, homo sapien
gtggtattcacttaccaaacacaaamcagtgaatctatctctcttccaaa

SEQ ID NO: 29027 - DNA, 50 bp, homo sapien
tttttggtcctcattttcttaatacsaatgctcacctccacttctcaatg

SEQ ID NO: 29028 - DNA, 50 bp, homo sapien
agttttcacctggtaccttaccatgracctctgacttttgttaaaggctt

SEQ ID NO: 29029 - DNA, 50 bp, homo sapien
atattccataagagtccttcaaagaktccaggagatcaaaaaccaatcac

SEQ ID NO: 29030 - DNA, 50 bp, homo sapien
taagatttcaacagaaaaactaagamgttacagcaaacaaacaaaacaaa

SEQ ID NO: 29031 - DNA, 50 bp, homo sapien
aaagaaagtagaacaaggtacgagamaaattcaatatgagaatgattttt

SEQ ID NO: 29032 - DNA, 50 bp, homo sapien
gggacagttaccctgccaaagaaccygggattatggagaagcttgttatc

SEQ ID NO: 29033 - DNA, 50 bp, homo sapien
atgtggagttagagagaagagttcakaatgctcttagctgaagttcggta

SEQ ID NO: 29034 - DNA, 50 bp, homo sapien
atattctctttgacttaatttgagawcccttgaagcccagttatttctgt

SEQ ID NO: 29035 - DNA, 50 bp, homo sapien
gactgtgtggtaaatttttgctgaawcctatttattgttaaatgaaactt

SEQ ID NO: 29036 - DNA, 50 bp, homo sapien
tcccccatagtaaatcctaaagaaayaattactgggtgggttatgtttaa

SEQ ID NO: 29037 - DNA, 50 bp, homo sapien
atactgactaactagtaattacttawgatacatgtaagttaagccagaat

SEQ ID NO: 29038 - DNA, 50 bp, homo sapien
caaacaagcaagaactgaggagttakcatattggcaaagataactggccc

SEQ ID NO: 29039 - DNA, 50 bp, homo sapien
gttctatattcaaagtcatattttcratccaaccatttttctccacctgc

SEQ ID NO: 29040 - DNA, 50 bp, homo sapien
tttctagaggaaaaaagtgaagtccrattcataaaaacaggaggctgaga

SEQ ID NO: 29041 - DNA, 50 bp, homo sapien
tccataactttcaagtccctgtgtayaagcattcaaggtggattgattta

SEQ ID NO: 29042 - DNA, 50 bp, homo sapien
tgggttgaagattgtgaactgctgayacttcatactggaaacaaatactt

SEQ ID NO: 29043 - DNA, 50 bp, homo sapien
tattagtgacctctatgtgatcaaamgttaaacaggttcaagaagctcca

SEQ ID NO: 29044 - DNA, 50 bp, homo sapien
tatcctagatgaactttaaatcaatraaatctctcaatggtgttataaat

SEQ ID NO: 29045 - DNA, 50 bp, homo sapien
acaaaaagtagttatatttacatgawagtttaatagtaagaaaatttttt

SEQ ID NO: 29046 - DNA, 50 bp, homo sapien
aatctactttaaaaaatatctgggamgttaataaaaaggtgccaaccttc

SEQ ID NO: 29047 - DNA, 50 bp, homo sapien
ctctgatttcatgtgctcttatatayacaacattttacaaagcttgtggc

SEQ ID NO: 29048 - DNA, 50 bp, homo sapien
taaggctgtcacccggactctccacygagcaggtttaattcctagccatc

SEQ ID NO: 29049 - DNA, 50 bp, homo sapien
atagttcaaatatctatgaagaaaaytacatttgtaggaatgattatcat

SEQ ID NO: 29050 - DNA, 50 bp, homo sapien
tctagattattttaagtagatttccrgatactttttaaatttaaaaaaat

SEQ ID NO: 29051 - DNA, 50 bp, homo sapien
tggtagcatatgggtctccttttaawtaacttcctgataaacctacagtt

SEQ ID NO: 29052 - DNA, 50 bp, homo sapien
aataacttcaaaactattttgctacratgtttcacttttaaaactgcaaa

SEQ ID NO: 29053 - DNA, 50 bp, homo sapien
ttgatccatatgatcattaccttacsagaaatgcctgaccaacaggtcat

SEQ ID NO: 29054 - DNA, 50 bp, homo sapien
aacaaagcagtggcttggtcctttaygaagagagtgaaagaaataagcaa

SEQ ID NO: 29055 - DNA, 50 bp, homo sapien
gggtttaaagaagagactgttgggamctatttatactcaagcatttaaag

SEQ ID NO: 29056 - DNA, 50 bp, homo sapien
gaaacaccaagaatttcagtaaataraggtagctgcggtgctaaatgcta

SEQ ID NO: 29057 - DNA, 50 bp, homo sapien
aatacagtatcaccaccagggtatgracagcgatacaatgaagatacagg

SEQ ID NO: 29058 - DNA, 50 bp, homo sapien
cttgcttttctgattgatgataaaamtagagagttaaaatttagctaaat

SEQ ID NO: 29059 - DNA, 50 bp, homo sapien
gaacttgacactgccaataatgacaycttcactgacatccaagcttcctg

SEQ ID NO: 29060 - DNA, 50 bp, homo sapien
aagagtgtacaattagttggagtcaytctagattttattttgttcttcta

SEQ ID NO: 29061 - DNA, 50 bp, homo sapien
acttcatttgttaagtgaatgaatamaatatatggctatatattagattc

SEQ ID NO: 29062 - DNA, 50 bp, homo sapien
ttaggaaatatttgagtaggtatccrgagtggacactcagtaagctttat

SEQ ID NO: 29063 - DNA, 50 bp, homo sapien
cagtgaagatcacatcttaaggtacracaagcagcaagtttagaaatggg

SEQ ID NO: 29064 - DNA, 50 bp, homo sapien
aatatagcttattatcctgatgacayagaataaatataaaaataaaaaca

SEQ ID NO: 29065 - DNA, 50 bp, homo sapien
cggtagccaaaatatcaaagtgagtsaaacacagttatataattaataca

SEQ ID NO: 29066 - DNA, 50 bp, homo sapien
tctgctaatttaactgataagggaayggtagccaaaatatcaaagtgagt

SEQ ID NO: 29067 - DNA, 50 bp, homo sapien
aactgtttttttgaccatggcttcargtttttctcacagattcatctaca

SEQ ID NO: 29068 - DNA, 50 bp, homo sapien
gagaacttagaatttcagagtatcargtagtaaaatgttgaaaagttttg

SEQ ID NO: 29069 - DNA, 50 bp, homo sapien
aatagagattttgactgaaattagasacttatatactaacaagcatgtaa

SEQ ID NO: 29070 - DNA, 50 bp, homo sapien
tattaaggagcctactctctgatacraactgtaattgactgatggatcta

SEQ ID NO: 29071 - DNA, 50 bp, homo sapien
aaagagttaatatatgtagggaagtsactaatgcattttcgggaaggtcc

SEQ ID NO: 29072 - DNA, 50 bp, homo sapien
atagccaaggtttggtatcaactgargtgtccaatagcaaataaatgtgt

SEQ ID NO: 29073 - DNA, 50 bp, homo sapien
tggtttcatgttattgtatataagamctgacatgaactctgtttacaata

SEQ ID NO: 29074 - DNA, 50 bp, homo sapien
aatacactcactaatattgttttatyaaatgatcacttgcaatatgagtt

SEQ ID NO: 29075 - DNA, 50 bp, homo sapien
ctagaaatttcaaattagtatctcaracattttttaaatggtataacaat

SEQ ID NO: 29076 - DNA, 50 bp, homo sapien
tatacaataacatgaaaccacactayatatgaggaaaagtcagacaattt

SEQ ID NO: 29077 - DNA, 50 bp, homo sapien
aaataaaaaataaaaattttaagtcycatacgaagaaatctataaagtaa

SEQ ID NO: 29078 - DNA, 50 bp, homo sapien
ttctgcaaactcttgttagcggaaaracaagaaatagtcatcactaatat

SEQ ID NO: 29079 - DNA, 50 bp, homo sapien
aggtaaaatacaggacccctggttawatttgtattatggataaataggga

SEQ ID NO: 29080 - DNA, 50 bp, homo sapien
gctttacagactaaatatattggaasaaaaattggagaaaaatgagcgag

SEQ ID NO: 29081 - DNA, 50 bp, homo sapien
caagaaatagtcatcactaatattaygctgtgagaaaaggtattggagac

SEQ ID NO: 29082 - DNA, 50 bp, homo sapien
catgaagcttagtcattgataagtcyattaaaaggtaagtgtttgtaaga

SEQ ID NO: 29083 - DNA, 50 bp, homo sapien
agcactgtaagtgatttgaaggatcyaaataaatgcctaagagtaaaact

SEQ ID NO: 29084 - DNA, 50 bp, homo sapien
gtggatttgcaccattatgcacatawgactttgggcaaatttagctatat

SEQ ID NO: 29085 - DNA, 50 bp, homo sapien
ctaaataaatgcctaagagtaaaacygtgtgcccaggctgtgttgataac

SEQ ID NO: 29086 - DNA, 50 bp, homo sapien
ctttcactatttttctgtctttggckatttcaattgagcattttatatga

SEQ ID NO: 29087 - DNA, 50 bp, homo sapien
aacaaggcagtgataatttctcaacmagttggctgttaaaacaaactctg

SEQ ID NO: 29088 - DNA, 50 bp, homo sapien
taacagagttttgaagctctgttaaygtttaaatgtcaatgctttatttc

SEQ ID NO: 29089 - DNA, 50 bp, homo sapien
tttgaatataaggcttgtaatacaakttaatagggttgagttgtgtaaaa

SEQ ID NO: 29090 - DNA, 50 bp, homo sapien
gtgctttaaattgaaggtttctgtcyaatgaatttaaaagacaactacat

SEQ ID NO: 29091 - DNA, 50 bp, homo sapien
aatacccagtatagttatatgagtcmgaaataaactgtgttaaaacacta

SEQ ID NO: 29092 - DNA, 50 bp, homo sapien
atggcaaccttgaaagttatctgtgraagctgatggaggctttacttaaa

SEQ ID NO: 29093 - DNA, 50 bp, homo sapien
taaagatgaatgagaagaacttagcragagtcagggctgtaacttcactt

SEQ ID NO: 29094 - DNA, 50 bp, homo sapien
tcaaaaaacaattttggcgctttgasatagtgatatacaaatttatttct

SEQ ID NO: 29095 - DNA, 50 bp, homo sapien
aaactagaacttcttctttctgaccyatcaaaattgtcactctttaggtc

SEQ ID NO: 29096 - DNA, 50 bp, homo sapien
caagatttgttaggaagtaatgtaayccaagatggtgcatcagtatcctg

SEQ ID NO: 29097 - DNA, 50 bp, homo sapien
ggacttgtacctggaattgcggttgracgagtacttttaagtgaccacca

SEQ ID NO: 29098 - DNA, 50 bp, homo sapien
aaacaatcatgaatttttctttaacrcggcaacagaaatgaattctctat

SEQ ID NO: 29099 - DNA, 50 bp, homo sapien
ttgatcatatctattcacacagttaygaccacttctgtatacataaatat

SEQ ID NO: 29100 - DNA, 50 bp, homo sapien
ctccaggaaccattagccatgctagyagatagttaaaggagtgggtttgg

SEQ ID NO: 29101 - DNA, 50 bp, homo sapien
ctttacatgcatatgccgatactgayggagaaatctggttaaaattaaag

SEQ ID NO: 29102 - DNA, 50 bp, homo sapien
cagtgttaagatattaaagacaaackggaataaacctacacatcataatg

SEQ ID NO: 29103 - DNA, 50 bp, homo sapien
atgacttctaaatcagcatgttaaartatttgaagtaaggatagtatata

SEQ ID NO: 29104 - DNA, 50 bp, homo sapien
aacaaaggaaacatactgaaattcaytcttcttcttgtaagacaataagc

SEQ ID NO: 29105 - DNA, 50 bp, homo sapien
ataaatttattccaaatgggctgaartaggttcaaaatgtcatcaagctt

SEQ ID NO: 29106 - DNA, 50 bp, homo sapien
gataatgaaaatatcaagtccattaytaagataaattagaaatgaatgta

SEQ ID NO: 29107 - DNA, 50 bp, homo sapien
tagaatagaggtggttatatgatgaygctaaagtgaaatagaaacactgg

SEQ ID NO: 29108 - DNA, 50 bp, homo sapien
ttgatattttcattatctatgtaaaygaagtggtagtttatcagactgaa

SEQ ID NO: 29109 - DNA, 50 bp, homo sapien
tttcaatactgaaaatgaccttggaygggattagtagcatagtggatact

SEQ ID NO: 29110 - DNA, 50 bp, homo sapien
gagatcttcagtgctttccgttggakatttgagctaattattgcttagtg

SEQ ID NO: 29111 - DNA, 50 bp, homo sapien
cactgtcatctgaaactgagactaayggtcttccttataaagatatctgc

SEQ ID NO: 29112 - DNA, 50 bp, homo sapien
gattcatattgtttgtttctatatcyatgctgaaatctggctctcttgat

SEQ ID NO: 29113 - DNA, 50 bp, homo sapien
agtatgagatcaaaaagtaaactcartgaatgatgagctctaagatccag

SEQ ID NO: 29114 - DNA, 50 bp, homo sapien
tttaattaactgcaaggaaccatgaraccgttttgagtggagtcaaaagg

SEQ ID NO: 29115 - DNA, 50 bp, homo sapien
aacgtgctttaatggcactgagaaayggtagaaagtttgtcttcagtggg

SEQ ID NO: 29116 - DNA, 50 bp, homo sapien
ctcaagaaatttttaggagcataacygtacacaggaaagatgaaaagtat

SEQ ID NO: 29117 - DNA, 50 bp, homo sapien
tttgtaaaactaagcagatgcatgartacttaattatcatcctctttttc

SEQ ID NO: 29118 - DNA, 50 bp, homo sapien
gcattattcttgctctctaagaacawgaagtcacgagagaaagtcagagg

SEQ ID NO: 29119 - DNA, 50 bp, homo sapien
atagaaacctgcataagtagtccaarcaaaaaagtggctagtggtggcat

SEQ ID NO: 29120 - DNA, 50 bp, homo sapien
ttcaactttttttcaaccacgctcaytctattagacaactaagaggtcta

SEQ ID NO: 29121 - DNA, 50 bp, homo sapien
agggcattgactaatttttttccacrcatgttcatatatattaaatggaa

SEQ ID NO: 29122 - DNA, 50 bp, homo sapien
tttttttctttccaggtaacccaaaygaagacaattagtgacagcagtgg

SEQ ID NO: 29123 - DNA, 50 bp, homo sapien
tcgtttcttaaaggtcaaagttatakctaagacactgaatgttttagtgc

SEQ ID NO: 29124 - DNA, 50 bp, homo sapien
aaaaatagaacagtcaaaagtcagarcattgtaagatcttttcacaaact

SEQ ID NO: 29125 - DNA, 50 bp, homo sapien
gtgcttacataaatagcatatgatasacggtaattaaatgtagaaaagct

SEQ ID NO: 29126 - DNA, 50 bp, homo sapien
atatagcatcaaacgttgcatttaayggtcatgtctctgaaatactgtgc

SEQ ID NO: 29127 - DNA, 50 bp, homo sapien
ttaccttgagcattttctagactcgyattgtggacatgaattctgttcat

SEQ ID NO: 29128 - DNA, 50 bp, homo sapien
atcttaactttctgcaattggaaatwatgtgggtaggtgatgcatcgccc

SEQ ID NO: 29129 - DNA, 50 bp, homo sapien
cagcaacttttctctaatttgctaaygagtaatgagattaaactcatagg

SEQ ID NO: 29130 - DNA, 50 bp, homo sapien
gagaagtaatattttcctccaatacyggttgagtaatatatatattcttt

SEQ ID NO: 29131 - DNA, 50 bp, homo sapien
aaggatttgttaaaactatgttgaaygatgatttcaataggctagtgact

SEQ ID NO: 29132 - DNA, 50 bp, homo sapien
tttaggaaataaaactcatctgttaycattatacaaaataacttgaggtg

SEQ ID NO: 29133 - DNA, 50 bp, homo sapien
atacttgaaattttttttgaatgtaracacaagaataacatttgaactat

SEQ ID NO: 29134 - DNA, 50 bp, homo sapien
gttgtttctgaaccataaggtaaacragtgatgtattttctttcattctc

SEQ ID NO: 29135 - DNA, 50 bp, homo sapien
gttatctgaatgatataaaccatgargcaataagtaatattggttttgaa

SEQ ID NO: 29136 - DNA, 50 bp, homo sapien
gtggatgcttaatgaatcgcatttargaatgtcatttctaatggctttaa

SEQ ID NO: 29137 - DNA, 50 bp, homo sapien
tgggaaaattgacagagttctcacartgctacaattctatgaatttaacc

SEQ ID NO: 29138 - DNA, 50 bp, homo sapien
caaatttcacacaaattgacatttcrcacagttgttttattctctctctc

SEQ ID NO: 29139 - DNA, 50 bp, homo sapien
gacaatggagagagaacctatacaayggaggtgcgacataattaatatcc

SEQ ID NO: 29140 - DNA, 50 bp, homo sapien
tggattttcaggattcgggccagtgragagaataagaaagaacattcctg

SEQ ID NO: 29141 - DNA, 32 bp, homo sapien
gaaaaaaaaatggctaygatggacagtggaag

SEQ ID NO: 29142 - DNA, 50 bp, homo sapien
tactaactaatccttctgactgttcrataataattaaattgtatggtgtt

SEQ ID NO: 29143 - DNA, 50 bp, homo sapien
tccttgttggtatccattacaaaaamgtcaattgcaaatggttttgtatt

SEQ ID NO: 29144 - DNA, 50 bp, homo sapien
taaaagtctttactaaattgaaataygtcaatgttagagtgtagaagttt

SEQ ID NO: 29145 - DNA, 50 bp, homo sapien
agaaaaaaaaaatcataaaacctgarctctttcttggagatatctaaaat

SEQ ID NO: 29146 - DNA, 50 bp, homo sapien
tcatctcctggttctaatttcatacratgatctgagcttagatcactctt

SEQ ID NO: 29147 - DNA, 50 bp, homo sapien
ttgcagcagaaatttgtcaaaccacrccatcaaagattttagagtacaaa

SEQ ID NO: 29148 - DNA, 50 bp, homo sapien
gtaaatatgatatttgtagtatttcmaaagtagatatctgaaacggtatt

SEQ ID NO: 29149 - DNA, 50 bp, homo sapien
gcatttttttcacaatttagtgtcartgaaggagataaacagttaaaagt

SEQ ID NO: 29150 - DNA, 50 bp, homo sapien
catttcctgcttcttgtttggactayctgctgcaatttgtttgtcattta

SEQ ID NO: 29151 - DNA, 50 bp, homo sapien
atattggctgtgggtttgttacagayggttgttattattttgaagtatgt

SEQ ID NO: 29152 - DNA, 50 bp, homo sapien
ttatgttaattaataggtatataaarattctttgctgtgtatagttgtaa

SEQ ID NO: 29153 - DNA, 50 bp, homo sapien
agaacatgagcaaaacacttttttasaatataagttggaacaggaaggca

SEQ ID NO: 29154 - DNA, 50 bp, homo sapien
ttttcacaatgaaaacttttatcaaygatgctatttttctaaaaactttt

SEQ ID NO: 29155 - DNA, 50 bp, homo sapien
aaacatttctgaatgtaggataatgrcatgtttaccattaataacatttt

SEQ ID NO: 29156 - DNA, 50 bp, homo sapien
gtcattgttcttccaactctatctaygtgaaccacaccaactctgtttac

SEQ ID NO: 29157 - DNA, 50 bp, homo sapien
ggtaaataggataaacattcttattraagtcagaaacaagcaaaacatcc

SEQ ID NO: 29158 - DNA, 50 bp, homo sapien
acattcatcaatcactaggataacaractaatgataataattttgacttc

SEQ ID NO: 29159 - DNA, 50 bp, homo sapien
atatctaattgctcattaatcattayctaaatctcaagagtgtgggctaa

SEQ ID NO: 29160 - DNA, 50 bp, homo sapien
aataattaaatcaatttttattgaarctatcagataagtaagttattcta

SEQ ID NO: 29161 - DNA, 50 bp, homo sapien
agagacccaatacatctactacttaygaaaattaaaaccagatataaaag

SEQ ID NO: 29162 - DNA, 50 bp, homo sapien
atatgtttattatatatcttttttgraggatctggatacttatataggta

SEQ ID NO: 29163 - DNA, 50 bp, homo sapien
tatatcttggtgcttgacaatcctargagaaagcatgacctctgccactg

SEQ ID NO: 29164 - DNA, 50 bp, homo sapien
ctttggttttcttgatattaaaaaamtgtatactatggatagtcatctag

SEQ ID NO: 29165 - DNA, 50 bp, homo sapien
atatcttggcctcaagaatttccaartatagtttacttggattttcccaa

SEQ ID NO: 29166 - DNA, 50 bp, homo sapien
tcaacagaaaccaatgtgaaacttasgtaatagatatatgttttcatact

SEQ ID NO: 29167 - DNA, 50 bp, homo sapien
tgaggaattaagaagatgtttgttaygtaggaagtaggattaatacaagg

SEQ ID NO: 29168 - DNA, 50 bp, homo sapien
ggcataaaggaaatgacatctagctmaatcagaaaaatctgtgttcgagt

SEQ ID NO: 29169 - DNA, 50 bp, homo sapien
agtggctgattcaattataaaaagasatcagaggataaagcttggaaatt

SEQ ID NO: 29170 - DNA, 50 bp, homo sapien
ttattttaagggtctaaaggacttgyaagaaagtatgacaaaaataggca

SEQ ID NO: 29171 - DNA, 50 bp, homo sapien
gagagactttgatttggaagtgagcsaattgaggaaggaaactctaagga

SEQ ID NO: 29172 - DNA, 50 bp, homo sapien
tcaagtcacacaccatatacttacaytatatccagctaccttataactgg

SEQ ID NO: 29173 - DNA, 50 bp, homo sapien
aaaaattgatttaattattgtgttaygaatttctgattacttaaaagcct

SEQ ID NO: 29174 - DNA, 50 bp, homo sapien
caaatatgaagcttttctcagtatawcttaaaatgcaaattagattgtcc

SEQ ID NO: 29175 - DNA, 50 bp, homo sapien
tttatttctgaaactgtcttaagcaygtgaaactcagataaaagactttg

SEQ ID NO: 29176 - DNA, 50 bp, homo sapien
tggctcatggtgttggtcatttggakacttgcatgtgggatgtctccatg

SEQ ID NO: 29177 - DNA, 50 bp, homo sapien
taaaatgataagcagtagaaacaaakggttgaaagttgaaggtaatatca

SEQ ID NO: 29178 - DNA, 50 bp, homo sapien
ttacaagatattttgaatgtaactargcatgcgacctgtggtctaaagat

SEQ ID NO: 29179 - DNA, 50 bp, homo sapien
ttcaaattataaattatagattatayatttcaagcacagttattttggta

SEQ ID NO: 29180 - DNA, 50 bp, homo sapien
ggagcctcttaacaaattctagttgracaagaacattctcgatccatctt

SEQ ID NO: 29181 - DNA, 50 bp, homo sapien
gtcaccatagagaagcactataaatratcttgactctcagtcccttcaaa

SEQ ID NO: 29182 - DNA, 50 bp, homo sapien
attctctttcagctccaatgtcccawcctagtgcagttcctggaagatat

SEQ ID NO: 29183 - DNA, 50 bp, homo sapien
gctcttctaagaagtagtctttctasatgtttttcctaattagctaaatg

SEQ ID NO: 29184 - DNA, 50 bp, homo sapien
gagctacgcaatattctttttcataycctcaatacattacaatacctgag

SEQ ID NO: 29185 - DNA, 50 bp, homo sapien
gaaagcttctcttaggcaggagctaygcaatattctttttcataccctca

SEQ ID NO: 29186 - DNA, 50 bp, homo sapien
aactgttcatcttttgaatagtaccraggagatgactacaggtaatgcat

SEQ ID NO: 29187 - DNA, 50 bp, homo sapien
tcacaataatcaattagataaagacmaatcagtgtccattgggtttagca

SEQ ID NO: 29188 - DNA, 50 bp, homo sapien
tacatcaaatatgtatgtaaaaataycacaagagtctgaaaaactgaaat

SEQ ID NO: 29189 - DNA, 50 bp, homo sapien
tgttcctatcaacacttctcattgtsaatttgtttgtttagacgttttaa

SEQ ID NO: 29190 - DNA, 50 bp, homo sapien
tatgcagaatgttacagttattttgraaagtaatttggaagtcttcttag

SEQ ID NO: 29191 - DNA, 50 bp, homo sapien
atagcaaacatggtgaaaaagcatgratatgcacaaaatctgtcaattct

SEQ ID NO: 29192 - DNA, 50 bp, homo sapien
catcatgtaatttcctcaggtgaagkcatctaacatattatgtgtggtac

SEQ ID NO: 29193 - DNA, 50 bp, homo sapien
aatttgggtacctagttgtactctgrcaagcagaaaattaagacagcttt

SEQ ID NO: 29194 - DNA, 50 bp, homo sapien
agtttctggtaaaagcaggaattaayatgaggtaatcactcaagaaattt

SEQ ID NO: 29195 - DNA, 50 bp, homo sapien
ttccaacaaatacaggaggttactaycactcataggactgaataaacata

SEQ ID NO: 29196 - DNA, 50 bp, homo sapien
acataggaaaatgtggtgataacaayttcgggggttcctagagcatgtgg

SEQ ID NO: 29197 - DNA, 50 bp, homo sapien
cagtactgtctaaaggtggagaataytatcctaaggaaaaattgcaaaca

SEQ ID NO: 29198 - DNA, 50 bp, homo sapien
atcaattagttcacacgctggcatcraaagacagggccactgaatggttg

SEQ ID NO: 29199 - DNA, 50 bp, homo sapien
catactaggttaaatactgttcttcyaccatttcttagcattgctcattt

SEQ ID NO: 29200 - DNA, 50 bp, homo sapien
taagcttgttacattagaatgatggwcattgatatcaaggtttaagagtc

SEQ ID NO: 29201 - DNA, 50 bp, homo sapien
aactattccttcatagagaaactaaygtgtatatttttaataacaggttt

SEQ ID NO: 29202 - DNA, 50 bp, homo sapien
ggccactaacactaaaacagtcacaytgcatcatcattatagacttgtcc

SEQ ID NO: 29203 - DNA, 50 bp, homo sapien
aacacctgtgatttgcaatacaaaaygaatgtcaccaaggcatacagtca

SEQ ID NO: 29204 - DNA, 50 bp, homo sapien
tttgagaaatatgagattttgtaaartgacaagtcctacaaattattagt

SEQ ID NO: 29205 - DNA, 50 bp, homo sapien
aaagcattcattctttacttgatggyccacatggttacagaccccgataa

SEQ ID NO: 29206 - DNA, 50 bp, homo sapien
atagtgagaaaaaagaaggtggactragagtgatatagaacctaatctta

SEQ ID NO: 29207 - DNA, 50 bp, homo sapien
atgtcactacattctaactggaaacsatgtgatcccgacatttgctgctg

SEQ ID NO: 29208 - DNA, 50 bp, homo sapien
ctataacatggattgcaaaatactgwaagacagaaaagaaaaaccctctg

SEQ ID NO: 29209 - DNA, 50 bp, homo sapien
aggaggctttgcaaattacagactaygaagtacttgacatatagtttcta

SEQ ID NO: 29210 - DNA, 50 bp, homo sapien
gaagccatcttttttgagaagtacaycagtttaataaactctaagctctt

SEQ ID NO: 29211 - DNA, 50 bp, homo sapien
ccactttacacttagtaatgattcaratgactgtgattattatcaccata

SEQ ID NO: 29212 - DNA, 50 bp, homo sapien
agtatatatctcatgtacctatgcastatttatcctcagccatttgttaa

SEQ ID NO: 29213 - DNA, 50 bp, homo sapien
atgaaaccatgtttatgtttttacarcttttattccatttgactccatcc

SEQ ID NO: 29214 - DNA, 50 bp, homo sapien
taataataaataataattggattagyagctttatgatctcatttgaagaa

SEQ ID NO: 29215 - DNA, 50 bp, homo sapien
aaatacaacatgtggttattctaaawgacctttcttcagcctttttctga

SEQ ID NO: 29216 - DNA, 50 bp, homo sapien
taatgacaaagatacttaatactagracagtcagtcaggccaagcacaaa

SEQ ID NO: 29217 - DNA, 50 bp, homo sapien
acagctcatttaattaacaggagtamgagacaaaatgcaaatatttttag

SEQ ID NO: 29218 - DNA, 50 bp, homo sapien
gaccttagagcaatgaccttcaatcyatcaagaaactggagggaaaggaa

SEQ ID NO: 29219 - DNA, 50 bp, homo sapien
gaactatagatctttaattttaatamcacaaatacacaagaaaataacat

SEQ ID NO: 29220 - DNA, 50 bp, homo sapien
ggcacctctaggcttttcgttagtgwcaattaattatgaatacgcttgac

SEQ ID NO: 29221 - DNA, 50 bp, homo sapien
tgcttactcctaaataaattccacayagaaggctgtttttaaaaaatcat

SEQ ID NO: 29222 - DNA, 50 bp, homo sapien
tcccacactcaattcagaggaaatcmgaccttattctccctttcctcaac

SEQ ID NO: 29223 - DNA, 50 bp, homo sapien
atcctttatctctttggccaatccakgaaataaggtgagcacaaactgag

SEQ ID NO: 29224 - DNA, 50 bp, homo sapien
attactaaaacttgtgcctatacagwaaaatgacctaaaatgttttatat

SEQ ID NO: 29225 - DNA, 50 bp, homo sapien
tgtagttttatatgaacctataatartaagccagttcaggaatgatgcct

SEQ ID NO: 29226 - DNA, 50 bp, homo sapien
tttccattcacacaatgtacccagaycaaaacttcgatttaaaagtttgt

SEQ ID NO: 29227 - DNA, 50 bp, homo sapien
tgctcaataagggtttgcttgaagtyaagagaaattgaattgtttctcaa

SEQ ID NO: 29228 - DNA, 50 bp, homo sapien
gctttattttaatttgaaacttcacraatacgaaaccatttgaatcaaac

SEQ ID NO: 29229 - DNA, 50 bp, homo sapien
ctcaggtactgacattctaggactaygacaaggccatgtggtaattagtc

SEQ ID NO: 29230 - DNA, 50 bp, homo sapien
tttacaagtaaatatttcctaatgcrcttccatgaatttaaaatgttaaa

SEQ ID NO: 29231 - DNA, 50 bp, homo sapien
cttgctaccaatcctctgccatctcraaacccccatggtaacaacgaatc

SEQ ID NO: 29232 - DNA, 50 bp, homo sapien
atttctacagcttaattgcttacaawttaatgattcataatatttcacaa

SEQ ID NO: 29233 - DNA, 50 bp, homo sapien
tctcaatattaaaatcaaatttgacraacaagattcatgttgacagaatt

SEQ ID NO: 29234 - DNA, 50 bp, homo sapien
aataaagcttcagctgtcttccaaaratagtataagatgattgcttgcta

SEQ ID NO: 29235 - DNA, 50 bp, homo sapien
cagaaagctttagatgttctaccaastctatgctctcctcttctttctgg

SEQ ID NO: 29236 - DNA, 50 bp, homo sapien
tttagaaaaaaacaataactaggtartacaggaatctatacttttagttc

SEQ ID NO: 29237 - DNA, 50 bp, homo sapien
agaactgtgcagctgaatttctttawgtctgaaataatttgagtttgtcc

SEQ ID NO: 29238 - DNA, 50 bp, homo sapien
gtgtggaatttatttaggagtaagcraaagaggaagccaagttgagatac

SEQ ID NO: 29239 - DNA, 50 bp, homo sapien
atttttgagattatgctatagattaygttttagatcctacattttatttc

SEQ ID NO: 29240 - DNA, 50 bp, homo sapien
aaatgtattttcctagtcacagatayaaaaagtaaataactagtatgtgt

SEQ ID NO: 29241 - DNA, 50 bp, homo sapien
gatataaaacttatgtgaaagaaaasatagagattaatagaataaattat

SEQ ID NO: 29242 - DNA, 50 bp, homo sapien
gcttggtaatttcaccttcttatgcracttaagtacaagtgataaggtgt

SEQ ID NO: 29243 - DNA, 50 bp, homo sapien
acgctcttttaaatgtttggagtacmgaatgtctttcatgaaatcatctt

SEQ ID NO: 29244 - DNA, 50 bp, homo sapien
ttgaacaaagctttagactcttgcaraattgataaaggaggattcatatt

SEQ ID NO: 29245 - DNA, 50 bp, homo sapien
agggatagtttgtaatgattagctcragggtccaaaacacttagaatgta

SEQ ID NO: 29246 - DNA, 50 bp, homo sapien
acacacagctggcaaattagttttgyagaagagtttaagttttcctattt

SEQ ID NO: 29247 - DNA, 50 bp, homo sapien
agcagatgagatctgagaataaacartgacttaggccaagtacacaggtc

SEQ ID NO: 29248 - DNA, 50 bp, homo sapien
aaacaatattatttttctcatgataygtaactgaatactaatgttacttc

SEQ ID NO: 29249 - DNA, 50 bp, homo sapien
agatttgtcaaacttataatacgtcraaaaattgtgttattgtattttcc

SEQ ID NO: 29250 - DNA, 50 bp, homo sapien
tgtctacaatgtatgatgttgtatarggtccttttactttgtttctggga

SEQ ID NO: 29251 - DNA, 50 bp, homo sapien
gaagcacagcaggccgacagtttacsaggcgcgcgtgtctccaaatgtta

SEQ ID NO: 29252 - DNA, 50 bp, homo sapien
acacttcatcagcatttctaatttcrccctagtccagtgatctcgctctg

SEQ ID NO: 29253 - DNA, 50 bp, homo sapien
aatgtgaaacgaagcagtgtcacagkcaactgggcctctcccctggccca

SEQ ID NO: 29254 - DNA, 50 bp, homo sapien
ctgagacttccccgcagatctctacygaatatcttcttatcactttttca

SEQ ID NO: 29255 - DNA, 50 bp, homo sapien
gaaaaaacactagcaaaggaatctcragaatgttggttcgggacacagct

SEQ ID NO: 29256 - DNA, 50 bp, homo sapien
aagcactcacagagtcctaaaagaaytgtaacagaagctaagggaagaca

SEQ ID NO: 29257 - DNA, 50 bp, homo sapien
ggattgtaataagaaaggtttggaargtaccatctctaataattttactt

SEQ ID NO: 29258 - DNA, 50 bp, homo sapien
gagccacctgaaaccaccaaagatamacagtgattttctcccgaatctaa

SEQ ID NO: 29259 - DNA, 50 bp, homo sapien
ttctaacaggaacacagtcataccgracccttgattttaaattcgaacgc

SEQ ID NO: 29260 - DNA, 50 bp, homo sapien
gtatagtatgttttttccagctttcrattccaagagttttcttgtctaaa

SEQ ID NO: 29261 - DNA, 50 bp, homo sapien
tttatgccaagcgagcacctctatascatttgttgcacaattagcaattc

SEQ ID NO: 29262 - DNA, 50 bp, homo sapien
ttggtattaagggacaagatactgamcctttactgtttttccaaagttaa

SEQ ID NO: 29263 - DNA, 50 bp, homo sapien
tcttcagcattccttgagtttctaawtatgatgatctcacctatcagtgt

SEQ ID NO: 29264 - DNA, 50 bp, homo sapien
ttaaggaaccttttcagttctctacrccataaccttggaatcagttatta

SEQ ID NO: 29265 - DNA, 50 bp, homo sapien
gtggaatgggagataccagtaagaarccacggctgtagtcagacaagaag

SEQ ID NO: 29266 - DNA, 50 bp, homo sapien
tctcttgatgaggtaatggtaactamgtgccaaattatttatttcttggg

SEQ ID NO: 29267 - DNA, 50 bp, homo sapien
agagccagttcacacctctgacaaamagataatgctaccatgttgagctt

SEQ ID NO: 29268 - DNA, 50 bp, homo sapien
agctaccaaaaccactccaataaagyctgggaaatttacccccatggagg

SEQ ID NO: 29269 - DNA, 50 bp, homo sapien
tctgccttttatagattggttttaaratattatactcttctttttatttc

SEQ ID NO: 29270 - DNA, 50 bp, homo sapien
taaatttgagagtctccatgactccraccaaaaaatatacaacagaaata

SEQ ID NO: 29271 - DNA, 50 bp, homo sapien
ctgtgagaagctcataaccacctaaygcaaaaataagtccagaaatgcaa

SEQ ID NO: 29272 - DNA, 50 bp, homo sapien
ctcacttcacgctctgcagacatgaraataataatcttcacaagactttt

SEQ ID NO: 29273 - DNA, 50 bp, homo sapien
tttacaggggcaaactctgcaactargaaaaggagacagaactgtttcca

SEQ ID NO: 29274 - DNA, 50 bp, homo sapien
agacaaccttttgccaactgaaacaygttagttcttttgatctataattc

SEQ ID NO: 29275 - DNA, 50 bp, homo sapien
cagatggtttgatttatttagtacaygagttccagggaagaacgagcaag

SEQ ID NO: 29276 - DNA, 50 bp, homo sapien
ggtaatgggtcattatagcatatccrgaaatgtctgtgattgtttttatg

SEQ ID NO: 29277 - DNA, 50 bp, homo sapien
acaatatacacaagctggtatgagcraatctgaaataaacaataagatgg

SEQ ID NO: 29278 - DNA, 50 bp, homo sapien
ttctgtggaatgaaagctcgacacargtactttataagatccactcatgt

SEQ ID NO: 29279 - DNA, 50 bp, homo sapien
taagattaatgttttaatctcaccaytaggcatgactttattttatttat

SEQ ID NO: 29280 - DNA, 50 bp, homo sapien
tagtaacttcactttgaaatgtaccractttacttctaagaaatatggta

SEQ ID NO: 29281 - DNA, 50 bp, homo sapien
agtaaggttgtcagaacaagttcaayggaagcaagagttggtaacagtgg

SEQ ID NO: 29282 - DNA, 50 bp, homo sapien
aatgaaatataccatggagttacaaygagtgtttcctttctctcagaaaa

SEQ ID NO: 29283 - DNA, 50 bp, homo sapien
gcatggcattttacagatgtgacagragtctttaatttgaactcaaaata

SEQ ID NO: 29284 - DNA, 50 bp, homo sapien
attgcttaatattatgtatgactagsactgtacaaaatatagaacacttg

SEQ ID NO: 29285 - DNA, 50 bp, homo sapien
aatatctcatgatgtgtgccttcaayacctgttcacaattccgctttctt

SEQ ID NO: 29286 - DNA, 50 bp, homo sapien
tttattcttctatggaaaccatagcwaaccgtctatttctgaagtatgaa

SEQ ID NO: 29287 - DNA, 50 bp, homo sapien
tgaaaagtggttgatatctaggaaaytgagttattagagaattagggaaa

SEQ ID NO: 29288 - DNA, 50 bp, homo sapien
atgatctaactagattaattctacayggaaacaaccagcatttagtaacc

SEQ ID NO: 29289 - DNA, 50 bp, homo sapien
tagcaaagtgacacaaagacaaaaarcggtattcagaatgtatctagagc

SEQ ID NO: 29290 - DNA, 50 bp, homo sapien
tatggcaattaattagaatgctctaygtaagacgtgtccatccctttgaa

SEQ ID NO: 29291 - DNA, 50 bp, homo sapien
ccaatgtacaggcatggcttctacarattggcttaatgcctcttcataca

SEQ ID NO: 29292 - DNA, 50 bp, homo sapien
attcagaaaaaaaaaaataggattcratgttgtgttttatgcccagtttg

SEQ ID NO: 29293 - DNA, 50 bp, homo sapien
ttgatatacacacttaacttatggcyaattggtgaactgtcatggactgg

SEQ ID NO: 29294 - DNA, 50 bp, homo sapien
gcaattaggtaattggcattgataargttgacctgaaaggaaattgtgaa

SEQ ID NO: 29295 - DNA, 50 bp, homo sapien
ttgggaggcaatgttccatgaataastcctcgcatctacatattcagagc

SEQ ID NO: 29296 - DNA, 50 bp, homo sapien
aaaaatgctgccctttctcatctcartattcagaaggtggcaaaaagcac

SEQ ID NO: 29297 - DNA, 50 bp, homo sapien
tgtatcaggctgcacttttagggaamctaatgcattttttcaaaacagaa

SEQ ID NO: 29298 - DNA, 50 bp, homo sapien
tactctgaaggactagcattaacaayacctaaatttgtgattaggtctga

SEQ ID NO: 29299 - DNA, 50 bp, homo sapien
atttaactgttagtaactaaatacasaacagagttttcagtcatctaaca

SEQ ID NO: 29300 - DNA, 50 bp, homo sapien
atgtgtagggactagaggtcgttacyaagcccttcagaagtaagctgagt

SEQ ID NO: 29301 - DNA, 50 bp, homo sapien
tgattttcatgctatctgccaccgcygatgaaacaaaacagtcctcacgt

SEQ ID NO: 29302 - DNA, 50 bp, homo sapien
aacatattttaaaatccagatcgtargaagtgtcacctggcccctcaccc

SEQ ID NO: 29303 - DNA, 50 bp, homo sapien
aataaatatattcagtataattggcraaccaggtttctcaactgtcagag

SEQ ID NO: 29304 - DNA, 50 bp, homo sapien
cttcataaaatgaacatattgtatasagtgattacaaactgaaaaaacaa

SEQ ID NO: 29305 - DNA, 50 bp, homo sapien
aatcagccaaatccatattaagtgayagtccacaaaatatctaggctatg

SEQ ID NO: 29306 - DNA, 50 bp, homo sapien
acctgtaaatgattacgatgtactayaccactctttggagtaaaagttga

SEQ ID NO: 29307 - DNA, 50 bp, homo sapien
cagataacaggaccttgaagacttaygacacagagaagcaattaatatgg

SEQ ID NO: 29308 - DNA, 50 bp, homo sapien
tattgtgttctgcaatgcgatcagayatattcagcctctgaagttaaaac

SEQ ID NO: 29309 - DNA, 50 bp, homo sapien
gaacttcaattcactttataagtacygcgtgctaaccaattgtgccactg

SEQ ID NO: 29310 - DNA, 50 bp, homo sapien
tttctcatattccattctctgtaagkcctgttctttaatttcaatattta

SEQ ID NO: 29311 - DNA, 50 bp, homo sapien
ttttagaaactctaactcttaaaaawtgcagtggagcaaatgaattaatg

SEQ ID NO: 29312 - DNA, 50 bp, homo sapien
tgtgagggggagaacggtgctttaamgttattatttcactgaaagagcta

SEQ ID NO: 29313 - DNA, 50 bp, homo sapien
atggtgctgaccaaacacatattaaktgctcgataaatccctgttgatca

SEQ ID NO: 29314 - DNA, 50 bp, homo sapien
atccaactacttctatcatctccacygttattattttagtccaaactaag

SEQ ID NO: 29315 - DNA, 50 bp, homo sapien
aaaacagagcaggatctctagttcasaaagggtaagaggcaggcatagtt

SEQ ID NO: 29316 - DNA, 50 bp, homo sapien
gtgacgcagactgttaaaaacagaayatcaccttggactttcatttctac

SEQ ID NO: 29317 - DNA, 50 bp, homo sapien
gggtccatgaccagaaggaataagayggtgttctaagaagacagcccact

SEQ ID NO: 29318 - DNA, 50 bp, homo sapien
tgcctgagtgtataatgcaaaaatascatccagagattatatatttctta

SEQ ID NO: 29319 - DNA, 50 bp, homo sapien
ttattaatacatttaaaaataaatgsatgactaattaaaactataaagga

SEQ ID NO: 29320 - DNA, 50 bp, homo sapien
ttttttgtatgtgtttgttcagttasagagttcttacattactaagaaga

SEQ ID NO: 29321 - DNA, 50 bp, homo sapien
aatcagtaactacaaaagtcttgaartgcagctagattcttggtagattg

SEQ ID NO: 29322 - DNA, 50 bp, homo sapien
cagaaaatgtgcaaaactggctttasgtacaacactaattttctaaaatg

SEQ ID NO: 29323 - DNA, 50 bp, homo sapien
ccaaagacaagttgtagaacccagayggtcattgagaattgttgagcctg

SEQ ID NO: 29324 - DNA, 50 bp, homo sapien
tccatgttttcttcaaaaaaaccacrctatatcatttttctaatcatcaa

SEQ ID NO: 29325 - DNA, 50 bp, homo sapien
ttaaatcagatatgcattatccaaarttaagaaatttaaacatttaaaat

SEQ ID NO: 29326 - DNA, 50 bp, homo sapien
ctgcccccaaaataaaattttcaccrcgagtcagggatcggcaaacattt

SEQ ID NO: 29327 - DNA, 50 bp, homo sapien
ctacataaagtatatgctttcgacaytctgctcattattgtcatgtgaga

SEQ ID NO: 29328 - DNA, 50 bp, homo sapien
tcctattcttctgggcaaatgtggaygaaaaggtcacttgctacctttga

SEQ ID NO: 29329 - DNA, 50 bp, homo sapien
aaagcatatactttatgtagacgatyaagtctttgctaagatgtgatggt

SEQ ID NO: 29330 - DNA, 50 bp, homo sapien
ctgacagaattcctgccatagatgartaaagcatttctgagaacccatgc

SEQ ID NO: 29331 - DNA, 50 bp, homo sapien
atttttcttacacagggaactaatawcccactccacataattttgggctt

SEQ ID NO: 29332 - DNA, 50 bp, homo sapien
ctcataaaagattaatgtgtttttargctaaataatctaattagccaatg

SEQ ID NO: 29333 - DNA, 50 bp, homo sapien
aaaagctttggtgaattacacaaaaycctggaatacagatacttaataga

SEQ ID NO: 29334 - DNA, 50 bp, homo sapien
atctttaataagattctaggctataygtgcctttggttgaattctcctga

SEQ ID NO: 29335 - DNA, 50 bp, homo sapien
catataaaattattaatgcgcatggragagaatcatagagtggttgcccc

SEQ ID NO: 29336 - DNA, 50 bp, homo sapien
agctctttaccctagggctattaacygtataacatggatattgagaggaa

SEQ ID NO: 29337 - DNA, 50 bp, homo sapien
ataatgccagacctagtgatactaasaaggcagactaattatagaaaata

SEQ ID NO: 29338 - DNA, 50 bp, homo sapien
aaaggaccctttatttttatcactcraattatcttgctccctttttgcct

SEQ ID NO: 29339 - DNA, 50 bp, homo sapien
taaggtattttactaaaataagatgscatagttttcacgttaccatttct

SEQ ID NO: 29340 - DNA, 50 bp, homo sapien
gcttttgtgctattattatttaataygtatggagagaaataatgcattta

SEQ ID NO: 29341 - DNA, 50 bp, homo sapien
ttaatatgggaatttgacttcccaarggtaaatgtaaacgtacagacata

SEQ ID NO: 29342 - DNA, 50 bp, homo sapien
cgaatacatatcacacaaaaacatgsatctttctagtctcataaccagac

SEQ ID NO: 29343 - DNA, 50 bp, homo sapien
tcaatttgaatgtagaattctcctaygaccattcaataacacttgtgaac

SEQ ID NO: 29344 - DNA, 50 bp, homo sapien
gacttgcaaaggacaggaaagttcamtcctatattttgaaggcactatat

SEQ ID NO: 29345 - DNA, 50 bp, homo sapien
tcaatctatttgctattgctgtgtcwcttctagaaactcctcattgtcct

SEQ ID NO: 29346 - DNA, 50 bp, homo sapien
gtccctcaactggactgacaaaatayacttcaaaagcaataaactgttta

SEQ ID NO: 29347 - DNA, 50 bp, homo sapien
gacagccaaatcgtatctttagagayccacacatgttagaggatgtcttt

SEQ ID NO: 29348 - DNA, 50 bp, homo sapien
attattcacaataacaaagacatcartcaatccaaatacccatcaatgat

SEQ ID NO: 29349 - DNA, 50 bp, homo sapien
tatcctttcactgaacactgaaacawatattgagaaccttctttgtcaag

SEQ ID NO: 29350 - DNA, 50 bp, homo sapien
aaatgatacatgtacttattccataycactggacatcgaagttattccca

SEQ ID NO: 29351 - DNA, 50 bp, homo sapien
tcccatattaaattactgaacaacamgaggtggtattatatgctttccta

SEQ ID NO: 29352 - DNA, 50 bp, homo sapien
tcagtagtctgaattctagtttatasctcagaattaaagtttacacctca

SEQ ID NO: 29353 - DNA, 50 bp, homo sapien
ccaccccatcagacggatagtagaaygaacattaaccctgaaaacatctt

SEQ ID NO: 29354 - DNA, 50 bp, homo sapien
accttatttgtgcttaatccccacartaaagagcaaaaggaaaatatctt

SEQ ID NO: 29355 - DNA, 50 bp, homo sapien
atttataataatgcagtcaaaacaarcaattcttaactcatagtggttgc

SEQ ID NO: 29356 - DNA, 50 bp, homo sapien
acaaagttttaaggttcaggaaagamtagccttctccttatgataattat

SEQ ID NO: 29357 - DNA, 50 bp, homo sapien
agcagtgataaatagcttgggatcaraaataactagaaaatttcactcct

SEQ ID NO: 29358 - DNA, 50 bp, homo sapien
atagtttctacattaaacttatcaawctgccagtgtatttctttacaatg

SEQ ID NO: 29359 - DNA, 50 bp, homo sapien
aaaaagcttatcaaattcacagaacygaaatgagggtccttgggaacaga

SEQ ID NO: 29360 - DNA, 50 bp, homo sapien
gatggtaaggaacaattagttaaggrataagattagtttcgagtttttct

SEQ ID NO: 29361 - DNA, 50 bp, homo sapien
aacaaagccaatttaggagagccgawatggacaatgattcttgctgcagt

SEQ ID NO: 29362 - DNA, 50 bp, homo sapien
gagactacattaattggaactgttakgccaacctttacgatgacccattt

SEQ ID NO: 29363 - DNA, 50 bp, homo sapien
tgactgcttttgactcctttataggycctacttcaaggcacatccaggaa

SEQ ID NO: 29364 - DNA, 50 bp, homo sapien
accagagataattacctttattaaaygattagtctttctagcaaaatctt

SEQ ID NO: 29365 - DNA, 50 bp, homo sapien
aagccaagacaaagccatatattgargtcttttgaacattattttgaaac

SEQ ID NO: 29366 - DNA, 50 bp, homo sapien
ttttaaaatatattcattactaaagwacgtgagttttaagccaggggtgg

SEQ ID NO: 29367 - DNA, 50 bp, homo sapien
ggttcaatcaggattattccatgggycatatcaaagttcctcactgcacc

SEQ ID NO: 29368 - DNA, 50 bp, homo sapien
atatcaatactattaagttagcatgycaaataaaaaggaagcttatacta

SEQ ID NO: 29369 - DNA, 50 bp, homo sapien
catcaatagcccaagactattaaagraaaggcgaaaactggtaccagaaa

SEQ ID NO: 29370 - DNA, 50 bp, homo sapien
caagtaactttctgaaatgctgagakaaactggtactttaaaatagataa

SEQ ID NO: 29371 - DNA, 50 bp, homo sapien
taaattttaaagcagcatcacaaaaygaataaaataatttcatgtgttcc

SEQ ID NO: 29372 - DNA, 50 bp, homo sapien
ttttcaaattttggtcatgttgaaarttgctggtttatactttttttttt

SEQ ID NO: 29373 - DNA, 50 bp, homo sapien
aattatttagattctagaaaaaaatmaatagtatgagcaaacaaattgag

SEQ ID NO: 29374 - DNA, 50 bp, homo sapien
gttcttagtaatcacataggagaaarttggattagaggaacatagaagaa

SEQ ID NO: 29375 - DNA, 50 bp, homo sapien
gaagctgcttaacatttgatcaaaarctctgtccagtcaattcctgcttc

SEQ ID NO: 29376 - DNA, 50 bp, homo sapien
tggtttgacctaagtatttatgtaaktatagcaagaacaatgactgaagc

SEQ ID NO: 29377 - DNA, 50 bp, homo sapien
agagcttttgatcaaatgttaagcarcttctgggatatttggcattttta

SEQ ID NO: 29378 - DNA, 50 bp, homo sapien
ataaccactattctaaaagctaatayggtgatcaacactcaacctctagg

SEQ ID NO: 29379 - DNA, 50 bp, homo sapien
cctatacctaccaatgaatgaaagaygtgaatgtataaatgctaaatcta

SEQ ID NO: 29380 - DNA, 50 bp, homo sapien
tcttagactttgtaaagttaaaatakcgatagtggcttctattttgttat

SEQ ID NO: 29381 - DNA, 50 bp, homo sapien
agtacctgatagatactaatatttcratccatactccccttcttcctgcc

SEQ ID NO: 29382 - DNA, 50 bp, homo sapien
ctaggctcttccaaaaagtacatcargcaggtgaagtttacacctctaac

SEQ ID NO: 29383 - DNA, 50 bp, homo sapien
aatattctttctcttgtcttgtgcaraacaatcttcatctaccatgcatt

SEQ ID NO: 29384 - DNA, 50 bp, homo sapien
gacagcacacatagaactatacagcmattcaagtaaatatttttcccatt

SEQ ID NO: 29385 - DNA, 50 bp, homo sapien
aaggaataggtatttttgcccagaasgaagaatatgaataaaattaatgg

SEQ ID NO: 29386 - DNA, 50 bp, homo sapien
gcctttttcaccaactggcttagcayggtttatattttctctttttaatt

SEQ ID NO: 29387 - DNA, 50 bp, homo sapien
agtgagctgcttaaagcaatacttaygtgtcatctcagcattttcgtggg

SEQ ID NO: 29388 - DNA, 50 bp, homo sapien
aggcattgttttacatattaatatayagcatgaacaagaacgacatatct

SEQ ID NO: 29389 - DNA, 50 bp, homo sapien
gtctcaggcaaagctggatcccaackatttcacttgcagaaatgtctacg

SEQ ID NO: 29390 - DNA, 50 bp, homo sapien
tacagtatgcaacctagaagagaccyggcttcctacagtcttctccaaaa

SEQ ID NO: 29391 - DNA, 50 bp, homo sapien
ctgccaagtcctatagcagtgcctaraaagagcgtgggcatttttgttga

SEQ ID NO: 29392 - DNA, 50 bp, homo sapien
atacatcttattcatggacttgttcraaacatccttcttctatttgtgac

SEQ ID NO: 29393 - DNA, 50 bp, homo sapien
ctgcgatgctccctttgagtttgaargcctaggaatctgaaactgatgat

SEQ ID NO: 29394 - DNA, 50 bp, homo sapien
tgtgattaggactatagtgaacagcrcagagatcctgtcctcttgaagct

SEQ ID NO: 29395 - DNA, 50 bp, homo sapien
atatatttgtggccagttaggaaagrcttcagagaggagatggaaggtac

SEQ ID NO: 29396 - DNA, 50 bp, homo sapien
tgcactaaatataaatgaagagcaartaagataaatattatacaccaggg

SEQ ID NO: 29397 - DNA, 50 bp, homo sapien
ctcctgcagcaccaagttgtgaggayacctgagaaatgctctctcctagg

SEQ ID NO: 29398 - DNA, 50 bp, homo sapien
aaacaattcctcattttaaagaagaycttgaatccattttgctgtcttga

SEQ ID NO: 29399 - DNA, 50 bp, homo sapien
gctgaaaagaagttcagacgattgcrgatagactagtttggctgttgtgc

SEQ ID NO: 29400 - DNA, 50 bp, homo sapien
atggtagaaagggcaaaaggaggatmaagtagactgtcttctaaaaaaga

SEQ ID NO: 29401 - DNA, 50 bp, homo sapien
aaaaatggacaaaatgattaaagacrgtcatttcaggccattagaaaatg

SEQ ID NO: 29402 - DNA, 50 bp, homo sapien
caataggttagttctccaaaaggaamaagacggccactggagccccagga

SEQ ID NO: 29403 - DNA, 50 bp, homo sapien
acccaaagaaatccatgcccaaacayattcttattaactgctgcaaacta

SEQ ID NO: 29404 - DNA, 50 bp, homo sapien
aaaggagccttgttctaacagcgtgrattacacatgtgcagtactcacat

SEQ ID NO: 29405 - DNA, 50 bp, homo sapien
acatgcatcgtttactatgtagtcaycaccaaattaaaaatggaaaaaaa

SEQ ID NO: 29406 - DNA, 50 bp, homo sapien
gttcatcgtggccaacggtggctaayagtgtgtaggtgacctgagaaaca

SEQ ID NO: 29407 - DNA, 50 bp, homo sapien
atacctttatctacccaaatatcctragactctgaaggaagcttaggctg

SEQ ID NO: 29408 - DNA, 50 bp, homo sapien
tgtctcagatattttgggttaatacwcatgaaatatctatttaggtgaat

SEQ ID NO: 29409 - DNA, 50 bp, homo sapien
ccttgctttctaaatgagttctgacracccccaacttctgtagtaggtgg

SEQ ID NO: 29410 - DNA, 50 bp, homo sapien
tcacagaagcctaatgaaaacacgayggagacacatccttggttgttctg

SEQ ID NO: 29411 - DNA, 50 bp, homo sapien
tttccttaaggcacatagacaaccamtcacataaaactcaaactaaaccc

SEQ ID NO: 29412 - DNA, 50 bp, homo sapien
cagacattcctatcagaaatcatcakatgtgttataattaaattgtaggt

SEQ ID NO: 29413 - DNA, 50 bp, homo sapien
tgggttttcttctgaagataagtcasgagccatggaaagattcttaggta

SEQ ID NO: 29414 - DNA, 50 bp, homo sapien
gacccagtcatgtcggtctactttarctgtgaaaggaagatagaaagtct

SEQ ID NO: 29415 - DNA, 50 bp, homo sapien
ggtctaagcccctggaacagaataargttaatgggctacatcttagccaa

SEQ ID NO: 29416 - DNA, 50 bp, homo sapien
atcggtaacagaaatattttcacaaygtcttaggtagaggaaaaaagtca

SEQ ID NO: 29417 - DNA, 50 bp, homo sapien
gacccttatcagagtgtctgtcttcrgaaatacttgagtcaaggagctgt

SEQ ID NO: 29418 - DNA, 50 bp, homo sapien
atcctcttaaaatagcctgccttcakaaaatatatagtttccttcatgca

SEQ ID NO: 29419 - DNA, 50 bp, homo sapien
taatttacttataaaaatattttaaktaggactccaataagataatatgt

SEQ ID NO: 29420 - DNA, 50 bp, homo sapien
gggtgttagccctgggttctaataaytcttgtgcaaataaagtaccgtat

SEQ ID NO: 29421 - DNA, 50 bp, homo sapien
ggaggggagatgaattgggactcatmaaatccaacttgctgggaaactga

SEQ ID NO: 29422 - DNA, 50 bp, homo sapien
tccaaactagaattgctttagatgaygggataacacaaggtgtcaaggct

SEQ ID NO: 29423 - DNA, 50 bp, homo sapien
ttttccttgcaactcaaaagaatccrgaaattagcaccctggactcacat

SEQ ID NO: 29424 - DNA, 50 bp, homo sapien
tttacctgaatattaagttcaaagayactctagtctctcaaaggaaacct

SEQ ID NO: 29425 - DNA, 50 bp, homo sapien
aagttcagttctcagccagacgatcyaaggtaacaaagggtgagaccctc

SEQ ID NO: 29426 - DNA, 50 bp, homo sapien
aagacagaaagagagtaaatcctacyataacttcaaggtcccagagataa

SEQ ID NO: 29427 - DNA, 50 bp, homo sapien
caacagattacagcagcattaacaaracctgggataccatcaccaatcaa

SEQ ID NO: 29428 - DNA, 50 bp, homo sapien
ctaagtaatttgaccagagaaaggamgaaaggtctcagctcatctaccca

SEQ ID NO: 29429 - DNA, 50 bp, homo sapien
ttctaacaactattgcaatttcaaartcatgttgagtaggaggagtactt

SEQ ID NO: 29430 - DNA, 50 bp, homo sapien
taaatacataaaattcagaagatgayaaaggaaaccaattacattgaaat

SEQ ID NO: 29431 - DNA, 50 bp, homo sapien
caaaaggaaaagagtcaaatcatgaygagataaatagcatgagttacgta

SEQ ID NO: 29432 - DNA, 50 bp, homo sapien
tccaaatgaaaagctcatgaaaacgyagtgatgtatcaacaaggaggtaa

SEQ ID NO: 29433 - DNA, 50 bp, homo sapien
ctttgtctgaaatatgggaataataktagtacttacttcagagtctatgt

SEQ ID NO: 29434 - DNA, 50 bp, homo sapien
tgaacaatattattttttataggtawgttgactcacattagctatttctg

SEQ ID NO: 29435 - DNA, 50 bp, homo sapien
tcacaagaggtctcccactggctcartcaataagcagtagcagcagcagc

SEQ ID NO: 29436 - DNA, 50 bp, homo sapien
ttaaaaatcagttaatatcctgctarctatcaccatccaaaaataagacc

SEQ ID NO: 29437 - DNA, 50 bp, homo sapien
attgtttaagcgtgcaattcaatgaygttaagaagatacacattgctatg

SEQ ID NO: 29438 - DNA, 50 bp, homo sapien
cagctctaggccaaataaataaccawcaaaaggacactccaaggggctgc

SEQ ID NO: 29439 - DNA, 50 bp, homo sapien
aagacaaaagacaagcaggactccawccattatgtcacgaatccttgcag

SEQ ID NO: 29440 - DNA, 50 bp, homo sapien
agacctttggattcctgtcctcagayaacaggacttttaaacattcagac

SEQ ID NO: 29441 - DNA, 50 bp, homo sapien
tggggagaaggtggattacctcttaygctccaagtagcaagtcatttaac

SEQ ID NO: 29442 - DNA, 50 bp, homo sapien
ggagccatgggttccatttgggacayaggtctctgccattgctgctcccc

SEQ ID NO: 29443 - DNA, 50 bp, homo sapien
catggctcactctgcctgttgtccaycggaaatcatctcagtgccctttt

SEQ ID NO: 29444 - DNA, 50 bp, homo sapien
cacatatttttaatttgacatccagratttttattataagcttaaataat

SEQ ID NO: 29445 - DNA, 50 bp, homo sapien
aagtgaaaacaagcatctatggtacrgcgtggtatgaactaaatattcag

SEQ ID NO: 29446 - DNA, 50 bp, homo sapien
gctgtagcaacagagaccagcgcaayggtactgtgaggacccaagaaaac

SEQ ID NO: 29447 - DNA, 50 bp, homo sapien
cagagaaagcaagagaggacataaaygaagaggatatatttctagtggca

SEQ ID NO: 29448 - DNA, 50 bp, homo sapien
aatccttaccacattgactgcttaartactttttctaataattataagca

SEQ ID NO: 29449 - DNA, 50 bp, homo sapien
tctgccacttgaagtctctataagckctttcattgagtctttcctgcctg

SEQ ID NO: 29450 - DNA, 50 bp, homo sapien
atgtgcttctaagccaacagtaaggyagtcatcagtgttgcagcagtgaa

SEQ ID NO: 29451 - DNA, 50 bp, homo sapien
tcaattttaagagctcttttgttccygaaatctttttttatagtctctta

SEQ ID NO: 29452 - DNA, 50 bp, homo sapien
tttgacttatcttcatttatttcaargcagtatttccttaaacttctctt

SEQ ID NO: 29453 - DNA, 50 bp, homo sapien
gtaagcataaatgtttcctacatagsccaaacgtgttgttttgaaagcta

SEQ ID NO: 29454 - DNA, 50 bp, homo sapien
ataatgtctctgagcttgtccctcawctataacagagagtaacagaatca

SEQ ID NO: 29455 - DNA, 50 bp, homo sapien
tcaaaattgccaccaggaaaggcgamtcatcttttagttctacagattct

SEQ ID NO: 29456 - DNA, 50 bp, homo sapien
taggagacctataattgattgtaagyataattgattgtaagtgctaagtg

SEQ ID NO: 29457 - DNA, 50 bp, homo sapien
cagtggagcttgctggttgacttacrctttatttcaggcatcaaaggcaa

SEQ ID NO: 29458 - DNA, 50 bp, homo sapien
atactgatctatttttagagttaagrcatttctagatatagaagcaaaaa

SEQ ID NO: 29459 - DNA, 50 bp, homo sapien
caaccttcctgcgagatcctgctcaygttacctcctaaatgctgttacgt

SEQ ID NO: 29460 - DNA, 50 bp, homo sapien
ggagagacttgacacaattacatacmaagaattcattgggaagagagagg

SEQ ID NO: 29461 - DNA, 50 bp, homo sapien
agaaagagccaaggttgatggagaaytgtggaagcgaaggagggtttttg

SEQ ID NO: 29462 - DNA, 50 bp, homo sapien
ttaatgggaaggaaatattacgatayggagacaaatatacatcactccaa

SEQ ID NO: 29463 - DNA, 50 bp, homo sapien
cttttattttgagtagcagtcattaraaagaactgggatatttgcttttc

SEQ ID NO: 29464 - DNA, 50 bp, homo sapien
agagaagcagaatgaggaagtgatayacagtaagaggcttattacaagac

SEQ ID NO: 29465 - DNA, 50 bp, homo sapien
acctgtttctgagataagtagcatarggcgcatttgaagaaatactattg

SEQ ID NO: 29466 - DNA, 50 bp, homo sapien
tcggctttgcgtgttgactatgctcrctgttaacatggtgccataaatta

SEQ ID NO: 29467 - DNA, 50 bp, homo sapien
caggcacatgaaggtatgcataaackgtcttcacatttaattttgtatga

SEQ ID NO: 29468 - DNA, 50 bp, homo sapien
taaagattaagaaaagataacaagaratgaataaatgaggtagtggaatt

SEQ ID NO: 29469 - DNA, 50 bp, homo sapien
aaaaatagctcccctaaatactgaarggccataaacctaggtacagaggg

SEQ ID NO: 29470 - DNA, 50 bp, homo sapien
ttgtctctaaaagccaattggtttaygcatttattcaataaacacttatt

SEQ ID NO: 29471 - DNA, 50 bp, homo sapien
ggaaaaacaaaaaggttatgagagaraaagatattaggttaagagccttc

SEQ ID NO: 29472 - DNA, 50 bp, homo sapien
aaaagataacaatatattagaaatasgcaagagatttgaataggcacttc

SEQ ID NO: 29473 - DNA, 50 bp, homo sapien
acgaactatccaatccaaatgttaaygctcatcttagcttactttctttt

SEQ ID NO: 29474 - DNA, 50 bp, homo sapien
gtagatacaggccagcagagaaataygtggtgtcttccagccatgactta

SEQ ID NO: 29475 - DNA, 50 bp, homo sapien
caaatagaaaacaccaatgatgataytactaccagcccagaaggctgatt

SEQ ID NO: 29476 - DNA, 50 bp, homo sapien
tcctcagaacacccattgccaaatasaaaacaccaatgatgatactacta

SEQ ID NO: 29477 - DNA, 50 bp, homo sapien
tagctccctttccctccttgtgcatwacaagaacacaagacattccttca

SEQ ID NO: 29478 - DNA, 50 bp, homo sapien
gagcaagtcagtcagcgatcagagcraagagaaatgctgtgacagctaca

SEQ ID NO: 29479 - DNA, 50 bp, homo sapien
ttacagaaccattgtctgaccttcgmaacgatggcgtgtatccctagaga

SEQ ID NO: 29480 - DNA, 50 bp, homo sapien
gatgcagaattaagatcatttgtgaytacagaaagagacaagaaaattaa

SEQ ID NO: 29481 - DNA, 50 bp, homo sapien
ccttctctgtttgaaatacttcctamagcaaacacaaaagtgggcaaaac

SEQ ID NO: 29482 - DNA, 50 bp, homo sapien
ggcaggaggcagaggttacaggcaamataagaaatcatggaggttataca

SEQ ID NO: 29483 - DNA, 50 bp, homo sapien
caaggctggggtccatagtgcatacsataggtttcagagggagagatggc

SEQ ID NO: 29484 - DNA, 50 bp, homo sapien
cattgttgcaggtgtactgattcaaygactatttttattcctactttacc

SEQ ID NO: 29485 - DNA, 50 bp, homo sapien
gagacaatgcactctgatatgactcrccaattgtacactgaattcaataa

SEQ ID NO: 29486 - DNA, 50 bp, homo sapien
gtaaaatctggccatcgtttaagcaytcttaggcaaacattagtctctcg

SEQ ID NO: 29487 - DNA, 50 bp, homo sapien
gacccggctgcaaccccactcggtcsatcttttatttatctgatttcctc

SEQ ID NO: 29488 - DNA, 50 bp, homo sapien
caaaattcaaatggggtgaaatccaygaacctctttatttactcttaata

SEQ ID NO: 29489 - DNA, 50 bp, homo sapien
agtaagtaatcactgaaaccttttaragaagctcaattcaaaattcaaat

SEQ ID NO: 29490 - DNA, 50 bp, homo sapien
agaactctaatgtattgaagcctatyaatggatccataataaaaataatt

SEQ ID NO: 29491 - DNA, 50 bp, homo sapien
gagaatttcttatggcaatgttgaaygtcaaaggaaactgattgttattt

SEQ ID NO: 29492 - DNA, 50 bp, homo sapien
caccactgatttgaaatcatcacgcrctccaaggaacattctcacaaatg

SEQ ID NO: 29493 - DNA, 50 bp, homo sapien
gataaaatattctctggcaacacaaktaagaaatcgataattaaaggaaa

SEQ ID NO: 29494 - DNA, 50 bp, homo sapien
ctttttttcctggatgactcatttamaagattggatggaaataggtttta

SEQ ID NO: 29495 - DNA, 50 bp, homo sapien
gaccctcgcatttaacttcgctctcsaacaattgatccatcatgccggga

SEQ ID NO: 29496 - DNA, 50 bp, homo sapien
aatttccttctcttccttttcatcasgcagtatttccaaaacaacctctg

SEQ ID NO: 29497 - DNA, 50 bp, homo sapien
aaacggtgattccaagccttcactamattagcagcttccatgtgtagtgt

SEQ ID NO: 29498 - DNA, 50 bp, homo sapien
ctaaaaatgaaagttttaaaatgtgraatagcatgattaatgaggacatt

SEQ ID NO: 29499 - DNA, 50 bp, homo sapien
tcatatggtggtttgtctccaataarcggtcacaagaacaaaagggggag

SEQ ID NO: 29500 - DNA, 50 bp, homo sapien
taaataatgtgcttgtttgctattgragccgatgcccctaagtaaagcta

SEQ ID NO: 29501 - DNA, 50 bp, homo sapien
gctctaatgaggcaagaggacgttayaccaaatactgtgggttaatttct

SEQ ID NO: 29502 - DNA, 50 bp, homo sapien
tgattgcattagccaaagcaagtcartaacctcgcctaacttccaagatg

SEQ ID NO: 29503 - DNA, 50 bp, homo sapien
aaagcaactaacatgcaatccttcartataaaggtagattataaacatcg

SEQ ID NO: 29504 - DNA, 50 bp, homo sapien
cggtagccatgatacatgctcagaartgtaaaacagaccatctgggagct

SEQ ID NO: 29505 - DNA, 50 bp, homo sapien
ctttggcatcatctttttatgatcaytcttcaaggactctttgtcttctt

SEQ ID NO: 29506 - DNA, 50 bp, homo sapien
ttttctgtcttgagtcaaaggtatcmaggaaccggtaaaaatctcatgta

SEQ ID NO: 29507 - DNA, 50 bp, homo sapien
gtcggcgcatggtgttagttatacartggtaaaaacatgggctgtagggc

SEQ ID NO: 29508 - DNA, 50 bp, homo sapien
tccctttatttagaaaaacaggcaastatctgcattgtcaaacactgctc

SEQ ID NO: 29509 - DNA, 50 bp, homo sapien
tgggcagaggcaggaccattgcagcraagaagtcctacagagcaatgaca

SEQ ID NO: 29510 - DNA, 50 bp, homo sapien
cttaatcttggatatttgtctcctargttgatgagaaattccaggagaag

SEQ ID NO: 29511 - DNA, 50 bp, homo sapien
ggcagactaacttgttagcttgcaartaggttataatttcagacccttca

SEQ ID NO: 29512 - DNA, 50 bp, homo sapien
attaggcccttaacatacaagtggayaatcaggaatttaaattgtttggc

SEQ ID NO: 29513 - DNA, 50 bp, homo sapien
tattccaccaataatttagcataccracagttactggtttgttaccaact

SEQ ID NO: 29514 - DNA, 50 bp, homo sapien
cagctcttttcactttcaatccatgmatttttcattatcgtacatttttc

SEQ ID NO: 29515 - DNA, 50 bp, homo sapien
tgcagttctccctgcaggctttctaygatctcatcccactcagaaactga

SEQ ID NO: 29516 - DNA, 50 bp, homo sapien
tgctctggtcataattagtctctaamctttcaaaatgcctgcttcagtga

SEQ ID NO: 29517 - DNA, 50 bp, homo sapien
ttagaagaatgttcaacattgataaytgaaggtcaactccgttctctggg

SEQ ID NO: 29518 - DNA, 50 bp, homo sapien
ggaagattgagatggaagttcctaasatctaggtgaaatccaagaagctg

SEQ ID NO: 29519 - DNA, 50 bp, homo sapien
tgccagaatatagccattgtctggcrcaaagcaggtatttaatggaggaa

SEQ ID NO: 29520 - DNA, 50 bp, homo sapien
tttccaaagtggagggaactacccasagaaaccactgcagaaatttgcag

SEQ ID NO: 29521 - DNA, 50 bp, homo sapien
ttaaatttattcaattctgtcctcamtatgtttttattttcttttaagta

SEQ ID NO: 29522 - DNA, 50 bp, homo sapien
ccacactcactcctctagtctgtaaratgtcagagaataacgcattgctc

SEQ ID NO: 29523 - DNA, 50 bp, homo sapien
ctctatatggaggatggacaacccaratatctaatgtaccgctaatttta

SEQ ID NO: 29524 - DNA, 50 bp, homo sapien
agagattctcggatgtttatactaastacattagaatttgaggtttaagt

SEQ ID NO: 29525 - DNA, 50 bp, homo sapien
ttaaaaccaaacactatcttataccyaataaaaaataatatgcaaagtcc

SEQ ID NO: 29526 - DNA, 50 bp, homo sapien
atctttggttgaaatgggaggattcragagaaaaaattatgtcatagaaa

SEQ ID NO: 29527 - DNA, 50 bp, homo sapien
taacatacttctgcaggctagccaarcaatcccagccatacttctgaaat

SEQ ID NO: 29528 - DNA, 50 bp, homo sapien
aaatgtgcttattattagttagaacrcctttggctatgaccggtatgcta

SEQ ID NO: 29529 - DNA, 50 bp, homo sapien
gttaaatcttgtgattctcagtagargtgtcctgcatatatggtggccat

SEQ ID NO: 29530 - DNA, 50 bp, homo sapien
tgtgaatgaatatacagagatataaygtgcatttcttaaggttaaaaatg

SEQ ID NO: 29531 - DNA, 50 bp, homo sapien
cattgctgattaaattgcacatataygatctcctttctcttcccagtttc

SEQ ID NO: 29532 - DNA, 50 bp, homo sapien
atggagtggcttccaggagagtccayataagtgaagaagggctgtgctgc

SEQ ID NO: 29533 - DNA, 50 bp, homo sapien
acaactgtgtgaatatcatcctgtakgaacatatttaagaataacccttg

SEQ ID NO: 29534 - DNA, 50 bp, homo sapien
aagttacaactagaaggctgatttakattttttggccaaagttatatgtt

SEQ ID NO: 29535 - DNA, 50 bp, homo sapien
tatttgactatattataattgattamctctatctaaaactctctctgtgt

SEQ ID NO: 29536 - DNA, 50 bp, homo sapien
ccgccccagaggcaggcatcaatacrcagctcatcgagggaatcctggaa

SEQ ID NO: 29537 - DNA, 50 bp, homo sapien
cctcagaactacgtctcagaaggcarcggactggtcttgcaggtcccgga

SEQ ID NO: 29538 - DNA, 50 bp, homo sapien
gaaggaacaaaaattaaaaccatagyatcaggagtacaagaaaatagcac

SEQ ID NO: 29539 - DNA, 50 bp, homo sapien
atgtgaacagttcattatggttgccragtcgattcatgctttgaccaaaa

SEQ ID NO: 29540 - DNA, 50 bp, homo sapien
ccaagcctattgagacatctgtaggraagagagttcagctcactgggaag

SEQ ID NO: 29541 - DNA, 50 bp, homo sapien
cttaccaggtctggtaataaagctamcatttttcctgctaaccagcaggt

SEQ ID NO: 29542 - DNA, 50 bp, homo sapien
caatgttcaatgcataagatgaaaayaccaagaaatagtaatgaagtcat

SEQ ID NO: 29543 - DNA, 50 bp, homo sapien
aaagcttctttttcatccatggggaraaacctgcggaatcccctttaatg

SEQ ID NO: 29544 - DNA, 50 bp, homo sapien
aaatcaaaagaagaataatgtgtcaygtaaaaattatataaaattcaact

SEQ ID NO: 29545 - DNA, 50 bp, homo sapien
aactttaaaaggcttggatttgcatkaaattgatacagaaaaagaaaaaa

SEQ ID NO: 29546 - DNA, 50 bp, homo sapien
atgaaaggtgctctataaacgcaaartgcaattcctcattagcactgtca

SEQ ID NO: 29547 - DNA, 50 bp, homo sapien
tgtcagatgcaataattcagaggcaraattttctctaaagcttgagggag

SEQ ID NO: 29548 - DNA, 50 bp, homo sapien
gagcatgtcgaatgaagcaacggtayggtttaggagagcaggcctgaatt

SEQ ID NO: 29549 - DNA, 50 bp, homo sapien
ttttaaagcatttttcctccataackaggcccatgaaatagatgagcatt

SEQ ID NO: 29550 - DNA, 50 bp, homo sapien
cagatttttcttgcaaatgcctgtaytaaagaaaaacataatttaagccc

SEQ ID NO: 29551 - DNA, 50 bp, homo sapien
tacaagttattcccagtagctgaacmactagataaagctactcaaaaaat

SEQ ID NO: 29552 - DNA, 50 bp, homo sapien
tatggtcttagcagttgcactaagawgtcagaagaacctgctattgtggg

SEQ ID NO: 29553 - DNA, 50 bp, homo sapien
cccgcctcgggcctactggctcagcractgtgagggagaggtctgtattt

SEQ ID NO: 29554 - DNA, 50 bp, homo sapien
cacagccatgcaagtgtttatttaaktctcttaatgtaggaggcaaatca

SEQ ID NO: 29555 - DNA, 50 bp, homo sapien
ccctcttccacctgaggattcaccaytcaaaaccagttcttgtccacaat

SEQ ID NO: 29556 - DNA, 50 bp, homo sapien
caattgtctcccaattcttaattcayagctgcattaatcataagcctctc

SEQ ID NO: 29557 - DNA, 50 bp, homo sapien
attagataaaagatttgggcagacayggttttgcatctgcaccccataat

SEQ ID NO: 29558 - DNA, 50 bp, homo sapien
ggtacagttctacttggtaattagayaaaagatttgggcagacacggttt

SEQ ID NO: 29559 - DNA, 50 bp, homo sapien
atagatttcaggcctgtatggaaaarcatcatgaaaatccctgtcctgtt

SEQ ID NO: 29560 - DNA, 50 bp, homo sapien
tgtcaatacaagcacggattttagcygaagatggacttggataccatctc

SEQ ID NO: 29561 - DNA, 50 bp, homo sapien
tcatgatgcttttccatacaggcctraaatctataggtaacacaaacagt

SEQ ID NO: 29562 - DNA, 50 bp, homo sapien
tgttaccttaagaacctcaatactaycttaattgggcatgcccgtaattt

SEQ ID NO: 29563 - DNA, 50 bp, homo sapien
cacacccagcctcaacctgtcattawcaagaattttggtgcaaatatacc

SEQ ID NO: 29564 - DNA, 50 bp, homo sapien
gctgttgactatccaggggattttasaagttattcccagtagctgaacca

SEQ ID NO: 29565 - DNA, 50 bp, homo sapien
gattagatttatcactgatgaaaacrgtatttatagagttatttttagac

SEQ ID NO: 29566 - DNA, 50 bp, homo sapien
cctatgaccgtgcttaatcttctctsaattcttgcaagctcctctcatgc

SEQ ID NO: 29567 - DNA, 50 bp, homo sapien
aggggaaggtcaggcacattaactasctgatgtttgcttctgattaaagt

SEQ ID NO: 29568 - DNA, 50 bp, homo sapien
ctgccccttagcaggtcacagcctaygcaatatctcacagaactacaatt

SEQ ID NO: 29569 - DNA, 50 bp, homo sapien
accatgttgtcctccttatagtgcaraacgggaattttcccaaaaaactg

SEQ ID NO: 29570 - DNA, 50 bp, homo sapien
ttctcacagccttcttcccacgataragacctccaagtccaggctcatgc

SEQ ID NO: 29571 - DNA, 50 bp, homo sapien
tgttgtatgttggctcctgaagaaaytccacccatgtaccctgggttatg

SEQ ID NO: 29572 - DNA, 50 bp, homo sapien
ccctccctgacagcgcaacagaatcyaagggattacaggatgatttcagg

SEQ ID NO: 29573 - DNA, 50 bp, homo sapien
ggagacattttcttcacaatatagasagtttccaaaagaccacccccatg

SEQ ID NO: 29574 - DNA, 50 bp, homo sapien
acagtcctgtggcgcactatccctgraatcatcctgtaatcccttggatt

SEQ ID NO: 29575 - DNA, 50 bp, homo sapien
tgtacctaaagcaaactgctaggtartaaggattacaacaattgctaagc

SEQ ID NO: 29576 - DNA, 50 bp, homo sapien
atacataaaaccaactaaccaaggascctagagagtgaaccaaagcaagc

SEQ ID NO: 29577 - DNA, 50 bp, homo sapien
aacagttaaaatagaatacataataycttggacttgaaataataccacgt

SEQ ID NO: 29578 - DNA, 50 bp, homo sapien
atctttttaatattttatataaccaracaggaagtatgcataaaccacct

SEQ ID NO: 29579 - DNA, 50 bp, homo sapien
gaatgactaggtcctaaaaacttatsaaggtgttactgtatatcagtacg

SEQ ID NO: 29580 - DNA, 50 bp, homo sapien
aggtaatcgaaaatgtttgcgttacraggaagtttacaagtaaaaggcaa

SEQ ID NO: 29581 - DNA, 50 bp, homo sapien
ggtacaaaggaatgagttggatagaygagttagaatctaaacctctctga

SEQ ID NO: 29582 - DNA, 50 bp, homo sapien
cctccacatcttgcttattctcagcracaatggacctgccatagtgctga

SEQ ID NO: 29583 - DNA, 50 bp, homo sapien
aggaaaacaaatagtaccacaacggsaaaggcagctgacctggtctcttt

SEQ ID NO: 29584 - DNA, 50 bp, homo sapien
catctttgtaaaacaaacctaatackgcaccatttccgtccagattcatg

SEQ ID NO: 29585 - DNA, 50 bp, homo sapien
agacgtaggaagtttggagagtgctkaacaaaccttggacaagggtatga

SEQ ID NO: 29586 - DNA, 50 bp, homo sapien
ataaaacacagaaaattaaaatggcyaatgtaaggactgagacaaatgtc

SEQ ID NO: 29587 - DNA, 50 bp, homo sapien
cttctatggcctcagtctatcactcragcagaaaccaccaacacccacat

SEQ ID NO: 29588 - DNA, 50 bp, homo sapien
cagtggggactgcggctcatcacaamgtttgcccatcctttaatttcttg

SEQ ID NO: 29589 - DNA, 50 bp, homo sapien
ttggtgcttcctccacagcaactacraaagccaaggaaccttccccagtc

SEQ ID NO: 29590 - DNA, 50 bp, homo sapien
tcagactaaaaggtattctaaggccrcagttcatatacatggtgtggtgg

SEQ ID NO: 29591 - DNA, 50 bp, homo sapien
ggaactgcatctggttcttgcaaaayaccaagtagacaggctctctttta

SEQ ID NO: 29592 - DNA, 50 bp, homo sapien
ttactgagttatgcctgttaattacyggcatagctaacaaagctatgtcc

SEQ ID NO: 29593 - DNA, 50 bp, homo sapien
tatagcaaaatctcactaaaatgaamtaactaaaatatcagatgatgatt

SEQ ID NO: 29594 - DNA, 50 bp, homo sapien
taactctaaagagtcctggaaaaccsagactattgactagattggagaac

SEQ ID NO: 29595 - DNA, 50 bp, homo sapien
ggactggaagatctactggctcttayctttggttggattatttgctaggg

SEQ ID NO: 29596 - DNA, 50 bp, homo sapien
atcactgggtatagttaaaaagatawgtaagacagtgtcccagagccctg

SEQ ID NO: 29597 - DNA, 50 bp, homo sapien
ctgcatctcctccctttctctgtgayggatattttccctgtgcaagagaa

SEQ ID NO: 29598 - DNA, 50 bp, homo sapien
ccttcactcttgactcagaggtaaamgctcccttgctcccaaatccttta

SEQ ID NO: 29599 - DNA, 50 bp, homo sapien
caaagccacaggtactagggaccccragatggtttatcatctatcatcag

SEQ ID NO: 29600 - DNA, 50 bp, homo sapien
ttttctatatacttttttagagtaaygaagccataaaatgtaagttcttt

SEQ ID NO: 29601 - DNA, 50 bp, homo sapien
gcacctgagctgaggtacaagggtaygcagagaggcagcagtgtgtgtga

SEQ ID NO: 29602 - DNA, 50 bp, homo sapien
cagaatggagcaggtgctaagataarcaagtagaacaacacagcagaaat

SEQ ID NO: 29603 - DNA, 50 bp, homo sapien
aaaaatcatcagaaatcacagagcarcttgatagtacattttaaaataac

SEQ ID NO: 29604 - DNA, 50 bp, homo sapien
cagttaggtaatcatataatcattarataggcactgttaaatcattttta

SEQ ID NO: 29605 - DNA, 50 bp, homo sapien
tttttcagggtgctaatatgatctayagttttcatgcagaataaattgtt

SEQ ID NO: 29606 - DNA, 50 bp, homo sapien
taagtcatatgtttaaagaagtataygtaaacacttgattgtttagttta

SEQ ID NO: 29607 - DNA, 50 bp, homo sapien
gaaatgcatcaaaatgtgaatagaaytgcattggatagaaatggtggttg

SEQ ID NO: 29608 - DNA, 50 bp, homo sapien
attgttggaggctgagtaattcttgyatgtatcaaatagtcagtaacagg

SEQ ID NO: 29609 - DNA, 50 bp, homo sapien
ttaaagtaaaaatttggccaagaacragaagtctctgaatgtgcttttct

SEQ ID NO: 29610 - DNA, 50 bp, homo sapien
aatacacgatttctattcgcagctarcatttagtaacacagaatcaggag

SEQ ID NO: 29611 - DNA, 50 bp, homo sapien
ctttcagcccttgggtaataaagtcrgacaatctggtccagcagccagaa

SEQ ID NO: 29612 - DNA, 50 bp, homo sapien
aaaacaatgagatttttcattcaaawtaaagctctctcaattgaaccttt

SEQ ID NO: 29613 - DNA, 50 bp, homo sapien
ccgactatagaccgccaagcctaaakcaggcccgtcacgttggatgccag

SEQ ID NO: 29614 - DNA, 50 bp, homo sapien
atcctctcctgcaggaaccttctccyaattaactaagaatctctatctta

SEQ ID NO: 29615 - DNA, 50 bp, homo sapien
taaatcagtttctctaaaaatgggawtacctggcttatccaggatcatca

SEQ ID NO: 29616 - DNA, 50 bp, homo sapien
ggtctgcaagttagtgtactaggaaktaaaaaatcccatgtggttaagga

SEQ ID NO: 29617 - DNA, 50 bp, homo sapien
gtctgggcctttctcacatggtgaaygctgatcgccatttctcatggacc

SEQ ID NO: 29618 - DNA, 50 bp, homo sapien
agggcacaagacctcattgggtacawcaggaaataaccacttaagcacaa

SEQ ID NO: 29619 - DNA, 50 bp, homo sapien
accaaaatgccaacagtggcattaaytactgcatggcatgattatagaat

SEQ ID NO: 29620 - DNA, 50 bp, homo sapien
tgccacttgcccttcactgcatgaaygtctctctaaccttgactttcatt

SEQ ID NO: 29621 - DNA, 50 bp, homo sapien
caattccctcttaatgacttagtaaytctcatcattctgaaattatcttg

SEQ ID NO: 29622 - DNA, 50 bp, homo sapien
gagcacctaccaattatacagaaaayctgagagtaaaagagtttagatga

SEQ ID NO: 29623 - DNA, 50 bp, homo sapien
attgttgtagcaaatgggagaatgcratttgatttttcatcttatctcca

SEQ ID NO: 29624 - DNA, 50 bp, homo sapien
ctgtgctggtcatctatagcgatagmaaccggccctcagggatccctgag

SEQ ID NO: 29625 - DNA, 50 bp, homo sapien
ttagaggagtcctggaagctcatcargtattctttaaaagagtatttagg

SEQ ID NO: 29626 - DNA, 50 bp, homo sapien
cattagtcacacaacataaaaccacrgaacgcagaatttgctcaccctgg

SEQ ID NO: 29627 - DNA, 50 bp, homo sapien
atacagggttaacaaatgtaggccaygttcccaagagttacttcagcaac

SEQ ID NO: 29628 - DNA, 50 bp, homo sapien
tgcaaaggccctgaggtagagagaamcttgataattgaaagaacagaaag

SEQ ID NO: 29629 - DNA, 50 bp, homo sapien
tcaaagaaaacgccacccgcttgtgraagtgattctgcccatgtgagggg

SEQ ID NO: 29630 - DNA, 50 bp, homo sapien
agccaaacctttcctgtaacagagayggtcatgcaagaaagcagacagca

SEQ ID NO: 29631 - DNA, 50 bp, homo sapien
aagagatttgcttgccaataggagcygcgtaagagtgtactcaagaagaa

SEQ ID NO: 29632 - DNA, 50 bp, homo sapien
tatcttggaaaaatatattgtggaartaaaaatccaattatatcatttac

SEQ ID NO: 29633 - DNA, 50 bp, homo sapien
aaagacttcagtgggagtcatcagasaaaaaggaacacaaccacctagcg

SEQ ID NO: 29634 - DNA, 50 bp, homo sapien
catatgaagtgtacatttttctccaygtttatgttttaagatgctaaaag

SEQ ID NO: 29635 - DNA, 50 bp, homo sapien
gcctaatgttcctcaaattttcttayaaaacctgattgtgtaattataaa

SEQ ID NO: 29636 - DNA, 50 bp, homo sapien
tatactagatttaaatgaataaatayaatccttcaccaaatatatagata

SEQ ID NO: 29637 - DNA, 50 bp, homo sapien
gtggacgtgtgcccaccaattacaaygggaaacatgaaaatatggaaaga

SEQ ID NO: 29638 - DNA, 50 bp, homo sapien
agagctgcccacagacaccgtaaggsactcaggtagatttaagcctgtcc

SEQ ID NO: 29639 - DNA, 50 bp, homo sapien
actggtcattttcctgaggcacaaayttaaatcctaaggctaatgtggag

SEQ ID NO: 29640 - DNA, 50 bp, homo sapien
gatagaaaagaactgaaaataaccasagaggaccacacatcaccctaggg

SEQ ID NO: 29641 - DNA, 50 bp, homo sapien
aaatatattttcattttcttaaatasattttgtctccgaataccatctac

SEQ ID NO: 29642 - DNA, 50 bp, homo sapien
caaaaccgagatagaggtggaaagayggactgaccaagtcctaaggaaat

SEQ ID NO: 29643 - DNA, 50 bp, homo sapien
cttgggcttgacttagagaagtataygtacctggttgtagtatttcatta

SEQ ID NO: 29644 - DNA, 50 bp, homo sapien
cacaagtgctaaacatatgcacaagkctactgacacagctttacctgcaa

SEQ ID NO: 29645 - DNA, 50 bp, homo sapien
cagtggagtctgtgtttccgaaaacractgtgagagccacggcagcacgt

SEQ ID NO: 29646 - DNA, 50 bp, homo sapien
ctgttaaacatatggaaagatacacrcactaatgggaaaaaagaaagaat

SEQ ID NO: 29647 - DNA, 50 bp, homo sapien
agaaatcaatgcaatgaagaccaacraagtgatagaaaatgggcgaagta

SEQ ID NO: 29648 - DNA, 50 bp, homo sapien
aattgttaagtttgcttttctgttayagagtgagtttgagcgtgttttca

SEQ ID NO: 29649 - DNA, 50 bp, homo sapien
agaaaacagcatcaaatcaaagtggwacatcacgttcagaaaagcgtcct

SEQ ID NO: 29650 - DNA, 50 bp, homo sapien
gacaaaagttgatatcctgtttgcaygagatatcagttttcagaattctg

SEQ ID NO: 29651 - DNA, 50 bp, homo sapien
gagctgtttgaatttataccacagaygctcaaagatcttaaagcttgcaa

SEQ ID NO: 29652 - DNA, 50 bp, homo sapien
aggagttgcagatggtggttttgaartagttcacctagcaacatgaagac

SEQ ID NO: 29653 - DNA, 50 bp, homo sapien
gtaaatgtaagtttgtggtgtgcgartactttcgtggcgtgattataact

SEQ ID NO: 29654 - DNA, 50 bp, homo sapien
catatgttcactgcttgtcatgatayggagataggtgcactgaagtgaat

SEQ ID NO: 29655 - DNA, 50 bp, homo sapien
gtctgtggtgatggctgaatgattcratgtaggtaaagtatacagcataa

SEQ ID NO: 29656 - DNA, 50 bp, homo sapien
aaagtactcgcacaccacaaacttamatttactacacgtgatgccctccg

SEQ ID NO: 29657 - DNA, 50 bp, homo sapien
attgcctcattcatagaaaggagacraagttaacataaaaaagagggttg

SEQ ID NO: 29658 - DNA, 50 bp, homo sapien
gaaacccatgtctcctttcagtaaartggaaactgtatgtgtttggacca

SEQ ID NO: 29659 - DNA, 50 bp, homo sapien
tcagcaccaattgacataaaatccaygggaattcagctgaagcttcacgc

SEQ ID NO: 29660 - DNA, 50 bp, homo sapien
gaagaaacttgggacgataaagagarctgtaaacttaattttgtagttag

SEQ ID NO: 29661 - DNA, 50 bp, homo sapien
tatacactacatctactgtggcaaayacgtacacacaagcatctgtgcac

SEQ ID NO: 29662 - DNA, 50 bp, homo sapien
ccactgtggctatgggtgtcaattcragtagcctttctgggaaacacttt

SEQ ID NO: 29663 - DNA, 50 bp, homo sapien
ttaatcccacagtgaatgcctgatasagtaaagtggagttggggagggtc

SEQ ID NO: 29664 - DNA, 50 bp, homo sapien
acactcaattttgccttgcttgatayatagttttgttattttgtgtgttt

SEQ ID NO: 29665 - DNA, 50 bp, homo sapien
cagcttgctcattggcttatgtatarcatttggctgctttcatgctatga

SEQ ID NO: 29666 - DNA, 50 bp, homo sapien
ctttaccaaaagtttgaaagtttaasaagcgctggctgccacctgctccc

SEQ ID NO: 29667 - DNA, 50 bp, homo sapien
tcgtgtttaatggaactcttgaaatyatagcctctccaaatctcctcagt

SEQ ID NO: 29668 - DNA, 50 bp, homo sapien
gacagaagaccaaaataatgtctctwaaatgtctatttgtttaccattcg

SEQ ID NO: 29669 - DNA, 50 bp, homo sapien
gattcaagatgattgggagaataacratgtcattactaaaatcagcgtct

SEQ ID NO: 29670 - DNA, 50 bp, homo sapien
gtaaaaggaaatctccttactggcgragtccctgggtggtctgtctgatt

SEQ ID NO: 29671 - DNA, 50 bp, homo sapien
tatgtaaaatataggatgatgtaaayttaggacagttagatctttgtctt

SEQ ID NO: 29672 - DNA, 50 bp, homo sapien
ggttcttttggaaccctcagattgaracgagagatgttttcatttttgag

SEQ ID NO: 29673 - DNA, 50 bp, homo sapien
cactcagatacataattcttataaargttacagttaacagagctaactga

SEQ ID NO: 29674 - DNA, 50 bp, homo sapien
tccagtaacttttggcaagttaatawcatcatccctaagtgactccataa

SEQ ID NO: 29675 - DNA, 50 bp, homo sapien
tacaggggtaggtagcataaaagacmgccgttctcaagaggcaaccatgc

SEQ ID NO: 29676 - DNA, 50 bp, homo sapien
caaaatagttagaacggtagctagaytaataaggaagaagagagagaaaa

SEQ ID NO: 29677 - DNA, 50 bp, homo sapien
ccattagggttctggtgggtaactcrattcttgaagctccataacatcca

SEQ ID NO: 29678 - DNA, 50 bp, homo sapien
tgggaggtacttgggtcatgagagartatccttcttgggttggttttcac

SEQ ID NO: 29679 - DNA, 50 bp, homo sapien
ccatgaaaactcactatcataaggtraaaaccaacccaagaaggatactc

SEQ ID NO: 29680 - DNA, 50 bp, homo sapien
taatttatgcacaaagataactatarcaatttttagtagatacagaagtg

SEQ ID NO: 29681 - DNA, 50 bp, homo sapien
ttcatctcacttccaaatttggttcsaaagcacagtacctaaaaaagttc

SEQ ID NO: 29682 - DNA, 50 bp, homo sapien
gatttttttgttttctcaagtaaacygaaaaatctatgaatatgagaact

SEQ ID NO: 29683 - DNA, 50 bp, homo sapien
cctagtgtaggcaaaggaagtctacrgataatccacaaaccggctttaag

SEQ ID NO: 29684 - DNA, 50 bp, homo sapien
gaagatgtcagtactggtaagttctraaattcatcaggataaacaaatat

SEQ ID NO: 29685 - DNA, 50 bp, homo sapien
ccactgcagatatactgaattgcaaygacaatgcggctacaaaacataaa

SEQ ID NO: 29686 - DNA, 50 bp, homo sapien
cccttcctgtaggtgctctgagatcsaactctagggacaatttattccaa

SEQ ID NO: 29687 - DNA, 50 bp, homo sapien
aagaatcacaccaatgagtttctaaktacaaaatgagataaagcactatg

SEQ ID NO: 29688 - DNA, 50 bp, homo sapien
acaagctaaaactataaaaatcatayaagaaaacggagaaagcttcatga

SEQ ID NO: 29689 - DNA, 50 bp, homo sapien
gctatgtgagacctgggtgagttaaratgcttaaagtgcttagaacaggg

SEQ ID NO: 29690 - DNA, 50 bp, homo sapien
aatgtggtaaccatttcaaaaaaccyatttcaggggctggccatggtggc

SEQ ID NO: 29691 - DNA, 50 bp, homo sapien
atttgggcgaatgaagaggaatgtcsaaaacacaattgctcctccccagc

SEQ ID NO: 29692 - DNA, 50 bp, homo sapien
gaagcaaaatgagcctagtccaagartcgagtccaagatgtaacttcctg

SEQ ID NO: 29693 - DNA, 50 bp, homo sapien
atcattggccccaccatggaccagtracatttggccattcattcacccgg

SEQ ID NO: 29694 - DNA, 50 bp, homo sapien
ctgcagaagggttggatgtgggtgaygcacagttgcaaagcggtgggtgc

SEQ ID NO: 29695 - DNA, 50 bp, homo sapien
ccactcagcagttcctcactacactsaaagcagccacctctgccatggga

SEQ ID NO: 29696 - DNA, 50 bp, homo sapien
ctcacaggacagaattctaccgttasgagtcatgaaatcagtggtgggaa

SEQ ID NO: 29697 - DNA, 50 bp, homo sapien
cagttaccaaatttactacaaaaatkaatgggcaaggaaggctgtgtttc

SEQ ID NO: 29698 - DNA, 50 bp, homo sapien
tgcccaggaaggagatgacagtggcyctggacagatggtaacaacagata

SEQ ID NO: 29699 - DNA, 50 bp, homo sapien
gttggactatattattatgtgaagcyactgagatttagggaacatttatt

SEQ ID NO: 29700 - DNA, 50 bp, homo sapien
ttcctttgaaagatgtgtgagggcakcccgcagcatgactctgcagtcta

SEQ ID NO: 29701 - DNA, 50 bp, homo sapien
ttttcgtgttcctggtttcatgaagscaaatactcctctttctaataata

SEQ ID NO: 29702 - DNA, 50 bp, homo sapien
tcctcattttgaaataggaaatgaayacctatcgttgcgatttcttgaaa

SEQ ID NO: 29703 - DNA, 50 bp, homo sapien
atttggcttcatgaaaccaggaacaygaaaatcaatttttagcaaaattt

SEQ ID NO: 29704 - DNA, 50 bp, homo sapien
atacaggaacttcaaaatgcctaagmcgcagcaatcagacactcctacaa

SEQ ID NO: 29705 - DNA, 50 bp, homo sapien
ttattttacacatttaaaaatattcraatctattatcattcaactttttt

SEQ ID NO: 29706 - DNA, 50 bp, homo sapien
cgtactgagagttttgtacattaaartataagagtcagtattttttttcc

SEQ ID NO: 29707 - DNA, 50 bp, homo sapien
ctgtggcctggctcctccatctcccrcatagttccagagctcagcagatt

SEQ ID NO: 29708 - DNA, 50 bp, homo sapien
cgtaggagttccaatattgctaaagraggaaaaaagctaagcttgttcat

SEQ ID NO: 29709 - DNA, 50 bp, homo sapien
actgtgatttttttttcaatgagagrcaccgaaaaggcatcttattaggg

SEQ ID NO: 29710 - DNA, 50 bp, homo sapien
actgtggaatcataactgatactcaraaacatgatcttgagtaatattca

SEQ ID NO: 29711 - DNA, 50 bp, homo sapien
ttctgataaatgaggttcatcataartagacggaggccaatctggagtca

SEQ ID NO: 29712 - DNA, 50 bp, homo sapien
gacgtgaagcaaagacactcatgaargttctttgtatgtactatgattgg

SEQ ID NO: 29713 - DNA, 50 bp, homo sapien
ctccccttaactgctctatagataamaaactgaacactacaaaacagtaa

SEQ ID NO: 29714 - DNA, 50 bp, homo sapien
tttgtgatgaccaagtctatagtcaracaccatgatacacatttattata

SEQ ID NO: 29715 - DNA, 50 bp, homo sapien
aagatatgtctgtatccattatgatyacctacacatattacacatagaag

SEQ ID NO: 29716 - DNA, 50 bp, homo sapien
atgatcaaaggcaaaaatgtatgcarggaaaatatagaatatttaagtta

SEQ ID NO: 29717 - DNA, 50 bp, homo sapien
gtgtactccttaggagcttggcctarcaaacttgttcctaaggaacccaa

SEQ ID NO: 29718 - DNA, 50 bp, homo sapien
atcattgttattttctgagtactaamaggacatttatctgctctgcaaat

SEQ ID NO: 29719 - DNA, 50 bp, homo sapien
aacttagaataaaagtacagtgtgargcaatagaatttacaatagaaatt

SEQ ID NO: 29720 - DNA, 50 bp, homo sapien
tccggggcttaattgttatcacttgragaacggctagaaatggatgcagg

SEQ ID NO: 29721 - DNA, 50 bp, homo sapien
caccctccacccttagagaattaaaycagtgctggagtagagcgtcacca

SEQ ID NO: 29722 - DNA, 50 bp, homo sapien
caacactagctgtgcaggcaaaggcrcagagtccagaaggaatagtcctg

SEQ ID NO: 29723 - DNA, 50 bp, homo sapien
ttggaaaactattgtaaagatgtcarctattcccagattaaccctttggt

SEQ ID NO: 29724 - DNA, 50 bp, homo sapien
gagacatggggaagcagttgatacgwcataaaaaaaagcccgtggcagat

SEQ ID NO: 29725 - DNA, 50 bp, homo sapien
atagcaatttaaaaaggccaaggaawttaagctgatcttgaaaaacaaca

SEQ ID NO: 29726 - DNA, 50 bp, homo sapien
agaaattgcagcttgccttgcacaasaggaaaaacaagaacaagttaaaa

SEQ ID NO: 29727 - DNA, 50 bp, homo sapien
tcacatagcataggctataacttcaytaaagaaaacatggtcacccctgc

SEQ ID NO: 29728 - DNA, 50 bp, homo sapien
aaagtccgtccatacaaaagaaggtracactctaataagcctcccaagct

SEQ ID NO: 29729 - DNA, 50 bp, homo sapien
actaataagactataacactagccartctgaaggacccaatgagaatctg

SEQ ID NO: 29730 - DNA, 50 bp, homo sapien
tgtaaaaagcatattggtgggaaagmatgagacccaagtttttatgccaa

SEQ ID NO: 29731 - DNA, 50 bp, homo sapien
aaggacccaatgagaatctgactgcygaagaatgcagttttcacatcctg

SEQ ID NO: 29732 - DNA, 50 bp, homo sapien
aaagctagaaccattgttgctctccrctgaacctaaagaataaagcttgc

SEQ ID NO: 29733 - DNA, 50 bp, homo sapien
caatgttacaagctcaagcatggtawatgaatttaggacagctccaagga

SEQ ID NO: 29734 - DNA, 50 bp, homo sapien
ccagcatgtatggatccatgggaatmagaccataaatgagtgaacagagg

SEQ ID NO: 29735 - DNA, 50 bp, homo sapien
ttaattaaggtcctttaacaaagtaygtccatggtgtttagcacaggttg

SEQ ID NO: 29736 - DNA, 50 bp, homo sapien
tttccatgtcaaacctgacttcgtayccattaagtatctcagggccattc

SEQ ID NO: 29737 - DNA, 50 bp, homo sapien
tcctttgcagcacccatccggtcgaygtacacagttggtgtgggtgcacg

SEQ ID NO: 29738 - DNA, 50 bp, homo sapien
acacaatccttgtggatatgattcaraggtgactttaattcagagaatgt

SEQ ID NO: 29739 - DNA, 50 bp, homo sapien
aatcttcaataatccaaaatgtaaayctctaagggtcctctccctgcaga

SEQ ID NO: 29740 - DNA, 50 bp, homo sapien
tttgctactacagagtcaaatgcccrcttttcttccagcgtttgtttctc

SEQ ID NO: 29741 - DNA, 50 bp, homo sapien
taagaaaaggcagcttcatgttgacrgacattgagaatgggtgcaggaaa

SEQ ID NO: 29742 - DNA, 50 bp, homo sapien
cactgcctcttgccctgctttgacaygctcactgtaacaaatcagtgaca

SEQ ID NO: 29743 - DNA, 50 bp, homo sapien
tctcttacgcatttccttacttctcyaactacttgctcatgctccttccc

SEQ ID NO: 29744 - DNA, 50 bp, homo sapien
aagttgaacacaagatttaacacacsaaaaactctatccaaaaaacgggg

SEQ ID NO: 29745 - DNA, 50 bp, homo sapien
aagaaagcaagactagaaatctgacrcatctaaaaggagactgagcctac

SEQ ID NO: 29746 - DNA, 50 bp, homo sapien
aaattactaccttggccaaatcatakagagtagggtgaaactaggctcac

SEQ ID NO: 29747 - DNA, 50 bp, homo sapien
tgtggcgagttctagataagcatcamcttcttcacttagcaaaaggggac

SEQ ID NO: 29748 - DNA, 50 bp, homo sapien
tgaacccacattttgggcgtgtagayggttcatataactcagatcacttg

SEQ ID NO: 29749 - DNA, 50 bp, homo sapien
aaatctggtcaggtttgcaatcatcygaagagtgtttatggaaaacacag

SEQ ID NO: 29750 - DNA, 50 bp, homo sapien
gttaagcacctgaagtttgttcttayggacactcagcctgtgttttccat

SEQ ID NO: 29751 - DNA, 50 bp, homo sapien
tgcagggagtccaggaaaagggcaaratttgggatatgcagagctggatg

SEQ ID NO: 29752 - DNA, 50 bp, homo sapien
tgaaaacccatcctaactagcttaamtataatagacaacgcaggtgtttt

SEQ ID NO: 29753 - DNA, 50 bp, homo sapien
gtgttaaatataatcctgcttcaacrgaaagaggtcaatctccttggcct

SEQ ID NO: 29754 - DNA, 50 bp, homo sapien
taaaagataaatgagaacaaattcaygcttatgggttggaagacttacta

SEQ ID NO: 29755 - DNA, 50 bp, homo sapien
cttggggttaccattgggactggccracttaacgaactaagcttggctca

SEQ ID NO: 29756 - DNA, 50 bp, homo sapien
caaagtctagccacaacctagcatargaaatcaggcttcaaccctgttga

SEQ ID NO: 29757 - DNA, 50 bp, homo sapien
cagaaaatccaaggcagacataatgrattaatacgcacagatggagctgt

SEQ ID NO: 29758 - DNA, 50 bp, homo sapien
tattctttcacttaaatggccaaaaygcagtagcagcatcttcaagggtg

SEQ ID NO: 29759 - DNA, 50 bp, homo sapien
aagagaaaaggaaggtattgaaaaamaaatgggatgtctagaaatgaaaa

SEQ ID NO: 29760 - DNA, 50 bp, homo sapien
agctttcattttaaaaccatacggcmactctttgttctccataaaatagg

SEQ ID NO: 29761 - DNA, 50 bp, homo sapien
gagagacaatacaccaggcacacaawtatgacaggtattaacaagtcgtg

SEQ ID NO: 29762 - DNA, 50 bp, homo sapien
aaagatgctttattgaatacttcccrgcacagatgatctgttactgttgg

SEQ ID NO: 29763 - DNA, 50 bp, homo sapien
agtgatttggccagttgtatttcacrgtaatggaactagatagtgttttc

SEQ ID NO: 29764 - DNA, 50 bp, homo sapien
acagggctatttcattaccaaattckaaaacataaattgaaaatgatgtc

SEQ ID NO: 29765 - DNA, 50 bp, homo sapien
tgccaaatgtcaaatggctatgagasaggtagatttgtaagatgcaccac

SEQ ID NO: 29766 - DNA, 50 bp, homo sapien
ggaggtcatctcttgtaagaacttaygaattttatccttctggtctttct

SEQ ID NO: 29767 - DNA, 50 bp, homo sapien
ttggatgttttcaggtaggtaaagayactctgaagcagtgttccttttga

SEQ ID NO: 29768 - DNA, 50 bp, homo sapien
agccaagactgctgatgttcaggaaycaatactcaaaaggtactccagaa

SEQ ID NO: 29769 - DNA, 50 bp, homo sapien
gaatacttcttctctccatactctaygcatgtctgggaaaggctccaaag

SEQ ID NO: 29770 - DNA, 50 bp, homo sapien
aagcagtgactgtgtttctgggttakcctgtagttttctaaactgtcaaa

SEQ ID NO: 29771 - DNA, 50 bp, homo sapien
acctaactgaagaaagctgtctaacraagtcaaggtcttggcagcaggag

SEQ ID NO: 29772 - DNA, 50 bp, homo sapien
tgttttcacaccctagaagaaaacayagggtgagcgtttacttcagtgaa

SEQ ID NO: 29773 - DNA, 50 bp, homo sapien
tacatccaccatgcttcaaaagataygtagcagggatacctagtttaaaa

SEQ ID NO: 29774 - DNA, 50 bp, homo sapien
cacctccctgctggggacaagggaayctgacacagaagtgatcacagttg

SEQ ID NO: 29775 - DNA, 50 bp, homo sapien
atcaagaatgggctacactgaaggcycttgcttcctgtttcaacaagtcc

SEQ ID NO: 29776 - DNA, 50 bp, homo sapien
ttcaacaagtccacttgctaaaatgyatgattccaaatctaccttctact

SEQ ID NO: 29777 - DNA, 50 bp, homo sapien
gcaaaggaagaccttttgcgggtgargcacaactgtcacctaatggctct

SEQ ID NO: 29778 - DNA, 50 bp, homo sapien
attttgaaagactttcacagtgagartagaaggtagatttggaatcatgc

SEQ ID NO: 29779 - DNA, 50 bp, homo sapien
cacttcagaggccctggtaagcatcraggatgttctatgagtatggaata

SEQ ID NO: 29780 - DNA, 50 bp, homo sapien
tgaattaataaggctgaaggctgcargtaagtttccaacagggctgctac

SEQ ID NO: 29781 - DNA, 50 bp, homo sapien
catggggaagaggcatttaacagccrggaaagttctgtgagcaaaaggta

SEQ ID NO: 29782 - DNA, 50 bp, homo sapien
gtgcaaagaatgcagattgagaagaktagagaaccatcaacttagtttga

SEQ ID NO: 29783 - DNA, 50 bp, homo sapien
tatcaagatgacatgcacattctaamgacaagcctgcagccataagtatg

SEQ ID NO: 29784 - DNA, 50 bp, homo sapien
ttcatcgtgcttgtgctaccatttarcatcttattagcagagccatctct

SEQ ID NO: 29785 - DNA, 50 bp, homo sapien
agccctcattgagtgcatcctgacaygaactgaacagattaactattttt

SEQ ID NO: 29786 - DNA, 50 bp, homo sapien
atagtgattgaggtagaaaatgttcratataaacaaaagacaacacagtg

SEQ ID NO: 29787 - DNA, 50 bp, homo sapien
cccatcagcagtgattaccaaccagsatgtcttctccagctcaggccacc

SEQ ID NO: 29788 - DNA, 50 bp, homo sapien
tggcggctcacctccatggcgtccaragacaggttgcaagagatctcgaa

SEQ ID NO: 29789 - DNA, 50 bp, homo sapien
tgcccattctgagcctttcatacaartagaatcccaccaggtttcgtacc

SEQ ID NO: 29790 - DNA, 50 bp, homo sapien
acattcagggaagtatgacctcaccraacaataaacaagtcaccagtgac

SEQ ID NO: 29791 - DNA, 50 bp, homo sapien
ccgaggagttttgttaaacagattaygcgtgtgagaatttctctctcatt

SEQ ID NO: 29792 - DNA, 50 bp, homo sapien
tctcactcctttctaccatctatcaytgaccataatgcagagaaccaagg

SEQ ID NO: 29793 - DNA, 50 bp, homo sapien
tccagttcaggcattttatgaagtgraagagaatttggcactgacttttt

SEQ ID NO: 29794 - DNA, 50 bp, homo sapien
ggatttccagatccatctgagatgasagtttcataataatcctgccacac

SEQ ID NO: 29795 - DNA, 50 bp, homo sapien
gatggtgatagtaaatggtgatatayagtaaatgtaaataatagcaaata

SEQ ID NO: 29796 - DNA, 50 bp, homo sapien
gactgtgtaaaatttagcctccctcmagatttctatatgtttgtgtttat

SEQ ID NO: 29797 - DNA, 50 bp, homo sapien
gaagccaattttacgcttaaaaatckctgagtgcataaacacaaacatat

SEQ ID NO: 29798 - DNA, 50 bp, homo sapien
tagcaacaagcttaaaataaaagaamgaaaactgtatctatggttctttg

SEQ ID NO: 29799 - DNA, 50 bp, homo sapien
cctacgtgatgccgttctgagggaartcgacatttcaaattcccagtatt

SEQ ID NO: 29800 - DNA, 50 bp, homo sapien
atttactccagaattgtgttttggayaaccacatgcttacaagcttccat

SEQ ID NO: 29801 - DNA, 50 bp, homo sapien
ggaaaaattgtacttgaaacagatayagcatgtaatacataaggagctgt

SEQ ID NO: 29802 - DNA, 50 bp, homo sapien
acagcctggcaatgtcctgacaaaayttcaacggtggacatgcactctca

SEQ ID NO: 29803 - DNA, 50 bp, homo sapien
tgtttggaatgagaaaacttgcagtwacagtctcgaccaagttgatgaag

SEQ ID NO: 29804 - DNA, 50 bp, homo sapien
tcccaacaccttgtgcattgaggtaygaatgttgggagagagacaaaaag

SEQ ID NO: 29805 - DNA, 50 bp, homo sapien
taagaagcagggttagattcaaccaytagagatgccactttaggattgtt

SEQ ID NO: 29806 - DNA, 50 bp, homo sapien
tattacttgcctcctatatagacccratattcaatgatgaagtagggtta

SEQ ID NO: 29807 - DNA, 50 bp, homo sapien
aagcagcagagtaaaataactataaytgaactctacttgtgcaattccag

SEQ ID NO: 29808 - DNA, 50 bp, homo sapien
ctataaatagaatctactagaggaaytgctataacttccttgaaattggc

SEQ ID NO: 29809 - DNA, 50 bp, homo sapien
ctgcgcccaggccaccttcatctccyatgacaagatggtcatctccctca

SEQ ID NO: 29810 - DNA, 50 bp, homo sapien
aagggacggcttcccagagcaagcaracttcctccaaggctccaagcatt

SEQ ID NO: 29811 - DNA, 50 bp, homo sapien
gcttggcctcttgtcataatcagccygagcggggatagctcacaagacca

SEQ ID NO: 29812 - DNA, 50 bp, homo sapien
ctatcaatctcagtgtcaatgcaacrgatactattcaactgttcttcctt

SEQ ID NO: 29813 - DNA, 50 bp, homo sapien
gctttcgttttttggaggtcagttcrccagcagtcaagaaacatggaaag

SEQ ID NO: 29814 - DNA, 50 bp, homo sapien
tctcagttactggatccattatcacrgaatgttcaagtaagtgttattct

SEQ ID NO: 29815 - DNA, 50 bp, homo sapien
tgtgcatgatcccatagttcacacayagactgtccatttcattaaatctc

SEQ ID NO: 29816 - DNA, 50 bp, homo sapien
cttggctaaaaacataataagtgacygcgaggagaggattaagaaaagtg

SEQ ID NO: 29817 - DNA, 50 bp, homo sapien
ttggcaaaaaaaatttcatcatcggkagagtatatttgttacttcagata

SEQ ID NO: 29818 - DNA, 50 bp, homo sapien
aacttggtacatctgagaaacaccartcaaggcattaggtgtcagagatt

SEQ ID NO: 29819 - DNA, 50 bp, homo sapien
acaacgtgggattgagctgcatgtawccacttatatgtgatatttttccc

SEQ ID NO: 29820 - DNA, 50 bp, homo sapien
gtccatatatgacaggaatttgatayaggttgctccaatttgacaacaat

SEQ ID NO: 29821 - DNA, 50 bp, homo sapien
taattgagaattttcactctaccaamaaaaggcaaaatgtctcttctcaa

SEQ ID NO: 29822 - DNA, 50 bp, homo sapien
tggctttcctctctttcttccagcaygtgttctttaatgattggttcctt

SEQ ID NO: 29823 - DNA, 50 bp, homo sapien
ccagtccacctttctttctctaacawctcagtcagcattcccagctctac

SEQ ID NO: 29824 - DNA, 50 bp, homo sapien
ccaaaaagatatatgtccactcggcrctatttccttcttcactgcacctg

SEQ ID NO: 29825 - DNA, 50 bp, homo sapien
acaggatctgagatgcatagttcctsaaatacttctgaataaatagcaga

SEQ ID NO: 29826 - DNA, 50 bp, homo sapien
ggagggaaagttgacataagttagckctgacacagtgtcctgagttgaat

SEQ ID NO: 29827 - DNA, 50 bp, homo sapien
tgtgggcagatcatgtctggtggcaytagagattatacacagagaaaagg

SEQ ID NO: 29828 - DNA, 50 bp, homo sapien
gcaagggagttaatggctcccgaaasgcctacagaaaaccctcagccatg

SEQ ID NO: 29829 - DNA, 50 bp, homo sapien
gatatcccgtgtaataatggaaaaaygaggacggtgagaaatctggcagg

SEQ ID NO: 29830 - DNA, 50 bp, homo sapien
aaataaaatcattttgctcaaaaaawatctagaatccacaaaggtttgac

SEQ ID NO: 29831 - DNA, 50 bp, homo sapien
actaagacaacaatagtaaatctgaracacagaaacattaattttctttt

SEQ ID NO: 29832 - DNA, 50 bp, homo sapien
aggttctttgcagttataattaagawgagatcatactggattagagtggg

SEQ ID NO: 29833 - DNA, 50 bp, homo sapien
aacagataaacaaaatacattaagcracattttgtaggcactgggtagca

SEQ ID NO: 29834 - DNA, 50 bp, homo sapien
atctaagagttattagccttaaagargacgtagagggtgagatcagggtg

SEQ ID NO: 29835 - DNA, 50 bp, homo sapien
gtgttccctaggataatgtaagaaaytgataggtaacttggaagactttg

SEQ ID NO: 29836 - DNA, 50 bp, homo sapien
caaagaaagtagaaggaagaaaatartagtgcagaaagagatgaaataga

SEQ ID NO: 29837 - DNA, 50 bp, homo sapien
acctaatggtaaaagctgtgaaaagsatactgaccaaaatagagaaagcc

SEQ ID NO: 29838 - DNA, 50 bp, homo sapien
aagaaaaatttgtggaagtctacacrctgccaaatctttcccaactgtac

SEQ ID NO: 29839 - DNA, 50 bp, homo sapien
taagaaaggtttgaaatgatggatayaattcattgataatttaactactg

SEQ ID NO: 29840 - DNA, 50 bp, homo sapien
gggaaatgacagacattatgcagccraagtcctaggatcatagttgtaaa

SEQ ID NO: 29841 - DNA, 50 bp, homo sapien
ggaaagtaaattggtgtatttactayggaaaacaatatagcaattacaaa

SEQ ID NO: 29842 - DNA, 50 bp, homo sapien
agcctcagctatcctaacttagttckccaggcagccacctccaactatct

SEQ ID NO: 29843 - DNA, 50 bp, homo sapien
tattcagtgtgggtctctatcctcaraggtcttcatccagttggataaat

SEQ ID NO: 29844 - DNA, 50 bp, homo sapien
gagcagagaactacaattcttccacrcagtgcatctggcatgaaaaggct

SEQ ID NO: 29845 - DNA, 50 bp, homo sapien
gtaaacagtagagccagagccataaktataactgttctttctgttacatg

SEQ ID NO: 29846 - DNA, 50 bp, homo sapien
tcttgggcttttaaagggcaaagcasagattttagattgtgagtctttat

SEQ ID NO: 29847 - DNA, 50 bp, homo sapien
ccatgaggggaaggactgaatgtctraattaatcaacagattcagaatcc

SEQ ID NO: 29848 - DNA, 50 bp, homo sapien
gcttatcatgcttaaaggacaaccaygtaagtaactccagagagccccta

SEQ ID NO: 29849 - DNA, 50 bp, homo sapien
taaaaagaaggataagggaaaagtayacaatggatgctgcttggctcata

SEQ ID NO: 29850 - DNA, 50 bp, homo sapien
ttgacatgtggaagaactctgtttcragaggaagcatttagagaagaaga

SEQ ID NO: 29851 - DNA, 50 bp, homo sapien
agagtatggcaatcaaaggtgaccasgttctaagtctgatgaactagttt

SEQ ID NO: 29852 - DNA, 50 bp, homo sapien
tgaatttgattcaatcctgaattccrctgcagagggctcctgtgagaacc

SEQ ID NO: 29853 - DNA, 50 bp, homo sapien
tagttgcttatcttcttgttccaaartatctcttggtagtaggctgttgg

SEQ ID NO: 29854 - DNA, 50 bp, homo sapien
cttatggtttggaagcagaatgacgycctgtggtcacttagcaatttctc

SEQ ID NO: 29855 - DNA, 50 bp, homo sapien
ttaccctccactactgtgcctaagayggctcttatccagcatggcacaca

SEQ ID NO: 29856 - DNA, 50 bp, homo sapien
aatgggtttggaatgggaggtgggamtcacacttgcaagacaatggagat

SEQ ID NO: 29857 - DNA, 50 bp, homo sapien
agtggggcccgtgctccagtctggcyacaatacccaccagagaggtgacc

SEQ ID NO: 29858 - DNA, 50 bp, homo sapien
ctaagttagagaaataatcatctaawtgagcctctaaaattctacaacaa

SEQ ID NO: 29859 - DNA, 50 bp, homo sapien
gttgtttgaatacttgagcccatgaygttgaaacagagttaggatagaag

SEQ ID NO: 29860 - DNA, 50 bp, homo sapien
tctcttgcaatcttaacttttaccayctcgacttgtggacacagaaggag

SEQ ID NO: 29861 - DNA, 50 bp, homo sapien
tagtgactgattaaatcaacagcaayaaatgaaagggagatttaaggaca

SEQ ID NO: 29862 - DNA, 50 bp, homo sapien
tggcagccaacactcttgtctcacaygtaagggacagcagtggccgaggg

SEQ ID NO: 29863 - DNA, 50 bp, homo sapien
tgttctagggcaggtgcaatagaacratgacggagatcctccctccctcc

SEQ ID NO: 29864 - DNA, 50 bp, homo sapien
agttgttgcttttaaagagagagacrctcacccattttaggtcaccctgg

SEQ ID NO: 29865 - DNA, 50 bp, homo sapien
agatgtagtttgccaagccataatayaggatcctgaaaagacagagatac

SEQ ID NO: 29866 - DNA, 50 bp, homo sapien
tgggaacatggcacccatttctgtcrcacccagagctgtcacaattgcag

SEQ ID NO: 29867 - DNA, 50 bp, homo sapien
aactccacaaccctactccagattaygacggctcacagtgggaacccact

SEQ ID NO: 29868 - DNA, 50 bp, homo sapien
catctgaagaatttcctggctgatamaaagtatttattttccctaaccag

SEQ ID NO: 29869 - DNA, 50 bp, homo sapien
atttaccagatcagcatggaggaaarcgtaacctcttttgagtgctgaga

SEQ ID NO: 29870 - DNA, 50 bp, homo sapien
ctcaaggaaacaatattgatcttaaraagtttttctatccaatacattag

SEQ ID NO: 29871 - DNA, 50 bp, homo sapien
taaaaggaaggcagcccctgtgttcsactaaactggctgttaggggactc

SEQ ID NO: 29872 - DNA, 50 bp, homo sapien
gcgagacgtccagcgtgctaatggawtaattattggcatttctctctctc

SEQ ID NO: 29873 - DNA, 50 bp, homo sapien
tgatcttcataaatgactgtgcatakatgagagctttcatcacactggtg

SEQ ID NO: 29874 - DNA, 50 bp, homo sapien
actattacaaatgacatgggcactaygaactagcctgataacatgcacca

SEQ ID NO: 29875 - DNA, 50 bp, homo sapien
gaaaaccaatgaacacacgtcccgamcagtatgtgaacactccgctatct

SEQ ID NO: 29876 - DNA, 50 bp, homo sapien
atttttttaaatttaatatttcatcrcttcacattgattcctgattcctt

SEQ ID NO: 29877 - DNA, 50 bp, homo sapien
tgcaaaacctcattgggtcagccagracagactcttaccatgctagggta

SEQ ID NO: 29878 - DNA, 50 bp, homo sapien
caccccacctcatcagacagacatayaccgcaccagtgcttgcttctcct

SEQ ID NO: 29879 - DNA, 50 bp, homo sapien
ctcaaaatttcatagtgggactgaawtatccctggccaacagcatgctct

SEQ ID NO: 29880 - DNA, 50 bp, homo sapien
ttttttttcctgcgtgccagatactraaataaagactttctgtgcattca

SEQ ID NO: 29881 - DNA, 50 bp, homo sapien
catggggccagagaacaaagtaacamaagcatagcaagattagcctcaaa

SEQ ID NO: 29882 - DNA, 50 bp, homo sapien
cgatggggtatctggaaataccatamaatttggtgtttgttgcagagtgt

SEQ ID NO: 29883 - DNA, 50 bp, homo sapien
aacttttcactgcacagaaatttaaracttcactttgaaacctgacacac

SEQ ID NO: 29884 - DNA, 50 bp, homo sapien
ccctccacacaaggttctttacgcasagtggaattattaatgagctacca

SEQ ID NO: 29885 - DNA, 50 bp, homo sapien
ccgcgagaaccgcgcgaagtcagagsaagtcaaaacgacctctacagcgg

SEQ ID NO: 29886 - DNA, 50 bp, homo sapien
atcgataactttgtgcttcagataaraaggaagacagagggttgaggctt

SEQ ID NO: 29887 - DNA, 50 bp, homo sapien
gttatcgatcatcaaacacagctaaygtcactaaaagaatgatgaacatg

SEQ ID NO: 29888 - DNA, 50 bp, homo sapien
tctgaaagctttttagaatgggaagraactgccaacaataattcataact

SEQ ID NO: 29889 - DNA, 50 bp, homo sapien
acagctaatgtcactaaaagaatgaygaacatgggtggctttgctagaag

SEQ ID NO: 29890 - DNA, 50 bp, homo sapien
gtgatggtctataactaaagccttgraaatctacctgatacctgttaaga

SEQ ID NO: 29891 - DNA, 50 bp, homo sapien
ctcttatgtctaattttggagataasgctacggaccattactctactggg

SEQ ID NO: 29892 - DNA, 50 bp, homo sapien
attgactagtgcaaacgaatacatayccaggaggtgtacatacctgatgg

SEQ ID NO: 29893 - DNA, 50 bp, homo sapien
agagaataccattgggtaaaccaagracagatgccaactgcctacatatg

SEQ ID NO: 29894 - DNA, 50 bp, homo sapien
tgaagaagggctaatgttgagtgacrggatcggtgccctgtgtgccattt

SEQ ID NO: 29895 - DNA, 50 bp, homo sapien
gagtctaggcttgataggtaacaaaygagactttcagtagcatttgttct

SEQ ID NO: 29896 - DNA, 50 bp, homo sapien
tgactacctaccatgagtcattgaasggtttaagtaaggtaggcacatgg

SEQ ID NO: 29897 - DNA, 50 bp, homo sapien
aatgtcattactcccaaatcctctcyattatttccttcctccttctctcc

SEQ ID NO: 29898 - DNA, 50 bp, homo sapien
ctttaggctgctataccgtgagacaragatggaaacagattgcttcacta

SEQ ID NO: 29899 - DNA, 50 bp, homo sapien
tgtctcccttgcctccactaagctckcaaaaccagttgcaaatttggctg

SEQ ID NO: 29900 - DNA, 50 bp, homo sapien
tttcagaagtcatgcttatattcacmaatggtagggaacagtagcttccc

SEQ ID NO: 29901 - DNA, 50 bp, homo sapien
catcacccaagctttctgtttgtgaygccaccgtgtgttttcatcgtccc

SEQ ID NO: 29902 - DNA, 50 bp, homo sapien
ctgaatataccttaacagatttttgratgggcttgccgatcagagggagc

SEQ ID NO: 29903 - DNA, 50 bp, homo sapien
gtcccacagtactctctggacctccrctgaaggcaacaaaatctccctct

SEQ ID NO: 29904 - DNA, 50 bp, homo sapien
ccttaaatgtctgggtgaaatagggwaaggcaaagaacaagaaagtacac

SEQ ID NO: 29905 - DNA, 50 bp, homo sapien
agagctttcatcatggcaagacatcractcttttgaggaaattccaaagg

SEQ ID NO: 29906 - DNA, 50 bp, homo sapien
gatagattatagaatgactacaataycctttttcagagcagaggaagtga

SEQ ID NO: 29907 - DNA, 50 bp, homo sapien
ctcctcaatagcattctacacacgargtcacacacatacacacatacact

SEQ ID NO: 29908 - DNA, 50 bp, homo sapien
taggattgttacatattccatgagayaatgggttgaaaagttttataatt

SEQ ID NO: 29909 - DNA, 50 bp, homo sapien
aagtaggtctgggctctttcctctaktacaccacacaagctccagcaaat

SEQ ID NO: 29910 - DNA, 50 bp, homo sapien
tgtagtgctgcccatgaactaggcastattctacccgggcattctgacac

SEQ ID NO: 29911 - DNA, 50 bp, homo sapien
acatgtccaggatagagtcttccaaytgaaagttatgtaacctgaaataa

SEQ ID NO: 29912 - DNA, 50 bp, homo sapien
ataaaaactagctcagttttgtgatyaagtgatatactaggtgtttgcaa

SEQ ID NO: 29913 - DNA, 50 bp, homo sapien
gtctaaaccagcacaacctccacaayaggaatctggcaacagctacccaa

SEQ ID NO: 29914 - DNA, 50 bp, homo sapien
atggctctcagtgctcaacaaaggcycagggatgagggtcttgctctgtc

SEQ ID NO: 29915 - DNA, 50 bp, homo sapien
gtattttcaaaatatacatcgggtargctaaaaatggacagcatttctct

SEQ ID NO: 29916 - DNA, 50 bp, homo sapien
ttttaatagtcactcaggacactaaracagctaggtgccagggcaaatca

SEQ ID NO: 29917 - DNA, 50 bp, homo sapien
tgatcagttgtgagctgtgtcacaartaactgtaactttcccatctcctc

SEQ ID NO: 29918 - DNA, 50 bp, homo sapien
gaccattccctaccaattttacagawtcaaaaatatttaggactaaaagg

SEQ ID NO: 29919 - DNA, 50 bp, homo sapien
aagaactctataatcatttatcttaycaaataatcttgcctgactccctt

SEQ ID NO: 29920 - DNA, 50 bp, homo sapien
catagctagtaggtggtagaacctgmataattgttgaaaggatcttggag

SEQ ID NO: 29921 - DNA, 50 bp, homo sapien
tgttggcagaagattggtggaagaamgcactgtacctagtaccgctttgg

SEQ ID NO: 29922 - DNA, 50 bp, homo sapien
ccttggtgtcagtgacctaagataakgaaactgcaaaatttttttggcca

SEQ ID NO: 29923 - DNA, 50 bp, homo sapien
accttggtgggtatgtagataaagaygatctagctcaatagtcctgtaat

SEQ ID NO: 29924 - DNA, 50 bp, homo sapien
gtaaacatgagattaaatgtgagttwaaaaagactgaactaattgtaggt

SEQ ID NO: 29925 - DNA, 50 bp, homo sapien
cttagggggagtaatgtatactagargcacacaatgtaactaaacaaaac

SEQ ID NO: 29926 - DNA, 50 bp, homo sapien
cttgcaaaatgttctcagtggtggartatcacgccaaagaaacacctgca

SEQ ID NO: 29927 - DNA, 50 bp, homo sapien
aaaatggtgaccactttggaaggaamgatgcttactgtgacatataactt

SEQ ID NO: 29928 - DNA, 50 bp, homo sapien
tcttttttttcttttaaagaaaatayctataagcacaatatattccattt

SEQ ID NO: 29929 - DNA, 50 bp, homo sapien
gaaccctcaaactccaaggctctggsatagatgaccaactatggccacag

SEQ ID NO: 29930 - DNA, 50 bp, homo sapien
atttatagactacctaataagtgccragcattgaacatatattgctaact

SEQ ID NO: 29931 - DNA, 50 bp, homo sapien
attttgcaggttttggaaggtgtcartgaaccatagtggatatactacta

SEQ ID NO: 29932 - DNA, 50 bp, homo sapien
gaggcatccctaatagctatggtgaygagtaggagtttggatattattca

SEQ ID NO: 29933 - DNA, 50 bp, homo sapien
ggcttttttttttcttttcctgatawgtctgacaagtaggaaggctgttt

SEQ ID NO: 29934 - DNA, 50 bp, homo sapien
atggaatctagctcacattttcagcmctagtttccaaggaacacaaagaa

SEQ ID NO: 29935 - DNA, 50 bp, homo sapien
ttgagagcagataaagtcgctaatawcaaattggatttgttcattggggt

SEQ ID NO: 29936 - DNA, 50 bp, homo sapien
tttctctgcaatagaattttttctgkatattgtctatgatgtgaattctc

SEQ ID NO: 29937 - DNA, 50 bp, homo sapien
tgtcctggagacttgggtccaatcarcactgactgatggctgtgcctttg

SEQ ID NO: 29938 - DNA, 50 bp, homo sapien
tttgatctagaaaggtgttatgccaygcagagacagtgaattggagttcc

SEQ ID NO: 29939 - DNA, 50 bp, homo sapien
acaggtgtgcaaagggctacgtgaayagtagagatagtgagtgacctgag

SEQ ID NO: 29940 - DNA, 50 bp, homo sapien
cacggagattgctctctggatgatcrcacaagcggatgctgcaggcccct

SEQ ID NO: 29941 - DNA, 50 bp, homo sapien
ggatgtgtctaatggatgaaataccygcagccggtaaaccactggtaaaa

SEQ ID NO: 29942 - DNA, 50 bp, homo sapien
ctcttaccttgtcgggtaaaagccaraagaggatacaccagctggtcttt

SEQ ID NO: 29943 - DNA, 50 bp, homo sapien
gccagtgggaggttcaattggtacamcctttggaagagtaatttagaaga

SEQ ID NO: 29944 - DNA, 50 bp, homo sapien
ctgtcctctatttctgccaaacccartcaacatggtgaataaatattcac

SEQ ID NO: 29945 - DNA, 50 bp, homo sapien
aagcataatgccaaaaagccagggamcgaattttatggatttcacaggat

SEQ ID NO: 29946 - DNA, 50 bp, homo sapien
agacttgtgagagattcatacatacraagatttcctgatagctatcaatc

SEQ ID NO: 29947 - DNA, 50 bp, homo sapien
ccaaggctagaactgatatccttcartagagtggagaagacttcctagag

SEQ ID NO: 29948 - DNA, 50 bp, homo sapien
agcaagagagataagaagcaagtacrgaaataaagaaacaggagtttgac

SEQ ID NO: 29949 - DNA, 50 bp, homo sapien
agaaaggaaagcttttctcatcaaakaggttgaaattactgtcgtaaaac

SEQ ID NO: 29950 - DNA, 50 bp, homo sapien
aacacttaaactcaccgcattagcamtatgaggcaaccagcagttactaa

SEQ ID NO: 29951 - DNA, 50 bp, homo sapien
cgcttattttcattcatcttgatatraattcaacaaacattctgtgtgtt

SEQ ID NO: 29952 - DNA, 50 bp, homo sapien
aatcatatttaccttttgattactayggtctattttaagtgaatctgttt

SEQ ID NO: 29953 - DNA, 50 bp, homo sapien
cccgatcagtgttctgtaaaatgaakaggtcactaaccggcattcaaaag

SEQ ID NO: 29954 - DNA, 50 bp, homo sapien
aaactgtctaggcctgatgcatttayaagtgattattaaatacacttctc

SEQ ID NO: 29955 - DNA, 50 bp, homo sapien
tgaacaaaatgacactgaacatccckgaacacaaatcttgacacacacac

SEQ ID NO: 29956 - DNA, 50 bp, homo sapien
ttgcatcgctgagcagtcaggagaargaatactgggtccttgactgcagc

SEQ ID NO: 29957 - DNA, 50 bp, homo sapien
gctttcttttagcatcctaccctttyaaaaatccaggaggcaaacaatga

SEQ ID NO: 29958 - DNA, 50 bp, homo sapien
aactaaggaagcaagggccttttccrcaagcatcatctgttcttgtttgg

SEQ ID NO: 29959 - DNA, 50 bp, homo sapien
gaaacacgtcagcatgcagctaccaygtaaaacaaagtctggccgaacct

SEQ ID NO: 29960 - DNA, 50 bp, homo sapien
catctgtggaccaaaatgactacaayggccttctaacctgtctggctcct

SEQ ID NO: 29961 - DNA, 50 bp, homo sapien
ttgagagatttgcaaatgcaactaasagggctttcttttagcatcctacc

SEQ ID NO: 29962 - DNA, 50 bp, homo sapien
ttgttaaaactgctaacttcaggaakaatgaagctgtaacttaaacatgt

SEQ ID NO: 29963 - DNA, 50 bp, homo sapien
cttgtctggtggctccttgaaggacyggctcaaagggcatgtatttaatt

SEQ ID NO: 29964 - DNA, 50 bp, homo sapien
ctacttgtaactcatgattctggaaraggtttctaaaacttgcagacttg

SEQ ID NO: 29965 - DNA, 50 bp, homo sapien
ttgaactgtgtttcatggctaccagrcagccgtcgagggtttggatgcag

SEQ ID NO: 29966 - DNA, 50 bp, homo sapien
tgatcaaagtctttaataaccacaastaagtgaaaatgcatttttaacac

SEQ ID NO: 29967 - DNA, 50 bp, homo sapien
aaacgaatctagatctctcttccaayggtcaaaattagaaaggggagagg

SEQ ID NO: 29968 - DNA, 50 bp, homo sapien
gccaaggaagacactcagaaacgaayctagatctctcttccaacggtcaa

SEQ ID NO: 29969 - DNA, 50 bp, homo sapien
atccaaagtcacctgttaaaacctaraggccaatgacaagtcacattacc

SEQ ID NO: 29970 - DNA, 50 bp, homo sapien
caagaagaaagtaagaggcaactacmatcttttctttggaactctttagc

SEQ ID NO: 29971 - DNA, 50 bp, homo sapien
gcggtcaaaaccttgctaattggcayataaagctgcctgttaagcagttt

SEQ ID NO: 29972 - DNA, 50 bp, homo sapien
tcaaaatccttatagactctgaccaycgcttggttccaagttcagtccca

SEQ ID NO: 29973 - DNA, 50 bp, homo sapien
tgcagacttcactcttaatgagcaaygcttctgctccctctggtttcctt

SEQ ID NO: 29974 - DNA, 50 bp, homo sapien
actgtccccagtggctggactctcaycgggccagtcactgagctggcgcc

SEQ ID NO: 29975 - DNA, 50 bp, homo sapien
taaaatcttattacgtttattttatyagtggaatactcagtttatgcaac

SEQ ID NO: 29976 - DNA, 50 bp, homo sapien
agaagtaaaattactaaacctgaaarggcagctgaagaagttgtatgaga

SEQ ID NO: 29977 - DNA, 50 bp, homo sapien
taaaatgctaccgtatctgtgtatgwatatgtgtgaataaatttacagac

SEQ ID NO: 29978 - DNA, 50 bp, homo sapien
aaagaaaacgtggtatatatacacartgggatactcggacattcaaagaa

SEQ ID NO: 29979 - DNA, 50 bp, homo sapien
tgcacacagagcatctggcaaggcgycacataggacctggtcaacagcag

SEQ ID NO: 29980 - DNA, 50 bp, homo sapien
atttcacaattgtggttgatcacacrgaaagaacacagattaaaatcagc

SEQ ID NO: 29981 - DNA, 50 bp, homo sapien
cttcatctaaagaagacataatagcractttctcctgatatcttctaaga

SEQ ID NO: 29982 - DNA, 50 bp, homo sapien
ggcatctgaagttttacattaacaawaactctgtcaacttgtcttccttc

SEQ ID NO: 29983 - DNA, 50 bp, homo sapien
ttcttctgtcctttgtgtttccaaargcaccatattttatttgataaaag

SEQ ID NO: 29984 - DNA, 50 bp, homo sapien
gaggatatcatatataatatcaaccraaacagacagcagccatggagcca

SEQ ID NO: 29985 - DNA, 50 bp, homo sapien
tagccttgcttctctgatctggtccrctcattaaggctatagatgtggtc

SEQ ID NO: 29986 - DNA, 50 bp, homo sapien
tcagaccacactttgaaaacaatgckctatactgtagtgcctcttcagtt

SEQ ID NO: 29987 - DNA, 50 bp, homo sapien
ttcccagagaaggggcacagttccayagagaggagttcagagagcagcag

SEQ ID NO: 29988 - DNA, 50 bp, homo sapien
cctcaccctcacctttatggcaataytaggtgtctgcattgtcaaaggga

SEQ ID NO: 29989 - DNA, 50 bp, homo sapien
gcttagtcctgtaaacaaagcaccaygtttcatcgtctcagataacacac

SEQ ID NO: 29990 - DNA, 50 bp, homo sapien
gagagaaataaaagtaggaagtaaayattagtataaacgtatgaagcaaa

SEQ ID NO: 29991 - DNA, 50 bp, homo sapien
atggaatatgtatctaccataatacraagcaataaggtattcaagtcctc

SEQ ID NO: 29992 - DNA, 50 bp, homo sapien
gaatcacggctacctgggtggatgcrctttgaactcaagatattcatccc

SEQ ID NO: 29993 - DNA, 50 bp, homo sapien
tcaccaagaactgaaaacttttccaygagacctgctgtgtgccaggggct

SEQ ID NO: 29994 - DNA, 50 bp, homo sapien
ggagggatattttgcaatccttactraaaagaaaacagtgatttgtacat

SEQ ID NO: 29995 - DNA, 50 bp, homo sapien
agttgctcatagttaatcaggtagaragacaagtaaacaggtgttcagaa

SEQ ID NO: 29996 - DNA, 50 bp, homo sapien
agatactgctctctagttggaaagamgaaaggataaggttggaggaaagt

SEQ ID NO: 29997 - DNA, 50 bp, homo sapien
aacccaccaccctcagctctcctcgrcattagccacgctgtctctctccc

SEQ ID NO: 29998 - DNA, 50 bp, homo sapien
atctcttatgcaatggctgttatgcrctcccacactttcctccaacctta

SEQ ID NO: 29999 - DNA, 50 bp, homo sapien
gtgctgagactttagtgtgacagtaygcgctaaacacctggcacatggag

SEQ ID NO: 30000 - DNA, 50 bp, homo sapien
ccctctatttgtagaggtgttagcaygagtcacacaaggatctggaagct

SEQ ID NO: 30001 - DNA, 50 bp, homo sapien
cttgccaaagtccaatctttacacargacattgactttatttcaaggcca

SEQ ID NO: 30002 - DNA, 50 bp, homo sapien
gccaacagcttggtcgactctttcgratatgtctccacccactctcttcc

SEQ ID NO: 30003 - DNA, 50 bp, homo sapien
ccttttgaatagatacatacatatamaggtaaatctagatatatttttaa

SEQ ID NO: 30004 - DNA, 50 bp, homo sapien
tgagccacctcgcccagccaggtcaraatatatgttaattcccattgagg

SEQ ID NO: 30005 - DNA, 50 bp, homo sapien
tgttgaggagagaattgaaattgaamcatgatggagaacaatctggtcac

SEQ ID NO: 30006 - DNA, 50 bp, homo sapien
aatacgctaacttcatggagcttaaktagttctcaatgcaatatgtccag

SEQ ID NO: 30007 - DNA, 50 bp, homo sapien
gcggtttcctacacgtatttatgcaygtgtttaaacaaactccgaacgtt

SEQ ID NO: 30008 - DNA, 50 bp, homo sapien
gcccactctaatcacaaatgcgatargtctaattctctccactttgggat

SEQ ID NO: 30009 - DNA, 50 bp, homo sapien
ttgtatttccctccactcactctgakaaaaccactgtatacatctccagg

SEQ ID NO: 30010 - DNA, 50 bp, homo sapien
ccctttttttcctgcgtttttttgayagcttcttagtcttatgtatccat

SEQ ID NO: 30011 - DNA, 50 bp, homo sapien
atgataaagaactcactacctagtaratcatccactgctatccttctcaa

SEQ ID NO: 30012 - DNA, 50 bp, homo sapien
aagacattgcccatgccattaccaargtattaccctctctgtctaacttt

SEQ ID NO: 30013 - DNA, 50 bp, homo sapien
tttctatagagaaataaactttactsacattttcagagaatccagttgga

SEQ ID NO: 30014 - DNA, 50 bp, homo sapien
gagcgaagctttggcaaaaatgtaawgccgtgcagcacagtaagtctttg

SEQ ID NO: 30015 - DNA, 50 bp, homo sapien
attagtatggataagcaaattaataycattgggccaacgtatgcttataa

SEQ ID NO: 30016 - DNA, 50 bp, homo sapien
gtaattttgtaatggcaataacagcratagtaattacaatgatgatgagt

SEQ ID NO: 30017 - DNA, 50 bp, homo sapien
ttaaaaaaaaattatctataccaagmactttacacagaataccacattta

SEQ ID NO: 30018 - DNA, 50 bp, homo sapien
ccaattctaaaagaccatatcaaaaytatctactagcctcattgaaaata

SEQ ID NO: 30019 - DNA, 50 bp, homo sapien
catatactattgcatctcattcgacraggttaaaattagacaaaacatgg

SEQ ID NO: 30020 - DNA, 50 bp, homo sapien
tattctttaaattgtagctgacacakagtatacctgaagcaccaatttaa

SEQ ID NO: 30021 - DNA, 50 bp, homo sapien
tgcagaggttaagagattagcagtcycttaattatcacagagatgtacta

SEQ ID NO: 30022 - DNA, 50 bp, homo sapien
agactttacaaatgctgaaactttargtaaaagatgagtacataaatttg

SEQ ID NO: 30023 - DNA, 50 bp, homo sapien
tcagcattgaattctgctccttaaamgatcagaagaacttgctttagtga

SEQ ID NO: 30024 - DNA, 50 bp, homo sapien
ctggacctgcagggtggtctttagakaggatcaactgtgtattctgaagt

SEQ ID NO: 30025 - DNA, 50 bp, homo sapien
tatgaaaaccagttctcatgaaataygcacttagagtaagaaaatacaga

SEQ ID NO: 30026 - DNA, 50 bp, homo sapien
atataaaagacataagagactgcaayttatttatcagattctgcatctag

SEQ ID NO: 30027 - DNA, 50 bp, homo sapien
tatgtgtgtcctttgcttaagacggsatctatgtctgtaactaacttggt

SEQ ID NO: 30028 - DNA, 50 bp, homo sapien
tcaagggacaggcacacacttcaccyaggtctactgttgggtgtccaaca

SEQ ID NO: 30029 - DNA, 50 bp, homo sapien
attggaaatatagcatactcgattayataggacagaaaccgttcagcatg

SEQ ID NO: 30030 - DNA, 50 bp, homo sapien
ccatgttggccatggctggtgcttaygatcttttaatggatggcctctac

SEQ ID NO: 30031 - DNA, 50 bp, homo sapien
aggggccatgagcaacagagatgaartagataaactagagtatattatgg

SEQ ID NO: 30032 - DNA, 50 bp, homo sapien
aatgccatccagatgtctagatgcayatccacattaacatattatgcaaa

SEQ ID NO: 30033 - DNA, 50 bp, homo sapien
aggctaatgaagatgctgccaaggayggagaatatcgtgaagacagagaa

SEQ ID NO: 30034 - DNA, 50 bp, homo sapien
tgttcaggtgtgcacttaagaaaccraaataatctaagtgaaatacctaa

SEQ ID NO: 30035 - DNA, 50 bp, homo sapien
acaggtcccacggccctcacgctgaygactctggagctgttttgccgccg

SEQ ID NO: 30036 - DNA, 50 bp, homo sapien
ctggggctaacagtaaaaagttggcracaccatgctcccagccaccacat

SEQ ID NO: 30037 - DNA, 50 bp, homo sapien
catgttatagttatgtttgtatgcaytagagtctcagtgtgcatgtatgt

SEQ ID NO: 30038 - DNA, 50 bp, homo sapien
gtttctcccaggtagtgagaactccragcccagactgtgtggactctaaa

SEQ ID NO: 30039 - DNA, 50 bp, homo sapien
ttattagtctagtttgccttcttatraattgggagaaacaatagggtagc

SEQ ID NO: 30040 - DNA, 50 bp, homo sapien
tctgctacaatgttgaaaagaactasgtagaacctgagttgagtgggaga

SEQ ID NO: 30041 - DNA, 50 bp, homo sapien
gttttattcttttttaatatttgagyccgaggtaagagtgtgtaataaag

SEQ ID NO: 30042 - DNA, 50 bp, homo sapien
tgaaccaatgctctcattttcaagawaacacacgaaagagtcaaaatgtt

SEQ ID NO: 30043 - DNA, 50 bp, homo sapien
gttaaagaagtgccttctctccttamgatttttgtgtggcctctcctgat

SEQ ID NO: 30044 - DNA, 50 bp, homo sapien
attctcagagtaactgtataaagcargtcttacttttccttttttacaga

SEQ ID NO: 30045 - DNA, 50 bp, homo sapien
aatgtgtacgatgttctggaaaacaratctccaagatgctgcaggttttg

SEQ ID NO: 30046 - DNA, 50 bp, homo sapien
atttgtataaattaatgatggtttaygcagccatgtctaatactttgttg

SEQ ID NO: 30047 - DNA, 50 bp, homo sapien
ttctttcagtttcagtgtttctagayacttcggctttgggtgtgtttctt

SEQ ID NO: 30048 - DNA, 50 bp, homo sapien
ataaaaataactgaaaaattatatgsaaaatacagatcaatgattgttct

SEQ ID NO: 30049 - DNA, 50 bp, homo sapien
tcatcttctgcatgagccttttgtargatttcccacacaattcctaaatt

SEQ ID NO: 30050 - DNA, 50 bp, homo sapien
taaaggaacaaatagattgttgtgamtatatagggtctgatgagccactt

SEQ ID NO: 30051 - DNA, 50 bp, homo sapien
gcaagttactattattatgtggaacrattaaggtggagaacttcaaatgc

SEQ ID NO: 30052 - DNA, 50 bp, homo sapien
ccgtctctctggagaaccctgatacwacgcgcatgaatcgcagatatgat

SEQ ID NO: 30053 - DNA, 50 bp, homo sapien
tactaaaggaatatttgaaatactaygctctcctaaataaacttctctaa

SEQ ID NO: 30054 - DNA, 50 bp, homo sapien
taaaggagtgccgtggaagaatctcratgaagcagaggaaagggacaaaa

SEQ ID NO: 30055 - DNA, 50 bp, homo sapien
atatcagggagagagttattaaacargtaaaaagtcatgaatacaatttt

SEQ ID NO: 30056 - DNA, 50 bp, homo sapien
aacactttcacacacatcatgtttayagaagtacaattggcaattgcaaa

SEQ ID NO: 30057 - DNA, 50 bp, homo sapien
tttttcttcaggagagtgtttctgcratgatcaagagcttttagaaaatg

SEQ ID NO: 30058 - DNA, 50 bp, homo sapien
cactctaaaatcactgaggtttatamtactaagagatagtactagacaag

SEQ ID NO: 30059 - DNA, 50 bp, homo sapien
aaccctctaggtgtgtctgttgcaarggatccacatttcagaacacccca

SEQ ID NO: 30060 - DNA, 50 bp, homo sapien
ctgcatgtgtaactgcaattcagtasccttcgtattatctgagaatcaga

SEQ ID NO: 30061 - DNA, 50 bp, homo sapien
tttaacagcccaaaagctatcaaagraagaatcattttaagagcttcaag

SEQ ID NO: 30062 - DNA, 50 bp, homo sapien
tgtgcatgtgtgtgtgatattaccamagctaagggaaggttttgtgtgtg

SEQ ID NO: 30063 - DNA, 50 bp, homo sapien
aaaaagagctcagatcatcttgtacyggcctctatgtttgaatggctgct

SEQ ID NO: 30064 - DNA, 50 bp, homo sapien
cgtgctgcccaggagacacaccacaktctgttctctctgctggggtattt

SEQ ID NO: 30065 - DNA, 50 bp, homo sapien
ggagggtgaggccactatgctgaaaycaatgatcaagtaaggaaagagac

SEQ ID NO: 30066 - DNA, 50 bp, homo sapien
attttatctgtgtcctgaatcgtcartctctttccttacttgatcattga

SEQ ID NO: 30067 - DNA, 50 bp, homo sapien
aaaacaaaacttatatgtgcttgtawaagatggactgcagagtttttgct

SEQ ID NO: 30068 - DNA, 50 bp, homo sapien
tttggttacttgaaacatagtaaaaragacatgcccttatctactttata

SEQ ID NO: 30069 - DNA, 50 bp, homo sapien
tgctgtaatcttaaatgtcttaaaargttcacatactattaatctatcag

SEQ ID NO: 30070 - DNA, 50 bp, homo sapien
aggtcctaaattagtataaagctaaygactgctgattgagagcaggtgga

SEQ ID NO: 30071 - DNA, 50 bp, homo sapien
ctactttcaggctgcgacgggagaaytgaatagttgtgacagagaccaca

SEQ ID NO: 30072 - DNA, 50 bp, homo sapien
gtgcccgggatgcctgtatctatgcscgtggacgttggagtagacagaaa

SEQ ID NO: 30073 - DNA, 50 bp, homo sapien
tggtaattctgagcctggttctttasgtatttaatttcagagactaataa

SEQ ID NO: 30074 - DNA, 50 bp, homo sapien
aaaaagattcattttctcattttaarccaattaaatattctgagtgagac

SEQ ID NO: 30075 - DNA, 50 bp, homo sapien
gaagaaaagatccgaggaaatacaastcctttcatcagacccttagatct

SEQ ID NO: 30076 - DNA, 50 bp, homo sapien
tgagcacacacaagcccttctatcaraatttagcaaaatgaggcatccta

SEQ ID NO: 30077 - DNA, 50 bp, homo sapien
ctccccaaagtgtgccaccattcaamataaagcccgttgcatttgctgtc

SEQ ID NO: 30078 - DNA, 50 bp, homo sapien
taaactgatacaagccaaagtcataraggactcccaagtcaaggcaatag

SEQ ID NO: 30079 - DNA, 50 bp, homo sapien
aagaacagagataaaaagaaaggtawcaagagtagactagatattaaaat

SEQ ID NO: 30080 - DNA, 50 bp, homo sapien
gagtcctctatgactttggcttgtawcagtttaaatatgactcctgaata

SEQ ID NO: 30081 - DNA, 50 bp, homo sapien
ctgaattaaatcttgtttccagctarcagaagggtatttgaaatacagat

SEQ ID NO: 30082 - DNA, 50 bp, homo sapien
acggcccacagctcaaaataaatggyagtgagcttcatcctgctgactag

SEQ ID NO: 30083 - DNA, 50 bp, homo sapien
ttggaaatcagagtgaaaacaatcasagaaaaatacttgtcaatcaaatc

SEQ ID NO: 30084 - DNA, 50 bp, homo sapien
tgccaaatgaccttgaaatgagctayataggcagagcaagaagaaagatg

SEQ ID NO: 30085 - DNA, 50 bp, homo sapien
gcaacggcttgtatctgggcttagaycacccttcacaggttgagggcacc

SEQ ID NO: 30086 - DNA, 50 bp, homo sapien
tcttggagatgaatcaggcatataarcaaatatgtactggacaaacagaa

SEQ ID NO: 30087 - DNA, 50 bp, homo sapien
gctattgtgatttctgggtcccacargttcaaaatttgcaagaacaacag

SEQ ID NO: 30088 - DNA, 50 bp, homo sapien
ggtaaattacatataccactttaacmatgagaaaatatatcccaaaattt

SEQ ID NO: 30089 - DNA, 50 bp, homo sapien
taaattcggaaaatgggatacattayctctagtgctcctttcaaatatag

SEQ ID NO: 30090 - DNA, 50 bp, homo sapien
agaagaaaaatttaaatttgtatatsaactaaaaaataaagaatatttca

SEQ ID NO: 30091 - DNA, 50 bp, homo sapien
aatatttcaaagatcaaaagaggaastgttaagaagtgagtttccactca

SEQ ID NO: 30092 - DNA, 50 bp, homo sapien
cctcaggaggtaggaaaatcctagaygctgagagactcactcaggagggg

SEQ ID NO: 30093 - DNA, 50 bp, homo sapien
gacaactttgggcagtgggtctcaamgaattcagcttcctaggccttcag

SEQ ID NO: 30094 - DNA, 50 bp, homo sapien
aaactccctcaaaattcctcgcacakaaatataacctttttggttcacct

SEQ ID NO: 30095 - DNA, 50 bp, homo sapien
aacctttttggttcacctgcataatyagtccaaagtaagcatacattatt

SEQ ID NO: 30096 - DNA, 50 bp, homo sapien
ttgagaaagagaatcaaaagacgctraaatgcttcagtctgtgcacaaat

SEQ ID NO: 30097 - DNA, 50 bp, homo sapien
ggctatgctctgtcaaatcatagacwcttactcagcaaaggggcatgtga

SEQ ID NO: 30098 - DNA, 50 bp, homo sapien
attcctgcagcccagtgtgaaatacracccgggaaagtgctgtcatatat

SEQ ID NO: 30099 - DNA, 50 bp, homo sapien
aaataattcccaacacgtacctgtcrcctgtctgtactcccatggggacg

SEQ ID NO: 30100 - DNA, 50 bp, homo sapien
aaatgaaactggagacaaaaccaccraatacttgtgccagttgctcttga

SEQ ID NO: 30101 - DNA, 50 bp, homo sapien
tcaggaaggcactagacttaacaatyacagctttattacgaacaatgcaa

SEQ ID NO: 30102 - DNA, 50 bp, homo sapien
ctttacttctcctcctagctgccaaygcgatctgtccactattaacagct

SEQ ID NO: 30103 - DNA, 50 bp, homo sapien
agtctgagttggctctcctttgcccrgacaggacttcacattagatgagc

SEQ ID NO: 30104 - DNA, 50 bp, homo sapien
caaatttttttaccatataagatgaygaacacaaaatcaacaccagagat

SEQ ID NO: 30105 - DNA, 50 bp, homo sapien
tctagtagggaatatgagacattgaygtatgacaattgttatagaataaa

SEQ ID NO: 30106 - DNA, 50 bp, homo sapien
acctcccaggtatgcagaactgagcrattttcaaaggtcttcaccattca

SEQ ID NO: 30107 - DNA, 50 bp, homo sapien
tatgttgttatgtgtgagtttggcaraaatgtagtagagtaacccagatg

SEQ ID NO: 30108 - DNA, 50 bp, homo sapien
atttacttttcgctatctcttcttayatagacgtgtttaaatatttcatt

SEQ ID NO: 30109 - DNA, 50 bp, homo sapien
aacctttttatcattcagaaagttayatcattcagaaagcacccctccag

SEQ ID NO: 30110 - DNA, 50 bp, homo sapien
aaaccaccttactatgattgctttcrccaacgaattcttaagaggaaggt

SEQ ID NO: 30111 - DNA, 50 bp, homo sapien
ccgagcccaccaagcctcccagaaaycatgtcagaaacgccttcttagga

SEQ ID NO: 30112 - DNA, 50 bp, homo sapien
acaactcattgtggacccgagctgcygacaattaaactgaatgtatgagt

SEQ ID NO: 30113 - DNA, 50 bp, homo sapien
aggcaggaaggagaatttgaggtacmcatgacctttgagttctggcaaag

SEQ ID NO: 30114 - DNA, 50 bp, homo sapien
gaaggtgatggaataattttaagaarcaagaatctgaatgaagtctggat

SEQ ID NO: 30115 - DNA, 50 bp, homo sapien
aaaaactacatgtcaaatggccctarataacttataactcttacaaagac

SEQ ID NO: 30116 - DNA, 50 bp, homo sapien
tttcaacacacagaatacagtaatayggtgtgtgtacatgctatatcatt

SEQ ID NO: 30117 - DNA, 50 bp, homo sapien
atggtatttccatcagttttattggmcacatgtcatgacagtaggaaaca

SEQ ID NO: 30118 - DNA, 50 bp, homo sapien
gttttcatatttgtgaaataggcttwaaaacacctaaatcccaaagctgc

SEQ ID NO: 30119 - DNA, 50 bp, homo sapien
gatgggtgccctcagaactaagggarcgacaagagtcaaggcttggaacc

SEQ ID NO: 30120 - DNA, 50 bp, homo sapien
gggtgtggaattttgagactgtttasctccacatggtttcaaacctacag

SEQ ID NO: 30121 - DNA, 50 bp, homo sapien
tcaggagagcttgtgagagaagtccratcagaaaggctttgaggaggccg

SEQ ID NO: 30122 - DNA, 50 bp, homo sapien
gttgtaatcaatgtctcatgtgcaargtgccatctgtaaaaactaagagg

SEQ ID NO: 30123 - DNA, 50 bp, homo sapien
ttgttgaacaatatcctttctttccraaaaataatgtttctcttttttcg

SEQ ID NO: 30124 - DNA, 50 bp, homo sapien
tgctgagtaatgtctattttgtgtayaattctgcactttcaagctttcct

SEQ ID NO: 30125 - DNA, 50 bp, homo sapien
aatgaacaactctaggataaaacaasttatacgtgacaggtactcagtca

SEQ ID NO: 30126 - DNA, 50 bp, homo sapien
ccagcaccttccattgccttattcamataaagtatcaggcatgaactagg

SEQ ID NO: 30127 - DNA, 50 bp, homo sapien
caaaaacattgaaaggcaaaatctaygctccgatgttctgtacaaattcc

SEQ ID NO: 30128 - DNA, 50 bp, homo sapien
tagataaataactgaagaagacagawcaagtaatttactagtacatggta

SEQ ID NO: 30129 - DNA, 50 bp, homo sapien
gtagcccttattttctgtgtagagaygctttccatccagatcagggagta

SEQ ID NO: 30130 - DNA, 50 bp, homo sapien
ttagcaaatgcttaataaatgttaamagtcatcattggtaggacacatct

SEQ ID NO: 30131 - DNA, 50 bp, homo sapien
ccattcaattttggcttctctttaamcatattgaccctagtttgttttca

SEQ ID NO: 30132 - DNA, 50 bp, homo sapien
atttatttgaaaacagaaacaaaacygtatgtggacactgattgcctgtt

SEQ ID NO: 30133 - DNA, 50 bp, homo sapien
tctgactgatgtgagaataagcatgmagagtcttgcttttaacacaggta

SEQ ID NO: 30134 - DNA, 50 bp, homo sapien
tcatctggccgttgtaacggaaacastcttgcccatttcagatcctgttt

SEQ ID NO: 30135 - DNA, 50 bp, homo sapien
tctattttgcatatgtttcatagcarcttgaaaggataaaataataattc

SEQ ID NO: 30136 - DNA, 50 bp, homo sapien
ttgatgatattgaaaatagggtcctraaaacctcgatttctgcttgttgg

SEQ ID NO: 30137 - DNA, 50 bp, homo sapien
aatgatgggttaataggatcatgaaratttccagagagttgagtcacttg

SEQ ID NO: 30138 - DNA, 50 bp, homo sapien
ggtgcttcggtcttccttcatttcamaaatgtcttaggtgccttccacac

SEQ ID NO: 30139 - DNA, 50 bp, homo sapien
aacctggctggctattagagatatcrcatggaggagaaattagatgccca

SEQ ID NO: 30140 - DNA, 50 bp, homo sapien
agctggacaacatgttcgttcatctyaccaacgtcgccatccagaaacac

SEQ ID NO: 30141 - DNA, 50 bp, homo sapien
aatctaactggagagggaagactcayccattgaaactatatgggcatcta

SEQ ID NO: 30142 - DNA, 50 bp, homo sapien
ttgtgaagcagaagtattcatcatamcagttgaggcttatattaccctgt

SEQ ID NO: 30143 - DNA, 50 bp, homo sapien
aataatttgcagcttaatttttcgtraagactcaatagggtcctcgtgct

SEQ ID NO: 30144 - DNA, 50 bp, homo sapien
ggacttccagccttcaggactgtgargaataaatgtctgtggtttataat

SEQ ID NO: 30145 - DNA, 50 bp, homo sapien
tcattgcattcaaataatcataaaaygtgtacctgcattaaatgaggcag

SEQ ID NO: 30146 - DNA, 50 bp, homo sapien
cttaggggccattgcaggtgaagtamcttttatttatctgggagagtatg

SEQ ID NO: 30147 - DNA, 50 bp, homo sapien
cccttcgacggtttaatcctccagcsactgtttacagagaactttctgtg

SEQ ID NO: 30148 - DNA, 50 bp, homo sapien
ttgttttggaacccaagttaatgacrcaccttttcttgtgtgggctacac

SEQ ID NO: 30149 - DNA, 50 bp, homo sapien
gtcaaacgaagcatggcttttaatgwcacagaaggttttgaaatgaccta

SEQ ID NO: 30150 - DNA, 50 bp, homo sapien
cagtttgaatgctaattctccttaaraggcttcattaaaaataataaaat

SEQ ID NO: 30151 - DNA, 50 bp, homo sapien
gttattaaggctggtttactactaaratgaaatccccaactgaatgcttc

SEQ ID NO: 30152 - DNA, 50 bp, homo sapien
tcataaatgaagtcagccttataaastgtgaaatccaagacgcgggctga

SEQ ID NO: 30153 - DNA, 50 bp, homo sapien
aatagtaagaaaaaaataaatctacwaatcactgatggaatagctatggt

SEQ ID NO: 30154 - DNA, 50 bp, homo sapien
gcaaaaagagaacatgtaaactagarcgtatgcagggtgatctggggatg

SEQ ID NO: 30155 - DNA, 50 bp, homo sapien
cttcatttatgaccatgttgtatgcrctctcatgtttcagaccaccagat

SEQ ID NO: 30156 - DNA, 50 bp, homo sapien
ttgattaagagcttattcacacagaycatatagaatgtggagtgagggca

SEQ ID NO: 30157 - DNA, 50 bp, homo sapien
cctccctctgattattaatattctaycacccaattttcaaaaatgtaatt

SEQ ID NO: 30158 - DNA, 50 bp, homo sapien
ctattaaaataatagaaacaattcaktaacttccagattcattggggtta

SEQ ID NO: 30159 - DNA, 50 bp, homo sapien
cagatgttgcatttcccaatgaaaaygatgatttattatgaaaaaagaaa

SEQ ID NO: 30160 - DNA, 50 bp, homo sapien
acttaaaagactgtggtagatcaggycacattaacggatcagtgcaagag

SEQ ID NO: 30161 - DNA, 50 bp, homo sapien
atttgagaaatcagcatgttttggayacaatgtctgtgctagacagaatt

SEQ ID NO: 30162 - DNA, 50 bp, homo sapien
catacaggctttgtagatgaagtcayggttattgtggaaataaaaagatg

SEQ ID NO: 30163 - DNA, 50 bp, homo sapien
gcagcctcttctctgtccctcagcckctggaattatggtgagttgtgaac

SEQ ID NO: 30164 - DNA, 50 bp, homo sapien
ggatcccatgaagttgaaggagtgayacgaggccctgtcgtaggtccagg

SEQ ID NO: 30165 - DNA, 50 bp, homo sapien
atgtactttttattgtggtaaaataygcatcacatgggatttgccatttt

SEQ ID NO: 30166 - DNA, 50 bp, homo sapien
acacggcaagctatgaaacttcaaaygagacttaaaatgttcagtaaaaa

SEQ ID NO: 30167 - DNA, 50 bp, homo sapien
tcctgctcatcaaagtagaaaacgaytccagtgaggttaagtgtcttgtc

SEQ ID NO: 30168 - DNA, 50 bp, homo sapien
tattccaatgtagattcatgtgaaargttctacatatcagacaaacccaa

SEQ ID NO: 30169 - DNA, 50 bp, homo sapien
aaatgtgtaggaatagcagagggtcratatttagacagccattctcactc

SEQ ID NO: 30170 - DNA, 50 bp, homo sapien
tttcttgccctagaaccaagagtgaygggacttggaacaggttctatttg

SEQ ID NO: 30171 - DNA, 50 bp, homo sapien
gaaccaaaaacaattgtttctaaacrctgaagtcaccaccgagactcaaa

SEQ ID NO: 30172 - DNA, 50 bp, homo sapien
gttgccttttgctctgaagacgatckgacagttctgatatgcgggtttat

SEQ ID NO: 30173 - DNA, 50 bp, homo sapien
tcaaggggctgtagggatgtaacccrgaaaaggagcaggaaagtccctcg

SEQ ID NO: 30174 - DNA, 50 bp, homo sapien
ttcaacacaatctcaacagaatgaaygaaaacttcagtatgccatgaaat

SEQ ID NO: 30175 - DNA, 50 bp, homo sapien
tccagagtctgctcttataacctcaygttacattatgctctccattgggt

SEQ ID NO: 30176 - DNA, 50 bp, homo sapien
ttcacctgcttcagttaagaccacamctacttcatcccagtcagatgtgt

SEQ ID NO: 30177 - DNA, 50 bp, homo sapien
aagttttcaaaaaccaagtgatataraagaaagaaaaagagattaaagaa

SEQ ID NO: 30178 - DNA, 50 bp, homo sapien
tgctttggatggcactgagtttatgsatttcatttagaataattgatatt

SEQ ID NO: 30179 - DNA, 50 bp, homo sapien
cagcctaaaattcactcagccacgawagagagacattagcaccgctttgt

SEQ ID NO: 30180 - DNA, 50 bp, homo sapien
aatagttcattgtgccaagtagcacrcattcaattactcttgaagctact

SEQ ID NO: 30181 - DNA, 50 bp, homo sapien
taagagataccaagtgaaatttagaygatgaggcgagggtaaaactgatc

SEQ ID NO: 30182 - DNA, 50 bp, homo sapien
aaagaagagggggttctgatcagggmaaaaagaatttggctaccacgtaa

SEQ ID NO: 30183 - DNA, 50 bp, homo sapien
tagttaccgaagtaaaagaagaagaygctttttactccaaaaagtaagaa

SEQ ID NO: 30184 - DNA, 50 bp, homo sapien
cacgaggcagggactatcattttacyaatgagaacaaggctcagagtggt

SEQ ID NO: 30185 - DNA, 50 bp, homo sapien
ggacggcagagttctggaacctcccrctgacactatcgggcaaagagctc

SEQ ID NO: 30186 - DNA, 50 bp, homo sapien
gtcatgtgtatgttccaggaaacaastcataaaaggcatttggctcaaat

SEQ ID NO: 30187 - DNA, 50 bp, homo sapien
cgacagagctctaggaatatacctcrctctagctgttgttgctggtcctg

SEQ ID NO: 30188 - DNA, 50 bp, homo sapien
ttcatgccacagcataacccgcagaygaacttaaaccttctacaatttca

SEQ ID NO: 30189 - DNA, 50 bp, homo sapien
aatacgtgttaatacgaccatgagtraaaggcccttcctggccgggcgca

SEQ ID NO: 30190 - DNA, 50 bp, homo sapien
gaggtaggttgtaatggcaccagatrataattcattggcaaatatctaat

SEQ ID NO: 30191 - DNA, 50 bp, homo sapien
gtggcccttattggcagaaactaaasaagatccctgctggcaaaggattg

SEQ ID NO: 30192 - DNA, 50 bp, homo sapien
atctagaaaagtgggctactaggtaygatccatgtacgtaatgacatcca

SEQ ID NO: 30193 - DNA, 50 bp, homo sapien
tcctggctgtgtaattcctgggtacragggtaaatctgatggatgtcatt

SEQ ID NO: 30194 - DNA, 50 bp, homo sapien
aaagtgattggtctaaagttaagaasataactcacagaggtgaaattagc

SEQ ID NO: 30195 - DNA, 50 bp, homo sapien
tcacagttggaaaaactctgcttaasgctcaaaggtgagttagtgctgcc

SEQ ID NO: 30196 - DNA, 50 bp, homo sapien
ttaaagaacttactttaaatatctcmcctgagtgaagtgtttattaaagc

SEQ ID NO: 30197 - DNA, 50 bp, homo sapien
aaagcaaactagaggtctccatttakcagaagtggtaatgacagtgatat

SEQ ID NO: 30198 - DNA, 50 bp, homo sapien
cagatttgatttaggagtatgtttcrcaacaggtagtttttatatacagg

SEQ ID NO: 30199 - DNA, 50 bp, homo sapien
gtgtgacggggacactcagtctcacrcattacccggctctctaagcacgt

SEQ ID NO: 30200 - DNA, 50 bp, homo sapien
aaaattaaaaaaataataatcccggyaatgaaatgcactgtctgttcata

SEQ ID NO: 30201 - DNA, 50 bp, homo sapien
taataaaatacctaaatgtcaaccaratttataaaaatgtattcatagtt

SEQ ID NO: 30202 - DNA, 50 bp, homo sapien
ctaggaagagccaactcaaatgtacrgcgtggctcattgccttgtagagt

SEQ ID NO: 30203 - DNA, 50 bp, homo sapien
gagctgtgtagaattccagagtccaragggatggttttcaggagttttca

SEQ ID NO: 30204 - DNA, 50 bp, homo sapien
catgctgactctaaccagtaaagagraccacctgtaattatgcccaacac

SEQ ID NO: 30205 - DNA, 50 bp, homo sapien
gagtgtaatagctaggtgtaaagtcrgacaagcctgggattgaattctgc

SEQ ID NO: 30206 - DNA, 50 bp, homo sapien
ttttgatggctgaataatatttcacsgcatggatataccacatattcttt

SEQ ID NO: 30207 - DNA, 50 bp, homo sapien
tagaaagattttcacaattgaaacaratcatgaaaccatcgaaattttgt

SEQ ID NO: 30208 - DNA, 50 bp, homo sapien
tatgattgtggttatttgtgtactcyatctctccaactgtaccttaagct

SEQ ID NO: 30209 - DNA, 50 bp, homo sapien
tacttgctcctcaatcttttcttacsaacaagcatcatcatctattctac

SEQ ID NO: 30210 - DNA, 50 bp, homo sapien
agagtgctataaaggctacagacatraaatattatttccaatatgcaagg

SEQ ID NO: 30211 - DNA, 50 bp, homo sapien
gcttttaaccctccactacctaaaaytcactcgttctgtgctctcacttg

SEQ ID NO: 30212 - DNA, 50 bp, homo sapien
ttcaaatgttcatattggaaacaagsatatcataatgtcatcagtgttga

SEQ ID NO: 30213 - DNA, 50 bp, homo sapien
caacatcctaatcttggactttggartcaggaatattttaggtgaaagca

SEQ ID NO: 30214 - DNA, 50 bp, homo sapien
tagataaaaaaataaattggtctacraaagaatgttgtggtatagatgtt

SEQ ID NO: 30215 - DNA, 50 bp, homo sapien
ttactttaaggcgaatgtgactgagmcacccaatttcatgaatggcactg

SEQ ID NO: 30216 - DNA, 50 bp, homo sapien
cctccaagttgatacctatacatcartcaacttttgaattccccttagac

SEQ ID NO: 30217 - DNA, 50 bp, homo sapien
tttagtgacttgcttttttttctccragtctttacagaatgttctactta

SEQ ID NO: 30218 - DNA, 50 bp, homo sapien
agccacacaaatgacagaataatgastatgtggaaaaacagctgagtgct

SEQ ID NO: 30219 - DNA, 50 bp, homo sapien
gaacaaaagggcagaagaagaataaratggtccacagatattgcaggtga

SEQ ID NO: 30220 - DNA, 50 bp, homo sapien
ttcaactttattttttaatcataaamgcatacagttagatattaaacatg

SEQ ID NO: 30221 - DNA, 50 bp, homo sapien
ctggcagcctgaggaattagctctgyagaatgttcagaatttgttctgtg

SEQ ID NO: 30222 - DNA, 50 bp, homo sapien
ataggacaaaaatattgttaaattckaaaaggtagtggccgggcgcggtg

SEQ ID NO: 30223 - DNA, 50 bp, homo sapien
attacaaacatcttatgcgctggtcraaatgttttgtcatcaagggaaaa

SEQ ID NO: 30224 - DNA, 50 bp, homo sapien
gaaatgttttgtcatcaagggaaaayaggtattgttacttaaaatggtct

SEQ ID NO: 30225 - DNA, 50 bp, homo sapien
ttttccaaattgggagtttgagaacyggagtattttaatggtgagattgc

SEQ ID NO: 30226 - DNA, 50 bp, homo sapien
agtccagttaaataattaaaaagccraaagggcatatttccagaattaaa

SEQ ID NO: 30227 - DNA, 50 bp, homo sapien
tcttgcctttcaaaacaatgtctccrctgaaatgcccagaagaataacgt

SEQ ID NO: 30228 - DNA, 50 bp, homo sapien
tgataggggaaagttttcagggaaaragtctacacaatagtagaatctga

SEQ ID NO: 30229 - DNA, 50 bp, homo sapien
taggattaactatctctttgtgtccyacattacatagtgcctcttcttgt

SEQ ID NO: 30230 - DNA, 50 bp, homo sapien
tttggctctaggtagagtctgtttgsattctatgaaaaaaaaaatagcag

SEQ ID NO: 30231 - DNA, 50 bp, homo sapien
ctcatagttcatcatccttttttcayaaaattataataacagttatacct

SEQ ID NO: 30232 - DNA, 50 bp, homo sapien
tgctgggcattgtgatattagaggtraagaaaatagacaaggtccctgcc

SEQ ID NO: 30233 - DNA, 50 bp, homo sapien
atatttactaggcagctaccttaaartctatagcttctgagaggcaaggc

SEQ ID NO: 30234 - DNA, 50 bp, homo sapien
tatttctggtttcagtctctttttcrattcacattacataactatattat

SEQ ID NO: 30235 - DNA, 50 bp, homo sapien
tttgtaaatgaaatgtttttttacaygtgtaggaattagagtgacttaca

SEQ ID NO: 30236 - DNA, 50 bp, homo sapien
taagctccccagccttatttaattamcttggaggaccttattctcagaaa

SEQ ID NO: 30237 - DNA, 50 bp, homo sapien
ccttttggctttttaattatttaacyggactatgatatacaaaaatggta

SEQ ID NO: 30238 - DNA, 50 bp, homo sapien
ataaatgctctgtcaagtgtatgaamatgaaactcttagcactatgcaaa

SEQ ID NO: 30239 - DNA, 50 bp, homo sapien
gtacatcttcttgagaagtctttggwagtgacacatgttccaatacttcc

SEQ ID NO: 30240 - DNA, 50 bp, homo sapien
taaatgagctcaacaccaaaagtccrataggcttctcaactgttatctct

SEQ ID NO: 30241 - DNA, 50 bp, homo sapien
cagaaaataaataagaaagacaatcraagttgcctggaggaagtaaggtt

SEQ ID NO: 30242 - DNA, 50 bp, homo sapien
gctcatcaagagatttcagactcaartaagtatcctgctctctgctaatt

SEQ ID NO: 30243 - DNA, 50 bp, homo sapien
cttgctaaaagcttcttggtgaacartaactctccaacacttggggcaac

SEQ ID NO: 30244 - DNA, 50 bp, homo sapien
aagaatttttaagccatcttggtgcsgaagaactattctatatacccaaa

SEQ ID NO: 30245 - DNA, 50 bp, homo sapien
tgagagagtgtagtatgggacttagyaccatgtttggcagatagcatggg

SEQ ID NO: 30246 - DNA, 50 bp, homo sapien
gaattttgagctttgaagaattccartattaaggaagcccactgagaaaa

SEQ ID NO: 30247 - DNA, 50 bp, homo sapien
gtcagtgctatcctactggtactacrggcacgcctactgttactgtgagt

SEQ ID NO: 30248 - DNA, 50 bp, homo sapien
caaataagtggttttactgtttttcyctggtgaattaattagttgtttaa

SEQ ID NO: 30249 - DNA, 50 bp, homo sapien
catacctgtatcccaagagtagatayagcccgatactacagtggatactc

SEQ ID NO: 30250 - DNA, 50 bp, homo sapien
caacaaccttcttgaatgtgtaagamgctatcattccaacaattataaaa

SEQ ID NO: 30251 - DNA, 50 bp, homo sapien
cttcctagtttgaatctgggctcatyatagttttcccccaggtgtacctc

SEQ ID NO: 30252 - DNA, 50 bp, homo sapien
tagccttggtaacagtatttgaataygcatgataataaatttgttcatat

SEQ ID NO: 30253 - DNA, 50 bp, homo sapien
attaaattcactaatgatcctaaacygagcagaggagtaaattccagaaa

SEQ ID NO: 30254 - DNA, 50 bp, homo sapien
atttaagttattccttccgtgttaaycatagagaggtgattatgtctttc

SEQ ID NO: 30255 - DNA, 50 bp, homo sapien
caagagcaattaatgatcacgtactsaagcacaagcgagaagagagagaa

SEQ ID NO: 30256 - DNA, 50 bp, homo sapien
agaggtggcgaccatatcagagagcraatgctttaacctacacaattaaa

SEQ ID NO: 30257 - DNA, 50 bp, homo sapien
attcttttgtcatatttagagaccaraaatgtactaagagcacaaaatca

SEQ ID NO: 30258 - DNA, 50 bp, homo sapien
aagatacgatagagagatttattacrggaattagcctacgtgattatgga

SEQ ID NO: 30259 - DNA, 50 bp, homo sapien
ttcagaacctaagaaactctatcaaygtttaagcaagggaaccctgtaga

SEQ ID NO: 30260 - DNA, 50 bp, homo sapien
gaaggagagtaaaatggcttgtggarctgatcagaatgcaatctgcagct

SEQ ID NO: 30261 - DNA, 50 bp, homo sapien
aatagagaaaggcactgtgatgggaraagaagtaaacagtttcagagctc

SEQ ID NO: 30262 - DNA, 50 bp, homo sapien
ttctagtccagggaggcaccaaagaygattgacaaggagtgcagatatat

SEQ ID NO: 30263 - DNA, 50 bp, homo sapien
tttagtgctcctctatcaaattttaygcttttctttcaactaggtcttgc

SEQ ID NO: 30264 - DNA, 50 bp, homo sapien
tcaaggtttttcatcgattcataccragaggcacagccacatagtattgt

SEQ ID NO: 30265 - DNA, 50 bp, homo sapien
aactaattatatgttgttttcattargcagatgtatgggatagtaccaat

SEQ ID NO: 30266 - DNA, 50 bp, homo sapien
acaagttgattgattaatacgacaayatagtctaggtcagaaactgccac

SEQ ID NO: 30267 - DNA, 50 bp, homo sapien
aaggaagcaacattttagataacacraatcaaacgagtttagaaaaagtc

SEQ ID NO: 30268 - DNA, 50 bp, homo sapien
ctttttgaagctttctttacgattcraaagaaatgacaatctgaaaggac

SEQ ID NO: 30269 - DNA, 50 bp, homo sapien
ggaaccacagatatcttttacccacrgagaaacattttcatcaaataata

SEQ ID NO: 30270 - DNA, 50 bp, homo sapien
aaccaatttaggtatttgttctgcayaggtatttattattgtaacaccat

SEQ ID NO: 30271 - DNA, 50 bp, homo sapien
aggaagagaaatagccaagagagaayagtatagataggagacagaatctc

SEQ ID NO: 30272 - DNA, 50 bp, homo sapien
tcacagagcttaagattgatacacamaaagcagctggacaccacagacat

SEQ ID NO: 30273 - DNA, 50 bp, homo sapien
aaaagattatgaaactatggtataaycctctaattgatagtgatattggt

SEQ ID NO: 30274 - DNA, 50 bp, homo sapien
cagtcccctgtgcatggccaaaaaaygcaatgggactgacttctaaccag

SEQ ID NO: 30275 - DNA, 50 bp, homo sapien
cggggatgcaggcactgctgtttcartatgggccttcccaaattctggac

SEQ ID NO: 30276 - DNA, 50 bp, homo sapien
acttcaaagaccacttcaaatattamcgcctctgtgaattctttcctgac

SEQ ID NO: 30277 - DNA, 50 bp, homo sapien
acatggtcctgcccttgaaacgtgcrgattatggatattacaattcaaga

SEQ ID NO: 30278 - DNA, 50 bp, homo sapien
ttgccatatctcacctaaccaaaaawgtctatcaaaatttagttttacca

SEQ ID NO: 30279 - DNA, 50 bp, homo sapien
aactgaaaacatacaagaactcaggracatatagcacacattccattagc

SEQ ID NO: 30280 - DNA, 50 bp, homo sapien
aaagatgttttatcagtgtcaataakgcaaatgtaaaacattaagatcca

SEQ ID NO: 30281 - DNA, 50 bp, homo sapien
gaggatacaaaagtgatcaagctacygattcaaatttagttaatttttta

SEQ ID NO: 30282 - DNA, 50 bp, homo sapien
aagcttcaattgtgaatactctcctkacaatttttcatgtataattttgc

SEQ ID NO: 30283 - DNA, 50 bp, homo sapien
atattgtattgaccggagagaaaaayaaatctttgcaaaataacatactt

SEQ ID NO: 30284 - DNA, 50 bp, homo sapien
tgggtttctagctaacatttctcccyaatagacgcctacagtaaagcttc

SEQ ID NO: 30285 - DNA, 50 bp, homo sapien
ttatgccaacttatatcaaggtttayatactcctttgaaaagtaaaatct

SEQ ID NO: 30286 - DNA, 50 bp, homo sapien
cacaaagtttgaaaacgatccctagmatgacatcaagtcaagggattatc

SEQ ID NO: 30287 - DNA, 50 bp, homo sapien
gcttgaatcagaaaggagacgtgtcwgaataattcatgagtgactctccc

SEQ ID NO: 30288 - DNA, 50 bp, homo sapien
attcagactaccacagtttatgccaratatatgccataataaccacatga

SEQ ID NO: 30289 - DNA, 50 bp, homo sapien
ggggaaggaaatgctttaaataatgrataatggtgttgctgatactaatt

SEQ ID NO: 30290 - DNA, 50 bp, homo sapien
agcctagtaccaattggaaatagtcrattatttggtgtttcaggataacg

SEQ ID NO: 30291 - DNA, 50 bp, homo sapien
cattagctatgaacttaaactcaaartacatgttgatggcattaaaaaaa

SEQ ID NO: 30292 - DNA, 50 bp, homo sapien
aatcaccatatttctcctttattaargctgtctccaatggcattctcagc

SEQ ID NO: 30293 - DNA, 50 bp, homo sapien
tgtcatcttccttctgtcatcctgcmatagagctattcctttactgaagg

SEQ ID NO: 30294 - DNA, 50 bp, homo sapien
aagcccaggtttttgtttttggttcmacatatattagtactgcattaaga

SEQ ID NO: 30295 - DNA, 50 bp, homo sapien
ttcttggaagtagctgagaattgaargagcctgaaagtttatgagagagg

SEQ ID NO: 30296 - DNA, 50 bp, homo sapien
tccagtggacagtccgtttcttggamgtagctgagaattgaaggagcctg

SEQ ID NO: 30297 - DNA, 50 bp, homo sapien
gacatatggtaaaaatctaagaatarcatcataaatcatccatgcctctg

SEQ ID NO: 30298 - DNA, 50 bp, homo sapien
ttcttccagttaactatgtgcaaagyaggaagtttaaaaagtggttgctt

SEQ ID NO: 30299 - DNA, 50 bp, homo sapien
agctggaagcaatccaagtgtccatraaaaggtaaatggataaacaaaat

SEQ ID NO: 30300 - DNA, 50 bp, homo sapien
gggagtctaggcttgtaccctcatgmagctgtatttaggtgccagagaag

SEQ ID NO: 30301 - DNA, 50 bp, homo sapien
atcattccctgctccctaaatattcsaacagtatttgcttatattttagt

SEQ ID NO: 30302 - DNA, 50 bp, homo sapien
taatgttcaaaaatattagatagccraaagactcagagaatccaatgtgt

SEQ ID NO: 30303 - DNA, 50 bp, homo sapien
ggtcctatgggggagagcaaataaasatgtcccttatctgtgcaaataat

SEQ ID NO: 30304 - DNA, 50 bp, homo sapien
ttgtaataactttggtgttaattgaygttagctggaacagaaaagaacac

SEQ ID NO: 30305 - DNA, 50 bp, homo sapien
ggatcgaatatccatcagtctaaggyagtatataggggaaagaggaggaa

SEQ ID NO: 30306 - DNA, 50 bp, homo sapien
ttttttttatggcagccttaggaaawgaatacaagccccaataaaaactt

SEQ ID NO: 30307 - DNA, 50 bp, homo sapien
caatcattctttcttaatatcaaagyctatgcaccttctacctcacaggc

SEQ ID NO: 30308 - DNA, 50 bp, homo sapien
atctggtaattatcaggtaatgaaaygagcaatggtaagtatattattaa

SEQ ID NO: 30309 - DNA, 50 bp, homo sapien
cacacaggcaggcaactgatgcaaartgctacttcaaagaccccttcatt

SEQ ID NO: 30310 - DNA, 50 bp, homo sapien
tggctctcacacatgtccataagaaygtcagaggaaataatcacaccctg

SEQ ID NO: 30311 - DNA, 50 bp, homo sapien
tattagaaatacccttaattatcacscagaaataattggttccagtggaa

SEQ ID NO: 30312 - DNA, 50 bp, homo sapien
cagaaaccctgaatacttttctttcraatcagcatgaaatggaccatata

SEQ ID NO: 30313 - DNA, 50 bp, homo sapien
aacaaaaaggtaatctgtcttctggraatgttaacactttaaagagaatg

SEQ ID NO: 30314 - DNA, 50 bp, homo sapien
tagattaatagaatagtgaatcctcraagttgacgactgcatacttaaac

SEQ ID NO: 30315 - DNA, 50 bp, homo sapien
atgtatgtagttctgataatattcasctccattcttgggtctcttgaagt

SEQ ID NO: 30316 - DNA, 50 bp, homo sapien
ttattcggaagatgttttatttaagsctccttttcatttcaaagttaatt

SEQ ID NO: 30317 - DNA, 50 bp, homo sapien
attactaaacttcatcttttcacccrcagattgacatttgagtagtgaaa

SEQ ID NO: 30318 - DNA, 50 bp, homo sapien
tccactaatttttaaggtctatctcraaacattctctacagagtccttgc

SEQ ID NO: 30319 - DNA, 50 bp, homo sapien
aagacctatttacaggacgaaaaaartacttaacacatgataactgttag

SEQ ID NO: 30320 - DNA, 50 bp, homo sapien
atatttcctaaccgatcctttgcaaraaaagttcacccactcctgtagtc

SEQ ID NO: 30321 - DNA, 50 bp, homo sapien
gttaccacttttcatcagaatgaaastgatcaaatattgtgtgaatgctt

SEQ ID NO: 30322 - DNA, 50 bp, homo sapien
attaggccactttcaacacaatgtgrattaacctaccaacgtgcggtcct

SEQ ID NO: 30323 - DNA, 50 bp, homo sapien
atcttccaattgtctgtatactgtaygtgagcaactattataaaaacagt

SEQ ID NO: 30324 - DNA, 50 bp, homo sapien
ctgccagtaagtctagttccatttakatttctcttttgtttaaaaacctg

SEQ ID NO: 30325 - DNA, 50 bp, homo sapien
ctggggagcctgcagacggtctgtgsatgaaatgggctttcaaggatgga

SEQ ID NO: 30326 - DNA, 50 bp, homo sapien
agatcctctgtttctttggaaaatgrcaccagattttatggagaactgaa

SEQ ID NO: 30327 - DNA, 50 bp, homo sapien
cagcatggaattggtttatccttctyaagctaatgcaaaaatgttttgta

SEQ ID NO: 30328 - DNA, 50 bp, homo sapien
aaagagacaattccactgcatacatsaaggcagctagttccagatacaga

SEQ ID NO: 30329 - DNA, 50 bp, homo sapien
atatggtatgtaatgtggcattagcrcaaacttcagcagccaagaacaat

SEQ ID NO: 30330 - DNA, 50 bp, homo sapien
atagagatggaaaagggttgatatcrgagattgtttttaattcttgcaaa

SEQ ID NO: 30331 - DNA, 50 bp, homo sapien
agagttcagctctcatcagtgtgagmagtgccaagtagcaggacgattgg

SEQ ID NO: 30332 - DNA, 50 bp, homo sapien
ggtcacttcagttttgtagagagaaygctaattactgtaaaaggcatttt

SEQ ID NO: 30333 - DNA, 50 bp, homo sapien
gcccttggcaacagaagtaacagcaragtaaacccattaaatagctgcta

SEQ ID NO: 30334 - DNA, 50 bp, homo sapien
ctatcttggaaccttaaatccttggragaaaactaagttgccaatgtagt

SEQ ID NO: 30335 - DNA, 50 bp, homo sapien
attacaactcaagtgagatcattgarctgtatcttgacctagggccatct

SEQ ID NO: 30336 - DNA, 50 bp, homo sapien
gaaagttaacctattatatctctaamctttgacatttctttcacttgttt

SEQ ID NO: 30337 - DNA, 50 bp, homo sapien
gaagggaagtttaaaagagagcatarcaacaaagcagggcaaagatctgg

SEQ ID NO: 30338 - DNA, 50 bp, homo sapien
gagctcgtggtacaaggactacctasattaaatgcatattggtttgtttg

SEQ ID NO: 30339 - DNA, 50 bp, homo sapien
gtatacagtataattctggagcatcratcttacacaactctctctcagat

SEQ ID NO: 30340 - DNA, 50 bp, homo sapien
atgtatccaccccaaatctgaggatratcattagtcaaaaacaggcagtt

SEQ ID NO: 30341 - DNA, 50 bp, homo sapien
ttcagccacctctcaaattatactaygaagcaagtccctcatcaatttgt

SEQ ID NO: 30342 - DNA, 50 bp, homo sapien
catgtgacattttacttagtgtggaygaggggaagtcaactgcagcaaaa

SEQ ID NO: 30343 - DNA, 50 bp, homo sapien
cacgcactgatcatttaacagtctaygtgggtaaggagtaactattgtac

SEQ ID NO: 30344 - DNA, 50 bp, homo sapien
gcatgtccagcattttgctaagtccygaggatgcaaataaatatatatag

SEQ ID NO: 30345 - DNA, 50 bp, homo sapien
ggggaaagattatactatgtccttawgcagaaatacatgaagcagatttc

SEQ ID NO: 30346 - DNA, 50 bp, homo sapien
gcttctgttgagatggtggtttcaarctgtgttcccacacctcttggaat

SEQ ID NO: 30347 - DNA, 50 bp, homo sapien
agatgaatctgaccagcttaacttakatcaggtgaaaaccacagcccagt

SEQ ID NO: 30348 - DNA, 50 bp, homo sapien
gctctttcatattcagtggtagattkaaaatttccttcctcgatattatt

SEQ ID NO: 30349 - DNA, 50 bp, homo sapien
ggggataccttaggttctgtcattaycaacatggttaatcctgtacttcc

SEQ ID NO: 30350 - DNA, 50 bp, homo sapien
gggtcctctctgacccatgagcaackaattgtatcccggctctgagtgac

SEQ ID NO: 30351 - DNA, 50 bp, homo sapien
agtcaactttatatgaacaggatgaratagcatacaacaggatgatatta

SEQ ID NO: 30352 - DNA, 50 bp, homo sapien
ttcataagtcacccagaagaacacartgtaattccctttagagtatcctc

SEQ ID NO: 30353 - DNA, 50 bp, homo sapien
tataagtcatactcaaacatattcamgagccatatacctgaccagaaaat

SEQ ID NO: 30354 - DNA, 50 bp, homo sapien
atgaagtttacagtccttcatttcaygtgcaattagaagggttattgtgt

SEQ ID NO: 30355 - DNA, 50 bp, homo sapien
ctcccaccttccattttcagagtaaygtgttccgtctgtggaaccacagc

SEQ ID NO: 30356 - DNA, 50 bp, homo sapien
aaactacttcatgtttccaaatcacmgaaccataaaatttcagccctgga

SEQ ID NO: 30357 - DNA, 50 bp, homo sapien
attgcatgtgcttactatgtgtaccraattatgttagaatgagagggaac

SEQ ID NO: 30358 - DNA, 50 bp, homo sapien
gatcttcagagagttttagaggctcratcattcatttatcattcatttac

SEQ ID NO: 30359 - DNA, 50 bp, homo sapien
gcatgaaaatgataacagaatatgcsaaaacttaaaagatgaagctaaag

SEQ ID NO: 30360 - DNA, 50 bp, homo sapien
acacttttttaacatcagttctccartgagttcatagcagattacagggt

SEQ ID NO: 30361 - DNA, 50 bp, homo sapien
atgttaattcaaatatggtaaataamccttacaaagaatgaaatagaggc

SEQ ID NO: 30362 - DNA, 50 bp, homo sapien
caagcttccccatctataaaatcagmagttgaaactatatgccttagata

SEQ ID NO: 30363 - DNA, 50 bp, homo sapien
atctcaggtacattttagacgtttasacatttatttgccatgttaattca

SEQ ID NO: 30364 - DNA, 50 bp, homo sapien
tgtttccttactcctgtgggataacrgactagctaagcctgatggctccc

SEQ ID NO: 30365 - DNA, 50 bp, homo sapien
agagtgtggaaatgagaacctaccarctgaattgtttttatttttggcag

SEQ ID NO: 30366 - DNA, 50 bp, homo sapien
tatccacagaaatattcactcatcasatacttattgggtgcctgcttcgt

SEQ ID NO: 30367 - DNA, 50 bp, homo sapien
gcaagttatttaaacccactgtgacrcaattttctcatctgtggagtgag

SEQ ID NO: 30368 - DNA, 50 bp, homo sapien
tcgtgccaagcaaggttctaagcgcygaactggtagcattgtaacaactg

SEQ ID NO: 30369 - DNA, 50 bp, homo sapien
tccaaatataccaacagcagatatcmaatgaccattacttcatactagaa

SEQ ID NO: 30370 - DNA, 50 bp, homo sapien
gatacaagataaccttgagctaacayggttatgagggattctttctaaat

SEQ ID NO: 30371 - DNA, 50 bp, homo sapien
taagaaacacctgcaatgttctgctsagatttcattagatgggaaagtgc

SEQ ID NO: 30372 - DNA, 50 bp, homo sapien
actccccaatcctgggagcttccgcragaggctttctatcttggcagagg

SEQ ID NO: 30373 - DNA, 50 bp, homo sapien
tgtttttctgatatacacatatgaaygactgaaaccttccttgtaggacc

SEQ ID NO: 30374 - DNA, 50 bp, homo sapien
caagcctgtttcttagtctcttcagraagtggtacacaccatctccactc

SEQ ID NO: 30375 - DNA, 50 bp, homo sapien
taaaaataacagaccagcacaattaytaaaatcagatgtaagtagaatca

SEQ ID NO: 30376 - DNA, 50 bp, homo sapien
aaggagtttcttttgacattgcaatraactatatgagtcttaatgaacat

SEQ ID NO: 30377 - DNA, 50 bp, homo sapien
ctttggtttcagcataccgttcttayatattgtgaacccagaaatgatta

SEQ ID NO: 30378 - DNA, 50 bp, homo sapien
aaacaaacatttaagctgttgatcaracttttatagcacccaatcaggtt

SEQ ID NO: 30379 - DNA, 50 bp, homo sapien
ttttcctaacttctgaaaccttacartcaatcgttagtaaaatcctctat

SEQ ID NO: 30380 - DNA, 50 bp, homo sapien
actacaaaatgagctgcagctttcaragccatgagggctcccccaggcca

SEQ ID NO: 30381 - DNA, 50 bp, homo sapien
ctgcatgtgagcattacgtttaagawcacaatgttgtagaagtatttctt

SEQ ID NO: 30382 - DNA, 50 bp, homo sapien
gctttgacaatcaaaccaaaacagasgagaatttacaaggacattaatag

SEQ ID NO: 30383 - DNA, 50 bp, homo sapien
ccaggcccaagttagaggctttacaygcaggttactataaagcaccttcg

SEQ ID NO: 30384 - DNA, 50 bp, homo sapien
aagtgccaagctacaaatgaagagakaatccttgttcctcaagctcccac

SEQ ID NO: 30385 - DNA, 50 bp, homo sapien
tttaagtattagctagaacaagaaasgactttttaggtgttgatcttatg

SEQ ID NO: 30386 - DNA, 50 bp, homo sapien
gaattccaatcacagggttttctccratcatgagaatttccaggttgggt

SEQ ID NO: 30387 - DNA, 50 bp, homo sapien
aatatcctgatatcctgtgttgttayctcctgcagcattgtgagtcaggc

SEQ ID NO: 30388 - DNA, 50 bp, homo sapien
taaaaaatctattaaggctccacctsaactccaacaaattgaaagttatt

SEQ ID NO: 30389 - DNA, 50 bp, homo sapien
attggaggcctttgcagtttgactaygacccatgttccagacaatgtgcc

SEQ ID NO: 30390 - DNA, 50 bp, homo sapien
tgcatttggaggaaaatcagattacmgagatgactgattactgtctacaa

SEQ ID NO: 30391 - DNA, 50 bp, homo sapien
aaatttttcctttgtttataaattayatattggctgcacttggggttgta

SEQ ID NO: 30392 - DNA, 50 bp, homo sapien
atccttagacaaaccaccatgattaygtcctctctacagataagaaaact

SEQ ID NO: 30393 - DNA, 50 bp, homo sapien
ggtggtttgtctaaggatctgattaygtgatttatgttctgttcctagca

SEQ ID NO: 30394 - DNA, 50 bp, homo sapien
ctattggggtgaaaattattctccawgcctaagaaagtcaagctgcaatt

SEQ ID NO: 30395 - DNA, 50 bp, homo sapien
caagtactagactgtgtggttataaktcatctaatatggacctcctgtta

SEQ ID NO: 30396 - DNA, 50 bp, homo sapien
gtttctgtggcagatattttgtagamctgggagtaaaggaaaactattta

SEQ ID NO: 30397 - DNA, 50 bp, homo sapien
ctctaaagatgctgctgtatcagctkaagacacttagttttaaaatctat

SEQ ID NO: 30398 - DNA, 50 bp, homo sapien
taacataatcgagttgggagaataamgctggaaggactaactgccataat

SEQ ID NO: 30399 - DNA, 50 bp, homo sapien
aagcttggactttatttatagctacygaaaggcctgacctgcccgattca

SEQ ID NO: 30400 - DNA, 50 bp, homo sapien
agctctaggcaaatgtcgggagttaytaacaattttatcagttgattggt

SEQ ID NO: 30401 - DNA, 50 bp, homo sapien
tacagaatcacatagtatactctcawctaagtaaaggaaaatgtgcttat

SEQ ID NO: 30402 - DNA, 50 bp, homo sapien
ctatctcggttttgatctgtgcttayggcatcctttgattcagatgaagg

SEQ ID NO: 30403 - DNA, 50 bp, homo sapien
ataatgaatcctagatttcttctccraggatttcagaagtgaggaaaggt

SEQ ID NO: 30404 - DNA, 50 bp, homo sapien
acctatttaaccatttccctagcgayggacatttaggttatttctctgtt

SEQ ID NO: 30405 - DNA, 50 bp, homo sapien
tgattaacaatatcaatacagaaaartaatcataaactatgaatcaaact

SEQ ID NO: 30406 - DNA, 50 bp, homo sapien
gcattaaaattatttacatatataaytgagtatctatctaaatggaattt

SEQ ID NO: 30407 - DNA, 50 bp, homo sapien
cccttagagaaacatgtctttaactsaaggaaaagatctttcaagacttg

SEQ ID NO: 30408 - DNA, 50 bp, homo sapien
ctttctcaacacaaattttctttgaycatagctgtatggaaacagaaggc

SEQ ID NO: 30409 - DNA, 50 bp, homo sapien
tgacaccacacctgagcaggatattmaacgaggaaagtgaacatcagcct

SEQ ID NO: 30410 - DNA, 50 bp, homo sapien
cagaggtagctctctaagggctctaycattattaaagaattagagaagaa

SEQ ID NO: 30411 - DNA, 50 bp, homo sapien
acacatgagatactgtgctatgatayaggttttcccaaaagctcctggaa

SEQ ID NO: 30412 - DNA, 50 bp, homo sapien
aggttttcccaaaagctcctggaaakatgtggaataatgaggcctgcatg

SEQ ID NO: 30413 - DNA, 50 bp, homo sapien
aataaattcacggaaaggttcagaayatagaaagtcacagagttggacaa

SEQ ID NO: 30414 - DNA, 50 bp, homo sapien
aagtgtaaggccaggtgttacagaasgtatgtgtttttaagaatcaagtg

SEQ ID NO: 30415 - DNA, 50 bp, homo sapien
gctggctcatacccaaatgcttttcyattggactatattcatgttgcacc

SEQ ID NO: 30416 - DNA, 50 bp, homo sapien
gcattttgacctataagttgccttakctctgcattcattaattaaagcaa

SEQ ID NO: 30417 - DNA, 50 bp, homo sapien
tctaaaaaagaagcattgtgttgcamagttaaaaaacattgctgaaggag

SEQ ID NO: 30418 - DNA, 50 bp, homo sapien
agatatataaagattttcatcctaaytgctttaattaatgaatgcagagc

SEQ ID NO: 30419 - DNA, 50 bp, homo sapien
cacttaaaataaaatgtgaaacctayaacatgatctacaagcttctgcat

SEQ ID NO: 30420 - DNA, 50 bp, homo sapien
cttcatcaggaaggtactcaggagayaaaaaggagcaggaaatatttgat

SEQ ID NO: 30421 - DNA, 50 bp, homo sapien
tgtgaggatccgttagcaatgtttaygatgggcaagtcttgtgatggggt

SEQ ID NO: 30422 - DNA, 50 bp, homo sapien
taaatttctgtaagacacaaggcacraggaagttatagattgcaaggccg

SEQ ID NO: 30423 - DNA, 50 bp, homo sapien
aggacaaagttcatacagaggaaaartgatattctttgttttggtgctga

SEQ ID NO: 30424 - DNA, 50 bp, homo sapien
gaagctaaaatccaagctctcctgayaatagtggtttagggtgcttcctg

SEQ ID NO: 30425 - DNA, 50 bp, homo sapien
gctttcatattttgtaacacatacckctttggctttggagtagtttaata

SEQ ID NO: 30426 - DNA, 50 bp, homo sapien
cttggagggcctgggatggcaaataygtatatcagcttgatcagaatcat

SEQ ID NO: 30427 - DNA, 50 bp, homo sapien
tgttattatatcagaaatgttctaayaaccacagagcaacctcaggaaaa

SEQ ID NO: 30428 - DNA, 50 bp, homo sapien
gagaatgaaaagataagtcacagacrgagagaaaatacttacaaaacaca

SEQ ID NO: 30429 - DNA, 50 bp, homo sapien
aagattgaagttgttttctgtgcaartgtggaatgtagacctctctactc

SEQ ID NO: 30430 - DNA, 50 bp, homo sapien
tgcaccaatgaagcaacctttccagsacaaaagaaatttaatactcagac

SEQ ID NO: 30431 - DNA, 50 bp, homo sapien
caggcaaaatagagatttgagccaawatccatggaatatgaactatacag

SEQ ID NO: 30432 - DNA, 50 bp, homo sapien
ttggaatttttgtggcagagacagcragtagtagactagttcctggggct

SEQ ID NO: 30433 - DNA, 50 bp, homo sapien
aagtgcttctacaagaagttacagarggcattataattaatgttgaaata

SEQ ID NO: 30434 - DNA, 50 bp, homo sapien
gcccgattgtaattaatggcaaagcwcacgtgggcagtcatgctaaacag

SEQ ID NO: 30435 - DNA, 50 bp, homo sapien
cttgcgcagaagtaagttttgcacckcttagatagaaaacggctttctct

SEQ ID NO: 30436 - DNA, 50 bp, homo sapien
acaggatcctgttgatataaagttcraagctagggaaaactaacctatgg

SEQ ID NO: 30437 - DNA, 50 bp, homo sapien
tgcaacatccccagtaacctgctccrgaacaacctgatacaaaaagtagg

SEQ ID NO: 30438 - DNA, 50 bp, homo sapien
agaagccaagtcataaggtggaatarctagtaatgtatttaatctcccta

SEQ ID NO: 30439 - DNA, 50 bp, homo sapien
ttccatttcttctctcctatattaamccctatgtggtgtaagtaaccgat

SEQ ID NO: 30440 - DNA, 50 bp, homo sapien
ccctgctaatgattttgcaaaaggckgacttgtctgaaactctgaaagtc

SEQ ID NO: 30441 - DNA, 50 bp, homo sapien
agcaccagtggcccattggactgaargagcctcagattcagatgacagtc

SEQ ID NO: 30442 - DNA, 50 bp, homo sapien
tagttatcccctactgggccgttctraatactgtaatttcactctcatct

SEQ ID NO: 30443 - DNA, 50 bp, homo sapien
ttgtaccctggtcaacgtgtggaaascgattcttaggacaatatgaaaca

SEQ ID NO: 30444 - DNA, 50 bp, homo sapien
taatggggtttaattaagcaccctaygtatcaagagaaaggaaaagatat

SEQ ID NO: 30445 - DNA, 50 bp, homo sapien
ctgtggcttctcagttacaatttggractatttttcgtgtagccttcgtc

SEQ ID NO: 30446 - DNA, 50 bp, homo sapien
aacttcactagcattgtgaatttaaygctaagactttcccttccaaaagc

SEQ ID NO: 30447 - DNA, 50 bp, homo sapien
taagaatcttataacttccctcctcratcaataaagttctgctcctgtca

(The sequence listing continues in the following parts.)

What is claimed is:

1. An array of oligonucleotides, the array consisting of: a plurality of different allele specific perfect match probes attached to a solid support, wherein each allele specific perfect match probe consists of 20 to 50 contiguous nucleotides from a different sequence listed in SEQ ID Nos. 1-116,211 and wherein the plurality of different allele specific perfect match probes consists of at least one probe consisting of between 20 and 50 contiguous nucleotides from each of SEQ ID NOs. 1-116,211; wherein each of the allele specific perfect match probes overlaps with nucleotide 26 of the sequence given in the respective SEQ ID NO, and each probe is perfectly complementary to one of the two possible alleles, and wherein each different allele specific perfect match probe is attached to a solid support in a known or determinable location of the array, wherein the two possible alleles are nucleotides allowed by the degenerate symbol at position 26 of the sequence given in the respective SEQ ID NO.

2. The array of claim 1 wherein the plurality of different allele specific perfect match probes consists of a first allele specific perfect match probe for the first allele of each SNP represented by SEQ ID Nos. 1-116,211 and a second allele specific perfect match probe for the second allele of each SNP represented by SEQ ID Nos. 1-116,211, wherein the SNP is represented by the degenerate nucleotide symbol at position 26 of the listed sequences, and the two alleles are nucleotides allowed by the degenerate symbol.

3. The array of claim 1 wherein each of the allele specific perfect match probes for a selected allele of a selected SNP varies from every other allele specific perfect match probe for that allele of that SNP in the position of the polymorphic base relative to the center of the probe.

4. The array of claim 3 wherein the polymorphic base in a probe is in a position selected from −7, −6, −5, −4, −3, −2, −1, 0, 1, 2, 3, 4, 5, 6, or 7 relative to the center, where 0 is the central position of the probe.

5. The array of claim 4 wherein the probes are 25 bases in length.

6. The array of claim 1 wherein each allele specific perfect match probe is attached to a different bead.

7. A method of genotyping single nucleotide polymorphisms in parallel comprising:
obtaining a nucleic acid sample;
amplifying fragments of DNA in the nucleic acid sample;
hybridizing the amplified sample to the array of claim 1
analyzing the resulting hybridization pattern; and
determining the genotype of the sample for each of the single nucleotide polymorphisms.

8. The method of claim 7 wherein the solid support is a plurality of beads wherein each allele specific perfect match probe is attached to a different bead.

9. The method of claim 7 wherein the step of amplifying fragments of DNA in the nucleic acid sample comprises fragmenting the sample with at least one restriction enzyme, ligating an adapter to at least some of the fragments to generate adapter ligated fragments, and amplifying at least some of the adapter ligated fragments by polymerase chain reaction using a primer to the adapter.

10. The method of claim 9 wherein the at least one restriction enzyme is selected from the group consisting of XbaI and HindIII.

11. The method of claim 7 wherein the step of amplifying fragments of DNA in the nucleic acid sample comprises:
(a) fragmenting a first aliquot of the sample with a first restriction enzyme to generate a first fragmented aliquot;
(b) fragmenting a second aliquot of the sample with a second restriction enzyme to generate a second fragmented aliquot;
(c) ligating a first adapter to at least some of the fragments in the first fragmented aliquot;
(d) ligating a second adapter to at least some of the fragments in the second fragmented aliquot;
(e) amplifying at least some of the fragments from (c); and,
(f) amplifying at least some of the fragments from (d); and wherein the product of step (e) is hybridized to a first solid support and the product of step (f) is hybridized to a second solid support.

12. The method of claim 11 wherein the first restriction enzyme is XbaI, the second restriction enzyme is HindIII and the first primer and the second primer have the same sequence.

13. The method of claim 7 wherein the steps of analyzing the resulting hybridization pattern; and determining the genotype of the sample for each of the single nucleotide polymorphisms are performed by a computer.

14. The method of claim 7 wherein the nucleic acid sample is from a human.

15. The method of claim 7 wherein the nucleic acid sample is from a non-human primate.

* * * * *